United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 22

SEQ ID NO: 950679 - RNA, 22 nt, Human
agcugcuacugcucugccagag

SEQ ID NO: 950680 - RNA, 22 nt, Human
cucuggaaaaccacuagcagga

SEQ ID NO: 950681 - RNA, 22 nt, Human
agucccagaucuccauucgguc

SEQ ID NO: 950682 - RNA, 22 nt, Human
aagaacagauucagccugaacu

SEQ ID NO: 950683 - RNA, 22 nt, Human
cugcugcauuacucuucucaag

SEQ ID NO: 950684 - RNA, 22 nt, Human
ugucaccaugccagcuucugcc

SEQ ID NO: 950685 - RNA, 22 nt, Human
ucaaggaggugcuuggcuucac

SEQ ID NO: 950686 - RNA, 22 nt, Human
uuucauuuugguuaugccauaa

SEQ ID NO: 950687 - RNA, 22 nt, Human
augcugagacuggagcagcugg

SEQ ID NO: 950688 - RNA, 22 nt, Human
caggaacagcaccaggagcuag

SEQ ID NO: 950689 - RNA, 22 nt, Human
gcugagagcaaagcaugucuag

SEQ ID NO: 950690 - RNA, 22 nt, Human
cuccuuccugguuagcaccuua

SEQ ID NO: 950691 - RNA, 22 nt, Human
gaagccaacauuccaaguagaa

SEQ ID NO: 950692 - RNA, 22 nt, Human
gagggagggccaggucccaacc

SEQ ID NO: 950693 - RNA, 22 nt, Human
aggaaaacacaguauugaugga

SEQ ID NO: 950694 - RNA, 21 nt, Human
ucucugggaggacuugugaga

SEQ ID NO: 950695 - RNA, 22 nt, Human
ugaggcaggacugagcgggaug

SEQ ID NO: 950696 - RNA, 22 nt, Human
ucaaaugcuguauuguaguaau

SEQ ID NO: 950697 - RNA, 22 nt, Human
aagagcuggcucuugcagcagc

SEQ ID NO: 950698 - RNA, 22 nt, Human
accuggagucauuugaggagua

SEQ ID NO: 950699 - RNA, 22 nt, Human
aagcagaggaccgacggaggga

SEQ ID NO: 950700 - RNA, 22 nt, Human
gcugauguaagacuuuugguuu

SEQ ID NO: 950701 - RNA, 22 nt, Human
ggucagggggaucugugaggua

SEQ ID NO: 950702 - RNA, 22 nt, Human
gagcugggacauggguccucuc

SEQ ID NO: 950703 - RNA, 22 nt, Human
acugaaggucucagcaaggaug

SEQ ID NO: 950704 - RNA, 20 nt, Human
gggugggagagucugagggu

SEQ ID NO: 950705 - RNA, 22 nt, Human
ugguuugcccacucgagugauu

SEQ ID NO: 950706 - RNA, 22 nt, Human
gcuuuuaauuaguugcuuccau

SEQ ID NO: 950707 - RNA, 22 nt, Human
auaaaagaaguuuugguacuug

SEQ ID NO: 950708 - RNA, 22 nt, Human
gcuuggcauugaccauuaucau

SEQ ID NO: 950709 - RNA, 20 nt, Human
gugaccagaagacagugggu

SEQ ID NO: 950710 - RNA, 22 nt, Human
auaauguagguauguguauuua

SEQ ID NO: 950711 - RNA, 22 nt, Human
cagaagccugccucagaugcac

SEQ ID NO: 950712 - RNA, 22 nt, Human
uuucaaauagaaucuuuccaaa

SEQ ID NO: 950713 - RNA, 22 nt, Human
auguguuuauaauuacucaauc

SEQ ID NO: 950714 - RNA, 22 nt, Human
gcuguuccugcuuagaggucgg

SEQ ID NO: 950715 - RNA, 22 nt, Human
aaugugcagaugaauaaacaaa

SEQ ID NO: 950716 - RNA, 19 nt, Human
ucaaaugccaaugucacag

SEQ ID NO: 950717 - RNA, 22 nt, Human
ucagagaaguaagguggggugc

SEQ ID NO: 950718 - RNA, 22 nt, Human
aggagaaguaaggcuagaugau

SEQ ID NO: 950719 - RNA, 22 nt, Human
ucuagaaauuuugccuuguauu

SEQ ID NO: 950720 - RNA, 22 nt, Human
agguccagcuguugcagccucc

SEQ ID NO: 950721 - RNA, 22 nt, Human
acugaguguaggacuuugaguu

SEQ ID NO: 950722 - RNA, 20 nt, Human
uggagcugugguaaggagca

SEQ ID NO: 950723 - RNA, 22 nt, Human
ugugcccauuacacagaggcau

SEQ ID NO: 950724 - RNA, 22 nt, Human
auguuucaaugcacuuuagccu

SEQ ID NO: 950725 - RNA, 22 nt, Human
ucaaaugcuucuacuccuaaga

SEQ ID NO: 950726 - RNA, 22 nt, Human
ucuacugcacuggugucucauc

SEQ ID NO: 950727 - RNA, 22 nt, Human
auuuggcacacuggguucucgu

SEQ ID NO: 950728 - RNA, 22 nt, Human
gcugcuuccuuuccugcugacc

SEQ ID NO: 950729 - RNA, 22 nt, Human
augcuuuuccaggagaaauaua

SEQ ID NO: 950730 - RNA, 22 nt, Human
aaaauuauagaucuagugccug

SEQ ID NO: 950731 - RNA, 22 nt, Human
cuacauaaauuuaucacagacu

SEQ ID NO: 950732 - RNA, 22 nt, Human
cucucccccacagcagccuucu

SEQ ID NO: 950733 - RNA, 21 nt, Human
ggccucugccuugccccacuc

SEQ ID NO: 950734 - RNA, 22 nt, Human
gcugaaggaggcucugguacua

SEQ ID NO: 950735 - RNA, 22 nt, Human
cugcugugccucuuuucacgug

SEQ ID NO: 950736 - RNA, 22 nt, Human
cuggagcccugaaugggcagga

SEQ ID NO: 950737 - RNA, 22 nt, Human
uguguacacaaugauugcagag

SEQ ID NO: 950738 - RNA, 22 nt, Human
aaaguuuccugcuaagugcuau

SEQ ID NO: 950739 - RNA, 22 nt, Human
acagccagguaaaggcauggca

SEQ ID NO: 950740 - RNA, 22 nt, Human
agugcuguccaguuucacaggu

SEQ ID NO: 950741 - RNA, 22 nt, Human
aguacuuuacuucuuacaguuu

SEQ ID NO: 950742 - RNA, 20 nt, Human
gcugaggucauuaugccuca

SEQ ID NO: 950743 - RNA, 22 nt, Human
acucagaguuugcguuccauac

SEQ ID NO: 950744 - RNA, 23 nt, Human
aguuccagaaaaaugcucaagca

SEQ ID NO: 950745 - RNA, 22 nt, Human
ugggcacacugaaucugcuauu

SEQ ID NO: 950746 - RNA, 22 nt, Human
uuugcagucuggccugcuuugg

SEQ ID NO: 950747 - RNA, 22 nt, Human
uuuugucuaagaacuuugcaaa

SEQ ID NO: 950748 - RNA, 22 nt, Human
cuggcucaguucuugguuuuca

SEQ ID NO: 950749 - RNA, 22 nt, Human
agggcucuguccccagaggccc

SEQ ID NO: 950750 - RNA, 22 nt, Human
gcucacugcaaccucugcuucc

SEQ ID NO: 950751 - RNA, 22 nt, Human
aagcccagaugggagcauuuca

SEQ ID NO: 950752 - RNA, 22 nt, Human
cccagacugcagagcgggcaga

SEQ ID NO: 950753 - RNA, 22 nt, Human
ccaaaauguuugaaugcaugug

SEQ ID NO: 950754 - RNA, 22 nt, Human
uggcccugccacucacugcuga

SEQ ID NO: 950755 - RNA, 22 nt, Human
ccucccaccguaucucaguggc

SEQ ID NO: 950756 - RNA, 22 nt, Human
agcagcuccugccaugagugcu

SEQ ID NO: 950757 - RNA, 22 nt, Human
gggacuguaaauucauauggcc

SEQ ID NO: 950758 - RNA, 22 nt, Human
gggacuggaguagaggccggug

SEQ ID NO: 950759 - RNA, 20 nt, Human
cuuccacacaagaagcacag

SEQ ID NO: 950760 - RNA, 22 nt, Human
ccaggacaaguguggccauggc

SEQ ID NO: 950761 - RNA, 22 nt, Human
caugaagcauguuuugucauga

SEQ ID NO: 950762 - RNA, 22 nt, Human
aaugggaggauuuucucucuug

SEQ ID NO: 950763 - RNA, 19 nt, Human
ugaaggagggggauggcca

SEQ ID NO: 950764 - RNA, 22 nt, Human
gcagccacagaggagggaugca

SEQ ID NO: 950765 - RNA, 22 nt, Human
aauggcugggaguguauuuugg

SEQ ID NO: 950766 - RNA, 22 nt, Human
gaggggcugcccuggugucagg

SEQ ID NO: 950767 - RNA, 22 nt, Human
gcuggcugaggucuagcucuuu

SEQ ID NO: 950768 - RNA, 22 nt, Human
gggcugcugccaaucacagccu

SEQ ID NO: 950769 - RNA, 22 nt, Human
caguagcagggauuauuuuagg

SEQ ID NO: 950770 - RNA, 22 nt, Human
ccagagcccagcacacggugcu

SEQ ID NO: 950771 - RNA, 19 nt, Human
cauuuuaagcauccccagu

SEQ ID NO: 950772 - RNA, 22 nt, Human
ugaaauauuuagagaguaaguu

SEQ ID NO: 950773 - RNA, 22 nt, Human
uggccugggcaugaagcaucgu

SEQ ID NO: 950774 - RNA, 20 nt, Human
gcucccagccugcagucccc

SEQ ID NO: 950775 - RNA, 22 nt, Human
ggcuucagugacuggugcccuc

SEQ ID NO: 950776 - RNA, 22 nt, Human
auuggcaggaaccgaggagggg

SEQ ID NO: 950777 - RNA, 20 nt, Human
uaugaagauaugugaacagc

SEQ ID NO: 950778 - RNA, 19 nt, Human
ucugucacuggggguauuc

SEQ ID NO: 950779 - RNA, 22 nt, Human
aagccuugcagcauuaggcucu

SEQ ID NO: 950780 - RNA, 22 nt, Human
gcacagggcugccaggcggcuu

SEQ ID NO: 950781 - RNA, 20 nt, Human
cagagaccaggccagguguc

SEQ ID NO: 950782 - RNA, 22 nt, Human
uugcugugucugauggcugaga

SEQ ID NO: 950783 - RNA, 22 nt, Human
gccugccuuugugaggaagcgg

SEQ ID NO: 950784 - RNA, 22 nt, Human
gucccugcccuccugggacuca

SEQ ID NO: 950785 - RNA, 22 nt, Human
gaguggggucugggcaucaguc

SEQ ID NO: 950786 - RNA, 22 nt, Human
ccagccuucugagcugccugga

SEQ ID NO: 950787 - RNA, 22 nt, Human
agagcucaagacgcucacagua

SEQ ID NO: 950788 - RNA, 22 nt, Human
agauauuuguaucuugcuauug

SEQ ID NO: 950789 - RNA, 22 nt, Human
gcagcugaagcugcaguuccag

SEQ ID NO: 950790 - RNA, 22 nt, Human
uuccuuaggcuguuugcagugc

SEQ ID NO: 950791 - RNA, 22 nt, Human
uagaaacacagagagacccaug

SEQ ID NO: 950792 - RNA, 22 nt, Human
agcacaggcuuuggugugaggg

SEQ ID NO: 950793 - RNA, 22 nt, Human
ccaggccaaauucagucagcag

SEQ ID NO: 950794 - RNA, 22 nt, Human
uacauucaacaugucacuaugu

SEQ ID NO: 950795 - RNA, 22 nt, Human
cagcaugguuggguucugggga

SEQ ID NO: 950796 - RNA, 19 nt, Human
acaaagcugugagcagcuu

SEQ ID NO: 950797 - RNA, 23 nt, Human
uggcucuguggaucccucaggag

SEQ ID NO: 950798 - RNA, 22 nt, Human
agcugcugcggaaagaugccac

SEQ ID NO: 950799 - RNA, 22 nt, Human
uggcacuggaaucguagccuug

SEQ ID NO: 950800 - RNA, 20 nt, Human
agcaggaaugaugcuuucau

SEQ ID NO: 950801 - RNA, 22 nt, Human
agggcagccugagugcuggccc

SEQ ID NO: 950802 - RNA, 22 nt, Human
agagagcauugaggaaaucuuc

SEQ ID NO: 950803 - RNA, 22 nt, Human
uuaaaugaugcauaucauuuag

SEQ ID NO: 950804 - RNA, 22 nt, Human
ugccagcacaaguuaagagauc

SEQ ID NO: 950805 - RNA, 22 nt, Human
gguaacaguauguagaguaaga

SEQ ID NO: 950806 - RNA, 22 nt, Human
acaggcugccuaccaaguauca

SEQ ID NO: 950807 - RNA, 20 nt, Human
ggcucugcuugugagcagcc

SEQ ID NO: 950808 - RNA, 21 nt, Human
ggcugcugggagagcugcgug

SEQ ID NO: 950809 - RNA, 22 nt, Human
ugguggcuucugaggauggcga

SEQ ID NO: 950810 - RNA, 22 nt, Human
uuccuuaguugacugucuuagu

SEQ ID NO: 950811 - RNA, 22 nt, Human
agagccuggucugagauaggac

SEQ ID NO: 950812 - RNA, 22 nt, Human
ucccaggauguuuauggcuggu

SEQ ID NO: 950813 - RNA, 17 nt, Human
gaggagcuccaguaggu

SEQ ID NO: 950814 - RNA, 22 nt, Human
gcugucacucaccaggccugca

SEQ ID NO: 950815 - RNA, 22 nt, Human
ccacagaguuacaaaacaguca

SEQ ID NO: 950816 - RNA, 22 nt, Human
ucuuugcagaauuuaacuuugc

SEQ ID NO: 950817 - RNA, 22 nt, Human
gagggguguggagccaucaguu

SEQ ID NO: 950818 - RNA, 22 nt, Human
uuugaaagcaccauuugaguag

SEQ ID NO: 950819 - RNA, 22 nt, Human
gcuggagguagggagguccugu

SEQ ID NO: 950820 - RNA, 22 nt, Human
cuggcugccacuucagggucuu

SEQ ID NO: 950821 - RNA, 22 nt, Human
acauuucuaauuuaauguaaca

SEQ ID NO: 950822 - RNA, 22 nt, Human
uguuccaugucuuuguaggacu

SEQ ID NO: 950823 - RNA, 22 nt, Human
gggcugucaugugucagugacc

SEQ ID NO: 950824 - RNA, 22 nt, Human
cugcuggggucagagcacuggg

SEQ ID NO: 950825 - RNA, 22 nt, Human
agcagcaggagccgugggguga

SEQ ID NO: 950826 - RNA, 22 nt, Human
aaguaaauaucuguuuauagca

SEQ ID NO: 950827 - RNA, 22 nt, Human
gguggccucgguggugcacagg

SEQ ID NO: 950828 - RNA, 22 nt, Human
gcagggccagguacaagaagca

SEQ ID NO: 950829 - RNA, 20 nt, Human
uguuccaugacuauuuggau

SEQ ID NO: 950830 - RNA, 22 nt, Human
aggcagaggagaaugaucuucc

SEQ ID NO: 950831 - RNA, 22 nt, Human
uuggccaaaggaaagacuacug

SEQ ID NO: 950832 - RNA, 22 nt, Human
cccugcagaccaaugccauaga

SEQ ID NO: 950833 - RNA, 22 nt, Human
auauguuuuuggaaagaacaca

SEQ ID NO: 950834 - RNA, 22 nt, Human
augucuaaaagauaaaguuuaa

SEQ ID NO: 950835 - RNA, 22 nt, Human
uucauguaauuccauaagguaa

SEQ ID NO: 950836 - RNA, 22 nt, Human
ccucuucuagguuucagccugc

SEQ ID NO: 950837 - RNA, 22 nt, Human
accuggcaugaagcaugccuua

SEQ ID NO: 950838 - RNA, 22 nt, Human
cugguacaaaaugcugauauca

SEQ ID NO: 950839 - RNA, 22 nt, Human
agcaggagcccuuaucaccagg

SEQ ID NO: 950840 - RNA, 21 nt, Human
cagugcucaaucugacagugg

SEQ ID NO: 950841 - RNA, 22 nt, Human
acagcuugcaauggcuuucaac

SEQ ID NO: 950842 - RNA, 22 nt, Human
uauggcauuuuguaagggcuug

SEQ ID NO: 950843 - RNA, 23 nt, Human
acauacauggagauaaagugaug

SEQ ID NO: 950844 - RNA, 18 nt, Human
cugccuguugcugagagg

SEQ ID NO: 950845 - RNA, 22 nt, Human
agggagguaggagcuucuagcu

SEQ ID NO: 950846 - RNA, 22 nt, Human
agacaaaugguaauuaugucua

SEQ ID NO: 950847 - RNA, 22 nt, Human
agguagagcuccaguagaaaau

SEQ ID NO: 950848 - RNA, 22 nt, Human
ugcagauucaaaugaaaugcaa

SEQ ID NO: 950849 - RNA, 22 nt, Human
uuacaugguuguuggaaaugcu

SEQ ID NO: 950850 - RNA, 23 nt, Human
aggaggccugaaacugaggcuga

SEQ ID NO: 950851 - RNA, 22 nt, Human
auaugucgcuacaucauuagau

SEQ ID NO: 950852 - RNA, 22 nt, Human
acagaauucuaguauguggcuu

SEQ ID NO: 950853 - RNA, 22 nt, Human
ucacaaauagcuauauuaagga

SEQ ID NO: 950854 - RNA, 22 nt, Human
uucaggaugaaagugugcaaca

SEQ ID NO: 950855 - RNA, 20 nt, Human
cugcugugguccuuuauuuu

SEQ ID NO: 950856 - RNA, 22 nt, Human
cucagaauuuagggcucugagg

SEQ ID NO: 950857 - RNA, 22 nt, Human
uaucuuguaauagguccacuug

SEQ ID NO: 950858 - RNA, 22 nt, Human
uaaggccaaacuauuauaguuc

SEQ ID NO: 950859 - RNA, 22 nt, Human
aagauauuuuagaacauucacu

SEQ ID NO: 950860 - RNA, 19 nt, Human
uuuuccuucuauauguuuc

SEQ ID NO: 950861 - RNA, 22 nt, Human
aacuuuauuguuaggggcuaaa

SEQ ID NO: 950862 - RNA, 22 nt, Human
cagccaggagccucugcaacua

SEQ ID NO: 950863 - RNA, 19 nt, Human
ucucagagcccuagaggcc

SEQ ID NO: 950864 - RNA, 20 nt, Human
cccuaggaacgcagcaggag

SEQ ID NO: 950865 - RNA, 17 nt, Human
agcagaagucagaggga

SEQ ID NO: 950866 - RNA, 22 nt, Human
ugcagucuuccagcugcacaaa

SEQ ID NO: 950867 - RNA, 22 nt, Human
aaaaguuuaagacucauucuag

SEQ ID NO: 950868 - RNA, 22 nt, Human
gugguuuugccauuacaaguaa

SEQ ID NO: 950869 - RNA, 22 nt, Human
ccuuucucuaucgacccaucgc

SEQ ID NO: 950870 - RNA, 22 nt, Human
augaaauugaucuugaacuuuu

SEQ ID NO: 950871 - RNA, 22 nt, Human
aaucaguuucuuggcaaguuua

SEQ ID NO: 950872 - RNA, 22 nt, Human
auagaaaacagauguccuuaaa

SEQ ID NO: 950873 - RNA, 22 nt, Human
ucauggagacuuugagccuguu

SEQ ID NO: 950874 - RNA, 22 nt, Human
caaauguguuuuuucuucuaca

SEQ ID NO: 950875 - RNA, 20 nt, Human
uccaggcagcucagaguguc

SEQ ID NO: 950876 - RNA, 22 nt, Human
ccagggugugagaaggaaguag

SEQ ID NO: 950877 - RNA, 22 nt, Human
gcagcuaccacccaggaaggac

SEQ ID NO: 950878 - RNA, 22 nt, Human
cucaggauugugccuagggaga

SEQ ID NO: 950879 - RNA, 22 nt, Human
cuggcagcauggagccugugcu

SEQ ID NO: 950880 - RNA, 22 nt, Human
cccccaaggccaggcugagacc

SEQ ID NO: 950881 - RNA, 20 nt, Human
gcugggggugugcugaguga

SEQ ID NO: 950882 - RNA, 22 nt, Human
ggaggcuccacugcucuuccug

SEQ ID NO: 950883 - RNA, 22 nt, Human
agggguggccugccuuacuccc

SEQ ID NO: 950884 - RNA, 22 nt, Human
ucauugcagacuaacaaucuca

SEQ ID NO: 950885 - RNA, 22 nt, Human
ugccugggagugaccaagacuc

SEQ ID NO: 950886 - RNA, 22 nt, Human
ggccuugggcuggcugcaguau

SEQ ID NO: 950887 - RNA, 22 nt, Human
gaguguggugaacaggagcacc

SEQ ID NO: 950888 - RNA, 22 nt, Human
cuucuucauaggcaguccuguu

SEQ ID NO: 950889 - RNA, 22 nt, Human
cuggagaggcugggaacagguu

SEQ ID NO: 950890 - RNA, 22 nt, Human
agagcagguggcaacucuggga

SEQ ID NO: 950891 - RNA, 22 nt, Human
gccugucaauuuuguguacaau

SEQ ID NO: 950892 - RNA, 20 nt, Human
aguguuccggaagacuggca

SEQ ID NO: 950893 - RNA, 23 nt, Human
aagaauaaaugacauuaaaggug

SEQ ID NO: 950894 - RNA, 22 nt, Human
cagaggccuggcuuggacaccu

SEQ ID NO: 950895 - RNA, 22 nt, Human
cgggcagaucacacagggcuug

SEQ ID NO: 950896 - RNA, 22 nt, Human
cugcugagaaaagacugaggga

SEQ ID NO: 950897 - RNA, 22 nt, Human
ugcucugguaacucacuuccau

SEQ ID NO: 950898 - RNA, 22 nt, Human
uggccuugggcagguggccugc

SEQ ID NO: 950899 - RNA, 22 nt, Human
cuugcugucuugcauuuagagc

SEQ ID NO: 950900 - RNA, 22 nt, Human
uguguuugggggagaugcauuu

SEQ ID NO: 950901 - RNA, 22 nt, Human
aggcagcuagagagugaaacug

SEQ ID NO: 950902 - RNA, 22 nt, Human
uccuucagaggacggcagccag

SEQ ID NO: 950903 - RNA, 22 nt, Human
uuugaaagaaaccagugaguga

SEQ ID NO: 950904 - RNA, 22 nt, Human
guucuucacauuucauugagga

SEQ ID NO: 950905 - RNA, 22 nt, Human
acacauuauagagaguauaaua

SEQ ID NO: 950906 - RNA, 19 nt, Human
ugagugggccccugcagac

SEQ ID NO: 950907 - RNA, 22 nt, Human
cuugcaggcagggccuccugga

SEQ ID NO: 950908 - RNA, 22 nt, Human
ggcugagccuggagcaucuggu

SEQ ID NO: 950909 - RNA, 22 nt, Human
gcaagcuggcuguuagaggaug

SEQ ID NO: 950910 - RNA, 22 nt, Human
aucuucaaagggauguccaugg

SEQ ID NO: 950911 - RNA, 22 nt, Human
ggccuugcuuggguuauaugcc

SEQ ID NO: 950912 - RNA, 20 nt, Human
aggcucugccauugucccug

SEQ ID NO: 950913 - RNA, 23 nt, Human
auggagcugguacuagcuaccuc

SEQ ID NO: 950914 - RNA, 22 nt, Human
ugguuuugcuccaguauaaaua

SEQ ID NO: 950915 - RNA, 20 nt, Human
uguccuaauagacaagcaga

SEQ ID NO: 950916 - RNA, 20 nt, Human
ugaugguucuuuccggguug

SEQ ID NO: 950917 - RNA, 22 nt, Human
ccagggcacuuaggcccagccc

SEQ ID NO: 950918 - RNA, 22 nt, Human
aauguacaaaagucagccaacu

SEQ ID NO: 950919 - RNA, 22 nt, Human
ccaagcuacuuaggagucugag

SEQ ID NO: 950920 - RNA, 22 nt, Human
caguguggagggagagagccug

SEQ ID NO: 950921 - RNA, 22 nt, Human
gcaaauauucaagacuuuucca

SEQ ID NO: 950922 - RNA, 22 nt, Human
auuguauuuguacaagacaugu

SEQ ID NO: 950923 - RNA, 22 nt, Human
uguuuuaagagcgcacuuuaua

SEQ ID NO: 950924 - RNA, 19 nt, Human
uggggcuguguuuugaccc

SEQ ID NO: 950925 - RNA, 22 nt, Human
ccuugcauauauuauaucuuug

SEQ ID NO: 950926 - RNA, 22 nt, Human
ugguccaagugagguggccucu

SEQ ID NO: 950927 - RNA, 22 nt, Human
augggaggaaggaggcccuuga

SEQ ID NO: 950928 - RNA, 22 nt, Human
uuuguuuugaacuagcucagaa

SEQ ID NO: 950929 - RNA, 22 nt, Human
auaauuuacaacugcuuuuaau

SEQ ID NO: 950930 - RNA, 22 nt, Human
cgcuggggcuuuuugcuugaga

SEQ ID NO: 950931 - RNA, 22 nt, Human
agcuggcccucgagagccaauu

SEQ ID NO: 950932 - RNA, 22 nt, Human
uuagcuaaacuguaacuagaau

SEQ ID NO: 950933 - RNA, 22 nt, Human
auucucaaacaagugguuugau

SEQ ID NO: 950934 - RNA, 22 nt, Human
acugcaucugaaacauggguca

SEQ ID NO: 950935 - RNA, 22 nt, Human
gaggccugcuuuggcacucugg

SEQ ID NO: 950936 - RNA, 22 nt, Human
uuguuuuaaugagggagguuga

SEQ ID NO: 950937 - RNA, 22 nt, Human
cuggccaauauagggaaaucuu

SEQ ID NO: 950938 - RNA, 22 nt, Human
ucugccuggauuccauucucca

SEQ ID NO: 950939 - RNA, 22 nt, Human
ggcaggugugagaucgaggcca

SEQ ID NO: 950940 - RNA, 22 nt, Human
ugaaaugagauagauaaucagg

SEQ ID NO: 950941 - RNA, 22 nt, Human
acuccaggguuuugcaccugga

SEQ ID NO: 950942 - RNA, 22 nt, Human
guccacauaggaacccagcuuc

SEQ ID NO: 950943 - RNA, 22 nt, Human
caagacaagaucuaagcaugcu

SEQ ID NO: 950944 - RNA, 21 nt, Human
gcaggggauagaaauggucug

SEQ ID NO: 950945 - RNA, 22 nt, Human
gcuguccucuuggacucagggc

SEQ ID NO: 950946 - RNA, 17 nt, Human
ccuuucucuuucaucuc

SEQ ID NO: 950947 - RNA, 22 nt, Human
uuucaaagguggaagagugaau

SEQ ID NO: 950948 - RNA, 22 nt, Human
ccuggcuggauggagccccugg

SEQ ID NO: 950949 - RNA, 22 nt, Human
cccugcagccuugcaugccuuc

SEQ ID NO: 950950 - RNA, 22 nt, Human
aauuucaaguggcaucuuugau

SEQ ID NO: 950951 - RNA, 22 nt, Human
agcugccagggacugggcaugg

SEQ ID NO: 950952 - RNA, 22 nt, Human
uagagcuggccgggacagcugg

SEQ ID NO: 950953 - RNA, 22 nt, Human
cucaccacagagccuguccagc

SEQ ID NO: 950954 - RNA, 22 nt, Human
ggaaggaggaugcucuggccuu

SEQ ID NO: 950955 - RNA, 18 nt, Human
aucuuuccauagcauguu

SEQ ID NO: 950956 - RNA, 20 nt, Human
auuccauaguuggcacuuuu

SEQ ID NO: 950957 - RNA, 22 nt, Human
uagcagggaaggugugcugagc

SEQ ID NO: 950958 - RNA, 22 nt, Human
cagccagcuggcacugugagua

SEQ ID NO: 950959 - RNA, 22 nt, Human
ccaggcaucacgggcauguggc

SEQ ID NO: 950960 - RNA, 22 nt, Human
aaaucugguucaguaaguccuc

SEQ ID NO: 950961 - RNA, 22 nt, Human
uaaguuaucggaguguguuuca

SEQ ID NO: 950962 - RNA, 22 nt, Human
ccuggcagcaggugggcccgug

SEQ ID NO: 950963 - RNA, 18 nt, Human
cccagcuccacuucccuc

SEQ ID NO: 950964 - RNA, 22 nt, Human
auaaagacaugcuuacuugccc

SEQ ID NO: 950965 - RNA, 22 nt, Human
auaguacacauccuacaauguu

SEQ ID NO: 950966 - RNA, 22 nt, Human
cugcacugagcucucccagccc

SEQ ID NO: 950967 - RNA, 20 nt, Human
aggccaaacccagcgcgccc

SEQ ID NO: 950968 - RNA, 22 nt, Human
ugacauaauaauccaaacauac

SEQ ID NO: 950969 - RNA, 22 nt, Human
agguggggaggagugucucuuu

SEQ ID NO: 950970 - RNA, 22 nt, Human
ugcuggcuggccuggccuggac

SEQ ID NO: 950971 - RNA, 22 nt, Human
ucaugcaaggcugaaacauggu

SEQ ID NO: 950972 - RNA, 22 nt, Human
guuuagaauucuaacuuuaagg

SEQ ID NO: 950973 - RNA, 22 nt, Human
acauuucuaguuguucaucucc

SEQ ID NO: 950974 - RNA, 22 nt, Human
guauuagggccaaaggcaggaa

SEQ ID NO: 950975 - RNA, 22 nt, Human
caggcacuggggaugcugggau

SEQ ID NO: 950976 - RNA, 22 nt, Human
cagugaaaucacaacuuuaguu

SEQ ID NO: 950977 - RNA, 22 nt, Human
uggaggcaucagagugcuuggc

SEQ ID NO: 950978 - RNA, 22 nt, Human
ugggaggacuugugggcuucau

SEQ ID NO: 950979 - RNA, 22 nt, Human
uuaucguacgcuucagaaauuu

SEQ ID NO: 950980 - RNA, 22 nt, Human
uuucacuagaacguucuuguuu

SEQ ID NO: 950981 - RNA, 22 nt, Human
ugucucagggcagcagcagggg

SEQ ID NO: 950982 - RNA, 22 nt, Human
uauguuaaauguuugauguuua

SEQ ID NO: 950983 - RNA, 22 nt, Human
gcagcuggaagugacacucugu

SEQ ID NO: 950984 - RNA, 18 nt, Human
gagaggcccggcugugcc

SEQ ID NO: 950985 - RNA, 17 nt, Human
acuccuggucugaaggg

SEQ ID NO: 950986 - RNA, 22 nt, Human
aaucaguuaaauauugaguaca

SEQ ID NO: 950987 - RNA, 22 nt, Human
ugacauaaguugguagaaagga

SEQ ID NO: 950988 - RNA, 22 nt, Human
aauaauguacauacauauuucg

SEQ ID NO: 950989 - RNA, 22 nt, Human
ggaaaugacuuggugcuucguu

SEQ ID NO: 950990 - RNA, 17 nt, Human
aagagaggcugagcugg

SEQ ID NO: 950991 - RNA, 21 nt, Human
cauuucaugauuauagaaaug

SEQ ID NO: 950992 - RNA, 22 nt, Human
uccuggauucugcccugaaggc

SEQ ID NO: 950993 - RNA, 22 nt, Human
agccuggacagcuacggagaac

SEQ ID NO: 950994 - RNA, 17 nt, Human
uccaggagaggcaaugg

SEQ ID NO: 950995 - RNA, 22 nt, Human
uuucaugugcaauuagcaauau

SEQ ID NO: 950996 - RNA, 22 nt, Human
cagccagcuucagauccaagcc

SEQ ID NO: 950997 - RNA, 22 nt, Human
acagaagagcacauuuaguaug

SEQ ID NO: 950998 - RNA, 22 nt, Human
cacccuggcuggaggugcagug

SEQ ID NO: 950999 - RNA, 22 nt, Human
ucagaagucccagaauucacau

SEQ ID NO: 951000 - RNA, 22 nt, Human
ugcgcggcucagucaucuccag

SEQ ID NO: 951001 - RNA, 22 nt, Human
cagcuucugucugauuagcaag

SEQ ID NO: 951002 - RNA, 22 nt, Human
ccauaaggagccagacauucca

SEQ ID NO: 951003 - RNA, 22 nt, Human
gacaggguacgggcuaggcaca

SEQ ID NO: 951004 - RNA, 19 nt, Human
agcauccagucaugggauc

SEQ ID NO: 951005 - RNA, 22 nt, Human
aucagugcuaaagcaaaugccc

SEQ ID NO: 951006 - RNA, 22 nt, Human
ugcuguguggaugugaagaauc

SEQ ID NO: 951007 - RNA, 18 nt, Human
aaaugcuaggcuacauga

SEQ ID NO: 951008 - RNA, 22 nt, Human
gaggcagcuggguccggucggg

SEQ ID NO: 951009 - RNA, 22 nt, Human
uugcauugauguuccuucuugc

SEQ ID NO: 951010 - RNA, 22 nt, Human
uccagggaucuuuagagucuuu

SEQ ID NO: 951011 - RNA, 22 nt, Human
uggagcugauacagcuggcuuu

SEQ ID NO: 951012 - RNA, 22 nt, Human
ucuggcucugaauucacuucug

SEQ ID NO: 951013 - RNA, 22 nt, Human
gucuggccuuuuuagcuugugg

SEQ ID NO: 951014 - RNA, 22 nt, Human
uagaggugucacuuugggaagu

SEQ ID NO: 951015 - RNA, 22 nt, Human
ugccugucucugacugccauua

SEQ ID NO: 951016 - RNA, 22 nt, Human
ggagccugacagugcccagcau

SEQ ID NO: 951017 - RNA, 22 nt, Human
uuuguuuagaugguaaaucagu

SEQ ID NO: 951018 - RNA, 22 nt, Human
aauagguagccagauauauaaa

SEQ ID NO: 951019 - RNA, 22 nt, Human
uucuaaauggggauccuuucug

SEQ ID NO: 951020 - RNA, 22 nt, Human
gaggcugucuguuagccuggga

SEQ ID NO: 951021 - RNA, 22 nt, Human
ggugagaggcagaggacagcuu

SEQ ID NO: 951022 - RNA, 22 nt, Human
accucuggccuucaggcaucau

SEQ ID NO: 951023 - RNA, 22 nt, Human
acccaggagacagguugcagug

SEQ ID NO: 951024 - RNA, 22 nt, Human
agggaagcuuguuacugagaag

SEQ ID NO: 951025 - RNA, 21 nt, Human
aucagcaaaugccugucuccc

SEQ ID NO: 951026 - RNA, 22 nt, Human
ucaucaaagcgcuuggaguagg

SEQ ID NO: 951027 - RNA, 22 nt, Human
gcuguccaugucuggccucagu

SEQ ID NO: 951028 - RNA, 22 nt, Human
ggaggccaucagggagggcauu

SEQ ID NO: 951029 - RNA, 20 nt, Human
aaguuuucuccaaauacagu

SEQ ID NO: 951030 - RNA, 22 nt, Human
gcaaaugcucuccuuggucagg

SEQ ID NO: 951031 - RNA, 22 nt, Human
cagagccauccaggugccuguu

SEQ ID NO: 951032 - RNA, 22 nt, Human
cuuuauguucaguacaaugcuu

SEQ ID NO: 951033 - RNA, 22 nt, Human
uccuggccgcuggccccugaga

SEQ ID NO: 951034 - RNA, 22 nt, Human
ugaaucaguauaaauucucaaa

SEQ ID NO: 951035 - RNA, 22 nt, Human
ccugacgaaaggcgugcuggag

SEQ ID NO: 951036 - RNA, 22 nt, Human
aaucuucuacuugacaguucuc

SEQ ID NO: 951037 - RNA, 22 nt, Human
aaggaguuuggguagucauaca

SEQ ID NO: 951038 - RNA, 22 nt, Human
ggagggaaugucuagcauucuu

SEQ ID NO: 951039 - RNA, 22 nt, Human
uauuagguaugaacuggcaacc

SEQ ID NO: 951040 - RNA, 22 nt, Human
guuccauaucacagcagacgaa

SEQ ID NO: 951041 - RNA, 22 nt, Human
ucucaggggccuggaguccugg

SEQ ID NO: 951042 - RNA, 20 nt, Human
ucaggcaguggggaaaggca

SEQ ID NO: 951043 - RNA, 22 nt, Human
gccagggcucgcggucccucgu

SEQ ID NO: 951044 - RNA, 22 nt, Human
caaguuaucagaaggcacuuuu

SEQ ID NO: 951045 - RNA, 22 nt, Human
gcagagcucuguucuuaucucc

SEQ ID NO: 951046 - RNA, 22 nt, Human
uuucacaaaugucuuuaacuug

SEQ ID NO: 951047 - RNA, 22 nt, Human
ugauuuccaauaaggagaaugu

SEQ ID NO: 951048 - RNA, 22 nt, Human
cugccugcuucugagccagagg

SEQ ID NO: 951049 - RNA, 22 nt, Human
uucaggaugcagagguuguagu

SEQ ID NO: 951050 - RNA, 22 nt, Human
cagcuucucagaaagcugaggu

SEQ ID NO: 951051 - RNA, 22 nt, Human
agcugccaaguuucucaguuua

SEQ ID NO: 951052 - RNA, 22 nt, Human
aggagaaagacuggacagccaa

SEQ ID NO: 951053 - RNA, 22 nt, Human
aggcacaggccucagcacccag

SEQ ID NO: 951054 - RNA, 22 nt, Human
uguagcucuccagccagcaagg

SEQ ID NO: 951055 - RNA, 22 nt, Human
uguuggcauuagaggguuauug

SEQ ID NO: 951056 - RNA, 22 nt, Human
ugucuuuucuacuguaagcaua

SEQ ID NO: 951057 - RNA, 22 nt, Human
aaaugcacucugcuucugugac

SEQ ID NO: 951058 - RNA, 22 nt, Human
uggccuggugucugcgaggccu

SEQ ID NO: 951059 - RNA, 22 nt, Human
cagacaugauguaagcagaggc

SEQ ID NO: 951060 - RNA, 22 nt, Human
ccugggaggcggagguugcagg

SEQ ID NO: 951061 - RNA, 23 nt, Human
acagcugcaccuggccgccuggc

SEQ ID NO: 951062 - RNA, 22 nt, Human
ccaucagcuccaguaucuucug

SEQ ID NO: 951063 - RNA, 22 nt, Human
ccauaagguugaaaacuguaca

SEQ ID NO: 951064 - RNA, 22 nt, Human
uuuucuaacaucuaguaauuug

SEQ ID NO: 951065 - RNA, 20 nt, Human
ucagugauuuugaagaggaa

SEQ ID NO: 951066 - RNA, 22 nt, Human
gagcugaguuaccuccagauca

SEQ ID NO: 951067 - RNA, 22 nt, Human
auguacacaugcaugcaugugc

SEQ ID NO: 951068 - RNA, 22 nt, Human
gcccaggauaaugcugucccug

SEQ ID NO: 951069 - RNA, 22 nt, Human
aucaguuuuuauuaauguagcu

SEQ ID NO: 951070 - RNA, 22 nt, Human
cuggaagguucuuugugugccu

SEQ ID NO: 951071 - RNA, 22 nt, Human
uacaguaacauguuguacaagc

SEQ ID NO: 951072 - RNA, 22 nt, Human
accaaacaaaauugugcacugu

SEQ ID NO: 951073 - RNA, 22 nt, Human
agugggcaugaucuggugucug

SEQ ID NO: 951074 - RNA, 22 nt, Human
gucuuucuuaauucaagugcuu

SEQ ID NO: 951075 - RNA, 22 nt, Human
aauguucauugauuaaaugaau

SEQ ID NO: 951076 - RNA, 17 nt, Human
ggcagcugccacuuuuu

SEQ ID NO: 951077 - RNA, 22 nt, Human
cagcagagacgguaagcagaac

SEQ ID NO: 951078 - RNA, 22 nt, Human
aaauacuagaauucagaguuga

SEQ ID NO: 951079 - RNA, 22 nt, Human
agccacagugcaagagagaaaa

SEQ ID NO: 951080 - RNA, 22 nt, Human
uacuaaauaguuuaauuccuca

SEQ ID NO: 951081 - RNA, 22 nt, Human
ggguggagaggcuaaguccagu

SEQ ID NO: 951082 - RNA, 22 nt, Human
caggcugcagaggccuuucaug

SEQ ID NO: 951083 - RNA, 22 nt, Human
uuucaacagcucucaaaugauc

SEQ ID NO: 951084 - RNA, 22 nt, Human
gcagcuggcccugacacgcaga

SEQ ID NO: 951085 - RNA, 21 nt, Human
uuacuuuugcaccaaccuaau

SEQ ID NO: 951086 - RNA, 22 nt, Human
ucuucagauggccaguuguccc

SEQ ID NO: 951087 - RNA, 22 nt, Human
uucaaucauuagaaucucaggc

SEQ ID NO: 951088 - RNA, 22 nt, Human
ggaugcugggagacagcaggca

SEQ ID NO: 951089 - RNA, 23 nt, Human
ugauuuuaaaaaguaaguuauca

SEQ ID NO: 951090 - RNA, 22 nt, Human
ucacucugggcccuacugggcu

SEQ ID NO: 951091 - RNA, 22 nt, Human
uugcaucuaccauaucaaagau

SEQ ID NO: 951092 - RNA, 22 nt, Human
uucaagauaauaggaaugaaaa

SEQ ID NO: 951093 - RNA, 22 nt, Human
auuguacaugcagugagucauc

SEQ ID NO: 951094 - RNA, 22 nt, Human
uuuaaauuauaguuaaugucug

SEQ ID NO: 951095 - RNA, 22 nt, Human
aggcauggcuuuaggcaggcgu

SEQ ID NO: 951096 - RNA, 22 nt, Human
gugugucuuuauaagaagaggg

SEQ ID NO: 951097 - RNA, 22 nt, Human
ugaaaucuccucuuuauauauc

SEQ ID NO: 951098 - RNA, 22 nt, Human
aaugaugggaaggagaaaagca

SEQ ID NO: 951099 - RNA, 22 nt, Human
uggaaauguauuugggcaugcc

SEQ ID NO: 951100 - RNA, 22 nt, Human
cucuccuggggagcacacacac

SEQ ID NO: 951101 - RNA, 22 nt, Human
uagaauaugugguaggaucugg

SEQ ID NO: 951102 - RNA, 22 nt, Human
ugggccacuugaaaguggaugu

SEQ ID NO: 951103 - RNA, 22 nt, Human
cccucagcuccacccucagcag

SEQ ID NO: 951104 - RNA, 18 nt, Human
cccacggugcuguagggc

SEQ ID NO: 951105 - RNA, 22 nt, Human
uugguuuacuaggauucaaauu

SEQ ID NO: 951106 - RNA, 22 nt, Human
cuuuguaucuaaauaucuugaa

SEQ ID NO: 951107 - RNA, 20 nt, Human
uucaaaguguaugauaugca

SEQ ID NO: 951108 - RNA, 22 nt, Human
aucuagaaguggcaugaauuac

SEQ ID NO: 951109 - RNA, 22 nt, Human
uuccuguauuuugcgaauuuuc

SEQ ID NO: 951110 - RNA, 21 nt, Human
uucaaagagugggcauuguca

SEQ ID NO: 951111 - RNA, 22 nt, Human
acccagcucuuugauggucuug

SEQ ID NO: 951112 - RNA, 22 nt, Human
gaaaggccauuucugaggguuu

SEQ ID NO: 951113 - RNA, 22 nt, Human
acagggcagugucuugaaaaau

SEQ ID NO: 951114 - RNA, 22 nt, Human
uggcucuggugcgggcuccugc

SEQ ID NO: 951115 - RNA, 22 nt, Human
ggucuaaaaugagucuuccuag

SEQ ID NO: 951116 - RNA, 22 nt, Human
acauaugugcuuauauccauga

SEQ ID NO: 951117 - RNA, 23 nt, Human
uccaggagaaccccugucugucc

SEQ ID NO: 951118 - RNA, 22 nt, Human
cccucugcucaggugcauaggc

SEQ ID NO: 951119 - RNA, 22 nt, Human
ugggcagcagcaaagccagacu

SEQ ID NO: 951120 - RNA, 22 nt, Human
uuugaaaguccuaggagagucc

SEQ ID NO: 951121 - RNA, 22 nt, Human
aucauaaaccacuuuguaaucu

SEQ ID NO: 951122 - RNA, 22 nt, Human
cucccaggacucagaggagaag

SEQ ID NO: 951123 - RNA, 22 nt, Human
aggcugggcaccguuuugaucc

SEQ ID NO: 951124 - RNA, 22 nt, Human
agcugggaggugggcagugaga

SEQ ID NO: 951125 - RNA, 22 nt, Human
caccuggcuggaagugcuccgg

SEQ ID NO: 951126 - RNA, 17 nt, Human
uggcagcugaaagcucu

SEQ ID NO: 951127 - RNA, 22 nt, Human
ucagccugcuccaagugcugcc

SEQ ID NO: 951128 - RNA, 22 nt, Human
ccagcuccuucugucuguggag

SEQ ID NO: 951129 - RNA, 22 nt, Human
uggcucagaugcucuuccagug

SEQ ID NO: 951130 - RNA, 22 nt, Human
auguguagaacuguaaugccca

SEQ ID NO: 951131 - RNA, 22 nt, Human
cuggcucucugagauauugagu

SEQ ID NO: 951132 - RNA, 22 nt, Human
aggcccuguuaugagccacugu

SEQ ID NO: 951133 - RNA, 22 nt, Human
uaugcacacaggcuuaauucau

SEQ ID NO: 951134 - RNA, 22 nt, Human
cuguuuaucuaggaguugcagg

SEQ ID NO: 951135 - RNA, 22 nt, Human
cugucaucacaguugagcagcc

SEQ ID NO: 951136 - RNA, 22 nt, Human
cucucuggcuuggcacggagau

SEQ ID NO: 951137 - RNA, 22 nt, Human
ccuggcucucugcagauccugg

SEQ ID NO: 951138 - RNA, 22 nt, Human
ugaugggacugccagcugcuga

SEQ ID NO: 951139 - RNA, 22 nt, Human
gagccagcagccggcaccacca

SEQ ID NO: 951140 - RNA, 23 nt, Human
uggagaugccccacucccugucu

SEQ ID NO: 951141 - RNA, 22 nt, Human
cacugaaggacaguaggaaggg

SEQ ID NO: 951142 - RNA, 19 nt, Human
uuacaucugcaacacuggu

SEQ ID NO: 951143 - RNA, 20 nt, Human
ucaccuuuguugguauucau

SEQ ID NO: 951144 - RNA, 22 nt, Human
acuaacauguuaaucaaaagaa

SEQ ID NO: 951145 - RNA, 22 nt, Human
cccucugaccuccugccacagu

SEQ ID NO: 951146 - RNA, 22 nt, Human
aguggcaggaaaguggaagaga

SEQ ID NO: 951147 - RNA, 21 nt, Human
agaaaaguagaguuuucagag

SEQ ID NO: 951148 - RNA, 22 nt, Human
accugccucuaagcagcaggug

SEQ ID NO: 951149 - RNA, 22 nt, Human
caggggcucuaaugcaugauca

SEQ ID NO: 951150 - RNA, 22 nt, Human
gacaucaauauucugcagggau

SEQ ID NO: 951151 - RNA, 17 nt, Human
uuccacaauaguuuguc

SEQ ID NO: 951152 - RNA, 22 nt, Human
cagaaguaagauuacugugaga

SEQ ID NO: 951153 - RNA, 22 nt, Human
gggaagggagggaccucagucu

SEQ ID NO: 951154 - RNA, 22 nt, Human
agaggaaguaaucaggaccugc

SEQ ID NO: 951155 - RNA, 22 nt, Human
acuuccuggcguagcugacauu

SEQ ID NO: 951156 - RNA, 22 nt, Human
gggccacauugaagggugggua

SEQ ID NO: 951157 - RNA, 22 nt, Human
agccacgucccugucaggguca

SEQ ID NO: 951158 - RNA, 22 nt, Human
cauuugaaauucuuagaacaaa

SEQ ID NO: 951159 - RNA, 23 nt, Human
ugucuggcucauggugggucuca

SEQ ID NO: 951160 - RNA, 23 nt, Human
cugcugugaaacaugguuuuggu

SEQ ID NO: 951161 - RNA, 22 nt, Human
uuauguagcagaaagauguuug

SEQ ID NO: 951162 - RNA, 22 nt, Human
cauucauuuacuuucaacagcu

SEQ ID NO: 951163 - RNA, 22 nt, Human
auuaaauuagcaaacugugaaa

SEQ ID NO: 951164 - RNA, 22 nt, Human
ucugcaggcuguacaggaagca

SEQ ID NO: 951165 - RNA, 22 nt, Human
gagaggagucccuaucacaguu

SEQ ID NO: 951166 - RNA, 18 nt, Human
gcccugguggagcuggug

SEQ ID NO: 951167 - RNA, 22 nt, Human
cauuaugugggaaaauguucuu

SEQ ID NO: 951168 - RNA, 21 nt, Human
ggcagcugaccgcgcggugca

SEQ ID NO: 951169 - RNA, 20 nt, Human
acccagcucugugcccuggg

SEQ ID NO: 951170 - RNA, 22 nt, Human
uccugagauguggagcuccaug

SEQ ID NO: 951171 - RNA, 22 nt, Human
acaacuucucacagauaaauuu

SEQ ID NO: 951172 - RNA, 22 nt, Human
uuacuuugaugaucaaugagcg

SEQ ID NO: 951173 - RNA, 22 nt, Human
cuggagcaggcuugucccagcu

SEQ ID NO: 951174 - RNA, 22 nt, Human
aaauaauugaguuggucaauau

SEQ ID NO: 951175 - RNA, 22 nt, Human
gccugaggaaugcuccugacuu

SEQ ID NO: 951176 - RNA, 22 nt, Human
gaguggggcccacugcugggug

SEQ ID NO: 951177 - RNA, 22 nt, Human
ccaggaagccucagaugcugag

SEQ ID NO: 951178 - RNA, 22 nt, Human
cuggggccacaacggcgcacgc

SEQ ID NO: 951179 - RNA, 22 nt, Human
ugcagcauucuuggccacuacu

SEQ ID NO: 951180 - RNA, 22 nt, Human
ucccucagggugcaguugcuuu

SEQ ID NO: 951181 - RNA, 22 nt, Human
aagggcugcuguagaagcagag

SEQ ID NO: 951182 - RNA, 22 nt, Human
uuucccaguucccugcucuaua

SEQ ID NO: 951183 - RNA, 22 nt, Human
gaccauuugcuaguaaauugca

SEQ ID NO: 951184 - RNA, 22 nt, Human
agcauuuaugacuaauguaaaa

SEQ ID NO: 951185 - RNA, 22 nt, Human
aacacuuucuuccuugcucagg

SEQ ID NO: 951186 - RNA, 22 nt, Human
ccuggagguggagguugcagug

SEQ ID NO: 951187 - RNA, 22 nt, Human
ccagccaggcauugcaaacuga

SEQ ID NO: 951188 - RNA, 22 nt, Human
ggucaggguauaaucaagugag

SEQ ID NO: 951189 - RNA, 22 nt, Human
auuuacagaagcauguaauagc

SEQ ID NO: 951190 - RNA, 22 nt, Human
aaggcacuugcccagagcugca

SEQ ID NO: 951191 - RNA, 22 nt, Human
ccaggguggggcaggcccacug

SEQ ID NO: 951192 - RNA, 22 nt, Human
uuaacagauguuuauggagcau

SEQ ID NO: 951193 - RNA, 22 nt, Human
aggaagcuggugugaggaugaa

SEQ ID NO: 951194 - RNA, 22 nt, Human
cggccaaauugcagagagaagc

SEQ ID NO: 951195 - RNA, 22 nt, Human
agcagcauagaagcugggagga

SEQ ID NO: 951196 - RNA, 22 nt, Human
cagcaugguggagcugcucuuu

SEQ ID NO: 951197 - RNA, 22 nt, Human
ugaugguuuuauuaauaggacc

SEQ ID NO: 951198 - RNA, 22 nt, Human
cugugccuuuguagcugugccu

SEQ ID NO: 951199 - RNA, 22 nt, Human
gcugcaggcgccugcggucucu

SEQ ID NO: 951200 - RNA, 22 nt, Human
cacugcagcaccaugcagggcu

SEQ ID NO: 951201 - RNA, 22 nt, Human
uggcucagccagcccuaggaac

SEQ ID NO: 951202 - RNA, 22 nt, Human
augugucuggcauggaaagugu

SEQ ID NO: 951203 - RNA, 22 nt, Human
acagcuggcaggggggcaugaa

SEQ ID NO: 951204 - RNA, 22 nt, Human
cauauuugguauaacuuaagca

SEQ ID NO: 951205 - RNA, 22 nt, Human
uagcagggaagaugaucagaau

SEQ ID NO: 951206 - RNA, 17 nt, Human
acacagggagagggagc

SEQ ID NO: 951207 - RNA, 22 nt, Human
gaccagagaaaggcacuggaag

SEQ ID NO: 951208 - RNA, 21 nt, Human
auaagcaugcugauuacauuu

SEQ ID NO: 951209 - RNA, 22 nt, Human
ucaaaguuuguggcaauuuauu

SEQ ID NO: 951210 - RNA, 22 nt, Human
uggaagccaggcccgcuccuaa

SEQ ID NO: 951211 - RNA, 22 nt, Human
uggcugugggaugagagccuca

SEQ ID NO: 951212 - RNA, 22 nt, Human
auucuucacaccuguuccuguu

SEQ ID NO: 951213 - RNA, 22 nt, Human
cuggccauguugccucugagac

SEQ ID NO: 951214 - RNA, 22 nt, Human
uggcucagucuggguugacuga

SEQ ID NO: 951215 - RNA, 20 nt, Human
cguaaggcaagugcugcauc

SEQ ID NO: 951216 - RNA, 22 nt, Human
ucccaggaugaagacaguguug

SEQ ID NO: 951217 - RNA, 22 nt, Human
ucuccugggcuugguugaaguu

SEQ ID NO: 951218 - RNA, 22 nt, Human
aaagcacauuacaagcucaguc

SEQ ID NO: 951219 - RNA, 18 nt, Human
gucaccuggaucagauua

SEQ ID NO: 951220 - RNA, 17 nt, Human
uuccucucacauuuuuu

SEQ ID NO: 951221 - RNA, 22 nt, Human
ucacucuguguuucccugggac

SEQ ID NO: 951222 - RNA, 22 nt, Human
cugagcuggucuauggacuugg

SEQ ID NO: 951223 - RNA, 22 nt, Human
ucagcugccccaguggccccag

SEQ ID NO: 951224 - RNA, 23 nt, Human
agccagggcacugguggagauug

SEQ ID NO: 951225 - RNA, 20 nt, Human
ccagucucuaucagaaauaa

SEQ ID NO: 951226 - RNA, 22 nt, Human
auauucacugagcauaaagcca

SEQ ID NO: 951227 - RNA, 22 nt, Human
gcugucccgaaccccugguaau

SEQ ID NO: 951228 - RNA, 22 nt, Human
uaacuccagagaauccauccau

SEQ ID NO: 951229 - RNA, 22 nt, Human
aaaggucauugaaaaggaggaa

SEQ ID NO: 951230 - RNA, 22 nt, Human
ucuggagaacuugcaagaggau

SEQ ID NO: 951231 - RNA, 22 nt, Human
gcuuccugucccucagccauga

SEQ ID NO: 951232 - RNA, 22 nt, Human
accaggggaugguuggcacugu

SEQ ID NO: 951233 - RNA, 22 nt, Human
ugaccaaaaaauucccugugag

SEQ ID NO: 951234 - RNA, 22 nt, Human
uucuucucucauagauuaaggu

SEQ ID NO: 951235 - RNA, 22 nt, Human
gauuucuuuagguguaauagug

SEQ ID NO: 951236 - RNA, 22 nt, Human
ggaggaugccaagcugugcaca

SEQ ID NO: 951237 - RNA, 22 nt, Human
ucagggcaaugucccucagaag

SEQ ID NO: 951238 - RNA, 20 nt, Human
aggaaaaggguggugguaga

SEQ ID NO: 951239 - RNA, 22 nt, Human
uagcauuuauggucaugugucc

SEQ ID NO: 951240 - RNA, 22 nt, Human
cugcugcugcuaucuacccagg

SEQ ID NO: 951241 - RNA, 22 nt, Human
guguacauauugagucugcuga

SEQ ID NO: 951242 - RNA, 22 nt, Human
aggccuuccucggagacaggga

SEQ ID NO: 951243 - RNA, 22 nt, Human
agagagagggaaacugcuaaac

SEQ ID NO: 951244 - RNA, 22 nt, Human
cacugaagccugggaguaagac

SEQ ID NO: 951245 - RNA, 22 nt, Human
uaaauuaugucacaugacucug

SEQ ID NO: 951246 - RNA, 21 nt, Human
cagaggcugagagggcaaucu

SEQ ID NO: 951247 - RNA, 22 nt, Human
caugcacuuaccugaaauucaa

SEQ ID NO: 951248 - RNA, 22 nt, Human
cuccucccugcgauugcucugc

SEQ ID NO: 951249 - RNA, 22 nt, Human
gaaaucugaacaacagcuguca

SEQ ID NO: 951250 - RNA, 22 nt, Human
aaggcagcacagcaacugcuca

SEQ ID NO: 951251 - RNA, 22 nt, Human
aaaucagugcucauuugaaagg

SEQ ID NO: 951252 - RNA, 22 nt, Human
aucuggcuuuuaccccacggcc

SEQ ID NO: 951253 - RNA, 23 nt, Human
ucuggcuccauccuuggggaucc

SEQ ID NO: 951254 - RNA, 22 nt, Human
aggugcagaaaaaaguccuuua

SEQ ID NO: 951255 - RNA, 18 nt, Human
ugacucacccugucagug

SEQ ID NO: 951256 - RNA, 22 nt, Human
ugugccuggcauucugggcuuc

SEQ ID NO: 951257 - RNA, 20 nt, Human
aagagaggaaguuauacuag

SEQ ID NO: 951258 - RNA, 22 nt, Human
ccugucaguugcugucagggau

SEQ ID NO: 951259 - RNA, 22 nt, Human
uccugucugucuuuggucccuu

SEQ ID NO: 951260 - RNA, 22 nt, Human
uccaaagaagucacaaacgaag

SEQ ID NO: 951261 - RNA, 22 nt, Human
cucauacauaugccauuccugc

SEQ ID NO: 951262 - RNA, 22 nt, Human
accucugcucaagaccccuccg

SEQ ID NO: 951263 - RNA, 22 nt, Human
aucucagacauguuguccauga

SEQ ID NO: 951264 - RNA, 22 nt, Human
aagauuauggcagauaacaauu

SEQ ID NO: 951265 - RNA, 22 nt, Human
aagaaauuaaggaaugcaacga

SEQ ID NO: 951266 - RNA, 22 nt, Human
cagcagaggcacgucugugaau

SEQ ID NO: 951267 - RNA, 22 nt, Human
ggcuggcacucuguccaguguc

SEQ ID NO: 951268 - RNA, 22 nt, Human
ucacagugaugacgugggagca

SEQ ID NO: 951269 - RNA, 22 nt, Human
ggcugcuguuucagagacuguu

SEQ ID NO: 951270 - RNA, 22 nt, Human
cagcucccaguggcagcuccuu

SEQ ID NO: 951271 - RNA, 19 nt, Human
cugucaggggcuggauguu

SEQ ID NO: 951272 - RNA, 22 nt, Human
uaugucuuuguccaugugcagu

SEQ ID NO: 951273 - RNA, 22 nt, Human
agcagcugcagggagggucugc

SEQ ID NO: 951274 - RNA, 22 nt, Human
guagcccaccuggggagggcga

SEQ ID NO: 951275 - RNA, 22 nt, Human
cuuuauguccaccagacugcaa

SEQ ID NO: 951276 - RNA, 22 nt, Human
agcuuuguauuugagcauacga

SEQ ID NO: 951277 - RNA, 22 nt, Human
cuuagcaugugguguccuugua

SEQ ID NO: 951278 - RNA, 22 nt, Human
gagguacagaguguuccaaugu

SEQ ID NO: 951279 - RNA, 22 nt, Human
agaauuagucacaauuauagga

SEQ ID NO: 951280 - RNA, 22 nt, Human
caggauccccaggucgccgucc

SEQ ID NO: 951281 - RNA, 22 nt, Human
ugggagaagcagcagccaagug

SEQ ID NO: 951282 - RNA, 22 nt, Human
uuucacaucagagguagauuag

SEQ ID NO: 951283 - RNA, 22 nt, Human
gagagggccgggggccagcucc

SEQ ID NO: 951284 - RNA, 22 nt, Human
ucugcagcuucuugccagagag

SEQ ID NO: 951285 - RNA, 22 nt, Human
aggagagggguaggauuaauuu

SEQ ID NO: 951286 - RNA, 22 nt, Human
auugacaagacaauggcucuua

SEQ ID NO: 951287 - RNA, 21 nt, Human
ugcagcugacacugguaugcc

SEQ ID NO: 951288 - RNA, 19 nt, Human
ggcugccuggagcgagggc

SEQ ID NO: 951289 - RNA, 22 nt, Human
cuguaaaacugcuuaaguaugc

SEQ ID NO: 951290 - RNA, 22 nt, Human
uuggcaggaauauugcagaggu

SEQ ID NO: 951291 - RNA, 22 nt, Human
agaauaaaucaaauguccugag

SEQ ID NO: 951292 - RNA, 22 nt, Human
gaauguaauagucaguagaaca

SEQ ID NO: 951293 - RNA, 22 nt, Human
gcagggcuguggacacuuuggu

SEQ ID NO: 951294 - RNA, 22 nt, Human
gcagauggugccaugucuugug

SEQ ID NO: 951295 - RNA, 22 nt, Human
cuggccuuggugcuugcagaca

SEQ ID NO: 951296 - RNA, 22 nt, Human
agggacacugaugagaaauucu

SEQ ID NO: 951297 - RNA, 22 nt, Human
cucagcccagcccaggaccagg

SEQ ID NO: 951298 - RNA, 22 nt, Human
uacaugcuccacuuucuccugu

SEQ ID NO: 951299 - RNA, 22 nt, Human
ggacccugggcuugcuccuggg

SEQ ID NO: 951300 - RNA, 22 nt, Human
ugucucagaggcaggaagagcc

SEQ ID NO: 951301 - RNA, 22 nt, Human
augucccuugucugugaugucu

SEQ ID NO: 951302 - RNA, 22 nt, Human
uuccucucaacaugccugccgg

SEQ ID NO: 951303 - RNA, 22 nt, Human
auuugaagucuucaugauuucu

SEQ ID NO: 951304 - RNA, 22 nt, Human
uagcugccagaccauucuuacu

SEQ ID NO: 951305 - RNA, 22 nt, Human
gggauggcucaaaggagucagg

SEQ ID NO: 951306 - RNA, 22 nt, Human
cuuguacauagagaagaagccu

SEQ ID NO: 951307 - RNA, 17 nt, Human
ucugccgacugccagcu

SEQ ID NO: 951308 - RNA, 22 nt, Human
ucagcuccucagagccucaguu

SEQ ID NO: 951309 - RNA, 22 nt, Human
auuuaucaccaguuagcugacu

SEQ ID NO: 951310 - RNA, 22 nt, Human
guacacucccccugugaaguug

SEQ ID NO: 951311 - RNA, 22 nt, Human
ugaggccaaugacccugggcag

SEQ ID NO: 951312 - RNA, 22 nt, Human
ugauuucccuguagccucugaa

SEQ ID NO: 951313 - RNA, 22 nt, Human
gcacugcagguggguggagagg

SEQ ID NO: 951314 - RNA, 22 nt, Human
gcaggcaguuugcuuuucccuc

SEQ ID NO: 951315 - RNA, 22 nt, Human
agccagccaguucacuaggaaa

SEQ ID NO: 951316 - RNA, 23 nt, Human
uggcagcagaucuuaaagugacc

SEQ ID NO: 951317 - RNA, 20 nt, Human
guugaaaguaauaugaugcu

SEQ ID NO: 951318 - RNA, 22 nt, Human
guccuggcccacuggcaggcug

SEQ ID NO: 951319 - RNA, 22 nt, Human
cagggugcgccacucagaugua

SEQ ID NO: 951320 - RNA, 22 nt, Human
gaggcaugcagagcuggagcag

SEQ ID NO: 951321 - RNA, 22 nt, Human
cccagcuccuuggaugggcagg

SEQ ID NO: 951322 - RNA, 19 nt, Human
ggaaacaggggccagagga

SEQ ID NO: 951323 - RNA, 21 nt, Human
ucagaguguguuacagcaagc

SEQ ID NO: 951324 - RNA, 22 nt, Human
uccagcucuaacaugcugggcc

SEQ ID NO: 951325 - RNA, 22 nt, Human
cuggguggaaagugcugagaau

SEQ ID NO: 951326 - RNA, 22 nt, Human
uuucaugaggggcaaaaucuca

SEQ ID NO: 951327 - RNA, 22 nt, Human
cccucccaagcacucugacaua

SEQ ID NO: 951328 - RNA, 22 nt, Human
caucacuguccaaaguucaguu

SEQ ID NO: 951329 - RNA, 22 nt, Human
aguccaggucucugagucacaa

SEQ ID NO: 951330 - RNA, 22 nt, Human
agagugaaaagcuagagcagua

SEQ ID NO: 951331 - RNA, 22 nt, Human
ucucugcugagaagggcuggca

SEQ ID NO: 951332 - RNA, 22 nt, Human
aaagauuucacaucccaagccu

SEQ ID NO: 951333 - RNA, 22 nt, Human
gagagcaggaggcagcgggacg

SEQ ID NO: 951334 - RNA, 22 nt, Human
ugugccuggaucucugugacaa

SEQ ID NO: 951335 - RNA, 22 nt, Human
ucuguucagcugccucagggua

SEQ ID NO: 951336 - RNA, 22 nt, Human
ugguacuuggaggcagaaaaau

SEQ ID NO: 951337 - RNA, 22 nt, Human
gaaguuuauuucaaucuauuca

SEQ ID NO: 951338 - RNA, 19 nt, Human
auggaaaaugccagacuga

SEQ ID NO: 951339 - RNA, 22 nt, Human
uugcauaaaagaguauaucuua

SEQ ID NO: 951340 - RNA, 22 nt, Human
ggcucugguugaccaugauggc

SEQ ID NO: 951341 - RNA, 22 nt, Human
cuugaaucuucugaguauuugc

SEQ ID NO: 951342 - RNA, 22 nt, Human
uacuguauuugauaagugaagu

SEQ ID NO: 951343 - RNA, 22 nt, Human
gagagaagggggauaugagccu

SEQ ID NO: 951344 - RNA, 22 nt, Human
guacauuuuacuuuguuugaau

SEQ ID NO: 951345 - RNA, 20 nt, Human
cugagcccccagccugcagg

SEQ ID NO: 951346 - RNA, 17 nt, Human
gggcagggacuccuggg

SEQ ID NO: 951347 - RNA, 22 nt, Human
cuauaauuaugcucaaaaugua

SEQ ID NO: 951348 - RNA, 22 nt, Human
cccugcagcuuuugcauaguca

SEQ ID NO: 951349 - RNA, 22 nt, Human
acaugauuggacuccuuccccu

SEQ ID NO: 951350 - RNA, 22 nt, Human
ccucaggauacaggagccacag

SEQ ID NO: 951351 - RNA, 22 nt, Human
caguacuuuucuggcuuucuac

SEQ ID NO: 951352 - RNA, 21 nt, Human
aaaguucaugcuuuaauauuc

SEQ ID NO: 951353 - RNA, 20 nt, Human
cuguggcucaugcaucugcc

SEQ ID NO: 951354 - RNA, 22 nt, Human
agcugagccagcagcaacagga

SEQ ID NO: 951355 - RNA, 22 nt, Human
uugaagcacaaugucuuuuauc

SEQ ID NO: 951356 - RNA, 22 nt, Human
acaggcuucucacagaaaaggg

SEQ ID NO: 951357 - RNA, 22 nt, Human
ccaggaguggcuggugaccuuc

SEQ ID NO: 951358 - RNA, 19 nt, Human
cugagagaugcuucacaca

SEQ ID NO: 951359 - RNA, 22 nt, Human
cugguucauccccuuccaggaa

SEQ ID NO: 951360 - RNA, 22 nt, Human
uagugcacacgcauguagcagu

SEQ ID NO: 951361 - RNA, 22 nt, Human
ugagauuuggaaaauuugauau

SEQ ID NO: 951362 - RNA, 22 nt, Human
gcugugagggcuucugaggcau

SEQ ID NO: 951363 - RNA, 22 nt, Human
ggcucagagaccugcgaucuga

SEQ ID NO: 951364 - RNA, 22 nt, Human
aaagaucagucugaagcaacau

SEQ ID NO: 951365 - RNA, 22 nt, Human
agccacaggaaacagagacagc

SEQ ID NO: 951366 - RNA, 22 nt, Human
uuucaauguaacauuuccaggc

SEQ ID NO: 951367 - RNA, 22 nt, Human
aagcagcacaguaauauuggug

SEQ ID NO: 951368 - RNA, 21 nt, Human
uucuucaugaugauuaauggc

SEQ ID NO: 951369 - RNA, 22 nt, Human
uggcuggggccugaauccugca

SEQ ID NO: 951370 - RNA, 22 nt, Human
uuugacagacauuuacuacauu

SEQ ID NO: 951371 - RNA, 20 nt, Human
agcugaggcaccugagguua

SEQ ID NO: 951372 - RNA, 22 nt, Human
cugaacucuuuaugacagcuug

SEQ ID NO: 951373 - RNA, 22 nt, Human
uaugcacacaucgcagcaggaa

SEQ ID NO: 951374 - RNA, 22 nt, Human
uggcagagagagugcagucgac

SEQ ID NO: 951375 - RNA, 22 nt, Human
gcugggagacagacuuggaacc

SEQ ID NO: 951376 - RNA, 22 nt, Human
agagccugcaucuagccucaga

SEQ ID NO: 951377 - RNA, 22 nt, Human
aaaguucugggggagaagaacg

SEQ ID NO: 951378 - RNA, 22 nt, Human
agugcuuuauguuguugugcaa

SEQ ID NO: 951379 - RNA, 22 nt, Human
uuccaggaauucagcucucagu

SEQ ID NO: 951380 - RNA, 22 nt, Human
ugcagcuguuacggacccuguc

SEQ ID NO: 951381 - RNA, 22 nt, Human
aauguguagcauuuaaugcagu

SEQ ID NO: 951382 - RNA, 21 nt, Human
aaggaaaagcuuggucucuga

SEQ ID NO: 951383 - RNA, 22 nt, Human
uccaggcugggcugaagggugc

SEQ ID NO: 951384 - RNA, 22 nt, Human
aggaugaggcuggcaggucuug

SEQ ID NO: 951385 - RNA, 22 nt, Human
acugggaggcaucuggagcuga

SEQ ID NO: 951386 - RNA, 22 nt, Human
uguggcugcucaggugcagacc

SEQ ID NO: 951387 - RNA, 22 nt, Human
uagaaacauguucuguucuguu

SEQ ID NO: 951388 - RNA, 22 nt, Human
agaccacagucaggcuccuggu

SEQ ID NO: 951389 - RNA, 22 nt, Human
caaauacucuggauguguuugu

SEQ ID NO: 951390 - RNA, 22 nt, Human
gaagcucucaaacucuccccuu

SEQ ID NO: 951391 - RNA, 22 nt, Human
uagaaaucagcaggcauaugua

SEQ ID NO: 951392 - RNA, 22 nt, Human
cggcuggggcuguccccaugac

SEQ ID NO: 951393 - RNA, 22 nt, Human
ugggggagauuagagcuucuua

SEQ ID NO: 951394 - RNA, 22 nt, Human
ucagagaaaugaaguagggauu

SEQ ID NO: 951395 - RNA, 19 nt, Human
auaaggcaauuggauuugg

SEQ ID NO: 951396 - RNA, 22 nt, Human
cagucuucuaaccuagcagccu

SEQ ID NO: 951397 - RNA, 22 nt, Human
uauuugcaacauaaaacucuga

SEQ ID NO: 951398 - RNA, 22 nt, Human
agguuuucagcuguauccugag

SEQ ID NO: 951399 - RNA, 22 nt, Human
ggccugcacagagguggcucua

SEQ ID NO: 951400 - RNA, 22 nt, Human
aaguugaagcaugaaccaaggu

SEQ ID NO: 951401 - RNA, 23 nt, Human
cagaagcaccuguugacugcugc

SEQ ID NO: 951402 - RNA, 22 nt, Human
agagugggccucugagucccag

SEQ ID NO: 951403 - RNA, 22 nt, Human
ggggauggugggaaggcaaucu

SEQ ID NO: 951404 - RNA, 22 nt, Human
agcagagccaggucucucugua

SEQ ID NO: 951405 - RNA, 22 nt, Human
acugugcaaugaguaauaaacu

SEQ ID NO: 951406 - RNA, 22 nt, Human
auggauaagaacaaauaucuga

SEQ ID NO: 951407 - RNA, 22 nt, Human
ggcagcauauauucagugggca

SEQ ID NO: 951408 - RNA, 19 nt, Human
ggcuccuguggcugcagcc

SEQ ID NO: 951409 - RNA, 22 nt, Human
ucuccugcucagaacagccuca

SEQ ID NO: 951410 - RNA, 22 nt, Human
gugugcaagggcauguacauug

SEQ ID NO: 951411 - RNA, 22 nt, Human
agaauuguaagcaauuugauua

SEQ ID NO: 951412 - RNA, 22 nt, Human
gaaggaaaggucucaugccuuu

SEQ ID NO: 951413 - RNA, 22 nt, Human
aaaaaugugaccacaggguguu

SEQ ID NO: 951414 - RNA, 22 nt, Human
ccugggagggcaagugcugaug

SEQ ID NO: 951415 - RNA, 22 nt, Human
uuuccuguugccaucaagaaug

SEQ ID NO: 951416 - RNA, 18 nt, Human
gggaagaggaucuggccc

SEQ ID NO: 951417 - RNA, 22 nt, Human
ugcuuuggaucuauuugcugag

SEQ ID NO: 951418 - RNA, 22 nt, Human
cgucccaguuccagccgcgcug

SEQ ID NO: 951419 - RNA, 22 nt, Human
ccuggccugugaaucugagagc

SEQ ID NO: 951420 - RNA, 22 nt, Human
aaagcccauguggaaguacagg

SEQ ID NO: 951421 - RNA, 22 nt, Human
gccccucccagucaggagcacu

SEQ ID NO: 951422 - RNA, 22 nt, Human
uccagucaucucccuucacauu

SEQ ID NO: 951423 - RNA, 22 nt, Human
gcucucuugguggcuguccugg

SEQ ID NO: 951424 - RNA, 20 nt, Human
ucuguaaagacuccagaagc

SEQ ID NO: 951425 - RNA, 17 nt, Human
gucauucucagaaaaug

SEQ ID NO: 951426 - RNA, 22 nt, Human
uggccuggaagagaggucgagg

SEQ ID NO: 951427 - RNA, 22 nt, Human
ugggcucugcugcguaccaguu

SEQ ID NO: 951428 - RNA, 21 nt, Human
gcagcaguguucuagaauacu

SEQ ID NO: 951429 - RNA, 22 nt, Human
caaaguccuagaacagugcuug

SEQ ID NO: 951430 - RNA, 19 nt, Human
accaggagacagugagcuu

SEQ ID NO: 951431 - RNA, 22 nt, Human
uccaguggagugugggggugaa

SEQ ID NO: 951432 - RNA, 22 nt, Human
gugggcuucuguuagggaggcu

SEQ ID NO: 951433 - RNA, 22 nt, Human
uaggcugggagccugaggcuag

SEQ ID NO: 951434 - RNA, 22 nt, Human
aaggccugaacaugaggagaug

SEQ ID NO: 951435 - RNA, 22 nt, Human
ggccucucucccuggcuugcag

SEQ ID NO: 951436 - RNA, 22 nt, Human
aggccugggucucgugccuacc

SEQ ID NO: 951437 - RNA, 22 nt, Human
gccuucccacccugcgaggcug

SEQ ID NO: 951438 - RNA, 22 nt, Human
ugccuuccuggagcugaaggcu

SEQ ID NO: 951439 - RNA, 22 nt, Human
caggcaggucagugaagaagga

SEQ ID NO: 951440 - RNA, 22 nt, Human
gccuggccgcuccgagcuccgc

SEQ ID NO: 951441 - RNA, 22 nt, Human
ucaggagaaggcaauguggaaa

SEQ ID NO: 951442 - RNA, 21 nt, Human
acagccugucaucucaugguc

SEQ ID NO: 951443 - RNA, 22 nt, Human
agccacagagguugaugugguu

SEQ ID NO: 951444 - RNA, 22 nt, Human
cagaggcacaagaaagcaaggc

SEQ ID NO: 951445 - RNA, 22 nt, Human
ugggcagagaucuggaucaaac

SEQ ID NO: 951446 - RNA, 22 nt, Human
acagggccucagcugauucugg

SEQ ID NO: 951447 - RNA, 22 nt, Human
gccugggagggcagcagugugg

SEQ ID NO: 951448 - RNA, 22 nt, Human
cagcucugaggaacacuccuuu

SEQ ID NO: 951449 - RNA, 22 nt, Human
aggcagcuuuguaguaaagcua

SEQ ID NO: 951450 - RNA, 22 nt, Human
gagcagcuggacaggccucccu

SEQ ID NO: 951451 - RNA, 22 nt, Human
gcagcuccuggcacaguuuuuu

SEQ ID NO: 951452 - RNA, 22 nt, Human
uucuuaaguauuucagagacug

SEQ ID NO: 951453 - RNA, 22 nt, Human
ccagcccugccagagagagcug

SEQ ID NO: 951454 - RNA, 22 nt, Human
uggaggaaaauuacuggggucu

SEQ ID NO: 951455 - RNA, 22 nt, Human
gccggggcuggggagagacaug

SEQ ID NO: 951456 - RNA, 22 nt, Human
ccugcagguccccggaugcgca

SEQ ID NO: 951457 - RNA, 22 nt, Human
agugugaccuuauuuggaaaca

SEQ ID NO: 951458 - RNA, 22 nt, Human
gucccuggggaaucagcuggag

SEQ ID NO: 951459 - RNA, 22 nt, Human
aggagucauugagagggguccu

SEQ ID NO: 951460 - RNA, 23 nt, Human
ugggccuggccucccaguccagc

SEQ ID NO: 951461 - RNA, 22 nt, Human
cugcugcauuccucuuuaugag

SEQ ID NO: 951462 - RNA, 22 nt, Human
aggguggccaugagggagagau

SEQ ID NO: 951463 - RNA, 22 nt, Human
cuuccugcaggacagccaucug

SEQ ID NO: 951464 - RNA, 22 nt, Human
cugcucuggggaagccagaugu

SEQ ID NO: 951465 - RNA, 19 nt, Human
ugcugcuguccuugcaggg

SEQ ID NO: 951466 - RNA, 22 nt, Human
accucugcuucccggguucaag

SEQ ID NO: 951467 - RNA, 22 nt, Human
uauuauguagaguaaggguuaa

SEQ ID NO: 951468 - RNA, 22 nt, Human
ugccuggcugggcugcucaugg

SEQ ID NO: 951469 - RNA, 21 nt, Human
agcucagccgggcacaguggc

SEQ ID NO: 951470 - RNA, 22 nt, Human
aagugguaggaagagagcacug

SEQ ID NO: 951471 - RNA, 22 nt, Human
uaaaugcaguacaaauuguucu

SEQ ID NO: 951472 - RNA, 22 nt, Human
cucagagaggcaguggaaguca

SEQ ID NO: 951473 - RNA, 22 nt, Human
gagcaacaguuuaugguuuuuc

SEQ ID NO: 951474 - RNA, 19 nt, Human
aaacacagauuucuuacca

SEQ ID NO: 951475 - RNA, 22 nt, Human
ugguccugccccgugcacagag

SEQ ID NO: 951476 - RNA, 22 nt, Human
uauuuuguuaauaauccagucc

SEQ ID NO: 951477 - RNA, 22 nt, Human
gcaggcaggcuuccuugaacug

SEQ ID NO: 951478 - RNA, 22 nt, Human
ggcagcaucacuugucuccagc

SEQ ID NO: 951479 - RNA, 19 nt, Human
ggcaggcuggauagagagg

SEQ ID NO: 951480 - RNA, 22 nt, Human
ugagcccagucugucugacaug

SEQ ID NO: 951481 - RNA, 22 nt, Human
cucuggccagagccugcgggaa

SEQ ID NO: 951482 - RNA, 22 nt, Human
gcauuccugagaaugcagagug

SEQ ID NO: 951483 - RNA, 22 nt, Human
agcucccugagaugccacagca

SEQ ID NO: 951484 - RNA, 22 nt, Human
cuggccuuuagccccagugucu

SEQ ID NO: 951485 - RNA, 22 nt, Human
uggccugcagaggcuguggggc

SEQ ID NO: 951486 - RNA, 22 nt, Human
uccugggcuguggccccgggca

SEQ ID NO: 951487 - RNA, 19 nt, Human
aggguggcaaaggagggug

SEQ ID NO: 951488 - RNA, 22 nt, Human
ucacaugcucaccuaagccaca

SEQ ID NO: 951489 - RNA, 22 nt, Human
ucuggcuccguguccgcuccca

SEQ ID NO: 951490 - RNA, 22 nt, Human
uaauacuuuugccuuguauuca

SEQ ID NO: 951491 - RNA, 22 nt, Human
ucaguuuucauuucaugagcag

SEQ ID NO: 951492 - RNA, 18 nt, Human
acagaggcagacauguau

SEQ ID NO: 951493 - RNA, 22 nt, Human
uuuugaauaauucagaaacagc

SEQ ID NO: 951494 - RNA, 22 nt, Human
gcugagaguguaggauguuuac

SEQ ID NO: 951495 - RNA, 22 nt, Human
gcugucucggggcuuucuccug

SEQ ID NO: 951496 - RNA, 22 nt, Human
ccuucugcucccuggccagggc

SEQ ID NO: 951497 - RNA, 22 nt, Human
uggcucaggauaauuuucccaa

SEQ ID NO: 951498 - RNA, 22 nt, Human
cagggcaggaauuugacauugc

SEQ ID NO: 951499 - RNA, 22 nt, Human
uacuuuaaaaacugauaauuca

SEQ ID NO: 951500 - RNA, 22 nt, Human
ugcagagggacagccacagcuc

SEQ ID NO: 951501 - RNA, 22 nt, Human
auacauuagaaucugguacuca

SEQ ID NO: 951502 - RNA, 22 nt, Human
augaugguuguccuaggugcau

SEQ ID NO: 951503 - RNA, 22 nt, Human
cuggccugagaaugcuacccuu

SEQ ID NO: 951504 - RNA, 22 nt, Human
aaaggucagcugccaucguucu

SEQ ID NO: 951505 - RNA, 22 nt, Human
caggcacugugcaagggucucg

SEQ ID NO: 951506 - RNA, 22 nt, Human
cagucauuggcuaaagcucccu

SEQ ID NO: 951507 - RNA, 22 nt, Human
uccugcagccacugcaggcaga

SEQ ID NO: 951508 - RNA, 22 nt, Human
uucaaugagcccaagaacguga

SEQ ID NO: 951509 - RNA, 22 nt, Human
uaucaucuuguugucaugcagc

SEQ ID NO: 951510 - RNA, 22 nt, Human
ccuggccuuaagggcagggagc

SEQ ID NO: 951511 - RNA, 22 nt, Human
ccugccaggacauugcuugaag

SEQ ID NO: 951512 - RNA, 22 nt, Human
cacagcuucugagugaggauuu

SEQ ID NO: 951513 - RNA, 22 nt, Human
uuaaauuuuagaaacagacucu

SEQ ID NO: 951514 - RNA, 22 nt, Human
auguuauuuuggaaaauacaaa

SEQ ID NO: 951515 - RNA, 22 nt, Human
ggcagcuccucucagcaaaaga

SEQ ID NO: 951516 - RNA, 22 nt, Human
gcuggccauagaagccaaagag

SEQ ID NO: 951517 - RNA, 22 nt, Human
ucacucugccuccauauuacua

SEQ ID NO: 951518 - RNA, 22 nt, Human
gaagaagcaggaguguguagca

SEQ ID NO: 951519 - RNA, 22 nt, Human
auacaaguugugauaauguaaa

SEQ ID NO: 951520 - RNA, 22 nt, Human
aaagcuauuuuauugcagcucu

SEQ ID NO: 951521 - RNA, 22 nt, Human
ccagcuggaagagugcagaacu

SEQ ID NO: 951522 - RNA, 22 nt, Human
uauuuguugaguuguuaugucu

SEQ ID NO: 951523 - RNA, 22 nt, Human
agggccuggcgcguggccgccg

SEQ ID NO: 951524 - RNA, 22 nt, Human
gcacugaaugcuuuuacuguaa

SEQ ID NO: 951525 - RNA, 22 nt, Human
ggugggcaggcgaggcccaggu

SEQ ID NO: 951526 - RNA, 20 nt, Human
aacacacugguggcaucagg

SEQ ID NO: 951527 - RNA, 22 nt, Human
ugagagaugaacucugauaugu

SEQ ID NO: 951528 - RNA, 22 nt, Human
aacauuucagcaaauaagaaca

SEQ ID NO: 951529 - RNA, 19 nt, Human
cccaaggcccugggcaggc

SEQ ID NO: 951530 - RNA, 22 nt, Human
aggcucagauucacauuugguu

SEQ ID NO: 951531 - RNA, 22 nt, Human
agcugcuguggggcucggccug

SEQ ID NO: 951532 - RNA, 22 nt, Human
acuauacauugaauguuaaggu

SEQ ID NO: 951533 - RNA, 22 nt, Human
uuucacaacugcuuauuugaga

SEQ ID NO: 951534 - RNA, 22 nt, Human
uuagaaagcuuuccauagucaa

SEQ ID NO: 951535 - RNA, 22 nt, Human
ccaaggcuggagugcaguggcg

SEQ ID NO: 951536 - RNA, 22 nt, Human
ccuggcaguggugaagaagagg

SEQ ID NO: 951537 - RNA, 22 nt, Human
cuggcucuaucuccaaggcugg

SEQ ID NO: 951538 - RNA, 20 nt, Human
auggccaaccugcuuaugac

SEQ ID NO: 951539 - RNA, 19 nt, Human
ccucugcgcuguccugcuc

SEQ ID NO: 951540 - RNA, 22 nt, Human
cugaggccagcugcagagcucu

SEQ ID NO: 951541 - RNA, 22 nt, Human
auaaacaguagagaaagguggu

SEQ ID NO: 951542 - RNA, 20 nt, Human
ccuggcugcauucaggacgg

SEQ ID NO: 951543 - RNA, 22 nt, Human
gacagaguuguugauguaugcu

SEQ ID NO: 951544 - RNA, 22 nt, Human
caggaccccauauucacugaac

SEQ ID NO: 951545 - RNA, 22 nt, Human
agccagcugccuuucacaucug

SEQ ID NO: 951546 - RNA, 22 nt, Human
agcuggagcuucaagcagguaa

SEQ ID NO: 951547 - RNA, 22 nt, Human
uuccucagaaaauacuguccaa

SEQ ID NO: 951548 - RNA, 22 nt, Human
gcacccagcccagggcgugaug

SEQ ID NO: 951549 - RNA, 22 nt, Human
guuuuauaggugaaauauuacu

SEQ ID NO: 951550 - RNA, 22 nt, Human
guuugcauggaagacagugagu

SEQ ID NO: 951551 - RNA, 22 nt, Human
aagaacauuuaugauggcauuu

SEQ ID NO: 951552 - RNA, 22 nt, Human
cuggggugugcucagagcaggg

SEQ ID NO: 951553 - RNA, 17 nt, Human
ugaaggccaugaccacg

SEQ ID NO: 951554 - RNA, 22 nt, Human
aagagcuggaguuugcagcccu

SEQ ID NO: 951555 - RNA, 22 nt, Human
uaggaugaucuuguagagagau

SEQ ID NO: 951556 - RNA, 22 nt, Human
gccaggugcuaucccugcgcug

SEQ ID NO: 951557 - RNA, 22 nt, Human
aacugcauuuaacaaauacucu

SEQ ID NO: 951558 - RNA, 22 nt, Human
uccugaggaaaguucaugaaug

SEQ ID NO: 951559 - RNA, 22 nt, Human
uccagggagagccgcugcucca

SEQ ID NO: 951560 - RNA, 22 nt, Human
agagaauuuuaaaagccuugaa

SEQ ID NO: 951561 - RNA, 22 nt, Human
cuggcuuccucaggagcagugg

SEQ ID NO: 951562 - RNA, 22 nt, Human
uagucucuggagacucuagggg

SEQ ID NO: 951563 - RNA, 22 nt, Human
agguacagaugaaagucuaguu

SEQ ID NO: 951564 - RNA, 22 nt, Human
cuaaaugacuuccagugguuau

SEQ ID NO: 951565 - RNA, 22 nt, Human
agauguaguagugggucuuuua

SEQ ID NO: 951566 - RNA, 22 nt, Human
cucuggccugcuuccucaggua

SEQ ID NO: 951567 - RNA, 20 nt, Human
aggcucagcugagcucuugg

SEQ ID NO: 951568 - RNA, 22 nt, Human
uauuaguagcuugaaauuggug

SEQ ID NO: 951569 - RNA, 22 nt, Human
cccaggaugucgaggcugcagu

SEQ ID NO: 951570 - RNA, 19 nt, Human
ggagccuggagcacgugcc

SEQ ID NO: 951571 - RNA, 22 nt, Human
cugcuuccauaaauaaugugcu

SEQ ID NO: 951572 - RNA, 22 nt, Human
gccuucaggaggguuccagaca

SEQ ID NO: 951573 - RNA, 22 nt, Human
ucccacucccaggcaggccucu

SEQ ID NO: 951574 - RNA, 22 nt, Human
aaggcagccucugccagccggg

SEQ ID NO: 951575 - RNA, 22 nt, Human
uuauuuucagcuaggaaagcca

SEQ ID NO: 951576 - RNA, 22 nt, Human
gugaggugggcuggccagagac

SEQ ID NO: 951577 - RNA, 22 nt, Human
aaauucagcagugaaaugcccc

SEQ ID NO: 951578 - RNA, 22 nt, Human
cccaggaggucgaagcugcagu

SEQ ID NO: 951579 - RNA, 22 nt, Human
cccagaaggucgaggcugcagu

SEQ ID NO: 951580 - RNA, 22 nt, Human
acagucuugagcaucagccaga

SEQ ID NO: 951581 - RNA, 22 nt, Human
uccaggagguagugcuuaauuu

SEQ ID NO: 951582 - RNA, 19 nt, Human
uuucuuaggccuuuggccu

SEQ ID NO: 951583 - RNA, 22 nt, Human
gcuugcucaacccccgucucuc

SEQ ID NO: 951584 - RNA, 22 nt, Human
gaagcagcuaggaucuucauuu

SEQ ID NO: 951585 - RNA, 22 nt, Human
aacaugaaguuuucuauaguga

SEQ ID NO: 951586 - RNA, 22 nt, Human
uccuggccuccguucucugcau

SEQ ID NO: 951587 - RNA, 22 nt, Human
uuccaggaggcacugacagagg

SEQ ID NO: 951588 - RNA, 22 nt, Human
ggaggccaaggcaggcggauca

SEQ ID NO: 951589 - RNA, 21 nt, Human
aaagagguuaauauuguaagu

SEQ ID NO: 951590 - RNA, 22 nt, Human
cuauuagguuggugcaaaagua

SEQ ID NO: 951591 - RNA, 22 nt, Human
gccuuugccugcgacguggcug

SEQ ID NO: 951592 - RNA, 22 nt, Human
gagagaaaugugcaguuugggc

SEQ ID NO: 951593 - RNA, 22 nt, Human
ugugaaagucaaauuaauugaa

SEQ ID NO: 951594 - RNA, 22 nt, Human
uaaugcacauagaaguacuuag

SEQ ID NO: 951595 - RNA, 22 nt, Human
aagggaggccagagguuuugca

SEQ ID NO: 951596 - RNA, 22 nt, Human
uggaggagaauuuauggucgaa

SEQ ID NO: 951597 - RNA, 22 nt, Human
uuugcagugauucuugcaguga

SEQ ID NO: 951598 - RNA, 22 nt, Human
gcugucccgcugacuuccagcu

SEQ ID NO: 951599 - RNA, 22 nt, Human
ucagagugaggcgucaacauga

SEQ ID NO: 951600 - RNA, 22 nt, Human
aauguuguuuuucugcaugucu

SEQ ID NO: 951601 - RNA, 22 nt, Human
ggcacugggcaccggcugaggg

SEQ ID NO: 951602 - RNA, 22 nt, Human
ggagaggaaaugccagcacuuc

SEQ ID NO: 951603 - RNA, 22 nt, Human
cagucccaggguugguucagcu

SEQ ID NO: 951604 - RNA, 22 nt, Human
gggacuggaacuacuggugcag

SEQ ID NO: 951605 - RNA, 22 nt, Human
ccagucugaggccuggugaggg

SEQ ID NO: 951606 - RNA, 22 nt, Human
cugggccauggaagucucugcc

SEQ ID NO: 951607 - RNA, 22 nt, Human
caggggcuagcacuuaauguuu

SEQ ID NO: 951608 - RNA, 21 nt, Human
ugaggcuguuguaccagggag

SEQ ID NO: 951609 - RNA, 22 nt, Human
ccuggcucuguccucgcgcaaa

SEQ ID NO: 951610 - RNA, 22 nt, Human
agucucugcacaguaagaagca

SEQ ID NO: 951611 - RNA, 21 nt, Human
ucaggggcuguguuuuccauc

SEQ ID NO: 951612 - RNA, 22 nt, Human
uggcagaguggaccauacucaa

SEQ ID NO: 951613 - RNA, 22 nt, Human
gguggagcuggaccaggagagg

SEQ ID NO: 951614 - RNA, 22 nt, Human
gaggucaauaauaugugcuuua

SEQ ID NO: 951615 - RNA, 22 nt, Human
gguggagcuguggacaggaagg

SEQ ID NO: 951616 - RNA, 22 nt, Human
cagugggaagggcagaggcuuu

SEQ ID NO: 951617 - RNA, 22 nt, Human
ucaggcugcccguucagggcuc

SEQ ID NO: 951618 - RNA, 20 nt, Human
uccuugaaagugggguauau

SEQ ID NO: 951619 - RNA, 22 nt, Human
ggugcagcugcagccugggagc

SEQ ID NO: 951620 - RNA, 20 nt, Human
ggccgaaauaauaguggcuu

SEQ ID NO: 951621 - RNA, 22 nt, Human
ugacauaaaccagugagcaaaa

SEQ ID NO: 951622 - RNA, 22 nt, Human
ugucacaaacauacauuauaga

SEQ ID NO: 951623 - RNA, 22 nt, Human
agccuuguuggucugaguuugg

SEQ ID NO: 951624 - RNA, 17 nt, Human
ggugaguguccaggugg

SEQ ID NO: 951625 - RNA, 22 nt, Human
acacauaagaaacuacaaagag

SEQ ID NO: 951626 - RNA, 22 nt, Human
ggcagcuuguccuucaggagag

SEQ ID NO: 951627 - RNA, 22 nt, Human
auccagagacccaaggacagaa

SEQ ID NO: 951628 - RNA, 22 nt, Human
auucuucauaccuacugagguu

SEQ ID NO: 951629 - RNA, 22 nt, Human
agcuccugaaaagcgcuugcuu

SEQ ID NO: 951630 - RNA, 22 nt, Human
ggauuuggaagaccgggucaca

SEQ ID NO: 951631 - RNA, 22 nt, Human
uggcagaguuggagguggaaga

SEQ ID NO: 951632 - RNA, 22 nt, Human
aaaugaacucuuccugcauccc

SEQ ID NO: 951633 - RNA, 22 nt, Human
cagcuggccaaucagggcgccc

SEQ ID NO: 951634 - RNA, 22 nt, Human
ucagaggagaaguugggaaaau

SEQ ID NO: 951635 - RNA, 22 nt, Human
acccaggacuuggcaaccucau

SEQ ID NO: 951636 - RNA, 22 nt, Human
cccaugagauucugaauuuggc

SEQ ID NO: 951637 - RNA, 22 nt, Human
auaagaaacauuauucuuucca

SEQ ID NO: 951638 - RNA, 23 nt, Human
agcuccagaacauagcacaggaa

SEQ ID NO: 951639 - RNA, 22 nt, Human
uccucuggggucagggcacuac

SEQ ID NO: 951640 - RNA, 22 nt, Human
guggauggacaugggcaagagg

SEQ ID NO: 951641 - RNA, 22 nt, Human
ccacuguuuuucaguuaacuuu

SEQ ID NO: 951642 - RNA, 22 nt, Human
uguauuagagcaguagaauuau

SEQ ID NO: 951643 - RNA, 22 nt, Human
gcuggccauauauuuugcuguu

SEQ ID NO: 951644 - RNA, 22 nt, Human
auggccaaagccacagcagagg

SEQ ID NO: 951645 - RNA, 22 nt, Human
uuuauuaauguagcauccaugg

SEQ ID NO: 951646 - RNA, 22 nt, Human
aucuuucuccauauacaucuuu

SEQ ID NO: 951647 - RNA, 22 nt, Human
uuaaaaugcagauuaugacuca

SEQ ID NO: 951648 - RNA, 22 nt, Human
uacaugcaugucacagaaugaa

SEQ ID NO: 951649 - RNA, 22 nt, Human
aggcugcucugcgaagucagcu

SEQ ID NO: 951650 - RNA, 22 nt, Human
ggccaggagcaagccaggcucu

SEQ ID NO: 951651 - RNA, 22 nt, Human
ucuuccucucuaauugaucaga

SEQ ID NO: 951652 - RNA, 22 nt, Human
acagaacugcaggaggaaaagc

SEQ ID NO: 951653 - RNA, 22 nt, Human
gauuuuauuagcccaaacuuug

SEQ ID NO: 951654 - RNA, 22 nt, Human
uggcagaguuauggguauuuau

SEQ ID NO: 951655 - RNA, 21 nt, Human
gugcuuuuccuuaauguucuu

SEQ ID NO: 951656 - RNA, 23 nt, Human
ccagcccuccaccagcucuaggc

SEQ ID NO: 951657 - RNA, 22 nt, Human
uggcuuccugcauggauccucu

SEQ ID NO: 951658 - RNA, 22 nt, Human
cugucucagcaggaagucauca

SEQ ID NO: 951659 - RNA, 22 nt, Human
cacacuagucuauccauuagcu

SEQ ID NO: 951660 - RNA, 22 nt, Human
augggagugacagggccacugg

SEQ ID NO: 951661 - RNA, 22 nt, Human
gcucuccaaacccuguggcuuu

SEQ ID NO: 951662 - RNA, 22 nt, Human
gggcagagacucagaaacagaa

SEQ ID NO: 951663 - RNA, 23 nt, Human
cuuuccuuucuuugacacccagc

SEQ ID NO: 951664 - RNA, 22 nt, Human
gagugcagaugaacagaagauu

SEQ ID NO: 951665 - RNA, 18 nt, Human
caugggugacagguggau

SEQ ID NO: 951666 - RNA, 22 nt, Human
ugucugagugugccugggcauu

SEQ ID NO: 951667 - RNA, 22 nt, Human
gccaggcaaauuaaggaaugca

SEQ ID NO: 951668 - RNA, 22 nt, Human
agucaaagcuacaggcauuuga

SEQ ID NO: 951669 - RNA, 22 nt, Human
cagccagguaugggcgugcggg

SEQ ID NO: 951670 - RNA, 22 nt, Human
gcaggcugaugacuggaguugg

SEQ ID NO: 951671 - RNA, 22 nt, Human
auguucuuucagccagugcauc

SEQ ID NO: 951672 - RNA, 22 nt, Human
ggcagagcugcaugagcacuca

SEQ ID NO: 951673 - RNA, 22 nt, Human
uucuuguauguaugcaaaauca

SEQ ID NO: 951674 - RNA, 22 nt, Human
guuugcauaucugugaaaugga

SEQ ID NO: 951675 - RNA, 22 nt, Human
uagugcuugagucucuccguac

SEQ ID NO: 951676 - RNA, 22 nt, Human
cugccugcacugccuggcucca

SEQ ID NO: 951677 - RNA, 22 nt, Human
ggagugggcagcacugcccugu

SEQ ID NO: 951678 - RNA, 20 nt, Human
uguuucuuuuaaugagcggc

SEQ ID NO: 951679 - RNA, 22 nt, Human
agagcccucucauuggcuuauu

SEQ ID NO: 951680 - RNA, 22 nt, Human
uagaauaaguugaugauauaug

SEQ ID NO: 951681 - RNA, 22 nt, Human
gcagcucccaucagggcacaga

SEQ ID NO: 951682 - RNA, 22 nt, Human
ucucuuucuauugcaccaugcu

SEQ ID NO: 951683 - RNA, 22 nt, Human
cauggcaggaggcugcuggcag

SEQ ID NO: 951684 - RNA, 20 nt, Human
uuucacaaugaacaugucuc

SEQ ID NO: 951685 - RNA, 22 nt, Human
uuucaggguacauggagcaaau

SEQ ID NO: 951686 - RNA, 22 nt, Human
cugggcacagcguugggcucuu

SEQ ID NO: 951687 - RNA, 22 nt, Human
auuaaaagcuucccaagaguua

SEQ ID NO: 951688 - RNA, 22 nt, Human
aaaguuugcaauuuauguuaau

SEQ ID NO: 951689 - RNA, 21 nt, Human
gccucugcugucuuauuguga

SEQ ID NO: 951690 - RNA, 22 nt, Human
cucucagacugaagggccugug

SEQ ID NO: 951691 - RNA, 22 nt, Human
ucuggccacuugcuucacacug

SEQ ID NO: 951692 - RNA, 22 nt, Human
aguuuauguagaauuggcaaua

SEQ ID NO: 951693 - RNA, 22 nt, Human
agccuucacugggaccuuggau

SEQ ID NO: 951694 - RNA, 22 nt, Human
uugaagcaugguacuuguucaa

SEQ ID NO: 951695 - RNA, 22 nt, Human
gaggaggcuaagugggcucugg

SEQ ID NO: 951696 - RNA, 22 nt, Human
cugccagcucaaagcgcagcua

SEQ ID NO: 951697 - RNA, 22 nt, Human
acauuucuuugcuagacagcag

SEQ ID NO: 951698 - RNA, 22 nt, Human
cagcuggcaaguggagcagggu

SEQ ID NO: 951699 - RNA, 22 nt, Human
uaauacagaaguguauuaaaau

SEQ ID NO: 951700 - RNA, 22 nt, Human
cagcacugcuucgcagccaggg

SEQ ID NO: 951701 - RNA, 22 nt, Human
acuaaauagccucugguaguug

SEQ ID NO: 951702 - RNA, 22 nt, Human
cugccagcagaggccagcgcug

SEQ ID NO: 951703 - RNA, 22 nt, Human
gaagagcuauguccagggagca

SEQ ID NO: 951704 - RNA, 22 nt, Human
aauauugagaaccagcauguuu

SEQ ID NO: 951705 - RNA, 22 nt, Human
aagcaccugcaguugacaaaaa

SEQ ID NO: 951706 - RNA, 22 nt, Human
ucuggcugcugcgugagugcuu

SEQ ID NO: 951707 - RNA, 22 nt, Human
cuggccuaaaauugcuucugca

SEQ ID NO: 951708 - RNA, 22 nt, Human
gcagcacauauaaacaaagaga

SEQ ID NO: 951709 - RNA, 22 nt, Human
ugaaaggugacauuucuuggau

SEQ ID NO: 951710 - RNA, 22 nt, Human
gccuggcaggaaucucagugcu

SEQ ID NO: 951711 - RNA, 22 nt, Human
uauugucuguccgggucaaagc

SEQ ID NO: 951712 - RNA, 22 nt, Human
aggcuggagggcaauggcaaga

SEQ ID NO: 951713 - RNA, 22 nt, Human
aggcccugggcaguucuguagc

SEQ ID NO: 951714 - RNA, 21 nt, Human
ugccaggccugagcugggguc

SEQ ID NO: 951715 - RNA, 22 nt, Human
acaagagauuaucuacagauga

SEQ ID NO: 951716 - RNA, 22 nt, Human
gcccccucuuuggagccagcca

SEQ ID NO: 951717 - RNA, 22 nt, Human
aguuugaauugaaaugcagaug

SEQ ID NO: 951718 - RNA, 22 nt, Human
auguuuauguugggcuauauuu

SEQ ID NO: 951719 - RNA, 22 nt, Human
ugcugugcuggcggcagaggcc

SEQ ID NO: 951720 - RNA, 22 nt, Human
ucugucccugagagcucaggag

SEQ ID NO: 951721 - RNA, 21 nt, Human
ugaaaguuggagucaaaugua

SEQ ID NO: 951722 - RNA, 22 nt, Human
ucaagagaagugcuccacagua

SEQ ID NO: 951723 - RNA, 22 nt, Human
cagcaguguacaaggugucaga

SEQ ID NO: 951724 - RNA, 22 nt, Human
uuauucaggcucucuuuggcua

SEQ ID NO: 951725 - RNA, 22 nt, Human
auuucuguaacuuaugaaaguu

SEQ ID NO: 951726 - RNA, 18 nt, Human
ggcagcuugacuagcaac

SEQ ID NO: 951727 - RNA, 23 nt, Human
gcucugcucuguuucauagacag

SEQ ID NO: 951728 - RNA, 22 nt, Human
cucucccagucaggcucaggau

SEQ ID NO: 951729 - RNA, 22 nt, Human
cucugggcaaagaugccucauc

SEQ ID NO: 951730 - RNA, 22 nt, Human
ucaggugguccuaagugccauc

SEQ ID NO: 951731 - RNA, 22 nt, Human
cagagccaggccugcccucuuu

SEQ ID NO: 951732 - RNA, 22 nt, Human
cacagccuccuucagagagcau

SEQ ID NO: 951733 - RNA, 22 nt, Human
agggagaaugaccaagguauau

SEQ ID NO: 951734 - RNA, 20 nt, Human
gaagcagcuucauguagaca

SEQ ID NO: 951735 - RNA, 22 nt, Human
ugggagcagcagggagaugcgg

SEQ ID NO: 951736 - RNA, 22 nt, Human
gguacaaggagugaagguuugg

SEQ ID NO: 951737 - RNA, 22 nt, Human
gcugggcuucucaaugcugccu

SEQ ID NO: 951738 - RNA, 22 nt, Human
auuaggaagaggaugucagcau

SEQ ID NO: 951739 - RNA, 22 nt, Human
gccagcaguccugcugugugcc

SEQ ID NO: 951740 - RNA, 22 nt, Human
ggaggccaaggagggcggauca

SEQ ID NO: 951741 - RNA, 22 nt, Human
ccuccuggccugugcagagccc

SEQ ID NO: 951742 - RNA, 22 nt, Human
uucaacuaauguuuauuuuaug

SEQ ID NO: 951743 - RNA, 22 nt, Human
ugaggggaaggcaugauaaaua

SEQ ID NO: 951744 - RNA, 22 nt, Human
uauuccuaagucccaacuacau

SEQ ID NO: 951745 - RNA, 22 nt, Human
agccucucugaugugacagcua

SEQ ID NO: 951746 - RNA, 22 nt, Human
uucucacuauguauguagauug

SEQ ID NO: 951747 - RNA, 22 nt, Human
gcucugucaacagcuagcugug

SEQ ID NO: 951748 - RNA, 22 nt, Human
gggcacugcuuugcucugucac

SEQ ID NO: 951749 - RNA, 22 nt, Human
cugaaggauuuaguucuuugcu

SEQ ID NO: 951750 - RNA, 21 nt, Human
gagugcagcaagguagagucu

SEQ ID NO: 951751 - RNA, 22 nt, Human
cagcaggguagguuguaucagu

SEQ ID NO: 951752 - RNA, 22 nt, Human
aagcagaauuucccacuaguug

SEQ ID NO: 951753 - RNA, 22 nt, Human
ccagggcuggguuugucggugu

SEQ ID NO: 951754 - RNA, 22 nt, Human
ccuuggcccuagccucaggcaa

SEQ ID NO: 951755 - RNA, 22 nt, Human
aaacacuucaaggacuucuguc

SEQ ID NO: 951756 - RNA, 22 nt, Human
caacaaguggguacuuuacagg

SEQ ID NO: 951757 - RNA, 22 nt, Human
gccaggcuccaggcccuccuga

SEQ ID NO: 951758 - RNA, 22 nt, Human
cuuugaagagauuacugugcuc

SEQ ID NO: 951759 - RNA, 22 nt, Human
caguucuuuguggggaguucuc

SEQ ID NO: 951760 - RNA, 22 nt, Human
gcccaucaucacuguggaggcu

SEQ ID NO: 951761 - RNA, 22 nt, Human
agccucugucaagcuuuucaaa

SEQ ID NO: 951762 - RNA, 22 nt, Human
caggguggggcuggcuaucaaa

SEQ ID NO: 951763 - RNA, 22 nt, Human
uaugucuugcauuuuucaaacu

SEQ ID NO: 951764 - RNA, 22 nt, Human
gcagggcagccacaggcccccu

SEQ ID NO: 951765 - RNA, 22 nt, Human
ugugaaaggagccauagacagu

SEQ ID NO: 951766 - RNA, 22 nt, Human
gacagccaugcacuucugcugu

SEQ ID NO: 951767 - RNA, 20 nt, Human
uguauauuuucugguguaaa

SEQ ID NO: 951768 - RNA, 22 nt, Human
agggagcugcucugcuuccgug

SEQ ID NO: 951769 - RNA, 22 nt, Human
ggucccaguugcccaggucagg

SEQ ID NO: 951770 - RNA, 22 nt, Human
ugcauccuuaaccagcaucacu

SEQ ID NO: 951771 - RNA, 22 nt, Human
ucuugggaucucuucaccaccu

SEQ ID NO: 951772 - RNA, 22 nt, Human
gaggccaggagugcuguaaguu

SEQ ID NO: 951773 - RNA, 23 nt, Human
uggauaaagcugugcugcauagg

SEQ ID NO: 951774 - RNA, 22 nt, Human
cuucucagaucucagcuuugag

SEQ ID NO: 951775 - RNA, 22 nt, Human
guucacaauggcuuuaccuaag

SEQ ID NO: 951776 - RNA, 22 nt, Human
agaacagaagggaggaaggccu

SEQ ID NO: 951777 - RNA, 22 nt, Human
auucuuauuuaaauagagucug

SEQ ID NO: 951778 - RNA, 22 nt, Human
uagcugucagcaaucaaguggu

SEQ ID NO: 951779 - RNA, 22 nt, Human
agagcagccugugaugaugcac

SEQ ID NO: 951780 - RNA, 19 nt, Human
uccuucagucagaucuggg

SEQ ID NO: 951781 - RNA, 22 nt, Human
ugugugcauucacaugcaugcc

SEQ ID NO: 951782 - RNA, 22 nt, Human
cccaggagguggaguucacagu

SEQ ID NO: 951783 - RNA, 22 nt, Human
aucaggaucacugggagucuug

SEQ ID NO: 951784 - RNA, 22 nt, Human
ugacuuccugcacucaggugau

SEQ ID NO: 951785 - RNA, 22 nt, Human
agcuaggaaauugaggcugaga

SEQ ID NO: 951786 - RNA, 18 nt, Human
cauuaugugguuauagaa

SEQ ID NO: 951787 - RNA, 22 nt, Human
agccucuggcccuagacugcuu

SEQ ID NO: 951788 - RNA, 22 nt, Human
uggcuguguuaccacuucaugu

SEQ ID NO: 951789 - RNA, 22 nt, Human
ucuggagcuggcagggcccugg

SEQ ID NO: 951790 - RNA, 22 nt, Human
gcuggcagguccaagauagagc

SEQ ID NO: 951791 - RNA, 22 nt, Human
aggccagcucuacccuuggacu

SEQ ID NO: 951792 - RNA, 22 nt, Human
caguggggaggccaggauagaa

SEQ ID NO: 951793 - RNA, 22 nt, Human
gcagggaaggggcaugcuggag

SEQ ID NO: 951794 - RNA, 22 nt, Human
cuguccuuacugcuucuggcuu

SEQ ID NO: 951795 - RNA, 22 nt, Human
cacuugggacaaagcuucugcu

SEQ ID NO: 951796 - RNA, 22 nt, Human
aaggagucucagcugggccuga

SEQ ID NO: 951797 - RNA, 22 nt, Human
ggagccugugcccaagcccaga

SEQ ID NO: 951798 - RNA, 19 nt, Human
uggcagaggcaguuuguac

SEQ ID NO: 951799 - RNA, 22 nt, Human
aaacucaaauuaaacuagcuua

SEQ ID NO: 951800 - RNA, 22 nt, Human
ccagcuuguuugaagcucguca

SEQ ID NO: 951801 - RNA, 22 nt, Human
aaacugcuuuccacaguggcua

SEQ ID NO: 951802 - RNA, 22 nt, Human
ucuguucaugucuuuuuaagug

SEQ ID NO: 951803 - RNA, 22 nt, Human
gaguuauuucagaaggaaagau

SEQ ID NO: 951804 - RNA, 22 nt, Human
aaaagagugacugauaaguaua

SEQ ID NO: 951805 - RNA, 22 nt, Human
cucaggauuuacuaauuucaag

SEQ ID NO: 951806 - RNA, 22 nt, Human
ucugcagcuugcacaggcaggc

SEQ ID NO: 951807 - RNA, 22 nt, Human
cagcauggugccagugagucca

SEQ ID NO: 951808 - RNA, 22 nt, Human
agggagagguugaaaccucagu

SEQ ID NO: 951809 - RNA, 22 nt, Human
guguuccauguuugagguaguu

SEQ ID NO: 951810 - RNA, 22 nt, Human
ugggguggauagaaagugaugu

SEQ ID NO: 951811 - RNA, 22 nt, Human
agggucaggagacacuggcaac

SEQ ID NO: 951812 - RNA, 22 nt, Human
aaaugcacugaacacauguugu

SEQ ID NO: 951813 - RNA, 22 nt, Human
cccugggcagucugcacuucag

SEQ ID NO: 951814 - RNA, 22 nt, Human
ccuccuggguucaagcgauucu

SEQ ID NO: 951815 - RNA, 22 nt, Human
accuuauuaaaaugaugaugua

SEQ ID NO: 951816 - RNA, 22 nt, Human
gcuugcuggugccugcaggcuc

SEQ ID NO: 951817 - RNA, 22 nt, Human
accugaggcuguuagucuaggu

SEQ ID NO: 951818 - RNA, 22 nt, Human
uuacauaacgguaugaaaaaug

SEQ ID NO: 951819 - RNA, 17 nt, Human
aguggcaggcagauggg

SEQ ID NO: 951820 - RNA, 19 nt, Human
uuggcagcugagauccugc

SEQ ID NO: 951821 - RNA, 22 nt, Human
gccugagcaggcguggaccaug

SEQ ID NO: 951822 - RNA, 22 nt, Human
aggucacacaacugucagaggc

SEQ ID NO: 951823 - RNA, 18 nt, Human
gagacacaagggccugga

SEQ ID NO: 951824 - RNA, 22 nt, Human
uggcagcucauuuggaaaugga

SEQ ID NO: 951825 - RNA, 22 nt, Human
aaaugucuuucuucugcuacgu

SEQ ID NO: 951826 - RNA, 22 nt, Human
ucaucacuguaucauugauaga

SEQ ID NO: 951827 - RNA, 22 nt, Human
aggcagacaaggucccuggucu

SEQ ID NO: 951828 - RNA, 22 nt, Human
auguggcauucuuggucauuuc

SEQ ID NO: 951829 - RNA, 17 nt, Human
ccaggagagaugcuugu

SEQ ID NO: 951830 - RNA, 22 nt, Human
uggguggcacuucuggggucca

SEQ ID NO: 951831 - RNA, 22 nt, Human
cugcagugcaagcccagaugga

SEQ ID NO: 951832 - RNA, 22 nt, Human
uucuucaauuauuggaaagaaa

SEQ ID NO: 951833 - RNA, 22 nt, Human
agcuauguuauagcauguauca

SEQ ID NO: 951834 - RNA, 22 nt, Human
caggaaagagcugccaggcagg

SEQ ID NO: 951835 - RNA, 22 nt, Human
uaagaacuucggacauguuauc

SEQ ID NO: 951836 - RNA, 22 nt, Human
ccuccuggaggcucuaagggag

SEQ ID NO: 951837 - RNA, 22 nt, Human
aguguguccagaaaucuguauu

SEQ ID NO: 951838 - RNA, 21 nt, Human
uccuggccagggcacuaggca

SEQ ID NO: 951839 - RNA, 21 nt, Human
acaggcucuggggaugcuggg

SEQ ID NO: 951840 - RNA, 22 nt, Human
auuccaggcagaccagagagau

SEQ ID NO: 951841 - RNA, 18 nt, Human
cugcccagagcacuugug

SEQ ID NO: 951842 - RNA, 22 nt, Human
cccuuccucccaggcuucugug

SEQ ID NO: 951843 - RNA, 22 nt, Human
gccaggcuggugucacaacucu

SEQ ID NO: 951844 - RNA, 22 nt, Human
gcacuugggcagagacgcacag

SEQ ID NO: 951845 - RNA, 22 nt, Human
agccuucaaccuagcuagagca

SEQ ID NO: 951846 - RNA, 22 nt, Human
ugcuggcccaguauggacugca

SEQ ID NO: 951847 - RNA, 22 nt, Human
gaaacuguauguaguuuuuggg

SEQ ID NO: 951848 - RNA, 22 nt, Human
aagaugcagcuuccacuuuugc

SEQ ID NO: 951849 - RNA, 22 nt, Human
acacuuuuagcuaugaguuaau

SEQ ID NO: 951850 - RNA, 23 nt, Human
gccaggcuccggucuguggccac

SEQ ID NO: 951851 - RNA, 22 nt, Human
cuggcugaguuacuccacugag

SEQ ID NO: 951852 - RNA, 22 nt, Human
aaagccuucaaguagauguaag

SEQ ID NO: 951853 - RNA, 19 nt, Human
acauuuagaauguacuugc

SEQ ID NO: 951854 - RNA, 22 nt, Human
uucaggauggaguaccuuuuau

SEQ ID NO: 951855 - RNA, 22 nt, Human
acacaugagaaacaucaguugu

SEQ ID NO: 951856 - RNA, 22 nt, Human
augcagaaggagccaugcuugc

SEQ ID NO: 951857 - RNA, 22 nt, Human
gccucucucuacccaguaugau

SEQ ID NO: 951858 - RNA, 22 nt, Human
uucaagaucuggguuuucagcu

SEQ ID NO: 951859 - RNA, 22 nt, Human
ucaucucaaaacccaaggggca

SEQ ID NO: 951860 - RNA, 22 nt, Human
uuucuggcagcgggacaggggu

SEQ ID NO: 951861 - RNA, 22 nt, Human
ucagagagugcaaaauauagcu

SEQ ID NO: 951862 - RNA, 22 nt, Human
ucugcgcugccuugauccuugg

SEQ ID NO: 951863 - RNA, 22 nt, Human
gccagcagguugucaaggagcu

SEQ ID NO: 951864 - RNA, 22 nt, Human
uguguuaaggugcaucuagugc

SEQ ID NO: 951865 - RNA, 23 nt, Human
uucuuauuuacuuuggaaucucc

SEQ ID NO: 951866 - RNA, 22 nt, Human
ugaggcaggagaaucaccggaa

SEQ ID NO: 951867 - RNA, 22 nt, Human
uuauauaaagauaacuuuucuu

SEQ ID NO: 951868 - RNA, 22 nt, Human
ucuccucugcgcggcagugccc

SEQ ID NO: 951869 - RNA, 22 nt, Human
uuaguuuucccaucuuuauggu

SEQ ID NO: 951870 - RNA, 22 nt, Human
auucuaggcuugaaacaugaag

SEQ ID NO: 951871 - RNA, 22 nt, Human
uuucuucagccuucacaaccug

SEQ ID NO: 951872 - RNA, 22 nt, Human
aaaguguacuaugucaugaaca

SEQ ID NO: 951873 - RNA, 21 nt, Human
ggccugagcaccuguccaccu

SEQ ID NO: 951874 - RNA, 22 nt, Human
ugaaaugauuauaugguguuug

SEQ ID NO: 951875 - RNA, 22 nt, Human
agugcuuugagcguuugaaaag

SEQ ID NO: 951876 - RNA, 22 nt, Human
uuuuaacuuaaaauacauagau

SEQ ID NO: 951877 - RNA, 22 nt, Human
auuuccuagccucucuugcagu

SEQ ID NO: 951878 - RNA, 22 nt, Human
agggcagaaguacagacacuua

SEQ ID NO: 951879 - RNA, 22 nt, Human
cugagauggaguuucgcucuuc

SEQ ID NO: 951880 - RNA, 22 nt, Human
guggagcccugccuugcucaug

SEQ ID NO: 951881 - RNA, 22 nt, Human
ccuuuggguucaaucucggucu

SEQ ID NO: 951882 - RNA, 22 nt, Human
cugugcuggcagaccuggaguu

SEQ ID NO: 951883 - RNA, 22 nt, Human
caagggcuucaaguggccaaga

SEQ ID NO: 951884 - RNA, 22 nt, Human
gcucagagcacucagacucagc

SEQ ID NO: 951885 - RNA, 20 nt, Human
uccaagcccuccuuccauuc

SEQ ID NO: 951886 - RNA, 22 nt, Human
ccuaggcccauuaauuccccuu

SEQ ID NO: 951887 - RNA, 22 nt, Human
agacgagggccuggcacacagu

SEQ ID NO: 951888 - RNA, 22 nt, Human
ucauuuaauaauuuuugaguag

SEQ ID NO: 951889 - RNA, 22 nt, Human
uuccaugugaguacacugugau

SEQ ID NO: 951890 - RNA, 22 nt, Human
ggcuucugaaaucucugugcgu

SEQ ID NO: 951891 - RNA, 22 nt, Human
cucaacagcucugccauacucc

SEQ ID NO: 951892 - RNA, 22 nt, Human
gcuuugaagacuuuuccagggu

SEQ ID NO: 951893 - RNA, 22 nt, Human
aagaagaugguuaacuuucagu

SEQ ID NO: 951894 - RNA, 22 nt, Human
ugagaauaggcauagaaccugg

SEQ ID NO: 951895 - RNA, 22 nt, Human
ugcaaacuauugguagagaugg

SEQ ID NO: 951896 - RNA, 17 nt, Human
cugaggcccagggccca

SEQ ID NO: 951897 - RNA, 22 nt, Human
gauuucuugaccccugucucag

SEQ ID NO: 951898 - RNA, 22 nt, Human
cucugugccagucugcacucgg

SEQ ID NO: 951899 - RNA, 22 nt, Human
ggaggcagaauagagugugggu

SEQ ID NO: 951900 - RNA, 22 nt, Human
caggaggaagaacucugcaaca

SEQ ID NO: 951901 - RNA, 22 nt, Human
ucugggaguuguaguccggugg

SEQ ID NO: 951902 - RNA, 22 nt, Human
aggcucugaugcaagcccaggg

SEQ ID NO: 951903 - RNA, 22 nt, Human
gcugccugggcaggaggcgcug

SEQ ID NO: 951904 - RNA, 22 nt, Human
uuaagucauuucugauuauaga

SEQ ID NO: 951905 - RNA, 22 nt, Human
ucccagggacugggcuaggcuu

SEQ ID NO: 951906 - RNA, 18 nt, Human
guucaaggucaagagaga

SEQ ID NO: 951907 - RNA, 22 nt, Human
cucccaggggaacuaucaagua

SEQ ID NO: 951908 - RNA, 22 nt, Human
cacugcaguaacucuaggacug

SEQ ID NO: 951909 - RNA, 21 nt, Human
ccugcugugaucuuagugagu

SEQ ID NO: 951910 - RNA, 18 nt, Human
ugcagcaagugcuaaaua

SEQ ID NO: 951911 - RNA, 22 nt, Human
cugggcagagcuaacaccugag

SEQ ID NO: 951912 - RNA, 22 nt, Human
ggucccaggaaucuguguucua

SEQ ID NO: 951913 - RNA, 22 nt, Human
gaggagcuggcugucgggaggc

SEQ ID NO: 951914 - RNA, 23 nt, Human
uguagcaucucuuauuucucagc

SEQ ID NO: 951915 - RNA, 22 nt, Human
cccagaggugcuucagaggugc

SEQ ID NO: 951916 - RNA, 22 nt, Human
aaaggccaagcaugagguggac

SEQ ID NO: 951917 - RNA, 18 nt, Human
aagccagagaccacugcc

SEQ ID NO: 951918 - RNA, 22 nt, Human
cuuggggcagugcuuggcacau

SEQ ID NO: 951919 - RNA, 22 nt, Human
accagcuguguccuggcugcag

SEQ ID NO: 951920 - RNA, 22 nt, Human
cauucuaucuuggacuggaucu

SEQ ID NO: 951921 - RNA, 22 nt, Human
uccauuggucucugugcccagg

SEQ ID NO: 951922 - RNA, 23 nt, Human
aagcuuccuucacgucuccuggg

SEQ ID NO: 951923 - RNA, 22 nt, Human
agcagcucugagaggccagcac

SEQ ID NO: 951924 - RNA, 22 nt, Human
ucugagagucucugaggcagau

SEQ ID NO: 951925 - RNA, 22 nt, Human
ucugaaaguaucuggaucuuuu

SEQ ID NO: 951926 - RNA, 22 nt, Human
uuugcagucaaauuugcuaaau

SEQ ID NO: 951927 - RNA, 22 nt, Human
cagcuuugauucuuucugccau

SEQ ID NO: 951928 - RNA, 22 nt, Human
gcucaggagcugacagccucaa

SEQ ID NO: 951929 - RNA, 22 nt, Human
agaaggggagaagcuaccagga

SEQ ID NO: 951930 - RNA, 22 nt, Human
gagagcugauagaugagcuacu

SEQ ID NO: 951931 - RNA, 22 nt, Human
aggcacugaaggaagcuugcgc

SEQ ID NO: 951932 - RNA, 22 nt, Human
ucacagaauagcacuguaagcg

SEQ ID NO: 951933 - RNA, 22 nt, Human
cauuacauuucaaaauguuucc

SEQ ID NO: 951934 - RNA, 22 nt, Human
ucagagugcagcgggaggcugg

SEQ ID NO: 951935 - RNA, 17 nt, Human
ugcauguccuuuguucc

SEQ ID NO: 951936 - RNA, 22 nt, Human
ugagggaggcccuuugagcaga

SEQ ID NO: 951937 - RNA, 22 nt, Human
ugugaaggagaugaagggagug

SEQ ID NO: 951938 - RNA, 22 nt, Human
accucugcaacccuggaauggg

SEQ ID NO: 951939 - RNA, 22 nt, Human
uaguccauuuucacacugcuga

SEQ ID NO: 951940 - RNA, 22 nt, Human
cagacuggccacaucugcacug

SEQ ID NO: 951941 - RNA, 22 nt, Human
acuccuggugcugaugaagaga

SEQ ID NO: 951942 - RNA, 22 nt, Human
ugagccaaacuucuccuugguc

SEQ ID NO: 951943 - RNA, 21 nt, Human
gggaaugagauucuuggagau

SEQ ID NO: 951944 - RNA, 22 nt, Human
cuuugcauacaauuuuuagaaa

SEQ ID NO: 951945 - RNA, 22 nt, Human
cacagaggcaaccuucuggggu

SEQ ID NO: 951946 - RNA, 22 nt, Human
ggagcagagcugggcuuggcug

SEQ ID NO: 951947 - RNA, 22 nt, Human
uacaguaucuucuggcaagcau

SEQ ID NO: 951948 - RNA, 20 nt, Human
ucagugauuaucucugagug

SEQ ID NO: 951949 - RNA, 22 nt, Human
ucugagagcuguagaagccuau

SEQ ID NO: 951950 - RNA, 22 nt, Human
cugugccuggggggcagagcug

SEQ ID NO: 951951 - RNA, 22 nt, Human
gugcuuccaucuagagggucac

SEQ ID NO: 951952 - RNA, 22 nt, Human
acauaacaaucauaggacauag

SEQ ID NO: 951953 - RNA, 22 nt, Human
agcacagauucugaagaguccu

SEQ ID NO: 951954 - RNA, 22 nt, Human
uauuucagggagaauaaauuug

SEQ ID NO: 951955 - RNA, 23 nt, Human
ccugugugcccuuaauucacagc

SEQ ID NO: 951956 - RNA, 22 nt, Human
aaacagaaauuuccucaugcuc

SEQ ID NO: 951957 - RNA, 22 nt, Human
uuagagucaagcugcauguucu

SEQ ID NO: 951958 - RNA, 22 nt, Human
uguguuaauuccacaaacauuc

SEQ ID NO: 951959 - RNA, 22 nt, Human
aggguaggaacugaguggaagg

SEQ ID NO: 951960 - RNA, 22 nt, Human
cccagcccccgagugucuggaa

SEQ ID NO: 951961 - RNA, 22 nt, Human
uggcagagaugaagaguuguuu

SEQ ID NO: 951962 - RNA, 20 nt, Human
ugcguguguauuuauuuucu

SEQ ID NO: 951963 - RNA, 22 nt, Human
uuugucuuauccaaucucucag

SEQ ID NO: 951964 - RNA, 22 nt, Human
gagguggccucaagcagucuuc

SEQ ID NO: 951965 - RNA, 22 nt, Human
ugcugccacugguagucucauu

SEQ ID NO: 951966 - RNA, 22 nt, Human
gcugucacaagcaucuggggca

SEQ ID NO: 951967 - RNA, 22 nt, Human
gcuggccugucuagagccuuac

SEQ ID NO: 951968 - RNA, 22 nt, Human
gcugccuugaacuuggccuggg

SEQ ID NO: 951969 - RNA, 22 nt, Human
ggcagcuggggcagugcccugu

SEQ ID NO: 951970 - RNA, 22 nt, Human
agagccagcauuugacacuggc

SEQ ID NO: 951971 - RNA, 20 nt, Human
cugggcagguguuugaucuc

SEQ ID NO: 951972 - RNA, 22 nt, Human
aaagauaugucuccaaagagau

SEQ ID NO: 951973 - RNA, 22 nt, Human
ucugccuuuucacugccacuaa

SEQ ID NO: 951974 - RNA, 22 nt, Human
gggcugggcaugguguucccuc

SEQ ID NO: 951975 - RNA, 22 nt, Human
cuggcccagucucagaguguca

SEQ ID NO: 951976 - RNA, 22 nt, Human
cccagcagccagaaugaggagc

SEQ ID NO: 951977 - RNA, 22 nt, Human
ucuuuuauccuacauuuagcuc

SEQ ID NO: 951978 - RNA, 22 nt, Human
uuggccaaggaccuuuuuggag

SEQ ID NO: 951979 - RNA, 22 nt, Human
cugggaggauacacaagaucag

SEQ ID NO: 951980 - RNA, 22 nt, Human
auucuagaugcuguaaguagca

SEQ ID NO: 951981 - RNA, 23 nt, Human
ucagaaugcacugaauuuacccu

SEQ ID NO: 951982 - RNA, 22 nt, Human
aaaugcagguaguauuuauuuu

SEQ ID NO: 951983 - RNA, 22 nt, Human
ugcuggaauaauuucauguuaa

SEQ ID NO: 951984 - RNA, 22 nt, Human
uuggcucaggaccccugugacu

SEQ ID NO: 951985 - RNA, 22 nt, Human
ggcuucccaaggagccaggaug

SEQ ID NO: 951986 - RNA, 22 nt, Human
gccucugcugacaagauggaca

SEQ ID NO: 951987 - RNA, 22 nt, Human
gcuggaccaggugugcacaggc

SEQ ID NO: 951988 - RNA, 22 nt, Human
guuucaaauagguuucagcaaa

SEQ ID NO: 951989 - RNA, 22 nt, Human
caagagcucagaaacccuugcu

SEQ ID NO: 951990 - RNA, 23 nt, Human
gugcugugagccccuuggccucc

SEQ ID NO: 951991 - RNA, 22 nt, Human
aggugccagcucucaggcagga

SEQ ID NO: 951992 - RNA, 22 nt, Human
agaggagguggugaugcuuuaa

SEQ ID NO: 951993 - RNA, 22 nt, Human
gaaggccuagggaugcucugcg

SEQ ID NO: 951994 - RNA, 22 nt, Human
ggcaaaaaccauaauuacuuuu

SEQ ID NO: 951995 - RNA, 22 nt, Human
ucagguggcuucggggaguggc

SEQ ID NO: 951996 - RNA, 21 nt, Human
aggcugcuggcucaggguccu

SEQ ID NO: 951997 - RNA, 22 nt, Human
gugcuuccugccuggugccuuu

SEQ ID NO: 951998 - RNA, 22 nt, Human
auguauguuaguguauuaucua

SEQ ID NO: 951999 - RNA, 22 nt, Human
ggagcaggagucucuugaauuu

SEQ ID NO: 952000 - RNA, 22 nt, Human
uccugcagagccgcccucaggu

SEQ ID NO: 952001 - RNA, 22 nt, Human
ucccaggauuuuaggcucucag

SEQ ID NO: 952002 - RNA, 22 nt, Human
uacauuccacuagugacuggcg

SEQ ID NO: 952003 - RNA, 19 nt, Human
acuuugcaugugugucuaa

SEQ ID NO: 952004 - RNA, 22 nt, Human
ggcccagcacagugcuuggggg

SEQ ID NO: 952005 - RNA, 22 nt, Human
uaggcacuuggcguguuggaga

SEQ ID NO: 952006 - RNA, 22 nt, Human
ugcugccacauuuaaagagggg

SEQ ID NO: 952007 - RNA, 22 nt, Human
uuaagacaguguauuuguuuuc

SEQ ID NO: 952008 - RNA, 22 nt, Human
cuguguuugaugagaagccacc

SEQ ID NO: 952009 - RNA, 21 nt, Human
uucaagauauuuaaaaggugg

SEQ ID NO: 952010 - RNA, 22 nt, Human
ucuuugaauucaaacuguucaa

SEQ ID NO: 952011 - RNA, 22 nt, Human
ugguccuggggaucugcaguga

SEQ ID NO: 952012 - RNA, 22 nt, Human
uccaagggcagccauagaacuu

SEQ ID NO: 952013 - RNA, 22 nt, Human
aggccugggcaagaaggggcgu

SEQ ID NO: 952014 - RNA, 22 nt, Human
ccaggccuagccccugagggua

SEQ ID NO: 952015 - RNA, 22 nt, Human
ggcucugcaugugagugggugg

SEQ ID NO: 952016 - RNA, 22 nt, Human
gagugcaucguggccauuuuaa

SEQ ID NO: 952017 - RNA, 22 nt, Human
ucacugaauacuugucucaucc

SEQ ID NO: 952018 - RNA, 22 nt, Human
gcugucaggccaugugggccuu

SEQ ID NO: 952019 - RNA, 22 nt, Human
gucauauacacugcauguaauc

SEQ ID NO: 952020 - RNA, 22 nt, Human
uuggcuucucuuaacccuaaag

SEQ ID NO: 952021 - RNA, 22 nt, Human
gaugaaaaucuugagaugucga

SEQ ID NO: 952022 - RNA, 22 nt, Human
agauggcaggcccugugggggu

SEQ ID NO: 952023 - RNA, 22 nt, Human
uauuugagcgaagcaguguuuu

SEQ ID NO: 952024 - RNA, 22 nt, Human
acugccuuauaugcugugugug

SEQ ID NO: 952025 - RNA, 22 nt, Human
uccuggcccacuaugccagcau

SEQ ID NO: 952026 - RNA, 22 nt, Human
ggcugcucugccuuccagcugg

SEQ ID NO: 952027 - RNA, 20 nt, Human
uccaagggcagcagaaucag

SEQ ID NO: 952028 - RNA, 22 nt, Human
uucagugugugauaccugcugu

SEQ ID NO: 952029 - RNA, 22 nt, Human
agcauccaacaggagggaaggg

SEQ ID NO: 952030 - RNA, 20 nt, Human
cacguuuuuccacuagcaaa

SEQ ID NO: 952031 - RNA, 22 nt, Human
gaaucacgguauucugcacggg

SEQ ID NO: 952032 - RNA, 22 nt, Human
cgaggcaggcaggcggaggaua

SEQ ID NO: 952033 - RNA, 22 nt, Human
ccugggcuucugucuagauguu

SEQ ID NO: 952034 - RNA, 22 nt, Human
ggagccuguggccgucacgacu

SEQ ID NO: 952035 - RNA, 19 nt, Human
aucugccuguuaucacaua

SEQ ID NO: 952036 - RNA, 22 nt, Human
ucugccagaaguucugagagua

SEQ ID NO: 952037 - RNA, 22 nt, Human
cugggagcuagcucugagcuga

SEQ ID NO: 952038 - RNA, 22 nt, Human
ugcuggcucaguuugcagacuc

SEQ ID NO: 952039 - RNA, 22 nt, Human
uaaauuauggcuggcagagcag

SEQ ID NO: 952040 - RNA, 22 nt, Human
uuucuuaaauauuugcaggaca

SEQ ID NO: 952041 - RNA, 23 nt, Human
ugcucugggaggcccuggagagc

SEQ ID NO: 952042 - RNA, 22 nt, Human
ucccagagcaguacuccaggag

SEQ ID NO: 952043 - RNA, 22 nt, Human
cuguauuuucaugccuacguac

SEQ ID NO: 952044 - RNA, 22 nt, Human
gaggcagcugaaggagugacag

SEQ ID NO: 952045 - RNA, 22 nt, Human
acagucuugcuguauggucagg

SEQ ID NO: 952046 - RNA, 22 nt, Human
aucacaggugguaggaaaagaa

SEQ ID NO: 952047 - RNA, 21 nt, Human
uuucacaaaaguaugugacaa

SEQ ID NO: 952048 - RNA, 22 nt, Human
aguggggacuuaugccagcauu

SEQ ID NO: 952049 - RNA, 22 nt, Human
ugggcagauguccucugaagug

SEQ ID NO: 952050 - RNA, 22 nt, Human
cccaggaggcagauguugcagu

SEQ ID NO: 952051 - RNA, 22 nt, Human
uagccucucuccuccacaaccu

SEQ ID NO: 952052 - RNA, 22 nt, Human
aagaaaugcagaaaugugcugg

SEQ ID NO: 952053 - RNA, 22 nt, Human
acaugauuuuaguaucauaaua

SEQ ID NO: 952054 - RNA, 22 nt, Human
uuugacaguaauaaagcacaag

SEQ ID NO: 952055 - RNA, 22 nt, Human
cagggccaaguuggugccuuuu

SEQ ID NO: 952056 - RNA, 22 nt, Human
gaggccaggggccuggagauga

SEQ ID NO: 952057 - RNA, 21 nt, Human
ucacucugauuaggugucucu

SEQ ID NO: 952058 - RNA, 22 nt, Human
ccagcucugccaagcgucagcu

SEQ ID NO: 952059 - RNA, 22 nt, Human
aaauguauugcauaggauauuu

SEQ ID NO: 952060 - RNA, 22 nt, Human
aaggucauuuaacaauuuauga

SEQ ID NO: 952061 - RNA, 22 nt, Human
gcagcuggugcaaaugucacuc

SEQ ID NO: 952062 - RNA, 22 nt, Human
auuuauuaugggauuuggcuca

SEQ ID NO: 952063 - RNA, 22 nt, Human
accagagcuggcucugagcacc

SEQ ID NO: 952064 - RNA, 22 nt, Human
uggcucugucacugugagcuau

SEQ ID NO: 952065 - RNA, 22 nt, Human
agaaaugaauauguagugguua

SEQ ID NO: 952066 - RNA, 22 nt, Human
uuacaguuuaguccaagccaga

SEQ ID NO: 952067 - RNA, 22 nt, Human
gcugcucugaaaaugacuguug

SEQ ID NO: 952068 - RNA, 22 nt, Human
agaccgagaaguucuccaggcc

SEQ ID NO: 952069 - RNA, 22 nt, Human
ugguggcaauguccuggagaag

SEQ ID NO: 952070 - RNA, 22 nt, Human
uagccuucucaagacaaaguug

SEQ ID NO: 952071 - RNA, 22 nt, Human
uggaagcagugauucuugucug

SEQ ID NO: 952072 - RNA, 22 nt, Human
ccaggcagagugcuccagaaag

SEQ ID NO: 952073 - RNA, 22 nt, Human
uauuuagaacagacaauagaaa

SEQ ID NO: 952074 - RNA, 22 nt, Human
uguggcuguguccaccugcugc

SEQ ID NO: 952075 - RNA, 22 nt, Human
uccugcaggccuguucccagua

SEQ ID NO: 952076 - RNA, 22 nt, Human
caggccagguggcaggcaaaac

SEQ ID NO: 952077 - RNA, 22 nt, Human
agagggauaauauguauuguaa

SEQ ID NO: 952078 - RNA, 22 nt, Human
ucauacaucuguccuggagcuc

SEQ ID NO: 952079 - RNA, 22 nt, Human
cuuuauguccuugaagaguugu

SEQ ID NO: 952080 - RNA, 22 nt, Human
agcagggggccacagucacagc

SEQ ID NO: 952081 - RNA, 22 nt, Human
uagaaacagagagauaugcccc

SEQ ID NO: 952082 - RNA, 22 nt, Human
gaguuauuuguagggauuauau

SEQ ID NO: 952083 - RNA, 22 nt, Human
cauugcuuccuaugucccuucu

SEQ ID NO: 952084 - RNA, 21 nt, Human
agacagaacaacugcucucca

SEQ ID NO: 952085 - RNA, 22 nt, Human
cagaaaaccugacucuagaacu

SEQ ID NO: 952086 - RNA, 22 nt, Human
uuuuccucuguuauuaguguga

SEQ ID NO: 952087 - RNA, 22 nt, Human
agagcugcccacacagcagauu

SEQ ID NO: 952088 - RNA, 22 nt, Human
auagucaaccuuguaauuagcc

SEQ ID NO: 952089 - RNA, 22 nt, Human
ugccacccagccaggaguggga

SEQ ID NO: 952090 - RNA, 22 nt, Human
ugaaagguagcuggccucauag

SEQ ID NO: 952091 - RNA, 22 nt, Human
ggacagcugcuuucaggccaca

SEQ ID NO: 952092 - RNA, 22 nt, Human
caagagcuggguggcaagcuag

SEQ ID NO: 952093 - RNA, 22 nt, Human
aagggccuccuggggagccugg

SEQ ID NO: 952094 - RNA, 22 nt, Human
aggcuauuuccacucuucucau

SEQ ID NO: 952095 - RNA, 22 nt, Human
cugggccagggaggugucugua

SEQ ID NO: 952096 - RNA, 22 nt, Human
gggcauggaggucugucugcag

SEQ ID NO: 952097 - RNA, 22 nt, Human
gcuggagccauuggcuuggccu

SEQ ID NO: 952098 - RNA, 22 nt, Human
auaucacaaacaagucuguacu

SEQ ID NO: 952099 - RNA, 22 nt, Human
acuuguguaacacagaaagaac

SEQ ID NO: 952100 - RNA, 22 nt, Human
ggugcugguucaggguggcugu

SEQ ID NO: 952101 - RNA, 22 nt, Human
gccacaggcacuuaagggcugg

SEQ ID NO: 952102 - RNA, 22 nt, Human
gggagggacacaaagaguuccc

SEQ ID NO: 952103 - RNA, 22 nt, Human
acauuucugcauguaggguaau

SEQ ID NO: 952104 - RNA, 22 nt, Human
acugcagggcauccuggccaag

SEQ ID NO: 952105 - RNA, 22 nt, Human
auucuucaaagagugucaaagu

SEQ ID NO: 952106 - RNA, 22 nt, Human
caucaguguggcaguucacugu

SEQ ID NO: 952107 - RNA, 22 nt, Human
ucuuuacaguccucugucaauc

SEQ ID NO: 952108 - RNA, 22 nt, Human
ggcugcuggggacgugggagag

SEQ ID NO: 952109 - RNA, 17 nt, Human
uucaagauauugaaaug

SEQ ID NO: 952110 - RNA, 21 nt, Human
aaguaaaucagagaaauaacc

SEQ ID NO: 952111 - RNA, 22 nt, Human
ccucccucuuucagucccacag

SEQ ID NO: 952112 - RNA, 22 nt, Human
agucucagaaaagaagcaugga

SEQ ID NO: 952113 - RNA, 22 nt, Human
gcaggguauaauacuuagguga

SEQ ID NO: 952114 - RNA, 22 nt, Human
uuguuuucacagcuuugcccgg

SEQ ID NO: 952115 - RNA, 22 nt, Human
cccaagggagugccuggucaac

SEQ ID NO: 952116 - RNA, 19 nt, Human
ucagaggauuuggcuauga

SEQ ID NO: 952117 - RNA, 22 nt, Human
ugaccaaagaguugcuuguauu

SEQ ID NO: 952118 - RNA, 22 nt, Human
caggacagguguucuagaucag

SEQ ID NO: 952119 - RNA, 22 nt, Human
agugaccauuuucagcuagagg

SEQ ID NO: 952120 - RNA, 22 nt, Human
ugugaacuggcagguggacggg

SEQ ID NO: 952121 - RNA, 22 nt, Human
cagccaggacagggaaacuagu

SEQ ID NO: 952122 - RNA, 23 nt, Human
agcagccauagggaagcaauaca

SEQ ID NO: 952123 - RNA, 22 nt, Human
aagcugcagacccccugucuca

SEQ ID NO: 952124 - RNA, 22 nt, Human
acagccagaggagccaggcugg

SEQ ID NO: 952125 - RNA, 22 nt, Human
gggugcaggcagcccaggcagg

SEQ ID NO: 952126 - RNA, 22 nt, Human
ucagauggguuuugaaggaugu

SEQ ID NO: 952127 - RNA, 22 nt, Human
agccaggaaugcaugcucugcu

SEQ ID NO: 952128 - RNA, 22 nt, Human
agaauccugaugaaaaggagag

SEQ ID NO: 952129 - RNA, 22 nt, Human
gagcugccuguugcauagcaac

SEQ ID NO: 952130 - RNA, 22 nt, Human
uacaaagccugguagauaucug

SEQ ID NO: 952131 - RNA, 22 nt, Human
uuuucauuguaaaucaggaaac

SEQ ID NO: 952132 - RNA, 22 nt, Human
ggaugcugacuuuggagcaugg

SEQ ID NO: 952133 - RNA, 22 nt, Human
agggcaguucaacuucauagug

SEQ ID NO: 952134 - RNA, 22 nt, Human
uguacaaugccgagacuaacuc

SEQ ID NO: 952135 - RNA, 19 nt, Human
aggcagaggcuuggcuagc

SEQ ID NO: 952136 - RNA, 22 nt, Human
ugggaugggaucucgcuguguc

SEQ ID NO: 952137 - RNA, 22 nt, Human
uccauucauucauugaugaaca

SEQ ID NO: 952138 - RNA, 22 nt, Human
accuugggcaaguuggaaacug

SEQ ID NO: 952139 - RNA, 22 nt, Human
ccuggccagcgccggcugcucg

SEQ ID NO: 952140 - RNA, 22 nt, Human
aggccagaugucgggcuagaag

SEQ ID NO: 952141 - RNA, 22 nt, Human
ccagccagccuugaucugagua

SEQ ID NO: 952142 - RNA, 22 nt, Human
agucaauucuuuucaacucaag

SEQ ID NO: 952143 - RNA, 22 nt, Human
ccagcucugcauguuucccuug

SEQ ID NO: 952144 - RNA, 22 nt, Human
gcugggaguuacugucuccuuu

SEQ ID NO: 952145 - RNA, 22 nt, Human
uuccucaucugugcaccucacu

SEQ ID NO: 952146 - RNA, 22 nt, Human
ucaguuuuuguuugccagauag

SEQ ID NO: 952147 - RNA, 22 nt, Human
ugggccacggggguggagagcu

SEQ ID NO: 952148 - RNA, 22 nt, Human
auuugcaugcuucuauugugaa

SEQ ID NO: 952149 - RNA, 22 nt, Human
cuccucagucaggucuaggguc

SEQ ID NO: 952150 - RNA, 22 nt, Human
accagguggccccagcgugguu

SEQ ID NO: 952151 - RNA, 22 nt, Human
ccaggcagcucugauuuauguc

SEQ ID NO: 952152 - RNA, 22 nt, Human
gaaauauucuugucuuguuuuc

SEQ ID NO: 952153 - RNA, 22 nt, Human
aaguucaagucugcaucuuuuu

SEQ ID NO: 952154 - RNA, 22 nt, Human
cagccaggagcucccccugcuc

SEQ ID NO: 952155 - RNA, 22 nt, Human
cugagaggaugcugcaguggag

SEQ ID NO: 952156 - RNA, 22 nt, Human
guagggagcccagagcccagug

SEQ ID NO: 952157 - RNA, 22 nt, Human
ucugggaacacacgucacuuca

SEQ ID NO: 952158 - RNA, 22 nt, Human
ccagagccccugagcuucccug

SEQ ID NO: 952159 - RNA, 22 nt, Human
auucuucaucacuaccuuguga

SEQ ID NO: 952160 - RNA, 22 nt, Human
caaggccacguucugcaugcgg

SEQ ID NO: 952161 - RNA, 22 nt, Human
uggcagcuugaaugcagucuuu

SEQ ID NO: 952162 - RNA, 22 nt, Human
ucaaagucauggcaggcucaga

SEQ ID NO: 952163 - RNA, 22 nt, Human
cugcagaggccucgccuccucu

SEQ ID NO: 952164 - RNA, 22 nt, Human
cugcccugccuggccagugugg

SEQ ID NO: 952165 - RNA, 22 nt, Human
ucaccuugaaugcagcagcgug

SEQ ID NO: 952166 - RNA, 23 nt, Human
acacauuuuucccguucugaggu

SEQ ID NO: 952167 - RNA, 22 nt, Human
cagcuucugcuaucgaacaucu

SEQ ID NO: 952168 - RNA, 22 nt, Human
ucagcaggcaggaggcaugcca

SEQ ID NO: 952169 - RNA, 22 nt, Human
ugggcacaggggaauggaugaa

SEQ ID NO: 952170 - RNA, 22 nt, Human
ucagaggaccuuacugagaacc

SEQ ID NO: 952171 - RNA, 22 nt, Human
uccaggacuagcauuucugaua

SEQ ID NO: 952172 - RNA, 22 nt, Human
cugcuuuguggaaucacacugg

SEQ ID NO: 952173 - RNA, 22 nt, Human
aacauuucugagaauaucaguu

SEQ ID NO: 952174 - RNA, 22 nt, Human
aggaagcucaaagccaugaugu

SEQ ID NO: 952175 - RNA, 22 nt, Human
aucuacagugcacaggacagcc

SEQ ID NO: 952176 - RNA, 22 nt, Human
ggggugggguuacucauugugc

SEQ ID NO: 952177 - RNA, 22 nt, Human
ugagccagccucagaagucacg

SEQ ID NO: 952178 - RNA, 22 nt, Human
cugggcacaaguggcccuggau

SEQ ID NO: 952179 - RNA, 22 nt, Human
uggcccuguguccugcugccag

SEQ ID NO: 952180 - RNA, 22 nt, Human
cugaggcuuugugugcaugccu

SEQ ID NO: 952181 - RNA, 18 nt, Human
cugcugugucgucugggc

SEQ ID NO: 952182 - RNA, 23 nt, Human
gacaccuuugccagaucaagaug

SEQ ID NO: 952183 - RNA, 22 nt, Human
ucaguuuugauuccugguucuc

SEQ ID NO: 952184 - RNA, 22 nt, Human
ccugcagagccacgugccagcg

SEQ ID NO: 952185 - RNA, 22 nt, Human
acaguggagaaggcaugaggcu

SEQ ID NO: 952186 - RNA, 19 nt, Human
gcuccugggccucacucau

SEQ ID NO: 952187 - RNA, 23 nt, Human
ucccaggaaucugcauuuuuaac

SEQ ID NO: 952188 - RNA, 22 nt, Human
ucuggcucaucucuccagguaa

SEQ ID NO: 952189 - RNA, 22 nt, Human
agcagccaagguaaccugugcu

SEQ ID NO: 952190 - RNA, 22 nt, Human
cagucccagcugcucagaaggc

SEQ ID NO: 952191 - RNA, 22 nt, Human
cccaggccagaacuugguugcu

SEQ ID NO: 952192 - RNA, 21 nt, Human
ccugccaggaaacugaguguc

SEQ ID NO: 952193 - RNA, 22 nt, Human
caggaggaaaugugacccugcu

SEQ ID NO: 952194 - RNA, 22 nt, Human
gauuucaccugaucuugucauc

SEQ ID NO: 952195 - RNA, 22 nt, Human
uggcaggggaggugcuugcuua

SEQ ID NO: 952196 - RNA, 19 nt, Human
cccaggagcaguauugaug

SEQ ID NO: 952197 - RNA, 22 nt, Human
auucuccaucaccacuggcacu

SEQ ID NO: 952198 - RNA, 22 nt, Human
ggagauggcucugcaaggucua

SEQ ID NO: 952199 - RNA, 22 nt, Human
ucuguccucuuugaagcugcuc

SEQ ID NO: 952200 - RNA, 22 nt, Human
ggcaggaggaagaguuagcacc

SEQ ID NO: 952201 - RNA, 22 nt, Human
ggcaggagaaaggucucuucuu

SEQ ID NO: 952202 - RNA, 22 nt, Human
gaggccuggcucugcccuccug

SEQ ID NO: 952203 - RNA, 22 nt, Human
acugucuucaaaugaauauauu

SEQ ID NO: 952204 - RNA, 21 nt, Human
ugggacagugauggcuccucc

SEQ ID NO: 952205 - RNA, 22 nt, Human
agcaccauugcaaauauggcag

SEQ ID NO: 952206 - RNA, 22 nt, Human
uuuacugugcauuagaaucacc

SEQ ID NO: 952207 - RNA, 22 nt, Human
uccacuuuagcaaugauugaau

SEQ ID NO: 952208 - RNA, 22 nt, Human
ugugugcagacagauauuacuu

SEQ ID NO: 952209 - RNA, 22 nt, Human
uuucacauuuuauacuuaagcc

SEQ ID NO: 952210 - RNA, 22 nt, Human
gucuuuauuugagauugucauu

SEQ ID NO: 952211 - RNA, 22 nt, Human
cuuagaaauuguuacucauuca

SEQ ID NO: 952212 - RNA, 22 nt, Human
ugaaagaacuagcaucuucaag

SEQ ID NO: 952213 - RNA, 23 nt, Human
uucuuucaagaaguucacagugc

SEQ ID NO: 952214 - RNA, 22 nt, Human
cuucuucaguugcauguauugg

SEQ ID NO: 952215 - RNA, 22 nt, Human
uuauguagugacugacuguuag

SEQ ID NO: 952216 - RNA, 22 nt, Human
agcaauauuuaaagguuugcaa

SEQ ID NO: 952217 - RNA, 22 nt, Human
cagcuggcauaccugggcccgg

SEQ ID NO: 952218 - RNA, 22 nt, Human
ccuuccaggugcaggcaagccu

SEQ ID NO: 952219 - RNA, 22 nt, Human
aaucucuuuggcucaaggaucc

SEQ ID NO: 952220 - RNA, 22 nt, Human
agaugcugugucuguucccuug

SEQ ID NO: 952221 - RNA, 20 nt, Human
gcauccagacacccagcugc

SEQ ID NO: 952222 - RNA, 22 nt, Human
aaagcucacaguaauacaaggc

SEQ ID NO: 952223 - RNA, 22 nt, Human
agggaagaagcugguaguaggu

SEQ ID NO: 952224 - RNA, 22 nt, Human
gcugucugucucugucccacca

SEQ ID NO: 952225 - RNA, 22 nt, Human
ugcugucccuaagucucuucaa

SEQ ID NO: 952226 - RNA, 22 nt, Human
ggcccagcugugcuuccagccc

SEQ ID NO: 952227 - RNA, 22 nt, Human
ccagcagcuuuauuggcucucc

SEQ ID NO: 952228 - RNA, 22 nt, Human
uuugaaaacuuaauuuggucgu

SEQ ID NO: 952229 - RNA, 22 nt, Human
ucugccagugguuuggcccuga

SEQ ID NO: 952230 - RNA, 22 nt, Human
aguuuuauuccaaugugcagca

SEQ ID NO: 952231 - RNA, 22 nt, Human
ccaaggagcaaguuuacaccug

SEQ ID NO: 952232 - RNA, 22 nt, Human
uuucaaaauuuugcagugguaa

SEQ ID NO: 952233 - RNA, 22 nt, Human
ccagggcugagcugugaccaug

SEQ ID NO: 952234 - RNA, 22 nt, Human
caaaguccauaguuuacaauag

SEQ ID NO: 952235 - RNA, 19 nt, Human
agguggucuaggcuggaga

SEQ ID NO: 952236 - RNA, 22 nt, Human
uucuuuggggaauauucugguu

SEQ ID NO: 952237 - RNA, 22 nt, Human
ggcuggcacagagggcuggugu

SEQ ID NO: 952238 - RNA, 22 nt, Human
uggaaugacagagagucugaau

SEQ ID NO: 952239 - RNA, 22 nt, Human
aucagcaaggcaaucacugcag

SEQ ID NO: 952240 - RNA, 22 nt, Human
cacaugaguccugccagguaug

SEQ ID NO: 952241 - RNA, 22 nt, Human
aaaaucuaaguagcgaguaagg

SEQ ID NO: 952242 - RNA, 22 nt, Human
gaggggcuggcacgauggcugc

SEQ ID NO: 952243 - RNA, 22 nt, Human
cacaguggcagguguggguugu

SEQ ID NO: 952244 - RNA, 22 nt, Human
guggcagagguuccucagugug

SEQ ID NO: 952245 - RNA, 22 nt, Human
caggaacacaaguucagggaug

SEQ ID NO: 952246 - RNA, 22 nt, Human
gcccucugcuggccucaccucg

SEQ ID NO: 952247 - RNA, 22 nt, Human
uggccuggaaaaaugcagaugg

SEQ ID NO: 952248 - RNA, 22 nt, Human
uaagauaauaaguaugucuaug

SEQ ID NO: 952249 - RNA, 22 nt, Human
guggccugggguuuguucugag

SEQ ID NO: 952250 - RNA, 22 nt, Human
aggaagcuccaugaaggcagag

SEQ ID NO: 952251 - RNA, 22 nt, Human
ucaucaaagucaaagaaugacu

SEQ ID NO: 952252 - RNA, 22 nt, Human
uaucuguuccaggcacucagcu

SEQ ID NO: 952253 - RNA, 22 nt, Human
gguuugcacgauauuuccaugg

SEQ ID NO: 952254 - RNA, 22 nt, Human
gccagcugaagcccugguggaa

SEQ ID NO: 952255 - RNA, 22 nt, Human
caucuuuuggccuauucugagg

SEQ ID NO: 952256 - RNA, 22 nt, Human
ucagagugugagacauauugga

SEQ ID NO: 952257 - RNA, 22 nt, Human
gacccuggaacuuucagcagag

SEQ ID NO: 952258 - RNA, 22 nt, Human
gguggggcccuggcacugguau

SEQ ID NO: 952259 - RNA, 22 nt, Human
aggcagccaaucagaggcugac

SEQ ID NO: 952260 - RNA, 22 nt, Human
gcaggcagucaucuuucauauu

SEQ ID NO: 952261 - RNA, 22 nt, Human
gaaaauguuuccuguuauuugc

SEQ ID NO: 952262 - RNA, 21 nt, Human
uaagaacauuaucuucuuccu

SEQ ID NO: 952263 - RNA, 19 nt, Human
uuugaaaggauuguuauuu

SEQ ID NO: 952264 - RNA, 22 nt, Human
ggaguaggaguagaacucauca

SEQ ID NO: 952265 - RNA, 22 nt, Human
gaagaacaagcagugcuuuccu

SEQ ID NO: 952266 - RNA, 22 nt, Human
cuuccugggcaauguucugcuu

SEQ ID NO: 952267 - RNA, 22 nt, Human
ccaggaagcggugagggcugcc

SEQ ID NO: 952268 - RNA, 23 nt, Human
gccugggacugguagugugaccu

SEQ ID NO: 952269 - RNA, 22 nt, Human
cagcuggcguggagugauugca

SEQ ID NO: 952270 - RNA, 22 nt, Human
uggcagcuacagacagagguga

SEQ ID NO: 952271 - RNA, 22 nt, Human
gggcucagccccauugaaccag

SEQ ID NO: 952272 - RNA, 22 nt, Human
ucuguucagaauuguaacacuc

SEQ ID NO: 952273 - RNA, 22 nt, Human
aggcagucuaucucuggagccu

SEQ ID NO: 952274 - RNA, 22 nt, Human
acagagcuucccagccugagca

SEQ ID NO: 952275 - RNA, 22 nt, Human
acauacauaugacaacuuuccu

SEQ ID NO: 952276 - RNA, 19 nt, Human
ucucagaggaaaaauugcu

SEQ ID NO: 952277 - RNA, 22 nt, Human
gcugcccaggguggagccggcu

SEQ ID NO: 952278 - RNA, 22 nt, Human
uaugucuuguguuugcuaaucu

SEQ ID NO: 952279 - RNA, 22 nt, Human
cuccugggagucuuccuggaug

SEQ ID NO: 952280 - RNA, 22 nt, Human
ucucaagaucucaagauggccc

SEQ ID NO: 952281 - RNA, 22 nt, Human
gcuccaggagagggaagcagau

SEQ ID NO: 952282 - RNA, 22 nt, Human
ucccagaggaaauggcagcuga

SEQ ID NO: 952283 - RNA, 22 nt, Human
ccuccagguguuacauaugacu

SEQ ID NO: 952284 - RNA, 19 nt, Human
uggcagggagaguuugaag

SEQ ID NO: 952285 - RNA, 22 nt, Human
cauuuaaagguuguggguaaaa

SEQ ID NO: 952286 - RNA, 22 nt, Human
ugccuucaaucaggauggucuc

SEQ ID NO: 952287 - RNA, 22 nt, Human
cucagagaaaaggagcaagggu

SEQ ID NO: 952288 - RNA, 22 nt, Human
ucagggacuuacaaaccagaag

SEQ ID NO: 952289 - RNA, 22 nt, Human
gggggcuggaauauccaucaac

SEQ ID NO: 952290 - RNA, 23 nt, Human
ccugucugugcuggguggacaca

SEQ ID NO: 952291 - RNA, 22 nt, Human
cuuucagagguuacucaggaaa

SEQ ID NO: 952292 - RNA, 22 nt, Human
uucuagaugauaaaccagcagc

SEQ ID NO: 952293 - RNA, 22 nt, Human
cuggccuggagccucugggugg

SEQ ID NO: 952294 - RNA, 22 nt, Human
auuuggaaaugcaucucuugag

SEQ ID NO: 952295 - RNA, 22 nt, Human
aaugaacaucaaaugccuacca

SEQ ID NO: 952296 - RNA, 18 nt, Human
uacaucuauauaguguuu

SEQ ID NO: 952297 - RNA, 21 nt, Human
uucaaaguuugccuaaagauu

SEQ ID NO: 952298 - RNA, 22 nt, Human
guuauuuucauuggcucagacu

SEQ ID NO: 952299 - RNA, 22 nt, Human
acauuuaaccaaacuguuuaau

SEQ ID NO: 952300 - RNA, 22 nt, Human
aagucacacuagacaacugagg

SEQ ID NO: 952301 - RNA, 22 nt, Human
uggagcauauucuggagcuugg

SEQ ID NO: 952302 - RNA, 22 nt, Human
uguuccauaaguggugcuuugu

SEQ ID NO: 952303 - RNA, 22 nt, Human
ugggcugcacccucagccucug

SEQ ID NO: 952304 - RNA, 22 nt, Human
agaggcugagaaacccucuucu

SEQ ID NO: 952305 - RNA, 22 nt, Human
agcugccacagagccuggccag

SEQ ID NO: 952306 - RNA, 22 nt, Human
aguucuuauuuuggaacugagg

SEQ ID NO: 952307 - RNA, 22 nt, Human
uggcaaggcugugggggcagag

SEQ ID NO: 952308 - RNA, 22 nt, Human
ugaaggccacuuccugugagcu

SEQ ID NO: 952309 - RNA, 22 nt, Human
auguuauuaaaguacagauucu

SEQ ID NO: 952310 - RNA, 23 nt, Human
ucacagggcacuggcugggguug

SEQ ID NO: 952311 - RNA, 22 nt, Human
aggggccugguuggccucuguu

SEQ ID NO: 952312 - RNA, 22 nt, Human
gcuggggaggcagcagagaaca

SEQ ID NO: 952313 - RNA, 22 nt, Human
accgaaggaaacuggaaccguu

SEQ ID NO: 952314 - RNA, 22 nt, Human
agccuugaacacugacugaagg

SEQ ID NO: 952315 - RNA, 22 nt, Human
agaaaaggauugauggaucaga

SEQ ID NO: 952316 - RNA, 22 nt, Human
ggacacaguggaagacagcuug

SEQ ID NO: 952317 - RNA, 22 nt, Human
auguucuguuuuguaauucaua

SEQ ID NO: 952318 - RNA, 22 nt, Human
caguaugucuacuggacaaagu

SEQ ID NO: 952319 - RNA, 22 nt, Human
cuguguggacugguugaggccc

SEQ ID NO: 952320 - RNA, 22 nt, Human
uguucuuuggcuucacagcucu

SEQ ID NO: 952321 - RNA, 22 nt, Human
gaaaggucuuccggucuuccag

SEQ ID NO: 952322 - RNA, 22 nt, Human
ugucucagaguaucccugaacu

SEQ ID NO: 952323 - RNA, 22 nt, Human
agcaggaaagaaaaaucugugu

SEQ ID NO: 952324 - RNA, 22 nt, Human
ugaaaugacaaagguuuuucuu

SEQ ID NO: 952325 - RNA, 22 nt, Human
uugcacuuuauagaaacuuuug

SEQ ID NO: 952326 - RNA, 22 nt, Human
ucuuguuaaagugaagauacug

SEQ ID NO: 952327 - RNA, 22 nt, Human
uagggaugacgaaaggacagag

SEQ ID NO: 952328 - RNA, 22 nt, Human
cagcugacccgugggaggcggg

SEQ ID NO: 952329 - RNA, 22 nt, Human
cagaacauuccaugugcccugc

SEQ ID NO: 952330 - RNA, 22 nt, Human
ccagcauggcaccugagaugag

SEQ ID NO: 952331 - RNA, 22 nt, Human
caguggguggcuaaguggcuga

SEQ ID NO: 952332 - RNA, 22 nt, Human
auggucuguuaggagcuacuuu

SEQ ID NO: 952333 - RNA, 22 nt, Human
cuuuggcaaugucauuuucaau

SEQ ID NO: 952334 - RNA, 22 nt, Human
gccaggcugcuggcugcugucc

SEQ ID NO: 952335 - RNA, 22 nt, Human
ucaggaauccagacagggcaca

SEQ ID NO: 952336 - RNA, 22 nt, Human
acaaaagugagugugucucaga

SEQ ID NO: 952337 - RNA, 20 nt, Human
ggucccugcccucugucauc

SEQ ID NO: 952338 - RNA, 19 nt, Human
uggggccuccugucccugg

SEQ ID NO: 952339 - RNA, 22 nt, Human
gcccaggauggcuggaggugcu

SEQ ID NO: 952340 - RNA, 22 nt, Human
aggcaguggaaggagaaagcaa

SEQ ID NO: 952341 - RNA, 21 nt, Human
aucuuuauuacgcagagaaga

SEQ ID NO: 952342 - RNA, 22 nt, Human
uguuuauugagugccuacuaua

SEQ ID NO: 952343 - RNA, 22 nt, Human
agccaucauuucugucacuggc

SEQ ID NO: 952344 - RNA, 22 nt, Human
acacaaauuguaggauaauugc

SEQ ID NO: 952345 - RNA, 22 nt, Human
auguucuuguucaaaugucagu

SEQ ID NO: 952346 - RNA, 20 nt, Human
agugugcauuuagagucugc

SEQ ID NO: 952347 - RNA, 22 nt, Human
uucuaaacuucaauucuaaauu

SEQ ID NO: 952348 - RNA, 22 nt, Human
acucugcuguuuacucucuaua

SEQ ID NO: 952349 - RNA, 22 nt, Human
uucaaugaggauagaacuggau

SEQ ID NO: 952350 - RNA, 22 nt, Human
aaaguuagaaugauaucaacga

SEQ ID NO: 952351 - RNA, 22 nt, Human
uaucuugagagacaacacagca

SEQ ID NO: 952352 - RNA, 22 nt, Human
cucuugggagugcucuggagaa

SEQ ID NO: 952353 - RNA, 22 nt, Human
ugccuugcgguguauuucuggg

SEQ ID NO: 952354 - RNA, 22 nt, Human
caugaaaauaacauuguuguga

SEQ ID NO: 952355 - RNA, 22 nt, Human
cccagagcuccgguccugccca

SEQ ID NO: 952356 - RNA, 21 nt, Human
uguaugcacgcacaugcacac

SEQ ID NO: 952357 - RNA, 22 nt, Human
uucauguauuuaucauguaaau

SEQ ID NO: 952358 - RNA, 22 nt, Human
ucucagaguuugaaucuggagu

SEQ ID NO: 952359 - RNA, 22 nt, Human
uuauacauguguuuugagauga

SEQ ID NO: 952360 - RNA, 22 nt, Human
gcagccuguuguaccagccugu

SEQ ID NO: 952361 - RNA, 22 nt, Human
uucucagaugauucagauaaac

SEQ ID NO: 952362 - RNA, 22 nt, Human
aucuagauuagguauaagagcu

SEQ ID NO: 952363 - RNA, 22 nt, Human
agugagaguauuaaugugaacu

SEQ ID NO: 952364 - RNA, 22 nt, Human
agcuuccuacaaccaucucaga

SEQ ID NO: 952365 - RNA, 22 nt, Human
uugaaagaggcaaaguuugauc

SEQ ID NO: 952366 - RNA, 22 nt, Human
uuucauuaguaugacagcacgc

SEQ ID NO: 952367 - RNA, 22 nt, Human
ucaggagagaaagaauacaauu

SEQ ID NO: 952368 - RNA, 22 nt, Human
ucugggagguggcagggugcau

SEQ ID NO: 952369 - RNA, 23 nt, Human
uaguuauuuucucuguaauuugc

SEQ ID NO: 952370 - RNA, 22 nt, Human
aaaggagacuucagaucuccuu

SEQ ID NO: 952371 - RNA, 22 nt, Human
ggcuguggucugggugcucccc

SEQ ID NO: 952372 - RNA, 23 nt, Human
acagaaaucauuuguaagguacc

SEQ ID NO: 952373 - RNA, 22 nt, Human
ccuuuuucaauauagaauugca

SEQ ID NO: 952374 - RNA, 22 nt, Human
aggcagcauccagaggagaaug

SEQ ID NO: 952375 - RNA, 22 nt, Human
gucugucucucuccagagugca

SEQ ID NO: 952376 - RNA, 20 nt, Human
aggaggggauagaaucaaag

SEQ ID NO: 952377 - RNA, 22 nt, Human
gcccaggagguugggcugugca

SEQ ID NO: 952378 - RNA, 22 nt, Human
ccaagaugaucuuuacaguguu

SEQ ID NO: 952379 - RNA, 22 nt, Human
accuuuuccagcuucuagaggc

SEQ ID NO: 952380 - RNA, 22 nt, Human
aucuggcuuacgaagcacuggu

SEQ ID NO: 952381 - RNA, 22 nt, Human
gcccucagaggacagcugacuu

SEQ ID NO: 952382 - RNA, 22 nt, Human
gaguggagcaaaagagguagau

SEQ ID NO: 952383 - RNA, 22 nt, Human
aggauauuugcuuaagauagcu

SEQ ID NO: 952384 - RNA, 22 nt, Human
cuugaauccaaaugggagauga

SEQ ID NO: 952385 - RNA, 22 nt, Human
caggaaaggugugucaugaugg

SEQ ID NO: 952386 - RNA, 22 nt, Human
cagaagcuuugcucauaaccau

SEQ ID NO: 952387 - RNA, 22 nt, Human
ucuuugaaagcuguucuagagu

SEQ ID NO: 952388 - RNA, 22 nt, Human
uagcugccuaugugauaagaga

SEQ ID NO: 952389 - RNA, 22 nt, Human
uuaucauugucgcagucuaauu

SEQ ID NO: 952390 - RNA, 22 nt, Human
ugccuugcuggaugucaguuuu

SEQ ID NO: 952391 - RNA, 22 nt, Human
acagccugagaguggagcuggc

SEQ ID NO: 952392 - RNA, 22 nt, Human
gaggcagcaggcugaggaggau

SEQ ID NO: 952393 - RNA, 18 nt, Human
ccucaggggaccuggcag

SEQ ID NO: 952394 - RNA, 22 nt, Human
aggccagguggucaugcuugcu

SEQ ID NO: 952395 - RNA, 22 nt, Human
gucccagaggcuuuggccacag

SEQ ID NO: 952396 - RNA, 22 nt, Human
gccuggaguagcauggcaagcc

SEQ ID NO: 952397 - RNA, 22 nt, Human
ugagcuuacgugggaacagacu

SEQ ID NO: 952398 - RNA, 22 nt, Human
cagcucugggugacaggagggc

SEQ ID NO: 952399 - RNA, 22 nt, Human
aucaggauagucuguaaauugu

SEQ ID NO: 952400 - RNA, 22 nt, Human
uacaaaugaguuguaugaacca

SEQ ID NO: 952401 - RNA, 22 nt, Human
ugaguagcggcuauguguaacu

SEQ ID NO: 952402 - RNA, 22 nt, Human
gaugggggccagggccugcuuu

SEQ ID NO: 952403 - RNA, 18 nt, Human
ucuccuggguaggggccu

SEQ ID NO: 952404 - RNA, 22 nt, Human
ggcagccuugacuagugacuua

SEQ ID NO: 952405 - RNA, 22 nt, Human
ugcacagagagaugagacacgu

SEQ ID NO: 952406 - RNA, 22 nt, Human
gggguggauuccuacaggucca

SEQ ID NO: 952407 - RNA, 22 nt, Human
uaucuuuaacuugcaguauuua

SEQ ID NO: 952408 - RNA, 22 nt, Human
gcagguggauuaucagaagugc

SEQ ID NO: 952409 - RNA, 22 nt, Human
ggcacugagcugccuuggggca

SEQ ID NO: 952410 - RNA, 22 nt, Human
gggcuucuagaccagcagugag

SEQ ID NO: 952411 - RNA, 22 nt, Human
uuucagaaaacuuaucaucagu

SEQ ID NO: 952412 - RNA, 22 nt, Human
uuaauuuauguccaaaccagau

SEQ ID NO: 952413 - RNA, 22 nt, Human
guaaaguucuauuugaauuuag

SEQ ID NO: 952414 - RNA, 22 nt, Human
uuuaacagaugugaaauuuuca

SEQ ID NO: 952415 - RNA, 22 nt, Human
ugggccuggaguuuguccagag

SEQ ID NO: 952416 - RNA, 22 nt, Human
gcaaggcuuugugaauuuuaaa

SEQ ID NO: 952417 - RNA, 21 nt, Human
ccugggagaauuggguguggc

SEQ ID NO: 952418 - RNA, 22 nt, Human
aggucaccauggcaugcuccac

SEQ ID NO: 952419 - RNA, 22 nt, Human
ucuggagagucacagugccaga

SEQ ID NO: 952420 - RNA, 22 nt, Human
gccuggagcagacgugucccgg

SEQ ID NO: 952421 - RNA, 22 nt, Human
auggaaagggaagcaaggaaca

SEQ ID NO: 952422 - RNA, 20 nt, Human
gcugccagugccugaugcuu

SEQ ID NO: 952423 - RNA, 22 nt, Human
auagaguccaaaguaugaauau

SEQ ID NO: 952424 - RNA, 22 nt, Human
gagaggccauggcugugcagug

SEQ ID NO: 952425 - RNA, 23 nt, Human
ggacagggcccugcccuauggcc

SEQ ID NO: 952426 - RNA, 22 nt, Human
caguacuuaacuuauaggagag

SEQ ID NO: 952427 - RNA, 22 nt, Human
ucuggcucuauaacuccuagcu

SEQ ID NO: 952428 - RNA, 22 nt, Human
gcagggacaaggcagguguucu

SEQ ID NO: 952429 - RNA, 22 nt, Human
ucagggcaggcgagcagcugcu

SEQ ID NO: 952430 - RNA, 22 nt, Human
gucaaacaaauuaacauaucca

SEQ ID NO: 952431 - RNA, 21 nt, Human
ggcagcguguggacaggaagg

SEQ ID NO: 952432 - RNA, 22 nt, Human
uacaaacuuguuuuaaguaagu

SEQ ID NO: 952433 - RNA, 22 nt, Human
ugaggcucaaggucugguggag

SEQ ID NO: 952434 - RNA, 22 nt, Human
accccagaggcggaggcugcag

SEQ ID NO: 952435 - RNA, 23 nt, Human
gcugucaguuguuuuugucucua

SEQ ID NO: 952436 - RNA, 22 nt, Human
agcacucuucugugauaguugu

SEQ ID NO: 952437 - RNA, 22 nt, Human
caaagugcuaggauuacaggcc

SEQ ID NO: 952438 - RNA, 22 nt, Human
auugucuguacuuuaaaaaugu

SEQ ID NO: 952439 - RNA, 22 nt, Human
cagaggcugcucuggguggcau

SEQ ID NO: 952440 - RNA, 22 nt, Human
uuauuccauucaguucaacaag

SEQ ID NO: 952441 - RNA, 22 nt, Human
uucucuuugacauuauucaggu

SEQ ID NO: 952442 - RNA, 22 nt, Human
cugcugugugcuuacuuggguu

SEQ ID NO: 952443 - RNA, 22 nt, Human
ugaacucucucaagugacagaa

SEQ ID NO: 952444 - RNA, 22 nt, Human
ccaggauggggagcagauagaa

SEQ ID NO: 952445 - RNA, 22 nt, Human
uugccaggagcucaucugaggg

SEQ ID NO: 952446 - RNA, 22 nt, Human
ccuucucuacuccugaugcaug

SEQ ID NO: 952447 - RNA, 22 nt, Human
gagcugccggcccacaguacua

SEQ ID NO: 952448 - RNA, 22 nt, Human
aagcuuccugaaugcucauuua

SEQ ID NO: 952449 - RNA, 22 nt, Human
ggcaacauucuccagauccuuu

SEQ ID NO: 952450 - RNA, 22 nt, Human
aaucagaaagaggucauguugc

SEQ ID NO: 952451 - RNA, 22 nt, Human
aggccugagguuccugugcuca

SEQ ID NO: 952452 - RNA, 22 nt, Human
gaugagcauuguuucauguguu

SEQ ID NO: 952453 - RNA, 22 nt, Human
accuggccauccagcuggcauc

SEQ ID NO: 952454 - RNA, 22 nt, Human
cuucuuuccuuccuccaguggc

SEQ ID NO: 952455 - RNA, 22 nt, Human
ccucuggguaucuguggaagua

SEQ ID NO: 952456 - RNA, 22 nt, Human
cagcaauaguguguuuguuuca

SEQ ID NO: 952457 - RNA, 22 nt, Human
ucaagagagugcugcuuggggu

SEQ ID NO: 952458 - RNA, 22 nt, Human
cugaaggacuuggugauaguug

SEQ ID NO: 952459 - RNA, 20 nt, Human
ccagaagagaugaucaucca

SEQ ID NO: 952460 - RNA, 22 nt, Human
uucagcaagaccaccauguacc

SEQ ID NO: 952461 - RNA, 22 nt, Human
ucucagggccucccucuguuuc

SEQ ID NO: 952462 - RNA, 22 nt, Human
uuuauuugaaucaggggagaau

SEQ ID NO: 952463 - RNA, 20 nt, Human
uuguuucugcuauuuucuaa

SEQ ID NO: 952464 - RNA, 22 nt, Human
ucauuuguacuugugugcuugu

SEQ ID NO: 952465 - RNA, 22 nt, Human
gaagcagcgaaguggaagggac

SEQ ID NO: 952466 - RNA, 22 nt, Human
uaagaagcuucugcuaaugccu

SEQ ID NO: 952467 - RNA, 22 nt, Human
caggguggcccuguggucucau

SEQ ID NO: 952468 - RNA, 22 nt, Human
acgcuuuuacuauuuugagcuc

SEQ ID NO: 952469 - RNA, 22 nt, Human
aauuugcaugaugagaacaaua

SEQ ID NO: 952470 - RNA, 22 nt, Human
gugcuucucuucacacccaacu

SEQ ID NO: 952471 - RNA, 22 nt, Human
auugaaaguccuaucuaaggga

SEQ ID NO: 952472 - RNA, 22 nt, Human
agcccagguugaggcugcagug

SEQ ID NO: 952473 - RNA, 22 nt, Human
ugcacccucaucagucaaaugg

SEQ ID NO: 952474 - RNA, 21 nt, Human
ccuguucacagaucuguaacu

SEQ ID NO: 952475 - RNA, 22 nt, Human
agcagccacagcagaucugagu

SEQ ID NO: 952476 - RNA, 22 nt, Human
ugcacacaaguuggagaaugaa

SEQ ID NO: 952477 - RNA, 22 nt, Human
gagcccugauuugcagcauuug

SEQ ID NO: 952478 - RNA, 22 nt, Human
gucuagagugcuuccuagucau

SEQ ID NO: 952479 - RNA, 22 nt, Human
ccuccugggccuugcucuguga

SEQ ID NO: 952480 - RNA, 22 nt, Human
uuacauuagacccacuuucaug

SEQ ID NO: 952481 - RNA, 22 nt, Human
gggcacugcuggaggcucccug

SEQ ID NO: 952482 - RNA, 21 nt, Human
ucuuuccugcccaguugcccu

SEQ ID NO: 952483 - RNA, 22 nt, Human
gaaaaguauguuuauuuugacu

SEQ ID NO: 952484 - RNA, 22 nt, Human
aacaugaagguaggaugguuuu

SEQ ID NO: 952485 - RNA, 22 nt, Human
uggccuggaaccuggcagggac

SEQ ID NO: 952486 - RNA, 15 nt, Human
uucaggauaugacuc

SEQ ID NO: 952487 - RNA, 22 nt, Human
uuuuaaucaugcuucuaugucc

SEQ ID NO: 952488 - RNA, 22 nt, Human
uucagaaagugaaucuuguuau

SEQ ID NO: 952489 - RNA, 22 nt, Human
ccagaggugccacagaaagagc

SEQ ID NO: 952490 - RNA, 17 nt, Human
uugggagagaaagguau

SEQ ID NO: 952491 - RNA, 22 nt, Human
uucuucucggcugucagauagu

SEQ ID NO: 952492 - RNA, 22 nt, Human
acaggcugcugggcuccgugcu

SEQ ID NO: 952493 - RNA, 22 nt, Human
cccuuucccuucuggcucaggg

SEQ ID NO: 952494 - RNA, 22 nt, Human
ugcaguggaagagguggagauc

SEQ ID NO: 952495 - RNA, 22 nt, Human
acccucccauuuccauguagca

SEQ ID NO: 952496 - RNA, 22 nt, Human
augcacagacccaaaggccauc

SEQ ID NO: 952497 - RNA, 22 nt, Human
cauucucaauaguagaugagua

SEQ ID NO: 952498 - RNA, 22 nt, Human
cacugcauggaugauggcugua

SEQ ID NO: 952499 - RNA, 22 nt, Human
cagagcaguccuugucaaucag

SEQ ID NO: 952500 - RNA, 23 nt, Human
cauccaggagcugagucugacug

SEQ ID NO: 952501 - RNA, 22 nt, Human
agagucuuuugucaguaauguu

SEQ ID NO: 952502 - RNA, 22 nt, Human
ucagaggucacacagcaaguuu

SEQ ID NO: 952503 - RNA, 22 nt, Human
cccuggaggucagaggccuggg

SEQ ID NO: 952504 - RNA, 22 nt, Human
agugacugggcagggcagggcc

SEQ ID NO: 952505 - RNA, 22 nt, Human
aaaauuauggaguaucccaaag

SEQ ID NO: 952506 - RNA, 22 nt, Human
uuggcauaccuuagugguggag

SEQ ID NO: 952507 - RNA, 23 nt, Human
ugauuaggucuacucuuggcucc

SEQ ID NO: 952508 - RNA, 22 nt, Human
ccagggugagaaaaggcuggau

SEQ ID NO: 952509 - RNA, 22 nt, Human
uccauuuucuaaguaucacuua

SEQ ID NO: 952510 - RNA, 22 nt, Human
agcugagcuaguaguuccagug

SEQ ID NO: 952511 - RNA, 22 nt, Human
cagucuuauccugaaaacaaca

SEQ ID NO: 952512 - RNA, 22 nt, Human
ccagucacuggaaaaugggaau

SEQ ID NO: 952513 - RNA, 22 nt, Human
gcacccaggccggcgacugcag

SEQ ID NO: 952514 - RNA, 22 nt, Human
aggggcugacuggaaagugcca

SEQ ID NO: 952515 - RNA, 22 nt, Human
agcuuuauucaugauuucaggg

SEQ ID NO: 952516 - RNA, 22 nt, Human
ucccaaagcuacucuucugacu

SEQ ID NO: 952517 - RNA, 22 nt, Human
uuucuucucacccaggacagag

SEQ ID NO: 952518 - RNA, 21 nt, Human
ggagucagggucuggcugggg

SEQ ID NO: 952519 - RNA, 22 nt, Human
ggaggugggagacauaggcggc

SEQ ID NO: 952520 - RNA, 22 nt, Human
uuaaauuccagccucauaauag

SEQ ID NO: 952521 - RNA, 22 nt, Human
ccuccuggauggauuuggugga

SEQ ID NO: 952522 - RNA, 22 nt, Human
ugagccugcugucgcuggaccc

SEQ ID NO: 952523 - RNA, 22 nt, Human
ugugugccugagccgugccugg

SEQ ID NO: 952524 - RNA, 22 nt, Human
uaaauacagucauuugagccau

SEQ ID NO: 952525 - RNA, 22 nt, Human
gggcugcuuuuuucuuagcaga

SEQ ID NO: 952526 - RNA, 22 nt, Human
cagagacagaaaauggaucuag

SEQ ID NO: 952527 - RNA, 22 nt, Human
cagaggcauacucccagucuug

SEQ ID NO: 952528 - RNA, 22 nt, Human
gcaggggcugcugggaacucgg

SEQ ID NO: 952529 - RNA, 22 nt, Human
cauuaaguauuucaguuacugu

SEQ ID NO: 952530 - RNA, 22 nt, Human
ggggauggauuccgggucccug

SEQ ID NO: 952531 - RNA, 22 nt, Human
gagggagggacuagcauucucu

SEQ ID NO: 952532 - RNA, 22 nt, Human
ugcaccauuuugucaggcuacu

SEQ ID NO: 952533 - RNA, 22 nt, Human
uguuuauaccuugguauaacca

SEQ ID NO: 952534 - RNA, 22 nt, Human
uuauuauuuuguguacagcaaa

SEQ ID NO: 952535 - RNA, 19 nt, Human
gcacacccugcaccaccau

SEQ ID NO: 952536 - RNA, 22 nt, Human
agagaaaacucauugagguguc

SEQ ID NO: 952537 - RNA, 22 nt, Human
aguuacaaccaugacacaagca

SEQ ID NO: 952538 - RNA, 22 nt, Human
uugcucugacuggagugcagug

SEQ ID NO: 952539 - RNA, 22 nt, Human
uggcucugccacuaacuuggua

SEQ ID NO: 952540 - RNA, 22 nt, Human
guucacaagcuggguuucugca

SEQ ID NO: 952541 - RNA, 22 nt, Human
agcaccugucacaagcagaagg

SEQ ID NO: 952542 - RNA, 22 nt, Human
aggcagaauguuggaaaggaag

SEQ ID NO: 952543 - RNA, 22 nt, Human
gcuggccugcgagggcaggcug

SEQ ID NO: 952544 - RNA, 22 nt, Human
ccuggagagagaggccaacugc

SEQ ID NO: 952545 - RNA, 22 nt, Human
gagaggggcgcgcagcucgcga

SEQ ID NO: 952546 - RNA, 22 nt, Human
cugaggccucucuccugggcuu

SEQ ID NO: 952547 - RNA, 22 nt, Human
cguggccuuugagugagcuccc

SEQ ID NO: 952548 - RNA, 22 nt, Human
uaaauaugcauguauccuuauc

SEQ ID NO: 952549 - RNA, 21 nt, Human
uggcugccuacaugcugcagg

SEQ ID NO: 952550 - RNA, 22 nt, Human
ugcuagaaaucugaaacuagca

SEQ ID NO: 952551 - RNA, 22 nt, Human
ggucugaaaauggugaccacca

SEQ ID NO: 952552 - RNA, 22 nt, Human
agggccagcugaugagaaugag

SEQ ID NO: 952553 - RNA, 20 nt, Human
ccuccaggcacacccaugug

SEQ ID NO: 952554 - RNA, 22 nt, Human
acagcagccugcagcccugugu

SEQ ID NO: 952555 - RNA, 22 nt, Human
ggucucagaucuuuauuaaggc

SEQ ID NO: 952556 - RNA, 22 nt, Human
cagggcacaguuauggaggugg

SEQ ID NO: 952557 - RNA, 22 nt, Human
uagaaauguuagauguauugag

SEQ ID NO: 952558 - RNA, 22 nt, Human
acauccugaagucagucauuug

SEQ ID NO: 952559 - RNA, 22 nt, Human
acucugcucccuaagccaugau

SEQ ID NO: 952560 - RNA, 22 nt, Human
aggcagccagauggcagccugc

SEQ ID NO: 952561 - RNA, 17 nt, Human
ggagagugggaauggcc

SEQ ID NO: 952562 - RNA, 22 nt, Human
aagcacagaaaaggagcaugga

SEQ ID NO: 952563 - RNA, 22 nt, Human
ugaaauguuugaagaccacuga

SEQ ID NO: 952564 - RNA, 22 nt, Human
cagggagcacugcgagcggcag

SEQ ID NO: 952565 - RNA, 22 nt, Human
gaggccuuagagcuuuucuaga

SEQ ID NO: 952566 - RNA, 21 nt, Human
gacaaagugaagcaggcagga

SEQ ID NO: 952567 - RNA, 21 nt, Human
ucuggagcccuaagcugagaa

SEQ ID NO: 952568 - RNA, 22 nt, Human
uugcauugaugucuauacgcug

SEQ ID NO: 952569 - RNA, 22 nt, Human
ucaucuucuauuaauagggaga

SEQ ID NO: 952570 - RNA, 22 nt, Human
uacauuaacuuacguccacaug

SEQ ID NO: 952571 - RNA, 21 nt, Human
uggagacucugguucuuugug

SEQ ID NO: 952572 - RNA, 22 nt, Human
gagauguacaauguguauuaau

SEQ ID NO: 952573 - RNA, 22 nt, Human
guaacauaguuugugcuucauc

SEQ ID NO: 952574 - RNA, 22 nt, Human
caugccaguuuugagaugcacc

SEQ ID NO: 952575 - RNA, 22 nt, Human
gagccuggauagccuuguucca

SEQ ID NO: 952576 - RNA, 22 nt, Human
gggcagcaucaggaggggcuuu

SEQ ID NO: 952577 - RNA, 22 nt, Human
uggcagcaaaaccagaaucaga

SEQ ID NO: 952578 - RNA, 22 nt, Human
uuaucacuuaugagcuuuuugc

SEQ ID NO: 952579 - RNA, 22 nt, Human
agggacacacuccaguguuauu

SEQ ID NO: 952580 - RNA, 22 nt, Human
gaggcagcugggcuggugguuu

SEQ ID NO: 952581 - RNA, 22 nt, Human
ucagagcuaaggggagagcaaa

SEQ ID NO: 952582 - RNA, 22 nt, Human
uccuauugguagacauuucugu

SEQ ID NO: 952583 - RNA, 22 nt, Human
cuucccagaccuuagagugcag

SEQ ID NO: 952584 - RNA, 17 nt, Human
ucagcaaagacaaagga

SEQ ID NO: 952585 - RNA, 22 nt, Human
cuggagccuagguugaccuggg

SEQ ID NO: 952586 - RNA, 22 nt, Human
aaguaaaauguuuccuuuauua

SEQ ID NO: 952587 - RNA, 22 nt, Human
uggagagguugaauaacuuguc

SEQ ID NO: 952588 - RNA, 22 nt, Human
aaauaaguaguuuaguguugug

SEQ ID NO: 952589 - RNA, 22 nt, Human
ggcugugccucaaggcuacuca

SEQ ID NO: 952590 - RNA, 22 nt, Human
uguaacaguaagccugugagcu

SEQ ID NO: 952591 - RNA, 22 nt, Human
gccuaauaugcaaaauugauac

SEQ ID NO: 952592 - RNA, 22 nt, Human
uuccuuguuuguagcucuggga

SEQ ID NO: 952593 - RNA, 22 nt, Human
ucaacugcaaguuugcuuaguu

SEQ ID NO: 952594 - RNA, 22 nt, Human
cugggcuccuaaccauccaggu

SEQ ID NO: 952595 - RNA, 22 nt, Human
aggcuuccuggaggaagaggua

SEQ ID NO: 952596 - RNA, 22 nt, Human
uucauucuuauuugugaucugg

SEQ ID NO: 952597 - RNA, 22 nt, Human
cagcauggacccaucgcugagu

SEQ ID NO: 952598 - RNA, 23 nt, Human
cuuugccacccagagccugacag

SEQ ID NO: 952599 - RNA, 22 nt, Human
cagcucugaagaaaggugucua

SEQ ID NO: 952600 - RNA, 22 nt, Human
ugcugugagguugagaaggaag

SEQ ID NO: 952601 - RNA, 22 nt, Human
cuuaacagcaagaucuguguca

SEQ ID NO: 952602 - RNA, 22 nt, Human
agaacagcaguuaugguucauu

SEQ ID NO: 952603 - RNA, 22 nt, Human
ucuggagauaagacagacagau

SEQ ID NO: 952604 - RNA, 22 nt, Human
uuuuggcacugcgucuacaugg

SEQ ID NO: 952605 - RNA, 22 nt, Human
cacaggaggaggccagagcgua

SEQ ID NO: 952606 - RNA, 22 nt, Human
aggcagagaaaaaccagauaug

SEQ ID NO: 952607 - RNA, 22 nt, Human
aauaaauguuaagauugucuca

SEQ ID NO: 952608 - RNA, 22 nt, Human
uuuuggucagguuggucucgaa

SEQ ID NO: 952609 - RNA, 22 nt, Human
ucuucagugcauguuaccuaua

SEQ ID NO: 952610 - RNA, 22 nt, Human
cuggcuucugggccagggcaga

SEQ ID NO: 952611 - RNA, 22 nt, Human
uugggcugaaguagagggcaga

SEQ ID NO: 952612 - RNA, 22 nt, Human
auuaauaugagaaaguggcaga

SEQ ID NO: 952613 - RNA, 22 nt, Human
agccuccacagaugcaaagggc

SEQ ID NO: 952614 - RNA, 22 nt, Human
ccacagggccuuuccugcuggc

SEQ ID NO: 952615 - RNA, 22 nt, Human
ucuacuguagugaugcugcagu

SEQ ID NO: 952616 - RNA, 22 nt, Human
uuugaacaagagcuucacauua

SEQ ID NO: 952617 - RNA, 22 nt, Human
ggggggugcugaucaguggagc

SEQ ID NO: 952618 - RNA, 22 nt, Human
uccuucaggccucauucucaua

SEQ ID NO: 952619 - RNA, 22 nt, Human
augcacuacuuggcuuuacuga

SEQ ID NO: 952620 - RNA, 22 nt, Human
uggcagcugucagaaugcaaau

SEQ ID NO: 952621 - RNA, 22 nt, Human
ggcagccagagggcagcuggau

SEQ ID NO: 952622 - RNA, 22 nt, Human
caggccucuauggucagcugag

SEQ ID NO: 952623 - RNA, 22 nt, Human
auggauaagucaaagaguaucc

SEQ ID NO: 952624 - RNA, 22 nt, Human
gcucucugccuuucucaaugac

SEQ ID NO: 952625 - RNA, 22 nt, Human
gaaauaagaguccaugccaggu

SEQ ID NO: 952626 - RNA, 22 nt, Human
gcuggccugaccugaggcuggg

SEQ ID NO: 952627 - RNA, 22 nt, Human
gguuggggcgagcuggaggccc

SEQ ID NO: 952628 - RNA, 20 nt, Human
cagcaggcuauggggcaccc

SEQ ID NO: 952629 - RNA, 22 nt, Human
cacauauuguaguucaccagga

SEQ ID NO: 952630 - RNA, 22 nt, Human
aggcucugcagugcuggaggac

SEQ ID NO: 952631 - RNA, 23 nt, Human
gaagcagaugucugaguaggcag

SEQ ID NO: 952632 - RNA, 22 nt, Human
gccuuggccaacaccuugcaaa

SEQ ID NO: 952633 - RNA, 22 nt, Human
gagccagcugagcugcacuguc

SEQ ID NO: 952634 - RNA, 22 nt, Human
ugauuuccaaaaggcuucuaag

SEQ ID NO: 952635 - RNA, 22 nt, Human
agcagcugaccagugaguccug

SEQ ID NO: 952636 - RNA, 22 nt, Human
gggcucuggaaggugcaccaug

SEQ ID NO: 952637 - RNA, 22 nt, Human
uuggaaggagucaaccagcuga

SEQ ID NO: 952638 - RNA, 22 nt, Human
uagggcuauucugaguaauaau

SEQ ID NO: 952639 - RNA, 22 nt, Human
gcucuauguugaccuucagugg

SEQ ID NO: 952640 - RNA, 22 nt, Human
uaaguucaguuggucgaaguag

SEQ ID NO: 952641 - RNA, 22 nt, Human
agccauuggcugccuggugcgu

SEQ ID NO: 952642 - RNA, 20 nt, Human
agagccuggaaaaagacauc

SEQ ID NO: 952643 - RNA, 22 nt, Human
gcagacagccagacugcacugg

SEQ ID NO: 952644 - RNA, 22 nt, Human
gccugaagaacagcugugagga

SEQ ID NO: 952645 - RNA, 19 nt, Human
augagcuggcauuucaggu

SEQ ID NO: 952646 - RNA, 21 nt, Human
gugugucuaauguaguggaaa

SEQ ID NO: 952647 - RNA, 22 nt, Human
augugucuucuaagccaagccu

SEQ ID NO: 952648 - RNA, 22 nt, Human
ccucagggaggccucuguggcu

SEQ ID NO: 952649 - RNA, 20 nt, Human
cccucugcacauggcugugg

SEQ ID NO: 952650 - RNA, 22 nt, Human
ugaaaauuguuguacuugauaa

SEQ ID NO: 952651 - RNA, 22 nt, Human
cuccagggagcugcgggagcca

SEQ ID NO: 952652 - RNA, 22 nt, Human
cauugaaaaacguugacugagu

SEQ ID NO: 952653 - RNA, 22 nt, Human
aaucuggcucagaagaagauga

SEQ ID NO: 952654 - RNA, 22 nt, Human
agguacagggugaaaguuuaug

SEQ ID NO: 952655 - RNA, 22 nt, Human
uuucauuauacagcuucauaaa

SEQ ID NO: 952656 - RNA, 22 nt, Human
gcagccaccucccauggcgggg

SEQ ID NO: 952657 - RNA, 22 nt, Human
augugucucuaccaaugcaauu

SEQ ID NO: 952658 - RNA, 22 nt, Human
gcagugugaccgagcuugcuuc

SEQ ID NO: 952659 - RNA, 23 nt, Human
cccaggaguuucacugcaaaggu

SEQ ID NO: 952660 - RNA, 22 nt, Human
gcccaggaucugcucagaucau

SEQ ID NO: 952661 - RNA, 22 nt, Human
uggcagcacuugaacuugagcc

SEQ ID NO: 952662 - RNA, 22 nt, Human
guggcccaggcuuggcgcuggc

SEQ ID NO: 952663 - RNA, 22 nt, Human
ccucagagaaagguauggcuga

SEQ ID NO: 952664 - RNA, 22 nt, Human
uucuuuucuuuaggcauugugu

SEQ ID NO: 952665 - RNA, 22 nt, Human
agcuucuguucaucuuccaggc

SEQ ID NO: 952666 - RNA, 22 nt, Human
guguguuuagcauuagcagggg

SEQ ID NO: 952667 - RNA, 22 nt, Human
ugcagagguuuccaggcaaguu

SEQ ID NO: 952668 - RNA, 22 nt, Human
cagaauaugacaagauuuuccu

SEQ ID NO: 952669 - RNA, 22 nt, Human
caguagcauguaauaaagacag

SEQ ID NO: 952670 - RNA, 22 nt, Human
uauuagguaaaggacuugcagg

SEQ ID NO: 952671 - RNA, 20 nt, Human
ugcagcugcaggaggguggg

SEQ ID NO: 952672 - RNA, 22 nt, Human
ugcccacaggaagacaccagcg

SEQ ID NO: 952673 - RNA, 22 nt, Human
cucuggaauguuuacaugcccu

SEQ ID NO: 952674 - RNA, 22 nt, Human
gucagcugucuccccagagugg

SEQ ID NO: 952675 - RNA, 22 nt, Human
cagcagcugggaaggaggcuga

SEQ ID NO: 952676 - RNA, 22 nt, Human
cacugggcguguccugggugag

SEQ ID NO: 952677 - RNA, 22 nt, Human
auuugcauaauagugauuugua

SEQ ID NO: 952678 - RNA, 21 nt, Human
ugucagaaauaagcaugugau

SEQ ID NO: 952679 - RNA, 22 nt, Human
gccgaagcugccgucugguccu

SEQ ID NO: 952680 - RNA, 22 nt, Human
ugagaaagugggugccuagcaa

SEQ ID NO: 952681 - RNA, 22 nt, Human
cuucucucccuggcacucagac

SEQ ID NO: 952682 - RNA, 22 nt, Human
ggucccugaagaggccuggggu

SEQ ID NO: 952683 - RNA, 22 nt, Human
ccuguuuacaucaucaaggacu

SEQ ID NO: 952684 - RNA, 22 nt, Human
aagcugaggcccauggcaaggu

SEQ ID NO: 952685 - RNA, 22 nt, Human
gagccuggggacccuccugagu

SEQ ID NO: 952686 - RNA, 22 nt, Human
caguacuuguccucagguguua

SEQ ID NO: 952687 - RNA, 22 nt, Human
ugucccaggcugaaguacagug

SEQ ID NO: 952688 - RNA, 22 nt, Human
aacaaauggaacacaaaucuuu

SEQ ID NO: 952689 - RNA, 22 nt, Human
agccugagccccauccagcuga

SEQ ID NO: 952690 - RNA, 22 nt, Human
acgcagaagggccuggcgugcc

SEQ ID NO: 952691 - RNA, 23 nt, Human
ucagcugcuuccuccugccugcc

SEQ ID NO: 952692 - RNA, 21 nt, Human
ucugggcccaugcugccucac

SEQ ID NO: 952693 - RNA, 22 nt, Human
aaaugcacaggagaaccaauuc

SEQ ID NO: 952694 - RNA, 22 nt, Human
uggcagcuuuuuguuucaggcu

SEQ ID NO: 952695 - RNA, 22 nt, Human
caguccaggccuggaggagcca

SEQ ID NO: 952696 - RNA, 22 nt, Human
uccuggccaaguuacucucugc

SEQ ID NO: 952697 - RNA, 18 nt, Human
aggcuucccaggcaggcc

SEQ ID NO: 952698 - RNA, 22 nt, Human
agcucccauuaucuucugaaac

SEQ ID NO: 952699 - RNA, 22 nt, Human
cagucacacaaguggacuuggg

SEQ ID NO: 952700 - RNA, 22 nt, Human
uacuuccagcaaucugcauauu

SEQ ID NO: 952701 - RNA, 22 nt, Human
cuuucacacacauacauuugga

SEQ ID NO: 952702 - RNA, 22 nt, Human
aaaugcacagaaaggaugugga

SEQ ID NO: 952703 - RNA, 22 nt, Human
aacuccuguucuaugacaagag

SEQ ID NO: 952704 - RNA, 19 nt, Human
cugaagucuuuucagcugg

SEQ ID NO: 952705 - RNA, 22 nt, Human
cugcucacgccaccguucauca

SEQ ID NO: 952706 - RNA, 22 nt, Human
aggaaaaaccuguuaaugguag

SEQ ID NO: 952707 - RNA, 22 nt, Human
ugcuccauucucuagccagugc

SEQ ID NO: 952708 - RNA, 22 nt, Human
uaaaugcaagugcuccugggag

SEQ ID NO: 952709 - RNA, 21 nt, Human
uggcucaguugcugggcacag

SEQ ID NO: 952710 - RNA, 19 nt, Human
cugugcuuuaaacuccuau

SEQ ID NO: 952711 - RNA, 22 nt, Human
aaaugugucaguuucauucucu

SEQ ID NO: 952712 - RNA, 22 nt, Human
ccugcccagcuucaccucaggc

SEQ ID NO: 952713 - RNA, 22 nt, Human
ucuucucccaucuccaggcagg

SEQ ID NO: 952714 - RNA, 23 nt, Human
ggcugagacuacaggcgcuugcc

SEQ ID NO: 952715 - RNA, 22 nt, Human
aggcaggcugcuauggaguaga

SEQ ID NO: 952716 - RNA, 22 nt, Human
agugucugccagcugccaggug

SEQ ID NO: 952717 - RNA, 19 nt, Human
ggcuggcaagugacagugu

SEQ ID NO: 952718 - RNA, 18 nt, Human
ucauuuguuuugcaugaa

SEQ ID NO: 952719 - RNA, 22 nt, Human
aauaauaagauacuaagggagu

SEQ ID NO: 952720 - RNA, 22 nt, Human
cacagaaguuucauagucucga

SEQ ID NO: 952721 - RNA, 22 nt, Human
cuucugaggcagcuauucaguu

SEQ ID NO: 952722 - RNA, 22 nt, Human
agacaugucaccaauucuuacu

SEQ ID NO: 952723 - RNA, 22 nt, Human
ucacauacacuaggauauuuuu

SEQ ID NO: 952724 - RNA, 22 nt, Human
cagggcagccaggccccguggg

SEQ ID NO: 952725 - RNA, 22 nt, Human
ucacacagauugguagagcuga

SEQ ID NO: 952726 - RNA, 22 nt, Human
ggguguguuccuaaggaaacca

SEQ ID NO: 952727 - RNA, 22 nt, Human
caguggaggccuugggaccuuu

SEQ ID NO: 952728 - RNA, 22 nt, Human
ggggauggaggcgugugguccu

SEQ ID NO: 952729 - RNA, 22 nt, Human
ugugaggagaggcccagcuccc

SEQ ID NO: 952730 - RNA, 22 nt, Human
caauaaguaauaggcaucuaau

SEQ ID NO: 952731 - RNA, 22 nt, Human
gacacuaaaguauaggguaucu

SEQ ID NO: 952732 - RNA, 22 nt, Human
aaacaccaagagcuagcuauua

SEQ ID NO: 952733 - RNA, 22 nt, Human
gaacaguaaauuuaugcagcac

SEQ ID NO: 952734 - RNA, 22 nt, Human
acagagguguuccagaccuagg

SEQ ID NO: 952735 - RNA, 20 nt, Human
uagaaaucuuauaaaagacu

SEQ ID NO: 952736 - RNA, 22 nt, Human
gugccuggcaugcgccggugcu

SEQ ID NO: 952737 - RNA, 18 nt, Human
ccuggcuuccaucuuggu

SEQ ID NO: 952738 - RNA, 22 nt, Human
aaaaguauuggccaccauuucu

SEQ ID NO: 952739 - RNA, 22 nt, Human
ugucaugcccaggagcaaggua

SEQ ID NO: 952740 - RNA, 23 nt, Human
auuguuuuuggcucucagggaau

SEQ ID NO: 952741 - RNA, 17 nt, Human
gucugggcuuuagagac

SEQ ID NO: 952742 - RNA, 22 nt, Human
ccagcucugcagggccuggggu

SEQ ID NO: 952743 - RNA, 22 nt, Human
gaggcaggguguugauuacaga

SEQ ID NO: 952744 - RNA, 22 nt, Human
uauuuguauguguguacauaua

SEQ ID NO: 952745 - RNA, 22 nt, Human
uauuucaacguaugaaaagcug

SEQ ID NO: 952746 - RNA, 22 nt, Human
augugcaugcacuuacaugugu

SEQ ID NO: 952747 - RNA, 22 nt, Human
gagcccuguagcaagucauguc

SEQ ID NO: 952748 - RNA, 22 nt, Human
uaaagacaugguguaggugaac

SEQ ID NO: 952749 - RNA, 22 nt, Human
gagacugauggggcucccagaa

SEQ ID NO: 952750 - RNA, 22 nt, Human
uggcugaacuaaugugcuguuu

SEQ ID NO: 952751 - RNA, 22 nt, Human
guggcaggagagacacagccau

SEQ ID NO: 952752 - RNA, 22 nt, Human
agcauuuauuucuuagaaauug

SEQ ID NO: 952753 - RNA, 22 nt, Human
ucuuagcacagcuauauaaguu

SEQ ID NO: 952754 - RNA, 19 nt, Human
uuugaauccagcugguaac

SEQ ID NO: 952755 - RNA, 22 nt, Human
uacaguaagaugaaauagcaau

SEQ ID NO: 952756 - RNA, 22 nt, Human
ccugagcuggaagagcuugugc

SEQ ID NO: 952757 - RNA, 22 nt, Human
gaggcaccucgcgggaggaggc

SEQ ID NO: 952758 - RNA, 22 nt, Human
uaauuuauuucaacugccaagg

SEQ ID NO: 952759 - RNA, 22 nt, Human
accaggggugucaacagcauuu

SEQ ID NO: 952760 - RNA, 22 nt, Human
cagcuggccccacaguagaggc

SEQ ID NO: 952761 - RNA, 22 nt, Human
uucacagaugccugaugugugg

SEQ ID NO: 952762 - RNA, 22 nt, Human
uaaggcauucucaugcugugaa

SEQ ID NO: 952763 - RNA, 22 nt, Human
gaggccacgguuuuccuugggg

SEQ ID NO: 952764 - RNA, 22 nt, Human
cugaggcucaagggcagguggg

SEQ ID NO: 952765 - RNA, 19 nt, Human
ccucugccagcccgccucu

SEQ ID NO: 952766 - RNA, 22 nt, Human
uuugaaagagcugauacaugaa

SEQ ID NO: 952767 - RNA, 22 nt, Human
cuguucauggaaaaauaguugg

SEQ ID NO: 952768 - RNA, 22 nt, Human
aaagcagauucugaugcaguag

SEQ ID NO: 952769 - RNA, 22 nt, Human
ccuccuggugggcgcuucuggc

SEQ ID NO: 952770 - RNA, 22 nt, Human
cuugaucuacauagugaaaccc

SEQ ID NO: 952771 - RNA, 22 nt, Human
agccaaagagaccccauaucca

SEQ ID NO: 952772 - RNA, 22 nt, Human
uggcacugggaugcuacuguua

SEQ ID NO: 952773 - RNA, 22 nt, Human
caagagagaugcagcucacuca

SEQ ID NO: 952774 - RNA, 22 nt, Human
gccuggcuccuaaggacuggcu

SEQ ID NO: 952775 - RNA, 22 nt, Human
gccuccccugcaauuguccuug

SEQ ID NO: 952776 - RNA, 22 nt, Human
gccuggcccagggcuccgcagg

SEQ ID NO: 952777 - RNA, 20 nt, Human
cuccagggaacagacuggag

SEQ ID NO: 952778 - RNA, 20 nt, Human
uuucagugguuugugccuag

SEQ ID NO: 952779 - RNA, 22 nt, Human
cagcagagguuggaacaguucu

SEQ ID NO: 952780 - RNA, 22 nt, Human
gcuggagccuucugcucuguug

SEQ ID NO: 952781 - RNA, 22 nt, Human
acagguggccccgagggagugg

SEQ ID NO: 952782 - RNA, 22 nt, Human
acagcauucaauaaauaauaac

SEQ ID NO: 952783 - RNA, 22 nt, Human
aaauguuagguuguacugaguc

SEQ ID NO: 952784 - RNA, 22 nt, Human
agacauuuauugaacaccuagc

SEQ ID NO: 952785 - RNA, 22 nt, Human
uucuucaguguagcaacuguau

SEQ ID NO: 952786 - RNA, 22 nt, Human
cccaggaguucgaggcuguagu

SEQ ID NO: 952787 - RNA, 23 nt, Human
cagaaaguuugagaagauacauc

SEQ ID NO: 952788 - RNA, 21 nt, Human
aggugcagagccagggaccag

SEQ ID NO: 952789 - RNA, 22 nt, Human
uugauaaaaugaugaaaucacu

SEQ ID NO: 952790 - RNA, 22 nt, Human
aucugccugcaguggagguggg

SEQ ID NO: 952791 - RNA, 22 nt, Human
cuuccugguuugaagcucgccg

SEQ ID NO: 952792 - RNA, 17 nt, Human
uuugaaaggaugucagu

SEQ ID NO: 952793 - RNA, 22 nt, Human
cucuggagguugagcccagcaa

SEQ ID NO: 952794 - RNA, 22 nt, Human
agagcagcugugacauggacag

SEQ ID NO: 952795 - RNA, 22 nt, Human
agcagaaccugcagaccugucu

SEQ ID NO: 952796 - RNA, 22 nt, Human
guuauaaaugacugcaaaaguu

SEQ ID NO: 952797 - RNA, 22 nt, Human
agcugccauccuguucagcacc

SEQ ID NO: 952798 - RNA, 20 nt, Human
cccugagaccagagagcagc

SEQ ID NO: 952799 - RNA, 22 nt, Human
ccagggcugcugugggacucca

SEQ ID NO: 952800 - RNA, 22 nt, Human
gcuccagaugaaaggccagagg

SEQ ID NO: 952801 - RNA, 22 nt, Human
ugcuggccaacaaggcuccaag

SEQ ID NO: 952802 - RNA, 22 nt, Human
cauuuucucaaugaacccucuu

SEQ ID NO: 952803 - RNA, 22 nt, Human
gaggggcagagguagagaacaa

SEQ ID NO: 952804 - RNA, 22 nt, Human
uaggauaggauggagacagaau

SEQ ID NO: 952805 - RNA, 22 nt, Human
ucugggagcacacgcagugauc

SEQ ID NO: 952806 - RNA, 22 nt, Human
uucaaaacagcuagauauugga

SEQ ID NO: 952807 - RNA, 22 nt, Human
cauugcacgggcgucugucugu

SEQ ID NO: 952808 - RNA, 22 nt, Human
uuuaaaaucagaugggaguugg

SEQ ID NO: 952809 - RNA, 22 nt, Human
agaggugacauaggagaggcuc

SEQ ID NO: 952810 - RNA, 22 nt, Human
ugucucagauacgccaucaagg

SEQ ID NO: 952811 - RNA, 22 nt, Human
ucucuggagcugcagauccagg

SEQ ID NO: 952812 - RNA, 22 nt, Human
gaagucuucauucucucugaga

SEQ ID NO: 952813 - RNA, 22 nt, Human
ggauguugauugaauggccauu

SEQ ID NO: 952814 - RNA, 22 nt, Human
uggcagcugauuagauggugcc

SEQ ID NO: 952815 - RNA, 22 nt, Human
gagccagguuugaaucucaguc

SEQ ID NO: 952816 - RNA, 22 nt, Human
ugugcagcuaguccuggacuug

SEQ ID NO: 952817 - RNA, 22 nt, Human
agaagucauuuauguuagauga

SEQ ID NO: 952818 - RNA, 22 nt, Human
ucuucaaguuccaaagugcagg

SEQ ID NO: 952819 - RNA, 22 nt, Human
cuggcuggucaucagcaguacg

SEQ ID NO: 952820 - RNA, 22 nt, Human
auagcuguuagauuggggucga

SEQ ID NO: 952821 - RNA, 22 nt, Human
uauguuauuuucauacaacaga

SEQ ID NO: 952822 - RNA, 22 nt, Human
uuggaaggcccugccuagcagg

SEQ ID NO: 952823 - RNA, 22 nt, Human
cagauggcugccaagaugggcu

SEQ ID NO: 952824 - RNA, 22 nt, Human
guggcagcggcccaggccgucu

SEQ ID NO: 952825 - RNA, 22 nt, Human
uuagaaacccagacucuuaggu

SEQ ID NO: 952826 - RNA, 22 nt, Human
aaagauuaaaucaaauugguca

SEQ ID NO: 952827 - RNA, 23 nt, Human
ggaguuggauuguacuugcugcu

SEQ ID NO: 952828 - RNA, 22 nt, Human
gacagcauggugucuguucagg

SEQ ID NO: 952829 - RNA, 21 nt, Human
uucaauacuauuucaauaguc

SEQ ID NO: 952830 - RNA, 22 nt, Human
cuccagggcagcauggcagugg

SEQ ID NO: 952831 - RNA, 23 nt, Human
agacaguggccgagagguacuag

SEQ ID NO: 952832 - RNA, 19 nt, Human
uagaggagaagggaagugg

SEQ ID NO: 952833 - RNA, 20 nt, Human
gugcuucagaagccauugcu

SEQ ID NO: 952834 - RNA, 22 nt, Human
uuucauguuuauggaaaaugag

SEQ ID NO: 952835 - RNA, 23 nt, Human
ggccuggcccagggcccugauga

SEQ ID NO: 952836 - RNA, 22 nt, Human
cccaaggccucuccuuggcuug

SEQ ID NO: 952837 - RNA, 22 nt, Human
aguaaaaucaccaucucuuugu

SEQ ID NO: 952838 - RNA, 22 nt, Human
uguggcugacuccuggucccca

SEQ ID NO: 952839 - RNA, 22 nt, Human
aaguuuguuguacauguuagua

SEQ ID NO: 952840 - RNA, 22 nt, Human
cuccugggcucaagugauccuc

SEQ ID NO: 952841 - RNA, 22 nt, Human
aaacaaguuuagaauaaugaau

SEQ ID NO: 952842 - RNA, 22 nt, Human
acaauguguuuuuauacauuug

SEQ ID NO: 952843 - RNA, 22 nt, Human
ccuggacucaggcugugggcac

SEQ ID NO: 952844 - RNA, 22 nt, Human
gcaaagucucaagacccaagug

SEQ ID NO: 952845 - RNA, 22 nt, Human
gggccuggggugacguaccccu

SEQ ID NO: 952846 - RNA, 22 nt, Human
uggcagcacaagguggcccaug

SEQ ID NO: 952847 - RNA, 22 nt, Human
caucaucaaaagugacagagaa

SEQ ID NO: 952848 - RNA, 22 nt, Human
guccagggaaauagcgacaggg

SEQ ID NO: 952849 - RNA, 21 nt, Human
uauacaugugugcauacgugu

SEQ ID NO: 952850 - RNA, 22 nt, Human
ccuccucugggaagauucagag

SEQ ID NO: 952851 - RNA, 22 nt, Human
gcuuuggaugugugccugaggu

SEQ ID NO: 952852 - RNA, 22 nt, Human
aggccuccuggcuccaggccuu

SEQ ID NO: 952853 - RNA, 22 nt, Human
cagcagcuuugccaagucagcc

SEQ ID NO: 952854 - RNA, 22 nt, Human
aaaauggucucagcuggcacca

SEQ ID NO: 952855 - RNA, 17 nt, Human
uagaauauggugggcug

SEQ ID NO: 952856 - RNA, 22 nt, Human
ugaggcagaaaauagcaguuca

SEQ ID NO: 952857 - RNA, 22 nt, Human
uugugguuaaccgcacauuuuu

SEQ ID NO: 952858 - RNA, 22 nt, Human
ccagagccuaagaucugauccu

SEQ ID NO: 952859 - RNA, 22 nt, Human
ggucccagguugacagggagac

SEQ ID NO: 952860 - RNA, 22 nt, Human
gcagcuuuuuggaugucaguua

SEQ ID NO: 952861 - RNA, 22 nt, Human
ggcugcuuuaucggcugcugaa

SEQ ID NO: 952862 - RNA, 22 nt, Human
gagcugccaagauuacaaucag

SEQ ID NO: 952863 - RNA, 22 nt, Human
ccagcuccagguagaugggcag

SEQ ID NO: 952864 - RNA, 22 nt, Human
acaggagacccugcugguucug

SEQ ID NO: 952865 - RNA, 22 nt, Human
gccuggcaggccucaugagggg

SEQ ID NO: 952866 - RNA, 22 nt, Human
gucacacuagggccaaguggag

SEQ ID NO: 952867 - RNA, 22 nt, Human
uuucuucaauugcuaacaagga

SEQ ID NO: 952868 - RNA, 22 nt, Human
aaagacugguguguuacauaua

SEQ ID NO: 952869 - RNA, 22 nt, Human
uugggcuggcagagguggucuu

SEQ ID NO: 952870 - RNA, 22 nt, Human
gugaaaucugaggcccaugaug

SEQ ID NO: 952871 - RNA, 22 nt, Human
uucuucaugcuguugcugcuug

SEQ ID NO: 952872 - RNA, 22 nt, Human
gggcagugguccaggcuacagc

SEQ ID NO: 952873 - RNA, 22 nt, Human
cggcuggguucggcugcaggcc

SEQ ID NO: 952874 - RNA, 22 nt, Human
auuacaguaacagcuacaaugc

SEQ ID NO: 952875 - RNA, 22 nt, Human
ccuugggacagccagcuucaga

SEQ ID NO: 952876 - RNA, 22 nt, Human
cuuauaguaugauguugagaau

SEQ ID NO: 952877 - RNA, 22 nt, Human
guguaauugaaauugagaacca

SEQ ID NO: 952878 - RNA, 22 nt, Human
uccagggaaggugugaggcugg

SEQ ID NO: 952879 - RNA, 22 nt, Human
gcagggccuuagcagcggcugc

SEQ ID NO: 952880 - RNA, 22 nt, Human
caaucuauaaauaucaguuucc

SEQ ID NO: 952881 - RNA, 22 nt, Human
agcuaccuggcuuaucacuguc

SEQ ID NO: 952882 - RNA, 18 nt, Human
guaggucaguaccaagca

SEQ ID NO: 952883 - RNA, 22 nt, Human
uauagaaguaagcauugugaug

SEQ ID NO: 952884 - RNA, 22 nt, Human
gugccagggggcacugaacaga

SEQ ID NO: 952885 - RNA, 22 nt, Human
uuugugaaaugaagucacaacu

SEQ ID NO: 952886 - RNA, 22 nt, Human
acauaaugaaaugcagaaauca

SEQ ID NO: 952887 - RNA, 22 nt, Human
cagcauggcuugaguguuuccu

SEQ ID NO: 952888 - RNA, 22 nt, Human
ccucucaucauuaucgcuuugu

SEQ ID NO: 952889 - RNA, 22 nt, Human
gggcaguggguggcugcagccu

SEQ ID NO: 952890 - RNA, 22 nt, Human
auuaggauuuuguccaaguagc

SEQ ID NO: 952891 - RNA, 22 nt, Human
accauccugaaaccuucaugcu

SEQ ID NO: 952892 - RNA, 22 nt, Human
agcugggucuugggccaggaga

SEQ ID NO: 952893 - RNA, 22 nt, Human
gccaggagagcuccuucagguu

SEQ ID NO: 952894 - RNA, 22 nt, Human
cuggguggcuguccagccagcc

SEQ ID NO: 952895 - RNA, 22 nt, Human
ggccuggagaaggcccagggag

SEQ ID NO: 952896 - RNA, 22 nt, Human
cuuauguaaaacggaaagggaa

SEQ ID NO: 952897 - RNA, 22 nt, Human
cauuuguaguuaaaaaugucuc

SEQ ID NO: 952898 - RNA, 22 nt, Human
uaauaauuggcuaacccuggga

SEQ ID NO: 952899 - RNA, 22 nt, Human
augcaaaagacuauuuguugcu

SEQ ID NO: 952900 - RNA, 22 nt, Human
aagaacuuccuaauauauuuuc

SEQ ID NO: 952901 - RNA, 22 nt, Human
cugggcugcaggaguggggcaa

SEQ ID NO: 952902 - RNA, 20 nt, Human
gggcagcuccccucauucug

SEQ ID NO: 952903 - RNA, 19 nt, Human
uggcuucuguuuucauguu

SEQ ID NO: 952904 - RNA, 22 nt, Human
gaugccugcauuucaggagagu

SEQ ID NO: 952905 - RNA, 22 nt, Human
ugcugggcuaggguggagcucu

SEQ ID NO: 952906 - RNA, 22 nt, Human
guuuuucuuugugugaagacaa

SEQ ID NO: 952907 - RNA, 22 nt, Human
ggugcuggacacguggcacucc

SEQ ID NO: 952908 - RNA, 22 nt, Human
ucaguguaaguuauguagaugu

SEQ ID NO: 952909 - RNA, 22 nt, Human
aggguccugggugcaguugcuu

SEQ ID NO: 952910 - RNA, 22 nt, Human
ccaaagucugcauuuuaacaug

SEQ ID NO: 952911 - RNA, 22 nt, Human
gucauggaggauugugaguggu

SEQ ID NO: 952912 - RNA, 22 nt, Human
uggaugcuguaggacacgcucu

SEQ ID NO: 952913 - RNA, 22 nt, Human
agcagcaugaugacagagucuc

SEQ ID NO: 952914 - RNA, 22 nt, Human
cagcaaaagccagcauaagcuc

SEQ ID NO: 952915 - RNA, 22 nt, Human
ucugucacccaggcuggagugc

SEQ ID NO: 952916 - RNA, 18 nt, Human
agaaggagcuaugggcag

SEQ ID NO: 952917 - RNA, 22 nt, Human
ucuucagugaauggcaagaucu

SEQ ID NO: 952918 - RNA, 21 nt, Human
gcacagugccaggcacacagu

SEQ ID NO: 952919 - RNA, 22 nt, Human
gccuggugcuaugagggccagc

SEQ ID NO: 952920 - RNA, 22 nt, Human
ggcuuggaccagucacaguggu

SEQ ID NO: 952921 - RNA, 22 nt, Human
uucagcagugcagacacccagu

SEQ ID NO: 952922 - RNA, 22 nt, Human
aaggcacuagcagaauuaguga

SEQ ID NO: 952923 - RNA, 22 nt, Human
agaguggggaagguguugagaa

SEQ ID NO: 952924 - RNA, 22 nt, Human
augugacaauauuuggucuuau

SEQ ID NO: 952925 - RNA, 18 nt, Human
acccaggcucaugguccu

SEQ ID NO: 952926 - RNA, 20 nt, Human
ccuggccaaugagauaggaa

SEQ ID NO: 952927 - RNA, 22 nt, Human
gugccuggcacacagaaggcaa

SEQ ID NO: 952928 - RNA, 17 nt, Human
aggcaggcagagcggga

SEQ ID NO: 952929 - RNA, 22 nt, Human
uaccaggcagcugcacagaggc

SEQ ID NO: 952930 - RNA, 22 nt, Human
aauguucaaacagaucacuuag

SEQ ID NO: 952931 - RNA, 22 nt, Human
uauuucuucgggauucaagcua

SEQ ID NO: 952932 - RNA, 23 nt, Human
ccugcagcugcuggggcuccacc

SEQ ID NO: 952933 - RNA, 22 nt, Human
aggcagcuggacauaacuaacc

SEQ ID NO: 952934 - RNA, 22 nt, Human
agggccugucagcgguguccug

SEQ ID NO: 952935 - RNA, 22 nt, Human
acacucuguaaugucacacucc

SEQ ID NO: 952936 - RNA, 22 nt, Human
uggcucagaaggcugccuucac

SEQ ID NO: 952937 - RNA, 22 nt, Human
uucuccucuguuggccuucccu

SEQ ID NO: 952938 - RNA, 20 nt, Human
ugcuuccuggccacugcggg

SEQ ID NO: 952939 - RNA, 22 nt, Human
ucaaaguuuuugagaauuacau

SEQ ID NO: 952940 - RNA, 22 nt, Human
auuucuguuugcuacuauaagu

SEQ ID NO: 952941 - RNA, 22 nt, Human
uucagaaguagcuaagcaguca

SEQ ID NO: 952942 - RNA, 22 nt, Human
agagacagaggcaauauagcuu

SEQ ID NO: 952943 - RNA, 22 nt, Human
cuugaaguugcaaaacauuaau

SEQ ID NO: 952944 - RNA, 22 nt, Human
gguggaaggccuggaaggaggc

SEQ ID NO: 952945 - RNA, 22 nt, Human
acaaaugugucuaauugugccu

SEQ ID NO: 952946 - RNA, 23 nt, Human
gcccaugcuguugggcccgagca

SEQ ID NO: 952947 - RNA, 22 nt, Human
gcaggggaguccacucuaugca

SEQ ID NO: 952948 - RNA, 22 nt, Human
gagggcugauaaaugcgcaugg

SEQ ID NO: 952949 - RNA, 22 nt, Human
aggcaguuuauccccagagccu

SEQ ID NO: 952950 - RNA, 21 nt, Human
guccaguggaggaggacagga

SEQ ID NO: 952951 - RNA, 22 nt, Human
ucugagccagccaccuccuuca

SEQ ID NO: 952952 - RNA, 22 nt, Human
ugacaugcuuguuuuccuugaa

SEQ ID NO: 952953 - RNA, 22 nt, Human
ccacagggauaggaauggggcu

SEQ ID NO: 952954 - RNA, 22 nt, Human
gccaggcuggccagcaccuucu

SEQ ID NO: 952955 - RNA, 22 nt, Human
ucaaugaugcugaagguagcgu

SEQ ID NO: 952956 - RNA, 22 nt, Human
gaagagcuguagccugcucuuu

SEQ ID NO: 952957 - RNA, 22 nt, Human
uggccucugugggagcugagca

SEQ ID NO: 952958 - RNA, 23 nt, Human
ucacaggggccagcgcucugugg

SEQ ID NO: 952959 - RNA, 22 nt, Human
cauuucuguucucuuccuguac

SEQ ID NO: 952960 - RNA, 19 nt, Human
gucacauuugucucccagg

SEQ ID NO: 952961 - RNA, 22 nt, Human
gcucugagucucagcuaccaca

SEQ ID NO: 952962 - RNA, 22 nt, Human
aggagaguaccauugggccgca

SEQ ID NO: 952963 - RNA, 22 nt, Human
ccuuuucuaaucuuaagaaugu

SEQ ID NO: 952964 - RNA, 22 nt, Human
uggcucagaagaaaagguaaac

SEQ ID NO: 952965 - RNA, 22 nt, Human
ugagaauuacaaaugagucaca

SEQ ID NO: 952966 - RNA, 22 nt, Human
ugcucccaggcucuguggucug

SEQ ID NO: 952967 - RNA, 22 nt, Human
cugcugugcuuguggccacccg

SEQ ID NO: 952968 - RNA, 22 nt, Human
gccagccugugcuuggccaggc

SEQ ID NO: 952969 - RNA, 22 nt, Human
ggccugagucacaucaggagag

SEQ ID NO: 952970 - RNA, 21 nt, Human
ugcuccuuagcugccccugcc

SEQ ID NO: 952971 - RNA, 22 nt, Human
acagcagagugugagauagcca

SEQ ID NO: 952972 - RNA, 22 nt, Human
ucuucucaguuucucuaggaug

SEQ ID NO: 952973 - RNA, 22 nt, Human
uucaaacaguguagaauauaug

SEQ ID NO: 952974 - RNA, 22 nt, Human
aggcagcuaagauggauaauga

SEQ ID NO: 952975 - RNA, 22 nt, Human
aucaggauccaccuugagccug

SEQ ID NO: 952976 - RNA, 19 nt, Human
gcucugagaggggcauggg

SEQ ID NO: 952977 - RNA, 23 nt, Human
ugaugggaaggaacgacuaccac

SEQ ID NO: 952978 - RNA, 21 nt, Human
acuguucaucuguucagaagc

SEQ ID NO: 952979 - RNA, 22 nt, Human
ucccuguccugggcaaucccag

SEQ ID NO: 952980 - RNA, 23 nt, Human
cccagcgcugagcccugcaggca

SEQ ID NO: 952981 - RNA, 22 nt, Human
acagaggcugcgcuugggaacg

SEQ ID NO: 952982 - RNA, 22 nt, Human
ugcucuagagcuauuggcuucc

SEQ ID NO: 952983 - RNA, 22 nt, Human
cuggugcaggaaggagcuggca

SEQ ID NO: 952984 - RNA, 22 nt, Human
uggcaaccagguggucuagggu

SEQ ID NO: 952985 - RNA, 22 nt, Human
agauuuagugguggaauuuugg

SEQ ID NO: 952986 - RNA, 22 nt, Human
cccagcuugcccaggacugagg

SEQ ID NO: 952987 - RNA, 22 nt, Human
uggccaaauuugguguaacuug

SEQ ID NO: 952988 - RNA, 22 nt, Human
guaaaguucuacuagaaucaac

SEQ ID NO: 952989 - RNA, 23 nt, Human
ggccucuguguucugcccacaug

SEQ ID NO: 952990 - RNA, 22 nt, Human
cccccaggcucugacacaggag

SEQ ID NO: 952991 - RNA, 22 nt, Human
ggcugggccagggccuguggac

SEQ ID NO: 952992 - RNA, 22 nt, Human
guccuggggauacagaagugaa

SEQ ID NO: 952993 - RNA, 22 nt, Human
agcugagcacauucaaacaggu

SEQ ID NO: 952994 - RNA, 20 nt, Human
ugcugcaguuucaugggacu

SEQ ID NO: 952995 - RNA, 22 nt, Human
cagcccuggccccagguggucu

SEQ ID NO: 952996 - RNA, 22 nt, Human
aguuuuucugcuggucucacua

SEQ ID NO: 952997 - RNA, 22 nt, Human
cucagaguccauaguuuacagu

SEQ ID NO: 952998 - RNA, 22 nt, Human
cugcagagaauuguggggcuuc

SEQ ID NO: 952999 - RNA, 22 nt, Human
gcaguaaaaaaggauaugugca

SEQ ID NO: 953000 - RNA, 22 nt, Human
ucugugccaccucuccaguguc

SEQ ID NO: 953001 - RNA, 22 nt, Human
cagcccuuuccuucucagcuuu

SEQ ID NO: 953002 - RNA, 22 nt, Human
uauaaaguuucgaaagauguau

SEQ ID NO: 953003 - RNA, 22 nt, Human
ucucucagucagaugcuaaaga

SEQ ID NO: 953004 - RNA, 22 nt, Human
uaagaacagugacagccaacau

SEQ ID NO: 953005 - RNA, 22 nt, Human
aggcuggcgacaucuggcgggc

SEQ ID NO: 953006 - RNA, 22 nt, Human
ccugucugcaugaucccugcca

SEQ ID NO: 953007 - RNA, 20 nt, Human
gccugagcuauugccaggau

SEQ ID NO: 953008 - RNA, 22 nt, Human
ugucccaguuuaucugggacug

SEQ ID NO: 953009 - RNA, 22 nt, Human
gccuuccuuacaccugcucagc

SEQ ID NO: 953010 - RNA, 22 nt, Human
gacucugcugacuaguugacua

SEQ ID NO: 953011 - RNA, 23 nt, Human
auuuccuacuauaaaagagguaa

SEQ ID NO: 953012 - RNA, 16 nt, Human
uguuagcugugcauua

SEQ ID NO: 953013 - RNA, 22 nt, Human
agggugccugcugcagguucag

SEQ ID NO: 953014 - RNA, 22 nt, Human
auuucacucucccugccacuua

SEQ ID NO: 953015 - RNA, 22 nt, Human
cagcuggaucccugcagaacuu

SEQ ID NO: 953016 - RNA, 22 nt, Human
uggagggcaucuguggucaggc

SEQ ID NO: 953017 - RNA, 22 nt, Human
cugccugcguugccucgugccu

SEQ ID NO: 953018 - RNA, 22 nt, Human
ucucuggaauuggcugaggcaa

SEQ ID NO: 953019 - RNA, 22 nt, Human
ggcaggcucagcagccaaggag

SEQ ID NO: 953020 - RNA, 22 nt, Human
ucccaggaaugucugaaaguga

SEQ ID NO: 953021 - RNA, 22 nt, Human
ggggcugguggugguuucucca

SEQ ID NO: 953022 - RNA, 22 nt, Human
agcugcucuugggugacuucaa

SEQ ID NO: 953023 - RNA, 22 nt, Human
augcuuuuccuaaaaugaugcc

SEQ ID NO: 953024 - RNA, 19 nt, Human
ugaagcagcaaacucucag

SEQ ID NO: 953025 - RNA, 22 nt, Human
ccaggagauaagcugaguuuau

SEQ ID NO: 953026 - RNA, 23 nt, Human
gcaggugguucgaacagaaguuu

SEQ ID NO: 953027 - RNA, 22 nt, Human
ucugggggcgaccagggacugc

SEQ ID NO: 953028 - RNA, 22 nt, Human
uccucagggcggccuccgucuu

SEQ ID NO: 953029 - RNA, 22 nt, Human
aaugggagagaacacaaagucc

SEQ ID NO: 953030 - RNA, 21 nt, Human
gcagggacaaagcuucaggag

SEQ ID NO: 953031 - RNA, 22 nt, Human
uccuugaaaggggcugcagggc

SEQ ID NO: 953032 - RNA, 18 nt, Human
gcugucugaggucugagg

SEQ ID NO: 953033 - RNA, 20 nt, Human
agggcagagggauuacaggc

SEQ ID NO: 953034 - RNA, 22 nt, Human
ugauuucccucaucauaacaga

SEQ ID NO: 953035 - RNA, 22 nt, Human
ggcuggcauccagggaaaucca

SEQ ID NO: 953036 - RNA, 22 nt, Human
uucaggaucaaguugccaguag

SEQ ID NO: 953037 - RNA, 22 nt, Human
cacucugagaaguacaagcucc

SEQ ID NO: 953038 - RNA, 22 nt, Human
acagggccagccugggaccugg

SEQ ID NO: 953039 - RNA, 22 nt, Human
ggagucagccugucagagugua

SEQ ID NO: 953040 - RNA, 18 nt, Human
ggaaaaggagugucuagc

SEQ ID NO: 953041 - RNA, 22 nt, Human
uguaugcaaauuuauuagcaca

SEQ ID NO: 953042 - RNA, 21 nt, Human
gcagagccggggcgagaaggc

SEQ ID NO: 953043 - RNA, 22 nt, Human
gcacagguugcaaaaguucaca

SEQ ID NO: 953044 - RNA, 22 nt, Human
uaaagguaacaugaacugcuuu

SEQ ID NO: 953045 - RNA, 22 nt, Human
ugguccagacauuucugaggua

SEQ ID NO: 953046 - RNA, 22 nt, Human
uguuacuuaucucacgugaugc

SEQ ID NO: 953047 - RNA, 22 nt, Human
uccaggcuggacaugaggcggg

SEQ ID NO: 953048 - RNA, 22 nt, Human
uaagacaauucuucagucacaa

SEQ ID NO: 953049 - RNA, 22 nt, Human
cugaggccuguguuggggcagu

SEQ ID NO: 953050 - RNA, 22 nt, Human
uuaggauagucuguuagaaaag

SEQ ID NO: 953051 - RNA, 22 nt, Human
cugccugugccaccgccucauu

SEQ ID NO: 953052 - RNA, 22 nt, Human
uagggauguaaacauaguaauu

SEQ ID NO: 953053 - RNA, 23 nt, Human
cuucucagaagucugugccagga

SEQ ID NO: 953054 - RNA, 22 nt, Human
ggccuugggaggagggucagaa

SEQ ID NO: 953055 - RNA, 22 nt, Human
agagccagagaccuggguucac

SEQ ID NO: 953056 - RNA, 22 nt, Human
uggcugucagcugccuggugcg

SEQ ID NO: 953057 - RNA, 22 nt, Human
gaaucucaaggcuugugaggau

SEQ ID NO: 953058 - RNA, 22 nt, Human
cugcccugcuugaugacagcga

SEQ ID NO: 953059 - RNA, 22 nt, Human
uuuguaaggcuaaauaauauuc

SEQ ID NO: 953060 - RNA, 22 nt, Human
ggguguccugugccaagcuggg

SEQ ID NO: 953061 - RNA, 22 nt, Human
gccaggcucucagugacugccc

SEQ ID NO: 953062 - RNA, 17 nt, Human
ggaaaaggaugauacag

SEQ ID NO: 953063 - RNA, 22 nt, Human
gaggggaagacuucuggacagu

SEQ ID NO: 953064 - RNA, 22 nt, Human
uggguggaauaaaucaguucug

SEQ ID NO: 953065 - RNA, 22 nt, Human
cagggaauccauggucauaagg

SEQ ID NO: 953066 - RNA, 22 nt, Human
aaagaacaucggagugggcggg

SEQ ID NO: 953067 - RNA, 22 nt, Human
cacaugggugugccuggaggaa

SEQ ID NO: 953068 - RNA, 20 nt, Human
ggguggaguugcggucugug

SEQ ID NO: 953069 - RNA, 22 nt, Human
caacagcugaucuuugaugaag

SEQ ID NO: 953070 - RNA, 22 nt, Human
ccagcucccugaagccuggucu

SEQ ID NO: 953071 - RNA, 22 nt, Human
aaagccaugggucuuuggcaua

SEQ ID NO: 953072 - RNA, 22 nt, Human
auagaauaaggcacagauucuu

SEQ ID NO: 953073 - RNA, 22 nt, Human
ggagcauguggggugagcaggg

SEQ ID NO: 953074 - RNA, 22 nt, Human
ggaggcagaacuucccgucagu

SEQ ID NO: 953075 - RNA, 21 nt, Human
uucuucaaagaagaaggcaca

SEQ ID NO: 953076 - RNA, 22 nt, Human
acauuuaggauguuuugagaga

SEQ ID NO: 953077 - RNA, 22 nt, Human
uggcccugacagguccugggca

SEQ ID NO: 953078 - RNA, 22 nt, Human
ucuggagccacaaaccucagcu

SEQ ID NO: 953079 - RNA, 22 nt, Human
caggccuggggcuggcuuccag

SEQ ID NO: 953080 - RNA, 19 nt, Human
ggcccaaguacugagugcc

SEQ ID NO: 953081 - RNA, 22 nt, Human
agcugcugaaugacacugcaag

SEQ ID NO: 953082 - RNA, 22 nt, Human
ucaaugaaagagcaugcauuuu

SEQ ID NO: 953083 - RNA, 22 nt, Human
caccugagugucaguauucuca

SEQ ID NO: 953084 - RNA, 22 nt, Human
uacacauguuuggcaaguaugu

SEQ ID NO: 953085 - RNA, 22 nt, Human
cugcuccacaccuccauuuccu

SEQ ID NO: 953086 - RNA, 22 nt, Human
gaguuauuggguggaaagguag

SEQ ID NO: 953087 - RNA, 22 nt, Human
gcagagugaggaagagcuucca

SEQ ID NO: 953088 - RNA, 22 nt, Human
agucagacacguuuuccauuag

SEQ ID NO: 953089 - RNA, 19 nt, Human
acaaaugauguugcacuga

SEQ ID NO: 953090 - RNA, 22 nt, Human
caggguggcacucagcgcaucu

SEQ ID NO: 953091 - RNA, 22 nt, Human
uuuaguagugacagauucuggg

SEQ ID NO: 953092 - RNA, 22 nt, Human
gcugucacauuuggagcacugg

SEQ ID NO: 953093 - RNA, 22 nt, Human
ugcuggcuguauaugugagagu

SEQ ID NO: 953094 - RNA, 22 nt, Human
agcaggguuccaggaguugcag

SEQ ID NO: 953095 - RNA, 22 nt, Human
auaacaugaccugugcuucaca

SEQ ID NO: 953096 - RNA, 22 nt, Human
guguuuccucacuucucugacu

SEQ ID NO: 953097 - RNA, 22 nt, Human
acagagccacuuuggugccuac

SEQ ID NO: 953098 - RNA, 22 nt, Human
agucccagcuucccccaugcag

SEQ ID NO: 953099 - RNA, 22 nt, Human
ucauugcaguagggagagaccc

SEQ ID NO: 953100 - RNA, 22 nt, Human
caaggccuccugggcccagaga

SEQ ID NO: 953101 - RNA, 22 nt, Human
agugaccaaucaugguuagauu

SEQ ID NO: 953102 - RNA, 22 nt, Human
cagcugccuaugaccuagccuc

SEQ ID NO: 953103 - RNA, 22 nt, Human
cauuacaugguccaggauauau

SEQ ID NO: 953104 - RNA, 22 nt, Human
uauuucugaggcccaggaagug

SEQ ID NO: 953105 - RNA, 22 nt, Human
cauccugguuaccccauaguca

SEQ ID NO: 953106 - RNA, 23 nt, Human
ggucccaguggagaggccucacc

SEQ ID NO: 953107 - RNA, 22 nt, Human
uauuggugggggcagagagaga

SEQ ID NO: 953108 - RNA, 22 nt, Human
aagagcuggauggaaucuggga

SEQ ID NO: 953109 - RNA, 22 nt, Human
cagcugcuguuacugcuuauua

SEQ ID NO: 953110 - RNA, 22 nt, Human
ccagccuggagggcaguggugg

SEQ ID NO: 953111 - RNA, 22 nt, Human
cacaauuuccuugcuucacuuu

SEQ ID NO: 953112 - RNA, 22 nt, Human
cccaggagccaucugucuuggc

SEQ ID NO: 953113 - RNA, 20 nt, Human
augugucuuagagcaucagg

SEQ ID NO: 953114 - RNA, 22 nt, Human
cuucccacuaguaucacagagc

SEQ ID NO: 953115 - RNA, 22 nt, Human
cuccuggacauggagcggagga

SEQ ID NO: 953116 - RNA, 22 nt, Human
cagcuugggucaggugccugcu

SEQ ID NO: 953117 - RNA, 22 nt, Human
ucacaugcuacugagccagacc

SEQ ID NO: 953118 - RNA, 22 nt, Human
gcccagcugcacccuggugggu

SEQ ID NO: 953119 - RNA, 22 nt, Human
aggaggggcauagaaauguaau

SEQ ID NO: 953120 - RNA, 20 nt, Human
guauauaaccauagugacua

SEQ ID NO: 953121 - RNA, 23 nt, Human
uugauuucaaaugcagagaacac

SEQ ID NO: 953122 - RNA, 22 nt, Human
cacagguggcuccaaguuagag

SEQ ID NO: 953123 - RNA, 22 nt, Human
aaaggccacugcaagggaaggu

SEQ ID NO: 953124 - RNA, 22 nt, Human
cuguacaggugaggagggggcu

SEQ ID NO: 953125 - RNA, 22 nt, Human
uuuuuccuuggaugugucucuc

SEQ ID NO: 953126 - RNA, 22 nt, Human
cagcugccagcuucucuccauc

SEQ ID NO: 953127 - RNA, 22 nt, Human
ugcaguggcgccaucucagcuc

SEQ ID NO: 953128 - RNA, 22 nt, Human
cacacauugaauucauucuugu

SEQ ID NO: 953129 - RNA, 22 nt, Human
aaggcacugaaaaauugugugu

SEQ ID NO: 953130 - RNA, 22 nt, Human
gaccagucauuacucaugcccu

SEQ ID NO: 953131 - RNA, 22 nt, Human
uguguacaagaguguuuacugu

SEQ ID NO: 953132 - RNA, 22 nt, Human
guucagggagggacagaugaag

SEQ ID NO: 953133 - RNA, 22 nt, Human
ucuuggagaauggcagagaagc

SEQ ID NO: 953134 - RNA, 22 nt, Human
cugacucagcagcugaugaucc

SEQ ID NO: 953135 - RNA, 22 nt, Human
cauucacaucuuguuccaucac

SEQ ID NO: 953136 - RNA, 22 nt, Human
gagagcuguccggcugagcagc

SEQ ID NO: 953137 - RNA, 22 nt, Human
gcaggcaguugcaguuuucuag

SEQ ID NO: 953138 - RNA, 22 nt, Human
cucccagagaccaagcugagaa

SEQ ID NO: 953139 - RNA, 22 nt, Human
aagcugccagauucagucugcu

SEQ ID NO: 953140 - RNA, 21 nt, Human
uaaauaauaaguugcugagau

SEQ ID NO: 953141 - RNA, 22 nt, Human
acuguauuuuugaaucauugug

SEQ ID NO: 953142 - RNA, 22 nt, Human
gcugggcaagugccuuggguuu

SEQ ID NO: 953143 - RNA, 22 nt, Human
cauuuccugucuggaggucaaa

SEQ ID NO: 953144 - RNA, 18 nt, Human
gagcacugguguugaggu

SEQ ID NO: 953145 - RNA, 22 nt, Human
caugaagcuugaagcaguccac

SEQ ID NO: 953146 - RNA, 22 nt, Human
ucugcaggacugaggccuguuu

SEQ ID NO: 953147 - RNA, 22 nt, Human
ccagggcuggugggagaugcug

SEQ ID NO: 953148 - RNA, 22 nt, Human
cauuguauugaggauacuuaag

SEQ ID NO: 953149 - RNA, 22 nt, Human
ccugccugggcucacuugccag

SEQ ID NO: 953150 - RNA, 20 nt, Human
ucauccaggacaggaguggc

SEQ ID NO: 953151 - RNA, 22 nt, Human
cacaugugugcugaggacugug

SEQ ID NO: 953152 - RNA, 19 nt, Human
uccuuugaauaucaguuga

SEQ ID NO: 953153 - RNA, 22 nt, Human
auggagggugguaagacagaga

SEQ ID NO: 953154 - RNA, 22 nt, Human
cugucaguucuuccagauagag

SEQ ID NO: 953155 - RNA, 22 nt, Human
uaauuauaacaguuacaucuua

SEQ ID NO: 953156 - RNA, 22 nt, Human
aguuuuucuccccuggcuucau

SEQ ID NO: 953157 - RNA, 22 nt, Human
uacaaaguaauguauaauaucg

SEQ ID NO: 953158 - RNA, 22 nt, Human
ucugggagaagcugaugugaag

SEQ ID NO: 953159 - RNA, 22 nt, Human
aaagccaugaauguuauagagg

SEQ ID NO: 953160 - RNA, 22 nt, Human
uguuccaucaguuuuugguuga

SEQ ID NO: 953161 - RNA, 22 nt, Human
guuauguacuuuuuaaaucuug

SEQ ID NO: 953162 - RNA, 22 nt, Human
agaagcugacagaugcagcagg

SEQ ID NO: 953163 - RNA, 22 nt, Human
auuuuucucuuuccacugagau

SEQ ID NO: 953164 - RNA, 22 nt, Human
gggcaguugauggaggucugga

SEQ ID NO: 953165 - RNA, 22 nt, Human
ugaaguuauauauguugaaaau

SEQ ID NO: 953166 - RNA, 22 nt, Human
gccaaagcagucuugccucugc

SEQ ID NO: 953167 - RNA, 22 nt, Human
ucucacuggguauaaaugagua

SEQ ID NO: 953168 - RNA, 22 nt, Human
aagcaaaggcaggagcuuguga

SEQ ID NO: 953169 - RNA, 22 nt, Human
cauuugcagagggugacacucu

SEQ ID NO: 953170 - RNA, 22 nt, Human
gaucuucuauguaaugaagugu

SEQ ID NO: 953171 - RNA, 22 nt, Human
cagagggcacaugguuuccuca

SEQ ID NO: 953172 - RNA, 22 nt, Human
acagcagcauaaacugacuaag

SEQ ID NO: 953173 - RNA, 22 nt, Human
agccaggauggucucgaucggc

SEQ ID NO: 953174 - RNA, 22 nt, Human
uuucagaaagcaucaucaaagu

SEQ ID NO: 953175 - RNA, 22 nt, Human
uccaugagaacccuuggagaua

SEQ ID NO: 953176 - RNA, 22 nt, Human
cugcugucgccgagcugcaugc

SEQ ID NO: 953177 - RNA, 22 nt, Human
acauuugaggauguuaagaaug

SEQ ID NO: 953178 - RNA, 22 nt, Human
gacaggaggcagagcucaggug

SEQ ID NO: 953179 - RNA, 21 nt, Human
uuaagagcuuagcaguaggcc

SEQ ID NO: 953180 - RNA, 22 nt, Human
uccuugaagcuuguaucuaaua

SEQ ID NO: 953181 - RNA, 22 nt, Human
agcucccagcagagcuggccac

SEQ ID NO: 953182 - RNA, 22 nt, Human
gcauguguuauuuuauguauga

SEQ ID NO: 953183 - RNA, 22 nt, Human
ucaggcacugcuuucugauaug

SEQ ID NO: 953184 - RNA, 22 nt, Human
aucuuccuucacuuucucccac

SEQ ID NO: 953185 - RNA, 22 nt, Human
agggagcuaggauccugaaggu

SEQ ID NO: 953186 - RNA, 22 nt, Human
gccaggagcaugucauuguuga

SEQ ID NO: 953187 - RNA, 22 nt, Human
agguacagcaauauaagagguc

SEQ ID NO: 953188 - RNA, 22 nt, Human
auguuuuauguuccacucaagg

SEQ ID NO: 953189 - RNA, 22 nt, Human
caguacuugggaaugcugggga

SEQ ID NO: 953190 - RNA, 22 nt, Human
uccagggccaagucauggaacc

SEQ ID NO: 953191 - RNA, 22 nt, Human
ucugcuggccuuagcaggucua

SEQ ID NO: 953192 - RNA, 22 nt, Human
aucaguuuaaaugggcuguugg

SEQ ID NO: 953193 - RNA, 22 nt, Human
uaaaugcagauuccugagccua

SEQ ID NO: 953194 - RNA, 22 nt, Human
aaggcaguuaauuuggcuagaa

SEQ ID NO: 953195 - RNA, 22 nt, Human
cagcagggcccccgggugcgcc

SEQ ID NO: 953196 - RNA, 22 nt, Human
uggaagagaaaggaguggaucu

SEQ ID NO: 953197 - RNA, 22 nt, Human
caaggccaugagcagcgagugu

SEQ ID NO: 953198 - RNA, 22 nt, Human
aucacauucuuucaaagcaguc

SEQ ID NO: 953199 - RNA, 22 nt, Human
aaaucaguuggaacacaagcag

SEQ ID NO: 953200 - RNA, 22 nt, Human
ggcugaaacagauuucaagaca

SEQ ID NO: 953201 - RNA, 22 nt, Human
aggaggugacagccugcaucug

SEQ ID NO: 953202 - RNA, 22 nt, Human
gcucuggagauggagccuugag

SEQ ID NO: 953203 - RNA, 22 nt, Human
cauuucugugacacuuccaucu

SEQ ID NO: 953204 - RNA, 22 nt, Human
augauauuugcaaugugcuugc

SEQ ID NO: 953205 - RNA, 22 nt, Human
agagcccugaagcagagcuaaa

SEQ ID NO: 953206 - RNA, 22 nt, Human
acccuggguucccgcagcacca

SEQ ID NO: 953207 - RNA, 22 nt, Human
aaggcccuggccccagcuucuu

SEQ ID NO: 953208 - RNA, 22 nt, Human
cugcuuccaugcaauggcaguc

SEQ ID NO: 953209 - RNA, 22 nt, Human
cugauuccugauucaugcucuu

SEQ ID NO: 953210 - RNA, 22 nt, Human
ugugcaguuucuauguugucca

SEQ ID NO: 953211 - RNA, 22 nt, Human
uauuucuguaugcauaaaagga

SEQ ID NO: 953212 - RNA, 19 nt, Human
ccagucccauacaggagau

SEQ ID NO: 953213 - RNA, 22 nt, Human
caggaggcaucauggagcggac

SEQ ID NO: 953214 - RNA, 19 nt, Human
gagguggguccccgcagcc

SEQ ID NO: 953215 - RNA, 22 nt, Human
uguugaagauaaaguucucauu

SEQ ID NO: 953216 - RNA, 21 nt, Human
acacauuaugagcauagacuc

SEQ ID NO: 953217 - RNA, 22 nt, Human
uagcaguggaaucuuuugucca

SEQ ID NO: 953218 - RNA, 22 nt, Human
ggccccaggaccuccacggucc

SEQ ID NO: 953219 - RNA, 21 nt, Human
gcuccuggugcugcguggcgc

SEQ ID NO: 953220 - RNA, 22 nt, Human
gagcugccuacauugccaagag

SEQ ID NO: 953221 - RNA, 22 nt, Human
cuagaaaaauacuuuauuguga

SEQ ID NO: 953222 - RNA, 22 nt, Human
ccugguccuuacgucauugcuu

SEQ ID NO: 953223 - RNA, 22 nt, Human
agcagcugaucaaagcacuuau

SEQ ID NO: 953224 - RNA, 22 nt, Human
uggagcuggaauuugagcugga

SEQ ID NO: 953225 - RNA, 22 nt, Human
ccaaaguccauaguuuacuuua

SEQ ID NO: 953226 - RNA, 23 nt, Human
ugugucugaggauauaugugcau

SEQ ID NO: 953227 - RNA, 22 nt, Human
ggccuguccagccugccuggcu

SEQ ID NO: 953228 - RNA, 22 nt, Human
ucagacuugccuuuuuauaaaa

SEQ ID NO: 953229 - RNA, 22 nt, Human
ggcaguggguggaucucaggga

SEQ ID NO: 953230 - RNA, 23 nt, Human
gugcucugcggucugcuagucug

SEQ ID NO: 953231 - RNA, 22 nt, Human
cauguacacucauguaacuaua

SEQ ID NO: 953232 - RNA, 22 nt, Human
ucaagagaaggggaaauagacu

SEQ ID NO: 953233 - RNA, 22 nt, Human
uaaaacuagugguugggacuaa

SEQ ID NO: 953234 - RNA, 22 nt, Human
agaaugcauuuuguguagcuau

SEQ ID NO: 953235 - RNA, 22 nt, Human
uuugcuauaaaagggucacacg

SEQ ID NO: 953236 - RNA, 22 nt, Human
agccagcuggugggucagcugg

SEQ ID NO: 953237 - RNA, 22 nt, Human
agcuguccuggcucaggcugug

SEQ ID NO: 953238 - RNA, 22 nt, Human
gcugucucauacaaggcccugc

SEQ ID NO: 953239 - RNA, 22 nt, Human
ggcagaggagcuggaaacaugg

SEQ ID NO: 953240 - RNA, 22 nt, Human
ggcugccugaggcugaggcccg

SEQ ID NO: 953241 - RNA, 22 nt, Human
gcagugacagggcugcugccuu

SEQ ID NO: 953242 - RNA, 23 nt, Human
ucucagaggauuccugggccuug

SEQ ID NO: 953243 - RNA, 17 nt, Human
gagauggguggaucacc

SEQ ID NO: 953244 - RNA, 22 nt, Human
gggacuggcacagggcugggag

SEQ ID NO: 953245 - RNA, 22 nt, Human
ucuggcucugacacuacuguua

SEQ ID NO: 953246 - RNA, 22 nt, Human
auuugagaugguaaauaacuuu

SEQ ID NO: 953247 - RNA, 22 nt, Human
cucagggccaaggaugcuguug

SEQ ID NO: 953248 - RNA, 22 nt, Human
aucuaggauuugaaugcacagu

SEQ ID NO: 953249 - RNA, 18 nt, Human
cagaaaucacaccagcac

SEQ ID NO: 953250 - RNA, 22 nt, Human
ccagcaugagacgaugaugaag

SEQ ID NO: 953251 - RNA, 22 nt, Human
ggcagaggaggggugaauuugc

SEQ ID NO: 953252 - RNA, 23 nt, Human
ugcugggcagagcuggugcugag

SEQ ID NO: 953253 - RNA, 22 nt, Human
uuuaggaucaaugagaaagucu

SEQ ID NO: 953254 - RNA, 22 nt, Human
auguuuaaauuuauagacagug

SEQ ID NO: 953255 - RNA, 22 nt, Human
augcugugccuucucugugcca

SEQ ID NO: 953256 - RNA, 20 nt, Human
agugucuggugcagggccuc

SEQ ID NO: 953257 - RNA, 22 nt, Human
accuuucaaaguggcuaucacu

SEQ ID NO: 953258 - RNA, 22 nt, Human
ccuggcagcuccuccccggcgg

SEQ ID NO: 953259 - RNA, 22 nt, Human
aggcaguuguagagagggcucu

SEQ ID NO: 953260 - RNA, 23 nt, Human
ccuccugggcacaggccugaugg

SEQ ID NO: 953261 - RNA, 22 nt, Human
agggagcuguggucagcucagu

SEQ ID NO: 953262 - RNA, 22 nt, Human
ccagcagcccucuuccaagacu

SEQ ID NO: 953263 - RNA, 22 nt, Human
agaaaacauuacauaggugugu

SEQ ID NO: 953264 - RNA, 22 nt, Human
guucuucaucuuaaccaucugu

SEQ ID NO: 953265 - RNA, 22 nt, Human
ugucauugaggaaaacuaggug

SEQ ID NO: 953266 - RNA, 22 nt, Human
uggcagcugugcuucauucuuu

SEQ ID NO: 953267 - RNA, 22 nt, Human
uaaugaugugugcaaacugaau

SEQ ID NO: 953268 - RNA, 22 nt, Human
aucaggauuacacggggaugcu

SEQ ID NO: 953269 - RNA, 22 nt, Human
uauaucuuauaugugcagguac

SEQ ID NO: 953270 - RNA, 22 nt, Human
ugugcagggaagggcaugcuau

SEQ ID NO: 953271 - RNA, 22 nt, Human
cuugcugggguaagucugugcu

SEQ ID NO: 953272 - RNA, 22 nt, Human
gaucauuuacuuguucuggacu

SEQ ID NO: 953273 - RNA, 22 nt, Human
gcagauggugggggaggaguac

SEQ ID NO: 953274 - RNA, 22 nt, Human
gcucagagaaucagcagacacc

SEQ ID NO: 953275 - RNA, 22 nt, Human
uggagggcucuuucaccuggua

SEQ ID NO: 953276 - RNA, 23 nt, Human
auuugagaaaguauuuuuaagac

SEQ ID NO: 953277 - RNA, 22 nt, Human
ccuggccaguuuccaggcccug

SEQ ID NO: 953278 - RNA, 22 nt, Human
cugggccaagaaguuguguaug

SEQ ID NO: 953279 - RNA, 22 nt, Human
uggagcagagaugguggccuuc

SEQ ID NO: 953280 - RNA, 22 nt, Human
ucaggaugguccuuuaugagaa

SEQ ID NO: 953281 - RNA, 23 nt, Human
gguggcaggaguggaugcugagc

SEQ ID NO: 953282 - RNA, 22 nt, Human
caggggcuuaagugacagaagg

SEQ ID NO: 953283 - RNA, 22 nt, Human
cccaggaggugugcccaacucg

SEQ ID NO: 953284 - RNA, 22 nt, Human
gcugccacgaucucugcuguag

SEQ ID NO: 953285 - RNA, 20 nt, Human
auguagaugaaagcaaaggc

SEQ ID NO: 953286 - RNA, 22 nt, Human
aaucuguuuaguucugcguaug

SEQ ID NO: 953287 - RNA, 22 nt, Human
uccaggccaauguagcaggccc

SEQ ID NO: 953288 - RNA, 23 nt, Human
uuugcaaauuggacacaaccaca

SEQ ID NO: 953289 - RNA, 22 nt, Human
ggcggggguccaggagccugca

SEQ ID NO: 953290 - RNA, 18 nt, Human
gaggauggaaggagaugc

SEQ ID NO: 953291 - RNA, 22 nt, Human
aggcagcccugugcuggaugcu

SEQ ID NO: 953292 - RNA, 22 nt, Human
cuccaggggccagaagccuggc

SEQ ID NO: 953293 - RNA, 22 nt, Human
agauuguagaaacuguagcauu

SEQ ID NO: 953294 - RNA, 22 nt, Human
uggcagcucuguucaacaugag

SEQ ID NO: 953295 - RNA, 22 nt, Human
uccuggcccggccgggccugcu

SEQ ID NO: 953296 - RNA, 22 nt, Human
ucagcagggaggcucugugccc

SEQ ID NO: 953297 - RNA, 22 nt, Human
agcaauaugacauugcuacauc

SEQ ID NO: 953298 - RNA, 22 nt, Human
uucuuaaguuuagcaacuugug

SEQ ID NO: 953299 - RNA, 22 nt, Human
cucaggauuuaaaggggcacuc

SEQ ID NO: 953300 - RNA, 22 nt, Human
gggcagcugccagaggccaugg

SEQ ID NO: 953301 - RNA, 22 nt, Human
caagagcugaggcuggagaggu

SEQ ID NO: 953302 - RNA, 23 nt, Human
acacaauagaguacuauucagcc

SEQ ID NO: 953303 - RNA, 22 nt, Human
gagccaagaucgcaccacugca

SEQ ID NO: 953304 - RNA, 17 nt, Human
ugccagccugucccagg

SEQ ID NO: 953305 - RNA, 22 nt, Human
ucaaauaaugccauucaucauc

SEQ ID NO: 953306 - RNA, 22 nt, Human
cauugcuuugugcauauuuaaa

SEQ ID NO: 953307 - RNA, 22 nt, Human
gcucuggguagccacugccugg

SEQ ID NO: 953308 - RNA, 22 nt, Human
gagccauacaaccuauaaagug

SEQ ID NO: 953309 - RNA, 22 nt, Human
ucuucuuccucauuuauacaua

SEQ ID NO: 953310 - RNA, 17 nt, Human
gcuggcugacccaugcc

SEQ ID NO: 953311 - RNA, 22 nt, Human
uggcacugccaaccugcuaggu

SEQ ID NO: 953312 - RNA, 22 nt, Human
cagagagggcggcccuggcuuc

SEQ ID NO: 953313 - RNA, 22 nt, Human
gggugggccugucuggccaugu

SEQ ID NO: 953314 - RNA, 22 nt, Human
ggaggaugagcuacgaggagcu

SEQ ID NO: 953315 - RNA, 22 nt, Human
cacugcuuaguugguaaaugug

SEQ ID NO: 953316 - RNA, 22 nt, Human
gcugcagcuguaggacacaauu

SEQ ID NO: 953317 - RNA, 22 nt, Human
gcucacugccauucucuagaug

SEQ ID NO: 953318 - RNA, 22 nt, Human
agcucagggcgaucugucucgg

SEQ ID NO: 953319 - RNA, 21 nt, Human
agaugaggauacugaggccua

SEQ ID NO: 953320 - RNA, 20 nt, Human
gggguuggcuggcacaggga

SEQ ID NO: 953321 - RNA, 22 nt, Human
caguuucucucaauaagcaucg

SEQ ID NO: 953322 - RNA, 22 nt, Human
ccaggguggaggcuggauggag

SEQ ID NO: 953323 - RNA, 22 nt, Human
accuggcacuacaggcaccugu

SEQ ID NO: 953324 - RNA, 22 nt, Human
cucugcuaagcaugaacaauua

SEQ ID NO: 953325 - RNA, 22 nt, Human
ugcauauugugaaaauguagau

SEQ ID NO: 953326 - RNA, 22 nt, Human
uacauucuacuuuuucacuccc

SEQ ID NO: 953327 - RNA, 22 nt, Human
cuccaggaaagccugaggcccg

SEQ ID NO: 953328 - RNA, 22 nt, Human
gcauguguugguuuaugcaugu

SEQ ID NO: 953329 - RNA, 22 nt, Human
aaucagaaaauucaguggaauu

SEQ ID NO: 953330 - RNA, 22 nt, Human
gggcuccagcccgggaccaggu

SEQ ID NO: 953331 - RNA, 22 nt, Human
uuugggaagaggaaucucugga

SEQ ID NO: 953332 - RNA, 22 nt, Human
uuaaaugaggcugauguagauu

SEQ ID NO: 953333 - RNA, 21 nt, Human
uggcacugcuuagcagguucc

SEQ ID NO: 953334 - RNA, 22 nt, Human
cuuuguaagucuuucuccaaga

SEQ ID NO: 953335 - RNA, 22 nt, Human
ucucagggcgcagugaggcagu

SEQ ID NO: 953336 - RNA, 22 nt, Human
acuuugcagggcuugauaucca

SEQ ID NO: 953337 - RNA, 22 nt, Human
gggaagauaguguugagggccc

SEQ ID NO: 953338 - RNA, 22 nt, Human
uggacagguuugggugccuguu

SEQ ID NO: 953339 - RNA, 22 nt, Human
cucaggauccaucuccugcccu

SEQ ID NO: 953340 - RNA, 22 nt, Human
cccuggaggaaaaucugaggcu

SEQ ID NO: 953341 - RNA, 22 nt, Human
ucugccugcggcugcagguggc

SEQ ID NO: 953342 - RNA, 22 nt, Human
auucagcaguuccugcuucagu

SEQ ID NO: 953343 - RNA, 22 nt, Human
aaaguguaaggaauuuaaguaa

SEQ ID NO: 953344 - RNA, 22 nt, Human
ccugggagguggagguugcagu

SEQ ID NO: 953345 - RNA, 22 nt, Human
uauguuuauacuuugauguacu

SEQ ID NO: 953346 - RNA, 21 nt, Human
cugccuugaaugguacuggga

SEQ ID NO: 953347 - RNA, 22 nt, Human
ugcuggcuacugauggcaggcc

SEQ ID NO: 953348 - RNA, 22 nt, Human
uagcaggguccaaugugaggca

SEQ ID NO: 953349 - RNA, 22 nt, Human
gggaagagaccguacccuggcc

SEQ ID NO: 953350 - RNA, 22 nt, Human
gcaaggcugcugccacccaucu

SEQ ID NO: 953351 - RNA, 22 nt, Human
cugggcagugcagcuauagaac

SEQ ID NO: 953352 - RNA, 22 nt, Human
gugggagccauuuccaguaugc

SEQ ID NO: 953353 - RNA, 20 nt, Human
acguggccaccaguggcuua

SEQ ID NO: 953354 - RNA, 18 nt, Human
ucugucucuguccuugcu

SEQ ID NO: 953355 - RNA, 20 nt, Human
uaggcagcuugacccuuggu

SEQ ID NO: 953356 - RNA, 22 nt, Human
gugggagcccucagggaggugc

SEQ ID NO: 953357 - RNA, 22 nt, Human
acuuugugcccaacagaaagaa

SEQ ID NO: 953358 - RNA, 22 nt, Human
ccugaagaugcuguggccuggu

SEQ ID NO: 953359 - RNA, 22 nt, Human
uaugaagacaaugauagcauga

SEQ ID NO: 953360 - RNA, 22 nt, Human
aaagacagagcuguaggggaaa

SEQ ID NO: 953361 - RNA, 22 nt, Human
uuggccaacagcgacagggcca

SEQ ID NO: 953362 - RNA, 22 nt, Human
uccuucagccaugggcucucca

SEQ ID NO: 953363 - RNA, 22 nt, Human
ugggcagaggcucugaagucca

SEQ ID NO: 953364 - RNA, 22 nt, Human
auaauucagguuuucuggcaca

SEQ ID NO: 953365 - RNA, 22 nt, Human
agagcuggcugcugcggugcuu

SEQ ID NO: 953366 - RNA, 22 nt, Human
agccuggaguucccaggagaag

SEQ ID NO: 953367 - RNA, 21 nt, Human
ccuccaggugauuccgugcuc

SEQ ID NO: 953368 - RNA, 22 nt, Human
gcucaggaucccaggggugugc

SEQ ID NO: 953369 - RNA, 22 nt, Human
cuuuccaaugucacuaugaauc

SEQ ID NO: 953370 - RNA, 22 nt, Human
auacauauaugguacuuccugg

SEQ ID NO: 953371 - RNA, 22 nt, Human
uuugcauuuccagaguagcaga

SEQ ID NO: 953372 - RNA, 22 nt, Human
aauuaguauugcgauucauuag

SEQ ID NO: 953373 - RNA, 22 nt, Human
uugcauugaucccagcuugggc

SEQ ID NO: 953374 - RNA, 22 nt, Human
gugcagcugugugagagcucca

SEQ ID NO: 953375 - RNA, 22 nt, Human
agagccuggggauuggcaaggg

SEQ ID NO: 953376 - RNA, 22 nt, Human
ucuucaucucagauuaacagga

SEQ ID NO: 953377 - RNA, 22 nt, Human
acauucuaacauuguacagaua

SEQ ID NO: 953378 - RNA, 22 nt, Human
guacaguuuucaguguucacug

SEQ ID NO: 953379 - RNA, 22 nt, Human
uacauguaauuuucauaguaag

SEQ ID NO: 953380 - RNA, 22 nt, Human
uuugaaaggguuaugagacuga

SEQ ID NO: 953381 - RNA, 22 nt, Human
gccaggggacgcggagcgacga

SEQ ID NO: 953382 - RNA, 22 nt, Human
ucuuuuuauauugacaaaaggu

SEQ ID NO: 953383 - RNA, 22 nt, Human
ugaaaugauaucugauaacaaa

SEQ ID NO: 953384 - RNA, 22 nt, Human
acucaggaaaaauguagugaua

SEQ ID NO: 953385 - RNA, 22 nt, Human
acugucucucuagcaguucagg

SEQ ID NO: 953386 - RNA, 23 nt, Human
agcagccagagauccucggcccu

SEQ ID NO: 953387 - RNA, 22 nt, Human
ucucucuugucaccccaucugc

SEQ ID NO: 953388 - RNA, 22 nt, Human
aggaccugacuggcuccugcuu

SEQ ID NO: 953389 - RNA, 22 nt, Human
gcugccuguggcccuucugggu

SEQ ID NO: 953390 - RNA, 22 nt, Human
cagguggggagaguguggagca

SEQ ID NO: 953391 - RNA, 22 nt, Human
uccagggaugguaaugagcagu

SEQ ID NO: 953392 - RNA, 22 nt, Human
caggagugucuccacacagcaa

SEQ ID NO: 953393 - RNA, 22 nt, Human
uugaaugaccaugaugcaaggg

SEQ ID NO: 953394 - RNA, 22 nt, Human
acccaggaaaacauggugcaga

SEQ ID NO: 953395 - RNA, 22 nt, Human
ucucagagcucacaccuccugg

SEQ ID NO: 953396 - RNA, 22 nt, Human
uuuccucugacugcuccccugc

SEQ ID NO: 953397 - RNA, 22 nt, Human
aggccagguuccucaaucuuga

SEQ ID NO: 953398 - RNA, 22 nt, Human
agaaaugaagagagucaagguu

SEQ ID NO: 953399 - RNA, 22 nt, Human
gagcagcucgagaaggaagcag

SEQ ID NO: 953400 - RNA, 22 nt, Human
uuugcaguagacaucuuauuuu

SEQ ID NO: 953401 - RNA, 22 nt, Human
gacaaaggaucagagguuggga

SEQ ID NO: 953402 - RNA, 22 nt, Human
gaccauuuuuacagagcauuca

SEQ ID NO: 953403 - RNA, 22 nt, Human
ucuugggauagugucucauggc

SEQ ID NO: 953404 - RNA, 21 nt, Human
agccuggcccagggggaggcu

SEQ ID NO: 953405 - RNA, 22 nt, Human
guggcacuaaauacagcauuuc

SEQ ID NO: 953406 - RNA, 22 nt, Human
cuuaaauuggaugaguuaaguu

SEQ ID NO: 953407 - RNA, 22 nt, Human
aauucuuguuguuaguauauuu

SEQ ID NO: 953408 - RNA, 22 nt, Human
aggcucuggacagugaggaguu

SEQ ID NO: 953409 - RNA, 22 nt, Human
ggaggugggcuaaggacucucu

SEQ ID NO: 953410 - RNA, 22 nt, Human
agagacaggauaucugcucaug

SEQ ID NO: 953411 - RNA, 22 nt, Human
cucccuggaggugagcuggcac

SEQ ID NO: 953412 - RNA, 22 nt, Human
gaaccucagugaaacuggaggu

SEQ ID NO: 953413 - RNA, 22 nt, Human
aagccagguguuuaggccagcg

SEQ ID NO: 953414 - RNA, 22 nt, Human
ccugucuguaucgguucagagu

SEQ ID NO: 953415 - RNA, 22 nt, Human
agagcagagggcucugggacaa

SEQ ID NO: 953416 - RNA, 22 nt, Human
ugaaaucuacccuauucagggu

SEQ ID NO: 953417 - RNA, 22 nt, Human
aagccgggccugagaaaugaca

SEQ ID NO: 953418 - RNA, 22 nt, Human
ccaaaugcuccacugacuuugg

SEQ ID NO: 953419 - RNA, 22 nt, Human
uguaugcagcaaaacaauuagu

SEQ ID NO: 953420 - RNA, 22 nt, Human
uaccuuggguugaguucauucu

SEQ ID NO: 953421 - RNA, 22 nt, Human
aaauacagaguugcuuaaaagc

SEQ ID NO: 953422 - RNA, 22 nt, Human
cugccuggcuaaacucaagucg

SEQ ID NO: 953423 - RNA, 22 nt, Human
aggaagcugcuggaguagugug

SEQ ID NO: 953424 - RNA, 22 nt, Human
gcugggagucgcgucuguggcc

SEQ ID NO: 953425 - RNA, 19 nt, Human
gggcuuggggcugaagccu

SEQ ID NO: 953426 - RNA, 22 nt, Human
aacagacagaaaaaugugaucu

SEQ ID NO: 953427 - RNA, 22 nt, Human
ucaggcaguagaauugcuugaa

SEQ ID NO: 953428 - RNA, 22 nt, Human
caguacuuuucaaccaguauga

SEQ ID NO: 953429 - RNA, 22 nt, Human
ugcagccaggaaauauuugcug

SEQ ID NO: 953430 - RNA, 22 nt, Human
acuguguccuauuuccuugaca

SEQ ID NO: 953431 - RNA, 22 nt, Human
uggcucagcuuuccccaucugg

SEQ ID NO: 953432 - RNA, 22 nt, Human
ucuuugcaaaauacaacaaugg

SEQ ID NO: 953433 - RNA, 22 nt, Human
uagcacauuguugaccagaagg

SEQ ID NO: 953434 - RNA, 22 nt, Human
uaugcacaauaugaucuauuug

SEQ ID NO: 953435 - RNA, 22 nt, Human
ucuuccagcaaugugaaaucac

SEQ ID NO: 953436 - RNA, 22 nt, Human
cugcccugaccugccucagagu

SEQ ID NO: 953437 - RNA, 19 nt, Human
ggcauccagaacuaccagu

SEQ ID NO: 953438 - RNA, 22 nt, Human
aggcaacuuuuggggaugaugg

SEQ ID NO: 953439 - RNA, 23 nt, Human
accaggagccaagaucucccugg

SEQ ID NO: 953440 - RNA, 22 nt, Human
aaauacagcagacuccuguugu

SEQ ID NO: 953441 - RNA, 22 nt, Human
acagauauaaacuauaguagug

SEQ ID NO: 953442 - RNA, 22 nt, Human
ggagaggugaauggcugcucua

SEQ ID NO: 953443 - RNA, 22 nt, Human
aggcaagcauugggaacagggc

SEQ ID NO: 953444 - RNA, 22 nt, Human
aucaaaaccuugacuuuuaaug

SEQ ID NO: 953445 - RNA, 22 nt, Human
aaggcagccgugugacugcaug

SEQ ID NO: 953446 - RNA, 22 nt, Human
ucuucagagacucugagccccu

SEQ ID NO: 953447 - RNA, 22 nt, Human
caguuucuacgaaggucaaccc

SEQ ID NO: 953448 - RNA, 22 nt, Human
caggcagggagcuggaaaggau

SEQ ID NO: 953449 - RNA, 22 nt, Human
aaauuaguacauugcaaagucc

SEQ ID NO: 953450 - RNA, 22 nt, Human
ucucuuucuauaugugagucuu

SEQ ID NO: 953451 - RNA, 22 nt, Human
ggccugcuauuggugggcagac

SEQ ID NO: 953452 - RNA, 22 nt, Human
ccaaggagaaugacaccaugga

SEQ ID NO: 953453 - RNA, 20 nt, Human
auauguguacguguauacau

SEQ ID NO: 953454 - RNA, 22 nt, Human
ugcaccauguaaguggccacgu

SEQ ID NO: 953455 - RNA, 22 nt, Human
auguguguacacacgugacucu

SEQ ID NO: 953456 - RNA, 22 nt, Human
ggcucagggaaugaggaagaau

SEQ ID NO: 953457 - RNA, 22 nt, Human
agcagccauccuuagagaaaga

SEQ ID NO: 953458 - RNA, 22 nt, Human
gcagcuuggugaaaggugaugg

SEQ ID NO: 953459 - RNA, 22 nt, Human
cuggcccauggugagcucuggg

SEQ ID NO: 953460 - RNA, 22 nt, Human
cuucucagcaugguuacuguga

SEQ ID NO: 953461 - RNA, 22 nt, Human
ccugggaggcugugggucugcu

SEQ ID NO: 953462 - RNA, 22 nt, Human
agagauucauguuuacuguagg

SEQ ID NO: 953463 - RNA, 22 nt, Human
ugcucuggagggugaagcuuuu

SEQ ID NO: 953464 - RNA, 22 nt, Human
uauuuagaugcauuuggauugc

SEQ ID NO: 953465 - RNA, 22 nt, Human
agagauaugaguaguugugaca

SEQ ID NO: 953466 - RNA, 22 nt, Human
uuugaaaauuuaagugcuacac

SEQ ID NO: 953467 - RNA, 22 nt, Human
ugguuucccauuaucugcagga

SEQ ID NO: 953468 - RNA, 22 nt, Human
uguuccuaaauaugaauggaga

SEQ ID NO: 953469 - RNA, 22 nt, Human
ggcugggagcuggacaggccgg

SEQ ID NO: 953470 - RNA, 22 nt, Human
ggagggcugccagguggagcgg

SEQ ID NO: 953471 - RNA, 22 nt, Human
ggccucuggcaggcaggcccuc

SEQ ID NO: 953472 - RNA, 22 nt, Human
uucacagaauggcaaguuaugg

SEQ ID NO: 953473 - RNA, 22 nt, Human
ugggugcaugugagcacgugca

SEQ ID NO: 953474 - RNA, 22 nt, Human
cagcccaggccgacaguuccuc

SEQ ID NO: 953475 - RNA, 22 nt, Human
ucagggcaagucucagaagguu

SEQ ID NO: 953476 - RNA, 22 nt, Human
acacauuuacauguuuacguau

SEQ ID NO: 953477 - RNA, 22 nt, Human
gugcaugugucuuuauaguagc

SEQ ID NO: 953478 - RNA, 22 nt, Human
ugcagcccuuccuuccucuggg

SEQ ID NO: 953479 - RNA, 22 nt, Human
agccaggcugcaguuggcuggc

SEQ ID NO: 953480 - RNA, 22 nt, Human
acauuuacagugcuagacaauc

SEQ ID NO: 953481 - RNA, 22 nt, Human
agagaauuacagaagaauguca

SEQ ID NO: 953482 - RNA, 21 nt, Human
cucuuuauauaguaaagauau

SEQ ID NO: 953483 - RNA, 22 nt, Human
guuugcauguauuaagucaaua

SEQ ID NO: 953484 - RNA, 15 nt, Human
caggagaggaagguu

SEQ ID NO: 953485 - RNA, 22 nt, Human
uggcagcugucuguggggucuc

SEQ ID NO: 953486 - RNA, 22 nt, Human
ugcuugaaagggguuucccagu

SEQ ID NO: 953487 - RNA, 23 nt, Human
ccuggcagcaaacgaggagguua

SEQ ID NO: 953488 - RNA, 22 nt, Human
aagucaauuuauguucucagac

SEQ ID NO: 953489 - RNA, 22 nt, Human
uuuuccagagcugucucuugca

SEQ ID NO: 953490 - RNA, 22 nt, Human
acaaauauuuacugaauccacu

SEQ ID NO: 953491 - RNA, 22 nt, Human
gaggaguguauuccacaccacu

SEQ ID NO: 953492 - RNA, 22 nt, Human
uccuugaagcaacgugcagaca

SEQ ID NO: 953493 - RNA, 22 nt, Human
cuagccugggauuugaacuuau

SEQ ID NO: 953494 - RNA, 22 nt, Human
gcuggccugcugggcaccaccg

SEQ ID NO: 953495 - RNA, 21 nt, Human
aacugcuggucuuuucugucu

SEQ ID NO: 953496 - RNA, 22 nt, Human
cuggcugcaggaugaggcugcc

SEQ ID NO: 953497 - RNA, 22 nt, Human
acauuucuuccacaugcugcug

SEQ ID NO: 953498 - RNA, 22 nt, Human
acuaaggaauaugacaaacuca

SEQ ID NO: 953499 - RNA, 23 nt, Human
uuggcagcgggucaggcuguggg

SEQ ID NO: 953500 - RNA, 22 nt, Human
cucauggauauaagaacuguuu

SEQ ID NO: 953501 - RNA, 22 nt, Human
ggacucuguuuuccugaucacu

SEQ ID NO: 953502 - RNA, 22 nt, Human
ucccagccacagguguagcccu

SEQ ID NO: 953503 - RNA, 22 nt, Human
uuaaaugugauuucauuuaugu

SEQ ID NO: 953504 - RNA, 22 nt, Human
caaaagauacuugcaucuaacu

SEQ ID NO: 953505 - RNA, 22 nt, Human
ggcucugcugguaagaugccuc

SEQ ID NO: 953506 - RNA, 22 nt, Human
uguuuuaagggucaacugucac

SEQ ID NO: 953507 - RNA, 18 nt, Human
cuguucuagaacuccugu

SEQ ID NO: 953508 - RNA, 22 nt, Human
ucagcagucacauguuguccca

SEQ ID NO: 953509 - RNA, 22 nt, Human
aacuucaaaugugacuuugcau

SEQ ID NO: 953510 - RNA, 22 nt, Human
agaucucaccucuguguauuau

SEQ ID NO: 953511 - RNA, 22 nt, Human
aagaggaagucuccauggagag

SEQ ID NO: 953512 - RNA, 22 nt, Human
uugaagaggacuuugcagcugu

SEQ ID NO: 953513 - RNA, 22 nt, Human
aucuguuuaauucauuuucaca

SEQ ID NO: 953514 - RNA, 22 nt, Human
ugagaggcagaauggugccugc

SEQ ID NO: 953515 - RNA, 22 nt, Human
ggugaaggucagagcaggaaaa

SEQ ID NO: 953516 - RNA, 22 nt, Human
cuuugaaaacuuaaauaacagc

SEQ ID NO: 953517 - RNA, 22 nt, Human
caggugaccuuuguccuaaguu

SEQ ID NO: 953518 - RNA, 22 nt, Human
ccugguguugugaaguagccgu

SEQ ID NO: 953519 - RNA, 22 nt, Human
ccagcagagggucuuggccauu

SEQ ID NO: 953520 - RNA, 22 nt, Human
aggaaaaaagucugugauuaua

SEQ ID NO: 953521 - RNA, 21 nt, Human
gcagaggcacggcaccaaggg

SEQ ID NO: 953522 - RNA, 22 nt, Human
ccugaggggcugcaggccagcu

SEQ ID NO: 953523 - RNA, 22 nt, Human
aggcuuauuaauaugauucugc

SEQ ID NO: 953524 - RNA, 22 nt, Human
cagcagugucuccagcaucaca

SEQ ID NO: 953525 - RNA, 22 nt, Human
gcugggcugagcuagacuuggc

SEQ ID NO: 953526 - RNA, 21 nt, Human
uuuauguacuucauagaguag

SEQ ID NO: 953527 - RNA, 19 nt, Human
gcaggguguugacuguccc

SEQ ID NO: 953528 - RNA, 22 nt, Human
gcaggcagguggcaucuuguga

SEQ ID NO: 953529 - RNA, 21 nt, Human
uuccagagauuguuucaccug

SEQ ID NO: 953530 - RNA, 22 nt, Human
uuucaaugacacaaaagagaaa

SEQ ID NO: 953531 - RNA, 22 nt, Human
caggagcagaggguggucagca

SEQ ID NO: 953532 - RNA, 22 nt, Human
caucaucaaaacaaauggaguc

SEQ ID NO: 953533 - RNA, 22 nt, Human
uggggcugaggagccucacucu

SEQ ID NO: 953534 - RNA, 23 nt, Human
agcacagacuagaaaggucuuuc

SEQ ID NO: 953535 - RNA, 22 nt, Human
gucugaggaagaugcaggggga

SEQ ID NO: 953536 - RNA, 22 nt, Human
uggcagcauuaauuauucaggu

SEQ ID NO: 953537 - RNA, 19 nt, Human
ugggccugcaucugggucu

SEQ ID NO: 953538 - RNA, 22 nt, Human
uuuuuuaguuaggucagaaugu

SEQ ID NO: 953539 - RNA, 22 nt, Human
gggagccaugcuggucuucuuu

SEQ ID NO: 953540 - RNA, 22 nt, Human
auuugcuuaucuccacaguugu

SEQ ID NO: 953541 - RNA, 22 nt, Human
ucagagugguagccuauuuucu

SEQ ID NO: 953542 - RNA, 22 nt, Human
aguuugaaauguuggcaauauu

SEQ ID NO: 953543 - RNA, 22 nt, Human
guucccauacaguaucagugcu

SEQ ID NO: 953544 - RNA, 22 nt, Human
uggucaggcugcucugcggcgu

SEQ ID NO: 953545 - RNA, 22 nt, Human
aaguauauuuuuugaagcauau

SEQ ID NO: 953546 - RNA, 20 nt, Human
cuuugccuauucucugccug

SEQ ID NO: 953547 - RNA, 22 nt, Human
gggaggcuggcucuggccacag

SEQ ID NO: 953548 - RNA, 22 nt, Human
ucacucugauagauaagcuaac

SEQ ID NO: 953549 - RNA, 22 nt, Human
ggcugggcugcugggucagagc

SEQ ID NO: 953550 - RNA, 22 nt, Human
cuggaaggucuguccccacugc

SEQ ID NO: 953551 - RNA, 22 nt, Human
uuagugucuucuucauccucug

SEQ ID NO: 953552 - RNA, 20 nt, Human
ugcagcugguuucacaggga

SEQ ID NO: 953553 - RNA, 22 nt, Human
agccucugguccucccucagcu

SEQ ID NO: 953554 - RNA, 21 nt, Human
cugugcuuuuuaagugugaug

SEQ ID NO: 953555 - RNA, 22 nt, Human
ccacugaggcaggcaguaucua

SEQ ID NO: 953556 - RNA, 21 nt, Human
auuuggcaaaggcgaugcaca

SEQ ID NO: 953557 - RNA, 22 nt, Human
agccuggcacugaggcagggcg

SEQ ID NO: 953558 - RNA, 22 nt, Human
gacagggcauggugcagaguuc

SEQ ID NO: 953559 - RNA, 22 nt, Human
acauauuuccaugcagcauguc

SEQ ID NO: 953560 - RNA, 22 nt, Human
guuccaaacaagucauaaagua

SEQ ID NO: 953561 - RNA, 22 nt, Human
ugaucagucccaugaucuucca

SEQ ID NO: 953562 - RNA, 22 nt, Human
ugcugcuccugccuggcuccca

SEQ ID NO: 953563 - RNA, 22 nt, Human
cagagguagccgagugcaaucg

SEQ ID NO: 953564 - RNA, 19 nt, Human
agaggcugucaccuguagc

SEQ ID NO: 953565 - RNA, 22 nt, Human
uuucuguaauuaaaagggcagg

SEQ ID NO: 953566 - RNA, 22 nt, Human
gaggcagagaccuucaggaccu

SEQ ID NO: 953567 - RNA, 22 nt, Human
ggagaaggugcuggucacugug

SEQ ID NO: 953568 - RNA, 21 nt, Human
gcacagcaugaguguuggcau

SEQ ID NO: 953569 - RNA, 22 nt, Human
gccaggaggucagccccucaac

SEQ ID NO: 953570 - RNA, 22 nt, Human
uacacuuuuuacuacagauucu

SEQ ID NO: 953571 - RNA, 22 nt, Human
cgagaguggacagggcgcagcu

SEQ ID NO: 953572 - RNA, 22 nt, Human
gacggcagaaacucaugagguc

SEQ ID NO: 953573 - RNA, 22 nt, Human
cucugugggggagaggcagcug

SEQ ID NO: 953574 - RNA, 22 nt, Human
cagaggcagacccuccagggcg

SEQ ID NO: 953575 - RNA, 22 nt, Human
aggcugcuggcaggcguggacg

SEQ ID NO: 953576 - RNA, 22 nt, Human
uuucuucuugauuuaaacaggg

SEQ ID NO: 953577 - RNA, 22 nt, Human
cccagcucaucaggagccgccc

SEQ ID NO: 953578 - RNA, 22 nt, Human
uaugagcuuccaguguugcaug

SEQ ID NO: 953579 - RNA, 22 nt, Human
auuaggacagagaugucaagag

SEQ ID NO: 953580 - RNA, 19 nt, Human
ggacacagaaagcugcauu

SEQ ID NO: 953581 - RNA, 22 nt, Human
augaugguaaauucaguauccg

SEQ ID NO: 953582 - RNA, 22 nt, Human
ugcuagaauaccuaccuggagg

SEQ ID NO: 953583 - RNA, 22 nt, Human
uagcugccuagacagcuauagc

SEQ ID NO: 953584 - RNA, 22 nt, Human
caggagacaauggcuguggggc

SEQ ID NO: 953585 - RNA, 22 nt, Human
agaauucuguucuucgggugug

SEQ ID NO: 953586 - RNA, 16 nt, Human
auucacaaggcaucgg

SEQ ID NO: 953587 - RNA, 22 nt, Human
gacccaggguuucugcacaggg

SEQ ID NO: 953588 - RNA, 22 nt, Human
agguggagacccagagaaggcg

SEQ ID NO: 953589 - RNA, 22 nt, Human
ggcuggccuguguggccgccac

SEQ ID NO: 953590 - RNA, 22 nt, Human
ugccuggcaaugccagaagcca

SEQ ID NO: 953591 - RNA, 22 nt, Human
acagagcaugcucaguguguga

SEQ ID NO: 953592 - RNA, 22 nt, Human
cagucucuaaaucaaucugaau

SEQ ID NO: 953593 - RNA, 22 nt, Human
gauuauguucgacuuuagaaau

SEQ ID NO: 953594 - RNA, 22 nt, Human
gccuccugagaagccacaggcu

SEQ ID NO: 953595 - RNA, 22 nt, Human
aaaggccaugguuggaguguuu

SEQ ID NO: 953596 - RNA, 21 nt, Human
uggcucuguucaauauaugga

SEQ ID NO: 953597 - RNA, 22 nt, Human
ccagcccugaacccugcugcau

SEQ ID NO: 953598 - RNA, 22 nt, Human
ggcagcuggccuccucgcccac

SEQ ID NO: 953599 - RNA, 22 nt, Human
uggccugccucccggcuucuuu

SEQ ID NO: 953600 - RNA, 22 nt, Human
gggcuggcaucaguugccgaga

SEQ ID NO: 953601 - RNA, 22 nt, Human
aggcccugaccugggagaucua

SEQ ID NO: 953602 - RNA, 22 nt, Human
uagcugccauugcuccaggaag

SEQ ID NO: 953603 - RNA, 22 nt, Human
uguaagauaugaguacauguaa

SEQ ID NO: 953604 - RNA, 22 nt, Human
uauuugaaaguguacaaaaacu

SEQ ID NO: 953605 - RNA, 22 nt, Human
ugcugagguuucgucugcuugc

SEQ ID NO: 953606 - RNA, 22 nt, Human
agaauuuuugauuaucuacucg

SEQ ID NO: 953607 - RNA, 22 nt, Human
ggaggccaccugaccugcuguu

SEQ ID NO: 953608 - RNA, 22 nt, Human
agucucugagguucagaugccu

SEQ ID NO: 953609 - RNA, 19 nt, Human
aaaugugaugguacaauuc

SEQ ID NO: 953610 - RNA, 22 nt, Human
cuucuucaaccugaaaguuuca

SEQ ID NO: 953611 - RNA, 22 nt, Human
aguggggaagagcaugggcccu

SEQ ID NO: 953612 - RNA, 22 nt, Human
ccugucugagccagggugggca

SEQ ID NO: 953613 - RNA, 22 nt, Human
aagauuuagggccaguuuacau

SEQ ID NO: 953614 - RNA, 21 nt, Human
cacugcagccuugaccugggc

SEQ ID NO: 953615 - RNA, 22 nt, Human
augugucuuauuugauuccaca

SEQ ID NO: 953616 - RNA, 22 nt, Human
cgaggcagaggcugaaacggcu

SEQ ID NO: 953617 - RNA, 22 nt, Human
ugucucaguucccuucucugga

SEQ ID NO: 953618 - RNA, 22 nt, Human
aaguugagaugucauaggagac

SEQ ID NO: 953619 - RNA, 22 nt, Human
aaucuguucuacucuauucaga

SEQ ID NO: 953620 - RNA, 22 nt, Human
gucccucugugucccugcaguc

SEQ ID NO: 953621 - RNA, 22 nt, Human
uggcccugaaucaaggccagca

SEQ ID NO: 953622 - RNA, 22 nt, Human
aggccuggccccaguugcuagg

SEQ ID NO: 953623 - RNA, 16 nt, Human
agcagccagcacugga

SEQ ID NO: 953624 - RNA, 22 nt, Human
acagucucuccacacugcaggg

SEQ ID NO: 953625 - RNA, 22 nt, Human
cugggugaguugaugaaggaga

SEQ ID NO: 953626 - RNA, 22 nt, Human
ccaggccagagugcaguggcac

SEQ ID NO: 953627 - RNA, 22 nt, Human
gaggauggaggugugagcuaug

SEQ ID NO: 953628 - RNA, 22 nt, Human
ccugugugcacacgaggccaug

SEQ ID NO: 953629 - RNA, 22 nt, Human
aggacucaucccugcuugucag

SEQ ID NO: 953630 - RNA, 22 nt, Human
uggcagggaguugcaggauuuc

SEQ ID NO: 953631 - RNA, 19 nt, Human
caagugaagccugggaugg

SEQ ID NO: 953632 - RNA, 22 nt, Human
ggcuccuguggcaagacagcuu

SEQ ID NO: 953633 - RNA, 22 nt, Human
uuuagaaauugcagagugggug

SEQ ID NO: 953634 - RNA, 22 nt, Human
caaaauugauuguggugauggu

SEQ ID NO: 953635 - RNA, 16 nt, Human
ucccaggaggcggaac

SEQ ID NO: 953636 - RNA, 22 nt, Human
uuaugcuaagugcaacaagcca

SEQ ID NO: 953637 - RNA, 22 nt, Human
uaaaagacauauaacuguagga

SEQ ID NO: 953638 - RNA, 22 nt, Human
uccugucagugaggcagaugaa

SEQ ID NO: 953639 - RNA, 22 nt, Human
gcaccugggacccagaggcacc

SEQ ID NO: 953640 - RNA, 22 nt, Human
uucacauugugcagauuauggu

SEQ ID NO: 953641 - RNA, 22 nt, Human
agggauggaagacuugaagacc

SEQ ID NO: 953642 - RNA, 22 nt, Human
uuguuuuggagaugagcuaaaa

SEQ ID NO: 953643 - RNA, 22 nt, Human
auuugucuuugagugcccugcu

SEQ ID NO: 953644 - RNA, 18 nt, Human
ucuuccaacacugacacc

SEQ ID NO: 953645 - RNA, 22 nt, Human
uuuacuuuugguaaggucauuu

SEQ ID NO: 953646 - RNA, 22 nt, Human
gcugucuggaggcucugaggga

SEQ ID NO: 953647 - RNA, 22 nt, Human
ccaggugggaggaaagcagaga

SEQ ID NO: 953648 - RNA, 22 nt, Human
ugaguuuugucuugcuagaagu

SEQ ID NO: 953649 - RNA, 21 nt, Human
ugcagagauaucugaagcaga

SEQ ID NO: 953650 - RNA, 22 nt, Human
gccuuccuuuuaccaccagcca

SEQ ID NO: 953651 - RNA, 22 nt, Human
cauggcagagccugcagguggg

SEQ ID NO: 953652 - RNA, 22 nt, Human
uggcagcuauggucuaagggcc

SEQ ID NO: 953653 - RNA, 22 nt, Human
aggcuggcuggcaggggacaca

SEQ ID NO: 953654 - RNA, 23 nt, Human
aguguuccaguugguugagagug

SEQ ID NO: 953655 - RNA, 22 nt, Human
agccaagcugaucuccugcuga

SEQ ID NO: 953656 - RNA, 22 nt, Human
acagaguaucuaucaggaguau

SEQ ID NO: 953657 - RNA, 22 nt, Human
cauucuuacacaauauuuuaau

SEQ ID NO: 953658 - RNA, 22 nt, Human
uuagcaucugcuguaagcuuau

SEQ ID NO: 953659 - RNA, 22 nt, Human
gcaaggcagcgcggaguagcua

SEQ ID NO: 953660 - RNA, 22 nt, Human
ggcuucccagcagagggcgcac

SEQ ID NO: 953661 - RNA, 22 nt, Human
acuacuuugggccauuuguuua

SEQ ID NO: 953662 - RNA, 22 nt, Human
caggaugggauguagugggccc

SEQ ID NO: 953663 - RNA, 22 nt, Human
aggcccaguuauccuacuuguu

SEQ ID NO: 953664 - RNA, 22 nt, Human
gguggccuccagggcauaggug

SEQ ID NO: 953665 - RNA, 22 nt, Human
gcccaggaugguguguaguggu

SEQ ID NO: 953666 - RNA, 22 nt, Human
agacgagggcccccaggacagc

SEQ ID NO: 953667 - RNA, 22 nt, Human
ugcagaagaccuuccagggcug

SEQ ID NO: 953668 - RNA, 22 nt, Human
uagagugguuaacaguuuagaa

SEQ ID NO: 953669 - RNA, 22 nt, Human
aggaguguggccagggcucugg

SEQ ID NO: 953670 - RNA, 22 nt, Human
uccucucagugugguuguggga

SEQ ID NO: 953671 - RNA, 22 nt, Human
agaggccugugugcuccagugg

SEQ ID NO: 953672 - RNA, 23 nt, Human
aggagccaggugcagcccuugug

SEQ ID NO: 953673 - RNA, 22 nt, Human
uaacuccacaccccucuuggug

SEQ ID NO: 953674 - RNA, 22 nt, Human
ugggcugcuuccucagcugaga

SEQ ID NO: 953675 - RNA, 22 nt, Human
guaagucugaguguaauucaca

SEQ ID NO: 953676 - RNA, 22 nt, Human
aaugauggauuuagacaagcug

SEQ ID NO: 953677 - RNA, 22 nt, Human
uuuucuuaugugcagcuauaug

SEQ ID NO: 953678 - RNA, 20 nt, Human
cuggcaggagcgagucuacc

SEQ ID NO: 953679 - RNA, 22 nt, Human
gggcugcugcccaggaggcacc

SEQ ID NO: 953680 - RNA, 21 nt, Human
guuuuaagggagaaaaccuag

SEQ ID NO: 953681 - RNA, 22 nt, Human
cccaggcuggauuucgguggca

SEQ ID NO: 953682 - RNA, 22 nt, Human
ucagaaguacugugcuacaaua

SEQ ID NO: 953683 - RNA, 22 nt, Human
agcugcagagguuugugcaaca

SEQ ID NO: 953684 - RNA, 22 nt, Human
aggagcugcaaauauuaguaau

SEQ ID NO: 953685 - RNA, 22 nt, Human
caagaaauguuuacugagcauc

SEQ ID NO: 953686 - RNA, 22 nt, Human
cugggcuggagugcaauggcgc

SEQ ID NO: 953687 - RNA, 20 nt, Human
gacaucauguacacauugcc

SEQ ID NO: 953688 - RNA, 23 nt, Human
uugaaggagaaagcuuucuuggu

SEQ ID NO: 953689 - RNA, 22 nt, Human
guuguuuuuguucucuauagcu

SEQ ID NO: 953690 - RNA, 22 nt, Human
cucuugggauuugcaggcucag

SEQ ID NO: 953691 - RNA, 22 nt, Human
ggcugccacgucgaggguccaa

SEQ ID NO: 953692 - RNA, 22 nt, Human
gcucucagguacaaagcugugu

SEQ ID NO: 953693 - RNA, 22 nt, Human
agaggauguucuaggcacucau

SEQ ID NO: 953694 - RNA, 22 nt, Human
ugugcugguacaugugaggaug

SEQ ID NO: 953695 - RNA, 22 nt, Human
cugugccuaagaugcaugucuc

SEQ ID NO: 953696 - RNA, 22 nt, Human
cgccucagccguggucaucuuc

SEQ ID NO: 953697 - RNA, 20 nt, Human
uuucugugcccaggucuguu

SEQ ID NO: 953698 - RNA, 22 nt, Human
ugccaggcuaaguggaggacuu

SEQ ID NO: 953699 - RNA, 20 nt, Human
acagaaagagagaaugucag

SEQ ID NO: 953700 - RNA, 22 nt, Human
auuaaauuaaguggcuaauuua

SEQ ID NO: 953701 - RNA, 22 nt, Human
gcugagguggcugccuuaguaa

SEQ ID NO: 953702 - RNA, 22 nt, Human
cuguacaucccgagagccagua

SEQ ID NO: 953703 - RNA, 22 nt, Human
cugcucuguuucuuagcugggu

SEQ ID NO: 953704 - RNA, 19 nt, Human
ggcugucuggcguguggau

SEQ ID NO: 953705 - RNA, 22 nt, Human
ugucucagaauggcucauaaua

SEQ ID NO: 953706 - RNA, 22 nt, Human
acauuucuggaguuucucaaca

SEQ ID NO: 953707 - RNA, 20 nt, Human
ccucaggaugagggugagca

SEQ ID NO: 953708 - RNA, 22 nt, Human
cagcuggccugaucccuguggc

SEQ ID NO: 953709 - RNA, 22 nt, Human
ucagagaguuacacaaauuguu

SEQ ID NO: 953710 - RNA, 22 nt, Human
cuuauguacacacauauauugu

SEQ ID NO: 953711 - RNA, 22 nt, Human
gugcagugaaaaaagaaugucc

SEQ ID NO: 953712 - RNA, 22 nt, Human
gcagaggagcaaguugcuacag

SEQ ID NO: 953713 - RNA, 22 nt, Human
aaaaaugucauuauggaacuga

SEQ ID NO: 953714 - RNA, 22 nt, Human
ugggagcucagaaagggagguc

SEQ ID NO: 953715 - RNA, 19 nt, Human
ggcucagggcgcugccgcc

SEQ ID NO: 953716 - RNA, 22 nt, Human
auaugcacauacauacauaggu

SEQ ID NO: 953717 - RNA, 22 nt, Human
uggcucaguuaggucagaaaca

SEQ ID NO: 953718 - RNA, 22 nt, Human
ggggagaguccuuuccaguucc

SEQ ID NO: 953719 - RNA, 22 nt, Human
uugccacugaaccagucuugca

SEQ ID NO: 953720 - RNA, 19 nt, Human
ugccuggcaccagcuccac

SEQ ID NO: 953721 - RNA, 22 nt, Human
cccuccagagcuugaccugcug

SEQ ID NO: 953722 - RNA, 18 nt, Human
cagaaguccuucaaggcc

SEQ ID NO: 953723 - RNA, 22 nt, Human
uacauuuggaugugcuuaagug

SEQ ID NO: 953724 - RNA, 22 nt, Human
aacucagcauccugcacagaga

SEQ ID NO: 953725 - RNA, 18 nt, Human
ggcaucugcacagcagcc

SEQ ID NO: 953726 - RNA, 22 nt, Human
cagguacacucccuugugcuga

SEQ ID NO: 953727 - RNA, 22 nt, Human
aaaauuauucauggcuuuugga

SEQ ID NO: 953728 - RNA, 22 nt, Human
aaagcagacugauuugcaucac

SEQ ID NO: 953729 - RNA, 22 nt, Human
cucugugauuuugugagccaga

SEQ ID NO: 953730 - RNA, 22 nt, Human
gugcauuuggugacucucaccc

SEQ ID NO: 953731 - RNA, 22 nt, Human
aagggcaggagaagacggauau

SEQ ID NO: 953732 - RNA, 22 nt, Human
ucaggagagagaaauuggggcu

SEQ ID NO: 953733 - RNA, 20 nt, Human
auuugcaucugaauaacuua

SEQ ID NO: 953734 - RNA, 22 nt, Human
ugaggcacaggcagugcccccg

SEQ ID NO: 953735 - RNA, 22 nt, Human
auggcucauuuaucuugcagcc

SEQ ID NO: 953736 - RNA, 22 nt, Human
cuggcuuccaugcuguaguggc

SEQ ID NO: 953737 - RNA, 22 nt, Human
uaagacaugguugaucuagugu

SEQ ID NO: 953738 - RNA, 22 nt, Human
uauucacuguaacucagcaaua

SEQ ID NO: 953739 - RNA, 22 nt, Human
gccugggaaaugguggggucag

SEQ ID NO: 953740 - RNA, 22 nt, Human
cccugccuugggguccacaccg

SEQ ID NO: 953741 - RNA, 22 nt, Human
ccugugggaggggccuggcgcg

SEQ ID NO: 953742 - RNA, 22 nt, Human
gugcugggauuacaggugugag

SEQ ID NO: 953743 - RNA, 22 nt, Human
uauguacagggauagaacuuga

SEQ ID NO: 953744 - RNA, 22 nt, Human
ggucccaggcucccucuugucc

SEQ ID NO: 953745 - RNA, 22 nt, Human
ggcaaggccaggccuccaagac

SEQ ID NO: 953746 - RNA, 22 nt, Human
auucugagacaauugccgucag

SEQ ID NO: 953747 - RNA, 22 nt, Human
guccaugacugugacucacaug

SEQ ID NO: 953748 - RNA, 22 nt, Human
uaaaugaagaaauggagauugu

SEQ ID NO: 953749 - RNA, 22 nt, Human
uuauuuaauuuucucacucaga

SEQ ID NO: 953750 - RNA, 22 nt, Human
gcucccagaaccaaggcugggg

SEQ ID NO: 953751 - RNA, 21 nt, Human
uggcugcuggcccucucucca

SEQ ID NO: 953752 - RNA, 22 nt, Human
gagggcauaguuaaauaggagg

SEQ ID NO: 953753 - RNA, 22 nt, Human
cugcugugcaacauugcaccua

SEQ ID NO: 953754 - RNA, 22 nt, Human
cuucugugcuucacaguugcca

SEQ ID NO: 953755 - RNA, 22 nt, Human
ucccaguguggcaggccaugga

SEQ ID NO: 953756 - RNA, 22 nt, Human
ucaaguguaguggugucagguc

SEQ ID NO: 953757 - RNA, 22 nt, Human
cagguaggauggaagggcucaa

SEQ ID NO: 953758 - RNA, 20 nt, Human
guggccuguccuguuguggg

SEQ ID NO: 953759 - RNA, 22 nt, Human
guggccucuguuggcuccuagg

SEQ ID NO: 953760 - RNA, 22 nt, Human
uuuccagguauuaauacuguau

SEQ ID NO: 953761 - RNA, 22 nt, Human
gccugcagaacugugaggcaau

SEQ ID NO: 953762 - RNA, 22 nt, Human
ccuggccagccagggcuggggu

SEQ ID NO: 953763 - RNA, 22 nt, Human
ccagagacgucggucagggcgc

SEQ ID NO: 953764 - RNA, 22 nt, Human
aagaugcuuauugcuccugcag

SEQ ID NO: 953765 - RNA, 22 nt, Human
aagauuuacuagcauaauagcu

SEQ ID NO: 953766 - RNA, 23 nt, Human
ugcagccacucaggagcucagug

SEQ ID NO: 953767 - RNA, 22 nt, Human
cauuucugcagaauugcucuuc

SEQ ID NO: 953768 - RNA, 22 nt, Human
gacagcagggacauguaggaag

SEQ ID NO: 953769 - RNA, 22 nt, Human
ggccugcuggcuccagcgcccg

SEQ ID NO: 953770 - RNA, 23 nt, Human
cagggccaggcagcagcugucac

SEQ ID NO: 953771 - RNA, 22 nt, Human
caggggcucccugggugccagu

SEQ ID NO: 953772 - RNA, 22 nt, Human
cucaaggaaagucuggagaaga

SEQ ID NO: 953773 - RNA, 22 nt, Human
ggcagcuucucccaggcuguuu

SEQ ID NO: 953774 - RNA, 22 nt, Human
cagggugcagugucgcugcuag

SEQ ID NO: 953775 - RNA, 22 nt, Human
ugcagcugcuggcccaggugcu

SEQ ID NO: 953776 - RNA, 22 nt, Human
cugcaggcccccuuccuggagu

SEQ ID NO: 953777 - RNA, 22 nt, Human
aggaagccuggggcugcccucg

SEQ ID NO: 953778 - RNA, 22 nt, Human
ucccagagcucugacaccagcu

SEQ ID NO: 953779 - RNA, 22 nt, Human
aggucauuuccuuagaggcaga

SEQ ID NO: 953780 - RNA, 22 nt, Human
ccagguggacggcgaguacagg

SEQ ID NO: 953781 - RNA, 22 nt, Human
gagcaccgccuccacgaugccc

SEQ ID NO: 953782 - RNA, 22 nt, Human
uucaggauucucucccauuuac

SEQ ID NO: 953783 - RNA, 22 nt, Human
uuugaaagggaaauaaacuccu

SEQ ID NO: 953784 - RNA, 19 nt, Human
gagaggccugugcuugaag

SEQ ID NO: 953785 - RNA, 22 nt, Human
agggagacacaugaggaaguca

SEQ ID NO: 953786 - RNA, 22 nt, Human
ggcucagacucccaggcccucu

SEQ ID NO: 953787 - RNA, 22 nt, Human
auucuucauacagacaaguccu

SEQ ID NO: 953788 - RNA, 23 nt, Human
uggggcugauggagacggaccag

SEQ ID NO: 953789 - RNA, 22 nt, Human
agagugaaguucaucgugcagc

SEQ ID NO: 953790 - RNA, 21 nt, Human
gccuggcagguggaagggcuc

SEQ ID NO: 953791 - RNA, 22 nt, Human
gaauacauuggaaaucagaaua

SEQ ID NO: 953792 - RNA, 22 nt, Human
gcaggcaggagcccaacugccu

SEQ ID NO: 953793 - RNA, 21 nt, Human
uggcagggguaguaguacagc

SEQ ID NO: 953794 - RNA, 22 nt, Human
ugccugugguuccaguuuuuuc

SEQ ID NO: 953795 - RNA, 22 nt, Human
cuggcuccacucccugccugac

SEQ ID NO: 953796 - RNA, 22 nt, Human
agaggcuggauugagcauagac

SEQ ID NO: 953797 - RNA, 22 nt, Human
ugggagagugcucaaugugcaa

SEQ ID NO: 953798 - RNA, 22 nt, Human
gagccaggcaccuucuguguug

SEQ ID NO: 953799 - RNA, 22 nt, Human
uggcagcaaguucuugggaggu

SEQ ID NO: 953800 - RNA, 22 nt, Human
agcaggugacccaagcaggcug

SEQ ID NO: 953801 - RNA, 22 nt, Human
aggcucuggaguguggugcugg

SEQ ID NO: 953802 - RNA, 22 nt, Human
ugggugagugggaaaagcccag

SEQ ID NO: 953803 - RNA, 20 nt, Human
cugggcucgguggcccuggc

SEQ ID NO: 953804 - RNA, 22 nt, Human
cacauccuucagcugagcccag

SEQ ID NO: 953805 - RNA, 22 nt, Human
ccaguucuaaacauaaagcuaa

SEQ ID NO: 953806 - RNA, 22 nt, Human
auguuacagaaagcaaagauga

SEQ ID NO: 953807 - RNA, 22 nt, Human
cucuuuccaggguaccccaggu

SEQ ID NO: 953808 - RNA, 22 nt, Human
uaagaacaagauguuccuguuu

SEQ ID NO: 953809 - RNA, 22 nt, Human
ccugcucagagcgucuugugug

SEQ ID NO: 953810 - RNA, 22 nt, Human
aacaucuacagugagauguuag

SEQ ID NO: 953811 - RNA, 22 nt, Human
uugaaauacugcauuguucagu

SEQ ID NO: 953812 - RNA, 22 nt, Human
cccauuuagauaacaguucaaa

SEQ ID NO: 953813 - RNA, 22 nt, Human
cagacagaccugcaagggcaca

SEQ ID NO: 953814 - RNA, 22 nt, Human
uucaggauaugugauaucugaa

SEQ ID NO: 953815 - RNA, 22 nt, Human
cuggugggagcagcaggcagcu

SEQ ID NO: 953816 - RNA, 22 nt, Human
acauacaucaaguaucacaaga

SEQ ID NO: 953817 - RNA, 19 nt, Human
uggcugggugccaauggcc

SEQ ID NO: 953818 - RNA, 22 nt, Human
cagggccagccauccugcuggg

SEQ ID NO: 953819 - RNA, 22 nt, Human
cccaggcugauguucagcgggu

SEQ ID NO: 953820 - RNA, 22 nt, Human
uguuuacaaggagaauuugagg

SEQ ID NO: 953821 - RNA, 23 nt, Human
uggccacagggugcuccauugua

SEQ ID NO: 953822 - RNA, 22 nt, Human
cugugucccccucagccaggug

SEQ ID NO: 953823 - RNA, 19 nt, Human
uagucuuuauucuuaauuu

SEQ ID NO: 953824 - RNA, 22 nt, Human
uuugcauuuauaaguuggugga

SEQ ID NO: 953825 - RNA, 22 nt, Human
uaaacaugugagugugcauaua

SEQ ID NO: 953826 - RNA, 22 nt, Human
gguggguauaguuagggccucu

SEQ ID NO: 953827 - RNA, 22 nt, Human
acagaggccccgugggagagcc

SEQ ID NO: 953828 - RNA, 22 nt, Human
cugggagcuggaugcccugccc

SEQ ID NO: 953829 - RNA, 18 nt, Human
uccugccugcgggcuccc

SEQ ID NO: 953830 - RNA, 22 nt, Human
ucucagaggcccgacguucucc

SEQ ID NO: 953831 - RNA, 22 nt, Human
ggugucccaggccagcugugug

SEQ ID NO: 953832 - RNA, 22 nt, Human
uacagucuuuggaaagagauag

SEQ ID NO: 953833 - RNA, 22 nt, Human
cccagggacagaugggcagcua

SEQ ID NO: 953834 - RNA, 17 nt, Human
cgagggcuugcuggcuc

SEQ ID NO: 953835 - RNA, 22 nt, Human
aaauaugaaugauaagaguuau

SEQ ID NO: 953836 - RNA, 22 nt, Human
gcccagcuggcuuccagcacau

SEQ ID NO: 953837 - RNA, 17 nt, Human
cucugcagugcauggcu

SEQ ID NO: 953838 - RNA, 22 nt, Human
cuguccucuguccucagcagga

SEQ ID NO: 953839 - RNA, 22 nt, Human
aaauaguucagcuuguaaaccc

SEQ ID NO: 953840 - RNA, 22 nt, Human
uauaguaaaauuuucauuuaug

SEQ ID NO: 953841 - RNA, 22 nt, Human
uagauuuccucuuccucauucc

SEQ ID NO: 953842 - RNA, 22 nt, Human
acauuugugcacaugugcaugg

SEQ ID NO: 953843 - RNA, 22 nt, Human
uaugcacaccuggguccuuguc

SEQ ID NO: 953844 - RNA, 22 nt, Human
uauguguacaucugguugagca

SEQ ID NO: 953845 - RNA, 22 nt, Human
caggugcuguccugcacauguc

SEQ ID NO: 953846 - RNA, 22 nt, Human
gcagagccaggagcccaggauc

SEQ ID NO: 953847 - RNA, 22 nt, Human
cccagccugugacagccguccu

SEQ ID NO: 953848 - RNA, 22 nt, Human
aggagacauaacuaugaugaga

SEQ ID NO: 953849 - RNA, 22 nt, Human
uggcgugcccuccagacuuggc

SEQ ID NO: 953850 - RNA, 22 nt, Human
guacaaaguggaccugauagua

SEQ ID NO: 953851 - RNA, 22 nt, Human
gccagacacuccccugggcagg

SEQ ID NO: 953852 - RNA, 22 nt, Human
gccagcagcccagaaggacuuu

SEQ ID NO: 953853 - RNA, 22 nt, Human
agauaugacuagaagcucauuu

SEQ ID NO: 953854 - RNA, 17 nt, Human
ccagguggaaucgugga

SEQ ID NO: 953855 - RNA, 22 nt, Human
aagauucuacaguagguacauu

SEQ ID NO: 953856 - RNA, 22 nt, Human
gagggaggugauacugaacgua

SEQ ID NO: 953857 - RNA, 22 nt, Human
acguguucaauuuccaucugac

SEQ ID NO: 953858 - RNA, 22 nt, Human
uuaacauuguccuuagcagauu

SEQ ID NO: 953859 - RNA, 20 nt, Human
auugucagccuucagaggag

SEQ ID NO: 953860 - RNA, 18 nt, Human
aucucccauuggccaagg

SEQ ID NO: 953861 - RNA, 22 nt, Human
ucuccugguauguaugcaccug

SEQ ID NO: 953862 - RNA, 22 nt, Human
cacauuucucuaccucacacaa

SEQ ID NO: 953863 - RNA, 22 nt, Human
ggcugccuucccugagccccgg

SEQ ID NO: 953864 - RNA, 22 nt, Human
cagccagccucucaaccaugca

SEQ ID NO: 953865 - RNA, 22 nt, Human
ugcauuguuugauaggugaauu

SEQ ID NO: 953866 - RNA, 22 nt, Human
cccaggagguggagguugcggu

SEQ ID NO: 953867 - RNA, 20 nt, Human
caggccagagguuugauggc

SEQ ID NO: 953868 - RNA, 20 nt, Human
acuguucaagggccuggugg

SEQ ID NO: 953869 - RNA, 22 nt, Human
uaaucacaucaggguaaauggg

SEQ ID NO: 953870 - RNA, 22 nt, Human
agcugccugggcuuguacaccu

SEQ ID NO: 953871 - RNA, 22 nt, Human
aggccagccucaggcagggacc

SEQ ID NO: 953872 - RNA, 22 nt, Human
agcugucuuucugccuccugau

SEQ ID NO: 953873 - RNA, 22 nt, Human
ccacaggggucucuguagcuga

SEQ ID NO: 953874 - RNA, 23 nt, Human
ucccuggaggcagguccagggcc

SEQ ID NO: 953875 - RNA, 22 nt, Human
gaaggcugaugacagauucugc

SEQ ID NO: 953876 - RNA, 22 nt, Human
aaguuauugcagcaauccaagu

SEQ ID NO: 953877 - RNA, 21 nt, Human
cucaggaucuuauauauuagu

SEQ ID NO: 953878 - RNA, 22 nt, Human
gcaccugcaggaugagccaggg

SEQ ID NO: 953879 - RNA, 22 nt, Human
cagagcagaaaccugggugauu

SEQ ID NO: 953880 - RNA, 22 nt, Human
aaucagaauuuauugaaucuuu

SEQ ID NO: 953881 - RNA, 22 nt, Human
uggaaagaaaguaaaggcguau

SEQ ID NO: 953882 - RNA, 19 nt, Human
ggcugccuuuccuuaccag

SEQ ID NO: 953883 - RNA, 22 nt, Human
ucuuucagccacuuaccugucu

SEQ ID NO: 953884 - RNA, 22 nt, Human
cacccagccuucacacaggagu

SEQ ID NO: 953885 - RNA, 19 nt, Human
cugggacaaugaaagcauc

SEQ ID NO: 953886 - RNA, 22 nt, Human
agcccaagcauaggagggaggc

SEQ ID NO: 953887 - RNA, 21 nt, Human
ucccugcuuucuggcccaguc

SEQ ID NO: 953888 - RNA, 22 nt, Human
agcuagccuaggcagagugcau

SEQ ID NO: 953889 - RNA, 22 nt, Human
ucauuuaauagcuuuugucuuu

SEQ ID NO: 953890 - RNA, 22 nt, Human
agggcuggcuccguuaccuuga

SEQ ID NO: 953891 - RNA, 22 nt, Human
uggacucagaaguguucuuuua

SEQ ID NO: 953892 - RNA, 22 nt, Human
ggcacugaauuucuuggcaucu

SEQ ID NO: 953893 - RNA, 22 nt, Human
gaggcagcaucuauggugggaa

SEQ ID NO: 953894 - RNA, 19 nt, Human
ucaguuuuagucaucaguu

SEQ ID NO: 953895 - RNA, 22 nt, Human
cagacaggcuagccagacucac

SEQ ID NO: 953896 - RNA, 19 nt, Human
ccuuugaaucaggacacuu

SEQ ID NO: 953897 - RNA, 22 nt, Human
aggcacugaauauccaguaaaa

SEQ ID NO: 953898 - RNA, 22 nt, Human
gggagggguugcauguuugagu

SEQ ID NO: 953899 - RNA, 22 nt, Human
ggggcagagucuggacuguugu

SEQ ID NO: 953900 - RNA, 19 nt, Human
ugaagcaggcagagaagau

SEQ ID NO: 953901 - RNA, 22 nt, Human
gagagugauucccucccauaga

SEQ ID NO: 953902 - RNA, 22 nt, Human
ugggcaaguaucggacucugag

SEQ ID NO: 953903 - RNA, 22 nt, Human
cagcugcccaagccccagaugu

SEQ ID NO: 953904 - RNA, 22 nt, Human
aacaaauguguggcaguguggg

SEQ ID NO: 953905 - RNA, 22 nt, Human
aguuuccaaagcauguucacac

SEQ ID NO: 953906 - RNA, 22 nt, Human
cagagcuguugcggggcuuggc

SEQ ID NO: 953907 - RNA, 22 nt, Human
gcucugugccacaugcaguguu

SEQ ID NO: 953908 - RNA, 22 nt, Human
ucacaugccacagaugaggcaa

SEQ ID NO: 953909 - RNA, 22 nt, Human
uauaugcucugggauccugaaa

SEQ ID NO: 953910 - RNA, 22 nt, Human
ccaggagaugauguuggggauu

SEQ ID NO: 953911 - RNA, 22 nt, Human
gcccagaguucaaggcugcagu

SEQ ID NO: 953912 - RNA, 22 nt, Human
uaaaacuuaacuauccagauua

SEQ ID NO: 953913 - RNA, 22 nt, Human
gcucugggugaacuuggagcaa

SEQ ID NO: 953914 - RNA, 22 nt, Human
caggaaagguagucacaaugua

SEQ ID NO: 953915 - RNA, 22 nt, Human
caaauacuaaacauaagauuuu

SEQ ID NO: 953916 - RNA, 22 nt, Human
uaaauuguuuucuagaaguugu

SEQ ID NO: 953917 - RNA, 22 nt, Human
cugaggaguuuggguuguucaa

SEQ ID NO: 953918 - RNA, 22 nt, Human
caaaaagcuuagguaacaagcc

SEQ ID NO: 953919 - RNA, 22 nt, Human
uuucaaaccuacuuguauguuu

SEQ ID NO: 953920 - RNA, 22 nt, Human
uucaugugaucacagauuguaa

SEQ ID NO: 953921 - RNA, 22 nt, Human
augauguuaccaguacuuagag

SEQ ID NO: 953922 - RNA, 22 nt, Human
cacagcuggugcacuagcucug

SEQ ID NO: 953923 - RNA, 22 nt, Human
uagaaauccccagucucauagu

SEQ ID NO: 953924 - RNA, 22 nt, Human
agaaauguauagugaauuuuuc

SEQ ID NO: 953925 - RNA, 22 nt, Human
ugaggggaacugaugcccauug

SEQ ID NO: 953926 - RNA, 19 nt, Human
uguguaaagucugugguca

SEQ ID NO: 953927 - RNA, 22 nt, Human
ucagcagggagaggagaaugca

SEQ ID NO: 953928 - RNA, 22 nt, Human
gcagggacgccagggacagcaa

SEQ ID NO: 953929 - RNA, 22 nt, Human
ugcauaguucuccuuccuccuc

SEQ ID NO: 953930 - RNA, 22 nt, Human
cuccucugucuggcccugagcc

SEQ ID NO: 953931 - RNA, 16 nt, Human
cagaguguaaacagga

SEQ ID NO: 953932 - RNA, 22 nt, Human
auguaugucugcauacacauac

SEQ ID NO: 953933 - RNA, 22 nt, Human
cuggggugucucgucugccauu

SEQ ID NO: 953934 - RNA, 22 nt, Human
cccaaggcauggcaugguggca

SEQ ID NO: 953935 - RNA, 22 nt, Human
cagcugccuguauuguccucau

SEQ ID NO: 953936 - RNA, 22 nt, Human
auagacuugguuaguaaauuug

SEQ ID NO: 953937 - RNA, 22 nt, Human
uagcagcucugauucugggccc

SEQ ID NO: 953938 - RNA, 23 nt, Human
ggcuggcccggggcugcuccuga

SEQ ID NO: 953939 - RNA, 22 nt, Human
cagagccccucagcucucuccc

SEQ ID NO: 953940 - RNA, 23 nt, Human
cccagggacacgaugacaccucc

SEQ ID NO: 953941 - RNA, 22 nt, Human
cagagggagcccuccaggagca

SEQ ID NO: 953942 - RNA, 22 nt, Human
cugaggcuuggaggggucuggu

SEQ ID NO: 953943 - RNA, 17 nt, Human
ucuguucaagugagagg

SEQ ID NO: 953944 - RNA, 19 nt, Human
gcugugugaccuugggcaa

SEQ ID NO: 953945 - RNA, 20 nt, Human
cuucuucagccuaugcuuca

SEQ ID NO: 953946 - RNA, 22 nt, Human
gcucccagauuucagccuugug

SEQ ID NO: 953947 - RNA, 22 nt, Human
auugucuuuccacugagaaguu

SEQ ID NO: 953948 - RNA, 22 nt, Human
uccuugaaugaagagaggugac

SEQ ID NO: 953949 - RNA, 22 nt, Human
acaguuaucuuugaaauagaga

SEQ ID NO: 953950 - RNA, 22 nt, Human
caguugaugggacucauguggg

SEQ ID NO: 953951 - RNA, 22 nt, Human
uagcacaggucuuguugccauu

SEQ ID NO: 953952 - RNA, 19 nt, Human
guggccagggcaggggcug

SEQ ID NO: 953953 - RNA, 22 nt, Human
gaaaaugugucaucccuacugu

SEQ ID NO: 953954 - RNA, 22 nt, Human
uuuccucuucgauuaaguuugg

SEQ ID NO: 953955 - RNA, 22 nt, Human
uucuaaagugcaaucugacaga

SEQ ID NO: 953956 - RNA, 22 nt, Human
agggaugguggagguugcaagu

SEQ ID NO: 953957 - RNA, 22 nt, Human
cccaccaguacagaugguagau

SEQ ID NO: 953958 - RNA, 22 nt, Human
cugagcccaggcgggagcugag

SEQ ID NO: 953959 - RNA, 22 nt, Human
uucuuucucaacaugaauguuu

SEQ ID NO: 953960 - RNA, 22 nt, Human
auguguuuugguaauuucugcu

SEQ ID NO: 953961 - RNA, 19 nt, Human
uggaagaggaagggaaaua

SEQ ID NO: 953962 - RNA, 22 nt, Human
cauguguagugaaauaagcagu

SEQ ID NO: 953963 - RNA, 22 nt, Human
cagcaauaagguaagcuucucc

SEQ ID NO: 953964 - RNA, 22 nt, Human
uggagcucaaaggccuguggga

SEQ ID NO: 953965 - RNA, 22 nt, Human
cuguuuaucccuuuggucagca

SEQ ID NO: 953966 - RNA, 22 nt, Human
cccaggaaaagcagugccagca

SEQ ID NO: 953967 - RNA, 22 nt, Human
acacaguaccccaaggcugggc

SEQ ID NO: 953968 - RNA, 22 nt, Human
aggcacugacucaagggagcca

SEQ ID NO: 953969 - RNA, 22 nt, Human
uaggccagcccuuaguccuguc

SEQ ID NO: 953970 - RNA, 22 nt, Human
uuucuuccuuaccuuacuagag

SEQ ID NO: 953971 - RNA, 22 nt, Human
uuuauuguuaucaugggugagu

SEQ ID NO: 953972 - RNA, 18 nt, Human
uugcuuuguaagcuugca

SEQ ID NO: 953973 - RNA, 22 nt, Human
uuguugguggaauugaugcuag

SEQ ID NO: 953974 - RNA, 22 nt, Human
cugccucuggccucaggcccag

SEQ ID NO: 953975 - RNA, 22 nt, Human
cuuccucugcggcgccgggcgc

SEQ ID NO: 953976 - RNA, 23 nt, Human
ggcucugugcugggccugcagga

SEQ ID NO: 953977 - RNA, 22 nt, Human
guucuugccagcauccucaggu

SEQ ID NO: 953978 - RNA, 22 nt, Human
uuuagaguugaguauucauugg

SEQ ID NO: 953979 - RNA, 22 nt, Human
acagccagaggugguccugggu

SEQ ID NO: 953980 - RNA, 22 nt, Human
gucugucuguuguugagaagca

SEQ ID NO: 953981 - RNA, 22 nt, Human
ucucaggaaauaggauuugagu

SEQ ID NO: 953982 - RNA, 22 nt, Human
ucugggaguuucugugggagcu

SEQ ID NO: 953983 - RNA, 22 nt, Human
cucaucugauaaaucacucuua

SEQ ID NO: 953984 - RNA, 22 nt, Human
cuccagaagacccauccucaug

SEQ ID NO: 953985 - RNA, 18 nt, Human
gggcacuggggacuggag

SEQ ID NO: 953986 - RNA, 22 nt, Human
agccaggaaccagcuacagucu

SEQ ID NO: 953987 - RNA, 22 nt, Human
ggcuguagguuggugcuggaca

SEQ ID NO: 953988 - RNA, 22 nt, Human
ccuguucaaugcccuggcuuca

SEQ ID NO: 953989 - RNA, 22 nt, Human
gcugccuguguggccacucacu

SEQ ID NO: 953990 - RNA, 22 nt, Human
ucagugaucuaaggguauggcc

SEQ ID NO: 953991 - RNA, 22 nt, Human
acagacagauuuugucugaugu

SEQ ID NO: 953992 - RNA, 22 nt, Human
uauuuaauuagugauuguagag

SEQ ID NO: 953993 - RNA, 22 nt, Human
augucuuucucacagccaguuc

SEQ ID NO: 953994 - RNA, 22 nt, Human
caagggccuccaccuugcucgu

SEQ ID NO: 953995 - RNA, 22 nt, Human
aaaugcuucaccucauuaaacu

SEQ ID NO: 953996 - RNA, 22 nt, Human
auugaaaggcaaaguaggaagc

SEQ ID NO: 953997 - RNA, 22 nt, Human
aguuuuuccugauuuuacagaa

SEQ ID NO: 953998 - RNA, 22 nt, Human
agugaaauagcauuuaugaagc

SEQ ID NO: 953999 - RNA, 22 nt, Human
cccagggaaugacucuggccuu

SEQ ID NO: 954000 - RNA, 22 nt, Human
gucaucuuccuaguguuaacua

SEQ ID NO: 954001 - RNA, 22 nt, Human
uggggagugaugccucggauaa

SEQ ID NO: 954002 - RNA, 23 nt, Human
agaggcaggaguggcuugcccgg

SEQ ID NO: 954003 - RNA, 22 nt, Human
ccucagaguaggucucagcugu

SEQ ID NO: 954004 - RNA, 22 nt, Human
uaaggccaauuaacaaccaggg

SEQ ID NO: 954005 - RNA, 22 nt, Human
gcccaggcuagcguagagugca

SEQ ID NO: 954006 - RNA, 22 nt, Human
aagcagccuggcaugaugcuuu

SEQ ID NO: 954007 - RNA, 22 nt, Human
augauggugagguugagcacag

SEQ ID NO: 954008 - RNA, 22 nt, Human
aauaauuagugggacagagaac

SEQ ID NO: 954009 - RNA, 18 nt, Human
uggcagccagcugcuccu

SEQ ID NO: 954010 - RNA, 22 nt, Human
aaggaagacacagaugaaguga

SEQ ID NO: 954011 - RNA, 22 nt, Human
acagacagggcaccugccuccu

SEQ ID NO: 954012 - RNA, 22 nt, Human
ucaaaacacuauuaccuuuaau

SEQ ID NO: 954013 - RNA, 22 nt, Human
cagcuuccgaccgggggcugca

SEQ ID NO: 954014 - RNA, 22 nt, Human
ggguggaguagaaagaugaauu

SEQ ID NO: 954015 - RNA, 22 nt, Human
gcagagcugggucuguauccaa

SEQ ID NO: 954016 - RNA, 22 nt, Human
aggucauuuuugccuucuauuu

SEQ ID NO: 954017 - RNA, 22 nt, Human
ggaggggcagccauggaacucc

SEQ ID NO: 954018 - RNA, 22 nt, Human
uggccugguccuugucaaggca

SEQ ID NO: 954019 - RNA, 21 nt, Human
uagagaaaagaagcuguuccu

SEQ ID NO: 954020 - RNA, 22 nt, Human
cggcagcucgagggccacccgu

SEQ ID NO: 954021 - RNA, 22 nt, Human
uaauuucacugauaugaaguca

SEQ ID NO: 954022 - RNA, 22 nt, Human
ccaggugguucaggucaccaua

SEQ ID NO: 954023 - RNA, 20 nt, Human
agaaucugacccagagagac

SEQ ID NO: 954024 - RNA, 22 nt, Human
uugaaagggauauaucuuucug

SEQ ID NO: 954025 - RNA, 22 nt, Human
ucauuauuuuggacuggagugu

SEQ ID NO: 954026 - RNA, 22 nt, Human
uguugagacugagggagucagc

SEQ ID NO: 954027 - RNA, 22 nt, Human
cacugaaucucaaggggagggu

SEQ ID NO: 954028 - RNA, 22 nt, Human
cugggaggcccacguugggaag

SEQ ID NO: 954029 - RNA, 22 nt, Human
aacauuuaugguagucauugca

SEQ ID NO: 954030 - RNA, 22 nt, Human
aauuuuaagcauaugacugguu

SEQ ID NO: 954031 - RNA, 22 nt, Human
cuagagaggcagauguccugug

SEQ ID NO: 954032 - RNA, 22 nt, Human
aggugcagcugacaccaugugg

SEQ ID NO: 954033 - RNA, 22 nt, Human
aaagagcuaacauugccgagau

SEQ ID NO: 954034 - RNA, 22 nt, Human
cugucccaggagcuguaagaca

SEQ ID NO: 954035 - RNA, 22 nt, Human
cauugaaaccuaacauaggcug

SEQ ID NO: 954036 - RNA, 22 nt, Human
ucagagucauugcaaguagaag

SEQ ID NO: 954037 - RNA, 22 nt, Human
agacagcugcucgcagagcuau

SEQ ID NO: 954038 - RNA, 22 nt, Human
ggacagaggguugacagaguau

SEQ ID NO: 954039 - RNA, 22 nt, Human
uggcagcagacaaaaggccauu

SEQ ID NO: 954040 - RNA, 22 nt, Human
gucacaggccuggaugaggggc

SEQ ID NO: 954041 - RNA, 22 nt, Human
cugucagguuggucucagagcu

SEQ ID NO: 954042 - RNA, 22 nt, Human
caaggcaggcaguucacuugag

SEQ ID NO: 954043 - RNA, 22 nt, Human
uaagauaaguggguugagaugg

SEQ ID NO: 954044 - RNA, 22 nt, Human
gggugggaacaggaugccagga

SEQ ID NO: 954045 - RNA, 22 nt, Human
ucacugcucagucuguacuaca

SEQ ID NO: 954046 - RNA, 22 nt, Human
aggaccuguagggccugcaucc

SEQ ID NO: 954047 - RNA, 22 nt, Human
uugagaagaauguguugaguuu

SEQ ID NO: 954048 - RNA, 22 nt, Human
caggaugagaagggcucuuacg

SEQ ID NO: 954049 - RNA, 22 nt, Human
gcugaagcugcagcaggaggaa

SEQ ID NO: 954050 - RNA, 22 nt, Human
ucuuuuaaaagcccugcugucu

SEQ ID NO: 954051 - RNA, 22 nt, Human
cuguccuggagggcauaggacg

SEQ ID NO: 954052 - RNA, 22 nt, Human
cagucauuuuauuugaaaauua

SEQ ID NO: 954053 - RNA, 22 nt, Human
aagugacaaaaggguauccaaa

SEQ ID NO: 954054 - RNA, 22 nt, Human
aggcugugggaauggcugcuug

SEQ ID NO: 954055 - RNA, 22 nt, Human
cuggccagaguuggagggugug

SEQ ID NO: 954056 - RNA, 22 nt, Human
aucugucuggaggccuggcaug

SEQ ID NO: 954057 - RNA, 22 nt, Human
aagggcagcuauuaucgucauc

SEQ ID NO: 954058 - RNA, 22 nt, Human
guuauacauauguguuaacaaa

SEQ ID NO: 954059 - RNA, 22 nt, Human
uguggcucucagauccuccaau

SEQ ID NO: 954060 - RNA, 22 nt, Human
uuugcagcaaggagagagcauu

SEQ ID NO: 954061 - RNA, 22 nt, Human
uauuuuaucugccagaguggag

SEQ ID NO: 954062 - RNA, 22 nt, Human
guuuccauggcucuguuaaugg

SEQ ID NO: 954063 - RNA, 22 nt, Human
aaguuucaugauguaauuauug

SEQ ID NO: 954064 - RNA, 22 nt, Human
uauucacauguacauaugcuca

SEQ ID NO: 954065 - RNA, 22 nt, Human
agcugcaggccucuccugggga

SEQ ID NO: 954066 - RNA, 22 nt, Human
ucacacagguuugcaaugauuu

SEQ ID NO: 954067 - RNA, 22 nt, Human
ucauccaggaaaagauuuggaa

SEQ ID NO: 954068 - RNA, 22 nt, Human
uccagggaccucccugagagcu

SEQ ID NO: 954069 - RNA, 22 nt, Human
ggcuguccuuggccaaggcacu

SEQ ID NO: 954070 - RNA, 22 nt, Human
uacaguauggaaaauguauagu

SEQ ID NO: 954071 - RNA, 20 nt, Human
uuuuccagaaaguaucauug

SEQ ID NO: 954072 - RNA, 22 nt, Human
aguacuuugcacuuugcucaga

SEQ ID NO: 954073 - RNA, 22 nt, Human
aguuuaaaucauguuuuguaac

SEQ ID NO: 954074 - RNA, 22 nt, Human
gcccugcugcuggcagaggcgc

SEQ ID NO: 954075 - RNA, 22 nt, Human
gcucugugcaguucagggacac

SEQ ID NO: 954076 - RNA, 19 nt, Human
aggcagcacccaguccuug

SEQ ID NO: 954077 - RNA, 22 nt, Human
acuggccaggagcuggaaauac

SEQ ID NO: 954078 - RNA, 22 nt, Human
ggucugaguggggccugagauu

SEQ ID NO: 954079 - RNA, 22 nt, Human
uucacagauguauuggaacucc

SEQ ID NO: 954080 - RNA, 22 nt, Human
uucaugugauaaaugugugacu

SEQ ID NO: 954081 - RNA, 22 nt, Human
gcuggcuuugcacugggugcau

SEQ ID NO: 954082 - RNA, 22 nt, Human
caguggucugugcuucuguaca

SEQ ID NO: 954083 - RNA, 22 nt, Human
agcucacaguguccuuccucaa

SEQ ID NO: 954084 - RNA, 22 nt, Human
uaugcacauauaaccugcacug

SEQ ID NO: 954085 - RNA, 22 nt, Human
caggauggagaguuguugguug

SEQ ID NO: 954086 - RNA, 19 nt, Human
agauggcaaaaugcaaaga

SEQ ID NO: 954087 - RNA, 22 nt, Human
uuucuuaggcucuaaaaugacu

SEQ ID NO: 954088 - RNA, 22 nt, Human
ucuuugcaaauguuauuaucuu

SEQ ID NO: 954089 - RNA, 22 nt, Human
gaggccugcagcguggucccug

SEQ ID NO: 954090 - RNA, 21 nt, Human
gggcagaggggccuccugggu

SEQ ID NO: 954091 - RNA, 22 nt, Human
uuuuaauucaaagugaauagug

SEQ ID NO: 954092 - RNA, 22 nt, Human
aaaggcuccuucucccaugacc

SEQ ID NO: 954093 - RNA, 22 nt, Human
ggagagugggagcaacuguugc

SEQ ID NO: 954094 - RNA, 22 nt, Human
gugugccaccagucaaggugaa

SEQ ID NO: 954095 - RNA, 22 nt, Human
uggcucagccuggcccuuucau

SEQ ID NO: 954096 - RNA, 22 nt, Human
aggggugaaagagggcccucaa

SEQ ID NO: 954097 - RNA, 22 nt, Human
gcaggagaacaaagcaagcugc

SEQ ID NO: 954098 - RNA, 22 nt, Human
uuucacaacguuguggugagag

SEQ ID NO: 954099 - RNA, 22 nt, Human
cugggagcuuguuaggaaugca

SEQ ID NO: 954100 - RNA, 22 nt, Human
ugccaggauggccagggggcca

SEQ ID NO: 954101 - RNA, 22 nt, Human
uggagccugagucagcggaggc

SEQ ID NO: 954102 - RNA, 22 nt, Human
aaggcgacacaggcagcaggcc

SEQ ID NO: 954103 - RNA, 22 nt, Human
gcccagagagaugcuguagacc

SEQ ID NO: 954104 - RNA, 22 nt, Human
uuagccauauagaaaaagagcu

SEQ ID NO: 954105 - RNA, 22 nt, Human
gcagagccugugucugagcaaa

SEQ ID NO: 954106 - RNA, 23 nt, Human
caugccaguuugugcaggcagau

SEQ ID NO: 954107 - RNA, 22 nt, Human
ucugccugagggagcugaggaa

SEQ ID NO: 954108 - RNA, 22 nt, Human
ccagcugcagguguuccagaug

SEQ ID NO: 954109 - RNA, 22 nt, Human
aacauguugcuuuaauaauauu

SEQ ID NO: 954110 - RNA, 22 nt, Human
ucaaugauaguacaaucagccu

SEQ ID NO: 954111 - RNA, 22 nt, Human
ugcugccuucuaggcgugcccu

SEQ ID NO: 954112 - RNA, 22 nt, Human
cuggcagcuuccuuugcaucug

SEQ ID NO: 954113 - RNA, 22 nt, Human
ucauguuuggaguuugcucacu

SEQ ID NO: 954114 - RNA, 22 nt, Human
ccucuuugugccugcaggcugc

SEQ ID NO: 954115 - RNA, 22 nt, Human
ucugagaguccaucuccaagcc

SEQ ID NO: 954116 - RNA, 22 nt, Human
cuguucucuggcgguggcuguu

SEQ ID NO: 954117 - RNA, 22 nt, Human
agaggagugggaagcagugcaa

SEQ ID NO: 954118 - RNA, 22 nt, Human
cugggagcgcagcaggcacaac

SEQ ID NO: 954119 - RNA, 22 nt, Human
cccuaggguuuggccagagccc

SEQ ID NO: 954120 - RNA, 22 nt, Human
agccuggaauuaaggaaaugca

SEQ ID NO: 954121 - RNA, 22 nt, Human
gggacgggcaguccaagggguc

SEQ ID NO: 954122 - RNA, 22 nt, Human
gcacugggaagaaugagccugu

SEQ ID NO: 954123 - RNA, 22 nt, Human
uuccauaauaggcuuaagugaa

SEQ ID NO: 954124 - RNA, 21 nt, Human
cuacuuaaguaggggauuagg

SEQ ID NO: 954125 - RNA, 22 nt, Human
agacagugauguaagcaggagu

SEQ ID NO: 954126 - RNA, 22 nt, Human
ggcaguggugggaggcucgcuc

SEQ ID NO: 954127 - RNA, 22 nt, Human
cucucugaggcaggccuguggg

SEQ ID NO: 954128 - RNA, 17 nt, Human
ugaaacaccaagacugu

SEQ ID NO: 954129 - RNA, 20 nt, Human
ugggcagcacugcuggcugg

SEQ ID NO: 954130 - RNA, 22 nt, Human
cagcuggaugggagaccauguu

SEQ ID NO: 954131 - RNA, 22 nt, Human
auuauuagacuuauaugguagu

SEQ ID NO: 954132 - RNA, 22 nt, Human
uggaagagguggaaguggcuuc

SEQ ID NO: 954133 - RNA, 22 nt, Human
gcaggagugacauggaugugga

SEQ ID NO: 954134 - RNA, 22 nt, Human
acccaggagcaggcugggcagu

SEQ ID NO: 954135 - RNA, 22 nt, Human
gagaagcaaucaguggccaccc

SEQ ID NO: 954136 - RNA, 22 nt, Human
cuuuggcaaugaaacacaagaa

SEQ ID NO: 954137 - RNA, 22 nt, Human
cuccucacuuuccagacugggc

SEQ ID NO: 954138 - RNA, 22 nt, Human
cugcccagaaucacucacucga

SEQ ID NO: 954139 - RNA, 22 nt, Human
gagcacaggcuuugguggacac

SEQ ID NO: 954140 - RNA, 22 nt, Human
cucagggggaaucaggucacag

SEQ ID NO: 954141 - RNA, 22 nt, Human
aauuucaaacuaauaggaacca

SEQ ID NO: 954142 - RNA, 22 nt, Human
cucugcauuuuaacagaugauu

SEQ ID NO: 954143 - RNA, 23 nt, Human
ugcucugugaauaguuggugacu

SEQ ID NO: 954144 - RNA, 22 nt, Human
aucagaauaauuagauuucaga

SEQ ID NO: 954145 - RNA, 22 nt, Human
uugcauaaaugcuuaaaauuug

SEQ ID NO: 954146 - RNA, 22 nt, Human
uccuuggcaugccgucuucucc

SEQ ID NO: 954147 - RNA, 22 nt, Human
ggaggccaggguggguggaucg

SEQ ID NO: 954148 - RNA, 22 nt, Human
ccaggagacccagggaaggagc

SEQ ID NO: 954149 - RNA, 22 nt, Human
cuugaaaugacaggagcacauc

SEQ ID NO: 954150 - RNA, 22 nt, Human
cugcugugcacccaggaaggcu

SEQ ID NO: 954151 - RNA, 22 nt, Human
uggagaagucaaagugaacagg

SEQ ID NO: 954152 - RNA, 22 nt, Human
cagccugcauuuguaucuguau

SEQ ID NO: 954153 - RNA, 22 nt, Human
cagcucccagagugaccagcag

SEQ ID NO: 954154 - RNA, 18 nt, Human
cuuucagauggauaugcu

SEQ ID NO: 954155 - RNA, 22 nt, Human
cuugaacucaaugugaggaaga

SEQ ID NO: 954156 - RNA, 22 nt, Human
uggccucuuacgacauagccuu

SEQ ID NO: 954157 - RNA, 22 nt, Human
ggagggugcauuuuacccugug

SEQ ID NO: 954158 - RNA, 22 nt, Human
uaagcauaacuaaaaaugauuu

SEQ ID NO: 954159 - RNA, 22 nt, Human
acacagccgugaaucugcuucu

SEQ ID NO: 954160 - RNA, 22 nt, Human
caaugugucaggaaaagggcca

SEQ ID NO: 954161 - RNA, 22 nt, Human
aggcugggcuccgcccaacucc

SEQ ID NO: 954162 - RNA, 22 nt, Human
uuuaacagguaaaguaaaugug

SEQ ID NO: 954163 - RNA, 22 nt, Human
ucauucuccucuggaaaaggca

SEQ ID NO: 954164 - RNA, 22 nt, Human
gcccugagacugagcauggguu

SEQ ID NO: 954165 - RNA, 22 nt, Human
gugauaaagacgugucauaauu

SEQ ID NO: 954166 - RNA, 22 nt, Human
ggucccaggaagugcggcggcg

SEQ ID NO: 954167 - RNA, 22 nt, Human
guuuauuaacugucaagugauu

SEQ ID NO: 954168 - RNA, 22 nt, Human
uccaugagcuagcuuuccaaag

SEQ ID NO: 954169 - RNA, 22 nt, Human
uccuggccuugcuccugaugcc

SEQ ID NO: 954170 - RNA, 19 nt, Human
cuugcugggugguuucugc

SEQ ID NO: 954171 - RNA, 22 nt, Human
aguugaauaauuagacauaucu

SEQ ID NO: 954172 - RNA, 22 nt, Human
cccaggagguggagcuugcagu

SEQ ID NO: 954173 - RNA, 22 nt, Human
gugacaguggucacuuguaguu

SEQ ID NO: 954174 - RNA, 20 nt, Human
gucaucgccggcagcaaaga

SEQ ID NO: 954175 - RNA, 22 nt, Human
agcugucagugcugugccugua

SEQ ID NO: 954176 - RNA, 22 nt, Human
agcucagcuuccucuccaugcu

SEQ ID NO: 954177 - RNA, 20 nt, Human
accaggagauggaggcaggg

SEQ ID NO: 954178 - RNA, 22 nt, Human
auucugauaucuuauucuagcu

SEQ ID NO: 954179 - RNA, 22 nt, Human
uguccucaaggagcuucagucu

SEQ ID NO: 954180 - RNA, 22 nt, Human
gcagggucugaggccacagagg

SEQ ID NO: 954181 - RNA, 22 nt, Human
gccuuggccuuccuaggccuga

SEQ ID NO: 954182 - RNA, 22 nt, Human
gccagcuggagugagagugggc

SEQ ID NO: 954183 - RNA, 22 nt, Human
cugagcugggaguggauagugg

SEQ ID NO: 954184 - RNA, 22 nt, Human
uugcuagcugguguaugcauug

SEQ ID NO: 954185 - RNA, 21 nt, Human
uaacuuuugugccuaucuugu

SEQ ID NO: 954186 - RNA, 22 nt, Human
cccuuagcuccaagggguuugg

SEQ ID NO: 954187 - RNA, 22 nt, Human
agggaaggaaaagcugucgcuu

SEQ ID NO: 954188 - RNA, 22 nt, Human
cauuccuuaacguggggagucu

SEQ ID NO: 954189 - RNA, 22 nt, Human
uuugcauuugcaaauaaugaaa

SEQ ID NO: 954190 - RNA, 22 nt, Human
gaaaaguacacagcccaaacau

SEQ ID NO: 954191 - RNA, 22 nt, Human
cuauuagguaugugguugcuau

SEQ ID NO: 954192 - RNA, 22 nt, Human
caaggccacugcucagguuucc

SEQ ID NO: 954193 - RNA, 22 nt, Human
aggcacuugaauugaugauguu

SEQ ID NO: 954194 - RNA, 17 nt, Human
auccccagcaucuagaa

SEQ ID NO: 954195 - RNA, 22 nt, Human
gcuccucuauuccccacauuuu

SEQ ID NO: 954196 - RNA, 22 nt, Human
aggccaaagcacagagcuggaa

SEQ ID NO: 954197 - RNA, 22 nt, Human
accaggaguuuugaccaggggc

SEQ ID NO: 954198 - RNA, 22 nt, Human
agugaaauaaagcugccuaugg

SEQ ID NO: 954199 - RNA, 22 nt, Human
cuguggcugcagccuugguccu

SEQ ID NO: 954200 - RNA, 22 nt, Human
cuggcugaggucaccaguagcu

SEQ ID NO: 954201 - RNA, 22 nt, Human
caaucagauaugugacauauuu

SEQ ID NO: 954202 - RNA, 22 nt, Human
acauuucucauucuccccuaac

SEQ ID NO: 954203 - RNA, 22 nt, Human
agcucugggccaggaacccuaa

SEQ ID NO: 954204 - RNA, 22 nt, Human
agcucccagggcugggcaaguu

SEQ ID NO: 954205 - RNA, 22 nt, Human
guggccaaaaggaagaagguua

SEQ ID NO: 954206 - RNA, 22 nt, Human
ggcugcagauagccagccacca

SEQ ID NO: 954207 - RNA, 22 nt, Human
aucugccuggcuccaggugagc

SEQ ID NO: 954208 - RNA, 22 nt, Human
ugaagcagaggggucuugagcu

SEQ ID NO: 954209 - RNA, 22 nt, Human
auaaugugauauuucauuuaca

SEQ ID NO: 954210 - RNA, 22 nt, Human
gccuggagaauuaaaaggaagg

SEQ ID NO: 954211 - RNA, 22 nt, Human
cauaauaucuccgauuacuugc

SEQ ID NO: 954212 - RNA, 19 nt, Human
agaaaucucgagauuuguu

SEQ ID NO: 954213 - RNA, 22 nt, Human
aaguucaaggcucuagaguucc

SEQ ID NO: 954214 - RNA, 22 nt, Human
cucuggagcaccgggcuaucca

SEQ ID NO: 954215 - RNA, 22 nt, Human
ggagccaggcaaucuguacuuu

SEQ ID NO: 954216 - RNA, 22 nt, Human
cucccaggguagggagagacua

SEQ ID NO: 954217 - RNA, 22 nt, Human
uacacacaugcauuugccuuau

SEQ ID NO: 954218 - RNA, 22 nt, Human
aggagucagauaugggaaaguu

SEQ ID NO: 954219 - RNA, 22 nt, Human
aucuuugaagaggacuugaagu

SEQ ID NO: 954220 - RNA, 22 nt, Human
uggcucagucauggaugaguaa

SEQ ID NO: 954221 - RNA, 22 nt, Human
ggaggggaggauuaaugacaaa

SEQ ID NO: 954222 - RNA, 22 nt, Human
aacagcuuugcuucuggagaca

SEQ ID NO: 954223 - RNA, 19 nt, Human
cagcucaguuugauucucu

SEQ ID NO: 954224 - RNA, 22 nt, Human
auuggcaaggcugcggugucug

SEQ ID NO: 954225 - RNA, 20 nt, Human
uggcaucucucaauuguagg

SEQ ID NO: 954226 - RNA, 22 nt, Human
ucagacuuuaaaggcuaacagg

SEQ ID NO: 954227 - RNA, 22 nt, Human
aggccuggcaugagaccugaga

SEQ ID NO: 954228 - RNA, 22 nt, Human
agcugcccuuaauaggcauuca

SEQ ID NO: 954229 - RNA, 22 nt, Human
cucagagucccuucccucgugg

SEQ ID NO: 954230 - RNA, 22 nt, Human
cuggaagggucuacuuagcaga

SEQ ID NO: 954231 - RNA, 22 nt, Human
aagauauucaaagauuuauuag

SEQ ID NO: 954232 - RNA, 22 nt, Human
agcuggcaguaugacuggugac

SEQ ID NO: 954233 - RNA, 22 nt, Human
aucuggcucuuccuggaguucc

SEQ ID NO: 954234 - RNA, 22 nt, Human
gcuggcuccucuguccucacgg

SEQ ID NO: 954235 - RNA, 22 nt, Human
uuucuguaaguggcaaauaaug

SEQ ID NO: 954236 - RNA, 22 nt, Human
gaugguuuggaaugaaguagcu

SEQ ID NO: 954237 - RNA, 22 nt, Human
aaggcagcaugaaucccuguac

SEQ ID NO: 954238 - RNA, 22 nt, Human
cuugccuguggcuaguuggcuc

SEQ ID NO: 954239 - RNA, 22 nt, Human
augcaguggcagcuccuggugu

SEQ ID NO: 954240 - RNA, 22 nt, Human
agccuggaggccaggagacagu

SEQ ID NO: 954241 - RNA, 22 nt, Human
acagugaaugcccaagaaaagu

SEQ ID NO: 954242 - RNA, 22 nt, Human
cuccagggggcauccacacagc

SEQ ID NO: 954243 - RNA, 22 nt, Human
agagaggcugggcguagggcuu

SEQ ID NO: 954244 - RNA, 17 nt, Human
gcugccaccuuuggagc

SEQ ID NO: 954245 - RNA, 22 nt, Human
cauggccugccuccuccuggug

SEQ ID NO: 954246 - RNA, 22 nt, Human
cagagcugcagauugaaggcau

SEQ ID NO: 954247 - RNA, 22 nt, Human
aaaagagguuaaccaggugugu

SEQ ID NO: 954248 - RNA, 22 nt, Human
uuggccaauggugauucccggc

SEQ ID NO: 954249 - RNA, 18 nt, Human
cagucccaaaccuuagga

SEQ ID NO: 954250 - RNA, 22 nt, Human
ucuccugguuuguuaaauaauu

SEQ ID NO: 954251 - RNA, 22 nt, Human
agccuggauccuaggcucagcu

SEQ ID NO: 954252 - RNA, 22 nt, Human
ucucaguguguuuucucucaga

SEQ ID NO: 954253 - RNA, 22 nt, Human
ucugaggcuaagagacagaggc

SEQ ID NO: 954254 - RNA, 22 nt, Human
agggaagugaaugacagauauc

SEQ ID NO: 954255 - RNA, 22 nt, Human
agguggccggugccagccgggc

SEQ ID NO: 954256 - RNA, 22 nt, Human
ccugugugucugucacugcaca

SEQ ID NO: 954257 - RNA, 22 nt, Human
gaggccagaagugccucgggcu

SEQ ID NO: 954258 - RNA, 22 nt, Human
gcagggcuaauggggcaaguag

SEQ ID NO: 954259 - RNA, 22 nt, Human
ccuggagauuauuugguccaau

SEQ ID NO: 954260 - RNA, 22 nt, Human
agagccugaggaugucccagcu

SEQ ID NO: 954261 - RNA, 19 nt, Human
ccaggccuccugggagguc

SEQ ID NO: 954262 - RNA, 22 nt, Human
ucacugcaaucucugccuucca

SEQ ID NO: 954263 - RNA, 22 nt, Human
gaagcagcuagcccacuaguca

SEQ ID NO: 954264 - RNA, 22 nt, Human
gggagccuugggagugccagcc

SEQ ID NO: 954265 - RNA, 22 nt, Human
ugccacagaggugaagcccacu

SEQ ID NO: 954266 - RNA, 22 nt, Human
gccuggcugagguggggaggca

SEQ ID NO: 954267 - RNA, 19 nt, Human
aggcugcaagguggugggc

SEQ ID NO: 954268 - RNA, 22 nt, Human
uauagagguggaaacugagguu

SEQ ID NO: 954269 - RNA, 22 nt, Human
guuuauaaggcccaauauuucu

SEQ ID NO: 954270 - RNA, 22 nt, Human
ugagugccugaacauagaguag

SEQ ID NO: 954271 - RNA, 22 nt, Human
gucacacucagaaugacuagag

SEQ ID NO: 954272 - RNA, 22 nt, Human
gcuccuggguguggcugccccu

SEQ ID NO: 954273 - RNA, 21 nt, Human
gccagggaagagaguuggcug

SEQ ID NO: 954274 - RNA, 22 nt, Human
cugccucuccccagaguggccc

SEQ ID NO: 954275 - RNA, 22 nt, Human
ugaaacaggaaguaaacagaca

SEQ ID NO: 954276 - RNA, 22 nt, Human
uuggccaagugguuaaucucca

SEQ ID NO: 954277 - RNA, 22 nt, Human
ucugcaucauuuuucagagccg

SEQ ID NO: 954278 - RNA, 22 nt, Human
guucuucaucauuuuagauagg

SEQ ID NO: 954279 - RNA, 22 nt, Human
ccucuggggguccucagagucu

SEQ ID NO: 954280 - RNA, 23 nt, Human
cagggaggagauacuguguaucu

SEQ ID NO: 954281 - RNA, 22 nt, Human
cuggcaguguccagcucgugau

SEQ ID NO: 954282 - RNA, 22 nt, Human
cucugggcaaguuucuucauga

SEQ ID NO: 954283 - RNA, 18 nt, Human
cagaugagaugcaaucuc

SEQ ID NO: 954284 - RNA, 22 nt, Human
uaggcagcauggauucugaaua

SEQ ID NO: 954285 - RNA, 22 nt, Human
gccaccucuuugucucugccgc

SEQ ID NO: 954286 - RNA, 22 nt, Human
uaaauuauguuccauguccuuu

SEQ ID NO: 954287 - RNA, 18 nt, Human
cgaggcaggcggaucacg

SEQ ID NO: 954288 - RNA, 22 nt, Human
ugauugaacugagcuucaagau

SEQ ID NO: 954289 - RNA, 22 nt, Human
cucugugccucaguuuucuucu

SEQ ID NO: 954290 - RNA, 22 nt, Human
gcagcugcuggagggaggcagg

SEQ ID NO: 954291 - RNA, 22 nt, Human
gucaggaugagggaugaggagu

SEQ ID NO: 954292 - RNA, 22 nt, Human
gggcccuggggccugauuugca

SEQ ID NO: 954293 - RNA, 21 nt, Human
uggagcugccacuuguccucc

SEQ ID NO: 954294 - RNA, 22 nt, Human
cccagcuccuuacagggccgaa

SEQ ID NO: 954295 - RNA, 22 nt, Human
ugccucagaguugucccuacca

SEQ ID NO: 954296 - RNA, 22 nt, Human
cccugggcaagcccuauuuucc

SEQ ID NO: 954297 - RNA, 22 nt, Human
cugggcucagaugagaggaagg

SEQ ID NO: 954298 - RNA, 22 nt, Human
agcucuccacacauaggacuag

SEQ ID NO: 954299 - RNA, 18 nt, Human
gcacucugacugcagagc

SEQ ID NO: 954300 - RNA, 22 nt, Human
ccuuucagaugggcauggaccg

SEQ ID NO: 954301 - RNA, 22 nt, Human
cagcaggcccagaguuucaugg

SEQ ID NO: 954302 - RNA, 22 nt, Human
aggagguggccugagcgugccc

SEQ ID NO: 954303 - RNA, 22 nt, Human
gaggcucugugaugugccaggc

SEQ ID NO: 954304 - RNA, 22 nt, Human
gaaggccacggaauggagcugg

SEQ ID NO: 954305 - RNA, 21 nt, Human
guggcccugccgcagugucca

SEQ ID NO: 954306 - RNA, 20 nt, Human
acugugaaugcugaauuagc

SEQ ID NO: 954307 - RNA, 22 nt, Human
uuccaggauagcuuucaggaau

SEQ ID NO: 954308 - RNA, 22 nt, Human
cauucacauucuucuuacuguu

SEQ ID NO: 954309 - RNA, 22 nt, Human
gggcagcuguaucugagcuuau

SEQ ID NO: 954310 - RNA, 22 nt, Human
gaucuuggggggaucaccaugg

SEQ ID NO: 954311 - RNA, 22 nt, Human
ggaggccaguccuggccgggcu

SEQ ID NO: 954312 - RNA, 22 nt, Human
gcuuagaaguuccuauaaaaug

SEQ ID NO: 954313 - RNA, 22 nt, Human
agggagcucacaguccaguaga

SEQ ID NO: 954314 - RNA, 16 nt, Human
ccuuucucugccuucc

SEQ ID NO: 954315 - RNA, 22 nt, Human
cacagggcuaaaugaaggguug

SEQ ID NO: 954316 - RNA, 22 nt, Human
cuauugaauuaacuauuaaagu

SEQ ID NO: 954317 - RNA, 22 nt, Human
cccaggagagggaaccaaaugu

SEQ ID NO: 954318 - RNA, 22 nt, Human
gugcauuggugcgccacuucac

SEQ ID NO: 954319 - RNA, 22 nt, Human
cccaggaacuccagagcuccuc

SEQ ID NO: 954320 - RNA, 22 nt, Human
ucugggaacagccuggcugugu

SEQ ID NO: 954321 - RNA, 21 nt, Human
gcagcagaggcuugacagaca

SEQ ID NO: 954322 - RNA, 22 nt, Human
cuggcucauccagguguugcuc

SEQ ID NO: 954323 - RNA, 22 nt, Human
ucaggauguccaaaauccagcc

SEQ ID NO: 954324 - RNA, 22 nt, Human
accauguuggccaagcuggucu

SEQ ID NO: 954325 - RNA, 22 nt, Human
gcagaacauuucacaguaucuu

SEQ ID NO: 954326 - RNA, 22 nt, Human
uguggccuccccacuucugggg

SEQ ID NO: 954327 - RNA, 22 nt, Human
ccucauggccuugagcugaggg

SEQ ID NO: 954328 - RNA, 22 nt, Human
cucuggagcgcugcuucccgcg

SEQ ID NO: 954329 - RNA, 22 nt, Human
uggcucaggugugagcugaaga

SEQ ID NO: 954330 - RNA, 19 nt, Human
auuucaagagguuuauugg

SEQ ID NO: 954331 - RNA, 21 nt, Human
ucuuguccuugcucucccacu

SEQ ID NO: 954332 - RNA, 22 nt, Human
guucuucaucauuaacacucug

SEQ ID NO: 954333 - RNA, 22 nt, Human
agucauauguggcauuuucuaa

SEQ ID NO: 954334 - RNA, 22 nt, Human
acauuucucauaggagagccac

SEQ ID NO: 954335 - RNA, 22 nt, Human
agcagccaguucucugugguag

SEQ ID NO: 954336 - RNA, 22 nt, Human
agggacugagcuaggaucuagu

SEQ ID NO: 954337 - RNA, 22 nt, Human
guggccaaaucaugucaaaggc

SEQ ID NO: 954338 - RNA, 22 nt, Human
auucagagcacuggguagaauu

SEQ ID NO: 954339 - RNA, 22 nt, Human
caggacagcucaacaccuccuc

SEQ ID NO: 954340 - RNA, 22 nt, Human
aaaagguagauucuccuucuau

SEQ ID NO: 954341 - RNA, 22 nt, Human
uggagaggagcaccauggccau

SEQ ID NO: 954342 - RNA, 22 nt, Human
ucucagaggucuucagccucug

SEQ ID NO: 954343 - RNA, 22 nt, Human
ugcaucuguucagagcugucga

SEQ ID NO: 954344 - RNA, 20 nt, Human
aggcaccugucacaggugag

SEQ ID NO: 954345 - RNA, 22 nt, Human
gagaggugaaggcugcccuggg

SEQ ID NO: 954346 - RNA, 22 nt, Human
caaaggcaguuacugaaugaag

SEQ ID NO: 954347 - RNA, 22 nt, Human
cugugucccuugucccagagcc

SEQ ID NO: 954348 - RNA, 22 nt, Human
augaaggcuguguggagccccc

SEQ ID NO: 954349 - RNA, 22 nt, Human
gcacucugccaggucuccugau

SEQ ID NO: 954350 - RNA, 22 nt, Human
gucugagcgcuggagcuugugu

SEQ ID NO: 954351 - RNA, 22 nt, Human
cucacagaugcugugggucagg

SEQ ID NO: 954352 - RNA, 22 nt, Human
ggcuucuuccugugaacauguu

SEQ ID NO: 954353 - RNA, 22 nt, Human
ucccagaguauuagcaauugcu

SEQ ID NO: 954354 - RNA, 22 nt, Human
ucacaggguaucugggauggau

SEQ ID NO: 954355 - RNA, 22 nt, Human
ggcuguggggggagccugcccg

SEQ ID NO: 954356 - RNA, 22 nt, Human
acuguucauuuggauuucucug

SEQ ID NO: 954357 - RNA, 22 nt, Human
gcugcucugugacagccuccgg

SEQ ID NO: 954358 - RNA, 22 nt, Human
ccugcacuaccuggggcugcug

SEQ ID NO: 954359 - RNA, 22 nt, Human
cacugaagccacuggaagagga

SEQ ID NO: 954360 - RNA, 22 nt, Human
caucacuguccucagcauucca

SEQ ID NO: 954361 - RNA, 21 nt, Human
auucagaguaauucaucuuua

SEQ ID NO: 954362 - RNA, 22 nt, Human
aguuuuaugcaguguucugaua

SEQ ID NO: 954363 - RNA, 22 nt, Human
uaugugucugucgugcauaaau

SEQ ID NO: 954364 - RNA, 22 nt, Human
ggauccuuaacuaucacaguga

SEQ ID NO: 954365 - RNA, 22 nt, Human
uccaguggcacuggagacuaga

SEQ ID NO: 954366 - RNA, 22 nt, Human
uuucucuaaauagggaggcuua

SEQ ID NO: 954367 - RNA, 23 nt, Human
augcucugggcugugggaccugc

SEQ ID NO: 954368 - RNA, 22 nt, Human
ccaggggaaacagggagcacuc

SEQ ID NO: 954369 - RNA, 22 nt, Human
ugcauggacucaucagacaaga

SEQ ID NO: 954370 - RNA, 22 nt, Human
gagcuguccgccccugggccga

SEQ ID NO: 954371 - RNA, 22 nt, Human
acuggccaggcgaaccacacug

SEQ ID NO: 954372 - RNA, 22 nt, Human
cugcuuugauuagaagaguaca

SEQ ID NO: 954373 - RNA, 22 nt, Human
ccaggaugacccccacuuuccu

SEQ ID NO: 954374 - RNA, 22 nt, Human
cggggcuguagcacagcugagc

SEQ ID NO: 954375 - RNA, 22 nt, Human
aggcagaggaaggguggauuug

SEQ ID NO: 954376 - RNA, 22 nt, Human
caaauucacaugauugcuucug

SEQ ID NO: 954377 - RNA, 22 nt, Human
ccagaggaggggggucuuucug

SEQ ID NO: 954378 - RNA, 22 nt, Human
agaggcugggaaggguccccgg

SEQ ID NO: 954379 - RNA, 22 nt, Human
gaauuacauuguuagccuuccu

SEQ ID NO: 954380 - RNA, 18 nt, Human
accuucauuccuuugccu

SEQ ID NO: 954381 - RNA, 22 nt, Human
uggcucagugaagagauaacuu

SEQ ID NO: 954382 - RNA, 20 nt, Human
ugugcccaauguccagguuc

SEQ ID NO: 954383 - RNA, 22 nt, Human
cuucccuuggugaacagagcau

SEQ ID NO: 954384 - RNA, 22 nt, Human
gucaggauuaaugggaguaugc

SEQ ID NO: 954385 - RNA, 22 nt, Human
uucucucauucaaauuaaagug

SEQ ID NO: 954386 - RNA, 21 nt, Human
gcucccuggcugugugaccug

SEQ ID NO: 954387 - RNA, 22 nt, Human
uaagaacauaaauucauacggg

SEQ ID NO: 954388 - RNA, 22 nt, Human
ggcuucaccgcgggguugcagg

SEQ ID NO: 954389 - RNA, 22 nt, Human
cccagcccaucucaaaggucua

SEQ ID NO: 954390 - RNA, 22 nt, Human
gaggccacagcuaucagggaca

SEQ ID NO: 954391 - RNA, 18 nt, Human
cuccagggaacucaguca

SEQ ID NO: 954392 - RNA, 22 nt, Human
cacaguuagcuccagucuuagc

SEQ ID NO: 954393 - RNA, 22 nt, Human
ggugaagggccuuaggagacag

SEQ ID NO: 954394 - RNA, 22 nt, Human
agaagcuuccuacauuguucuu

SEQ ID NO: 954395 - RNA, 22 nt, Human
cugaccaucauggugaaacccc

SEQ ID NO: 954396 - RNA, 22 nt, Human
auuuucaucauggguuuaacau

SEQ ID NO: 954397 - RNA, 22 nt, Human
acaggugauucaggcucuggga

SEQ ID NO: 954398 - RNA, 22 nt, Human
cccugcagccggccagcucauu

SEQ ID NO: 954399 - RNA, 22 nt, Human
augccagggucacagucauauu

SEQ ID NO: 954400 - RNA, 22 nt, Human
ccaugcaauuucuguaaaacca

SEQ ID NO: 954401 - RNA, 22 nt, Human
ccucagggacuccaugcugcag

SEQ ID NO: 954402 - RNA, 23 nt, Human
gcauugucuccccacuucugggc

SEQ ID NO: 954403 - RNA, 22 nt, Human
uaagaacaucuguccccagauu

SEQ ID NO: 954404 - RNA, 22 nt, Human
gcugggagugggcaagaugaga

SEQ ID NO: 954405 - RNA, 22 nt, Human
auuaggcaauucugggcaucuc

SEQ ID NO: 954406 - RNA, 22 nt, Human
uacuaucucuucuaacuucaga

SEQ ID NO: 954407 - RNA, 22 nt, Human
agcagcugccagagagaguucc

SEQ ID NO: 954408 - RNA, 22 nt, Human
ugaggcaggacuugcauaaagu

SEQ ID NO: 954409 - RNA, 22 nt, Human
agcuucuggaaggcaaggcuug

SEQ ID NO: 954410 - RNA, 22 nt, Human
ugcuggaggccugacuguguuu

SEQ ID NO: 954411 - RNA, 22 nt, Human
aggagucauaaaugugaacaaa

SEQ ID NO: 954412 - RNA, 22 nt, Human
ugguaauuaauuugauagguuc

SEQ ID NO: 954413 - RNA, 22 nt, Human
ggccugagcucuggggaggcaa

SEQ ID NO: 954414 - RNA, 22 nt, Human
ucacaggaggaaccuggccugg

SEQ ID NO: 954415 - RNA, 22 nt, Human
cccaggcagugugugcaugcgu

SEQ ID NO: 954416 - RNA, 21 nt, Human
agaggccuuacaggauagacc

SEQ ID NO: 954417 - RNA, 22 nt, Human
uggcuguggacucagauggcuc

SEQ ID NO: 954418 - RNA, 22 nt, Human
gggaguguugagcgcccugcca

SEQ ID NO: 954419 - RNA, 22 nt, Human
guucuucaaagugacaacuaaa

SEQ ID NO: 954420 - RNA, 22 nt, Human
gcugucugagaacaugguggaa

SEQ ID NO: 954421 - RNA, 22 nt, Human
ccacaggggcccacgagccgcu

SEQ ID NO: 954422 - RNA, 22 nt, Human
ccugagagcagcuuccugcuua

SEQ ID NO: 954423 - RNA, 22 nt, Human
cccaggaguuagagguuguggu

SEQ ID NO: 954424 - RNA, 17 nt, Human
auguuaauuucacauuu

SEQ ID NO: 954425 - RNA, 22 nt, Human
uugcauugugauuacagaggug

SEQ ID NO: 954426 - RNA, 19 nt, Human
augucuguugaauuucaua

SEQ ID NO: 954427 - RNA, 22 nt, Human
ggucucagcaguugcuuugacu

SEQ ID NO: 954428 - RNA, 22 nt, Human
acaguuucuccauuuacaccuu

SEQ ID NO: 954429 - RNA, 22 nt, Human
auuugaauggcuuaacacaacg

SEQ ID NO: 954430 - RNA, 22 nt, Human
cagagugaaauaggggaucaag

SEQ ID NO: 954431 - RNA, 22 nt, Human
gcagcuuuguggagaggcccau

SEQ ID NO: 954432 - RNA, 22 nt, Human
guccuggggauuauagaguguu

SEQ ID NO: 954433 - RNA, 22 nt, Human
guuuauuagaguuuucugucug

SEQ ID NO: 954434 - RNA, 22 nt, Human
caguuuaaccuauccauuaugu

SEQ ID NO: 954435 - RNA, 22 nt, Human
auucucaaaacauaacuucacu

SEQ ID NO: 954436 - RNA, 22 nt, Human
uggaaggcaugggaacuguucu

SEQ ID NO: 954437 - RNA, 22 nt, Human
cacuguaucuuuuccaaagucu

SEQ ID NO: 954438 - RNA, 22 nt, Human
acaccuuucagguccagacagu

SEQ ID NO: 954439 - RNA, 22 nt, Human
aggguauaaagagcaagcagaa

SEQ ID NO: 954440 - RNA, 22 nt, Human
gaagcagcuggugagauggagc

SEQ ID NO: 954441 - RNA, 22 nt, Human
gaggccagggaugcaaugagag

SEQ ID NO: 954442 - RNA, 22 nt, Human
aaaaaaucagaucuuugguuaa

SEQ ID NO: 954443 - RNA, 22 nt, Human
aguggaccagaagacugaagcu

SEQ ID NO: 954444 - RNA, 22 nt, Human
gagguauguaugcuacauucuu

SEQ ID NO: 954445 - RNA, 22 nt, Human
uggagagguuuaaacaaaaguu

SEQ ID NO: 954446 - RNA, 22 nt, Human
guccaaauaaguugcaaaauag

SEQ ID NO: 954447 - RNA, 21 nt, Human
acugccugucuccauagucua

SEQ ID NO: 954448 - RNA, 22 nt, Human
gcuggcagccaagugaagaggg

SEQ ID NO: 954449 - RNA, 22 nt, Human
gcagagcuucuguccuucagga

SEQ ID NO: 954450 - RNA, 22 nt, Human
ucgcugugguuucuguacaugg

SEQ ID NO: 954451 - RNA, 22 nt, Human
gaggagcuggcagcgucuccgc

SEQ ID NO: 954452 - RNA, 22 nt, Human
agccagcuguucuggggcagca

SEQ ID NO: 954453 - RNA, 22 nt, Human
gcacugggaaugugagcagcug

SEQ ID NO: 954454 - RNA, 22 nt, Human
ggugccaggcucccagcucagg

SEQ ID NO: 954455 - RNA, 22 nt, Human
cuugcugugugguguucucaga

SEQ ID NO: 954456 - RNA, 22 nt, Human
agcugguucauucauucauggu

SEQ ID NO: 954457 - RNA, 22 nt, Human
auauuaggcaaggagauuauuu

SEQ ID NO: 954458 - RNA, 22 nt, Human
gagggcuccauuccccgugccc

SEQ ID NO: 954459 - RNA, 22 nt, Human
uauuuugagguauuuuugagcu

SEQ ID NO: 954460 - RNA, 21 nt, Human
ccucuggcuugugcugugccc

SEQ ID NO: 954461 - RNA, 22 nt, Human
cugccgaguacagccauagaaa

SEQ ID NO: 954462 - RNA, 22 nt, Human
ugggccugauucuugaauccug

SEQ ID NO: 954463 - RNA, 19 nt, Human
ucccuggcgccucucgggc

SEQ ID NO: 954464 - RNA, 22 nt, Human
ccaaggagcaaggcucaacaag

SEQ ID NO: 954465 - RNA, 22 nt, Human
uguaggacauguacuuguaaca

SEQ ID NO: 954466 - RNA, 22 nt, Human
uacccaggaggaaacugaggcu

SEQ ID NO: 954467 - RNA, 23 nt, Human
agccacuucuaucuugcuccugg

SEQ ID NO: 954468 - RNA, 22 nt, Human
acauguaaaaggaacaugcaug

SEQ ID NO: 954469 - RNA, 22 nt, Human
uucacauuagugguucuauaua

SEQ ID NO: 954470 - RNA, 22 nt, Human
uugaaaguuaucuagauucuga

SEQ ID NO: 954471 - RNA, 22 nt, Human
gauggcacacagacauccccgc

SEQ ID NO: 954472 - RNA, 22 nt, Human
agggacacaugugauuauuuau

SEQ ID NO: 954473 - RNA, 22 nt, Human
aggagggaccuaggaauauugc

SEQ ID NO: 954474 - RNA, 22 nt, Human
caggagugcagguggugaggca

SEQ ID NO: 954475 - RNA, 22 nt, Human
uggcagucauuaucgcugaguc

SEQ ID NO: 954476 - RNA, 22 nt, Human
caaaggcaacauauacuuguuu

SEQ ID NO: 954477 - RNA, 22 nt, Human
cuggccagcugacagcagggcu

SEQ ID NO: 954478 - RNA, 22 nt, Human
ccucuggggugagugggccacu

SEQ ID NO: 954479 - RNA, 22 nt, Human
aagagcugcccaaggugaacag

SEQ ID NO: 954480 - RNA, 22 nt, Human
caggaggcccaaagggcgcaga

SEQ ID NO: 954481 - RNA, 22 nt, Human
uucuucuucuggcugcaccugg

SEQ ID NO: 954482 - RNA, 22 nt, Human
aauccuggaauacaagagugaa

SEQ ID NO: 954483 - RNA, 22 nt, Human
cucuggagguggagguugcagu

SEQ ID NO: 954484 - RNA, 21 nt, Human
ucucugguuggaguugugcca

SEQ ID NO: 954485 - RNA, 22 nt, Human
cacaccuguaauaccagcuacu

SEQ ID NO: 954486 - RNA, 22 nt, Human
uacaaaguauauuucuagcugu

SEQ ID NO: 954487 - RNA, 22 nt, Human
cccuggagguggagguugcagg

SEQ ID NO: 954488 - RNA, 19 nt, Human
ccucccacggauuccuucc

SEQ ID NO: 954489 - RNA, 22 nt, Human
agugcauuauauguuucaaugg

SEQ ID NO: 954490 - RNA, 21 nt, Human
ccucugcucgggcaugcguuu

SEQ ID NO: 954491 - RNA, 22 nt, Human
ggcugcaggcaggguauccacu

SEQ ID NO: 954492 - RNA, 22 nt, Human
auccaguuuaugucauauucuu

SEQ ID NO: 954493 - RNA, 22 nt, Human
cgaggcagggaagcugcaaaag

SEQ ID NO: 954494 - RNA, 22 nt, Human
agcagcaacuuauuuuucuuau

SEQ ID NO: 954495 - RNA, 22 nt, Human
agacaggaugcauacucuuggu

SEQ ID NO: 954496 - RNA, 22 nt, Human
cuccuggaccagggcuauuggg

SEQ ID NO: 954497 - RNA, 17 nt, Human
auuagguuuugucauga

SEQ ID NO: 954498 - RNA, 22 nt, Human
aguaaaauuguauuggaaaaca

SEQ ID NO: 954499 - RNA, 21 nt, Human
agcugccacccuagcuucuga

SEQ ID NO: 954500 - RNA, 22 nt, Human
gcugagaggcacuaucuccgga

SEQ ID NO: 954501 - RNA, 22 nt, Human
cgcugggggaacagcgagggug

SEQ ID NO: 954502 - RNA, 22 nt, Human
cuuggcagagggcugggcucag

SEQ ID NO: 954503 - RNA, 22 nt, Human
cagcugaacauguagagcaucu

SEQ ID NO: 954504 - RNA, 22 nt, Human
agaaaucugacugcugugcaca

SEQ ID NO: 954505 - RNA, 22 nt, Human
cagaggcauauaauugcugggg

SEQ ID NO: 954506 - RNA, 22 nt, Human
uuggccaagggcucuuuaggcu

SEQ ID NO: 954507 - RNA, 22 nt, Human
uggcucugcugaaccuagugca

SEQ ID NO: 954508 - RNA, 19 nt, Human
uggcaucuguaaaauggug

SEQ ID NO: 954509 - RNA, 22 nt, Human
ucugcuguucauucuuuuagcu

SEQ ID NO: 954510 - RNA, 22 nt, Human
cuguccuaugaguacucacuag

SEQ ID NO: 954511 - RNA, 22 nt, Human
cugcccugugaggguccuuggg

SEQ ID NO: 954512 - RNA, 22 nt, Human
gcugagggcuguaacagcagag

SEQ ID NO: 954513 - RNA, 22 nt, Human
ggcugcugcccaccccugcaug

SEQ ID NO: 954514 - RNA, 22 nt, Human
cauguacauucuguagauggag

SEQ ID NO: 954515 - RNA, 22 nt, Human
auaaacacuucuagggcacaca

SEQ ID NO: 954516 - RNA, 22 nt, Human
uucuacaugguugcucagaggg

SEQ ID NO: 954517 - RNA, 23 nt, Human
aggcuuccuaucuuagagcuggg

SEQ ID NO: 954518 - RNA, 18 nt, Human
ggcagggaaaagauaggg

SEQ ID NO: 954519 - RNA, 22 nt, Human
gcugguaggaagugcuccugcc

SEQ ID NO: 954520 - RNA, 22 nt, Human
aacugcauuugcauaaguccau

SEQ ID NO: 954521 - RNA, 22 nt, Human
auggccaagagucgauuugggg

SEQ ID NO: 954522 - RNA, 22 nt, Human
ggccccuggcaccaggcugauu

SEQ ID NO: 954523 - RNA, 22 nt, Human
cuguacaucucugaggacagua

SEQ ID NO: 954524 - RNA, 22 nt, Human
ggagcacuauaauagagauuuu

SEQ ID NO: 954525 - RNA, 19 nt, Human
auacacauacguaaacuga

SEQ ID NO: 954526 - RNA, 22 nt, Human
ccaggccauucccagaguugcu

SEQ ID NO: 954527 - RNA, 22 nt, Human
ugaaaugagauaauuuaagugc

SEQ ID NO: 954528 - RNA, 22 nt, Human
ccagagcaauucucacagaacu

SEQ ID NO: 954529 - RNA, 22 nt, Human
uguacacaauucuuaacauaca

SEQ ID NO: 954530 - RNA, 22 nt, Human
cauugcucaggcccagcaggaa

SEQ ID NO: 954531 - RNA, 22 nt, Human
caggcugaggcaguaggguuug

SEQ ID NO: 954532 - RNA, 19 nt, Human
ccagguggaacugagguag

SEQ ID NO: 954533 - RNA, 22 nt, Human
uccagagcagguggucagaagg

SEQ ID NO: 954534 - RNA, 19 nt, Human
aaagcagaggagcaucuga

SEQ ID NO: 954535 - RNA, 22 nt, Human
gccuggcacucacugaagaggc

SEQ ID NO: 954536 - RNA, 22 nt, Human
uguuaaauguuccuuuacugga

SEQ ID NO: 954537 - RNA, 22 nt, Human
agagugaaguaauuguuaggau

SEQ ID NO: 954538 - RNA, 22 nt, Human
aggcaaaauuacaaaguuauua

SEQ ID NO: 954539 - RNA, 22 nt, Human
aauguucaguagaauaggaaug

SEQ ID NO: 954540 - RNA, 22 nt, Human
auucauucugaccucaagagaa

SEQ ID NO: 954541 - RNA, 22 nt, Human
uggcugugucaucauagcugug

SEQ ID NO: 954542 - RNA, 16 nt, Human
gcucugcugaggccca

SEQ ID NO: 954543 - RNA, 22 nt, Human
uuuucaguuccaucucugcucu

SEQ ID NO: 954544 - RNA, 22 nt, Human
aggcccugcaggaguggggaca

SEQ ID NO: 954545 - RNA, 22 nt, Human
augggcaugcuucuaguugaaa

SEQ ID NO: 954546 - RNA, 22 nt, Human
gccaugaggaacuguaagacaa

SEQ ID NO: 954547 - RNA, 22 nt, Human
acagcaggauuuggcgauguug

SEQ ID NO: 954548 - RNA, 22 nt, Human
uguacaguaggaacuuguuauu

SEQ ID NO: 954549 - RNA, 22 nt, Human
ccucugcagcagagagccagag

SEQ ID NO: 954550 - RNA, 22 nt, Human
gaaggagagggucaaggauaau

SEQ ID NO: 954551 - RNA, 23 nt, Human
ugucauugugacuacagaaccag

SEQ ID NO: 954552 - RNA, 21 nt, Human
aggcagcuggaaggccuggcu

SEQ ID NO: 954553 - RNA, 22 nt, Human
gguggggucacgacagagggaa

SEQ ID NO: 954554 - RNA, 22 nt, Human
uuucuuuaucauagcaucuuug

SEQ ID NO: 954555 - RNA, 22 nt, Human
ggagcuggcuacagagaacucc

SEQ ID NO: 954556 - RNA, 22 nt, Human
uagcuuuguuagaaugucuuca

SEQ ID NO: 954557 - RNA, 21 nt, Human
uggccaaaaccauauuauuaa

SEQ ID NO: 954558 - RNA, 22 nt, Human
ucugcuguaaagaauuucugcc

SEQ ID NO: 954559 - RNA, 22 nt, Human
auauuguugacuauaagaguaa

SEQ ID NO: 954560 - RNA, 22 nt, Human
uccuggcccuguggccugcagu

SEQ ID NO: 954561 - RNA, 22 nt, Human
gagcuggugaucagcuggagga

SEQ ID NO: 954562 - RNA, 22 nt, Human
cugagggcccugaagcuuggca

SEQ ID NO: 954563 - RNA, 22 nt, Human
ucaguggauauuucuguggcug

SEQ ID NO: 954564 - RNA, 22 nt, Human
ccucccucuguuagagcugucu

SEQ ID NO: 954565 - RNA, 22 nt, Human
uaucuuugaugccagauguuac

SEQ ID NO: 954566 - RNA, 22 nt, Human
cagcagcugauggggaagugau

SEQ ID NO: 954567 - RNA, 22 nt, Human
aaaugcacacaccaggaaacua

SEQ ID NO: 954568 - RNA, 22 nt, Human
agauuuccugcacugccuuuga

SEQ ID NO: 954569 - RNA, 22 nt, Human
gaguuauuugguuugcaugcag

SEQ ID NO: 954570 - RNA, 22 nt, Human
gagcacagaaucuucccaugca

SEQ ID NO: 954571 - RNA, 22 nt, Human
augggaugaacuugaucugcuu

SEQ ID NO: 954572 - RNA, 22 nt, Human
ugggccuccaauuccagcggga

SEQ ID NO: 954573 - RNA, 23 nt, Human
agggcugaugccauugcagcucu

SEQ ID NO: 954574 - RNA, 22 nt, Human
ggcagauggaagaggcuggguc

SEQ ID NO: 954575 - RNA, 22 nt, Human
ucuuuacacaagacaagaauaa

SEQ ID NO: 954576 - RNA, 22 nt, Human
auguuaaaugguuuauuauuaa

SEQ ID NO: 954577 - RNA, 22 nt, Human
gcagagccccauugcuggcggg

SEQ ID NO: 954578 - RNA, 22 nt, Human
gcagcuggagccagccagacac

SEQ ID NO: 954579 - RNA, 22 nt, Human
uggcucaggguccccaaauggu

SEQ ID NO: 954580 - RNA, 22 nt, Human
cuggugggaggcaagguggaag

SEQ ID NO: 954581 - RNA, 22 nt, Human
uccuggccucacaguccugggu

SEQ ID NO: 954582 - RNA, 22 nt, Human
aggguauguuuuuaucuacugu

SEQ ID NO: 954583 - RNA, 18 nt, Human
agccuggaggguugaagu

SEQ ID NO: 954584 - RNA, 23 nt, Human
agggagcuaaaaggcuggagcag

SEQ ID NO: 954585 - RNA, 22 nt, Human
aggcugccuguuccaaucuccu

SEQ ID NO: 954586 - RNA, 22 nt, Human
ccagggcagaaaaagagggaau

SEQ ID NO: 954587 - RNA, 22 nt, Human
aauuagagaucaguucuuugac

SEQ ID NO: 954588 - RNA, 22 nt, Human
aggucaaaccacagcucuaggc

SEQ ID NO: 954589 - RNA, 22 nt, Human
auaaguaggaaaauuugaauau

SEQ ID NO: 954590 - RNA, 22 nt, Human
ugggccacaagccaugggacca

SEQ ID NO: 954591 - RNA, 22 nt, Human
aggagcagaccguaguccugca

SEQ ID NO: 954592 - RNA, 22 nt, Human
cggcuggguagaggugccgggu

SEQ ID NO: 954593 - RNA, 22 nt, Human
uuugacagauccuuaacucagc

SEQ ID NO: 954594 - RNA, 22 nt, Human
uuugaaauguaucaguauaggu

SEQ ID NO: 954595 - RNA, 22 nt, Human
ccuggccaggcauggagucaca

SEQ ID NO: 954596 - RNA, 22 nt, Human
cugguccuugacgcgugggagg

SEQ ID NO: 954597 - RNA, 22 nt, Human
gagaaagacguaggcugggagg

SEQ ID NO: 954598 - RNA, 22 nt, Human
gcuguucucuguaacaugcauu

SEQ ID NO: 954599 - RNA, 22 nt, Human
ccaggcaggcgauggugcagug

SEQ ID NO: 954600 - RNA, 22 nt, Human
gggaucagcaagccacugcacc

SEQ ID NO: 954601 - RNA, 17 nt, Human
cauuuguugaucaguug

SEQ ID NO: 954602 - RNA, 22 nt, Human
gaacaauagugguaacaaagcc

SEQ ID NO: 954603 - RNA, 22 nt, Human
agguuauaugucauacugaagu

SEQ ID NO: 954604 - RNA, 22 nt, Human
acuucuucuucagcugggggau

SEQ ID NO: 954605 - RNA, 22 nt, Human
uccucacaagcaagcacaggua

SEQ ID NO: 954606 - RNA, 19 nt, Human
cugagcagcggcagcacuu

SEQ ID NO: 954607 - RNA, 22 nt, Human
ucuucucuacaccagcagcccc

SEQ ID NO: 954608 - RNA, 22 nt, Human
cagggacaugacuggucucugu

SEQ ID NO: 954609 - RNA, 22 nt, Human
acaagagacaagagguucuucu

SEQ ID NO: 954610 - RNA, 22 nt, Human
cuggcccagagcucuggccuuu

SEQ ID NO: 954611 - RNA, 22 nt, Human
gcagcugaaagggaucucuaca

SEQ ID NO: 954612 - RNA, 22 nt, Human
cuucuccucugaguccugggag

SEQ ID NO: 954613 - RNA, 22 nt, Human
agucccagcuacucaagaggcu

SEQ ID NO: 954614 - RNA, 22 nt, Human
uuucacauuuaggcgugaauug

SEQ ID NO: 954615 - RNA, 20 nt, Human
gcccuggagccuuguccugg

SEQ ID NO: 954616 - RNA, 22 nt, Human
uggagcaggccggaaguggcuu

SEQ ID NO: 954617 - RNA, 22 nt, Human
aagacuuucaaaccuauguuug

SEQ ID NO: 954618 - RNA, 22 nt, Human
cagaagcauugacuccuugcuc

SEQ ID NO: 954619 - RNA, 22 nt, Human
uuggcaguagucucggcuaccc

SEQ ID NO: 954620 - RNA, 22 nt, Human
cacgggagacgugaucuuggac

SEQ ID NO: 954621 - RNA, 22 nt, Human
gaggugggagggcagucccuaa

SEQ ID NO: 954622 - RNA, 22 nt, Human
uggcccgaccucugcucaugca

SEQ ID NO: 954623 - RNA, 22 nt, Human
uggagacucugcaucugugaca

SEQ ID NO: 954624 - RNA, 22 nt, Human
uucuucuuaauguccugggaac

SEQ ID NO: 954625 - RNA, 22 nt, Human
aucuuucaguuucauaccaauu

SEQ ID NO: 954626 - RNA, 22 nt, Human
gagcugcugguugcuggugccu

SEQ ID NO: 954627 - RNA, 22 nt, Human
uauuagugaaagaauuaguuug

SEQ ID NO: 954628 - RNA, 22 nt, Human
uggcucuggcgugaagcccaga

SEQ ID NO: 954629 - RNA, 22 nt, Human
ucugagagagggucagaugcua

SEQ ID NO: 954630 - RNA, 22 nt, Human
guggcuucacauggcauuuggc

SEQ ID NO: 954631 - RNA, 22 nt, Human
ggcagccaugucccagggcuuc

SEQ ID NO: 954632 - RNA, 22 nt, Human
agagugcaaccgaaacaagcag

SEQ ID NO: 954633 - RNA, 22 nt, Human
agcagggcuuugcagacuuggg

SEQ ID NO: 954634 - RNA, 22 nt, Human
gucuucaauagagccucaauuu

SEQ ID NO: 954635 - RNA, 22 nt, Human
uggcagcugcguuguguuucug

SEQ ID NO: 954636 - RNA, 22 nt, Human
ccuggcagcuaagugcuuugag

SEQ ID NO: 954637 - RNA, 22 nt, Human
uuuguaaagucuguucugaguu

SEQ ID NO: 954638 - RNA, 22 nt, Human
uuccaggacuggguguuugaag

SEQ ID NO: 954639 - RNA, 22 nt, Human
uuugacagcuuguuacaaaguu

SEQ ID NO: 954640 - RNA, 22 nt, Human
cccugccugugggcaucaacau

SEQ ID NO: 954641 - RNA, 22 nt, Human
cucuggaguuagugaucugggc

SEQ ID NO: 954642 - RNA, 22 nt, Human
ucaguucuuuauuucacaguga

SEQ ID NO: 954643 - RNA, 22 nt, Human
aggugccagugcuguggucccc

SEQ ID NO: 954644 - RNA, 22 nt, Human
cauuuguaggaugcuucuuguu

SEQ ID NO: 954645 - RNA, 22 nt, Human
acugaaggcuuaacucuuucau

SEQ ID NO: 954646 - RNA, 22 nt, Human
cugggucuggugucaggcgacg

SEQ ID NO: 954647 - RNA, 22 nt, Human
cucugagcccgcugcagcccca

SEQ ID NO: 954648 - RNA, 22 nt, Human
agagugaaggccagguuacagu

SEQ ID NO: 954649 - RNA, 22 nt, Human
cucagaagccuucagucuuggc

SEQ ID NO: 954650 - RNA, 22 nt, Human
ugucccaguuuugcagguuaga

SEQ ID NO: 954651 - RNA, 22 nt, Human
uagaaaugcaguguacuguguc

SEQ ID NO: 954652 - RNA, 22 nt, Human
gaugccucuuuuggcugaauua

SEQ ID NO: 954653 - RNA, 22 nt, Human
aggccaaauugaucaucuuuag

SEQ ID NO: 954654 - RNA, 22 nt, Human
acugccugcauccuuaggguag

SEQ ID NO: 954655 - RNA, 22 nt, Human
aaccuuuugcaagugccuugac

SEQ ID NO: 954656 - RNA, 22 nt, Human
uggcugaaggaagauucuucua

SEQ ID NO: 954657 - RNA, 22 nt, Human
caguugccuacuacauggcagg

SEQ ID NO: 954658 - RNA, 22 nt, Human
uggaggcauaggccugggcccu

SEQ ID NO: 954659 - RNA, 22 nt, Human
gggauggcuuuguggcugacuc

SEQ ID NO: 954660 - RNA, 22 nt, Human
ucaaacuguuuacagugagaua

SEQ ID NO: 954661 - RNA, 22 nt, Human
ucuggauggucagcucuuccug

SEQ ID NO: 954662 - RNA, 22 nt, Human
cagagccugccaccuuucuccc

SEQ ID NO: 954663 - RNA, 20 nt, Human
ucugugugccaucaccuaac

SEQ ID NO: 954664 - RNA, 21 nt, Human
ugcucacagaugugcucagug

SEQ ID NO: 954665 - RNA, 22 nt, Human
gacagccucaugaggagcaaaa

SEQ ID NO: 954666 - RNA, 22 nt, Human
gagggagggaaaguuuaacacu

SEQ ID NO: 954667 - RNA, 22 nt, Human
ugcccaggguuucuaagagcag

SEQ ID NO: 954668 - RNA, 22 nt, Human
caggcagcagccacucugguau

SEQ ID NO: 954669 - RNA, 22 nt, Human
aggaaaaagaguugcugccuuc

SEQ ID NO: 954670 - RNA, 22 nt, Human
agcuuaggaggaugaugaacau

SEQ ID NO: 954671 - RNA, 22 nt, Human
ucuggcucuguguccucaccca

SEQ ID NO: 954672 - RNA, 22 nt, Human
cagcugccccgcuggcugacca

SEQ ID NO: 954673 - RNA, 22 nt, Human
ugcugaggagguggcugugcuu

SEQ ID NO: 954674 - RNA, 22 nt, Human
gcaccugggcaaggauucagag

SEQ ID NO: 954675 - RNA, 19 nt, Human
acaagggcaggcaagguga

SEQ ID NO: 954676 - RNA, 22 nt, Human
aggcccagggcugcucucugaa

SEQ ID NO: 954677 - RNA, 21 nt, Human
cugcucuggggaccggcugug

SEQ ID NO: 954678 - RNA, 22 nt, Human
uguccacaucacucacuuguca

SEQ ID NO: 954679 - RNA, 22 nt, Human
auuugaagaaaguuuucuagau

SEQ ID NO: 954680 - RNA, 22 nt, Human
caaugaaauugagauccagaga

SEQ ID NO: 954681 - RNA, 22 nt, Human
aagccagguuccauggaggagc

SEQ ID NO: 954682 - RNA, 22 nt, Human
acagagauguggaugagggauu

SEQ ID NO: 954683 - RNA, 22 nt, Human
gcugggagcccuggucugcucc

SEQ ID NO: 954684 - RNA, 22 nt, Human
ugccagcacuucuggcugucug

SEQ ID NO: 954685 - RNA, 22 nt, Human
uuucaacaccagagaccaugcg

SEQ ID NO: 954686 - RNA, 22 nt, Human
uggcaaacuggaggaagcccug

SEQ ID NO: 954687 - RNA, 21 nt, Human
ccuccaggagcagagcccuga

SEQ ID NO: 954688 - RNA, 22 nt, Human
acuuccuggcugggugaccugg

SEQ ID NO: 954689 - RNA, 22 nt, Human
aaagcuaugaggcaugcauuuc

SEQ ID NO: 954690 - RNA, 22 nt, Human
gccuugggauucuuggaugcuc

SEQ ID NO: 954691 - RNA, 22 nt, Human
cacugaaggaaggacuacugca

SEQ ID NO: 954692 - RNA, 22 nt, Human
augaaugacugucuacuuuggg

SEQ ID NO: 954693 - RNA, 22 nt, Human
ggcugccagugagugcagaccg

SEQ ID NO: 954694 - RNA, 22 nt, Human
uuugcauuuuagauuuaggccu

SEQ ID NO: 954695 - RNA, 22 nt, Human
caggcacuucugcugcuugucu

SEQ ID NO: 954696 - RNA, 22 nt, Human
ugucauaaaacacaagcuguug

SEQ ID NO: 954697 - RNA, 22 nt, Human
cauguuuucuaggcuuucacaa

SEQ ID NO: 954698 - RNA, 22 nt, Human
ccagucacagguguguuuauau

SEQ ID NO: 954699 - RNA, 22 nt, Human
ccauccuaucugaccuacuugu

SEQ ID NO: 954700 - RNA, 22 nt, Human
uucucagaauugacugggagca

SEQ ID NO: 954701 - RNA, 22 nt, Human
uaugcacaacaugcagguuugu

SEQ ID NO: 954702 - RNA, 22 nt, Human
ggagcagcuugcaugcucaggg

SEQ ID NO: 954703 - RNA, 22 nt, Human
uccucuggcccagcugccucug

SEQ ID NO: 954704 - RNA, 22 nt, Human
ugcucuguaaggucagaaaagg

SEQ ID NO: 954705 - RNA, 22 nt, Human
gauggguggucucagacuugcc

SEQ ID NO: 954706 - RNA, 22 nt, Human
ccauggaguuccucuggucuau

SEQ ID NO: 954707 - RNA, 22 nt, Human
agcccaugcaacaggccuagcg

SEQ ID NO: 954708 - RNA, 22 nt, Human
cucagucucuugggcugugaag

SEQ ID NO: 954709 - RNA, 22 nt, Human
acagccaggaauucuggagaag

SEQ ID NO: 954710 - RNA, 22 nt, Human
gccagaaacauacacaucacuu

SEQ ID NO: 954711 - RNA, 22 nt, Human
ugcauauuuuauaaagauggaa

SEQ ID NO: 954712 - RNA, 22 nt, Human
aaucaguucuacaucuuaucca

SEQ ID NO: 954713 - RNA, 22 nt, Human
cauuugaaauaguucauucuug

SEQ ID NO: 954714 - RNA, 22 nt, Human
uucacagacuuuccauagauug

SEQ ID NO: 954715 - RNA, 22 nt, Human
ggauggcauguugggcucuguu

SEQ ID NO: 954716 - RNA, 23 nt, Human
cuucacaaucaaaaucaguucug

SEQ ID NO: 954717 - RNA, 22 nt, Human
aguguuccacacaucuggggaa

SEQ ID NO: 954718 - RNA, 22 nt, Human
ggcagcuauuccaagcagcacu

SEQ ID NO: 954719 - RNA, 22 nt, Human
ucccuggcugggggcugccuug

SEQ ID NO: 954720 - RNA, 22 nt, Human
auaaggcacacauagauagggu

SEQ ID NO: 954721 - RNA, 22 nt, Human
cuggcucaauaaauauuagcug

SEQ ID NO: 954722 - RNA, 22 nt, Human
ucugccuguucaagucuucuag

SEQ ID NO: 954723 - RNA, 22 nt, Human
augcuguguccuagugaaagaa

SEQ ID NO: 954724 - RNA, 22 nt, Human
augcugugaaaaagaaggcuga

SEQ ID NO: 954725 - RNA, 22 nt, Human
ugggcuggcccaccacaccucg

SEQ ID NO: 954726 - RNA, 22 nt, Human
uuguaacaaucugucauaaaug

SEQ ID NO: 954727 - RNA, 22 nt, Human
ggggcagaaagcccacagagug

SEQ ID NO: 954728 - RNA, 22 nt, Human
agugcuuucccugaaaccuucc

SEQ ID NO: 954729 - RNA, 22 nt, Human
auaugccauuagcuagaaauaa

SEQ ID NO: 954730 - RNA, 22 nt, Human
uuucacagcuggguggcagagu

SEQ ID NO: 954731 - RNA, 22 nt, Human
cauuuguuggucagauuguagu

SEQ ID NO: 954732 - RNA, 22 nt, Human
ugucucaggggcauugaaauaa

SEQ ID NO: 954733 - RNA, 22 nt, Human
agcuugaguuuuggaugaagug

SEQ ID NO: 954734 - RNA, 22 nt, Human
guuggccugaauggucaagagg

SEQ ID NO: 954735 - RNA, 21 nt, Human
aggucccagguuugggcagca

SEQ ID NO: 954736 - RNA, 23 nt, Human
acagagaucuugacuuguaugga

SEQ ID NO: 954737 - RNA, 22 nt, Human
uucggcuuggguauuucucagg

SEQ ID NO: 954738 - RNA, 22 nt, Human
ugauuuccuagcugacaugaaa

SEQ ID NO: 954739 - RNA, 21 nt, Human
uuagaaagcucacuacaguua

SEQ ID NO: 954740 - RNA, 22 nt, Human
gcugaagagagaugcguccagc

SEQ ID NO: 954741 - RNA, 22 nt, Human
gcagggcaugggcccugucugc

SEQ ID NO: 954742 - RNA, 22 nt, Human
cacaggcuuccaguccccagcu

SEQ ID NO: 954743 - RNA, 22 nt, Human
gccaggagccagcuucuuagca

SEQ ID NO: 954744 - RNA, 22 nt, Human
aucaguuuugggggacauacug

SEQ ID NO: 954745 - RNA, 19 nt, Human
gagcacagcggcauuuggu

SEQ ID NO: 954746 - RNA, 22 nt, Human
cugcuguggaugcaggaccuca

SEQ ID NO: 954747 - RNA, 22 nt, Human
cacugagcugauagaauuccag

SEQ ID NO: 954748 - RNA, 22 nt, Human
acaaaaagggagaugagguaga

SEQ ID NO: 954749 - RNA, 22 nt, Human
cccaugagguggagguugcagu

SEQ ID NO: 954750 - RNA, 22 nt, Human
gccaggugcauggcugagucuc

SEQ ID NO: 954751 - RNA, 22 nt, Human
cucacugcccugaaguuggguu

SEQ ID NO: 954752 - RNA, 22 nt, Human
uggcuuccuggacagaugcggu

SEQ ID NO: 954753 - RNA, 22 nt, Human
gaacagcuucuugggagcuggg

SEQ ID NO: 954754 - RNA, 22 nt, Human
aauguuauuacacuugugaaau

SEQ ID NO: 954755 - RNA, 22 nt, Human
ccaggcugcuuagccuuaucuu

SEQ ID NO: 954756 - RNA, 22 nt, Human
gacaggggucccucugggcugu

SEQ ID NO: 954757 - RNA, 22 nt, Human
agagccuggcucccagcuaccg

SEQ ID NO: 954758 - RNA, 22 nt, Human
gagagcugggaaagccguggag

SEQ ID NO: 954759 - RNA, 22 nt, Human
ucagaggaauaaugcugcauuu

SEQ ID NO: 954760 - RNA, 19 nt, Human
aggugaugugacucuagaa

SEQ ID NO: 954761 - RNA, 22 nt, Human
ugggacagagugagcuuuggcc

SEQ ID NO: 954762 - RNA, 22 nt, Human
cagccugacaccagcuuugggc

SEQ ID NO: 954763 - RNA, 20 nt, Human
ucauccaguugguuuauggu

SEQ ID NO: 954764 - RNA, 22 nt, Human
uuccaugagcucugaguucaca

SEQ ID NO: 954765 - RNA, 22 nt, Human
ggccuggcucuugcccagccug

SEQ ID NO: 954766 - RNA, 22 nt, Human
cacccacauggaaauucacagu

SEQ ID NO: 954767 - RNA, 22 nt, Human
aagaacauguuaaaagauucac

SEQ ID NO: 954768 - RNA, 22 nt, Human
cauuaaauuccuuguucucaaa

SEQ ID NO: 954769 - RNA, 22 nt, Human
uugacaauguccuuugaauuuc

SEQ ID NO: 954770 - RNA, 22 nt, Human
agcuggguggagggcccacggu

SEQ ID NO: 954771 - RNA, 23 nt, Human
cucccuggaguuucuggaagaug

SEQ ID NO: 954772 - RNA, 22 nt, Human
ccacagaaaguugucuagagua

SEQ ID NO: 954773 - RNA, 22 nt, Human
ggcuucuccccuuugagucuuc

SEQ ID NO: 954774 - RNA, 22 nt, Human
uuacuuuguucucaagauaugu

SEQ ID NO: 954775 - RNA, 22 nt, Human
uccagaggcuccaaagggagau

SEQ ID NO: 954776 - RNA, 22 nt, Human
gcagaggcugggugucccaguc

SEQ ID NO: 954777 - RNA, 22 nt, Human
cauuaucucuucuauaugcuag

SEQ ID NO: 954778 - RNA, 22 nt, Human
agaggcccucucucuccugaug

SEQ ID NO: 954779 - RNA, 22 nt, Human
uucucuggaacugaaacaagau

SEQ ID NO: 954780 - RNA, 22 nt, Human
ucacaggauaagguggcaucac

SEQ ID NO: 954781 - RNA, 22 nt, Human
gggcugacucugcacugagcca

SEQ ID NO: 954782 - RNA, 22 nt, Human
gcaccugauugauuucacugcu

SEQ ID NO: 954783 - RNA, 21 nt, Human
ggcacugagccagauggacuc

SEQ ID NO: 954784 - RNA, 22 nt, Human
augucccaagauacagcuagag

SEQ ID NO: 954785 - RNA, 22 nt, Human
gaaaauacuucaguguucuggc

SEQ ID NO: 954786 - RNA, 23 nt, Human
cuguggcugaguccuguuggagu

SEQ ID NO: 954787 - RNA, 22 nt, Human
agacagcugggaaauggagugu

SEQ ID NO: 954788 - RNA, 22 nt, Human
aaauguuucuacuugugagcau

SEQ ID NO: 954789 - RNA, 22 nt, Human
cagcucugugcaggccugggga

SEQ ID NO: 954790 - RNA, 22 nt, Human
guccagggcuaaaucagguucc

SEQ ID NO: 954791 - RNA, 22 nt, Human
aaaguuucaauagaggaagugg

SEQ ID NO: 954792 - RNA, 23 nt, Human
guggccuccccggaaugccucgc

SEQ ID NO: 954793 - RNA, 22 nt, Human
cuuuuauuuugaauuaagggcu

SEQ ID NO: 954794 - RNA, 22 nt, Human
uaacagaagagcaggcagcccu

SEQ ID NO: 954795 - RNA, 22 nt, Human
gugccuuccccgguggucuguu

SEQ ID NO: 954796 - RNA, 22 nt, Human
cagaauggcuuuuauggcucag

SEQ ID NO: 954797 - RNA, 22 nt, Human
ucccuucacagaugcgauguuu

SEQ ID NO: 954798 - RNA, 23 nt, Human
ggcagagagcauggcuggggccc

SEQ ID NO: 954799 - RNA, 22 nt, Human
ggaugggagcagaggacgacca

SEQ ID NO: 954800 - RNA, 22 nt, Human
cugggcaggagggcucuaugga

SEQ ID NO: 954801 - RNA, 22 nt, Human
aucccaugagaccacguuggcu

SEQ ID NO: 954802 - RNA, 22 nt, Human
guuuuucuaggaccaugugauu

SEQ ID NO: 954803 - RNA, 22 nt, Human
caauaagugcuuuuguuuagca

SEQ ID NO: 954804 - RNA, 22 nt, Human
cagcaggcugcgauugcucauu

SEQ ID NO: 954805 - RNA, 22 nt, Human
gcuuccaaaucuguucaaaaug

SEQ ID NO: 954806 - RNA, 22 nt, Human
auuauauaggacuugcccuucc

SEQ ID NO: 954807 - RNA, 22 nt, Human
aucacugucgucaucugagauu

SEQ ID NO: 954808 - RNA, 22 nt, Human
acagggaaguucugcaacagga

SEQ ID NO: 954809 - RNA, 22 nt, Human
agcauaaguugguacagccacu

SEQ ID NO: 954810 - RNA, 22 nt, Human
gggagggauuaguucugccugg

SEQ ID NO: 954811 - RNA, 22 nt, Human
ucccagccauuccuuuaggugu

SEQ ID NO: 954812 - RNA, 22 nt, Human
uggagcaggugccaggugugug

SEQ ID NO: 954813 - RNA, 23 nt, Human
gaggcagcuccugcagugcccug

SEQ ID NO: 954814 - RNA, 22 nt, Human
agucccagaucuacaggaggga

SEQ ID NO: 954815 - RNA, 22 nt, Human
aaagcagcagcaccugcauuuc

SEQ ID NO: 954816 - RNA, 23 nt, Human
ucagucuucccugucaguaauag

SEQ ID NO: 954817 - RNA, 22 nt, Human
agagcuguuuggacaucugagu

SEQ ID NO: 954818 - RNA, 22 nt, Human
uaguacuuaucucugucauugu

SEQ ID NO: 954819 - RNA, 22 nt, Human
aggagcagcuucugaaccaugu

SEQ ID NO: 954820 - RNA, 22 nt, Human
agggcagaaauauugauacugu

SEQ ID NO: 954821 - RNA, 22 nt, Human
auuguuuuauuaaaugagcccu

SEQ ID NO: 954822 - RNA, 22 nt, Human
gagggaaagguuaauacaugau

SEQ ID NO: 954823 - RNA, 22 nt, Human
auacaucucauguaagagauaa

SEQ ID NO: 954824 - RNA, 22 nt, Human
uggcuccuaggauggugccugg

SEQ ID NO: 954825 - RNA, 21 nt, Human
uaaaugugagcagggcugggc

SEQ ID NO: 954826 - RNA, 22 nt, Human
gggagagagaaaacguggcgca

SEQ ID NO: 954827 - RNA, 22 nt, Human
ggcucaagcagucugccugccu

SEQ ID NO: 954828 - RNA, 22 nt, Human
cagcugaguguuggcauguuca

SEQ ID NO: 954829 - RNA, 20 nt, Human
ccugaggguuuguguucuuu

SEQ ID NO: 954830 - RNA, 22 nt, Human
auggccaagaaguauuccugac

SEQ ID NO: 954831 - RNA, 22 nt, Human
uagugaaauuuaugcacagcua

SEQ ID NO: 954832 - RNA, 22 nt, Human
ccucuccuugcacccgucccgc

SEQ ID NO: 954833 - RNA, 22 nt, Human
agggacagucuacuguucacug

SEQ ID NO: 954834 - RNA, 22 nt, Human
gcugucacucuccggccuuccc

SEQ ID NO: 954835 - RNA, 22 nt, Human
agggccuggcuucacuuucuca

SEQ ID NO: 954836 - RNA, 22 nt, Human
aggcacugugcagucccaagca

SEQ ID NO: 954837 - RNA, 18 nt, Human
aggcagacacuagagguc

SEQ ID NO: 954838 - RNA, 23 nt, Human
ucagagagcuguugagagcugcc

SEQ ID NO: 954839 - RNA, 22 nt, Human
ucuacagacagagcagguggga

SEQ ID NO: 954840 - RNA, 22 nt, Human
uuucucuguucucuaacuguaa

SEQ ID NO: 954841 - RNA, 22 nt, Human
caugagauaauuuuucuccagu

SEQ ID NO: 954842 - RNA, 22 nt, Human
auccagucaaaauuaguaaggu

SEQ ID NO: 954843 - RNA, 22 nt, Human
gagagcugcauucucagacaca

SEQ ID NO: 954844 - RNA, 22 nt, Human
uaaggcagaaauaugagcaggg

SEQ ID NO: 954845 - RNA, 23 nt, Human
uggcucugugucacauacaggau

SEQ ID NO: 954846 - RNA, 22 nt, Human
cucugcugggauguaaagucuu

SEQ ID NO: 954847 - RNA, 22 nt, Human
uuuauuaugauggacaccuucg

SEQ ID NO: 954848 - RNA, 22 nt, Human
ccaggccucuggcugcuuaguc

SEQ ID NO: 954849 - RNA, 22 nt, Human
gcugagagcaguguggccuuaa

SEQ ID NO: 954850 - RNA, 22 nt, Human
ugcaaucucggcacuuugggag

SEQ ID NO: 954851 - RNA, 22 nt, Human
ucaccaggcuggaaugcagugg

SEQ ID NO: 954852 - RNA, 22 nt, Human
cacugggcaauucugagccuaa

SEQ ID NO: 954853 - RNA, 23 nt, Human
ugcagagggacugaagccagcuu

SEQ ID NO: 954854 - RNA, 22 nt, Human
aaguaacaaugcuguugaauug

SEQ ID NO: 954855 - RNA, 22 nt, Human
gagcagcugcagugcagacccu

SEQ ID NO: 954856 - RNA, 22 nt, Human
aggugaguugguaggaaguuug

SEQ ID NO: 954857 - RNA, 22 nt, Human
ugcauauuuguaugauguuuag

SEQ ID NO: 954858 - RNA, 22 nt, Human
cuggcagcauuaacagagagca

SEQ ID NO: 954859 - RNA, 22 nt, Human
uccucaggaucuaggagugcuu

SEQ ID NO: 954860 - RNA, 22 nt, Human
ugacauaaaucuaaaggaaagg

SEQ ID NO: 954861 - RNA, 22 nt, Human
gucucagggacugcuucugggg

SEQ ID NO: 954862 - RNA, 22 nt, Human
gccuaggaguacagaaugguuu

SEQ ID NO: 954863 - RNA, 22 nt, Human
uccagugcuggaccagagcacc

SEQ ID NO: 954864 - RNA, 22 nt, Human
ugcccacauggugccauggcca

SEQ ID NO: 954865 - RNA, 22 nt, Human
guaaauaacugguaauuggggu

SEQ ID NO: 954866 - RNA, 22 nt, Human
gcucucugaggugcuggcagag

SEQ ID NO: 954867 - RNA, 23 nt, Human
agaauuguaaauagaauauaccu

SEQ ID NO: 954868 - RNA, 22 nt, Human
cagaguguggcaucuuccaacu

SEQ ID NO: 954869 - RNA, 22 nt, Human
cccccagccagcagugcucagc

SEQ ID NO: 954870 - RNA, 22 nt, Human
caggugcucccagagaagugcu

SEQ ID NO: 954871 - RNA, 22 nt, Human
cuggccaagcacuggggucaaa

SEQ ID NO: 954872 - RNA, 17 nt, Human
uccuggcucugccacug

SEQ ID NO: 954873 - RNA, 22 nt, Human
cuggcagccaagugggauacuc

SEQ ID NO: 954874 - RNA, 22 nt, Human
ggcaggguggcccuccagugag

SEQ ID NO: 954875 - RNA, 22 nt, Human
auucaaguggcugcuauguuaa

SEQ ID NO: 954876 - RNA, 22 nt, Human
cagggugccaaagaacaaauau

SEQ ID NO: 954877 - RNA, 21 nt, Human
uccacaaguuagaaggaaauu

SEQ ID NO: 954878 - RNA, 22 nt, Human
ggcucagguuuccuucccagcu

SEQ ID NO: 954879 - RNA, 22 nt, Human
uagggcagccuuauagcuccca

SEQ ID NO: 954880 - RNA, 22 nt, Human
cugugucuucaauguacuggga

SEQ ID NO: 954881 - RNA, 22 nt, Human
aagggcagaaagggacgcuuug

SEQ ID NO: 954882 - RNA, 22 nt, Human
ggugaagggugucauggcauuu

SEQ ID NO: 954883 - RNA, 22 nt, Human
ggccucugccccagccacaccu

SEQ ID NO: 954884 - RNA, 22 nt, Human
gccugagauucugcauuucuaa

SEQ ID NO: 954885 - RNA, 21 nt, Human
ggcagaaguagcauggacggg

SEQ ID NO: 954886 - RNA, 22 nt, Human
gcaguggcuaagcucgcaugca

SEQ ID NO: 954887 - RNA, 22 nt, Human
aggccaaagugcuccuuuuaga

SEQ ID NO: 954888 - RNA, 22 nt, Human
ccucaggauccgcaggugcagu

SEQ ID NO: 954889 - RNA, 22 nt, Human
ugggcugcugagaaugagagag

SEQ ID NO: 954890 - RNA, 22 nt, Human
uccagggacacagaguccuucu

SEQ ID NO: 954891 - RNA, 22 nt, Human
cgccaggcuugguagcucaugc

SEQ ID NO: 954892 - RNA, 22 nt, Human
uuuccauauuuggucuuuggga

SEQ ID NO: 954893 - RNA, 22 nt, Human
uaaugucaaggugauagauuug

SEQ ID NO: 954894 - RNA, 22 nt, Human
uggcccuguggaggucagugag

SEQ ID NO: 954895 - RNA, 22 nt, Human
agcaccuguugcacuucauaau

SEQ ID NO: 954896 - RNA, 22 nt, Human
aaggaaccuggaguagagggag

SEQ ID NO: 954897 - RNA, 22 nt, Human
augguuuguaacccaauacucc

SEQ ID NO: 954898 - RNA, 22 nt, Human
agcagagcugcaguggccugcu

SEQ ID NO: 954899 - RNA, 22 nt, Human
cauuuagacauuugauuugggg

SEQ ID NO: 954900 - RNA, 22 nt, Human
gcagugguggagcuuacauauc

SEQ ID NO: 954901 - RNA, 22 nt, Human
ucugaaaugcaaauuugacuga

SEQ ID NO: 954902 - RNA, 22 nt, Human
uuugaacuucuccauucugaug

SEQ ID NO: 954903 - RNA, 22 nt, Human
gagaagccgagucagcugagcc

SEQ ID NO: 954904 - RNA, 22 nt, Human
gagacagugguugcagaagcuc

SEQ ID NO: 954905 - RNA, 22 nt, Human
ggagcugucuguagggcacagg

SEQ ID NO: 954906 - RNA, 22 nt, Human
aacagaaaagguagguggcuuu

SEQ ID NO: 954907 - RNA, 22 nt, Human
acagguggggaggcugagguuc

SEQ ID NO: 954908 - RNA, 22 nt, Human
gcugucagugaggugagacaug

SEQ ID NO: 954909 - RNA, 22 nt, Human
gggcucuggauggagccugcag

SEQ ID NO: 954910 - RNA, 22 nt, Human
cucccagggccaucgagucacu

SEQ ID NO: 954911 - RNA, 22 nt, Human
gcccugagggguggugucugua

SEQ ID NO: 954912 - RNA, 22 nt, Human
ggccuggccuccagaugugggc

SEQ ID NO: 954913 - RNA, 22 nt, Human
cacugcucgcugcagcauggcc

SEQ ID NO: 954914 - RNA, 23 nt, Human
gugugccaagcacugugccagga

SEQ ID NO: 954915 - RNA, 22 nt, Human
agguggcuccucccauggcugg

SEQ ID NO: 954916 - RNA, 22 nt, Human
cccaggcugaugggaugggcca

SEQ ID NO: 954917 - RNA, 22 nt, Human
cccagggaagccauuucugacu

SEQ ID NO: 954918 - RNA, 22 nt, Human
ugggcugcugcggugcucuugg

SEQ ID NO: 954919 - RNA, 22 nt, Human
acacuuuuguguauauccaguu

SEQ ID NO: 954920 - RNA, 22 nt, Human
uacuuuuuagcacagugugugc

SEQ ID NO: 954921 - RNA, 22 nt, Human
uaaggccaggcuguggucggca

SEQ ID NO: 954922 - RNA, 22 nt, Human
uugcuuuguuacugcaguuucc

SEQ ID NO: 954923 - RNA, 22 nt, Human
agcccagguucuaaagccaaac

SEQ ID NO: 954924 - RNA, 22 nt, Human
ucugggaaaugcuguuccuugu

SEQ ID NO: 954925 - RNA, 22 nt, Human
aaacccugcccuucccaagaug

SEQ ID NO: 954926 - RNA, 20 nt, Human
aagcaauauagugcaaaugu

SEQ ID NO: 954927 - RNA, 22 nt, Human
uuuuuauaacucuuuugugaca

SEQ ID NO: 954928 - RNA, 22 nt, Human
aagcagggugucuugacccaug

SEQ ID NO: 954929 - RNA, 22 nt, Human
aauuuagauugauaaacaugga

SEQ ID NO: 954930 - RNA, 22 nt, Human
auauauaaccuggauaaggcuu

SEQ ID NO: 954931 - RNA, 22 nt, Human
ccagcuccgggaguugcugcug

SEQ ID NO: 954932 - RNA, 22 nt, Human
auucuuuuuuaaggaauagaac

SEQ ID NO: 954933 - RNA, 22 nt, Human
ggucucagcccucgccagcagc

SEQ ID NO: 954934 - RNA, 23 nt, Human
cccuguagcccaggacaggcuuu

SEQ ID NO: 954935 - RNA, 22 nt, Human
uccauuuuucaugacuccucaa

SEQ ID NO: 954936 - RNA, 22 nt, Human
ucuggccaggauggcaagacca

SEQ ID NO: 954937 - RNA, 22 nt, Human
ggccuucacgugaccuggcgug

SEQ ID NO: 954938 - RNA, 22 nt, Human
uccagccaacugccuagggagc

SEQ ID NO: 954939 - RNA, 22 nt, Human
gcacugcagccucagauggugg

SEQ ID NO: 954940 - RNA, 22 nt, Human
cuucacaaucaccuuuucggaa

SEQ ID NO: 954941 - RNA, 23 nt, Human
ucuggcucuaugugacagcucuc

SEQ ID NO: 954942 - RNA, 22 nt, Human
cuggcuccuccaaggccuggag

SEQ ID NO: 954943 - RNA, 22 nt, Human
ugagaacugaggauuugaauuc

SEQ ID NO: 954944 - RNA, 22 nt, Human
ccuguucacgguguguuguuag

SEQ ID NO: 954945 - RNA, 22 nt, Human
uuauauacugugguaguacugu

SEQ ID NO: 954946 - RNA, 22 nt, Human
cuauugaaaguguacaauucaa

SEQ ID NO: 954947 - RNA, 22 nt, Human
ggcaggaggugaguggcgggug

SEQ ID NO: 954948 - RNA, 22 nt, Human
aagauuucagaguuugggggaa

SEQ ID NO: 954949 - RNA, 22 nt, Human
uacaguaaccuuauuugucauu

SEQ ID NO: 954950 - RNA, 22 nt, Human
aggucagcaggccaggggcgaa

SEQ ID NO: 954951 - RNA, 22 nt, Human
agagcugugcuuugcaccacgu

SEQ ID NO: 954952 - RNA, 22 nt, Human
ccugggaguggcacucacagca

SEQ ID NO: 954953 - RNA, 22 nt, Human
ccaaagugcugagauuacaggu

SEQ ID NO: 954954 - RNA, 22 nt, Human
gagccagccgcaagagcuguga

SEQ ID NO: 954955 - RNA, 22 nt, Human
aggcacugaagaacucuuuuug

SEQ ID NO: 954956 - RNA, 22 nt, Human
ucucaggggauucacuggcacc

SEQ ID NO: 954957 - RNA, 22 nt, Human
aucugguuuggggauccuugug

SEQ ID NO: 954958 - RNA, 22 nt, Human
aacauaaauuugaaguggcaaa

SEQ ID NO: 954959 - RNA, 22 nt, Human
agcagcauuaugauauaucuua

SEQ ID NO: 954960 - RNA, 19 nt, Human
ucaggacugacuugaaguc

SEQ ID NO: 954961 - RNA, 22 nt, Human
acaggugguaaaauggacuguc

SEQ ID NO: 954962 - RNA, 22 nt, Human
auggccaagaucacagacuuca

SEQ ID NO: 954963 - RNA, 22 nt, Human
ggcuucucucuucacauggcuu

SEQ ID NO: 954964 - RNA, 22 nt, Human
uagcugugagcacccaggcugu

SEQ ID NO: 954965 - RNA, 22 nt, Human
cagagcugcacauucuaugaug

SEQ ID NO: 954966 - RNA, 22 nt, Human
ugcauauuauguguaucugucu

SEQ ID NO: 954967 - RNA, 22 nt, Human
auggacagugugucuguuucca

SEQ ID NO: 954968 - RNA, 22 nt, Human
agagccaggcggcugggcaccu

SEQ ID NO: 954969 - RNA, 22 nt, Human
gucccugcaucaccacgggacu

SEQ ID NO: 954970 - RNA, 17 nt, Human
gcuuccucaugcaguuc

SEQ ID NO: 954971 - RNA, 22 nt, Human
cagauggcauuuccuuucuggc

SEQ ID NO: 954972 - RNA, 22 nt, Human
uacaaagucaccagcuucuugc

SEQ ID NO: 954973 - RNA, 22 nt, Human
ucaggaggccaccaggaccugu

SEQ ID NO: 954974 - RNA, 22 nt, Human
accugccuauggagccacaugg

SEQ ID NO: 954975 - RNA, 22 nt, Human
ucuggccacuaauaggucucac

SEQ ID NO: 954976 - RNA, 20 nt, Human
ugcagaagaacguucugguu

SEQ ID NO: 954977 - RNA, 22 nt, Human
guaauaaugguccccaaacacu

SEQ ID NO: 954978 - RNA, 22 nt, Human
ucucccacuggccuuguaugau

SEQ ID NO: 954979 - RNA, 22 nt, Human
acccuuucuuacucacacgcuc

SEQ ID NO: 954980 - RNA, 22 nt, Human
guggcuucugcggugugcgcag

SEQ ID NO: 954981 - RNA, 22 nt, Human
acuguggggggcuuugcucagu

SEQ ID NO: 954982 - RNA, 22 nt, Human
cagcuugcaguacuuguuuuug

SEQ ID NO: 954983 - RNA, 22 nt, Human
ugcagcagacugaguaugagaa

SEQ ID NO: 954984 - RNA, 22 nt, Human
ccuggcugugcauugccggccc

SEQ ID NO: 954985 - RNA, 22 nt, Human
cucugagcugaaacaugagcau

SEQ ID NO: 954986 - RNA, 22 nt, Human
agggaaagguagugaggucaca

SEQ ID NO: 954987 - RNA, 22 nt, Human
uuuaggaugcucuauucugacu

SEQ ID NO: 954988 - RNA, 22 nt, Human
ccuugcguuuuacagcuucuag

SEQ ID NO: 954989 - RNA, 22 nt, Human
cuccaguaucuguaggaaaagg

SEQ ID NO: 954990 - RNA, 22 nt, Human
aggcacugaccugcuuccuuga

SEQ ID NO: 954991 - RNA, 22 nt, Human
caugugguucaaguacuccaca

SEQ ID NO: 954992 - RNA, 22 nt, Human
uguaggauguaaggcaggcauc

SEQ ID NO: 954993 - RNA, 22 nt, Human
gccugccucaaaaucccaguuc

SEQ ID NO: 954994 - RNA, 18 nt, Human
gcuccuggagucugacuc

SEQ ID NO: 954995 - RNA, 19 nt, Human
ucauucaggaccaguggau

SEQ ID NO: 954996 - RNA, 23 nt, Human
ugcucccaggugacgcugcuguu

SEQ ID NO: 954997 - RNA, 18 nt, Human
ggagccagucugucucug

SEQ ID NO: 954998 - RNA, 19 nt, Human
gauuucuacaaaugucaga

SEQ ID NO: 954999 - RNA, 22 nt, Human
aaacuguaaacacagcaguaca

SEQ ID NO: 955000 - RNA, 22 nt, Human
acucucucacagcuuggcugau

SEQ ID NO: 955001 - RNA, 20 nt, Human
caaugcacacagcugcuucu

SEQ ID NO: 955002 - RNA, 22 nt, Human
gugucccaggagaggagacaau

SEQ ID NO: 955003 - RNA, 22 nt, Human
cuuccaaagcacuuuauggacc

SEQ ID NO: 955004 - RNA, 22 nt, Human
ugagccaguggaagauggcagu

SEQ ID NO: 955005 - RNA, 22 nt, Human
gggagucugggcuagacuccuu

SEQ ID NO: 955006 - RNA, 22 nt, Human
aggcucugaaggagaaccuguu

SEQ ID NO: 955007 - RNA, 22 nt, Human
ucucaggacuuugggaagcuca

SEQ ID NO: 955008 - RNA, 21 nt, Human
gcugcccaacccugcaucucc

SEQ ID NO: 955009 - RNA, 22 nt, Human
aucuuucaaucaggaaaaaucu

SEQ ID NO: 955010 - RNA, 22 nt, Human
uccaugugccaaggggcagagg

SEQ ID NO: 955011 - RNA, 22 nt, Human
cagcuucccuuggcugagcaga

SEQ ID NO: 955012 - RNA, 22 nt, Human
cagggccauaucuugugcacca

SEQ ID NO: 955013 - RNA, 22 nt, Human
ccugccuggcugucagcagagc

SEQ ID NO: 955014 - RNA, 22 nt, Human
agucucagccacacagaccuau

SEQ ID NO: 955015 - RNA, 22 nt, Human
uucacauuugcccuuaugugug

SEQ ID NO: 955016 - RNA, 22 nt, Human
uuuccucuaaacgcauuugcuu

SEQ ID NO: 955017 - RNA, 21 nt, Human
uucaaaaugguguguuugucu

SEQ ID NO: 955018 - RNA, 22 nt, Human
ugccugggccucugaggaaggc

SEQ ID NO: 955019 - RNA, 22 nt, Human
ucacaggguguacaucaccuau

SEQ ID NO: 955020 - RNA, 22 nt, Human
cugugaggcccugggugcugga

SEQ ID NO: 955021 - RNA, 22 nt, Human
gcccaggcuggagugcaguagc

SEQ ID NO: 955022 - RNA, 22 nt, Human
agcuggcacagaccaggagauc

SEQ ID NO: 955023 - RNA, 22 nt, Human
aggugcagcaugaguccaacgg

SEQ ID NO: 955024 - RNA, 22 nt, Human
gaacagaauuaccgaagaucug

SEQ ID NO: 955025 - RNA, 22 nt, Human
guacauuggcaacucucuuaga

SEQ ID NO: 955026 - RNA, 22 nt, Human
uguauagaguuggaagaugacu

SEQ ID NO: 955027 - RNA, 21 nt, Human
auacacauacacauaaaugug

SEQ ID NO: 955028 - RNA, 21 nt, Human
ucuuccuccacagcgugccac

SEQ ID NO: 955029 - RNA, 21 nt, Human
ggcccugguuacgccuccucu

SEQ ID NO: 955030 - RNA, 22 nt, Human
auagauacauuagguaacuugu

SEQ ID NO: 955031 - RNA, 22 nt, Human
uccaggccacugcagaggcucu

SEQ ID NO: 955032 - RNA, 22 nt, Human
ucugcugcacaaauucaucucu

SEQ ID NO: 955033 - RNA, 22 nt, Human
ggccugcucuggcuguggucag

SEQ ID NO: 955034 - RNA, 22 nt, Human
cugcugugagcacuccagccug

SEQ ID NO: 955035 - RNA, 22 nt, Human
aaagaacaaaugauauaugguu

SEQ ID NO: 955036 - RNA, 22 nt, Human
ugaagcagagaauuugacaguc

SEQ ID NO: 955037 - RNA, 22 nt, Human
ucccagaguuuccuguguccca

SEQ ID NO: 955038 - RNA, 22 nt, Human
ucugaaaucuguaagcacuagc

SEQ ID NO: 955039 - RNA, 22 nt, Human
acucugcuaucuuagcaaaagg

SEQ ID NO: 955040 - RNA, 22 nt, Human
gaaaugcaggcuuggauucagc

SEQ ID NO: 955041 - RNA, 22 nt, Human
gugcagugagcagugcagcacc

SEQ ID NO: 955042 - RNA, 22 nt, Human
ugcaggugguuuggacacugcu

SEQ ID NO: 955043 - RNA, 18 nt, Human
acccucuggcuucugagc

SEQ ID NO: 955044 - RNA, 22 nt, Human
cuggccuagcucucugcuugaa

SEQ ID NO: 955045 - RNA, 22 nt, Human
aauaugaauuauuguuacaagu

SEQ ID NO: 955046 - RNA, 22 nt, Human
gccucccuguucuuccacaaua

SEQ ID NO: 955047 - RNA, 22 nt, Human
aaugaaauguagcuuauccaua

SEQ ID NO: 955048 - RNA, 19 nt, Human
caggaugaucccaugacac

SEQ ID NO: 955049 - RNA, 22 nt, Human
ugcagaagauggucugagcacc

SEQ ID NO: 955050 - RNA, 22 nt, Human
aguuucaauucuuuucacaaag

SEQ ID NO: 955051 - RNA, 22 nt, Human
aggugcuggagucugggcagga

SEQ ID NO: 955052 - RNA, 18 nt, Human
cuucagugacagucuggc

SEQ ID NO: 955053 - RNA, 22 nt, Human
guccuggcuuaguucgcuguaa

SEQ ID NO: 955054 - RNA, 22 nt, Human
caagauggagaagcagcaaggg

SEQ ID NO: 955055 - RNA, 22 nt, Human
ugcuguggcaguuuauguauag

SEQ ID NO: 955056 - RNA, 22 nt, Human
aggcuagcaaugggagaugagu

SEQ ID NO: 955057 - RNA, 22 nt, Human
gggcugcacagaucuucaaggg

SEQ ID NO: 955058 - RNA, 22 nt, Human
cagcugugaauugucuuaucua

SEQ ID NO: 955059 - RNA, 21 nt, Human
gauugaaaccauggcagugag

SEQ ID NO: 955060 - RNA, 17 nt, Human
aauagcugcucagagag

SEQ ID NO: 955061 - RNA, 23 nt, Human
caguggagacucaugcuuccuua

SEQ ID NO: 955062 - RNA, 22 nt, Human
agaggccagguccagaguuugu

SEQ ID NO: 955063 - RNA, 22 nt, Human
gccuggagugguccugcugccc

SEQ ID NO: 955064 - RNA, 22 nt, Human
uuucaguuuaugucuugaauua

SEQ ID NO: 955065 - RNA, 22 nt, Human
gagggcagaaaauuaugcggug

SEQ ID NO: 955066 - RNA, 22 nt, Human
uuggccaaauacacaccuuuug

SEQ ID NO: 955067 - RNA, 22 nt, Human
acugucugcaaaacucauacuc

SEQ ID NO: 955068 - RNA, 22 nt, Human
guuauaaaggugauaaugguca

SEQ ID NO: 955069 - RNA, 22 nt, Human
uugauagguuuuauguauaguu

SEQ ID NO: 955070 - RNA, 22 nt, Influenza A virus
acaggcauucaaaugggacugu

SEQ ID NO: 955071 - RNA, 22 nt, Influenza A virus
uccuggaagagaaggcaauggu

SEQ ID NO: 955072 - RNA, 22 nt, Human
auuauuagauucuuaauuguaa

SEQ ID NO: 955073 - RNA, 22 nt, Human
aaagauaugucuccaaagagau

SEQ ID NO: 955074 - RNA, 22 nt, Human
agucugcuuccuggagaacuca

SEQ ID NO: 955075 - RNA, 22 nt, Human
cuggccaagcuucucuaagcag

SEQ ID NO: 955076 - RNA, 22 nt, Human
cugaaaugguugccuggagaau

SEQ ID NO: 955077 - RNA, 22 nt, Human
aaguaugugauacauguuaauu

SEQ ID NO: 955078 - RNA, 22 nt, Human
ucuccuggguaaaaggguugau

SEQ ID NO: 955079 - RNA, 22 nt, Human
auguuguagcauaugaaauaua

SEQ ID NO: 955080 - RNA, 22 nt, Human
aaaugauggaaaugaggcugaa

SEQ ID NO: 955081 - RNA, 22 nt, Human
uuauuugguugcugacuuggaa

SEQ ID NO: 955082 - RNA, 22 nt, Human
aauguuauuacacuugugaaau

SEQ ID NO: 955083 - RNA, 22 nt, Human
uauuggaugauucacuuggcag

SEQ ID NO: 955084 - RNA, 22 nt, Human
auucacaauagcagcuugcaug

SEQ ID NO: 955085 - RNA, 22 nt, Human
auucacaaauaacaggugcaga

SEQ ID NO: 955086 - RNA, 22 nt, Human
gacacuaaaguauaggguaucu

SEQ ID NO: 955087 - RNA, 22 nt, Human
aaagcagcagcaccugcauuuc

SEQ ID NO: 955088 - RNA, 22 nt, Human
aaauaggagcuuaagcacuucu

SEQ ID NO: 955089 - RNA, 22 nt, Human
ucucugcuaagauugugucuag

SEQ ID NO: 955090 - RNA, 22 nt, Human
ucugagccuauuucaaauuccu

SEQ ID NO: 955091 - RNA, 22 nt, Human
auuauaaagaacaugugugugg

SEQ ID NO: 955092 - RNA, 22 nt, Human
auauuagggucucuaaauucua

SEQ ID NO: 955093 - RNA, 22 nt, Human
guuuaauaauguugaauuacua

SEQ ID NO: 955094 - RNA, 22 nt, Human
acucugcucccuaagccaugau

SEQ ID NO: 955095 - RNA, 22 nt, Human
uggcacaugguaagugcuuaac

SEQ ID NO: 955096 - RNA, 22 nt, Human
uauuaggguaaauuugacaugc

SEQ ID NO: 955097 - RNA, 22 nt, Human
uugauaaaaugaugaaaucacu

SEQ ID NO: 955098 - RNA, 22 nt, Human
acauagaaccuggcacauagua

SEQ ID NO: 955099 - RNA, 22 nt, Human
uucaacuagauuuauacaauuc

SEQ ID NO: 955100 - RNA, 21 nt, Human
ucuccuggguccaacccaugc

SEQ ID NO: 955101 - RNA, 22 nt, Human
uuauuuggguuugaguguggca

SEQ ID NO: 955102 - RNA, 22 nt, Human
cugggccaagaaguuguguaug

SEQ ID NO: 955103 - RNA, 23 nt, Human
auagucauguaaaauauuugaag

SEQ ID NO: 955104 - RNA, 22 nt, Human
ucacucuguggcccaggcagug

SEQ ID NO: 955105 - RNA, 22 nt, Human
auaauguguucaucuuacaauu

SEQ ID NO: 955106 - RNA, 22 nt, Human
cauucacaucuuguuccaucac

SEQ ID NO: 955107 - RNA, 22 nt, Human
ucuggccaggggucccugaagg

SEQ ID NO: 955108 - RNA, 22 nt, Human
cuacucugaauugaagugauau

SEQ ID NO: 955109 - RNA, 22 nt, Human
uauuagguaugaacuggcaacc

SEQ ID NO: 955110 - RNA, 22 nt, Human
aaugauguauguauaaggcagg

SEQ ID NO: 955111 - RNA, 22 nt, Human
gaaaaguacacagcccaaacau

SEQ ID NO: 955112 - RNA, 22 nt, Human
ucacucugguccauccgagagc

SEQ ID NO: 955113 - RNA, 22 nt, Human
cugagccaugagccugcgccca

SEQ ID NO: 955114 - RNA, 22 nt, Human
acuccugggugcauuucugauu

SEQ ID NO: 955115 - RNA, 22 nt, Human
auauuaggcaaggagauuauuu

SEQ ID NO: 955116 - RNA, 22 nt, Human
ggcagcauuuagagcacagugu

SEQ ID NO: 955117 - RNA, 22 nt, Human
cucuggccugcagauccaugcu

SEQ ID NO: 955118 - RNA, 22 nt, Human
aaauaguuacuucugcugucuu

SEQ ID NO: 955119 - RNA, 22 nt, Human
gcucugcuuucuggggggaucc

SEQ ID NO: 955120 - RNA, 22 nt, Human
cuuauuagugucugucugaguu

SEQ ID NO: 955121 - RNA, 22 nt, Human
aaaucaguaaauguucauuaac

SEQ ID NO: 955122 - RNA, 22 nt, Human
gaccuuuuuacuguguacgcug

SEQ ID NO: 955123 - RNA, 22 nt, Human
cacucugcgcugggcgccagcg

SEQ ID NO: 955124 - RNA, 22 nt, Human
cuuauuagaaagaaaagacaug

SEQ ID NO: 955125 - RNA, 22 nt, Human
uguuuauuacaguucuuggaau

SEQ ID NO: 955126 - RNA, 22 nt, Human
uaggcaauauuagacuuugucu

SEQ ID NO: 955127 - RNA, 22 nt, Human
uuuaguagaugcagcauuauuu

SEQ ID NO: 955128 - RNA, 21 nt, Human
auuguuaucauugugcugugu

SEQ ID NO: 955129 - RNA, 22 nt, Human
gaagccuugaacugcaaacccc

SEQ ID NO: 955130 - RNA, 22 nt, Human
cuccuggaagcccgcccugcug

SEQ ID NO: 955131 - RNA, 22 nt, Human
ucuccuggagcaggaagguggg

SEQ ID NO: 955132 - RNA, 22 nt, Human
aagaguaugcaugcauguuugu

SEQ ID NO: 955133 - RNA, 22 nt, Human
ucuucaaaaaauauccaucagu

SEQ ID NO: 955134 - RNA, 20 nt, Human
uuggcagcaguuccaaguga

SEQ ID NO: 955135 - RNA, 22 nt, Human
ccuccugggacucauuagcacc

SEQ ID NO: 955136 - RNA, 19 nt, Human
caugcugaccugcuguggu

SEQ ID NO: 955137 - RNA, 22 nt, Human
acucuggcccuccugcugccag

SEQ ID NO: 955138 - RNA, 22 nt, Human
cagcaggguagguuguaucagu

SEQ ID NO: 955139 - RNA, 22 nt, Human
ccuggccagcagccccuuccuc

SEQ ID NO: 955140 - RNA, 22 nt, Human
acuggccaugaacuugggaucu

SEQ ID NO: 955141 - RNA, 22 nt, Human
acucucugguauuggcaaguuu

SEQ ID NO: 955142 - RNA, 22 nt, Human
ucuccuggcaugugggucaucu

SEQ ID NO: 955143 - RNA, 22 nt, Human
aagucauugguagcuugauagg

SEQ ID NO: 955144 - RNA, 22 nt, Human
ucugaagccuuuguacaggccu

SEQ ID NO: 955145 - RNA, 22 nt, Human
uuguuacuaagccuuuaaauag

SEQ ID NO: 955146 - RNA, 22 nt, Human
agagucuuuugucaguaauguu

SEQ ID NO: 955147 - RNA, 18 nt, Human
augugcaauuuuguauuu

SEQ ID NO: 955148 - RNA, 22 nt, Human
ugaagggggagauauaugugug

SEQ ID NO: 955149 - RNA, 19 nt, Human
ucucugcuucucuuggcau

SEQ ID NO: 955150 - RNA, 22 nt, Human
auuauuagugauguuguuacug

SEQ ID NO: 955151 - RNA, 22 nt, Human
cugaaaugacgguuuggggcaa

SEQ ID NO: 955152 - RNA, 18 nt, Human
gcacucugacugcagagc

SEQ ID NO: 955153 - RNA, 22 nt, Human
cugccuggguucaaguccuguu

SEQ ID NO: 955154 - RNA, 22 nt, Human
caaaaguaauugugguuuuugc

SEQ ID NO: 955155 - RNA, 21 nt, Human
gacucugcaccaaauuaagcc

SEQ ID NO: 955156 - RNA, 21 nt, Human
uggccaaacuggagcauuuga

SEQ ID NO: 955157 - RNA, 22 nt, Human
acucugcuaucuuagcaaaagg

SEQ ID NO: 955158 - RNA, 22 nt, Human
gaaacacaugcagcuccauaga

SEQ ID NO: 955159 - RNA, 21 nt, Human
uuugaauagaaauagugcuua

SEQ ID NO: 955160 - RNA, 22 nt, Human
aaaaaguauuggccaugguuga

SEQ ID NO: 955161 - RNA, 18 nt, Human
uuuaugagcugugggacc

SEQ ID NO: 955162 - RNA, 22 nt, Human
auuggucaggacuggcaugugg

SEQ ID NO: 955163 - RNA, 22 nt, Human
ccugggcaggccggacgcuggg

SEQ ID NO: 955164 - RNA, 22 nt, Human
guucacaagaguuacagacaga

SEQ ID NO: 955165 - RNA, 22 nt, Human
uggcagcaccagcaguguccuu

SEQ ID NO: 955166 - RNA, 19 nt, Human
agucugcauuucuagcaag

SEQ ID NO: 955167 - RNA, 22 nt, Human
uuauuagggugguuuauguucu

SEQ ID NO: 955168 - RNA, 22 nt, Human
uccugagcugccgcaucagcag

SEQ ID NO: 955169 - RNA, 22 nt, Human
aacagacauauuuuuaauaugc

SEQ ID NO: 955170 - RNA, 22 nt, Human
ccucugcucccuggugucugag

SEQ ID NO: 955171 - RNA, 22 nt, Human
agcaugcgcuugaucagcucca

SEQ ID NO: 955172 - RNA, 22 nt, Human
aguuuaaaucauguuuuguaac

SEQ ID NO: 955173 - RNA, 22 nt, Human
auuaaggaauguaggcaagaag

SEQ ID NO: 955174 - RNA, 22 nt, Human
guacauuucauuuaaaugaugu

SEQ ID NO: 955175 - RNA, 22 nt, Human
aaauacaguguguguucuuuga

SEQ ID NO: 955176 - RNA, 22 nt, Human
aaucauaauucaaauaagcuua

SEQ ID NO: 955177 - RNA, 22 nt, Human
acucugcuugcccaauggaaac

SEQ ID NO: 955178 - RNA, 22 nt, Human
aggauuugaaccugcauccagu

SEQ ID NO: 955179 - RNA, 22 nt, Human
cugccuugguuucuagcagggc

SEQ ID NO: 955180 - RNA, 22 nt, Human
uuauuaugguauuucuuugcag

SEQ ID NO: 955181 - RNA, 22 nt, Human
uuuauauuucccaggauuggcc

SEQ ID NO: 955182 - RNA, 17 nt, Human
uuaagguggaucagcac

SEQ ID NO: 955183 - RNA, 22 nt, Human
ucugcaggaggcuggcugcagg

SEQ ID NO: 955184 - RNA, 18 nt, Human
auguauguacauauuuau

SEQ ID NO: 955185 - RNA, 22 nt, Human
uuuauuauguacaggcacuaua

SEQ ID NO: 955186 - RNA, 22 nt, Human
acucugcucaaaguccugaggc

SEQ ID NO: 955187 - RNA, 22 nt, Human
uuuaugagcaccuuggcccaga

SEQ ID NO: 955188 - RNA, 22 nt, Human
gcuggccauauauuuugcuguu

SEQ ID NO: 955189 - RNA, 22 nt, Human
ucugagccaauuucugugucca

SEQ ID NO: 955190 - RNA, 22 nt, Human
uucagcaaugacagccuauaua

SEQ ID NO: 955191 - RNA, 22 nt, Human
ucuucaaacugaaaauuuagaa

SEQ ID NO: 955192 - RNA, 22 nt, Human
auauuaaugagcaaguaaguga

SEQ ID NO: 955193 - RNA, 22 nt, Human
aaaacaguuauaaacagaguca

SEQ ID NO: 955194 - RNA, 18 nt, Human
uguuaggaagggcacaca

SEQ ID NO: 955195 - RNA, 22 nt, Human
gucauggaggauugugaguggu

SEQ ID NO: 955196 - RNA, 22 nt, Human
cuccugggaauuuaguugugag

SEQ ID NO: 955197 - RNA, 22 nt, Human
uagaacaugugaaaauauagcc

SEQ ID NO: 955198 - RNA, 22 nt, Human
gcacucugccaggucuccugau

SEQ ID NO: 955199 - RNA, 22 nt, Human
guauuagggccaaaggcaggaa

SEQ ID NO: 955200 - RNA, 22 nt, Human
cugagggugcuauucuugccuu

SEQ ID NO: 955201 - RNA, 22 nt, Human
acauuucuuucuauucaguagc

SEQ ID NO: 955202 - RNA, 22 nt, Human
ggccacaacuugcuccuagccc

SEQ ID NO: 955203 - RNA, 22 nt, Human
uuuuaugugcuggacuggcagu

SEQ ID NO: 955204 - RNA, 22 nt, Human
uuggccaacauggugaaacccc

SEQ ID NO: 955205 - RNA, 22 nt, Human
uauucacaggcuggagugaugu

SEQ ID NO: 955206 - RNA, 22 nt, Human
ccuccugggccuugcucuguga

SEQ ID NO: 955207 - RNA, 22 nt, Human
aaaucagucccucuuggaauuu

SEQ ID NO: 955208 - RNA, 22 nt, Human
auggccaaauaacagcuugcau

SEQ ID NO: 955209 - RNA, 22 nt, Human
uuucauuauaaaaaguuggcuu

SEQ ID NO: 955210 - RNA, 20 nt, Human
auuaggauuuuaggucauca

SEQ ID NO: 955211 - RNA, 22 nt, Human
cugugccaucugcacucucguc

SEQ ID NO: 955212 - RNA, 22 nt, Human
uuucacaaguaaaguccuaagu

SEQ ID NO: 955213 - RNA, 22 nt, Human
ucuccugggcuugguugaaguu

SEQ ID NO: 955214 - RNA, 22 nt, Human
auaaacaucuguuucucuucug

SEQ ID NO: 955215 - RNA, 22 nt, Human
uuggcaucaguguaggaccugu

SEQ ID NO: 955216 - RNA, 22 nt, Human
uuaggcauuggaaggucagcuu

SEQ ID NO: 955217 - RNA, 22 nt, Human
cauguguaugcauucauacaua

SEQ ID NO: 955218 - RNA, 20 nt, Human
uguuccaagcuaaugaauga

SEQ ID NO: 955219 - RNA, 22 nt, Human
ucacaaagggagggauagcugg

SEQ ID NO: 955220 - RNA, 22 nt, Human
aauucacaaaaccagauugcuu

SEQ ID NO: 955221 - RNA, 22 nt, Human
uuuauguaauuucauaggugug

SEQ ID NO: 955222 - RNA, 22 nt, Human
gcugauguuuaguugauguuac

SEQ ID NO: 955223 - RNA, 22 nt, Human
auuaggaaacugaaugucagaa

SEQ ID NO: 955224 - RNA, 22 nt, Human
acagggaacaggaauauacaaa

SEQ ID NO: 955225 - RNA, 22 nt, Human
uaggauaugguagaaaucauuc

SEQ ID NO: 955226 - RNA, 23 nt, Human
uggcuaaaggcucuaguccugcu

SEQ ID NO: 955227 - RNA, 22 nt, Human
ucauugaagugacugaaagauu

SEQ ID NO: 955228 - RNA, 22 nt, Human
caucuuuuggccuauucugagg

SEQ ID NO: 955229 - RNA, 22 nt, Human
agacauuuggaagauacacaua

SEQ ID NO: 955230 - RNA, 22 nt, Human
uugcaguugucuuuccuaauuu

SEQ ID NO: 955231 - RNA, 22 nt, Human
guaauguguuuugaaaaacagu

SEQ ID NO: 955232 - RNA, 22 nt, Human
gcaauaaauaacauggaagaca

SEQ ID NO: 955233 - RNA, 22 nt, Human
augauugguggucagcaguaug

SEQ ID NO: 955234 - RNA, 22 nt, Human
ucuggccaacccucaaguugua

SEQ ID NO: 955235 - RNA, 22 nt, Human
gcuccugggcucuaccuugcua

SEQ ID NO: 955236 - RNA, 22 nt, Human
ugaggccagcuucagcagugga

SEQ ID NO: 955237 - RNA, 22 nt, Human
uuacuggcugggccugagggcu

SEQ ID NO: 955238 - RNA, 22 nt, Human
caguuuaaccuauccauuaugu

SEQ ID NO: 955239 - RNA, 22 nt, Human
acuaacauguuaaucaaaagaa

SEQ ID NO: 955240 - RNA, 22 nt, Human
gaaaaagugaccuugguagcua

SEQ ID NO: 955241 - RNA, 22 nt, Human
gcucugcugggugggcaguuau

SEQ ID NO: 955242 - RNA, 22 nt, Human
uuaaagagucuacugcacaucc

SEQ ID NO: 955243 - RNA, 22 nt, Human
cuccuggcucugccacuuacua

SEQ ID NO: 955244 - RNA, 22 nt, Human
ucuuggccagguguggugccuc

SEQ ID NO: 955245 - RNA, 22 nt, Human
agcuccugcucuuugucccuaa

SEQ ID NO: 955246 - RNA, 22 nt, Human
acucugcugauagguccucaga

SEQ ID NO: 955247 - RNA, 22 nt, Human
ugcugaaagucccaaaucucau

SEQ ID NO: 955248 - RNA, 22 nt, Human
aaagauguuuuauaaguuaugg

SEQ ID NO: 955249 - RNA, 22 nt, Human
ucacucuguguuugaacucaag

SEQ ID NO: 955250 - RNA, 22 nt, Human
uagaaaugauuuugaugcuuca

SEQ ID NO: 955251 - RNA, 22 nt, Human
ugucccaguuggguauugaauu

SEQ ID NO: 955252 - RNA, 22 nt, Human
uggaagagacacuuacauucag

SEQ ID NO: 955253 - RNA, 22 nt, Human
uggcagcagggccccuggagga

SEQ ID NO: 955254 - RNA, 21 nt, Human
ccugggccaaauucccuggac

SEQ ID NO: 955255 - RNA, 22 nt, Human
aaauuauuuucagaauggagaa

SEQ ID NO: 955256 - RNA, 22 nt, Human
uuggccaagauacgagcacaua

SEQ ID NO: 955257 - RNA, 22 nt, Human
gcucugcuaauauuguaguacc

SEQ ID NO: 955258 - RNA, 22 nt, Human
guggccaacucaauguuuuuca

SEQ ID NO: 955259 - RNA, 23 nt, Human
uggccaagauaaucucaguuuuc

SEQ ID NO: 955260 - RNA, 22 nt, Human
aauuaggaaaugagaguauuug

SEQ ID NO: 955261 - RNA, 22 nt, Human
ucuuggcaauuugaucucaguu

SEQ ID NO: 955262 - RNA, 22 nt, Human
cagacauauguuuuaacagauu

SEQ ID NO: 955263 - RNA, 22 nt, Human
auuauuagacuuauaugguagu

SEQ ID NO: 955264 - RNA, 21 nt, Human
auguaggaguuauuggaacag

SEQ ID NO: 955265 - RNA, 19 nt, Human
acauuuaaauucagaucuc

SEQ ID NO: 955266 - RNA, 22 nt, Human
acaguuauucuuuaugcaacca

SEQ ID NO: 955267 - RNA, 22 nt, Human
aacacauauuuauauaugcaca

SEQ ID NO: 955268 - RNA, 22 nt, Human
uacaaaaaauugauacugacga

SEQ ID NO: 955269 - RNA, 22 nt, Human
uuucacaacacaaucucguuaa

SEQ ID NO: 955270 - RNA, 23 nt, Human
guuguaauggauaaugcaaauug

SEQ ID NO: 955271 - RNA, 22 nt, Human
cagaggaguucaguacacagcc

SEQ ID NO: 955272 - RNA, 22 nt, Human
auuuggcaaauaauuugagggu

SEQ ID NO: 955273 - RNA, 22 nt, Human
augcacuacuagaugcaaaagu

SEQ ID NO: 955274 - RNA, 19 nt, Human
uauucaggaugauggcaca

SEQ ID NO: 955275 - RNA, 22 nt, Human
acaaaguaggucaucaaagcuc

SEQ ID NO: 955276 - RNA, 22 nt, Human
guaaaauagaauaacguggcua

SEQ ID NO: 955277 - RNA, 20 nt, Human
ugagccaaacgaugaagagc

SEQ ID NO: 955278 - RNA, 22 nt, Human
cuucaugcugauauccucgaug

SEQ ID NO: 955279 - RNA, 22 nt, Human
uggucaaaaacucucaguggac

SEQ ID NO: 955280 - RNA, 21 nt, Human
cuggccgaccccucugugcuc

SEQ ID NO: 955281 - RNA, 19 nt, Human
cugggccagagcuguccuc

SEQ ID NO: 955282 - RNA, 22 nt, Human
ucauaaaaauagacucuaaagu

SEQ ID NO: 955283 - RNA, 22 nt, Human
ugaggccagucucaucacaggc

SEQ ID NO: 955284 - RNA, 20 nt, Human
ucuccuggucugguccgugc

SEQ ID NO: 955285 - RNA, 21 nt, Human
uucugagcacucaucacuguc

SEQ ID NO: 955286 - RNA, 20 nt, Human
uccugagccuccaccauguc

SEQ ID NO: 955287 - RNA, 22 nt, Human
acacagaguauuuagaaggggu

SEQ ID NO: 955288 - RNA, 22 nt, Human
auuuauuauugugguuacuucu

SEQ ID NO: 955289 - RNA, 22 nt, Human
aauaaaaugaacugguagaguu

SEQ ID NO: 955290 - RNA, 22 nt, Human
gugauaaagacgugucauaauu

SEQ ID NO: 955291 - RNA, 22 nt, Human
aagaauaaauuaagauacuuag

SEQ ID NO: 955292 - RNA, 22 nt, Human
cauuccuuaacguggggagucu

SEQ ID NO: 955293 - RNA, 22 nt, Human
uuuucauuguuacuaugagcua

SEQ ID NO: 955294 - RNA, 22 nt, Human
aaaagguaguugccaaauaagg

SEQ ID NO: 955295 - RNA, 22 nt, Human
cugggccacaagccugugugau

SEQ ID NO: 955296 - RNA, 22 nt, Human
ggauuuggaagaccgggucaca

SEQ ID NO: 955297 - RNA, 22 nt, Human
uggcaacaugucgaagugcugu

SEQ ID NO: 955298 - RNA, 22 nt, Human
aggagacauaacuaugaugaga

SEQ ID NO: 955299 - RNA, 22 nt, Human
cucugcuaagcaugaacaauua

SEQ ID NO: 955300 - RNA, 22 nt, Human
cagucauuuuauuugaaaauua

SEQ ID NO: 955301 - RNA, 22 nt, Human
uccuggccuugcuccugaugcc

SEQ ID NO: 955302 - RNA, 22 nt, Human
uuaaaugaugcauaucauuuag

SEQ ID NO: 955303 - RNA, 22 nt, Human
caugcaggcccgccugaauggg

SEQ ID NO: 955304 - RNA, 22 nt, Human
uuauuagguuuacauaaagguu

SEQ ID NO: 955305 - RNA, 22 nt, Human
uccugggcgguuaugugaucug

SEQ ID NO: 955306 - RNA, 22 nt, Human
acuuccugcaaucguccacucc

SEQ ID NO: 955307 - RNA, 22 nt, Human
uguuuaauucaccaucauguuc

SEQ ID NO: 955308 - RNA, 22 nt, Human
auaaugugaagauaaugcaaga

SEQ ID NO: 955309 - RNA, 22 nt, Human
ccagacaggaacacacaucucc

SEQ ID NO: 955310 - RNA, 22 nt, Human
uccugucuaaagaccugcaggc

SEQ ID NO: 955311 - RNA, 23 nt, Human
ccagucucacguauacaggauuu

SEQ ID NO: 955312 - RNA, 22 nt, Human
uuuauaagaagcaaugucugag

SEQ ID NO: 955313 - RNA, 22 nt, Human
uuuuaugauugagcuggcuaca

SEQ ID NO: 955314 - RNA, 22 nt, Human
caaguaaagaaucacauuucuu

SEQ ID NO: 955315 - RNA, 22 nt, Human
caccguuugguuuggauuuaca

SEQ ID NO: 955316 - RNA, 22 nt, Human
uuggcagauuugucaguaagcu

SEQ ID NO: 955317 - RNA, 22 nt, Human
caaggugcagcguugucaagcu

SEQ ID NO: 955318 - RNA, 22 nt, Human
uuauuagagauauuugguuagg

SEQ ID NO: 955319 - RNA, 22 nt, Human
uuauuagguuauucucuguacu

SEQ ID NO: 955320 - RNA, 22 nt, Human
acugccugcucauaacauugcu

SEQ ID NO: 955321 - RNA, 22 nt, Human
auuuauuaugggauuuggcaca

SEQ ID NO: 955322 - RNA, 22 nt, Human
caaaaguaauggcgguuuuuac

SEQ ID NO: 955323 - RNA, 22 nt, Human
accaaacaaaauugugcacugu

SEQ ID NO: 955324 - RNA, 22 nt, Human
uccuggcccacuaugccagcau

SEQ ID NO: 955325 - RNA, 22 nt, Human
cagcuccugaggacugcuggga

SEQ ID NO: 955326 - RNA, 22 nt, Human
cagucauuggcuaaagcucccu

SEQ ID NO: 955327 - RNA, 22 nt, Human
cagucucagaggugggaguggg

SEQ ID NO: 955328 - RNA, 22 nt, Human
gcuguuaggugcccugaccuug

SEQ ID NO: 955329 - RNA, 19 nt, Human
cuuauuagagugagagcuu

SEQ ID NO: 955330 - RNA, 22 nt, Human
cuucacaacgacaucugguuag

SEQ ID NO: 955331 - RNA, 22 nt, Human
uaagucaugauucuguguuacu

SEQ ID NO: 955332 - RNA, 17 nt, Human
acuccuggucugaaggg

SEQ ID NO: 955333 - RNA, 22 nt, Human
auaaaaaggacagauguggucu

SEQ ID NO: 955334 - RNA, 22 nt, Human
acagaccucuagauuacauuug

SEQ ID NO: 955335 - RNA, 22 nt, Human
uggucaaaaaggccuagacaca

SEQ ID NO: 955336 - RNA, 22 nt, Human
uuggccaacagcgacagggcca

SEQ ID NO: 955337 - RNA, 22 nt, Human
uggcacauaguaggugcucaau

SEQ ID NO: 955338 - RNA, 22 nt, Human
ucuggccaggauggcaagacca

SEQ ID NO: 955339 - RNA, 22 nt, Human
cugagccuguguuucucuggca

SEQ ID NO: 955340 - RNA, 22 nt, Human
cucaaauauguggucagaaagc

SEQ ID NO: 955341 - RNA, 22 nt, Human
guggccaaggugcagagcagcu

SEQ ID NO: 955342 - RNA, 16 nt, Human
gcuccugggcccucga

SEQ ID NO: 955343 - RNA, 22 nt, Human
guaaauaacugguaauuggggu

SEQ ID NO: 955344 - RNA, 22 nt, Human
uggccaaaguagaaaauaauag

SEQ ID NO: 955345 - RNA, 22 nt, Human
aacucugcuuauaguuugucca

SEQ ID NO: 955346 - RNA, 22 nt, Human
cugaagccaugugcucacuggu

SEQ ID NO: 955347 - RNA, 22 nt, Human
uuaauaaacaggugcagcugaa

SEQ ID NO: 955348 - RNA, 22 nt, Human
acuggccagaacuaagucacau

SEQ ID NO: 955349 - RNA, 22 nt, Human
uccaagggaauuuaaaguugcu

SEQ ID NO: 955350 - RNA, 22 nt, Human
ugaaugugaugcuaaacauaug

SEQ ID NO: 955351 - RNA, 22 nt, Human
agacauaagugcuaugacauug

SEQ ID NO: 955352 - RNA, 22 nt, Human
gcuggccauggccugcgccauc

SEQ ID NO: 955353 - RNA, 17 nt, Human
cagacaggcugucaccc

SEQ ID NO: 955354 - RNA, 22 nt, Human
uagaauauacacuacagcuuaa

SEQ ID NO: 955355 - RNA, 22 nt, Human
acaccuuuuauucgccaggcac

SEQ ID NO: 955356 - RNA, 22 nt, Human
uuggccaaagcucaccagugcu

SEQ ID NO: 955357 - RNA, 22 nt, Human
ucacaagaauuuguagaugaaa

SEQ ID NO: 955358 - RNA, 22 nt, Human
uuuucauuguuccucgagcauu

SEQ ID NO: 955359 - RNA, 22 nt, Human
acucugcuggcugcagggcagc

SEQ ID NO: 955360 - RNA, 22 nt, Human
uggucaacaggcagggaugaaa

SEQ ID NO: 955361 - RNA, 22 nt, Human
aaaguaaccuaguaauaguguc

SEQ ID NO: 955362 - RNA, 22 nt, Human
uauauuaaagugcuuugcagug

SEQ ID NO: 955363 - RNA, 22 nt, Human
ucucugcucugugccucaguuu

SEQ ID NO: 955364 - RNA, 22 nt, Human
uucagcaagaccaccauguacc

SEQ ID NO: 955365 - RNA, 22 nt, Human
auuagguugugcuuuguggaca

SEQ ID NO: 955366 - RNA, 22 nt, Human
gagagcuguuuaucuucuucaa

SEQ ID NO: 955367 - RNA, 22 nt, Human
uuucuuaguccuagagugauuu

SEQ ID NO: 955368 - RNA, 22 nt, Human
guggccaagagauaaaauugug

SEQ ID NO: 955369 - RNA, 22 nt, Human
cacaugugugcugaggacugug

SEQ ID NO: 955370 - RNA, 22 nt, Human
cugggccagcaacugcaaugga

SEQ ID NO: 955371 - RNA, 22 nt, Human
gucuggccugccagcucuggug

SEQ ID NO: 955372 - RNA, 22 nt, Human
caaaaguaauugugguuuucac

SEQ ID NO: 955373 - RNA, 19 nt, Human
agucucacccaagcagucu

SEQ ID NO: 955374 - RNA, 22 nt, Human
ugaaacacuuucaauuacauau

SEQ ID NO: 955375 - RNA, 22 nt, Human
uacaucuagccuuacaauuauu

SEQ ID NO: 955376 - RNA, 22 nt, Human
cuuaauaaaugguagcuguuau

SEQ ID NO: 955377 - RNA, 22 nt, Human
acacauuauagagaguauaaua

SEQ ID NO: 955378 - RNA, 22 nt, Human
acucugcuaaauguguaggcuc

SEQ ID NO: 955379 - RNA, 22 nt, Human
cuaccuuucugacucuugggau

SEQ ID NO: 955380 - RNA, 22 nt, Human
ugcaacauuauuaaacuaagca

SEQ ID NO: 955381 - RNA, 18 nt, Human
auggucucauacugggag

SEQ ID NO: 955382 - RNA, 22 nt, Human
cuggccaagcacuggggucaaa

SEQ ID NO: 955383 - RNA, 21 nt, Human
uccuggcccacucuaucccca

SEQ ID NO: 955384 - RNA, 23 nt, Human
ccagucucuuuccaaaaucacau

SEQ ID NO: 955385 - RNA, 22 nt, Human
ugaauauguuccucacaaguuc

SEQ ID NO: 955386 - RNA, 21 nt, Human
uuuauuaacaacuguggacgu

SEQ ID NO: 955387 - RNA, 22 nt, Human
aaaugugcuucuuacucucaau

SEQ ID NO: 955388 - RNA, 22 nt, Human
auucuuuuuuaaggaauagaac

SEQ ID NO: 955389 - RNA, 22 nt, Human
ucuggccacuaauaggucucac

SEQ ID NO: 955390 - RNA, 22 nt, Human
aaugauguauuaguacaacaca

SEQ ID NO: 955391 - RNA, 22 nt, Human
cagcugacgccagaguggaauu

SEQ ID NO: 955392 - RNA, 22 nt, Human
aaauauaguaaaugcauaguuc

SEQ ID NO: 955393 - RNA, 22 nt, Human
acacauuuaaaaaggaacauau

SEQ ID NO: 955394 - RNA, 22 nt, Human
acaaaaagggagaugagguaga

SEQ ID NO: 955395 - RNA, 19 nt, Human
gucaucuuuuaauaaugug

SEQ ID NO: 955396 - RNA, 22 nt, Human
aggccaaauagcagguuugcua

SEQ ID NO: 955397 - RNA, 22 nt, Human
uuaaguaagaccuuaugucuug

SEQ ID NO: 955398 - RNA, 23 nt, Human
cacuccuguuucuaagccagcau

SEQ ID NO: 955399 - RNA, 22 nt, Human
ccuuuuauaaaguuguauugaa

SEQ ID NO: 955400 - RNA, 22 nt, Human
gcuccuggguguggcugccccu

SEQ ID NO: 955401 - RNA, 23 nt, Human
uuucaacaaugcuuagagaaaac

SEQ ID NO: 955402 - RNA, 19 nt, Human
agcagcuggagguggagug

SEQ ID NO: 955403 - RNA, 22 nt, Human
uugcaaauuccaauccaauauu

SEQ ID NO: 955404 - RNA, 22 nt, Human
cacuaugcuuacaugcuuauau

SEQ ID NO: 955405 - RNA, 22 nt, Human
cugaccaucauggugaaacccc

SEQ ID NO: 955406 - RNA, 22 nt, Human
uccuggccagaggacaaagcug

SEQ ID NO: 955407 - RNA, 22 nt, Human
acuuccugaauggggcuaauua

SEQ ID NO: 955408 - RNA, 22 nt, Human
uucugagguccaugcaguacug

SEQ ID NO: 955409 - RNA, 22 nt, Human
acuccagguuuuuucacugaag

SEQ ID NO: 955410 - RNA, 22 nt, Human
aacucuggagcacgcccuggcc

SEQ ID NO: 955411 - RNA, 22 nt, Human
uuaauaggcuucuaacauagcu

SEQ ID NO: 955412 - RNA, 22 nt, Human
acuucuggauagagucagcuuu

SEQ ID NO: 955413 - RNA, 22 nt, Human
agccuugaacacugacugaagg

SEQ ID NO: 955414 - RNA, 22 nt, Human
uucuuauucuugaaauguggga

SEQ ID NO: 955415 - RNA, 22 nt, Human
aauucacaauguguagucaugc

SEQ ID NO: 955416 - RNA, 22 nt, Human
uccuggccuccguucucugcau

SEQ ID NO: 955417 - RNA, 22 nt, Human
auggccaagaaguauuccugac

SEQ ID NO: 955418 - RNA, 22 nt, Human
aacacauaggcagagcaugaca

SEQ ID NO: 955419 - RNA, 21 nt, Human
acugccugucuccauagucua

SEQ ID NO: 955420 - RNA, 22 nt, Human
aaacugcugguugcuggccagc

SEQ ID NO: 955421 - RNA, 22 nt, Human
acacuugauaggucaaaucagu

SEQ ID NO: 955422 - RNA, 22 nt, Human
agggaagugaaugacagauauc

SEQ ID NO: 955423 - RNA, 20 nt, Human
ccuccuggucaggugugcag

SEQ ID NO: 955424 - RNA, 22 nt, Human
cuauuagguaugugguugcuau

SEQ ID NO: 955425 - RNA, 22 nt, Human
aggaagaauguuuacauaucaa

SEQ ID NO: 955426 - RNA, 22 nt, Human
ucagggaaauuuccauguguuu

SEQ ID NO: 955427 - RNA, 22 nt, Human
uggucaaauuuagucucuggaa

SEQ ID NO: 955428 - RNA, 22 nt, Human
aguguacaguuuguaguacuac

SEQ ID NO: 955429 - RNA, 22 nt, Human
aaagaacaauguggaaucuccu

SEQ ID NO: 955430 - RNA, 22 nt, Human
cuguuuauggagguaaggcauc

SEQ ID NO: 955431 - RNA, 22 nt, Human
aauucacauauacauuauuccu

SEQ ID NO: 955432 - RNA, 22 nt, Human
ugcaugugcccacucuggcuua

SEQ ID NO: 955433 - RNA, 22 nt, Human
uggcaacauggacaggucugcc

SEQ ID NO: 955434 - RNA, 21 nt, Human
auuuggcaaaggcgaugcaca

SEQ ID NO: 955435 - RNA, 22 nt, Human
accuguuuggaggagguguuag

SEQ ID NO: 955436 - RNA, 17 nt, Human
acucugcugaaguagaa

SEQ ID NO: 955437 - RNA, 22 nt, Human
cugagccagggccacacaugga

SEQ ID NO: 955438 - RNA, 22 nt, Human
uuggccaaggaaguagcaacgg

SEQ ID NO: 955439 - RNA, 22 nt, Human
ugaaagcacaaguucuaacagg

SEQ ID NO: 955440 - RNA, 22 nt, Human
ucuuguuaucaggaaaacagua

SEQ ID NO: 955441 - RNA, 22 nt, Human
agaaauguggaggaacagggcu

SEQ ID NO: 955442 - RNA, 22 nt, Human
uuauuagagugcuuugagaaag

SEQ ID NO: 955443 - RNA, 22 nt, Human
aaagacauugaagaaggacuua

SEQ ID NO: 955444 - RNA, 21 nt, Human
ccuggccaaucugauaggguu

SEQ ID NO: 955445 - RNA, 22 nt, Human
uauccaaacauauagucucucu

SEQ ID NO: 955446 - RNA, 22 nt, Human
aagaugcagcaaacuacuuuuu

SEQ ID NO: 955447 - RNA, 22 nt, Human
guccaaauaaguugcaaaauag

SEQ ID NO: 955448 - RNA, 22 nt, Human
agcuuuguauuugagcauacga

SEQ ID NO: 955449 - RNA, 22 nt, Human
ucuccuggcauuugguugagua

SEQ ID NO: 955450 - RNA, 22 nt, Human
ccugugccagcugggcccugcc

SEQ ID NO: 955451 - RNA, 22 nt, Human
aaagcuauuugugaguuauaga

SEQ ID NO: 955452 - RNA, 22 nt, Human
acacauuaugagcaguugucuu

SEQ ID NO: 955453 - RNA, 22 nt, Human
agggucuguggaugcaucuggg

SEQ ID NO: 955454 - RNA, 22 nt, Human
aggccaaauguguauaaaacau

SEQ ID NO: 955455 - RNA, 22 nt, Human
aaagauuaaaucaaauugguca

SEQ ID NO: 955456 - RNA, 21 nt, Human
uggaccaaaguaauuugccuu

SEQ ID NO: 955457 - RNA, 22 nt, Human
uuaaaaugcagauucugauuca

SEQ ID NO: 955458 - RNA, 22 nt, Human
aagcuaugggggaguuucaacc

SEQ ID NO: 955459 - RNA, 22 nt, Human
aauuaggaaauucagccauuuu

SEQ ID NO: 955460 - RNA, 17 nt, Human
uagaauauggugggcug

SEQ ID NO: 955461 - RNA, 22 nt, Human
ugcaugcugcacacaugcguag

SEQ ID NO: 955462 - RNA, 22 nt, Human
gcuggccauagaagccaaagag

SEQ ID NO: 955463 - RNA, 22 nt, Human
uaagccugguucauaauuugcu

SEQ ID NO: 955464 - RNA, 22 nt, Human
cuucugagcagaccuccugggg

SEQ ID NO: 955465 - RNA, 22 nt, Human
aaugugcagaugaauaaacaaa

SEQ ID NO: 955466 - RNA, 21 nt, Human
gucaaacuugcaccagugccc

SEQ ID NO: 955467 - RNA, 22 nt, Human
cuccugcgguacuacugugcuu

SEQ ID NO: 955468 - RNA, 22 nt, Human
gaggaaagcugguuuaaaguau

SEQ ID NO: 955469 - RNA, 22 nt, Human
gaaaaguaaacacuagggguca

SEQ ID NO: 955470 - RNA, 22 nt, Human
aaaguuuggauuagcaguuaga

SEQ ID NO: 955471 - RNA, 22 nt, Human
uaccuuuugcuuauuaugacac

SEQ ID NO: 955472 - RNA, 22 nt, Human
auauauaagcugaugagccaca

SEQ ID NO: 955473 - RNA, 22 nt, Human
ggucugaaaauggugaccacca

SEQ ID NO: 955474 - RNA, 22 nt, Human
auuagagaaugugcugacauug

SEQ ID NO: 955475 - RNA, 21 nt, Human
ucacauuucucauggguaaau

SEQ ID NO: 955476 - RNA, 22 nt, Human
ucuccugggaggacaaggaagg

SEQ ID NO: 955477 - RNA, 22 nt, Human
cuggcccaggaagacguguccc

SEQ ID NO: 955478 - RNA, 22 nt, Human
ucaaauaaugccauucaucauc

SEQ ID NO: 955479 - RNA, 22 nt, Human
gcuccugggcccugggcuaacu

SEQ ID NO: 955480 - RNA, 22 nt, Human
aaaugaugcucacagauuagug

SEQ ID NO: 955481 - RNA, 17 nt, Human
auguuaauuucacauuu

SEQ ID NO: 955482 - RNA, 22 nt, Human
guggccaagaggggacuggaua

SEQ ID NO: 955483 - RNA, 20 nt, Human
aggccaaacccagcgcgccc

SEQ ID NO: 955484 - RNA, 22 nt, Human
uacucugccccagccaauaaug

SEQ ID NO: 955485 - RNA, 22 nt, Human
gcacucugugaucugcagagcc

SEQ ID NO: 955486 - RNA, 22 nt, Human
acauaaauagauuauugggagg

SEQ ID NO: 955487 - RNA, 22 nt, Human
acagacauucagcuaagucuau

SEQ ID NO: 955488 - RNA, 22 nt, Human
agaggaaguaaucaggaccugc

SEQ ID NO: 955489 - RNA, 22 nt, Human
ucagggaaugaugcacacaguu

SEQ ID NO: 955490 - RNA, 22 nt, Human
caucuuuaacaauuuacaaugu

SEQ ID NO: 955491 - RNA, 22 nt, Human
auguggcauucuuggucauuuc

SEQ ID NO: 955492 - RNA, 22 nt, Human
ccuccuggggugaaggauggga

SEQ ID NO: 955493 - RNA, 22 nt, Human
cuggccaacaucuggggcacau

SEQ ID NO: 955494 - RNA, 22 nt, Human
acuuugaaacuaaaauucauua

SEQ ID NO: 955495 - RNA, 23 nt, Human
ucugggccacuugucugcacuuc

SEQ ID NO: 955496 - RNA, 22 nt, Human
gucaucuuaucauuguugcugu

SEQ ID NO: 955497 - RNA, 22 nt, Human
uugccacugaaccagucuugca

SEQ ID NO: 955498 - RNA, 22 nt, Human
uaaaugauaauaaugcuagugu

SEQ ID NO: 955499 - RNA, 22 nt, Human
uaacuccagagaauccauccau

SEQ ID NO: 955500 - RNA, 19 nt, Human
ugaggccaaggucacagau

SEQ ID NO: 955501 - RNA, 22 nt, Human
uggucaaaagaaagcucagaac

SEQ ID NO: 955502 - RNA, 22 nt, Human
ugacauaaaucuaaaggaaagg

SEQ ID NO: 955503 - RNA, 22 nt, Human
ucuaagccuaggaaaugaguuu

SEQ ID NO: 955504 - RNA, 22 nt, Human
uuugauaacagugaauaucaug

SEQ ID NO: 955505 - RNA, 22 nt, Human
acauuuuuuagagucccacauu

SEQ ID NO: 955506 - RNA, 22 nt, Human
aauguacaauaagacaaagagg

SEQ ID NO: 955507 - RNA, 22 nt, Human
uuaaaaugcagauuaugacuca

SEQ ID NO: 955508 - RNA, 22 nt, Human
aucuacaggauaguuuaauauu

SEQ ID NO: 955509 - RNA, 22 nt, Human
uuagagaugucccaaaaugaag

SEQ ID NO: 955510 - RNA, 22 nt, Human
aaacuccugcauacucagaagc

SEQ ID NO: 955511 - RNA, 22 nt, Human
uuuuaucugcuucauuaguuga

SEQ ID NO: 955512 - RNA, 22 nt, Human
augugcaacuucagcagaaagg

SEQ ID NO: 955513 - RNA, 21 nt, Human
ucugagagcaacugcccuuua

SEQ ID NO: 955514 - RNA, 23 nt, Human
agacaguggccgagagguacuag

SEQ ID NO: 955515 - RNA, 22 nt, Human
aaauguuagguuguacugaguc

SEQ ID NO: 955516 - RNA, 22 nt, Human
auacauacauguacacauaaau

SEQ ID NO: 955517 - RNA, 22 nt, Human
uauuuaaaaagaggccagcugg

SEQ ID NO: 955518 - RNA, 20 nt, Human
cacguuuuuccacuagcaaa

SEQ ID NO: 955519 - RNA, 22 nt, Human
uggcaagccugagauccgggag

SEQ ID NO: 955520 - RNA, 22 nt, Human
uauucacaaaaugagguccuca

SEQ ID NO: 955521 - RNA, 22 nt, Human
aaccaaauggaugguaagaggg

SEQ ID NO: 955522 - RNA, 22 nt, Human
cuuauaguaugauguugagaau

SEQ ID NO: 955523 - RNA, 19 nt, Human
uuggcagcugagauccugc

SEQ ID NO: 955524 - RNA, 22 nt, Human
uagaaaugugauaauagcuuaa

SEQ ID NO: 955525 - RNA, 22 nt, Human
agagacugcgugucagcgcugg

SEQ ID NO: 955526 - RNA, 22 nt, Human
auggccaagcauauacagauug

SEQ ID NO: 955527 - RNA, 22 nt, Human
uucaccuugaauaugucuuaaa

SEQ ID NO: 955528 - RNA, 22 nt, Human
ucuccugguauguaugcaccug

SEQ ID NO: 955529 - RNA, 22 nt, Human
gcacucuguuucuccugucagc

SEQ ID NO: 955530 - RNA, 18 nt, Human
gcuccugguuggaaagaa

SEQ ID NO: 955531 - RNA, 22 nt, Human
aucaggaucugcaucauaagaa

SEQ ID NO: 955532 - RNA, 22 nt, Human
uugagggucuggaucugcugcu

SEQ ID NO: 955533 - RNA, 22 nt, Human
gaguuuaacacuuggagaaaag

SEQ ID NO: 955534 - RNA, 19 nt, Human
uggaagaggaagggaaaua

SEQ ID NO: 955535 - RNA, 22 nt, Human
acaggccugagauuuugcauuu

SEQ ID NO: 955536 - RNA, 22 nt, Human
uugcuucagagggagacacuuu

SEQ ID NO: 955537 - RNA, 22 nt, Human
ucacucuguuagaggaaagugc

SEQ ID NO: 955538 - RNA, 22 nt, Human
cagcuguggcugccacugcucc

SEQ ID NO: 955539 - RNA, 22 nt, Human
aaaaaugugaccacaggguguu

SEQ ID NO: 955540 - RNA, 22 nt, Human
aauguggaaucauggacuuuau

SEQ ID NO: 955541 - RNA, 22 nt, Human
gagggaaggacccauuuuaagu

SEQ ID NO: 955542 - RNA, 20 nt, Human
uuggccaaaucuuagucaug

SEQ ID NO: 955543 - RNA, 22 nt, Human
uccuaggcaguuggugcuccau

SEQ ID NO: 955544 - RNA, 22 nt, Human
ggcagacaccuuuaugucuaau

SEQ ID NO: 955545 - RNA, 22 nt, Human
aucaggaucagggcuagcagag

SEQ ID NO: 955546 - RNA, 22 nt, Human
cgagcaugaugacggcuguggc

SEQ ID NO: 955547 - RNA, 22 nt, Human
caccuugugauccucuugccuu

SEQ ID NO: 955548 - RNA, 22 nt, Human
acuggccaggcagcaguagcuu

SEQ ID NO: 955549 - RNA, 22 nt, Human
augugaggaagaaagagguaag

SEQ ID NO: 955550 - RNA, 22 nt, Human
ccuguuuagugaggugaggagu

SEQ ID NO: 955551 - RNA, 22 nt, Human
acuccuggguuccggagauucu

SEQ ID NO: 955552 - RNA, 22 nt, Human
cuggcacaugcucccugagugg

SEQ ID NO: 955553 - RNA, 22 nt, Human
ucugaaaucuguaagcacuagc

SEQ ID NO: 955554 - RNA, 22 nt, Human
uaacccaauaauugguggccuu

SEQ ID NO: 955555 - RNA, 22 nt, Human
uuggccaaauacacaccuuuug

SEQ ID NO: 955556 - RNA, 22 nt, Human
uccuugacugugaggaacuagc

SEQ ID NO: 955557 - RNA, 22 nt, Human
auauugaacccuacagacugua

SEQ ID NO: 955558 - RNA, 22 nt, Human
gcucugcucuaacauuccugac

SEQ ID NO: 955559 - RNA, 22 nt, Human
uugaaauacugcauuguucagu

SEQ ID NO: 955560 - RNA, 22 nt, Human
aaagucauuggaauauuaauga

SEQ ID NO: 955561 - RNA, 22 nt, Human
aaauaaguaguuuaguguugug

SEQ ID NO: 955562 - RNA, 21 nt, Human
uguaaguuucaucugaauugg

SEQ ID NO: 955563 - RNA, 22 nt, Human
uaaaagacauauaacuguagga

SEQ ID NO: 955564 - RNA, 22 nt, Human
uaggaugagggguggccaagua

SEQ ID NO: 955565 - RNA, 22 nt, Human
uaugucacauuguaacagugug

SEQ ID NO: 955566 - RNA, 22 nt, Human
guucacaauggcuuuaccuaag

SEQ ID NO: 955567 - RNA, 22 nt, Human
aaaagagucuuaggcagucaua

SEQ ID NO: 955568 - RNA, 22 nt, Human
cuccugggcucaagugauccuc

SEQ ID NO: 955569 - RNA, 22 nt, Human
uuauguaggauaaugaauugcc

SEQ ID NO: 955570 - RNA, 22 nt, Human
agacaggagagggaacugccgg

SEQ ID NO: 955571 - RNA, 22 nt, Human
uauuagguuggugcaacaguaa

SEQ ID NO: 955572 - RNA, 22 nt, Human
gcacagcucgagcucaggaggg

SEQ ID NO: 955573 - RNA, 22 nt, Human
aaguuguauauaccgcuuuaag

SEQ ID NO: 955574 - RNA, 22 nt, Human
acuggccaggcacagcuguggg

SEQ ID NO: 955575 - RNA, 22 nt, Human
ucaucuaagagucuuacauuua

SEQ ID NO: 955576 - RNA, 22 nt, Human
gucuagagugcuuccuagucau

SEQ ID NO: 955577 - RNA, 22 nt, Human
ugucuuaagaaauugcauuugu

SEQ ID NO: 955578 - RNA, 22 nt, Human
caaaaguaauuaugguuuuugc

SEQ ID NO: 955579 - RNA, 22 nt, Human
ucuugaaggggggcaguguuga

SEQ ID NO: 955580 - RNA, 22 nt, Human
uccuggccaaguuacucucugc

SEQ ID NO: 955581 - RNA, 22 nt, Human
cacucugagccaaaacuaauuc

SEQ ID NO: 955582 - RNA, 22 nt, Human
ucuauuuacagaaagcagaauu

SEQ ID NO: 955583 - RNA, 22 nt, Human
aagccuugcagcauuaggcucu

SEQ ID NO: 955584 - RNA, 22 nt, Human
agcuauguauaaauaggccacu

SEQ ID NO: 955585 - RNA, 22 nt, Human
aauguacacugaaagccuauca

SEQ ID NO: 955586 - RNA, 22 nt, Human
ccuccuggugacaaggcaaagc

SEQ ID NO: 955587 - RNA, 21 nt, Human
gcuccuggugcugcguggcgc

SEQ ID NO: 955588 - RNA, 22 nt, Human
cagagacauuaagugccaugau

SEQ ID NO: 955589 - RNA, 22 nt, Human
ccugguccuuacgucauugcuu

SEQ ID NO: 955590 - RNA, 22 nt, Human
uuaguuaggaaacaaaguuguu

SEQ ID NO: 955591 - RNA, 22 nt, Human
uuagugauaggaagccagauug

SEQ ID NO: 955592 - RNA, 20 nt, Human
aggcucugcauuucugagug

SEQ ID NO: 955593 - RNA, 22 nt, Human
augcaaaaguaacugugauuuu

SEQ ID NO: 955594 - RNA, 20 nt, Human
ucacucugaugcuagggugg

SEQ ID NO: 955595 - RNA, 22 nt, Human
uuucacaacugcuuauuugaga

SEQ ID NO: 955596 - RNA, 22 nt, Human
acugucuucaaaugaauauauu

SEQ ID NO: 955597 - RNA, 23 nt, Human
uccaagggcuacaaacacagacc

SEQ ID NO: 955598 - RNA, 18 nt, Human
acuaugcugaauaaaugg

SEQ ID NO: 955599 - RNA, 22 nt, Human
cuucacaaaauauuucauuaua

SEQ ID NO: 955600 - RNA, 22 nt, Human
uuuauuaaaacuguuggcucug

SEQ ID NO: 955601 - RNA, 22 nt, Human
aacucacuuuguggcuucugaa

SEQ ID NO: 955602 - RNA, 22 nt, Human
cagcucugaggaacacuccuuu

SEQ ID NO: 955603 - RNA, 22 nt, Human
acucugcaauguggcaagaaca

SEQ ID NO: 955604 - RNA, 19 nt, Human
gcucugcuacuauuaccac

SEQ ID NO: 955605 - RNA, 22 nt, Human
uaacuccacaccccucuuggug

SEQ ID NO: 955606 - RNA, 21 nt, Human
cauauuaaaucggugccuuua

SEQ ID NO: 955607 - RNA, 22 nt, Human
guucacaagcugauugucuuuc

SEQ ID NO: 955608 - RNA, 22 nt, Human
uuucacaagacagcuacuguug

SEQ ID NO: 955609 - RNA, 22 nt, Human
uagaacaugcucauguauaaau

SEQ ID NO: 955610 - RNA, 22 nt, Human
auggccaagcaugccuguggcc

SEQ ID NO: 955611 - RNA, 22 nt, Human
aaaaguaauugcaauuuuguag

SEQ ID NO: 955612 - RNA, 22 nt, Human
uguuuaguaggaguuuaauacu

SEQ ID NO: 955613 - RNA, 22 nt, Human
gaucuuggggggaucaccaugg

SEQ ID NO: 955614 - RNA, 22 nt, Human
gaaauguguuguucauuucuaa

SEQ ID NO: 955615 - RNA, 22 nt, Human
gcuccuggcauccugcuuuuaa

SEQ ID NO: 955616 - RNA, 22 nt, Human
aaauauaauuucugccucaaua

SEQ ID NO: 955617 - RNA, 22 nt, Human
guggccaagaaaauagaugcau

SEQ ID NO: 955618 - RNA, 22 nt, Human
cuuauuagaguuguguucuguu

SEQ ID NO: 955619 - RNA, 20 nt, Human
caaguguagaaacuaauaag

SEQ ID NO: 955620 - RNA, 22 nt, Human
aggauauuugcuuaagauagcu

SEQ ID NO: 955621 - RNA, 22 nt, Human
uguuuauuuucaggauggauug

SEQ ID NO: 955622 - RNA, 22 nt, Human
acauucuaacauuguacagaua

SEQ ID NO: 955623 - RNA, 22 nt, Human
uuauuuaaaauguagguuggga

SEQ ID NO: 955624 - RNA, 22 nt, Human
uuuuauuaucuuugaaugggac

SEQ ID NO: 955625 - RNA, 22 nt, Human
uuuauuguuguuagucauaagu

SEQ ID NO: 955626 - RNA, 22 nt, Human
uccaagggcucauggacacuuu

SEQ ID NO: 955627 - RNA, 22 nt, Human
gcuccuggagagauugagaaag

SEQ ID NO: 955628 - RNA, 22 nt, Human
gcuggccaaaguguaccuggag

SEQ ID NO: 955629 - RNA, 22 nt, Human
cugcccaaauccuucuuccucu

SEQ ID NO: 955630 - RNA, 22 nt, Human
cuucugaggcagcuauucaguu

SEQ ID NO: 955631 - RNA, 22 nt, Human
guucacaaaguacuguaugcau

SEQ ID NO: 955632 - RNA, 22 nt, Human
ugagaauaggcauagaaccugg

SEQ ID NO: 955633 - RNA, 22 nt, Human
auauuaggaguuaaauguauua

SEQ ID NO: 955634 - RNA, 22 nt, Human
uucugagcuacauaguacuggg

SEQ ID NO: 955635 - RNA, 22 nt, Human
cugggccaucuccuuugugugg

SEQ ID NO: 955636 - RNA, 22 nt, Human
aguuucaauucuuuucacaaag

SEQ ID NO: 955637 - RNA, 22 nt, Human
ugcugaaauuagaacauugagg

SEQ ID NO: 955638 - RNA, 22 nt, Human
cagggaauccauggucauaagg

SEQ ID NO: 955639 - RNA, 21 nt, Human
agacaguaacucuucuacucc

SEQ ID NO: 955640 - RNA, 22 nt, Human
uaggauaugugaaaucauauua

SEQ ID NO: 955641 - RNA, 22 nt, Human
aacuaaaucuggcauuuagagc

SEQ ID NO: 955642 - RNA, 22 nt, Human
uauccaaaguuucucagaaacu

SEQ ID NO: 955643 - RNA, 22 nt, Human
gcuggccaguguggugaccacc

SEQ ID NO: 955644 - RNA, 22 nt, Human
ugucaucuucaucauaaguaaa

SEQ ID NO: 955645 - RNA, 22 nt, Human
cugugccaggcccagcugacuu

SEQ ID NO: 955646 - RNA, 22 nt, Human
ugaaagcacugauucucaacuc

SEQ ID NO: 955647 - RNA, 22 nt, Human
cagcuuugucugauuccucuuu

SEQ ID NO: 955648 - RNA, 22 nt, Human
uggccauagcucagcuccuuca

SEQ ID NO: 955649 - RNA, 22 nt, Human
uuuauguaguuacggacuauca

SEQ ID NO: 955650 - RNA, 22 nt, Human
auguggcacagcacaguaagag

SEQ ID NO: 955651 - RNA, 22 nt, Human
guuauuaguaagacucgcacau

SEQ ID NO: 955652 - RNA, 22 nt, Human
caaaacauucagagagcucacu

SEQ ID NO: 955653 - RNA, 21 nt, Human
cggccaaauuccuccuaggga

SEQ ID NO: 955654 - RNA, 22 nt, Human
aaacacauuuuaggaaaaucua

SEQ ID NO: 955655 - RNA, 22 nt, Human
uggaagagguggaaguggcuuc

SEQ ID NO: 955656 - RNA, 16 nt, Human
gucuggccuaccugcc

SEQ ID NO: 955657 - RNA, 22 nt, Human
augaaauguuggucccaaucgc

SEQ ID NO: 955658 - RNA, 22 nt, Human
agacucugcuaagaauauaauu

SEQ ID NO: 955659 - RNA, 22 nt, Human
gcccucugcacagcucugagca

SEQ ID NO: 955660 - RNA, 22 nt, Human
uaaaaaguugaaaggacuuauc

SEQ ID NO: 955661 - RNA, 22 nt, Human
uuuauuagauuaucaaagaggu

SEQ ID NO: 955662 - RNA, 22 nt, Human
ccuggccacagggcucugcauu

SEQ ID NO: 955663 - RNA, 22 nt, Human
acuccuggguugcaguccucaa

SEQ ID NO: 955664 - RNA, 22 nt, Human
uuuuaguuguacugucaacagu

SEQ ID NO: 955665 - RNA, 22 nt, Human
ugagccaaugauuugaauagag

SEQ ID NO: 955666 - RNA, 22 nt, Human
acagcaugucuaguuaaauacu

SEQ ID NO: 955667 - RNA, 20 nt, Human
cugggccauccuuuuacaau

SEQ ID NO: 955668 - RNA, 22 nt, Human
uuauuuggaaauauggcuucug

SEQ ID NO: 955669 - RNA, 22 nt, Human
acacauuauaggcaaucaaaag

SEQ ID NO: 955670 - RNA, 22 nt, Human
ugaaauguaaauaggacuagaa

SEQ ID NO: 955671 - RNA, 22 nt, Human
ucagcaggcaggaggcaugcca

SEQ ID NO: 955672 - RNA, 22 nt, Human
auagucaaccuuguaauuagcc

SEQ ID NO: 955673 - RNA, 22 nt, Human
cagagagggcggcccuggcuuc

SEQ ID NO: 955674 - RNA, 22 nt, Human
cacucugccugauguuacaugg

SEQ ID NO: 955675 - RNA, 22 nt, Human
auucacaaagaagggaaguaca

SEQ ID NO: 955676 - RNA, 22 nt, Human
cucauacauaugccauuccugc

SEQ ID NO: 955677 - RNA, 22 nt, Human
gcucugcugaagccccuugcau

SEQ ID NO: 955678 - RNA, 22 nt, Human
auauuagguuggugcaaaagua

SEQ ID NO: 955679 - RNA, 22 nt, Human
uagcacugaaucacaugcugcu

SEQ ID NO: 955680 - RNA, 20 nt, Human
uugaggagauauugaauacu

SEQ ID NO: 955681 - RNA, 22 nt, Human
uacucugccacuaggaguucug

SEQ ID NO: 955682 - RNA, 22 nt, Human
gaguuuaaauaacacauuucca

SEQ ID NO: 955683 - RNA, 22 nt, Human
guucacaaaauucuggccagug

SEQ ID NO: 955684 - RNA, 22 nt, Human
auguuuaaaggagucagagacu

SEQ ID NO: 955685 - RNA, 22 nt, Human
aguguacacuaaaugaauacaa

SEQ ID NO: 955686 - RNA, 22 nt, Human
ucauugaaugcucugcagguug

SEQ ID NO: 955687 - RNA, 22 nt, Human
gcuuccuaaaugcacagggcag

SEQ ID NO: 955688 - RNA, 22 nt, Human
aaacacagggauauauauucca

SEQ ID NO: 955689 - RNA, 22 nt, Human
uggcaccagcaccuagaugggg

SEQ ID NO: 955690 - RNA, 22 nt, Human
ggcagcaucacuugucuccagc

SEQ ID NO: 955691 - RNA, 22 nt, Human
cuucacaauucuaacagggcaa

SEQ ID NO: 955692 - RNA, 22 nt, Human
uguguuaauuccacaaacauuc

SEQ ID NO: 955693 - RNA, 22 nt, Human
uuuaggauaacuccaguuuucc

SEQ ID NO: 955694 - RNA, 22 nt, Human
ugcauguuauuguggcaagaau

SEQ ID NO: 955695 - RNA, 22 nt, Human
ccuccuggaaaaauucccuggc

SEQ ID NO: 955696 - RNA, 22 nt, Human
aucugaagcuaucugcacuuca

SEQ ID NO: 955697 - RNA, 22 nt, Human
uaaagcacgucuauuuaaugau

SEQ ID NO: 955698 - RNA, 22 nt, Human
aacaugucuggguauucacaag

SEQ ID NO: 955699 - RNA, 22 nt, Human
uuaauuuuuauguauagugugu

SEQ ID NO: 955700 - RNA, 19 nt, Human
ccucugcuccaguuuccuu

SEQ ID NO: 955701 - RNA, 23 nt, Human
ugucuggcucauggugggucuca

SEQ ID NO: 955702 - RNA, 22 nt, Human
ucacucugucccccauugagau

SEQ ID NO: 955703 - RNA, 22 nt, Human
auuauuaggacuacugggguug

SEQ ID NO: 955704 - RNA, 22 nt, Human
aaacacaucauucaugucguca

SEQ ID NO: 955705 - RNA, 17 nt, Human
ucuccuggcucuaucag

SEQ ID NO: 955706 - RNA, 22 nt, Human
uccaagggcaugcugaaauaag

SEQ ID NO: 955707 - RNA, 22 nt, Human
ccuccugggcuccugucugcac

SEQ ID NO: 955708 - RNA, 22 nt, Human
ccuccuggccugugcagagccc

SEQ ID NO: 955709 - RNA, 22 nt, Human
uuauguagcagaaagauguuug

SEQ ID NO: 955710 - RNA, 22 nt, Human
uuggccaagucacugguuaaug

SEQ ID NO: 955711 - RNA, 22 nt, Human
cugagccagcgggcucacuuuu

SEQ ID NO: 955712 - RNA, 22 nt, Human
uccuggcccgaucccugugaag

SEQ ID NO: 955713 - RNA, 22 nt, Human
ucaaaaaguugaagaguugggg

SEQ ID NO: 955714 - RNA, 20 nt, Human
uccagggcaacuagagugug

SEQ ID NO: 955715 - RNA, 22 nt, Human
uuggcagcauccaagucucggg

SEQ ID NO: 955716 - RNA, 22 nt, Human
gaauuacauuguuagccuuccu

SEQ ID NO: 955717 - RNA, 22 nt, Human
uaggaugaucuuguagagagau

SEQ ID NO: 955718 - RNA, 22 nt, Human
uuuaggaucaaugagaaagucu

SEQ ID NO: 955719 - RNA, 22 nt, Human
cuccuggaccagggcuauuggg

SEQ ID NO: 955720 - RNA, 22 nt, Human
ucacucuguguuucccugggac

SEQ ID NO: 955721 - RNA, 22 nt, Human
ucuccugggugcuuuaucagaa

SEQ ID NO: 955722 - RNA, 22 nt, Human
ccuuuuaugaacuugagcaggu

SEQ ID NO: 955723 - RNA, 23 nt, Human
acucagcuuugggagaugacuca

SEQ ID NO: 955724 - RNA, 22 nt, Human
gggccaaggggagcuggaaggg

SEQ ID NO: 955725 - RNA, 22 nt, Human
aaagucauugcuguuaucaaug

SEQ ID NO: 955726 - RNA, 22 nt, Human
guacacucccccugugaaguug

SEQ ID NO: 955727 - RNA, 18 nt, Human
uggcagcaggaagccauu

SEQ ID NO: 955728 - RNA, 23 nt, Human
aacuccugaaucgugagccaucu

SEQ ID NO: 955729 - RNA, 22 nt, Human
uugaauaauuaauuacacucag

SEQ ID NO: 955730 - RNA, 22 nt, Human
uuccuugaaugagucauggaaa

SEQ ID NO: 955731 - RNA, 18 nt, Human
aggccaaacuuguaagca

SEQ ID NO: 955732 - RNA, 16 nt, Human
gcucugcugaggccca

SEQ ID NO: 955733 - RNA, 19 nt, Human
gcuccugggccucacucau

SEQ ID NO: 955734 - RNA, 22 nt, Human
uuggccaaauaaucuugcagau

SEQ ID NO: 955735 - RNA, 22 nt, Human
acucugcucuuuggacaaugcc

SEQ ID NO: 955736 - RNA, 22 nt, Human
guuugaaugcaguaugcauuuu

SEQ ID NO: 955737 - RNA, 22 nt, Human
uggcaacaccuggaagacaugg

SEQ ID NO: 955738 - RNA, 22 nt, Human
aguugcagacgcagagauguug

SEQ ID NO: 955739 - RNA, 22 nt, Human
gggaagauaguguugagggccc

SEQ ID NO: 955740 - RNA, 22 nt, Human
uauaaagaaguguaaacaggaa

SEQ ID NO: 955741 - RNA, 22 nt, Human
augcugagcagagcugacaugc

SEQ ID NO: 955742 - RNA, 22 nt, Human
aauccuggaauacaagagugaa

SEQ ID NO: 955743 - RNA, 22 nt, Human
augaggauuaacuguugucaua

SEQ ID NO: 955744 - RNA, 22 nt, Human
uaaugaugugugcaaacugaau

SEQ ID NO: 955745 - RNA, 22 nt, Human
uucagcaacauuuguugagugc

SEQ ID NO: 955746 - RNA, 22 nt, Human
ugcugagguuucgucugcuugc

SEQ ID NO: 955747 - RNA, 22 nt, Human
uuggccaaaaaagucauuagaa

SEQ ID NO: 955748 - RNA, 22 nt, Human
uccuggcccggccgggccugcu

SEQ ID NO: 955749 - RNA, 22 nt, Human
aaccaggugacucauggugagc

SEQ ID NO: 955750 - RNA, 22 nt, Human
uuguuaguuuauauaauguagu

SEQ ID NO: 955751 - RNA, 22 nt, Human
uagaauaaguugaugauauaug

SEQ ID NO: 955752 - RNA, 22 nt, Human
auagaguccaaaguaugaauau

SEQ ID NO: 955753 - RNA, 22 nt, Human
ucuccuggccgggcuguccccu

SEQ ID NO: 955754 - RNA, 22 nt, Human
uuguauucauugcuuacccaau

SEQ ID NO: 955755 - RNA, 22 nt, Human
cuggcccagagcucuggccuuu

SEQ ID NO: 955756 - RNA, 22 nt, Human
uaaaccuugguagcaucuugcu

SEQ ID NO: 955757 - RNA, 22 nt, Human
augcccugaggaaugucacgcu

SEQ ID NO: 955758 - RNA, 22 nt, Human
caauaaguaauaggcaucuaau

SEQ ID NO: 955759 - RNA, 22 nt, Human
uuuuauucuaaguaugauggga

SEQ ID NO: 955760 - RNA, 22 nt, Human
cugagggucaacuugauuguau

SEQ ID NO: 955761 - RNA, 22 nt, Human
ucuggccacccgaggccccugc

SEQ ID NO: 955762 - RNA, 19 nt, Human
auuagcaugcuugaggaug

SEQ ID NO: 955763 - RNA, 22 nt, Human
acuccuggaaaagaacgcaggg

SEQ ID NO: 955764 - RNA, 22 nt, Human
augaaauaucuugaagaaauuc

SEQ ID NO: 955765 - RNA, 22 nt, Human
ucugccacuagugguuaccuua

SEQ ID NO: 955766 - RNA, 22 nt, Human
uucaggauggcggauguugggg

SEQ ID NO: 955767 - RNA, 22 nt, Human
ugcauuccauguguuuccugag

SEQ ID NO: 955768 - RNA, 22 nt, Human
aaagacauuagauuaacguaca

SEQ ID NO: 955769 - RNA, 22 nt, Human
gacucugcuacaggccgagguu

SEQ ID NO: 955770 - RNA, 22 nt, Human
uuucaacagcucucaaaugauc

SEQ ID NO: 955771 - RNA, 22 nt, Human
uuggccaagggaucgagguugg

SEQ ID NO: 955772 - RNA, 22 nt, Human
uccaagggcuuuggcgugaagu

SEQ ID NO: 955773 - RNA, 22 nt, Human
caauaagugcuuuuguuuagca

SEQ ID NO: 955774 - RNA, 22 nt, Human
aucauuuaaaacaagucucuau

SEQ ID NO: 955775 - RNA, 22 nt, Human
acuugaaaggaagcucuaaaac

SEQ ID NO: 955776 - RNA, 22 nt, Human
acacuucuauucccugcacaaa

SEQ ID NO: 955777 - RNA, 17 nt, Human
acacagggagagggagc

SEQ ID NO: 955778 - RNA, 22 nt, Human
auagucacucuguuagguguuu

SEQ ID NO: 955779 - RNA, 22 nt, Human
acauucuuaacaguuaaaaacu

SEQ ID NO: 955780 - RNA, 23 nt, Human
agggcacugaagcuggaauuggg

SEQ ID NO: 955781 - RNA, 22 nt, Human
gagggcuccucacauucucuau

SEQ ID NO: 955782 - RNA, 22 nt, Human
auauaauaguuucauaaaggcu

SEQ ID NO: 955783 - RNA, 22 nt, Human
acaugaaaccugagucuaacuc

SEQ ID NO: 955784 - RNA, 22 nt, Human
aauacugccugugagguaacuc

SEQ ID NO: 955785 - RNA, 22 nt, Human
gaaauauuacaguggaggggau

SEQ ID NO: 955786 - RNA, 22 nt, Human
guuuauuauacaacaaaagcua

SEQ ID NO: 955787 - RNA, 22 nt, Human
ucagggaacuacuucucccuau

SEQ ID NO: 955788 - RNA, 22 nt, Human
ucuggccacuugcuucacacug

SEQ ID NO: 955789 - RNA, 22 nt, Human
uuccuguuucauagaaaacuga

SEQ ID NO: 955790 - RNA, 22 nt, Human
accuuauuaaaaugaugaugua

SEQ ID NO: 955791 - RNA, 22 nt, Human
auaugaaaguaagcaugugugu

SEQ ID NO: 955792 - RNA, 20 nt, Human
ccuuuauuauuuguaugaug

SEQ ID NO: 955793 - RNA, 22 nt, Human
uguuggcagauugucuaggguu

SEQ ID NO: 955794 - RNA, 22 nt, Human
ccuggccauuugaacuucagac

SEQ ID NO: 955795 - RNA, 22 nt, Human
gagggcuccauuccccgugccc

SEQ ID NO: 955796 - RNA, 22 nt, Human
caccucuuugauuugaggcaag

SEQ ID NO: 955797 - RNA, 22 nt, Human
cucucuggcacuucauugcugu

SEQ ID NO: 955798 - RNA, 23 nt, Human
uucaaaacuggaaaaucagaugc

SEQ ID NO: 955799 - RNA, 22 nt, Human
ucuccuggaagugauuccccug

SEQ ID NO: 955800 - RNA, 22 nt, Human
gcuggccagugucccagggauc

SEQ ID NO: 955801 - RNA, 22 nt, Human
ccacucugauuggucaccucug

SEQ ID NO: 955802 - RNA, 22 nt, Human
uuccuggcauagagagggcaca

SEQ ID NO: 955803 - RNA, 22 nt, Human
cagccuuugggucagaagauuc

SEQ ID NO: 955804 - RNA, 18 nt, Human
aacuucaacuacaaugga

SEQ ID NO: 955805 - RNA, 22 nt, Human
uccaagggcagcagccauagcc

SEQ ID NO: 955806 - RNA, 22 nt, Human
caacuccuccccagcaugccaa

SEQ ID NO: 955807 - RNA, 16 nt, Human
ucucugcuucauaggu

SEQ ID NO: 955808 - RNA, 22 nt, Human
agccauuggcugccuggugcgu

SEQ ID NO: 955809 - RNA, 22 nt, Human
cacucugcugaaaucgccuugu

SEQ ID NO: 955810 - RNA, 22 nt, Human
caaaaguagugaaguuguacau

SEQ ID NO: 955811 - RNA, 22 nt, Human
uggcacauagaaaaggaucaau

SEQ ID NO: 955812 - RNA, 22 nt, Human
uguuggcaucucugagagaguu

SEQ ID NO: 955813 - RNA, 22 nt, Human
auaaauaucacuguugucccuc

SEQ ID NO: 955814 - RNA, 22 nt, Human
cugccacuagcuuucacaucuu

SEQ ID NO: 955815 - RNA, 22 nt, Human
auggccaagagucgauuugggg

SEQ ID NO: 955816 - RNA, 22 nt, Human
cucuggccuggggccugcuccc

SEQ ID NO: 955817 - RNA, 22 nt, Human
cuucaaacccagauuaaaugca

SEQ ID NO: 955818 - RNA, 22 nt, Human
cuuaggaugaguuuuugcguuu

SEQ ID NO: 955819 - RNA, 19 nt, Human
cauuccuuugucugccaaa

SEQ ID NO: 955820 - RNA, 22 nt, Human
auuaggcaauucugggcaucuc

SEQ ID NO: 955821 - RNA, 22 nt, Human
ggucugaguggugcugacucag

SEQ ID NO: 955822 - RNA, 22 nt, Human
uaacccaaaggcaaugucucga

SEQ ID NO: 955823 - RNA, 20 nt, Human
cugagccaacucucuucuug

SEQ ID NO: 955824 - RNA, 20 nt, Human
acauggaaggucaaacuauc

SEQ ID NO: 955825 - RNA, 22 nt, Human
aagcaugugcuggggcuuuuug

SEQ ID NO: 955826 - RNA, 22 nt, Human
augaaagaugauuuaaaguacu

SEQ ID NO: 955827 - RNA, 23 nt, Human
gcucugcucuguuucauagacag

SEQ ID NO: 955828 - RNA, 22 nt, Human
ucuccuggauagauacuaucca

SEQ ID NO: 955829 - RNA, 22 nt, Human
cuccugggcucauaucauucag

SEQ ID NO: 955830 - RNA, 22 nt, Human
uuccuggcaugaaaaauaucac

SEQ ID NO: 955831 - RNA, 22 nt, Human
agcuuguagaaggccacgagca

SEQ ID NO: 955832 - RNA, 22 nt, Human
aaacaaguuuagaauaaugaau

SEQ ID NO: 955833 - RNA, 22 nt, Human
auuaggauguguauauuguguu

SEQ ID NO: 955834 - RNA, 22 nt, Human
gcucugcuugcaucaugacugc

SEQ ID NO: 955835 - RNA, 20 nt, Human
auggccaaccugcuuaugac

SEQ ID NO: 955836 - RNA, 22 nt, Human
cucuugaaaauuggaacacaga

SEQ ID NO: 955837 - RNA, 22 nt, Human
ucuuuuauccuacauuuagcuc

SEQ ID NO: 955838 - RNA, 17 nt, Human
uuccacaauaguuuguc

SEQ ID NO: 955839 - RNA, 22 nt, Human
uucaaucauuuuuacauagucc

SEQ ID NO: 955840 - RNA, 22 nt, Human
ccuccuggcuuuucccauugaa

SEQ ID NO: 955841 - RNA, 22 nt, Human
uaacugauauugaaaaacauca

SEQ ID NO: 955842 - RNA, 22 nt, Human
agcuagaauguuccuuuucauu

SEQ ID NO: 955843 - RNA, 22 nt, Human
ucauguuuggaguuugcucacu

SEQ ID NO: 955844 - RNA, 22 nt, Human
augcacuaugaugagcuagucu

SEQ ID NO: 955845 - RNA, 22 nt, Human
acauuuaaauaugccuuauauu

SEQ ID NO: 955846 - RNA, 22 nt, Human
gacagagaggcugagcaguaca

SEQ ID NO: 955847 - RNA, 22 nt, Human
aacugccuggccaggcugcaac

SEQ ID NO: 955848 - RNA, 22 nt, Human
ccacucugauuuuggcuccacu

SEQ ID NO: 955849 - RNA, 22 nt, Human
uaugucuugcauuuuucaaacu

SEQ ID NO: 955850 - RNA, 22 nt, Human
gaaucauagaacauuaauagaa

SEQ ID NO: 955851 - RNA, 22 nt, Human
ugaaagcagugccaugauuaug

SEQ ID NO: 955852 - RNA, 22 nt, Human
ccuggccaggcauggagucaca

SEQ ID NO: 955853 - RNA, 22 nt, Human
auggcaagcaagcugaagagau

SEQ ID NO: 955854 - RNA, 22 nt, Human
ggaagugaggaauuagguuuau

SEQ ID NO: 955855 - RNA, 22 nt, Human
uccuggcccuguggccugcagu

SEQ ID NO: 955856 - RNA, 22 nt, Human
ccacucugcugugcuccaugau

SEQ ID NO: 955857 - RNA, 20 nt, Human
uuucacaaugaacaugucuc

SEQ ID NO: 955858 - RNA, 19 nt, Human
acuuccugcccgcuccuuu

SEQ ID NO: 955859 - RNA, 22 nt, Human
auucuuuucccaacugcuuuaa

SEQ ID NO: 955860 - RNA, 22 nt, Human
aaauauuauugcuuaaggggag

SEQ ID NO: 955861 - RNA, 22 nt, Human
cuuuuuaucucuuaaugauguu

SEQ ID NO: 955862 - RNA, 22 nt, Human
aaaacagacagccaguguagag

SEQ ID NO: 955863 - RNA, 22 nt, Human
guauuaggagguggagccuuug

SEQ ID NO: 955864 - RNA, 21 nt, Human
uuccuggcggcagaaacguga

SEQ ID NO: 955865 - RNA, 22 nt, Human
auuaggacacauacauguacag

SEQ ID NO: 955866 - RNA, 17 nt, Human
ccacucaguaauuucuc

SEQ ID NO: 955867 - RNA, 22 nt, Human
acagggaaguucugcaacagga

SEQ ID NO: 955868 - RNA, 22 nt, Human
uuaggcauauggcacaugauag

SEQ ID NO: 955869 - RNA, 22 nt, Human
aaccuucacuugcuucauuuga

SEQ ID NO: 955870 - RNA, 22 nt, Human
uccuggccgccgcguggggccg

SEQ ID NO: 955871 - RNA, 22 nt, Human
aauaagaaagagucagcuucag

SEQ ID NO: 955872 - RNA, 22 nt, Human
uagcuuuguuagaaugucuuca

SEQ ID NO: 955873 - RNA, 22 nt, Human
uggccacaguguccagcagcag

SEQ ID NO: 955874 - RNA, 21 nt, Human
aaguuuguucuuguauagucu

SEQ ID NO: 955875 - RNA, 22 nt, Human
auuggcaaggcugcggugucug

SEQ ID NO: 955876 - RNA, 22 nt, Human
aacauguugcuuuaauaauauu

SEQ ID NO: 955877 - RNA, 20 nt, Human
aggauuugagaaggcgucuu

SEQ ID NO: 955878 - RNA, 22 nt, Human
ucucuggcagggauaucuggcu

SEQ ID NO: 955879 - RNA, 18 nt, Human
ucuuggcagcaucuggca

SEQ ID NO: 955880 - RNA, 22 nt, Human
uuguuuaaaauguagcaagaaa

SEQ ID NO: 955881 - RNA, 22 nt, Human
acacuuuuguguauauccaguu

SEQ ID NO: 955882 - RNA, 22 nt, Human
uggaagagaaaggaguggaucu

SEQ ID NO: 955883 - RNA, 22 nt, Human
acuggccaggcgaaccacacug

SEQ ID NO: 955884 - RNA, 22 nt, Human
aaaguuugcaauuuauguuaau

SEQ ID NO: 955885 - RNA, 22 nt, Human
aggucaccauggcaugcuccac

SEQ ID NO: 955886 - RNA, 22 nt, Human
cauugguagaguuuguuuuaua

SEQ ID NO: 955887 - RNA, 22 nt, Human
agaauaaaucaaauguccugag

SEQ ID NO: 955888 - RNA, 22 nt, Human
acucugcuauugcagugcaaaa

SEQ ID NO: 955889 - RNA, 22 nt, Human
aauucacagcauuugcccaucu

SEQ ID NO: 955890 - RNA, 22 nt, Human
gacauaaaauucaauaauuugu

SEQ ID NO: 955891 - RNA, 22 nt, Human
aagucauucuauuucucuaugu

SEQ ID NO: 955892 - RNA, 22 nt, Human
agaauaaauguuggacuuagga

SEQ ID NO: 955893 - RNA, 22 nt, Human
agggaaugcuccguauaaaucu

SEQ ID NO: 955894 - RNA, 22 nt, Human
aacuucugggcuguccaaaacu

SEQ ID NO: 955895 - RNA, 22 nt, Human
uuaaaagagcagcccagcauau

SEQ ID NO: 955896 - RNA, 22 nt, Human
gacucugcugacuaguugacua

SEQ ID NO: 955897 - RNA, 22 nt, Human
ucugccacuuuugcuuacuggg

SEQ ID NO: 955898 - RNA, 22 nt, Human
uuggccaauccuauuggguggg

SEQ ID NO: 955899 - RNA, 22 nt, Human
guugaaauuugugauaauuuag

SEQ ID NO: 955900 - RNA, 22 nt, Human
auacagcagugaauaagauaaa

SEQ ID NO: 955901 - RNA, 22 nt, Human
ucuugcuaaagaccaacacauu

SEQ ID NO: 955902 - RNA, 22 nt, Human
agaauaugaggaaacugugaau

SEQ ID NO: 955903 - RNA, 22 nt, Human
uuugauucuguaaaauaacagg

SEQ ID NO: 955904 - RNA, 20 nt, Human
ccagucucuaucagaaauaa

SEQ ID NO: 955905 - RNA, 22 nt, Human
cugggccaguuaugucucaucu

SEQ ID NO: 955906 - RNA, 18 nt, Human
acaguaaagaaaggaauu

SEQ ID NO: 955907 - RNA, 22 nt, Human
gcucugcuggaaguucucugga

SEQ ID NO: 955908 - RNA, 22 nt, Human
uaucuuugaugccagauguuac

SEQ ID NO: 955909 - RNA, 22 nt, Human
uacaccuuaaucauaugugucu

SEQ ID NO: 955910 - RNA, 22 nt, Human
cacaguuucuauaggucagaau

SEQ ID NO: 955911 - RNA, 22 nt, Human
cuucuuaaagauuacacaauga

SEQ ID NO: 955912 - RNA, 22 nt, Human
gcugaaauucagauuccuaggc

SEQ ID NO: 955913 - RNA, 17 nt, Human
auuagguuuugucauga

SEQ ID NO: 955914 - RNA, 22 nt, Human
gaaaugugggucaugacccauu

SEQ ID NO: 955915 - RNA, 22 nt, Human
acuuugaaggggaacauuuuaa

SEQ ID NO: 955916 - RNA, 20 nt, Human
caguuuaacuuugagcaguu

SEQ ID NO: 955917 - RNA, 22 nt, Human
uuccuggcugaacugaacuccu

SEQ ID NO: 955918 - RNA, 22 nt, Human
aacucugccagguuucaggagc

SEQ ID NO: 955919 - RNA, 22 nt, Human
gucucuaucauagcugaacccu

SEQ ID NO: 955920 - RNA, 22 nt, Human
uacuccugcugauccugccagc

SEQ ID NO: 955921 - RNA, 22 nt, Human
ucacucuguuuuacucacuguu

SEQ ID NO: 955922 - RNA, 22 nt, Human
ggccaaauuuggccaugagcau

SEQ ID NO: 955923 - RNA, 22 nt, Human
aggccaaagcaagacccuguaa

SEQ ID NO: 955924 - RNA, 22 nt, Human
gaguuuaaaacgcuuguauuua

SEQ ID NO: 955925 - RNA, 22 nt, Human
uuccuggccucucucugagcag

SEQ ID NO: 955926 - RNA, 22 nt, Human
aggccaaauugaucaucuuuag

SEQ ID NO: 955927 - RNA, 22 nt, Human
uuggccaagacucauguccuau

SEQ ID NO: 955928 - RNA, 22 nt, Human
gauuuggccuuucgcaugguau

SEQ ID NO: 955929 - RNA, 22 nt, Human
auuaggauuugguauggucaua

SEQ ID NO: 955930 - RNA, 21 nt, Human
cucucugcuuaugaauaguga

SEQ ID NO: 955931 - RNA, 22 nt, Human
aaaagcuagucaaugauguauu

SEQ ID NO: 955932 - RNA, 22 nt, Human
aaugauguuuuuaaagaacaua

SEQ ID NO: 955933 - RNA, 22 nt, Human
agagggcugcugcacagugcuc

SEQ ID NO: 955934 - RNA, 23 nt, Human
ucaaacauauugugagacacagg

SEQ ID NO: 955935 - RNA, 22 nt, Human
ccuccuggcccugggccuggaa

SEQ ID NO: 955936 - RNA, 22 nt, Human
aucaggauccaccuugagccug

SEQ ID NO: 955937 - RNA, 20 nt, Human
auucacaaagccaguguugc

SEQ ID NO: 955938 - RNA, 22 nt, Human
aauaauguugacgauagucuua

SEQ ID NO: 955939 - RNA, 22 nt, Human
uggccaaauuugguguaacuug

SEQ ID NO: 955940 - RNA, 22 nt, Human
gucaucuuccuaguguuaacua

SEQ ID NO: 955941 - RNA, 23 nt, Human
aacugagauaauguauguaaagc

SEQ ID NO: 955942 - RNA, 22 nt, Human
aaagucauacauggugcuuacu

SEQ ID NO: 955943 - RNA, 22 nt, Human
uagaauaugugguguauacuuu

SEQ ID NO: 955944 - RNA, 22 nt, Human
ccugagccuggcucaugcacuc

SEQ ID NO: 955945 - RNA, 23 nt, Human
ucuccuggcugcacuguggccac

SEQ ID NO: 955946 - RNA, 17 nt, Human
uucugagccacuuccuu

SEQ ID NO: 955947 - RNA, 22 nt, Human
uggcagcagacaaaaggccauu

SEQ ID NO: 955948 - RNA, 22 nt, Human
uauuagugaaagaauuaguuug

SEQ ID NO: 955949 - RNA, 22 nt, Human
gcuccuggugcuguagagauuu

SEQ ID NO: 955950 - RNA, 22 nt, Human
aauucacauguugaaguccuaa

SEQ ID NO: 955951 - RNA, 22 nt, Human
cuuaggauuuaauuucagacuc

SEQ ID NO: 955952 - RNA, 22 nt, Human
cuucacaaucaccuuuucggaa

SEQ ID NO: 955953 - RNA, 22 nt, Human
caccuuuugugucugcguuugu

SEQ ID NO: 955954 - RNA, 23 nt, Human
uauuagggccaggacuggcaaau

SEQ ID NO: 955955 - RNA, 22 nt, Human
gcaccuuucuauauucaguggc

SEQ ID NO: 955956 - RNA, 22 nt, Human
cacuaaguaagcuccucuacaa

SEQ ID NO: 955957 - RNA, 22 nt, Human
uauuagagaaaagauggaugug

SEQ ID NO: 955958 - RNA, 22 nt, Human
cuuuguauucaguugggcugug

SEQ ID NO: 955959 - RNA, 22 nt, Human
acucuuuuauaaagcaucuuga

SEQ ID NO: 955960 - RNA, 22 nt, Human
uuucacaauuuuaaggagcaaa

SEQ ID NO: 955961 - RNA, 21 nt, Human
gacaggacuagaccagagcuc

SEQ ID NO: 955962 - RNA, 22 nt, Human
gaauauuaguaucaguuauacc

SEQ ID NO: 955963 - RNA, 22 nt, Human
uuuuauauugagugagaguucc

SEQ ID NO: 955964 - RNA, 22 nt, Human
ccuccuggaggcucuaagggag

SEQ ID NO: 955965 - RNA, 22 nt, Human
agcuccugaaaauccagacugg

SEQ ID NO: 955966 - RNA, 21 nt, Human
aaaaagcuggggcaugcaugc

SEQ ID NO: 955967 - RNA, 22 nt, Human
aaauaaguuaaacuagaaugau

SEQ ID NO: 955968 - RNA, 22 nt, Human
uauuaugagguauuuggacuuu

SEQ ID NO: 955969 - RNA, 22 nt, Human
aucauaaaccacuuuguaaucu

SEQ ID NO: 955970 - RNA, 22 nt, Human
auagauguucaaucagauauuu

SEQ ID NO: 955971 - RNA, 22 nt, Human
ccucugcugcuguugagcaccg

SEQ ID NO: 955972 - RNA, 22 nt, Human
aauucacaugcaugucugugca

SEQ ID NO: 955973 - RNA, 22 nt, Human
gcuggccauggggagugaggag

SEQ ID NO: 955974 - RNA, 22 nt, Human
acauuuaaauaccuauguuucu

SEQ ID NO: 955975 - RNA, 20 nt, Human
acugggcauaccuguccugu

SEQ ID NO: 955976 - RNA, 23 nt, Human
uuuuaauuuggacauaagaagau

SEQ ID NO: 955977 - RNA, 22 nt, Human
auguuuaagaaagucuuccaua

SEQ ID NO: 955978 - RNA, 18 nt, Human
augcuuugcuuacguuau

SEQ ID NO: 955979 - RNA, 22 nt, Human
aauaauguuaugucauucuucu

SEQ ID NO: 955980 - RNA, 22 nt, Human
uugaggaguguuuagggugagg

SEQ ID NO: 955981 - RNA, 22 nt, Human
gcuggccaggugcuuugguucu

SEQ ID NO: 955982 - RNA, 22 nt, Human
caugucuuggcuuaggcacaga

SEQ ID NO: 955983 - RNA, 22 nt, Human
aaacacuagcaggaagcacuga

SEQ ID NO: 955984 - RNA, 22 nt, Human
guucacaagaugugguggggag

SEQ ID NO: 955985 - RNA, 22 nt, Human
aggauguugcuauuggcagucu

SEQ ID NO: 955986 - RNA, 22 nt, Human
ccuuuucuaaucuuaagaaugu

SEQ ID NO: 955987 - RNA, 21 nt, Human
ucacucugauuaggugucucu

SEQ ID NO: 955988 - RNA, 22 nt, Human
acuggccaugggauuuauauuu

SEQ ID NO: 955989 - RNA, 22 nt, Human
cuguuuauagcagagcaagccu

SEQ ID NO: 955990 - RNA, 22 nt, Human
cugguccauucucucccugaag

SEQ ID NO: 955991 - RNA, 22 nt, Human
acauuaaugaggugaugacaca

SEQ ID NO: 955992 - RNA, 22 nt, Human
auggccaaggggccuaggcagg

SEQ ID NO: 955993 - RNA, 22 nt, Human
ucugccaccaccuacacuagua

SEQ ID NO: 955994 - RNA, 22 nt, Human
ucuuuuaaaagcccugcugucu

SEQ ID NO: 955995 - RNA, 22 nt, Human
uauauuaacacccacuugccuc

SEQ ID NO: 955996 - RNA, 21 nt, Human
uggcagacuagaguauagaug

SEQ ID NO: 955997 - RNA, 22 nt, Human
ucugagccaccugccagugcug

SEQ ID NO: 955998 - RNA, 22 nt, Human
uuucacaaucaaauggugaaau

SEQ ID NO: 955999 - RNA, 22 nt, Human
ucugcuguugccaugaguaaua

SEQ ID NO: 956000 - RNA, 22 nt, Human
ggccaaaucuguaaggcaagau

SEQ ID NO: 956001 - RNA, 21 nt, Human
auuuggauauugcuggcaaau

SEQ ID NO: 956002 - RNA, 18 nt, Human
gcuccuggagucugacuc

SEQ ID NO: 956003 - RNA, 22 nt, Human
cccauggcuuaggagggagugu

SEQ ID NO: 956004 - RNA, 22 nt, Human
uaaccuuucaggcauguagguu

SEQ ID NO: 956005 - RNA, 22 nt, Human
uauuggcagcaugagcuccugg

SEQ ID NO: 956006 - RNA, 22 nt, Human
acacucugcucugagcuucagg

SEQ ID NO: 956007 - RNA, 22 nt, Human
augcugagugagugaaacccag

SEQ ID NO: 956008 - RNA, 22 nt, Human
ucuuuuuauauugacaaaaggu

SEQ ID NO: 956009 - RNA, 20 nt, Human
ucaccuuuguugguauucau

SEQ ID NO: 956010 - RNA, 20 nt, Human
aaaaacaguaaugcugaaga

SEQ ID NO: 956011 - RNA, 22 nt, Human
aacuccuguucuaugacaagag

SEQ ID NO: 956012 - RNA, 22 nt, Human
guugaaaugagggauuaaucag

SEQ ID NO: 956013 - RNA, 22 nt, Human
gucugagcgcuggagcuugugu

SEQ ID NO: 956014 - RNA, 22 nt, Human
uggcagcacuugaacuugagcc

SEQ ID NO: 956015 - RNA, 22 nt, Human
uauuuaauuugcucauugugau

SEQ ID NO: 956016 - RNA, 22 nt, Human
auuagagaaauguugccaagau

SEQ ID NO: 956017 - RNA, 23 nt, Human
cuucacaaucaaaaucaguucug

SEQ ID NO: 956018 - RNA, 22 nt, Human
uuaaaacagcgugaaucuggca

SEQ ID NO: 956019 - RNA, 22 nt, Human
ugaauaagaauuauuauaauga

SEQ ID NO: 956020 - RNA, 22 nt, Human
auggccaagaauauuucucaac

SEQ ID NO: 956021 - RNA, 22 nt, Human
auuuggcauaggcagaggccca

SEQ ID NO: 956022 - RNA, 22 nt, Human
gcuggccacacugcugauggag

SEQ ID NO: 956023 - RNA, 22 nt, Human
caaguaugagaaagcuauuacc

SEQ ID NO: 956024 - RNA, 22 nt, Human
ucacucugagaggucacuggaa

SEQ ID NO: 956025 - RNA, 21 nt, Human
agggaaagaaaaugagcuaau

SEQ ID NO: 956026 - RNA, 22 nt, Human
cucugcuuuuuaaaaggagucc

SEQ ID NO: 956027 - RNA, 22 nt, Human
gaggaaggucccaucagaauuu

SEQ ID NO: 956028 - RNA, 22 nt, Human
agacagugcaagaagagcaggc

SEQ ID NO: 956029 - RNA, 21 nt, Human
ugacauaauccauaguacaaa

SEQ ID NO: 956030 - RNA, 22 nt, Human
ugacauaaaccagugagcaaaa

SEQ ID NO: 956031 - RNA, 22 nt, Human
uuuaggaugcucuauucugacu

SEQ ID NO: 956032 - RNA, 22 nt, Human
uccugggcuuuguuucucuccu

SEQ ID NO: 956033 - RNA, 22 nt, Human
cuggccaauauagggaaaucuu

SEQ ID NO: 956034 - RNA, 22 nt, Human
acucugcuuccacuuuugcuaa

SEQ ID NO: 956035 - RNA, 22 nt, Human
aaacagaaauuuccucaugcuc

SEQ ID NO: 956036 - RNA, 22 nt, Human
aggauguuaucugugcaggugg

SEQ ID NO: 956037 - RNA, 22 nt, Human
augcaaaagacuauuuguugcu

SEQ ID NO: 956038 - RNA, 22 nt, Human
aauaugaauuauuguuacaagu

SEQ ID NO: 956039 - RNA, 22 nt, Human
aauaugucugcuaauuguuucu

SEQ ID NO: 956040 - RNA, 22 nt, Human
aaaguauuuuugacaggcauua

SEQ ID NO: 956041 - RNA, 22 nt, Human
cugagccagcuggcaugugcua

SEQ ID NO: 956042 - RNA, 22 nt, Human
uaggauuuggcuuuagucaggu

SEQ ID NO: 956043 - RNA, 22 nt, Human
ugaaauguguaauguggaugcc

SEQ ID NO: 956044 - RNA, 22 nt, Human
acacucugugaggcauguaaug

SEQ ID NO: 956045 - RNA, 22 nt, Human
ccuccugggacaggcuggcaca

SEQ ID NO: 956046 - RNA, 22 nt, Human
uggucuaaauauggcucuaaau

SEQ ID NO: 956047 - RNA, 22 nt, Human
uggaagaggcccaugacugccu

SEQ ID NO: 956048 - RNA, 22 nt, Human
uggcacaaaucuagucccuggu

SEQ ID NO: 956049 - RNA, 22 nt, Human
cugagccauccauaccagcuua

SEQ ID NO: 956050 - RNA, 22 nt, Human
uccugggcaaaaguaucuguga

SEQ ID NO: 956051 - RNA, 21 nt, Human
gggucugaauaucuggugcug

SEQ ID NO: 956052 - RNA, 22 nt, Human
uggccacaugcgucugugaggc

SEQ ID NO: 956053 - RNA, 22 nt, Human
aacaaguaaguuuauauauauu

SEQ ID NO: 956054 - RNA, 23 nt, Human
uucuuauuuacuuuggaaucucc

SEQ ID NO: 956055 - RNA, 22 nt, Human
acuccugguuuguguccuggcu

SEQ ID NO: 956056 - RNA, 22 nt, Human
cuccugggagucuuccuggaug

SEQ ID NO: 956057 - RNA, 17 nt, Human
agcugaaauugcugaag

SEQ ID NO: 956058 - RNA, 22 nt, Human
gcuagaaaucgacuucagaauu

SEQ ID NO: 956059 - RNA, 22 nt, Human
aggauuuguuuauaggucuuaa

SEQ ID NO: 956060 - RNA, 22 nt, Human
uaugcauuuuauagugcaaagc

SEQ ID NO: 956061 - RNA, 22 nt, Human
cuucacaaagcucucuuuaugu

SEQ ID NO: 956062 - RNA, 22 nt, Human
cuggccauguugccucugagac

SEQ ID NO: 956063 - RNA, 22 nt, Human
uuggccaaccagaacggagguc

SEQ ID NO: 956064 - RNA, 22 nt, Human
acagcauugcuccaucucaaga

SEQ ID NO: 956065 - RNA, 22 nt, Human
guauguauguauauguuuaaga

SEQ ID NO: 956066 - RNA, 22 nt, Human
uaggaugaaaauccagcuuaua

SEQ ID NO: 956067 - RNA, 22 nt, Human
aacauuucuucugaaacugagu

SEQ ID NO: 956068 - RNA, 20 nt, Human
ccuggccaaugagauaggaa

SEQ ID NO: 956069 - RNA, 22 nt, Human
augauguuaccaguacuuagag

SEQ ID NO: 956070 - RNA, 22 nt, Human
caauagaaaacucaauacuuaa

SEQ ID NO: 956071 - RNA, 22 nt, Human
gacuccuggcuuucccucuuag

SEQ ID NO: 956072 - RNA, 22 nt, Human
caccuuguggcccagucagguu

SEQ ID NO: 956073 - RNA, 22 nt, Human
uagaauguaaauuccaagggca

SEQ ID NO: 956074 - RNA, 22 nt, Human
uguguuaaguauuugauacacu

SEQ ID NO: 956075 - RNA, 22 nt, Human
gagaggggcgcgcagcucgcga

SEQ ID NO: 956076 - RNA, 22 nt, Human
ucuccuggaagaauaccacacu

SEQ ID NO: 956077 - RNA, 22 nt, Human
acauuccugaggaaauacauuc

SEQ ID NO: 956078 - RNA, 21 nt, Human
gauguuggaggcuggggucug

SEQ ID NO: 956079 - RNA, 17 nt, Human
ucugaagccagucugcu

SEQ ID NO: 956080 - RNA, 22 nt, Human
ucugagaggcaucugcacuucu

SEQ ID NO: 956081 - RNA, 22 nt, Human
uuccuggcgccacggagccggu

SEQ ID NO: 956082 - RNA, 22 nt, Human
ucuuuaaucauaaccaagaugg

SEQ ID NO: 956083 - RNA, 23 nt, Human
cagaaaguuugagaagauacauc

SEQ ID NO: 956084 - RNA, 21 nt, Human
uggcagacaggaggagcucac

SEQ ID NO: 956085 - RNA, 22 nt, Human
uuaauguggaaagcucuugagu

SEQ ID NO: 956086 - RNA, 22 nt, Human
cgcaccacugaauuccagccug

SEQ ID NO: 956087 - RNA, 22 nt, Human
uuccuggcaccaccacuucuag

SEQ ID NO: 956088 - RNA, 22 nt, Human
auucacaacugauccuugcuca

SEQ ID NO: 956089 - RNA, 22 nt, Human
uaaaacugaauacauacugagg

SEQ ID NO: 956090 - RNA, 22 nt, Human
gaguuauuagucaaauagggaa

SEQ ID NO: 956091 - RNA, 22 nt, Human
gagcacugauuuauuuuugucu

SEQ ID NO: 956092 - RNA, 22 nt, Human
cuguuuaucuaggaguugcagg

SEQ ID NO: 956093 - RNA, 22 nt, Human
augcccaaugucacaauuuuug

SEQ ID NO: 956094 - RNA, 19 nt, Human
ucuaagccucaauguuuuc

SEQ ID NO: 956095 - RNA, 22 nt, Human
ucaaauaaggagucaugaccau

SEQ ID NO: 956096 - RNA, 22 nt, Human
cauuuuauccucugggaagcua

SEQ ID NO: 956097 - RNA, 22 nt, Human
ugaaggugucuuugugaacauc

SEQ ID NO: 956098 - RNA, 22 nt, Human
auguuuaaauuuauagacagug

SEQ ID NO: 956099 - RNA, 21 nt, Human
cauuucaugauuauagaaaug

SEQ ID NO: 956100 - RNA, 22 nt, Human
cagcuuugcccuuugcccaauc

SEQ ID NO: 956101 - RNA, 22 nt, Human
guggccaaacaccaguuuagga

SEQ ID NO: 956102 - RNA, 22 nt, Human
agacagugauguaagcaggagu

SEQ ID NO: 956103 - RNA, 22 nt, Human
gcagcauauuguacuggccugc

SEQ ID NO: 956104 - RNA, 22 nt, Human
uuguuauaaagacuaaauaugu

SEQ ID NO: 956105 - RNA, 23 nt, Human
uuggcagcgggucaggcuguggg

SEQ ID NO: 956106 - RNA, 22 nt, Human
cagacagggaccucgcuccaga

SEQ ID NO: 956107 - RNA, 22 nt, Human
ucaaaacacuauuaccuuuaau

SEQ ID NO: 956108 - RNA, 22 nt, Human
uaggaucucaccauagaaggaa

SEQ ID NO: 956109 - RNA, 18 nt, Human
uugauaaacaauuucauu

SEQ ID NO: 956110 - RNA, 22 nt, Human
cagacaggaauucuggcguggu

SEQ ID NO: 956111 - RNA, 22 nt, Human
gacaucaauauucugcagggau

SEQ ID NO: 956112 - RNA, 22 nt, Human
uuauuaguguugauauuaggau

SEQ ID NO: 956113 - RNA, 22 nt, Human
guuuauuagaguuuucugucug

SEQ ID NO: 956114 - RNA, 22 nt, Human
acauucaaggccuucugacaca

SEQ ID NO: 956115 - RNA, 22 nt, Human
cugggccagaccuuguggucuu

SEQ ID NO: 956116 - RNA, 22 nt, Human
aaagacagagcuguaggggaaa

SEQ ID NO: 956117 - RNA, 22 nt, Human
ucuggcaaaggcaaccacaguu

SEQ ID NO: 956118 - RNA, 22 nt, Human
gcagggaagggaaacagagacc

SEQ ID NO: 956119 - RNA, 22 nt, Human
ccaaaaagcucagagauauguu

SEQ ID NO: 956120 - RNA, 22 nt, Human
acuccuggggcugccaucacag

SEQ ID NO: 956121 - RNA, 22 nt, Human
guacacauugucuguuuacuuc

SEQ ID NO: 956122 - RNA, 21 nt, Human
cucuuuauauaguaaagauau

SEQ ID NO: 956123 - RNA, 22 nt, Human
gucaucuugcuguuuuagaucu

SEQ ID NO: 956124 - RNA, 22 nt, Human
cacuccuguuccacuaaaugag

SEQ ID NO: 956125 - RNA, 22 nt, Human
caaaaguaaucguggcuuuugc

SEQ ID NO: 956126 - RNA, 22 nt, Human
auaaagacaugcuuacuugccc

SEQ ID NO: 956127 - RNA, 22 nt, Human
aauguacaaaagucagccaacu

SEQ ID NO: 956128 - RNA, 22 nt, Human
acaaaaagcuccauuacugucc

SEQ ID NO: 956129 - RNA, 22 nt, Human
uaaaagacccucuagaguccca

SEQ ID NO: 956130 - RNA, 22 nt, Human
uuaaaagaauccuguuauccuc

SEQ ID NO: 956131 - RNA, 22 nt, Human
cucuuuaaaguaaaauuugucu

SEQ ID NO: 956132 - RNA, 22 nt, Human
ugaaacaggaaguaaacagaca

SEQ ID NO: 956133 - RNA, 22 nt, Human
uagcacaggucuuguugccauu

SEQ ID NO: 956134 - RNA, 22 nt, Human
ugcuugaggggaauaaaaagaa

SEQ ID NO: 956135 - RNA, 22 nt, Human
acaccuuucagguccagacagu

SEQ ID NO: 956136 - RNA, 20 nt, Human
agacaggagcccccauucag

SEQ ID NO: 956137 - RNA, 22 nt, Human
aacugcuguggccuaguacuua

SEQ ID NO: 956138 - RNA, 22 nt, Human
uguguuaacacugcaugauaau

SEQ ID NO: 956139 - RNA, 22 nt, Human
uguuccuguguggaaaagggcc

SEQ ID NO: 956140 - RNA, 22 nt, Human
uggcagcauuaauuauucaggu

SEQ ID NO: 956141 - RNA, 22 nt, Human
uggacaaaugauuucuaccuuu

SEQ ID NO: 956142 - RNA, 19 nt, Human
auagaaaggguuaaagaca

SEQ ID NO: 956143 - RNA, 22 nt, Human
uauucacauuaauaagucuuca

SEQ ID NO: 956144 - RNA, 21 nt, Human
aacauuucaggauccaaauug

SEQ ID NO: 956145 - RNA, 22 nt, Human
gcucugcuggagggaaagagaa

SEQ ID NO: 956146 - RNA, 22 nt, Human
auuaggauuuuguccaaguagc

SEQ ID NO: 956147 - RNA, 22 nt, Human
aggccaaagugcuccuuuuaga

SEQ ID NO: 956148 - RNA, 22 nt, Human
ucugagccaaaauaaacagcau

SEQ ID NO: 956149 - RNA, 22 nt, Human
aaguuuguuguacauguuagua

SEQ ID NO: 956150 - RNA, 18 nt, Human
aaguaugccuauguuauu

SEQ ID NO: 956151 - RNA, 22 nt, Human
agcacucuucugugauaguugu

SEQ ID NO: 956152 - RNA, 22 nt, Human
auauuaauuauuuacacaugag

SEQ ID NO: 956153 - RNA, 22 nt, Human
gagacagugguugcagaagcuc

SEQ ID NO: 956154 - RNA, 22 nt, Human
cagggucugaaacugaucacag

SEQ ID NO: 956155 - RNA, 22 nt, Human
ugguccaagugagguggccucu

SEQ ID NO: 956156 - RNA, 20 nt, Human
ucucugcuguccacauuugc

SEQ ID NO: 956157 - RNA, 22 nt, Human
uauauuaaaugaccaguuuuaa

SEQ ID NO: 956158 - RNA, 22 nt, Human
ugucuuaauaugugcauucugu

SEQ ID NO: 956159 - RNA, 22 nt, Human
uuguacacaauucuuaacauac

SEQ ID NO: 956160 - RNA, 22 nt, Human
aacacaaagaagcugcaggauc

SEQ ID NO: 956161 - RNA, 22 nt, Human
cuaauguggacucuaucaaagu

SEQ ID NO: 956162 - RNA, 22 nt, Human
cuccuggaggauagugacuggg

SEQ ID NO: 956163 - RNA, 22 nt, Human
guauuagguuggugcaaaagua

SEQ ID NO: 956164 - RNA, 22 nt, Human
guggccaauaggagcagcuauc

SEQ ID NO: 956165 - RNA, 19 nt, Human
ugcuagaaauucugugacu

SEQ ID NO: 956166 - RNA, 22 nt, Human
cugggccaaaagaaguguucuu

SEQ ID NO: 956167 - RNA, 22 nt, Human
aaauaugugaucagugaauaaa

SEQ ID NO: 956168 - RNA, 22 nt, Human
gaaauauuucucuugagccccu

SEQ ID NO: 956169 - RNA, 22 nt, Human
uuugcaauuugugcugcaaaug

SEQ ID NO: 956170 - RNA, 22 nt, Human
auuuauuaccucggaguuucug

SEQ ID NO: 956171 - RNA, 22 nt, Human
auagugcaguggacugaguuaa

SEQ ID NO: 956172 - RNA, 22 nt, Human
uaggaugacacagcaaguauag

SEQ ID NO: 956173 - RNA, 17 nt, Human
cagcucugcaucuuccu

SEQ ID NO: 956174 - RNA, 22 nt, Human
aaauaacuuaugaucgucuggc

SEQ ID NO: 956175 - RNA, 22 nt, Human
ucacucugaaugguacugagga

SEQ ID NO: 956176 - RNA, 22 nt, Human
cugcauucauaucagauagaag

SEQ ID NO: 956177 - RNA, 22 nt, Human
uauauuaguggaaugauaugaa

SEQ ID NO: 956178 - RNA, 18 nt, Human
gcuccuggaccaggucac

SEQ ID NO: 956179 - RNA, 22 nt, Human
gccauaaauugcuggucaaaau

SEQ ID NO: 956180 - RNA, 22 nt, Human
cauauuaaggucuguaaggggu

SEQ ID NO: 956181 - RNA, 22 nt, Human
auaaaaccaaagcagcaguguu

SEQ ID NO: 956182 - RNA, 22 nt, Human
uuuauaaguacuuugucugcuu

SEQ ID NO: 956183 - RNA, 22 nt, Human
aaaaauguuaucuacuguccga

SEQ ID NO: 956184 - RNA, 22 nt, Human
ucacucugcugcccgagggcug

SEQ ID NO: 956185 - RNA, 20 nt, Human
ucugccacugcacucugccc

SEQ ID NO: 956186 - RNA, 22 nt, Human
aacaauaauugcgguucucuau

SEQ ID NO: 956187 - RNA, 22 nt, Human
ggccaaaugaaggcaaugggac

SEQ ID NO: 956188 - RNA, 22 nt, Human
gauuaggagggagaggcaagua

SEQ ID NO: 956189 - RNA, 22 nt, Human
auuagguaagauaaagcagagg

SEQ ID NO: 956190 - RNA, 22 nt, Human
uuaaaugaacgagauaugcaac

SEQ ID NO: 956191 - RNA, 22 nt, Human
ccugggccugaaaacauuucuc

SEQ ID NO: 956192 - RNA, 18 nt, Human
cugaggccaacuacacug

SEQ ID NO: 956193 - RNA, 22 nt, Human
guuuuauuuccaugagagaccg

SEQ ID NO: 956194 - RNA, 17 nt, Human
cuccuggccaccccucu

SEQ ID NO: 956195 - RNA, 22 nt, Human
guucacaaauaugcacuuacga

SEQ ID NO: 956196 - RNA, 22 nt, Human
aagucuguagaaaaacaguuua

SEQ ID NO: 956197 - RNA, 20 nt, Human
ucacagaaacaaauagagaa

SEQ ID NO: 956198 - RNA, 22 nt, Human
uaaaguguccuagcuaggaggc

SEQ ID NO: 956199 - RNA, 19 nt, Human
uuuaggauaaagucuggac

SEQ ID NO: 956200 - RNA, 22 nt, Human
aggagacaucuaacuguagguu

SEQ ID NO: 956201 - RNA, 17 nt, Human
ugaagaugcauggcagc

SEQ ID NO: 956202 - RNA, 22 nt, Human
gcaaaacagucgaugccuccca

SEQ ID NO: 956203 - RNA, 22 nt, Human
cagccuuugugaacaucaggug

SEQ ID NO: 956204 - RNA, 22 nt, Human
auggccaaagccacagcagagg

SEQ ID NO: 956205 - RNA, 22 nt, Human
ucuguaaauccugcucagcaac

SEQ ID NO: 956206 - RNA, 22 nt, Human
cuggcacacaaguauuuccuuu

SEQ ID NO: 956207 - RNA, 22 nt, Human
uuauguagugacugacuguuag

SEQ ID NO: 956208 - RNA, 22 nt, Human
uuggccaaaggaaagacuacug

SEQ ID NO: 956209 - RNA, 22 nt, Human
aggauguucgggucacauagcc

SEQ ID NO: 956210 - RNA, 22 nt, Human
auaaaacuuauuagaauugugu

SEQ ID NO: 956211 - RNA, 22 nt, Human
ccuaggcccauuaauuccccuu

SEQ ID NO: 956212 - RNA, 20 nt, Human
uacuuaggcuuguuuuggcc

SEQ ID NO: 956213 - RNA, 22 nt, Human
aguuauagaaccagguccucac

SEQ ID NO: 956214 - RNA, 22 nt, Human
guucacaagcuggguuucugca

SEQ ID NO: 956215 - RNA, 22 nt, Human
aaacuccugggcucaagcaguu

SEQ ID NO: 956216 - RNA, 22 nt, Human
uuggcacacaguaagcccuaag

SEQ ID NO: 956217 - RNA, 22 nt, Human
uuuauuagugcuuguaucacug

SEQ ID NO: 956218 - RNA, 22 nt, Human
ggucagccuuggauuugguagc

SEQ ID NO: 956219 - RNA, 22 nt, Human
acacucuguaaugucacacucc

SEQ ID NO: 956220 - RNA, 22 nt, Human
gcucugcugacagcugggacag

SEQ ID NO: 956221 - RNA, 22 nt, Human
gaaaaugugucaucccuacugu

SEQ ID NO: 956222 - RNA, 22 nt, Human
cuccugaguaguagcauuguca

SEQ ID NO: 956223 - RNA, 22 nt, Human
auuauggacguuaauuuuggaa

SEQ ID NO: 956224 - RNA, 22 nt, Human
uacucugcaggauggacuaugg

SEQ ID NO: 956225 - RNA, 22 nt, Human
uggcucaagugauccuccugcc

SEQ ID NO: 956226 - RNA, 22 nt, Human
ggccaaaugaaaucugagcaau

SEQ ID NO: 956227 - RNA, 22 nt, Human
ucugugccuccguaacacacca

SEQ ID NO: 956228 - RNA, 22 nt, Human
gcaccuuuuucuaggagaaugu

SEQ ID NO: 956229 - RNA, 22 nt, Human
ucagggaacaauguuauggcuu

SEQ ID NO: 956230 - RNA, 22 nt, Human
uagaaaugauugguugagcucu

SEQ ID NO: 956231 - RNA, 22 nt, Human
auagaauagcauagaaaauuga

SEQ ID NO: 956232 - RNA, 22 nt, Human
ggucuaaaaugagucuuccuag

SEQ ID NO: 956233 - RNA, 22 nt, Human
uccugagcuucaaaacacuuug

SEQ ID NO: 956234 - RNA, 22 nt, Human
agaguucagcuacugcaaaugu

SEQ ID NO: 956235 - RNA, 22 nt, Human
cuuuugauaguugcugagcagg

SEQ ID NO: 956236 - RNA, 22 nt, Human
uauagcaagcaggacagucuca

SEQ ID NO: 956237 - RNA, 22 nt, Human
auucacaaugauacauaagcga

SEQ ID NO: 956238 - RNA, 22 nt, Human
uucaggaugaaagugugcaaca

SEQ ID NO: 956239 - RNA, 22 nt, Human
uuuauuuggcaucucugccaag

SEQ ID NO: 956240 - RNA, 22 nt, Human
guugaaauccuaacccccuagu

SEQ ID NO: 956241 - RNA, 19 nt, Human
aauaauguucaugagauug

SEQ ID NO: 956242 - RNA, 22 nt, Human
cauuaaauuccuuguucucaaa

SEQ ID NO: 956243 - RNA, 18 nt, Human
uccuggccacacuaccuu

SEQ ID NO: 956244 - RNA, 22 nt, Human
uuagugauuacuacauagauga

SEQ ID NO: 956245 - RNA, 22 nt, Human
aggcauguauaugugcacaugu

SEQ ID NO: 956246 - RNA, 17 nt, Human
auucuuugaugucucug

SEQ ID NO: 956247 - RNA, 22 nt, Human
uauuauuauaguuauugggaag

SEQ ID NO: 956248 - RNA, 22 nt, Human
gcucugcucccucaaaugacau

SEQ ID NO: 956249 - RNA, 22 nt, Human
uuuaguagugacagauucuggg

SEQ ID NO: 956250 - RNA, 22 nt, Human
ucacucugcaggaaggagcagc

SEQ ID NO: 956251 - RNA, 22 nt, Human
uuggccaaggaccuuuuuggag

SEQ ID NO: 956252 - RNA, 22 nt, Human
cuggcgcaacagaaaaucugga

SEQ ID NO: 956253 - RNA, 22 nt, Human
aggccaaaccggauggaaaagg

SEQ ID NO: 956254 - RNA, 22 nt, Human
aaagcacauuacaagcucaguc

SEQ ID NO: 956255 - RNA, 22 nt, Human
uaagauaauaaguaugucuaug

SEQ ID NO: 956256 - RNA, 22 nt, Human
ucuguaaaacuucuuuguaaau

SEQ ID NO: 956257 - RNA, 22 nt, Human
ccuccuggugggcgcuucuggc

SEQ ID NO: 956258 - RNA, 22 nt, Human
uccuggccuuauccccaaacug

SEQ ID NO: 956259 - RNA, 22 nt, Human
uucaugcuuuuaccgcuguuaa

SEQ ID NO: 956260 - RNA, 22 nt, Human
uuaggauaugaaacaguauaag

SEQ ID NO: 956261 - RNA, 22 nt, Human
cugggccauggaagucucugcc

SEQ ID NO: 956262 - RNA, 22 nt, Human
ccuccugguccagcaucucuuu

SEQ ID NO: 956263 - RNA, 18 nt, Human
accuucauuccuuugccu

SEQ ID NO: 956264 - RNA, 22 nt, Human
uguuuaaucuauaaaauggaga

SEQ ID NO: 956265 - RNA, 22 nt, Human
uacuaggaagcagcugcauugg

SEQ ID NO: 956266 - RNA, 22 nt, Human
cagggucuuggcgccaucaccc

SEQ ID NO: 956267 - RNA, 22 nt, Human
uucugagcugcaacacuaacau

SEQ ID NO: 956268 - RNA, 22 nt, Human
ccuccuggguucaagcgauucu

SEQ ID NO: 956269 - RNA, 22 nt, Human
uacucugcaaguugaagguggc

SEQ ID NO: 956270 - RNA, 22 nt, Human
aguauacauauauuagccuucg

SEQ ID NO: 956271 - RNA, 22 nt, Human
uacucugcucauuggagugugu

SEQ ID NO: 956272 - RNA, 22 nt, Human
ugcucccagggacucuggcugg

SEQ ID NO: 956273 - RNA, 22 nt, Human
auuuggauucuuauuuagcacu

SEQ ID NO: 956274 - RNA, 22 nt, Human
uaaccaaagggccuaaggaaug

SEQ ID NO: 956275 - RNA, 21 nt, Human
ccacucugaguguugaacaga

SEQ ID NO: 956276 - RNA, 22 nt, Human
aaacaccaagagcuagcuauua

SEQ ID NO: 956277 - RNA, 22 nt, Human
uugacaaugcacugugcuaagu

SEQ ID NO: 956278 - RNA, 22 nt, Human
uggcagcacuagguacugagcu

SEQ ID NO: 956279 - RNA, 22 nt, Human
auucacaaguugauggauauuu

SEQ ID NO: 956280 - RNA, 22 nt, Human
acucugcugucugauggcagga

SEQ ID NO: 956281 - RNA, 22 nt, Human
aaagaauacccugggucauaaa

SEQ ID NO: 956282 - RNA, 22 nt, Human
uaaagaacacagggaauagcac

SEQ ID NO: 956283 - RNA, 22 nt, Human
acuaaauaguuuugacagaaca

SEQ ID NO: 956284 - RNA, 22 nt, Human
uaaccuuuguucaauguaagau

SEQ ID NO: 956285 - RNA, 22 nt, Human
uuauucaggcucucuuuggcua

SEQ ID NO: 956286 - RNA, 23 nt, Human
ccuccugggcacaggccugaugg

SEQ ID NO: 956287 - RNA, 22 nt, Human
uucagcaagaauuuacugagcu

SEQ ID NO: 956288 - RNA, 22 nt, Human
cuccuuggccguuaaugucaca

SEQ ID NO: 956289 - RNA, 22 nt, Human
ucauaaaaugcuccugauauug

SEQ ID NO: 956290 - RNA, 22 nt, Human
uccaaggguucaugugcauuca

SEQ ID NO: 956291 - RNA, 22 nt, Human
ucacuaaguuacauuuaguauu

SEQ ID NO: 956292 - RNA, 22 nt, Human
uuucacaaacugaggagacaau

SEQ ID NO: 956293 - RNA, 21 nt, Human
ugaaacacucuuuccaugaga

SEQ ID NO: 956294 - RNA, 22 nt, Human
gcucugcuguggaauccucucc

SEQ ID NO: 956295 - RNA, 22 nt, Human
auuuauuaagcaucugcuaugu

SEQ ID NO: 956296 - RNA, 22 nt, Human
gcuggccaggaagagucucaga

SEQ ID NO: 956297 - RNA, 22 nt, Human
uuuaauugauucacagucugua

SEQ ID NO: 956298 - RNA, 22 nt, Human
uccuggccuagcucacccugga

SEQ ID NO: 956299 - RNA, 22 nt, Human
aacuccugaggaaauggucuca

SEQ ID NO: 956300 - RNA, 22 nt, Human
uuauuuagucuagaugaauuuu

SEQ ID NO: 956301 - RNA, 22 nt, Human
cagcuccucacgagucuugaaa

SEQ ID NO: 956302 - RNA, 22 nt, Human
uggcagcaauuagcuagagcug

SEQ ID NO: 956303 - RNA, 22 nt, Human
aagaacauuuaugauggcauuu

SEQ ID NO: 956304 - RNA, 22 nt, Human
aaauaguuagcccugcauauau

SEQ ID NO: 956305 - RNA, 22 nt, Human
ucuccugguuuguuaaauaauu

SEQ ID NO: 956306 - RNA, 22 nt, Human
uagaaacagagagauaugcccc

SEQ ID NO: 956307 - RNA, 22 nt, Human
acuggccaggagcuggaaauac

SEQ ID NO: 956308 - RNA, 22 nt, Human
acaaaaaccguggauucagcau

SEQ ID NO: 956309 - RNA, 22 nt, Human
aaaaagcuuaaaugagcaguuc

SEQ ID NO: 956310 - RNA, 22 nt, Human
uagggauggcagcauguagcuu

SEQ ID NO: 956311 - RNA, 22 nt, Human
cagccuuuaagcuuggauaggu

SEQ ID NO: 956312 - RNA, 22 nt, Human
uggagggaacaaaggaguccca

SEQ ID NO: 956313 - RNA, 22 nt, Human
auuagggaaggauuuggccuga

SEQ ID NO: 956314 - RNA, 22 nt, Human
gaacccaaccucacuuggggua

SEQ ID NO: 956315 - RNA, 22 nt, Human
ucuccuggccuuuagguuaagg

SEQ ID NO: 956316 - RNA, 22 nt, Human
aaacaugagcacuugcuucaua

SEQ ID NO: 956317 - RNA, 22 nt, Human
uaaguauguuagaaaaucaagu

SEQ ID NO: 956318 - RNA, 22 nt, Human
cugcugagaaaagacugaggga

SEQ ID NO: 956319 - RNA, 22 nt, Human
agucauguguucaucuuucauu

SEQ ID NO: 956320 - RNA, 22 nt, Human
guggccaaaaggaagaagguua

SEQ ID NO: 956321 - RNA, 22 nt, Human
aucaggauggguuuggcuuagg

SEQ ID NO: 956322 - RNA, 22 nt, Human
cugggccagggaggugucugua

SEQ ID NO: 956323 - RNA, 22 nt, Human
acuggccagguucaaaauacag

SEQ ID NO: 956324 - RNA, 21 nt, Human
uucagcaagcacucuggacac

SEQ ID NO: 956325 - RNA, 22 nt, Human
cucaugucuucacccauucuaa

SEQ ID NO: 956326 - RNA, 22 nt, Human
uccuggccaggaugaccuaaca

SEQ ID NO: 956327 - RNA, 22 nt, Human
uguuuaauugggccaacagcgg

SEQ ID NO: 956328 - RNA, 22 nt, Human
auuccaaagccugaauaaugga

SEQ ID NO: 956329 - RNA, 22 nt, Human
ggcaagcauaaccuguacagcc

SEQ ID NO: 956330 - RNA, 22 nt, Human
ucuuaaaaguaugccaauugga

SEQ ID NO: 956331 - RNA, 22 nt, Human
ucugagccguauggcuuggcua

SEQ ID NO: 956332 - RNA, 22 nt, Human
cuuuauauccagauguuuggug

SEQ ID NO: 956333 - RNA, 22 nt, Human
agcagacauaucucaugucaca

SEQ ID NO: 956334 - RNA, 22 nt, Human
uuuuauuaguggcuagaugggg

SEQ ID NO: 956335 - RNA, 22 nt, Human
aaauguggguaaugggacugga

SEQ ID NO: 956336 - RNA, 22 nt, Human
aagugccaucauagcauggcug

SEQ ID NO: 956337 - RNA, 22 nt, Human
cuucuuaucaaguggcaaaucu

SEQ ID NO: 956338 - RNA, 22 nt, Human
uccugggcuuaagugauccucc

SEQ ID NO: 956339 - RNA, 22 nt, Human
uuuuaguuguaguuggugagga

SEQ ID NO: 956340 - RNA, 22 nt, Human
aaguuuguguaguuuagcaucc

SEQ ID NO: 956341 - RNA, 19 nt, Human
acugccugaggcucacagg

SEQ ID NO: 956342 - RNA, 21 nt, Human
gugguucuagagaaacagaau

SEQ ID NO: 956343 - RNA, 22 nt, Human
cuuccugggcaauguucugcuu

SEQ ID NO: 956344 - RNA, 22 nt, Human
aauucacaaaaguuagauccau

SEQ ID NO: 956345 - RNA, 22 nt, Human
cugugccaguguauuccuguga

SEQ ID NO: 956346 - RNA, 22 nt, Human
aauaagaauuuacuugucaaga

SEQ ID NO: 956347 - RNA, 20 nt, Human
aauauaauucucugaauuua

SEQ ID NO: 956348 - RNA, 22 nt, Human
aaauauguaaccaaggugaagu

SEQ ID NO: 956349 - RNA, 22 nt, Human
uucaaaacagcuagauauugga

SEQ ID NO: 956350 - RNA, 22 nt, Human
caaaaguaccuugugugcuuug

SEQ ID NO: 956351 - RNA, 22 nt, Human
ucugacauuuugagaaugacau

SEQ ID NO: 956352 - RNA, 22 nt, Human
ggaugcacgaaggcgccucgga

SEQ ID NO: 956353 - RNA, 20 nt, Human
uauuaggaaggaggaaggaa

SEQ ID NO: 956354 - RNA, 23 nt, Human
auauuagggagauuagcccucua

SEQ ID NO: 956355 - RNA, 22 nt, Human
cagcuuuuuagaaucuagggca

SEQ ID NO: 956356 - RNA, 22 nt, Human
caaauaguuuuucauguauuau

SEQ ID NO: 956357 - RNA, 22 nt, Human
uuucaagagggaacugaacaca

SEQ ID NO: 956358 - RNA, 22 nt, Human
ucuccuggauggaccuucucuu

SEQ ID NO: 956359 - RNA, 22 nt, Human
uuuaauguucaucucaaaggau

SEQ ID NO: 956360 - RNA, 22 nt, Human
uguaggauguaaggcaggcauc

SEQ ID NO: 956361 - RNA, 22 nt, Human
cggccaaauugcagagagaagc

SEQ ID NO: 956362 - RNA, 22 nt, Human
acucugcuuaauuaaaaccagg

SEQ ID NO: 956363 - RNA, 22 nt, Human
uaaaaugacuuccuccaacauc

SEQ ID NO: 956364 - RNA, 22 nt, Human
uagggauggaaacuaggaaucu

SEQ ID NO: 956365 - RNA, 22 nt, Human
auggccaagcuuacucuguugu

SEQ ID NO: 956366 - RNA, 22 nt, Human
uuucaaauaccauaaaccuaau

SEQ ID NO: 956367 - RNA, 22 nt, Human
auucacaaagucacccuuacac

SEQ ID NO: 956368 - RNA, 22 nt, Human
uaacauuccucaaaguuuucag

SEQ ID NO: 956369 - RNA, 22 nt, Human
aaauaguaaagugguagccauc

SEQ ID NO: 956370 - RNA, 22 nt, Human
aagacagagacucugcaacagg

SEQ ID NO: 956371 - RNA, 22 nt, Human
ccuuuuauacucagugauauca

SEQ ID NO: 956372 - RNA, 18 nt, Human
uuaaggauaagcagacua

SEQ ID NO: 956373 - RNA, 22 nt, Human
gcuggccagggcugcucgcgga

SEQ ID NO: 956374 - RNA, 22 nt, Human
auuuacagaagcauguaauagc

SEQ ID NO: 956375 - RNA, 22 nt, Human
acuaugcucauuguuaauauuu

SEQ ID NO: 956376 - RNA, 22 nt, Human
cauguuaaugaauuuuugcagu

SEQ ID NO: 956377 - RNA, 22 nt, Human
uguguauagcaguuuccagucu

SEQ ID NO: 956378 - RNA, 22 nt, Human
aaguuuaagguggaaguggugg

SEQ ID NO: 956379 - RNA, 22 nt, Human
ugucaucuuuuuaaagaagaga

SEQ ID NO: 956380 - RNA, 19 nt, Human
gcuccuggaugaccugugg

SEQ ID NO: 956381 - RNA, 22 nt, Human
ucugaagccaccucugcuuguc

SEQ ID NO: 956382 - RNA, 22 nt, Human
uauuagguaaaggacuugcagg

SEQ ID NO: 956383 - RNA, 22 nt, Human
auguuuuacccuuugcacaaac

SEQ ID NO: 956384 - RNA, 22 nt, Human
aaagacauggaacuagagaugg

SEQ ID NO: 956385 - RNA, 22 nt, Human
uacaguauggaaaauguauagu

SEQ ID NO: 956386 - RNA, 22 nt, Human
ucuggccagaaagacuugaugu

SEQ ID NO: 956387 - RNA, 22 nt, Human
acagggaauggagggaucagua

SEQ ID NO: 956388 - RNA, 22 nt, Human
cuggcucaauuuguacugcugu

SEQ ID NO: 956389 - RNA, 22 nt, Human
aggauaguugugaagauaggcu

SEQ ID NO: 956390 - RNA, 22 nt, Human
uuggcagcagggaguuggccgc

SEQ ID NO: 956391 - RNA, 22 nt, Human
cagcugugaauugucuuaucua

SEQ ID NO: 956392 - RNA, 22 nt, Human
uccaaagaagucacaaacgaag

SEQ ID NO: 956393 - RNA, 22 nt, Human
cuguuuauuacacuggauagca

SEQ ID NO: 956394 - RNA, 22 nt, Human
uuuuuuauaucaacugaagucu

SEQ ID NO: 956395 - RNA, 22 nt, Human
uaguuauuauuguuacuaucag

SEQ ID NO: 956396 - RNA, 22 nt, Human
uggcagacuuuagggucuacau

SEQ ID NO: 956397 - RNA, 20 nt, Human
guauuaggagguaaauguaa

SEQ ID NO: 956398 - RNA, 19 nt, Human
uccaccuuucuucauuugg

SEQ ID NO: 956399 - RNA, 22 nt, Human
ccuguuuaucuaucuagagaug

SEQ ID NO: 956400 - RNA, 22 nt, Human
uagaaacaucagcuaaccaaaa

SEQ ID NO: 956401 - RNA, 22 nt, Human
uuggcagagaguaugcugaaga

SEQ ID NO: 956402 - RNA, 22 nt, Human
ugcccaaaccucuccuagcucu

SEQ ID NO: 956403 - RNA, 22 nt, Human
aggccaaagcacagagcuggaa

SEQ ID NO: 956404 - RNA, 22 nt, Human
gcuggccacauugugccguccu

SEQ ID NO: 956405 - RNA, 22 nt, Human
ccuggccagcgccggcugcucg

SEQ ID NO: 956406 - RNA, 22 nt, Human
guuuaaguuucagaagcuaaga

SEQ ID NO: 956407 - RNA, 22 nt, Human
uauuagcgcuuacugaguugcc

SEQ ID NO: 956408 - RNA, 22 nt, Human
aaaauaacuucuacuauuugca

SEQ ID NO: 956409 - RNA, 22 nt, Human
auggccaaaucuaaacuguugg

SEQ ID NO: 956410 - RNA, 22 nt, Human
auagaauaaggcacagauucuu

SEQ ID NO: 956411 - RNA, 22 nt, Human
uccuggcccucugcaaacgcca

SEQ ID NO: 956412 - RNA, 22 nt, Human
uccaagggcaacaauggaacac

SEQ ID NO: 956413 - RNA, 22 nt, Human
caaaaguaauguaugcucaucg

SEQ ID NO: 956414 - RNA, 22 nt, Human
ugcugagaaucacagguuauaa

SEQ ID NO: 956415 - RNA, 22 nt, Human
ucucugcucaggcaccagcccu

SEQ ID NO: 956416 - RNA, 22 nt, Human
uuuuacuuaauucuuggucaug

SEQ ID NO: 956417 - RNA, 22 nt, Human
gcuggccauucucuuugagaug

SEQ ID NO: 956418 - RNA, 22 nt, Human
ucuggccagugaaaugcagaau

SEQ ID NO: 956419 - RNA, 22 nt, Human
aaacuacuaugggaauguacuu

SEQ ID NO: 956420 - RNA, 22 nt, Human
uuggccaaggucacugggugag

SEQ ID NO: 956421 - RNA, 22 nt, Human
cuccuggcuuucccagaccagg

SEQ ID NO: 956422 - RNA, 22 nt, Human
uaggauaggauggagacagaau

SEQ ID NO: 956423 - RNA, 20 nt, Human
uguccuaauagacaagcaga

SEQ ID NO: 956424 - RNA, 22 nt, Human
acucugcuguuuacucucuaua

SEQ ID NO: 956425 - RNA, 22 nt, Human
agugaacaaagguagugagcau

SEQ ID NO: 956426 - RNA, 22 nt, Human
ucaauaaaauuguuuuccuauc

SEQ ID NO: 956427 - RNA, 22 nt, Human
aaauaguuguuuggaucaauaa

SEQ ID NO: 956428 - RNA, 22 nt, Human
accuuuuauguaaauauauguu

SEQ ID NO: 956429 - RNA, 21 nt, Human
caugcaggauuuaaccuagaa

SEQ ID NO: 956430 - RNA, 20 nt, Human
guauuagguguuccucuuuc

SEQ ID NO: 956431 - RNA, 22 nt, Human
caacaaguggguacuuuacagg

SEQ ID NO: 956432 - RNA, 22 nt, Human
augauguugauaaauuacuuua

SEQ ID NO: 956433 - RNA, 22 nt, Human
auggccaacugaaaugaaagau

SEQ ID NO: 956434 - RNA, 21 nt, Human
ugcuggaaaaagugguucuag

SEQ ID NO: 956435 - RNA, 22 nt, Human
acacuuuuagcuaugaguuaau

SEQ ID NO: 956436 - RNA, 22 nt, Human
aauaguaaaagauacagcuaau

SEQ ID NO: 956437 - RNA, 22 nt, Human
uuggccaagugguuaaucucca

SEQ ID NO: 956438 - RNA, 22 nt, Human
ccuggccaggcuccaaguacug

SEQ ID NO: 956439 - RNA, 22 nt, Human
gcuccuggcuccaggcagccaa

SEQ ID NO: 956440 - RNA, 22 nt, Human
uucuuaggacuaguauagcaug

SEQ ID NO: 956441 - RNA, 22 nt, Human
aauauccagguagaugucuucu

SEQ ID NO: 956442 - RNA, 22 nt, Human
acaggacuguggaaggaucucu

SEQ ID NO: 956443 - RNA, 22 nt, Human
aaucaguauugguauagaauga

SEQ ID NO: 956444 - RNA, 22 nt, Human
guauuagguuggugcaaaauug

SEQ ID NO: 956445 - RNA, 22 nt, Human
ccuguuuacaucaucaaggacu

SEQ ID NO: 956446 - RNA, 22 nt, Human
uuucauuauucaugcuaguuau

SEQ ID NO: 956447 - RNA, 22 nt, Human
ucaaaacaaucauuggaugugc

SEQ ID NO: 956448 - RNA, 22 nt, Human
gugcaagguacauccuugaugu

SEQ ID NO: 956449 - RNA, 22 nt, Human
uaaagacaugguguaggugaac

SEQ ID NO: 956450 - RNA, 22 nt, Human
ccuccugguugcaaugaaaugg

SEQ ID NO: 956451 - RNA, 20 nt, Human
uaacauaguccagagaacga

SEQ ID NO: 956452 - RNA, 22 nt, Human
caaauauuccagguacaucccu

SEQ ID NO: 956453 - RNA, 22 nt, Human
uuaaaaugaauauugauuagca

SEQ ID NO: 956454 - RNA, 23 nt, Human
ugauuaggucuacucuuggcucc

SEQ ID NO: 956455 - RNA, 23 nt, Human
gacaccuuugccagaucaagaug

SEQ ID NO: 956456 - RNA, 22 nt, Human
caauaagccagguguuuguguu

SEQ ID NO: 956457 - RNA, 22 nt, Human
cguggccagccauuuccuggaa

SEQ ID NO: 956458 - RNA, 22 nt, Human
ucuggccaacaaaaacuaaguc

SEQ ID NO: 956459 - RNA, 22 nt, Human
auucacaacaaaaggauaugag

SEQ ID NO: 956460 - RNA, 22 nt, Human
uagaaacagcauauauuagccc

SEQ ID NO: 956461 - RNA, 22 nt, Human
aggauuuuagauaagacagcaa

SEQ ID NO: 956462 - RNA, 22 nt, Human
ucuuguuacaguuuauuacaug

SEQ ID NO: 956463 - RNA, 22 nt, Human
uauugaaauccauuacguucuu

SEQ ID NO: 956464 - RNA, 20 nt, Human
uccuggccucccuggggcuc

SEQ ID NO: 956465 - RNA, 23 nt, Human
ggccacaaauagucuccccuggc

SEQ ID NO: 956466 - RNA, 22 nt, Human
cugggcaauaugcugggccugg

SEQ ID NO: 956467 - RNA, 22 nt, Human
cuuuagugguauuuuagcaagu

SEQ ID NO: 956468 - RNA, 22 nt, Human
ucucugcuugguguaugugagu

SEQ ID NO: 956469 - RNA, 22 nt, Human
uaauaggagccaggucacauag

SEQ ID NO: 956470 - RNA, 22 nt, Human
ggauuugggcuugcagcagagc

SEQ ID NO: 956471 - RNA, 22 nt, Human
aggaucuugcuguagaggauag

SEQ ID NO: 956472 - RNA, 22 nt, Human
accucugcaacccuggaauggg

SEQ ID NO: 956473 - RNA, 22 nt, Human
gaaauauugggacucagagcuu

SEQ ID NO: 956474 - RNA, 17 nt, Human
cuccuggcagccucagg

SEQ ID NO: 956475 - RNA, 18 nt, Human
uagaauauaggucauucu

SEQ ID NO: 956476 - RNA, 22 nt, Human
aaauauuagggagaacagggac

SEQ ID NO: 956477 - RNA, 19 nt, Human
uccugggcugcgucuugcc

SEQ ID NO: 956478 - RNA, 22 nt, Human
auucugaguccaugggggcagg

SEQ ID NO: 956479 - RNA, 22 nt, Human
ccuggccaggcucucagcacug

SEQ ID NO: 956480 - RNA, 22 nt, Human
auuaggcagggcaugguggcuc

SEQ ID NO: 956481 - RNA, 22 nt, Human
uuuauuaauguagcauccaugg

SEQ ID NO: 956482 - RNA, 22 nt, Human
ucacucuggccucugcagcagu

SEQ ID NO: 956483 - RNA, 22 nt, Human
guuuuauuggaacacagccaug

SEQ ID NO: 956484 - RNA, 22 nt, Human
gacauacagcauggucuaugaa

SEQ ID NO: 956485 - RNA, 22 nt, Human
accuuguuaaaaugaggauucu

SEQ ID NO: 956486 - RNA, 22 nt, Human
cuggccuagcucucugcuugaa

SEQ ID NO: 956487 - RNA, 22 nt, Human
acaguguuuuaugagaauuguu

SEQ ID NO: 956488 - RNA, 22 nt, Human
uugagggaacaugagaaucauc

SEQ ID NO: 956489 - RNA, 17 nt, Human
aaauaugaccucaaagu

SEQ ID NO: 956490 - RNA, 22 nt, Human
agccaugugucuuuauucuguu

SEQ ID NO: 956491 - RNA, 22 nt, Human
caacccaaaagcguuuccauuu

SEQ ID NO: 956492 - RNA, 22 nt, Human
cucugcugggauguaaagucuu

SEQ ID NO: 956493 - RNA, 22 nt, Human
caacuccuggcuguuaggcaca

SEQ ID NO: 956494 - RNA, 22 nt, Human
cuaaauaaucccucuggucuua

SEQ ID NO: 956495 - RNA, 22 nt, Human
gagccaagaucgcaccacugca

SEQ ID NO: 956496 - RNA, 22 nt, Human
cugcacaguuugauuucuugcu

SEQ ID NO: 956497 - RNA, 22 nt, Human
agccuugaguucaagugcuggc

SEQ ID NO: 956498 - RNA, 22 nt, Human
ucacucugccuccauauuacua

SEQ ID NO: 956499 - RNA, 22 nt, Human
cacugucuuuugugaagacaau

SEQ ID NO: 956500 - RNA, 18 nt, Human
ugcagcaagugcuaaaua

SEQ ID NO: 956501 - RNA, 22 nt, Human
acuccuggguucuaaauuugaa

SEQ ID NO: 956502 - RNA, 22 nt, Human
cuggccaguugccuuccugggu

SEQ ID NO: 956503 - RNA, 22 nt, Human
uugcuucauuuuaaauaaagac

SEQ ID NO: 956504 - RNA, 18 nt, Human
ucagggaaucuuggccuu

SEQ ID NO: 956505 - RNA, 22 nt, Human
uguagaaagaauauguuucaua

SEQ ID NO: 956506 - RNA, 19 nt, Human
ccuggccagacuucugccc

SEQ ID NO: 956507 - RNA, 22 nt, Human
aaauauguauggaguucaugaa

SEQ ID NO: 956508 - RNA, 22 nt, Human
aacuaacagucauuaaaagaac

SEQ ID NO: 956509 - RNA, 21 nt, Human
uuucacaaaaguaugugacaa

SEQ ID NO: 956510 - RNA, 22 nt, Human
cuuucacacacauacauuugga

SEQ ID NO: 956511 - RNA, 22 nt, Human
aggucacccguuugacuaucca

SEQ ID NO: 956512 - RNA, 22 nt, Human
aacaaaccuucccuauacgucu

SEQ ID NO: 956513 - RNA, 22 nt, Human
cuggccaauccauuaauuuguu

SEQ ID NO: 956514 - RNA, 19 nt, Human
gcuggccacgccccaguug

SEQ ID NO: 956515 - RNA, 22 nt, Human
guuauauaagacaaaucagagu

SEQ ID NO: 956516 - RNA, 22 nt, Human
aauaauaagauacuaagggagu

SEQ ID NO: 956517 - RNA, 22 nt, Human
agacauuuauugaacaccuagc

SEQ ID NO: 956518 - RNA, 22 nt, Human
uugaaaaguuuugaaacacucu

SEQ ID NO: 956519 - RNA, 22 nt, Human
aacauuucauuggaagcuaugu

SEQ ID NO: 956520 - RNA, 22 nt, Human
guuuauuauucaacuucauguu

SEQ ID NO: 956521 - RNA, 22 nt, Human
acucugcucuuauaguguuaua

SEQ ID NO: 956522 - RNA, 22 nt, Human
aacuccagggcauugucuccug

SEQ ID NO: 956523 - RNA, 22 nt, Human
cuauuagguuggugcaaaagua

SEQ ID NO: 956524 - RNA, 22 nt, Human
ucacucugauagauaagcuaac

SEQ ID NO: 956525 - RNA, 19 nt, Human
uuucuuaggccuuuggccu

SEQ ID NO: 956526 - RNA, 22 nt, Human
aaaguuugagugauuugacaca

SEQ ID NO: 956527 - RNA, 21 nt, Human
ugcauuccuccauccaacagg

SEQ ID NO: 956528 - RNA, 22 nt, Human
gcuccuggcucuggccaaggga

SEQ ID NO: 956529 - RNA, 22 nt, Human
agcugaaagugcuuugaggacu

SEQ ID NO: 956530 - RNA, 22 nt, Human
uauuuauucauucagcaagcau

SEQ ID NO: 956531 - RNA, 22 nt, Human
aaugauggucauggcaacuuuu

SEQ ID NO: 956532 - RNA, 22 nt, Human
cagcuuuguccugcaaaccuga

SEQ ID NO: 956533 - RNA, 22 nt, Human
aaauuagucauguuguauuacu

SEQ ID NO: 956534 - RNA, 22 nt, Human
uucaucaauguguuuaauaaug

SEQ ID NO: 956535 - RNA, 22 nt, Human
ucuggccaauguugugaucaca

SEQ ID NO: 956536 - RNA, 23 nt, Human
uuccuggcagguacaacuuuuac

SEQ ID NO: 956537 - RNA, 22 nt, Human
uucagauaaacuacaaauaauu

SEQ ID NO: 956538 - RNA, 21 nt, Human
uuuauuuauauaggacacaug

SEQ ID NO: 956539 - RNA, 22 nt, Human
acuaaauagccucugguaguug

SEQ ID NO: 956540 - RNA, 22 nt, Human
gcuggccagcccucuuccucca

SEQ ID NO: 956541 - RNA, 22 nt, Human
cauuucauaguugucacaauaa

SEQ ID NO: 956542 - RNA, 22 nt, Human
aaauaugaaugauaagaguuau

SEQ ID NO: 956543 - RNA, 22 nt, Human
agagugauccuaauugauuugg

SEQ ID NO: 956544 - RNA, 22 nt, Human
aaguaugcaaaucgucuuagaa

SEQ ID NO: 956545 - RNA, 22 nt, Human
ccuggccagggucugggcugcu

SEQ ID NO: 956546 - RNA, 22 nt, Human
guuauuagaagugaaggauugu

SEQ ID NO: 956547 - RNA, 22 nt, Human
auguuauaguuauaaaaugagg

SEQ ID NO: 956548 - RNA, 22 nt, Human
aacuccagugucagcugcaaug

SEQ ID NO: 956549 - RNA, 22 nt, Human
auagacauuuugcauucaagca

SEQ ID NO: 956550 - RNA, 22 nt, Human
guuaggauguggggacuuuggg

SEQ ID NO: 956551 - RNA, 22 nt, Human
cuccugugggucaccaauaggc

SEQ ID NO: 956552 - RNA, 22 nt, Human
gauuaggacauggauguauguu

SEQ ID NO: 956553 - RNA, 22 nt, Human
uaaccuuuggugaaauauuaac

SEQ ID NO: 956554 - RNA, 18 nt, Human
ugucaucuguuuaaaacc

SEQ ID NO: 956555 - RNA, 22 nt, Human
uuugaaauguaucaguauaggu

SEQ ID NO: 956556 - RNA, 22 nt, Human
ucugugccaccucuccaguguc

SEQ ID NO: 956557 - RNA, 22 nt, Human
agacaggaugcauacucuuggu

SEQ ID NO: 956558 - RNA, 22 nt, Human
uggcaccaggcgggguggcugu

SEQ ID NO: 956559 - RNA, 22 nt, Human
cauagaaacugagacaaggauu

SEQ ID NO: 956560 - RNA, 22 nt, Human
ucuggccauggcaagccgagug

SEQ ID NO: 956561 - RNA, 22 nt, Human
uuuuaauugcaauuaugguccc

SEQ ID NO: 956562 - RNA, 22 nt, Human
aauucacaggagguauuugucc

SEQ ID NO: 956563 - RNA, 22 nt, Human
acuccugggugcugaccagcgu

SEQ ID NO: 956564 - RNA, 22 nt, Human
ccuccuggauggauuuggugga

SEQ ID NO: 956565 - RNA, 22 nt, Human
auuacacacucaaguccuguua

SEQ ID NO: 956566 - RNA, 22 nt, Human
uagcuuuguguaugaugucugu

SEQ ID NO: 956567 - RNA, 22 nt, Human
uggcagcagaacaugaaaccca

SEQ ID NO: 956568 - RNA, 22 nt, Human
cuggcacaaugucacuuuugcu

SEQ ID NO: 956569 - RNA, 22 nt, Human
acuccuggugcugaugaagaga

SEQ ID NO: 956570 - RNA, 22 nt, Human
caaaaguaauugcaguuuuugc

SEQ ID NO: 956571 - RNA, 22 nt, Human
gcaggagagucugugccagguu

SEQ ID NO: 956572 - RNA, 20 nt, Human
ggccgaaauaauaguggcuu

SEQ ID NO: 956573 - RNA, 22 nt, Human
gggucugaggaguaccauuguc

SEQ ID NO: 956574 - RNA, 22 nt, Human
cugagccaguagucagggacaa

SEQ ID NO: 956575 - RNA, 22 nt, Human
acuccugguucccaguugagau

SEQ ID NO: 956576 - RNA, 22 nt, Human
ugacauaaguugguagaaagga

SEQ ID NO: 956577 - RNA, 22 nt, Human
aaaacuccugaaauuguuuccc

SEQ ID NO: 956578 - RNA, 22 nt, Human
gcucugcugagauaucugggag

SEQ ID NO: 956579 - RNA, 20 nt, Human
ucuguaaagacuccagaagc

SEQ ID NO: 956580 - RNA, 22 nt, Human
gaaaaguauguuuauuuugacu

SEQ ID NO: 956581 - RNA, 22 nt, Human
gucuggccuuuuuagcuugugg

SEQ ID NO: 956582 - RNA, 22 nt, Human
gauauagguucauaguguuaca

SEQ ID NO: 956583 - RNA, 22 nt, Human
uuuaguagaaauauuugggccu

SEQ ID NO: 956584 - RNA, 22 nt, Human
uuuuuauaugaaggauagugcg

SEQ ID NO: 956585 - RNA, 22 nt, Human
uuuuaauucaaagugaauagug

SEQ ID NO: 956586 - RNA, 22 nt, Human
aaugaaauguagcuuauccaua

SEQ ID NO: 956587 - RNA, 21 nt, Human
uuuuauugaugaauggccacu

SEQ ID NO: 956588 - RNA, 22 nt, Human
uuuaggaucucucuuguuacau

SEQ ID NO: 956589 - RNA, 22 nt, Human
uugaaugaccaugaugcaaggg

SEQ ID NO: 956590 - RNA, 22 nt, Human
aaauacagcagacuccuguugu

SEQ ID NO: 956591 - RNA, 22 nt, Human
aaauauagcaauuaugccuacu

SEQ ID NO: 956592 - RNA, 22 nt, Human
augaaaaguucgaucuagaagg

SEQ ID NO: 956593 - RNA, 22 nt, Human
ucugccaccuucauccuccacu

SEQ ID NO: 956594 - RNA, 22 nt, Human
cuggccaacuugcuuguuggca

SEQ ID NO: 956595 - RNA, 22 nt, Human
acacauaagaaacuacaaagag

SEQ ID NO: 956596 - RNA, 22 nt, Human
gcauugaguccacucugucuuu

SEQ ID NO: 956597 - RNA, 21 nt, Human
acacauuaugagcauagacuc

SEQ ID NO: 956598 - RNA, 22 nt, Human
acucugcucuguauuucacugu

SEQ ID NO: 956599 - RNA, 22 nt, Human
aacugcauuuaacaaauacucu

SEQ ID NO: 956600 - RNA, 22 nt, Human
uagagcugggcagugcucugag

SEQ ID NO: 956601 - RNA, 22 nt, Human
aggauuucugugccuggaaaau

SEQ ID NO: 956602 - RNA, 19 nt, Human
auaaauaaaaagugggaga

SEQ ID NO: 956603 - RNA, 22 nt, Human
uacaaagagguaauugcauaua

SEQ ID NO: 956604 - RNA, 22 nt, Human
aauaaaauggucaguuuucuca

SEQ ID NO: 956605 - RNA, 22 nt, Human
gauguuucaugcuagcaugugu

SEQ ID NO: 956606 - RNA, 22 nt, Human
ccuggccaaucuagggcuguua

SEQ ID NO: 956607 - RNA, 22 nt, Human
ccuggccacucagguguggggc

SEQ ID NO: 956608 - RNA, 22 nt, Human
accuguuuuccuaucuagauug

SEQ ID NO: 956609 - RNA, 16 nt, Human
auucacaaggcaucgg

SEQ ID NO: 956610 - RNA, 22 nt, Human
acagacauuuucuguauugccu

SEQ ID NO: 956611 - RNA, 19 nt, Human
uggucuaaaugugugcccc

SEQ ID NO: 956612 - RNA, 22 nt, Human
aaugccuuggagagccuagagg

SEQ ID NO: 956613 - RNA, 22 nt, Human
guggccaaggcagagaaagagc

SEQ ID NO: 956614 - RNA, 22 nt, Human
aaaaguaauugaugcaaucgua

SEQ ID NO: 956615 - RNA, 22 nt, Human
acuccaggguuuugcaccugga

SEQ ID NO: 956616 - RNA, 22 nt, Human
gcuccuggcaggcagugugugu

SEQ ID NO: 956617 - RNA, 22 nt, Human
uaaaauguuugcaagagaccag

SEQ ID NO: 956618 - RNA, 22 nt, Human
auauaaagagcuuaguauagug

SEQ ID NO: 956619 - RNA, 22 nt, Human
uuuaggauauuaauguucagag

SEQ ID NO: 956620 - RNA, 22 nt, Human
cuggccuaaaauugcuucugca

SEQ ID NO: 956621 - RNA, 22 nt, Human
auucugagaaaugcauugucag

SEQ ID NO: 956622 - RNA, 22 nt, Human
uugcaaaugggcaaagcagauc

SEQ ID NO: 956623 - RNA, 22 nt, Human
cuccuggcucgcccccagcuga

SEQ ID NO: 956624 - RNA, 22 nt, Human
uggccacacccaccuagaggag

SEQ ID NO: 956625 - RNA, 22 nt, Human
aaguaugcuaauuaacuagcac

SEQ ID NO: 956626 - RNA, 22 nt, Human
ucuccuggcucuaaaaggcugu

SEQ ID NO: 956627 - RNA, 22 nt, Human
uggcagcagcuaacuuaggcag

SEQ ID NO: 956628 - RNA, 22 nt, Human
cuaggccacuugcucucaugga

SEQ ID NO: 956629 - RNA, 22 nt, Human
ucacucugacuuggccuccaac

SEQ ID NO: 956630 - RNA, 22 nt, Human
uauuggucuuggaagguuuugu

SEQ ID NO: 956631 - RNA, 22 nt, Human
aguaugaagaugaugaaaaaua

SEQ ID NO: 956632 - RNA, 22 nt, Human
uugcaaaugaccauugccacau

SEQ ID NO: 956633 - RNA, 22 nt, Human
uuugaauaucacaaacuuucaa

SEQ ID NO: 956634 - RNA, 22 nt, Human
acauacaucaaguaucacaaga

SEQ ID NO: 956635 - RNA, 16 nt, Human
aggccaaaaaggggca

SEQ ID NO: 956636 - RNA, 22 nt, Human
guuauaaaaugcacaguuguuu

SEQ ID NO: 956637 - RNA, 22 nt, Human
uggagccagagcgcagccuggg

SEQ ID NO: 956638 - RNA, 22 nt, Human
ccuggccauagggcccaggaaa

SEQ ID NO: 956639 - RNA, 22 nt, Human
cagacaggcaggugcugcuuug

SEQ ID NO: 956640 - RNA, 22 nt, Human
acuccuggggauccauuccuuu

SEQ ID NO: 956641 - RNA, 22 nt, Human
uaaauaugcauguauccuuauc

SEQ ID NO: 956642 - RNA, 22 nt, Human
uuucacaaguuucaggauucug

SEQ ID NO: 956643 - RNA, 22 nt, Human
ugaccaaaaaauucccugugag

SEQ ID NO: 956644 - RNA, 22 nt, Human
gcucugcugcuuacuagauggu

SEQ ID NO: 956645 - RNA, 22 nt, Human
gaaauauuguacuggagauguu

SEQ ID NO: 956646 - RNA, 22 nt, Human
ucuccugguacccuuccuagca

SEQ ID NO: 956647 - RNA, 22 nt, Human
cuggccacugguggucauaggc

SEQ ID NO: 956648 - RNA, 22 nt, Human
augauugaaaaugacauugcca

SEQ ID NO: 956649 - RNA, 22 nt, Human
agauaaauuccuaagauuucag

SEQ ID NO: 956650 - RNA, 22 nt, Human
aguuggcauuuuauuuaaguau

SEQ ID NO: 956651 - RNA, 22 nt, Human
aaagcuauuuuauugcagcucu

SEQ ID NO: 956652 - RNA, 22 nt, Human
caaguuaucagaaggcacuuuu

SEQ ID NO: 956653 - RNA, 21 nt, Human
uuauugagacauuuguggaaa

SEQ ID NO: 956654 - RNA, 22 nt, Human
auaaaagaaguuuugguacuug

SEQ ID NO: 956655 - RNA, 22 nt, Human
ucuggccaguagauguggguug

SEQ ID NO: 956656 - RNA, 22 nt, Human
caugcaggcacccagagcccac

SEQ ID NO: 956657 - RNA, 22 nt, Human
aagucaaaccuugcucacagga

SEQ ID NO: 956658 - RNA, 22 nt, Human
accuguuuguguccauuaguga

SEQ ID NO: 956659 - RNA, 22 nt, Human
gcagggaaggggcaugcuggag

SEQ ID NO: 956660 - RNA, 22 nt, Human
aggccaaagcucaccugcagcu

SEQ ID NO: 956661 - RNA, 22 nt, Human
uuagauaacaguagaauaucaa

SEQ ID NO: 956662 - RNA, 22 nt, Human
uucaaacaguguagaauauaug

SEQ ID NO: 956663 - RNA, 22 nt, Human
guucacaauuuuuacugauugg

SEQ ID NO: 956664 - RNA, 22 nt, Human
uuucaacauauaccauaaugcc

SEQ ID NO: 956665 - RNA, 22 nt, Human
gaugcaaagcauuuuugugugu

SEQ ID NO: 956666 - RNA, 22 nt, Human
ccuccugguaauuagcgaaagg

SEQ ID NO: 956667 - RNA, 22 nt, Human
cuccuggcacugucuugaccca

SEQ ID NO: 956668 - RNA, 22 nt, Human
uuuacuguuuacagcuaaugca

SEQ ID NO: 956669 - RNA, 22 nt, Human
aucuuucaaucaggaaaaaucu

SEQ ID NO: 956670 - RNA, 22 nt, Human
uaaauaaguucuucauuguuug

SEQ ID NO: 956671 - RNA, 20 nt, Human
guguuucaugugauacaaug

SEQ ID NO: 956672 - RNA, 22 nt, Human
caacugagcaguagcgucugga

SEQ ID NO: 956673 - RNA, 22 nt, Human
ucacucugggcccuacugggcu

SEQ ID NO: 956674 - RNA, 22 nt, Human
agcuauguauuuguguguuaaa

SEQ ID NO: 956675 - RNA, 22 nt, Human
uaaguuaucggaguguguuuca

SEQ ID NO: 956676 - RNA, 18 nt, Human
uacaucuauauaguguuu

SEQ ID NO: 956677 - RNA, 22 nt, Human
uucagcaauuuuuuaagcuaau

SEQ ID NO: 956678 - RNA, 22 nt, Human
uucugagccucauucaugaggc

SEQ ID NO: 956679 - RNA, 22 nt, Human
agcauaaguugguacagccacu

SEQ ID NO: 956680 - RNA, 22 nt, Human
agacagguaaauagagaugcug

SEQ ID NO: 956681 - RNA, 22 nt, Human
aacacugcugcuggguucugug

SEQ ID NO: 956682 - RNA, 22 nt, Human
guuccaaacaagucauaaagua

SEQ ID NO: 956683 - RNA, 22 nt, Human
aggcucugugcagccugcaucu

SEQ ID NO: 956684 - RNA, 22 nt, Human
auaaugugauauuucauuuaca

SEQ ID NO: 956685 - RNA, 22 nt, Human
uuauuaggaacucaggauuuuu

SEQ ID NO: 956686 - RNA, 21 nt, Human
acucugcugcgggcuuggccu

SEQ ID NO: 956687 - RNA, 22 nt, Human
ccuggaccaaacacuggccugg

SEQ ID NO: 956688 - RNA, 22 nt, Human
ggucugaguggggccugagauu

SEQ ID NO: 956689 - RNA, 22 nt, Human
auuaggauguuccuaugcacau

SEQ ID NO: 956690 - RNA, 22 nt, Human
ucugagccagccaccuccuuca

SEQ ID NO: 956691 - RNA, 22 nt, Human
ucuccuggcccugucgccaucu

SEQ ID NO: 956692 - RNA, 22 nt, Human
ccuccuggagcauuggugagga

SEQ ID NO: 956693 - RNA, 22 nt, Human
guuaauaaagguauagaaucag

SEQ ID NO: 956694 - RNA, 22 nt, Human
aacacuuucuuccuugcucagg

SEQ ID NO: 956695 - RNA, 22 nt, Human
auucacauguugaagcccuaac

SEQ ID NO: 956696 - RNA, 22 nt, Human
gcuccuggauguucaagucggc

SEQ ID NO: 956697 - RNA, 22 nt, Human
auuacacaggauuugccuuacu

SEQ ID NO: 956698 - RNA, 22 nt, Human
uuuauuauccaguguugucaug

SEQ ID NO: 956699 - RNA, 22 nt, Human
ucugcaagauggucuuagaggu

SEQ ID NO: 956700 - RNA, 22 nt, Human
auguuuuauauuuugcagcagu

SEQ ID NO: 956701 - RNA, 22 nt, Human
ugaaaaacuuuaauccauaaag

SEQ ID NO: 956702 - RNA, 22 nt, Human
uuuauagggacaguucuuggag

SEQ ID NO: 956703 - RNA, 22 nt, Human
cugcugucauagccaucccucc

SEQ ID NO: 956704 - RNA, 22 nt, Human
uuuacugugcauuagaaucacc

SEQ ID NO: 956705 - RNA, 22 nt, Human
ugcuuccuauccacacaaugcc

SEQ ID NO: 956706 - RNA, 22 nt, Human
ucaaugaaagagcaugcauuuu

SEQ ID NO: 956707 - RNA, 22 nt, Human
ggcaacauucuccagauccuuu

SEQ ID NO: 956708 - RNA, 22 nt, Human
auccauggaggacaagagcaau

SEQ ID NO: 956709 - RNA, 22 nt, Human
uugcauguagaauacucaacuu

SEQ ID NO: 956710 - RNA, 22 nt, Human
ucacuaagugccgaguuuaguu

SEQ ID NO: 956711 - RNA, 18 nt, Human
uuaauguggcuuacuaug

SEQ ID NO: 956712 - RNA, 22 nt, Human
augugcuaaacucaacaaaucu

SEQ ID NO: 956713 - RNA, 22 nt, Human
gauuucuuuagguguaauagug

SEQ ID NO: 956714 - RNA, 22 nt, Human
ugcugaaaacucaaccauugug

SEQ ID NO: 956715 - RNA, 22 nt, Human
ccuucuuaaacaucauuuuggc

SEQ ID NO: 956716 - RNA, 22 nt, Human
acucugacuggagugagagagg

SEQ ID NO: 956717 - RNA, 22 nt, Human
acauaaugaaaugcagaaauca

SEQ ID NO: 956718 - RNA, 22 nt, Human
ucuuuauuuuaugcuugugcaa

SEQ ID NO: 956719 - RNA, 22 nt, Human
aaaagucugcucucauuucaga

SEQ ID NO: 956720 - RNA, 22 nt, Human
guauuaggaaauaugaagaaag

SEQ ID NO: 956721 - RNA, 22 nt, Human
ccucugcucugguccaugugcu

SEQ ID NO: 956722 - RNA, 22 nt, Human
uuaguaggagagcuuguucauu

SEQ ID NO: 956723 - RNA, 22 nt, Human
aagggcugagcacagugagcca

SEQ ID NO: 956724 - RNA, 22 nt, Human
uucagcaagugucucuacuguc

SEQ ID NO: 956725 - RNA, 22 nt, Human
ggucugaguagagggcuggcga

SEQ ID NO: 956726 - RNA, 22 nt, Human
uuaggauagucuguuagaaaag

SEQ ID NO: 956727 - RNA, 22 nt, Human
uauguagguaaacacagacaua

SEQ ID NO: 956728 - RNA, 22 nt, Human
uccuggccucgcuguccaccuu

SEQ ID NO: 956729 - RNA, 22 nt, Human
cuguuacacggaccuucaaauc

SEQ ID NO: 956730 - RNA, 22 nt, Human
gacucugcuaggaaaaucucag

SEQ ID NO: 956731 - RNA, 22 nt, Human
aacauuucugagaauaucaguu

SEQ ID NO: 956732 - RNA, 15 nt, Human
ucacucuggaaggga

SEQ ID NO: 956733 - RNA, 22 nt, Human
uucuuagaugauuaaugauggg

SEQ ID NO: 956734 - RNA, 22 nt, Human
guuaggauauggugaaauggag

SEQ ID NO: 956735 - RNA, 23 nt, Human
cuccuggaggguccggcccugcc

SEQ ID NO: 956736 - RNA, 22 nt, Human
augcuuccaaggcuaagacaag

SEQ ID NO: 956737 - RNA, 22 nt, Human
uggcagcacaagguggcccaug

SEQ ID NO: 956738 - RNA, 22 nt, Human
agucuuaacuaugcaaguacua

SEQ ID NO: 956739 - RNA, 22 nt, Human
ugucaucucacugauauagaug

SEQ ID NO: 956740 - RNA, 22 nt, Human
uuuauauagagauuugugcaug

SEQ ID NO: 956741 - RNA, 22 nt, Human
cauccugguuaccccauaguca

SEQ ID NO: 956742 - RNA, 22 nt, Human
uggcaucauagccaaggugcuu

SEQ ID NO: 956743 - RNA, 22 nt, Human
ccacucugauuucaagggagau

SEQ ID NO: 956744 - RNA, 22 nt, Human
gggcauguagugugcauagaga

SEQ ID NO: 956745 - RNA, 22 nt, Human
augguacaauguguuuguuagg

SEQ ID NO: 956746 - RNA, 22 nt, Human
cuugaucuacauagugaaaccc

SEQ ID NO: 956747 - RNA, 22 nt, Human
caaaaagcuuagguaacaagcc

SEQ ID NO: 956748 - RNA, 22 nt, Human
accuauuuaugcaauuaugaaa

SEQ ID NO: 956749 - RNA, 20 nt, Human
cauuggacuuggcuucaugg

SEQ ID NO: 956750 - RNA, 22 nt, Human
caacccaagguuaguuggucuu

SEQ ID NO: 956751 - RNA, 22 nt, Human
uaaaaaguagugagaauggcgc

SEQ ID NO: 956752 - RNA, 22 nt, Human
ugucaucuuggucuggaauaag

SEQ ID NO: 956753 - RNA, 22 nt, Human
aacauuucagcaccugauuccu

SEQ ID NO: 956754 - RNA, 22 nt, Human
aacauucaccucuaccuccuuc

SEQ ID NO: 956755 - RNA, 22 nt, Human
acucugcuaaauguaaguuggu

SEQ ID NO: 956756 - RNA, 22 nt, Human
uuucuauucuggaucuguggca

SEQ ID NO: 956757 - RNA, 22 nt, Human
auuaggaaauguguugcaagca

SEQ ID NO: 956758 - RNA, 22 nt, Human
aagauauuuuagaacauucacu

SEQ ID NO: 956759 - RNA, 22 nt, Human
accuacccuuagaucacaaggg

SEQ ID NO: 956760 - RNA, 22 nt, Human
auaauaaaccaggaugggucug

SEQ ID NO: 956761 - RNA, 22 nt, Human
uugaaaugcagauuccaaucca

SEQ ID NO: 956762 - RNA, 22 nt, Human
ccuccuggaggcucuagggaaa

SEQ ID NO: 956763 - RNA, 22 nt, Human
aacuucuggauguuucaaaugu

SEQ ID NO: 956764 - RNA, 22 nt, Human
aaacccaucugucugucugcag

SEQ ID NO: 956765 - RNA, 22 nt, Human
uuggccaauuuagaacguguug

SEQ ID NO: 956766 - RNA, 22 nt, Human
uaggauguagcuaugucaucau

SEQ ID NO: 956767 - RNA, 22 nt, Human
gcagacaucaagcacaggccca

SEQ ID NO: 956768 - RNA, 22 nt, Human
cuccacagcucaggcucagagu

SEQ ID NO: 956769 - RNA, 22 nt, Human
aaagguaacaguuauaaccagg

SEQ ID NO: 956770 - RNA, 22 nt, Human
auuuauuaugggauuuggcuca

SEQ ID NO: 956771 - RNA, 22 nt, Human
aaguuuguucagggcuuacauu

SEQ ID NO: 956772 - RNA, 22 nt, Human
gucugucuguuguugagaagca

SEQ ID NO: 956773 - RNA, 22 nt, Human
uuucuggcagcgggacaggggu

SEQ ID NO: 956774 - RNA, 22 nt, Human
ucacaaaucauuuuaucugugu

SEQ ID NO: 956775 - RNA, 22 nt, Human
uggcgcaacucauucauggugu

SEQ ID NO: 956776 - RNA, 22 nt, Human
auucacaaguucuagggauuag

SEQ ID NO: 956777 - RNA, 22 nt, Human
aguuucuuuagauagaaaguuc

SEQ ID NO: 956778 - RNA, 22 nt, Human
augcaaaugaacauguugcuag

SEQ ID NO: 956779 - RNA, 22 nt, Human
cacucugcagcugaagggcugg

SEQ ID NO: 956780 - RNA, 22 nt, Human
cuugaaaugacaggagcacauc

SEQ ID NO: 956781 - RNA, 22 nt, Human
uauucacauucucaggccuggu

SEQ ID NO: 956782 - RNA, 22 nt, Human
cauaacauccuugcuacuuuga

SEQ ID NO: 956783 - RNA, 22 nt, Human
uuggccaauggugauucccggc

SEQ ID NO: 956784 - RNA, 22 nt, Human
augucacauggccuguacuuug

SEQ ID NO: 956785 - RNA, 22 nt, Human
gaguuauuugguuugcaugcag

SEQ ID NO: 956786 - RNA, 22 nt, Human
uaaaaguaggaaugaaacgcau

SEQ ID NO: 956787 - RNA, 22 nt, Human
gcuccuggugcaaaguuucuuc

SEQ ID NO: 956788 - RNA, 22 nt, Human
uaagaacaguagaacaguaggu

SEQ ID NO: 956789 - RNA, 22 nt, Human
accuuuuuguucuguucucagc

SEQ ID NO: 956790 - RNA, 23 nt, Human
uacuuaggaauggggacggcaag

SEQ ID NO: 956791 - RNA, 22 nt, Human
auucugagacaauugccgucag

SEQ ID NO: 956792 - RNA, 23 nt, Human
acagaaaguucugcuggacagag

SEQ ID NO: 956793 - RNA, 22 nt, Human
augugagguaucuaggucuucg

SEQ ID NO: 956794 - RNA, 22 nt, Human
uggccaagaaugauaugugaag

SEQ ID NO: 956795 - RNA, 22 nt, Human
aguuuaauauccuucaacuuuc

SEQ ID NO: 956796 - RNA, 22 nt, Human
aguaacucauguaaaccucaca

SEQ ID NO: 956797 - RNA, 22 nt, Human
agggaagaugucucaucuuagg

SEQ ID NO: 956798 - RNA, 22 nt, Human
aagaacauucgaacuauuuucu

SEQ ID NO: 956799 - RNA, 22 nt, Human
aaaauauuuuagggccaggaga

SEQ ID NO: 956800 - RNA, 22 nt, Human
cuucacaaauggccuagaguuc

SEQ ID NO: 956801 - RNA, 21 nt, Human
uccuggccagggcacuaggca

SEQ ID NO: 956802 - RNA, 22 nt, Human
aauaauuagugggacagagaac

SEQ ID NO: 956803 - RNA, 22 nt, Human
uuucacaaacucagggugugug

SEQ ID NO: 956804 - RNA, 22 nt, Human
uuuuauugucaaugaagacaga

SEQ ID NO: 956805 - RNA, 22 nt, Human
auuagguuagugugcaagagaa

SEQ ID NO: 956806 - RNA, 22 nt, Human
uaaaguauauuuuuucucaaua

SEQ ID NO: 956807 - RNA, 22 nt, Human
ugagccaaacuucuccuugguc

SEQ ID NO: 956808 - RNA, 22 nt, Human
aacugcuggggaggccaaacuc

SEQ ID NO: 956809 - RNA, 22 nt, Human
gaaauauucuugucuuguuuuc

SEQ ID NO: 956810 - RNA, 22 nt, Human
uaugcacaauaugaucuauuug

SEQ ID NO: 956811 - RNA, 22 nt, Human
augauguuauuuucagaaacau

SEQ ID NO: 956812 - RNA, 21 nt, Human
ccucugcucgggcaugcguuu

SEQ ID NO: 956813 - RNA, 22 nt, Human
aauuaggagaaaacuguugucu

SEQ ID NO: 956814 - RNA, 22 nt, Human
cuggucaaggagagucucugca

SEQ ID NO: 956815 - RNA, 22 nt, Human
caaaaguaauugcgguuuuugc

SEQ ID NO: 956816 - RNA, 22 nt, Human
accuucaaugaaaauaauaguc

SEQ ID NO: 956817 - RNA, 22 nt, Human
uaaaaguauacuuucaaaggag

SEQ ID NO: 956818 - RNA, 22 nt, Human
uggcacaugguaagacucagua

SEQ ID NO: 956819 - RNA, 20 nt, Human
uuggcagcagcucagccacc

SEQ ID NO: 956820 - RNA, 22 nt, Human
gcaccuuuggaaugaaaaguug

SEQ ID NO: 956821 - RNA, 22 nt, Human
augucacauggucaccucuagc

SEQ ID NO: 956822 - RNA, 22 nt, Human
aauauuaauagaagggguucua

SEQ ID NO: 956823 - RNA, 22 nt, Human
gcagacauuuugaaucuaggcu

SEQ ID NO: 956824 - RNA, 22 nt, Human
uaguuuaauggucaacuaauga

SEQ ID NO: 956825 - RNA, 20 nt, Human
uccuggccuucucgggcagu

SEQ ID NO: 956826 - RNA, 23 nt, Human
uccugaggguuucccagccuugg

SEQ ID NO: 956827 - RNA, 22 nt, Human
acucugcuuauugcugcaggca

SEQ ID NO: 956828 - RNA, 22 nt, Human
aacucugcagugacuuauaaag

SEQ ID NO: 956829 - RNA, 22 nt, Human
gcuccuggucuggagcuucaag

SEQ ID NO: 956830 - RNA, 22 nt, Human
uuaauguguguacaggauuuug

SEQ ID NO: 956831 - RNA, 22 nt, Human
uuucacaacguuguggugagag

SEQ ID NO: 956832 - RNA, 22 nt, Human
agaauaaacugcuuuagggcag

SEQ ID NO: 956833 - RNA, 22 nt, Human
uccuguuaguguuagacuuccc

SEQ ID NO: 956834 - RNA, 22 nt, Human
auuacaaaagaagggagaaggu

SEQ ID NO: 956835 - RNA, 22 nt, Human
caaauaguaugagcaaugauuc

SEQ ID NO: 956836 - RNA, 22 nt, Human
cagcuccugggccaucuccuag

SEQ ID NO: 956837 - RNA, 21 nt, Human
gggaaugagauucuuggagau

SEQ ID NO: 956838 - RNA, 22 nt, Human
ucugagcccucuuuugcagccc

SEQ ID NO: 956839 - RNA, 22 nt, Human
uuuuaacuuaaaauacauagau

SEQ ID NO: 956840 - RNA, 22 nt, Human
uccuggcccaaucugcccauga

SEQ ID NO: 956841 - RNA, 22 nt, Human
guauuaggugguggaauuguag

SEQ ID NO: 956842 - RNA, 22 nt, Human
agacaggcagaggcugcagagg

SEQ ID NO: 956843 - RNA, 22 nt, Human
aggcucugcagugcuggaggac

SEQ ID NO: 956844 - RNA, 22 nt, Human
uucaaaacaaucuguuugcauu

SEQ ID NO: 956845 - RNA, 21 nt, Human
acagacagggccagugucccc

SEQ ID NO: 956846 - RNA, 22 nt, Human
ccuuuucaacuaagauucugca

SEQ ID NO: 956847 - RNA, 22 nt, Human
ggccaaaccgcaauuauuuuug

SEQ ID NO: 956848 - RNA, 22 nt, Human
auuuggcacacuggguucucgu

SEQ ID NO: 956849 - RNA, 22 nt, Human
ugcaaaugaguugcagaucagg

SEQ ID NO: 956850 - RNA, 22 nt, Human
ugcaccuuguccauuuuuggcc

SEQ ID NO: 956851 - RNA, 22 nt, Human
guuaggauuauauaucccauga

SEQ ID NO: 956852 - RNA, 23 nt, Human
uuauugaggguguagauuggugu

SEQ ID NO: 956853 - RNA, 22 nt, Human
cggccaagccggggccccgaag

SEQ ID NO: 956854 - RNA, 22 nt, Human
cagccuuuuaggacuauuugug

SEQ ID NO: 956855 - RNA, 22 nt, Human
uugaaauauggauugaccuuga

SEQ ID NO: 956856 - RNA, 22 nt, Human
ugaagucuauuaacugauuucu

SEQ ID NO: 956857 - RNA, 22 nt, Human
cuuuauuagauguagacuuucu

SEQ ID NO: 956858 - RNA, 22 nt, Human
agcacauucuugccuuaaccuc

SEQ ID NO: 956859 - RNA, 19 nt, Human
ucaaaacacaaaugguuga

SEQ ID NO: 956860 - RNA, 22 nt, Human
acucugcuugggccauaucugg

SEQ ID NO: 956861 - RNA, 22 nt, Human
gucaucuuugcccugugcagga

SEQ ID NO: 956862 - RNA, 22 nt, Human
uuucacaaagcauagcacuuua

SEQ ID NO: 956863 - RNA, 22 nt, Human
ucuuguuaaagugaagauacug

SEQ ID NO: 956864 - RNA, 22 nt, Human
aacauaaauuugaaguggcaaa

SEQ ID NO: 956865 - RNA, 22 nt, Human
uauauuaacuugugauccugga

SEQ ID NO: 956866 - RNA, 22 nt, Human
cuguaaaacugcuuaaguaugc

SEQ ID NO: 956867 - RNA, 21 nt, Human
auucugaguugucagucuuca

SEQ ID NO: 956868 - RNA, 22 nt, Human
aaacccugcccuucccaagaug

SEQ ID NO: 956869 - RNA, 22 nt, Human
cuccuggcccugagcucccagg

SEQ ID NO: 956870 - RNA, 22 nt, Human
gcuccuggccagcacagggccc

SEQ ID NO: 956871 - RNA, 22 nt, Human
gacuccugccuccucuguuugc

SEQ ID NO: 956872 - RNA, 22 nt, Human
uuuuauauggcacauugguugg

SEQ ID NO: 956873 - RNA, 22 nt, Human
acgcuuuuacuauuuugagcuc

SEQ ID NO: 956874 - RNA, 22 nt, Human
uggcaaacuggaggaagcccug

SEQ ID NO: 956875 - RNA, 22 nt, Human
gagaaggaguagcugaccuggg

SEQ ID NO: 956876 - RNA, 22 nt, Human
uagaauaugugguaggaucugg

SEQ ID NO: 956877 - RNA, 22 nt, Human
auauuaggugcucaauacaugc

SEQ ID NO: 956878 - RNA, 20 nt, Human
ucuccuggugacaguaccca

SEQ ID NO: 956879 - RNA, 22 nt, Human
agcuauguuauagcauguauca

SEQ ID NO: 956880 - RNA, 22 nt, Human
aaaccaaacauuugcgguggug

SEQ ID NO: 956881 - RNA, 22 nt, Human
auggccaagaaauugccgacug

SEQ ID NO: 956882 - RNA, 22 nt, Human
cuuuuauuuugaauuaagggcu

SEQ ID NO: 956883 - RNA, 21 nt, Human
acuggccaccacuggcagggg

SEQ ID NO: 956884 - RNA, 22 nt, Human
auuaggacagagaugucaagag

SEQ ID NO: 956885 - RNA, 22 nt, Human
acauaaaguacugagagacucu

SEQ ID NO: 956886 - RNA, 22 nt, Human
ccugggcaucucaugcaccugc

SEQ ID NO: 956887 - RNA, 22 nt, Human
uuggcagcccagcuuacuagca

SEQ ID NO: 956888 - RNA, 22 nt, Human
uuaauaaaguaugaauuggaaa

SEQ ID NO: 956889 - RNA, 18 nt, Human
gaaaggagagacaguagg

SEQ ID NO: 956890 - RNA, 22 nt, Human
uuucaacaggaugauaauaggc

SEQ ID NO: 956891 - RNA, 22 nt, Human
accuuauuuugaaauagauugu

SEQ ID NO: 956892 - RNA, 22 nt, Human
gaacccaaaccuggaccucccu

SEQ ID NO: 956893 - RNA, 22 nt, Human
aaacauucucagcccugcuugc

SEQ ID NO: 956894 - RNA, 22 nt, Human
uacagccucacauuuacuuaca

SEQ ID NO: 956895 - RNA, 22 nt, Human
uccuggucuacacugcauuggg

SEQ ID NO: 956896 - RNA, 22 nt, Human
uaagucauaagucaugauguua

SEQ ID NO: 956897 - RNA, 22 nt, Human
aaauaguucagcuuguaaaccc

SEQ ID NO: 956898 - RNA, 22 nt, Human
cuauuuaugugcuauuuuguau

SEQ ID NO: 956899 - RNA, 22 nt, Human
auucacaaaugcugccccauuc

SEQ ID NO: 956900 - RNA, 22 nt, Human
aaaagagugacugauaaguaua

SEQ ID NO: 956901 - RNA, 22 nt, Human
uuucacaaaugucuuuaacuug

SEQ ID NO: 956902 - RNA, 22 nt, Human
uggcagcagacaucugaggucu

SEQ ID NO: 956903 - RNA, 21 nt, Human
auguaggguuugccuucucua

SEQ ID NO: 956904 - RNA, 22 nt, Human
ggccacaagugguccugagucc

SEQ ID NO: 956905 - RNA, 22 nt, Human
guggccaagggacucuaaggca

SEQ ID NO: 956906 - RNA, 22 nt, Human
cucccuggugacucccaaagcu

SEQ ID NO: 956907 - RNA, 22 nt, Human
gcagcauacagggagaguacuc

SEQ ID NO: 956908 - RNA, 22 nt, Human
aggauuuugacuuauucaggga

SEQ ID NO: 956909 - RNA, 22 nt, Human
uagauaaauuagaaaguuuacu

SEQ ID NO: 956910 - RNA, 22 nt, Human
cuguuuaucccuuuggucagca

SEQ ID NO: 956911 - RNA, 22 nt, Human
uagggauguaaacauaguaauu

SEQ ID NO: 956912 - RNA, 22 nt, Human
aaaaguauuuauggcuauguaa

SEQ ID NO: 956913 - RNA, 22 nt, Human
guauuaggaggaacacaggccu

SEQ ID NO: 956914 - RNA, 22 nt, Human
uaccucacugggccucaguuuu

SEQ ID NO: 956915 - RNA, 20 nt, Human
acuccugguaacuuuuguga

SEQ ID NO: 956916 - RNA, 22 nt, Human
ggaagugaggaaauauuuuguu

SEQ ID NO: 956917 - RNA, 22 nt, Human
cuauuaggcuuccauuucaugc

SEQ ID NO: 956918 - RNA, 22 nt, Human
cacccacauggaaauucacagu

SEQ ID NO: 956919 - RNA, 22 nt, Human
ucugcuguccuuuauauagauu

SEQ ID NO: 956920 - RNA, 22 nt, Human
gggaggaggaauguuuugugua

SEQ ID NO: 956921 - RNA, 22 nt, Human
aauuaaauugguuuagagagga

SEQ ID NO: 956922 - RNA, 22 nt, Human
gaguuauugaguauagaaugua

SEQ ID NO: 956923 - RNA, 22 nt, Human
cuuagaaaugcagauucucagg

SEQ ID NO: 956924 - RNA, 18 nt, Human
ucuccuggguaggggccu

SEQ ID NO: 956925 - RNA, 20 nt, Human
ucugccacuuuuucugucac

SEQ ID NO: 956926 - RNA, 22 nt, Human
gacagguggggaaacuaaggua

SEQ ID NO: 956927 - RNA, 22 nt, Human
uuaggaaucaccugcagaucuu

SEQ ID NO: 956928 - RNA, 22 nt, Human
auucaucaacugauagccauag

SEQ ID NO: 956929 - RNA, 22 nt, Human
cauaagaaauuuaacagaacuu

SEQ ID NO: 956930 - RNA, 22 nt, Human
cauucacauucuucuuacuguu

SEQ ID NO: 956931 - RNA, 22 nt, Human
uguuggcauuagaggguuauug

SEQ ID NO: 956932 - RNA, 22 nt, Human
aacaguaucuuuuaucagaaau

SEQ ID NO: 956933 - RNA, 22 nt, Human
gcuuagaaguuccuauaaaaug

SEQ ID NO: 956934 - RNA, 22 nt, Human
uauauuaaccauaggguucuag

SEQ ID NO: 956935 - RNA, 22 nt, Human
augcacuacuuggcuuuacuga

SEQ ID NO: 956936 - RNA, 22 nt, Human
guuccaguaugauuccacccau

SEQ ID NO: 956937 - RNA, 20 nt, Human
uauauaggaaauauuguguu

SEQ ID NO: 956938 - RNA, 22 nt, Human
ugucuuaauuuggaugauguuu

SEQ ID NO: 956939 - RNA, 22 nt, Human
aaguuugugucagagcuguuac

SEQ ID NO: 956940 - RNA, 22 nt, Human
uagaaacacagagagacccaug

SEQ ID NO: 956941 - RNA, 22 nt, Human
uuauuaggaaaaggucagaugu

SEQ ID NO: 956942 - RNA, 22 nt, Human
aaacucaaauuaaacuagcuua

SEQ ID NO: 956943 - RNA, 22 nt, Human
agaaguauaaagaauguuuaug

SEQ ID NO: 956944 - RNA, 22 nt, Human
cuccuggcuucugaaaucgugg

SEQ ID NO: 956945 - RNA, 22 nt, Human
ugugaaauucuugaaaugcaca

SEQ ID NO: 956946 - RNA, 22 nt, Human
uaaaacuagugguugggacuaa

SEQ ID NO: 956947 - RNA, 22 nt, Human
gacuccugggccucugagaggc

SEQ ID NO: 956948 - RNA, 22 nt, Human
uuggccaauuccagaggaucau

SEQ ID NO: 956949 - RNA, 23 nt, Human
agucuuaauacagcucuuuucua

SEQ ID NO: 956950 - RNA, 22 nt, Human
uauugaggauugaggaaagcac

SEQ ID NO: 956951 - RNA, 22 nt, Human
uccuggccucacaguccugggu

SEQ ID NO: 956952 - RNA, 22 nt, Human
guaauaaugguccccaaacacu

SEQ ID NO: 956953 - RNA, 19 nt, Human
aggucuaaucauaagacaa

SEQ ID NO: 956954 - RNA, 22 nt, Human
uagaauaugauuaauuuucuua

SEQ ID NO: 956955 - RNA, 22 nt, Human
uauucacagguucuggggauca

SEQ ID NO: 956956 - RNA, 22 nt, Human
cauauaaauacaacauguguua

SEQ ID NO: 956957 - RNA, 22 nt, Human
aaaugaguuuccucaauguccu

SEQ ID NO: 956958 - RNA, 19 nt, Human
cugggccagaaucagcuca

SEQ ID NO: 956959 - RNA, 22 nt, Human
agaaaugaagcaggaguuauua

SEQ ID NO: 956960 - RNA, 22 nt, Human
aaccuuuugcaagugccuugac

SEQ ID NO: 956961 - RNA, 22 nt, Human
cuauuagguaugcagccuauuu

SEQ ID NO: 956962 - RNA, 20 nt, Human
ccaauaaagcucuauaggga

SEQ ID NO: 956963 - RNA, 22 nt, Human
cugcuaaaccucucugagagcu

SEQ ID NO: 956964 - RNA, 22 nt, Human
cauuuaaagguuguggguaaaa

SEQ ID NO: 956965 - RNA, 22 nt, Human
uuucacaaugcaauccuacuuc

SEQ ID NO: 956966 - RNA, 22 nt, Human
acagucauuagauacaaugucu

SEQ ID NO: 956967 - RNA, 22 nt, Human
accuuuuccagcuucuagaggc

SEQ ID NO: 956968 - RNA, 22 nt, Human
uuuaucagagauauguguggac

SEQ ID NO: 956969 - RNA, 22 nt, Human
uuuaauuaggaaaugggcaggg

SEQ ID NO: 956970 - RNA, 22 nt, Human
ugcaccuucauuuuaggcagcu

SEQ ID NO: 956971 - RNA, 22 nt, Human
aaacugccuccugggcaacuaa

SEQ ID NO: 956972 - RNA, 22 nt, Human
uugcaaauauguucuccuauuc

SEQ ID NO: 956973 - RNA, 23 nt, Human
cuucuggcucuauaucagaauuc

SEQ ID NO: 956974 - RNA, 22 nt, Human
uccuggccgcuggccccugaga

SEQ ID NO: 956975 - RNA, 22 nt, Human
cucucuggaccucaacuauuuu

SEQ ID NO: 956976 - RNA, 22 nt, Human
ucacucuggaguccgcuaccag

SEQ ID NO: 956977 - RNA, 22 nt, Human
cuaagccacucaaaucuugugg

SEQ ID NO: 956978 - RNA, 22 nt, Human
gucugucucccugugacugaga

SEQ ID NO: 956979 - RNA, 22 nt, Human
gcucugcucuugacuuaccagg

SEQ ID NO: 956980 - RNA, 22 nt, Human
ucuuugcacacaucccuucccg

SEQ ID NO: 956981 - RNA, 22 nt, Human
ucugugccucaucugguucagg

SEQ ID NO: 956982 - RNA, 22 nt, Human
cugcucacgccaccguucauca

SEQ ID NO: 956983 - RNA, 22 nt, Human
aauucacagaaccauggugcuc

SEQ ID NO: 956984 - RNA, 22 nt, Human
aauuucaaguggcaucuuugau

SEQ ID NO: 956985 - RNA, 22 nt, Human
cagacaggguccuguccgucac

SEQ ID NO: 956986 - RNA, 22 nt, Human
uuuuaauacugcuauuguagga

SEQ ID NO: 956987 - RNA, 22 nt, Human
ugucaucugauauuacuuauag

SEQ ID NO: 956988 - RNA, 22 nt, Human
gaguuauuuugagcagaugguu

SEQ ID NO: 956989 - RNA, 22 nt, Human
uucagcaacucaaaccuauuag

SEQ ID NO: 956990 - RNA, 22 nt, Human
cugagccaccggcagggacauc

SEQ ID NO: 956991 - RNA, 22 nt, Human
uccaagggaaacugcacuucua

SEQ ID NO: 956992 - RNA, 21 nt, Human
cuccugggcuaagauauagug

SEQ ID NO: 956993 - RNA, 18 nt, Human
ucauuagggauugcaaag

SEQ ID NO: 956994 - RNA, 22 nt, Human
aaacaccagcacuguuuacaaa

SEQ ID NO: 956995 - RNA, 22 nt, Human
gcucugcugauccgcagccauc

SEQ ID NO: 956996 - RNA, 22 nt, Human
gucaucuucgcagagugauuuu

SEQ ID NO: 956997 - RNA, 22 nt, Human
cagccuuuuccauguauuguug

SEQ ID NO: 956998 - RNA, 22 nt, Human
aucaggauguuuggcugucaua

SEQ ID NO: 956999 - RNA, 22 nt, Human
agaaaugacacacaugagacau

SEQ ID NO: 957000 - RNA, 22 nt, Human
uaacuccaucucugugucugcu

SEQ ID NO: 957001 - RNA, 22 nt, Human
guguugacucuuggacuucaag

SEQ ID NO: 957002 - RNA, 22 nt, Human
agcuauguaacagugccaugga

SEQ ID NO: 957003 - RNA, 22 nt, Human
aaugugcaggcucaaaccuugu

SEQ ID NO: 957004 - RNA, 22 nt, Human
cauagaaaagaguagguaaugu

SEQ ID NO: 957005 - RNA, 21 nt, Human
uggccaaaaccauauuauuaa

SEQ ID NO: 957006 - RNA, 22 nt, Human
cuuuuacugugaaaagaaacug

SEQ ID NO: 957007 - RNA, 22 nt, Human
aauagaauguaaucuaauacau

SEQ ID NO: 957008 - RNA, 22 nt, Human
cauguguagugaaauaagcagu

SEQ ID NO: 957009 - RNA, 22 nt, Human
cuggcucaccuccgcuccagca

SEQ ID NO: 957010 - RNA, 22 nt, Human
uuccuggccccaccccuggaga

SEQ ID NO: 957011 - RNA, 22 nt, Human
gggaggagggugcuggcuaaac

SEQ ID NO: 957012 - RNA, 22 nt, Human
uucuuaagcaccuaaaaagugg

SEQ ID NO: 957013 - RNA, 22 nt, Human
ucacucugggccagcgcaggua

SEQ ID NO: 957014 - RNA, 22 nt, Human
auucacaauuagaaguagauaa

SEQ ID NO: 957015 - RNA, 23 nt, Human
uuucacaaugagcauuacagaau

SEQ ID NO: 957016 - RNA, 22 nt, Human
uuuuaucugugacaucuggcag

SEQ ID NO: 957017 - RNA, 19 nt, Human
cauuaggauuagagacaag

SEQ ID NO: 957018 - RNA, 22 nt, Human
cccaaacaguuccugugguacu

SEQ ID NO: 957019 - RNA, 22 nt, Human
uagaguguuguaauugaaaagg

SEQ ID NO: 957020 - RNA, 22 nt, Human
auucggaucauguguauguguu

SEQ ID NO: 957021 - RNA, 22 nt, Human
uuugcaaaaugucuuguguuag

SEQ ID NO: 957022 - RNA, 22 nt, Human
uccaagggaaugugggcaaugc

SEQ ID NO: 957023 - RNA, 21 nt, Human
ucuuggccuaaguucacugaa

SEQ ID NO: 957024 - RNA, 22 nt, Human
ccuggccaguuuccaggcccug

SEQ ID NO: 957025 - RNA, 22 nt, Human
uaauaaaugaaagugcuggcau

SEQ ID NO: 957026 - RNA, 22 nt, Human
ccuccugggagagcacggaggg

SEQ ID NO: 957027 - RNA, 22 nt, Human
agggucugcauuccaacuuggg

SEQ ID NO: 957028 - RNA, 22 nt, Human
ugcugaaacaauaacauacugg

SEQ ID NO: 957029 - RNA, 22 nt, Human
aacucugcaaccuauguagacc

SEQ ID NO: 957030 - RNA, 22 nt, Human
gcuccuggcuucacugacauca

SEQ ID NO: 957031 - RNA, 22 nt, Human
uuucuauuuuaaaggcauaugg

SEQ ID NO: 957032 - RNA, 22 nt, Human
uaccuucaccagcgaauguuug

SEQ ID NO: 957033 - RNA, 22 nt, Human
auuaaauacugcaggcuaagca

SEQ ID NO: 957034 - RNA, 22 nt, Human
cacacuuuuggcauguuugguu

SEQ ID NO: 957035 - RNA, 22 nt, Human
ucuuggccccaccugugccagc

SEQ ID NO: 957036 - RNA, 22 nt, Human
cagcugcaguucaaugcuugcu

SEQ ID NO: 957037 - RNA, 23 nt, Human
uggccacagggugcuccauugua

SEQ ID NO: 957038 - RNA, 22 nt, Human
auggccaagaucacagacuuca

SEQ ID NO: 957039 - RNA, 22 nt, Human
gagaggugaauguggaugccac

SEQ ID NO: 957040 - RNA, 22 nt, Human
gccaugaggaacuguaagacaa

SEQ ID NO: 957041 - RNA, 22 nt, Human
ccaaaaaguacauuuaggugug

SEQ ID NO: 957042 - RNA, 22 nt, Human
gaauuacaaagugagacaagcu

SEQ ID NO: 957043 - RNA, 22 nt, Human
acauccugaagucagucauuug

SEQ ID NO: 957044 - RNA, 22 nt, Human
aaagucauuguaauauaugcua

SEQ ID NO: 957045 - RNA, 22 nt, Human
ucuggccagcaugagaccuggu

SEQ ID NO: 957046 - RNA, 22 nt, Human
uggcacauagcagguacucagu

SEQ ID NO: 957047 - RNA, 22 nt, Human
uacaucuauacugaucuacauu

SEQ ID NO: 957048 - RNA, 22 nt, Human
ucauugaauauggggccauaca

SEQ ID NO: 957049 - RNA, 22 nt, Human
cacucugcaggccaaaccaaag

SEQ ID NO: 957050 - RNA, 22 nt, Human
cuggccaaugccuggggaauag

SEQ ID NO: 957051 - RNA, 22 nt, Human
uaguuuaaaaguuagggaugau

SEQ ID NO: 957052 - RNA, 22 nt, Human
acaaacagcuaacauauguuaa

SEQ ID NO: 957053 - RNA, 22 nt, Human
cagggucuuauaaggccaauuu

SEQ ID NO: 957054 - RNA, 22 nt, Human
ccuggccagaggcgugccugug

SEQ ID NO: 957055 - RNA, 22 nt, Human
uaguuaggguucugcagagaca

SEQ ID NO: 957056 - RNA, 22 nt, Human
cugccuggcuaaacucaagucg

SEQ ID NO: 957057 - RNA, 22 nt, Human
acaccuuugugaagugaugaug

SEQ ID NO: 957058 - RNA, 22 nt, Human
guggccaaaucaugucaaaggc

SEQ ID NO: 957059 - RNA, 22 nt, Human
ccuggccacccagccuuggcca

SEQ ID NO: 957060 - RNA, 22 nt, Human
aauuaggaauaaaugaguacuu

SEQ ID NO: 957061 - RNA, 19 nt, Human
uggcagcauugguaccuug

SEQ ID NO: 957062 - RNA, 22 nt, Human
ccuggccagcuaauugcccauc

SEQ ID NO: 957063 - RNA, 19 nt, Human
uccucagugacaaccucag

SEQ ID NO: 957064 - RNA, 22 nt, Human
caguuuaaaugagugacugcag

SEQ ID NO: 957065 - RNA, 22 nt, Human
uauuuaauaaaacuauggcaug

SEQ ID NO: 957066 - RNA, 22 nt, Human
ugcaccuuguugcuuuuacgaa

SEQ ID NO: 957067 - RNA, 20 nt, Human
uuggcagcuucaggguacua

SEQ ID NO: 957068 - RNA, 22 nt, Human
cucuugaagggcaucugaguua

SEQ ID NO: 957069 - RNA, 22 nt, Human
gcucugcuguguuuguucagca

SEQ ID NO: 957070 - RNA, 22 nt, Human
ccugagccucuugcacgcucag

SEQ ID NO: 957071 - RNA, 18 nt, Human
aggauauuaagaguacag

SEQ ID NO: 957072 - RNA, 20 nt, Human
aacacacugguggcaucagg

SEQ ID NO: 957073 - RNA, 22 nt, Human
aaaaugagauacaguuugaaag

SEQ ID NO: 957074 - RNA, 22 nt, Human
uucaggauucuuucagacuggg

SEQ ID NO: 957075 - RNA, 22 nt, Human
gcuccuggcucucugagggcug

SEQ ID NO: 957076 - RNA, 22 nt, Human
uugcaaauuauuuuagucccuu

SEQ ID NO: 957077 - RNA, 22 nt, Human
ucauugaauuugguucaauaug

SEQ ID NO: 957078 - RNA, 22 nt, Human
aacauuucagcaaauaagaaca

SEQ ID NO: 957079 - RNA, 20 nt, Human
uuaggcauuuggauuggcuu

SEQ ID NO: 957080 - RNA, 18 nt, Human
uuucacaaccuccagagg

SEQ ID NO: 957081 - RNA, 22 nt, Human
uccugugccuccaccugcuccg

SEQ ID NO: 957082 - RNA, 22 nt, Human
uauucacauguacauaugcuca

SEQ ID NO: 957083 - RNA, 22 nt, Human
auuaggaagaggaugucagcau

SEQ ID NO: 957084 - RNA, 22 nt, Human
ucucuggccgagagucccuggg

SEQ ID NO: 957085 - RNA, 22 nt, Human
cuuuguaucuaaauaucuugaa

SEQ ID NO: 957086 - RNA, 22 nt, Human
uaacuaacuaguguucaaaaua

SEQ ID NO: 957087 - RNA, 22 nt, Human
auguuuaaucggcugccuuucc

SEQ ID NO: 957088 - RNA, 22 nt, Human
uauauuaaacccucucuguagg

SEQ ID NO: 957089 - RNA, 22 nt, Human
uaccuauagguacaauuacaag

SEQ ID NO: 957090 - RNA, 22 nt, Human
ucaaauacauggucaaucaacu

SEQ ID NO: 957091 - RNA, 22 nt, Human
aauaagauugacacaaguaccu

SEQ ID NO: 957092 - RNA, 22 nt, Human
acauaacaaucauaggacauag

SEQ ID NO: 957093 - RNA, 22 nt, Human
ucucugcugagaagggcuggca

SEQ ID NO: 957094 - RNA, 22 nt, Human
aauguucaguagaauaggaaug

SEQ ID NO: 957095 - RNA, 22 nt, Human
uaugcacacauguaugcaugug

SEQ ID NO: 957096 - RNA, 22 nt, Human
uuggccaagggcucuuuaggcu

SEQ ID NO: 957097 - RNA, 22 nt, Human
acuccaggcaucugcuucugcu

SEQ ID NO: 957098 - RNA, 22 nt, Human
auuauuaggugcucucugacaa

SEQ ID NO: 957099 - RNA, 22 nt, Human
auauauaaccuggauaaggcuu

SEQ ID NO: 957100 - RNA, 22 nt, Human
uaugcacaacaugcagguuugu

SEQ ID NO: 957101 - RNA, 19 nt, Human
ucucacaguuuccuugccu

SEQ ID NO: 957102 - RNA, 22 nt, Human
auuagcauauuaaauagucauu

SEQ ID NO: 957103 - RNA, 22 nt, Human
uaaauacuuuuacuccacugau

SEQ ID NO: 957104 - RNA, 22 nt, Human
uuggcacagagcugcagccugg

SEQ ID NO: 957105 - RNA, 19 nt, Human
cugaggcccauguaccaug

SEQ ID NO: 957106 - RNA, 22 nt, Human
acagcauucaauaaauaauaac

SEQ ID NO: 957107 - RNA, 22 nt, Human
uuggccaaacagaguucaacag

SEQ ID NO: 957108 - RNA, 22 nt, Human
cagagcagucuggagauccagc

SEQ ID NO: 957109 - RNA, 22 nt, Human
aauagaauuuguacuguguuuu

SEQ ID NO: 957110 - RNA, 22 nt, Human
guggccaauuuccaucuguaag

SEQ ID NO: 957111 - RNA, 22 nt, Human
acaccuuugccccaagucauag

SEQ ID NO: 957112 - RNA, 22 nt, Human
augguacaaaauguauaaaguc

SEQ ID NO: 957113 - RNA, 20 nt, Human
ugaaauaaggaguuguccuu

SEQ ID NO: 957114 - RNA, 22 nt, Human
ucuccuggcucaccaggcugga

SEQ ID NO: 957115 - RNA, 22 nt, Human
aagucauuaucucuucuaaucu

SEQ ID NO: 957116 - RNA, 22 nt, Human
cacuggcccauuccugucuggc

SEQ ID NO: 957117 - RNA, 22 nt, Human
ucugagccacagauguccuguu

SEQ ID NO: 957118 - RNA, 22 nt, Human
gagccaggggucagcuccgagg

SEQ ID NO: 957119 - RNA, 22 nt, Human
guuuauuaacugucaagugauu

SEQ ID NO: 957120 - RNA, 22 nt, Human
gaguuuaaagcauacauauuuu

SEQ ID NO: 957121 - RNA, 19 nt, Human
ucauaaaaaugguaaccca

SEQ ID NO: 957122 - RNA, 22 nt, Human
aagauguaucuuuccuuuaauu

SEQ ID NO: 957123 - RNA, 20 nt, Human
aaaauauguauaacucuucu

SEQ ID NO: 957124 - RNA, 22 nt, Human
ccuggccagccagggcuggggu

SEQ ID NO: 957125 - RNA, 22 nt, Human
ucagggaaucagacucugcagc

SEQ ID NO: 957126 - RNA, 22 nt, Human
uggccacauccuuuccuuguca

SEQ ID NO: 957127 - RNA, 22 nt, Human
cacagcuaggaggaaagcagag

SEQ ID NO: 957128 - RNA, 22 nt, Human
gcucugcugucuucuugcaggc

SEQ ID NO: 957129 - RNA, 22 nt, Human
ugcauguggaccccuggugccu

SEQ ID NO: 957130 - RNA, 22 nt, Human
acauuucagcgugcaugacaug

SEQ ID NO: 957131 - RNA, 22 nt, Human
aauaggcaguuggauaugcaag

SEQ ID NO: 957132 - RNA, 22 nt, Human
aaacagucaugguugcuguuca

SEQ ID NO: 957133 - RNA, 22 nt, Human
auucacaaaaugauauagauac

SEQ ID NO: 957134 - RNA, 19 nt, Human
uuucacaaagagagcguga

SEQ ID NO: 957135 - RNA, 20 nt, Human
augcaaacccugcuuugugg

SEQ ID NO: 957136 - RNA, 20 nt, Human
auguaaaauuauaaggcuga

SEQ ID NO: 957137 - RNA, 22 nt, Human
cucucugcaaguuuugaaauag

SEQ ID NO: 957138 - RNA, 22 nt, Human
ugcucuucggggccacugcuug

SEQ ID NO: 957139 - RNA, 22 nt, Human
cuuugaauuccaguacaauaac

SEQ ID NO: 957140 - RNA, 22 nt, Human
agacaugagaaacccaccagag

SEQ ID NO: 957141 - RNA, 22 nt, Human
uggcagacacugucgaagccua

SEQ ID NO: 957142 - RNA, 22 nt, Human
uuauugagcacauaguaugugg

SEQ ID NO: 957143 - RNA, 23 nt, Human
gcuguuagauuuaauaagcauuu

SEQ ID NO: 957144 - RNA, 22 nt, Human
uauuggauagcuugugcagaau

SEQ ID NO: 957145 - RNA, 22 nt, Human
ucuccuggucaccucagaaguc

SEQ ID NO: 957146 - RNA, 22 nt, Human
aauaauguacauacauauuucg

SEQ ID NO: 957147 - RNA, 22 nt, Human
ugauaauauuuugaaucauaag

SEQ ID NO: 957148 - RNA, 22 nt, Human
uccuggccuugcgucuugggag

SEQ ID NO: 957149 - RNA, 22 nt, Human
agacagugauguaagcaggagu

SEQ ID NO: 957150 - RNA, 22 nt, Human
uagaaaugauuuugaugcuuca

SEQ ID NO: 957151 - RNA, 22 nt, Human
aacuccuguucuaugacaagag

SEQ ID NO: 957152 - RNA, 18 nt, Human
gcuccuggaccaggucac

SEQ ID NO: 957153 - RNA, 22 nt, Human
acagacauuuucuguauugccu

SEQ ID NO: 957154 - RNA, 20 nt, Human
uuggcagcaguuccaaguga

SEQ ID NO: 957155 - RNA, 22 nt, Human
uagaaacagcauauauuagccc

SEQ ID NO: 957156 - RNA, 22 nt, Human
caugucuuggcuuaggcacaga

SEQ ID NO: 957157 - RNA, 22 nt, Human
uguuuaguaggaguuuaauacu

SEQ ID NO: 957158 - RNA, 22 nt, Human
gaguuuaacacuuggagaaaag

SEQ ID NO: 957159 - RNA, 22 nt, Human
cagacaggguccuguccgucac

SEQ ID NO: 957160 - RNA, 22 nt, Human
uggcagcagacaaaaggccauu

SEQ ID NO: 957161 - RNA, 21 nt, Human
ccacucugaguguugaacaga

SEQ ID NO: 957162 - RNA, 22 nt, Human
aggccaaauugaucaucuuuag

SEQ ID NO: 957163 - RNA, 22 nt, Human
guauuaggaggaacacaggccu

SEQ ID NO: 957164 - RNA, 22 nt, Human
auuaggauuuuguccaaguagc

SEQ ID NO: 957165 - RNA, 22 nt, Human
auauaaagagcuuaguauagug

SEQ ID NO: 957166 - RNA, 22 nt, Human
augguacaaaauguauaaaguc

SEQ ID NO: 957167 - RNA, 17 nt, Human
uuaagguggaucagcac

SEQ ID NO: 957168 - RNA, 22 nt, Human
acuaaauagccucugguaguug

SEQ ID NO: 957169 - RNA, 22 nt, Human
aauguucaguagaauaggaaug

SEQ ID NO: 957170 - RNA, 22 nt, Human
uugaaaugcagauuccaaucca

SEQ ID NO: 957171 - RNA, 22 nt, Human
uauucacaaaaugagguccuca

SEQ ID NO: 957172 - RNA, 22 nt, Human
ggccaaauuuggccaugagcau

SEQ ID NO: 957173 - RNA, 22 nt, Human
ccuguuuaucuaucuagagaug

SEQ ID NO: 957174 - RNA, 22 nt, Human
uguuuauuuucaggauggauug

SEQ ID NO: 957175 - RNA, 22 nt, Human
uaacccaaaggcaaugucucga

SEQ ID NO: 957176 - RNA, 22 nt, Human
cuggcucaccuccgcuccagca

SEQ ID NO: 957177 - RNA, 22 nt, Human
gcccucugcacagcucugagca

SEQ ID NO: 957178 - RNA, 22 nt, Human
aaccaaauggaugguaagaggg

SEQ ID NO: 957179 - RNA, 22 nt, Human
aaacugcugguugcuggccagc

SEQ ID NO: 957180 - RNA, 22 nt, Human
auguuuaaaggagucagagacu

SEQ ID NO: 957181 - RNA, 22 nt, Human
uuggccaagauacgagcacaua

SEQ ID NO: 957182 - RNA, 22 nt, Human
gagacagugguugcagaagcuc

SEQ ID NO: 957183 - RNA, 22 nt, Human
uuuuaucugcuucauuaguuga

SEQ ID NO: 957184 - RNA, 22 nt, Human
uaaaagacauauaacuguagga

SEQ ID NO: 957185 - RNA, 18 nt, Human
uccuggccacacuaccuu

SEQ ID NO: 957186 - RNA, 23 nt, Human
uggcuaaaggcucuaguccugcu

SEQ ID NO: 957187 - RNA, 22 nt, Human
ucucuggccgagagucccuggg

SEQ ID NO: 957188 - RNA, 22 nt, Human
aacaaguaaguuuauauauauu

SEQ ID NO: 957189 - RNA, 20 nt, Human
aaaaacaguaaugcugaaga

SEQ ID NO: 957190 - RNA, 22 nt, Human
uggagggaacaaaggaguccca

SEQ ID NO: 957191 - RNA, 22 nt, Human
aaaugugcuucuuacucucaau

SEQ ID NO: 957192 - RNA, 22 nt, Human
cuauuuaugugcuauuuuguau

SEQ ID NO: 957193 - RNA, 22 nt, Human
cagccuuuaagcuuggauaggu

SEQ ID NO: 957194 - RNA, 22 nt, Human
uuaaaaugcagauucugauuca

SEQ ID NO: 957195 - RNA, 22 nt, Human
ugaaggugucuuugugaacauc

SEQ ID NO: 957196 - RNA, 22 nt, Human
ggccaaaugaaaucugagcaau

SEQ ID NO: 957197 - RNA, 22 nt, Human
ucaaauaaugccauucaucauc

SEQ ID NO: 957198 - RNA, 22 nt, Human
uaaaguguccuagcuaggaggc

SEQ ID NO: 957199 - RNA, 22 nt, Human
guauguauguauauguuuaaga

SEQ ID NO: 957200 - RNA, 22 nt, Human
cagcuuuguccugcaaaccuga

SEQ ID NO: 957201 - RNA, 22 nt, Human
gcucugcucccucaaaugacau

SEQ ID NO: 957202 - RNA, 22 nt, Human
agaggaaguaaucaggaccugc

SEQ ID NO: 957203 - RNA, 22 nt, Human
cuggccaacuugcuuguuggca

SEQ ID NO: 957204 - RNA, 22 nt, Human
ugaggccagcuucagcagugga

SEQ ID NO: 957205 - RNA, 22 nt, Human
gauguuucaugcuagcaugugu

SEQ ID NO: 957206 - RNA, 22 nt, Human
cugagggucaacuugauuguau

SEQ ID NO: 957207 - RNA, 22 nt, Human
auuagcauauuaaauagucauu

SEQ ID NO: 957208 - RNA, 22 nt, Human
guaaauaacugguaauuggggu

SEQ ID NO: 957209 - RNA, 22 nt, Human
acucuggcccuccugcugccag

SEQ ID NO: 957210 - RNA, 22 nt, Human
uuuauaaguacuuugucugcuu

SEQ ID NO: 957211 - RNA, 18 nt, Human
auggucucauacugggag

SEQ ID NO: 957212 - RNA, 22 nt, Human
uuucuauucuggaucuguggca

SEQ ID NO: 957213 - RNA, 22 nt, Human
cagucauuggcuaaagcucccu

SEQ ID NO: 957214 - RNA, 23 nt, Human
acucagcuuugggagaugacuca

SEQ ID NO: 957215 - RNA, 23 nt, Human
auagucauguaaaauauuugaag

SEQ ID NO: 957216 - RNA, 22 nt, Human
guacauuucauuuaaaugaugu

SEQ ID NO: 957217 - RNA, 22 nt, Human
uccuggccucgcuguccaccuu

SEQ ID NO: 957218 - RNA, 22 nt, Human
ucucugcucugugccucaguuu

SEQ ID NO: 957219 - RNA, 22 nt, Human
gagaggugaauguggaugccac

SEQ ID NO: 957220 - RNA, 22 nt, Human
ugacauaaaucuaaaggaaagg

SEQ ID NO: 957221 - RNA, 22 nt, Human
uuauuaggaacucaggauuuuu

SEQ ID NO: 957222 - RNA, 22 nt, Human
agaauaaauguuggacuuagga

SEQ ID NO: 957223 - RNA, 22 nt, Human
ucuuuuauccuacauuuagcuc

SEQ ID NO: 957224 - RNA, 21 nt, Human
ugacauaauccauaguacaaa

SEQ ID NO: 957225 - RNA, 19 nt, Human
ucuaagccucaauguuuuc

SEQ ID NO: 957226 - RNA, 22 nt, Human
guggccaaaucaugucaaaggc

SEQ ID NO: 957227 - RNA, 22 nt, Human
ccuuuuaugaacuugagcaggu

SEQ ID NO: 957228 - RNA, 22 nt, Human
uuucacaauuuuaaggagcaaa

SEQ ID NO: 957229 - RNA, 22 nt, Human
agggaaugcuccguauaaaucu

SEQ ID NO: 957230 - RNA, 22 nt, Human
caccucuuugauuugaggcaag

SEQ ID NO: 957231 - RNA, 22 nt, Human
acauuaaugaggugaugacaca

SEQ ID NO: 957232 - RNA, 22 nt, Human
cugcuaaaccucucugagagcu

SEQ ID NO: 957233 - RNA, 22 nt, Human
ccuggccagcuaauugcccauc

SEQ ID NO: 957234 - RNA, 22 nt, Human
cagcaggguagguuguaucagu

SEQ ID NO: 957235 - RNA, 22 nt, Human
cauaagaaauuuaacagaacuu

SEQ ID NO: 957236 - RNA, 22 nt, Human
uuggccaauggugauucccggc

SEQ ID NO: 957237 - RNA, 22 nt, Human
ucugaagccaccucugcuuguc

SEQ ID NO: 957238 - RNA, 22 nt, Human
uaucuuugaugccagauguuac

SEQ ID NO: 957239 - RNA, 22 nt, Human
cuccuggaggauagugacuggg

SEQ ID NO: 957240 - RNA, 22 nt, Human
auggccaagaaguauuccugac

SEQ ID NO: 957241 - RNA, 22 nt, Human
uauuagguaugaacuggcaacc

SEQ ID NO: 957242 - RNA, 22 nt, Human
gaguuauugaguauagaaugua

SEQ ID NO: 957243 - RNA, 22 nt, Human
uaugcacaauaugaucuauuug

SEQ ID NO: 957244 - RNA, 22 nt, Human
agcuauguuauagcauguauca

SEQ ID NO: 957245 - RNA, 22 nt, Human
ugaaugugaugcuaaacauaug

SEQ ID NO: 957246 - RNA, 22 nt, Human
ucuccuggucaccucagaaguc

SEQ ID NO: 957247 - RNA, 22 nt, Human
ggucugaguggugcugacucag

SEQ ID NO: 957248 - RNA, 22 nt, Human
uugagggaacaugagaaucauc

SEQ ID NO: 957249 - RNA, 22 nt, Human
uuauuagagauauuugguuagg

SEQ ID NO: 957250 - RNA, 20 nt, Human
ggccgaaauaauaguggcuu

SEQ ID NO: 957251 - RNA, 22 nt, Human
ucuggccaguagauguggguug

SEQ ID NO: 957252 - RNA, 21 nt, Human
acugccugucuccauagucua

SEQ ID NO: 957253 - RNA, 22 nt, Human
acuggccaggagcuggaaauac

SEQ ID NO: 957254 - RNA, 22 nt, Human
cccauggcuuaggagggagugu

SEQ ID NO: 957255 - RNA, 22 nt, Human
ggaagugaggaaauauuuuguu

SEQ ID NO: 957256 - RNA, 22 nt, Human
ccacucugauuucaagggagau

SEQ ID NO: 957257 - RNA, 22 nt, Human
acacauuuaaaaaggaacauau

SEQ ID NO: 957258 - RNA, 22 nt, Human
uggaagagguggaaguggcuuc

SEQ ID NO: 957259 - RNA, 22 nt, Human
gaguuauuagucaaauagggaa

SEQ ID NO: 957260 - RNA, 22 nt, Human
aagucauugguagcuugauagg

SEQ ID NO: 957261 - RNA, 22 nt, Human
guuccaaacaagucauaaagua

SEQ ID NO: 957262 - RNA, 22 nt, Human
cuuuuuaucucuuaaugauguu

SEQ ID NO: 957263 - RNA, 22 nt, Human
aaagguaacaguuauaaccagg

SEQ ID NO: 957264 - RNA, 22 nt, Human
uggucaaaaacucucaguggac

SEQ ID NO: 957265 - RNA, 22 nt, Human
aggcucugugcagccugcaucu

SEQ ID NO: 957266 - RNA, 22 nt, Human
acuccuggaaaagaacgcaggg

SEQ ID NO: 957267 - RNA, 22 nt, Human
guacacucccccugugaaguug

SEQ ID NO: 957268 - RNA, 22 nt, Human
cuacucugaauugaagugauau

SEQ ID NO: 957269 - RNA, 22 nt, Human
uuucaacauauaccauaaugcc

SEQ ID NO: 957270 - RNA, 22 nt, Human
gagccaagaucgcaccacugca

SEQ ID NO: 957271 - RNA, 22 nt, Human
aaauaggagcuuaagcacuucu

SEQ ID NO: 957272 - RNA, 22 nt, Human
aacugcauuuaacaaauacucu

SEQ ID NO: 957273 - RNA, 22 nt, Human
uauauuaacuugugauccugga

SEQ ID NO: 957274 - RNA, 22 nt, Human
ucagggaaugaugcacacaguu

SEQ ID NO: 957275 - RNA, 22 nt, Human
gacucugcuacaggccgagguu

SEQ ID NO: 957276 - RNA, 22 nt, Human
acucugcuugggccauaucugg

SEQ ID NO: 957277 - RNA, 22 nt, Human
uccuggcccaaucugcccauga

SEQ ID NO: 957278 - RNA, 22 nt, Human
uccaagggcaugcugaaauaag

SEQ ID NO: 957279 - RNA, 22 nt, Human
cuggcgcaacagaaaaucugga

SEQ ID NO: 957280 - RNA, 22 nt, Human
uggucaaaaaggccuagacaca

SEQ ID NO: 957281 - RNA, 22 nt, Human
cagcuccugggccaucuccuag

SEQ ID NO: 957282 - RNA, 22 nt, Human
cucugcugggauguaaagucuu

SEQ ID NO: 957283 - RNA, 22 nt, Human
aaugaaauguagcuuauccaua

SEQ ID NO: 957284 - RNA, 22 nt, Human
augcugagcagagcugacaugc

SEQ ID NO: 957285 - RNA, 22 nt, Human
auaaugugauauuucauuuaca

SEQ ID NO: 957286 - RNA, 22 nt, Human
ucacucugcaggaaggagcagc

SEQ ID NO: 957287 - RNA, 19 nt, Human
acuuccugcccgcuccuuu

SEQ ID NO: 957288 - RNA, 22 nt, Human
cuaauguggacucuaucaaagu

SEQ ID NO: 957289 - RNA, 22 nt, Human
cuucacaacgacaucugguuag

SEQ ID NO: 957290 - RNA, 22 nt, Human
ugaagucuauuaacugauuucu

SEQ ID NO: 957291 - RNA, 22 nt, Human
auguuuuauauuuugcagcagu

SEQ ID NO: 957292 - RNA, 22 nt, Human
cuauuagguaugcagccuauuu

SEQ ID NO: 957293 - RNA, 22 nt, Human
ucacucugagaggucacuggaa

SEQ ID NO: 957294 - RNA, 19 nt, Human
gcuccugggccucacucau

SEQ ID NO: 957295 - RNA, 22 nt, Human
gggucugaggaguaccauuguc

SEQ ID NO: 957296 - RNA, 22 nt, Human
aaaagucugcucucauuucaga

SEQ ID NO: 957297 - RNA, 22 nt, Human
uuggccaacagcgacagggcca

SEQ ID NO: 957298 - RNA, 23 nt, Human
cagaaaguuugagaagauacauc

SEQ ID NO: 957299 - RNA, 22 nt, Human
acuaaauaguuuugacagaaca

SEQ ID NO: 957300 - RNA, 22 nt, Human
aaacaaguuuagaauaaugaau

SEQ ID NO: 957301 - RNA, 22 nt, Human
uggcagacacugucgaagccua

SEQ ID NO: 957302 - RNA, 22 nt, Human
caaaaguaauugugguuuucac

SEQ ID NO: 957303 - RNA, 22 nt, Human
cugugccaguguauuccuguga

SEQ ID NO: 957304 - RNA, 22 nt, Human
gcaccuuucuauauucaguggc

SEQ ID NO: 957305 - RNA, 22 nt, Human
accuguuuggaggagguguuag

SEQ ID NO: 957306 - RNA, 22 nt, Human
uuugauaacagugaauaucaug

SEQ ID NO: 957307 - RNA, 22 nt, Human
gacucugcuaggaaaaucucag

SEQ ID NO: 957308 - RNA, 22 nt, Human
agucuuaacuaugcaaguacua

SEQ ID NO: 957309 - RNA, 22 nt, Human
uuuuaguuguaguuggugagga

SEQ ID NO: 957310 - RNA, 22 nt, Human
cacuaaguaagcuccucuacaa

SEQ ID NO: 957311 - RNA, 22 nt, Human
auuaggauuugguauggucaua

SEQ ID NO: 957312 - RNA, 21 nt, Human
acagacagggccagugucccc

SEQ ID NO: 957313 - RNA, 22 nt, Human
acacagaguauuuagaaggggu

SEQ ID NO: 957314 - RNA, 22 nt, Human
aaccuucacuugcuucauuuga

SEQ ID NO: 957315 - RNA, 22 nt, Human
uggcagcagacaucugaggucu

SEQ ID NO: 957316 - RNA, 22 nt, Human
uagaauauacacuacagcuuaa

SEQ ID NO: 957317 - RNA, 22 nt, Human
uccuggccaggaugaccuaaca

SEQ ID NO: 957318 - RNA, 22 nt, Human
uauuauuauaguuauugggaag

SEQ ID NO: 957319 - RNA, 22 nt, Human
uauuuaauuugcucauugugau

SEQ ID NO: 957320 - RNA, 23 nt, Human
guuguaauggauaaugcaaauug

SEQ ID NO: 957321 - RNA, 22 nt, Human
gucugucucccugugacugaga

SEQ ID NO: 957322 - RNA, 18 nt, Human
aacuucaacuacaaugga

SEQ ID NO: 957323 - RNA, 22 nt, Human
uauguagguaaacacagacaua

SEQ ID NO: 957324 - RNA, 18 nt, Human
uagaauauaggucauucu

SEQ ID NO: 957325 - RNA, 22 nt, Human
gcuggccauagaagccaaagag

SEQ ID NO: 957326 - RNA, 23 nt, Human
aacugagauaauguauguaaagc

SEQ ID NO: 957327 - RNA, 22 nt, Human
gacucugcugacuaguugacua

SEQ ID NO: 957328 - RNA, 22 nt, Human
ucugaaaucuguaagcacuagc

SEQ ID NO: 957329 - RNA, 22 nt, Human
ucuaagccuaggaaaugaguuu

SEQ ID NO: 957330 - RNA, 16 nt, Human
auucacaaggcaucgg

SEQ ID NO: 957331 - RNA, 22 nt, Human
ccaaaaagcucagagauauguu

SEQ ID NO: 957332 - RNA, 22 nt, Human
uuuucauuguuacuaugagcua

SEQ ID NO: 957333 - RNA, 22 nt, Human
agacauaagugcuaugacauug

SEQ ID NO: 957334 - RNA, 22 nt, Human
aauucacaugcaugucugugca

SEQ ID NO: 957335 - RNA, 22 nt, Human
ucuccugggugcuuuaucagaa

SEQ ID NO: 957336 - RNA, 21 nt, Human
uucugagcacucaucacuguc

SEQ ID NO: 957337 - RNA, 22 nt, Human
aaaguuugcaauuuauguuaau

SEQ ID NO: 957338 - RNA, 22 nt, Human
cagcuccugaggacugcuggga

SEQ ID NO: 957339 - RNA, 22 nt, Human
uggcagcauuaauuauucaggu

SEQ ID NO: 957340 - RNA, 22 nt, Human
cuguuacacggaccuucaaauc

SEQ ID NO: 957341 - RNA, 22 nt, Human
gcuggccauauauuuugcuguu

SEQ ID NO: 957342 - RNA, 22 nt, Human
uccuggucuacacugcauuggg

SEQ ID NO: 957343 - RNA, 22 nt, Human
acuccugggugcugaccagcgu

SEQ ID NO: 957344 - RNA, 22 nt, Human
auucacaaaaugauauagauac

SEQ ID NO: 957345 - RNA, 22 nt, Human
uagcacaggucuuguugccauu

SEQ ID NO: 957346 - RNA, 20 nt, Human
uauuaggaaggaggaaggaa

SEQ ID NO: 957347 - RNA, 22 nt, Human
uuggccaauuccagaggaucau

SEQ ID NO: 957348 - RNA, 20 nt, Human
uauauaggaaauauuguguu

SEQ ID NO: 957349 - RNA, 22 nt, Human
uuugauucuguaaaauaacagg

SEQ ID NO: 957350 - RNA, 22 nt, Human
uacucugcaaguugaagguggc

SEQ ID NO: 957351 - RNA, 22 nt, Human
aaagucauuggaauauuaauga

SEQ ID NO: 957352 - RNA, 22 nt, Human
guauuagggccaaaggcaggaa

SEQ ID NO: 957353 - RNA, 22 nt, Human
ucugagccaaaauaaacagcau

SEQ ID NO: 957354 - RNA, 22 nt, Human
guauuagguuggugcaaaagua

SEQ ID NO: 957355 - RNA, 22 nt, Human
gaagccuugaacugcaaacccc

SEQ ID NO: 957356 - RNA, 22 nt, Human
acacucuguaaugucacacucc

SEQ ID NO: 957357 - RNA, 22 nt, Human
aacucugcuuauaguuugucca

SEQ ID NO: 957358 - RNA, 22 nt, Human
aaacuacuaugggaauguacuu

SEQ ID NO: 957359 - RNA, 22 nt, Human
gcucugcuuucuggggggaucc

SEQ ID NO: 957360 - RNA, 22 nt, Human
ucacucugaaugguacugagga

SEQ ID NO: 957361 - RNA, 22 nt, Human
ucuccuggauggaccuucucuu

SEQ ID NO: 957362 - RNA, 22 nt, Human
cuggccuaaaauugcuucugca

SEQ ID NO: 957363 - RNA, 21 nt, Human
gggucugaauaucuggugcug

SEQ ID NO: 957364 - RNA, 22 nt, Human
ucugacauuuugagaaugacau

SEQ ID NO: 957365 - RNA, 22 nt, Human
cugagccaugagccugcgccca

SEQ ID NO: 957366 - RNA, 22 nt, Human
aagauauuuuagaacauucacu

SEQ ID NO: 957367 - RNA, 22 nt, Human
uuggccaacauggugaaacccc

SEQ ID NO: 957368 - RNA, 22 nt, Human
ucaaauacauggucaaucaacu

SEQ ID NO: 957369 - RNA, 22 nt, Human
cuccugggaauuuaguugugag

SEQ ID NO: 957370 - RNA, 22 nt, Human
uugagggucuggaucugcugcu

SEQ ID NO: 957371 - RNA, 22 nt, Human
acacuugauaggucaaaucagu

SEQ ID NO: 957372 - RNA, 22 nt, Human
cauagaaaagaguagguaaugu

SEQ ID NO: 957373 - RNA, 22 nt, Human
aaaugauggaaaugaggcugaa

SEQ ID NO: 957374 - RNA, 22 nt, Human
aaaagcuagucaaugauguauu

SEQ ID NO: 957375 - RNA, 22 nt, Human
auagaauagcauagaaaauuga

SEQ ID NO: 957376 - RNA, 22 nt, Human
aacauuucuucugaaacugagu

SEQ ID NO: 957377 - RNA, 21 nt, Human
ugaaacacucuuuccaugaga

SEQ ID NO: 957378 - RNA, 22 nt, Human
acuucuggauagagucagcuuu

SEQ ID NO: 957379 - RNA, 22 nt, Human
uguguauagcaguuuccagucu

SEQ ID NO: 957380 - RNA, 22 nt, Human
cauguguagugaaauaagcagu

SEQ ID NO: 957381 - RNA, 22 nt, Human
uuggcacagagcugcagccugg

SEQ ID NO: 957382 - RNA, 22 nt, Human
aauaauguugacgauagucuua

SEQ ID NO: 957383 - RNA, 22 nt, Human
aacuccagggcauugucuccug

SEQ ID NO: 957384 - RNA, 21 nt, Human
acuggccaccacuggcagggg

SEQ ID NO: 957385 - RNA, 22 nt, Human
agaaaugaagcaggaguuauua

SEQ ID NO: 957386 - RNA, 18 nt, Human
uuucacaaccuccagagg

SEQ ID NO: 957387 - RNA, 22 nt, Human
cuccuggcucugccacuuacua

SEQ ID NO: 957388 - RNA, 22 nt, Human
aagucauuaucucuucuaaucu

SEQ ID NO: 957389 - RNA, 22 nt, Human
caaaaguaauggcgguuuuuac

SEQ ID NO: 957390 - RNA, 22 nt, Human
uuuuaguuguacugucaacagu

SEQ ID NO: 957391 - RNA, 22 nt, Human
ccuggccagccagggcuggggu

SEQ ID NO: 957392 - RNA, 22 nt, Human
uuauuagguuuacauaaagguu

SEQ ID NO: 957393 - RNA, 22 nt, Human
acacauuauagagaguauaaua

SEQ ID NO: 957394 - RNA, 22 nt, Human
gucaucuuaucauuguugcugu

SEQ ID NO: 957395 - RNA, 22 nt, Human
uuuuuauaugaaggauagugcg

SEQ ID NO: 957396 - RNA, 22 nt, Human
auucacaauagcagcuugcaug

SEQ ID NO: 957397 - RNA, 21 nt, Human
auuuggauauugcuggcaaau

SEQ ID NO: 957398 - RNA, 20 nt, Human
guauuagguguuccucuuuc

SEQ ID NO: 957399 - RNA, 20 nt, Human
ccaauaaagcucuauaggga

SEQ ID NO: 957400 - RNA, 22 nt, Human
gcuccuggcucuggccaaggga

SEQ ID NO: 957401 - RNA, 22 nt, Human
aaagacauugaagaaggacuua

SEQ ID NO: 957402 - RNA, 22 nt, Human
augcccaaugucacaauuuuug

SEQ ID NO: 957403 - RNA, 22 nt, Human
acuccuggggauccauuccuuu

SEQ ID NO: 957404 - RNA, 22 nt, Human
aauaauaagauacuaagggagu

SEQ ID NO: 957405 - RNA, 22 nt, Human
gauauagguucauaguguuaca

SEQ ID NO: 957406 - RNA, 19 nt, Human
ucucugcuucucuuggcau

SEQ ID NO: 957407 - RNA, 22 nt, Human
ucucugcuaagauugugucuag

SEQ ID NO: 957408 - RNA, 23 nt, Human
ucaaacauauugugagacacagg

SEQ ID NO: 957409 - RNA, 22 nt, Human
gcucugcugaagccccuugcau

SEQ ID NO: 957410 - RNA, 22 nt, Human
ucuccuggcucaccaggcugga

SEQ ID NO: 957411 - RNA, 22 nt, Human
ucacucuguuagaggaaagugc

SEQ ID NO: 957412 - RNA, 22 nt, Human
ugucaucucacugauauagaug

SEQ ID NO: 957413 - RNA, 22 nt, Human
aggauguuaucugugcaggugg

SEQ ID NO: 957414 - RNA, 22 nt, Human
agaauaaacugcuuuagggcag

SEQ ID NO: 957415 - RNA, 22 nt, Human
ggcagacaccuuuaugucuaau

SEQ ID NO: 957416 - RNA, 22 nt, Human
auggccaaagccacagcagagg

SEQ ID NO: 957417 - RNA, 22 nt, Human
ccuggccagggucugggcugcu

SEQ ID NO: 957418 - RNA, 22 nt, Human
cuuaggaugaguuuuugcguuu

SEQ ID NO: 957419 - RNA, 22 nt, Human
uuucacaaucaaauggugaaau

SEQ ID NO: 957420 - RNA, 21 nt, Human
gcuccuggugcugcguggcgc

SEQ ID NO: 957421 - RNA, 22 nt, Human
cauguuaaugaauuuuugcagu

SEQ ID NO: 957422 - RNA, 22 nt, Human
aggccaaauagcagguuugcua

SEQ ID NO: 957423 - RNA, 23 nt, Human
uccaagggcuacaaacacagacc

SEQ ID NO: 957424 - RNA, 19 nt, Human
uccaccuuucuucauuugg

SEQ ID NO: 957425 - RNA, 22 nt, Human
ucacucugauagauaagcuaac

SEQ ID NO: 957426 - RNA, 22 nt, Human
agaauaaaucaaauguccugag

SEQ ID NO: 957427 - RNA, 22 nt, Human
augugaggaagaaagagguaag

SEQ ID NO: 957428 - RNA, 22 nt, Human
aaauaguucagcuuguaaaccc

SEQ ID NO: 957429 - RNA, 22 nt, Human
cagccuuuuccauguauuguug

SEQ ID NO: 957430 - RNA, 22 nt, Human
cugagccauccauaccagcuua

SEQ ID NO: 957431 - RNA, 22 nt, Human
uuucaacaggaugauaauaggc

SEQ ID NO: 957432 - RNA, 22 nt, Human
uuguauucauugcuuacccaau

SEQ ID NO: 957433 - RNA, 22 nt, Human
ccuggccaguuuccaggcccug

SEQ ID NO: 957434 - RNA, 22 nt, Human
auaaaaccaaagcagcaguguu

SEQ ID NO: 957435 - RNA, 22 nt, Human
aucaggaucagggcuagcagag

SEQ ID NO: 957436 - RNA, 19 nt, Human
uggaagaggaagggaaaua

SEQ ID NO: 957437 - RNA, 22 nt, Human
aaucaguauugguauagaauga

SEQ ID NO: 957438 - RNA, 22 nt, Human
augauguuauuuucagaaacau

SEQ ID NO: 957439 - RNA, 22 nt, Human
uugaggaguguuuagggugagg

SEQ ID NO: 957440 - RNA, 22 nt, Human
cuucuuaucaaguggcaaaucu

SEQ ID NO: 957441 - RNA, 22 nt, Human
cugaaaugacgguuuggggcaa

SEQ ID NO: 957442 - RNA, 22 nt, Human
uaauaggagccaggucacauag

SEQ ID NO: 957443 - RNA, 22 nt, Human
uacaucuagccuuacaauuauu

SEQ ID NO: 957444 - RNA, 22 nt, Human
acagaccucuagauuacauuug

SEQ ID NO: 957445 - RNA, 22 nt, Human
acugccugcucauaacauugcu

SEQ ID NO: 957446 - RNA, 22 nt, Human
gcuuccuaaaugcacagggcag

SEQ ID NO: 957447 - RNA, 22 nt, Human
cugcacaguuugauuucuugcu

SEQ ID NO: 957448 - RNA, 20 nt, Human
ccuuuauuauuuguaugaug

SEQ ID NO: 957449 - RNA, 22 nt, Human
aaauacaguguguguucuuuga

SEQ ID NO: 957450 - RNA, 22 nt, Human
uaagaacaguagaacaguaggu

SEQ ID NO: 957451 - RNA, 22 nt, Human
auuaaggaauguaggcaagaag

SEQ ID NO: 957452 - RNA, 22 nt, Human
auagugcaguggacugaguuaa

SEQ ID NO: 957453 - RNA, 22 nt, Human
aaacacauuuuaggaaaaucua

SEQ ID NO: 957454 - RNA, 22 nt, Human
acucugcucuguauuucacugu

SEQ ID NO: 957455 - RNA, 22 nt, Human
cauccugguuaccccauaguca

SEQ ID NO: 957456 - RNA, 22 nt, Human
aggccaaaccggauggaaaagg

SEQ ID NO: 957457 - RNA, 22 nt, Human
uggcagcaauuagcuagagcug

SEQ ID NO: 957458 - RNA, 22 nt, Human
uaccuuuugcuuauuaugacac

SEQ ID NO: 957459 - RNA, 22 nt, Human
acucugcuugcccaauggaaac

SEQ ID NO: 957460 - RNA, 22 nt, Human
aacaaaccuucccuauacgucu

SEQ ID NO: 957461 - RNA, 18 nt, Human
gcuccugguuggaaagaa

SEQ ID NO: 957462 - RNA, 22 nt, Human
cuccuuggccguuaaugucaca

SEQ ID NO: 957463 - RNA, 22 nt, Human
auucggaucauguguauguguu

SEQ ID NO: 957464 - RNA, 22 nt, Human
caaaaguaaucguggcuuuugc

SEQ ID NO: 957465 - RNA, 22 nt, Human
aauuaaauugguuuagagagga

SEQ ID NO: 957466 - RNA, 22 nt, Human
ucaaugaaagagcaugcauuuu

SEQ ID NO: 957467 - RNA, 23 nt, Human
uggccacagggugcuccauugua

SEQ ID NO: 957468 - RNA, 22 nt, Human
gcuccuggagagauugagaaag

SEQ ID NO: 957469 - RNA, 22 nt, Human
cuaggccacuugcucucaugga

SEQ ID NO: 957470 - RNA, 22 nt, Human
acucuuuuauaaagcaucuuga

SEQ ID NO: 957471 - RNA, 22 nt, Human
uuuacugugcauuagaaucacc

SEQ ID NO: 957472 - RNA, 22 nt, Human
guuaggauuauauaucccauga

SEQ ID NO: 957473 - RNA, 22 nt, Human
uugcuucauuuuaaauaaagac

SEQ ID NO: 957474 - RNA, 22 nt, Human
cauuuuauccucugggaagcua

SEQ ID NO: 957475 - RNA, 20 nt, Human
ucacagaaacaaauagagaa

SEQ ID NO: 957476 - RNA, 22 nt, Human
aauucacagaaccauggugcuc

SEQ ID NO: 957477 - RNA, 22 nt, Human
ggucagccuuggauuugguagc

SEQ ID NO: 957478 - RNA, 22 nt, Human
aaauuauuuucagaauggagaa

SEQ ID NO: 957479 - RNA, 22 nt, Human
uacucugccacuaggaguucug

SEQ ID NO: 957480 - RNA, 22 nt, Human
uccaagggcaacaauggaacac

SEQ ID NO: 957481 - RNA, 22 nt, Human
guuauuaguaagacucgcacau

SEQ ID NO: 957482 - RNA, 22 nt, Human
gcacagcucgagcucaggaggg

SEQ ID NO: 957483 - RNA, 22 nt, Human
acaguguuuuaugagaauuguu

SEQ ID NO: 957484 - RNA, 22 nt, Human
gcucugcucuaacauuccugac

SEQ ID NO: 957485 - RNA, 22 nt, Human
caaaaagcuuagguaacaagcc

SEQ ID NO: 957486 - RNA, 22 nt, Human
gcucugcuguguuuguucagca

SEQ ID NO: 957487 - RNA, 22 nt, Human
cuggccaauccauuaauuuguu

SEQ ID NO: 957488 - RNA, 22 nt, Human
auauuaauuauuuacacaugag

SEQ ID NO: 957489 - RNA, 22 nt, Human
ucuuguuaaagugaagauacug

SEQ ID NO: 957490 - RNA, 22 nt, Human
ucugugccucaucugguucagg

SEQ ID NO: 957491 - RNA, 22 nt, Human
acaaaaagcuccauuacugucc

SEQ ID NO: 957492 - RNA, 22 nt, Human
uuggccaaauacacaccuuuug

SEQ ID NO: 957493 - RNA, 22 nt, Human
aucugaagcuaucugcacuuca

SEQ ID NO: 957494 - RNA, 22 nt, Human
ugcaccuuguugcuuuuacgaa

SEQ ID NO: 957495 - RNA, 22 nt, Human
acuccuggguugcaguccucaa

SEQ ID NO: 957496 - RNA, 22 nt, Human
cucuuuaaaguaaaauuugucu

SEQ ID NO: 957497 - RNA, 22 nt, Human
uagggauggaaacuaggaaucu

SEQ ID NO: 957498 - RNA, 22 nt, Human
acucugcuaucuuagcaaaagg

SEQ ID NO: 957499 - RNA, 22 nt, Human
uccaagggcucauggacacuuu

SEQ ID NO: 957500 - RNA, 19 nt, Human
uuggcagcugagauccugc

SEQ ID NO: 957501 - RNA, 22 nt, Human
aauaugucugcuaauuguuucu

SEQ ID NO: 957502 - RNA, 22 nt, Human
agacaggcagaggcugcagagg

SEQ ID NO: 957503 - RNA, 22 nt, Human
aggcucugcagugcuggaggac

SEQ ID NO: 957504 - RNA, 22 nt, Human
auagaauaaggcacagauucuu

SEQ ID NO: 957505 - RNA, 17 nt, Human
auguuaauuucacauuu

SEQ ID NO: 957506 - RNA, 22 nt, Human
aacugcuggggaggccaaacuc

SEQ ID NO: 957507 - RNA, 22 nt, Human
aaucauaauucaaauaagcuua

SEQ ID NO: 957508 - RNA, 22 nt, Human
cacagcuaggaggaaagcagag

SEQ ID NO: 957509 - RNA, 22 nt, Human
agagggcugcugcacagugcuc

SEQ ID NO: 957510 - RNA, 22 nt, Human
uggccauagcucagcuccuuca

SEQ ID NO: 957511 - RNA, 22 nt, Human
ucagcaggcaggaggcaugcca

SEQ ID NO: 957512 - RNA, 22 nt, Human
gcagacauuuugaaucuaggcu

SEQ ID NO: 957513 - RNA, 22 nt, Human
uucaaacaguguagaauauaug

SEQ ID NO: 957514 - RNA, 22 nt, Human
uagcuuuguguaugaugucugu

SEQ ID NO: 957515 - RNA, 23 nt, Human
cuucuggcucuauaucagaauuc

SEQ ID NO: 957516 - RNA, 22 nt, Human
ucucugcugagaagggcuggca

SEQ ID NO: 957517 - RNA, 22 nt, Human
aucuacaggauaguuuaauauu

SEQ ID NO: 957518 - RNA, 22 nt, Human
ucugagccuauuucaaauuccu

SEQ ID NO: 957519 - RNA, 22 nt, Human
uagaauaugugguguauacuuu

SEQ ID NO: 957520 - RNA, 22 nt, Human
uuucuggcagcgggacaggggu

SEQ ID NO: 957521 - RNA, 22 nt, Human
uucagcaagaauuuacugagcu

SEQ ID NO: 957522 - RNA, 22 nt, Human
ccaaaaaguacauuuaggugug

SEQ ID NO: 957523 - RNA, 22 nt, Human
uuaaaagaauccuguuauccuc

SEQ ID NO: 957524 - RNA, 22 nt, Human
auauuaaugagcaaguaaguga

SEQ ID NO: 957525 - RNA, 22 nt, Human
uuggccaagggcucuuuaggcu

SEQ ID NO: 957526 - RNA, 22 nt, Human
ccuggccaggcuccaaguacug

SEQ ID NO: 957527 - RNA, 22 nt, Human
agacagguaaauagagaugcug

SEQ ID NO: 957528 - RNA, 22 nt, Human
aaaccaaacauuugcgguggug

SEQ ID NO: 957529 - RNA, 22 nt, Human
acaggccugagauuuugcauuu

SEQ ID NO: 957530 - RNA, 22 nt, Human
gaguuuaaauaacacauuucca

SEQ ID NO: 957531 - RNA, 22 nt, Human
gcuggccauggggagugaggag

SEQ ID NO: 957532 - RNA, 22 nt, Human
aaaguuugagugauuugacaca

SEQ ID NO: 957533 - RNA, 22 nt, Human
uuauguagugacugacuguuag

SEQ ID NO: 957534 - RNA, 22 nt, Human
auucacaaguugauggauauuu

SEQ ID NO: 957535 - RNA, 22 nt, Human
agccuugaacacugacugaagg

SEQ ID NO: 957536 - RNA, 17 nt, Human
uuccacaauaguuuguc

SEQ ID NO: 957537 - RNA, 22 nt, Human
aaccuuuugcaagugccuugac

SEQ ID NO: 957538 - RNA, 22 nt, Human
auuuggcacacuggguucucgu

SEQ ID NO: 957539 - RNA, 22 nt, Human
ccuccuggugggcgcuucuggc

SEQ ID NO: 957540 - RNA, 22 nt, Human
aucuuucaaucaggaaaaaucu

SEQ ID NO: 957541 - RNA, 18 nt, Human
acuaugcugaauaaaugg

SEQ ID NO: 957542 - RNA, 22 nt, Human
uuccuugaaugagucauggaaa

SEQ ID NO: 957543 - RNA, 20 nt, Human
ucacucugaugcuagggugg

SEQ ID NO: 957544 - RNA, 22 nt, Human
ccuaggcccauuaauuccccuu

SEQ ID NO: 957545 - RNA, 22 nt, Human
agcauaaguugguacagccacu

SEQ ID NO: 957546 - RNA, 22 nt, Human
accuguuuguguccauuaguga

SEQ ID NO: 957547 - RNA, 22 nt, Human
guggccaauaggagcagcuauc

SEQ ID NO: 957548 - RNA, 22 nt, Human
aagaauaaauuaagauacuuag

SEQ ID NO: 957549 - RNA, 22 nt, Human
uuuuaacuuaaaauacauagau

SEQ ID NO: 957550 - RNA, 22 nt, Human
cucuggccuggggccugcuccc

SEQ ID NO: 957551 - RNA, 22 nt, Human
ugcugagaaucacagguuauaa

SEQ ID NO: 957552 - RNA, 22 nt, Human
acucugcugauagguccucaga

SEQ ID NO: 957553 - RNA, 21 nt, Human
uguaaguuucaucugaauugg

SEQ ID NO: 957554 - RNA, 17 nt, Human
ucuccuggcucuaucag

SEQ ID NO: 957555 - RNA, 22 nt, Human
auucuuuuuuaaggaauagaac

SEQ ID NO: 957556 - RNA, 20 nt, Human
uccuggccucccuggggcuc

SEQ ID NO: 957557 - RNA, 22 nt, Human
uuuaguagaugcagcauuauuu

SEQ ID NO: 957558 - RNA, 22 nt, Human
guucacaaaguacuguaugcau

SEQ ID NO: 957559 - RNA, 22 nt, Human
gacagguggggaaacuaaggua

SEQ ID NO: 957560 - RNA, 22 nt, Human
uuuauauuucccaggauuggcc

SEQ ID NO: 957561 - RNA, 22 nt, Human
uucugagcuacauaguacuggg

SEQ ID NO: 957562 - RNA, 22 nt, Human
aauaagaauuuacuugucaaga

SEQ ID NO: 957563 - RNA, 22 nt, Human
ccuccugggacaggcuggcaca

SEQ ID NO: 957564 - RNA, 22 nt, Human
auaaauaucacuguugucccuc

SEQ ID NO: 957565 - RNA, 22 nt, Human
uugcaaaugggcaaagcagauc

SEQ ID NO: 957566 - RNA, 22 nt, Human
acacuuuuagcuaugaguuaau

SEQ ID NO: 957567 - RNA, 21 nt, Human
uccuggccagggcacuaggca

SEQ ID NO: 957568 - RNA, 22 nt, Human
guggccaagggacucuaaggca

SEQ ID NO: 957569 - RNA, 22 nt, Human
cugggccaguuaugucucaucu

SEQ ID NO: 957570 - RNA, 22 nt, Human
cuccuggcuucugaaaucgugg

SEQ ID NO: 957571 - RNA, 22 nt, Human
auguuuuacccuuugcacaaac

SEQ ID NO: 957572 - RNA, 22 nt, Human
aaagcacauuacaagcucaguc

SEQ ID NO: 957573 - RNA, 22 nt, Human
aacagacauauuuuuaauaugc

SEQ ID NO: 957574 - RNA, 22 nt, Human
ucugcaggaggcuggcugcagg

SEQ ID NO: 957575 - RNA, 22 nt, Human
uucaaaacagcuagauauugga

SEQ ID NO: 957576 - RNA, 22 nt, Human
cauuuaaagguuguggguaaaa

SEQ ID NO: 957577 - RNA, 22 nt, Human
ucuccuggaagaauaccacacu

SEQ ID NO: 957578 - RNA, 22 nt, Human
cauucacauucuucuuacuguu

SEQ ID NO: 957579 - RNA, 22 nt, Human
uguuuauuacaguucuuggaau

SEQ ID NO: 957580 - RNA, 22 nt, Human
ucugccacuagugguuaccuua

SEQ ID NO: 957581 - RNA, 22 nt, Human
caaguaaagaaucacauuucuu

SEQ ID NO: 957582 - RNA, 22 nt, Human
cugcauucauaucagauagaag

SEQ ID NO: 957583 - RNA, 22 nt, Human
aucaggauccaccuugagccug

SEQ ID NO: 957584 - RNA, 22 nt, Human
aguugcagacgcagagauguug

SEQ ID NO: 957585 - RNA, 22 nt, Human
auucugaguccaugggggcagg

SEQ ID NO: 957586 - RNA, 22 nt, Human
uuguuauaaagacuaaauaugu

SEQ ID NO: 957587 - RNA, 20 nt, Human
augcaaacccugcuuugugg

SEQ ID NO: 957588 - RNA, 22 nt, Human
auucacaauuagaaguagauaa

SEQ ID NO: 957589 - RNA, 22 nt, Human
ucuggccacccgaggccccugc

SEQ ID NO: 957590 - RNA, 19 nt, Human
uggucuaaaugugugcccc

SEQ ID NO: 957591 - RNA, 22 nt, Human
uucagauaaacuacaaauaauu

SEQ ID NO: 957592 - RNA, 22 nt, Human
aaaacagacagccaguguagag

SEQ ID NO: 957593 - RNA, 22 nt, Human
aggucacccguuugacuaucca

SEQ ID NO: 957594 - RNA, 22 nt, Human
agcuauguaacagugccaugga

SEQ ID NO: 957595 - RNA, 22 nt, Human
cacuaugcuuacaugcuuauau

SEQ ID NO: 957596 - RNA, 22 nt, Human
ucuuguuaucaggaaaacagua

SEQ ID NO: 957597 - RNA, 22 nt, Human
uucuuagaugauuaaugauggg

SEQ ID NO: 957598 - RNA, 22 nt, Human
cauagaaacugagacaaggauu

SEQ ID NO: 957599 - RNA, 22 nt, Human
uuuaauuaggaaaugggcaggg

SEQ ID NO: 957600 - RNA, 22 nt, Human
augucacauggucaccucuagc

SEQ ID NO: 957601 - RNA, 22 nt, Human
uucuuauucuugaaauguggga

SEQ ID NO: 957602 - RNA, 22 nt, Human
aaugugcaggcucaaaccuugu

SEQ ID NO: 957603 - RNA, 22 nt, Human
aaauuagucauguuguauuacu

SEQ ID NO: 957604 - RNA, 22 nt, Human
uggcgcaacucauucauggugu

SEQ ID NO: 957605 - RNA, 22 nt, Human
guuauuagaagugaaggauugu

SEQ ID NO: 957606 - RNA, 22 nt, Human
uuaaaagagcagcccagcauau

SEQ ID NO: 957607 - RNA, 22 nt, Human
cuccuggcccugagcucccagg

SEQ ID NO: 957608 - RNA, 22 nt, Human
gauuaggagggagaggcaagua

SEQ ID NO: 957609 - RNA, 22 nt, Human
aucaggauggguuuggcuuagg

SEQ ID NO: 957610 - RNA, 22 nt, Human
gucaucuugcuguuuuagaucu

SEQ ID NO: 957611 - RNA, 22 nt, Human
uucugagguccaugcaguacug

SEQ ID NO: 957612 - RNA, 22 nt, Human
cagccuuugggucagaagauuc

SEQ ID NO: 957613 - RNA, 22 nt, Human
aaaaaguauuggccaugguuga

SEQ ID NO: 957614 - RNA, 22 nt, Human
uucaaucauuuuuacauagucc

SEQ ID NO: 957615 - RNA, 18 nt, Human
aggccaaacuuguaagca

SEQ ID NO: 957616 - RNA, 22 nt, Human
ucugagcccucuuuugcagccc

SEQ ID NO: 957617 - RNA, 22 nt, Human
ccuggccagcgccggcugcucg

SEQ ID NO: 957618 - RNA, 22 nt, Human
cuugaucuacauagugaaaccc

SEQ ID NO: 957619 - RNA, 22 nt, Human
acucugcucuuauaguguuaua

SEQ ID NO: 957620 - RNA, 23 nt, Human
cuccuggaggguccggcccugcc

SEQ ID NO: 957621 - RNA, 22 nt, Human
uucuuaagcaccuaaaaagugg

SEQ ID NO: 957622 - RNA, 22 nt, Human
uuggcagcagggaguuggccgc

SEQ ID NO: 957623 - RNA, 19 nt, Human
ucaaaacacaaaugguuga

SEQ ID NO: 957624 - RNA, 22 nt, Human
acagcauucaauaaauaauaac

SEQ ID NO: 957625 - RNA, 22 nt, Human
gggcauguagugugcauagaga

SEQ ID NO: 957626 - RNA, 22 nt, Human
accuuuuauguaaauauauguu

SEQ ID NO: 957627 - RNA, 22 nt, Human
cuggccaagcuucucuaagcag

SEQ ID NO: 957628 - RNA, 22 nt, Human
uuggccaaggucacugggugag

SEQ ID NO: 957629 - RNA, 22 nt, Human
auaauaaaccaggaugggucug

SEQ ID NO: 957630 - RNA, 21 nt, Human
ugcuggaaaaagugguucuag

SEQ ID NO: 957631 - RNA, 22 nt, Human
uaacccaauaauugguggccuu

SEQ ID NO: 957632 - RNA, 22 nt, Human
aggaagaauguuuacauaucaa

SEQ ID NO: 957633 - RNA, 20 nt, Human
ucucugcuguccacauuugc

SEQ ID NO: 957634 - RNA, 22 nt, Human
guugaaauuugugauaauuuag

SEQ ID NO: 957635 - RNA, 22 nt, Human
ucauugaauauggggccauaca

SEQ ID NO: 957636 - RNA, 22 nt, Human
caaauauuccagguacaucccu

SEQ ID NO: 957637 - RNA, 22 nt, Human
ucugcuguugccaugaguaaua

SEQ ID NO: 957638 - RNA, 22 nt, Human
gcuccuggcuccaggcagccaa

SEQ ID NO: 957639 - RNA, 22 nt, Human
aauaauuagugggacagagaac

SEQ ID NO: 957640 - RNA, 19 nt, Human
auaaauaaaaagugggaga

SEQ ID NO: 957641 - RNA, 22 nt, Human
ucacucugccuccauauuacua

SEQ ID NO: 957642 - RNA, 22 nt, Human
accuuuuuguucuguucucagc

SEQ ID NO: 957643 - RNA, 22 nt, Human
ucuggccacuugcuucacacug

SEQ ID NO: 957644 - RNA, 22 nt, Human
uuaggaaucaccugcagaucuu

SEQ ID NO: 957645 - RNA, 22 nt, Human
gaaaugugggucaugacccauu

SEQ ID NO: 957646 - RNA, 22 nt, Human
acuaugcucauuguuaauauuu

SEQ ID NO: 957647 - RNA, 19 nt, Human
uuucuuaggccuuuggccu

SEQ ID NO: 957648 - RNA, 22 nt, Human
uuauuuggaaauauggcuucug

SEQ ID NO: 957649 - RNA, 22 nt, Human
aaaacuccugaaauuguuuccc

SEQ ID NO: 957650 - RNA, 22 nt, Human
cuccugggcucaagugauccuc

SEQ ID NO: 957651 - RNA, 22 nt, Human
aauaugaauuauuguuacaagu

SEQ ID NO: 957652 - RNA, 22 nt, Human
aauguacacugaaagccuauca

SEQ ID NO: 957653 - RNA, 22 nt, Human
ccuccuggauggauuuggugga

SEQ ID NO: 957654 - RNA, 22 nt, Human
guucacaaauaugcacuuacga

SEQ ID NO: 957655 - RNA, 22 nt, Human
gucuagagugcuuccuagucau

SEQ ID NO: 957656 - RNA, 22 nt, Human
uuuauuguuguuagucauaagu

SEQ ID NO: 957657 - RNA, 22 nt, Human
cugaaaugguugccuggagaau

SEQ ID NO: 957658 - RNA, 22 nt, Human
uugccacugaaccagucuugca

SEQ ID NO: 957659 - RNA, 22 nt, Human
ugagccaaugauuugaauagag

SEQ ID NO: 957660 - RNA, 22 nt, Human
uuucacaaguuucaggauucug

SEQ ID NO: 957661 - RNA, 22 nt, Human
aucauaaaccacuuuguaaucu

SEQ ID NO: 957662 - RNA, 22 nt, Human
gagggaaggacccauuuuaagu

SEQ ID NO: 957663 - RNA, 22 nt, Human
auuaggcagggcaugguggcuc

SEQ ID NO: 957664 - RNA, 19 nt, Human
caugcugaccugcuguggu

SEQ ID NO: 957665 - RNA, 22 nt, Human
accuuuuccagcuucuagaggc

SEQ ID NO: 957666 - RNA, 22 nt, Human
cucugcuuuuuaaaaggagucc

SEQ ID NO: 957667 - RNA, 22 nt, Human
cacacuuuuggcauguuugguu

SEQ ID NO: 957668 - RNA, 22 nt, Human
gcuccuggcuucacugacauca

SEQ ID NO: 957669 - RNA, 22 nt, Human
ugcaugcugcacacaugcguag

SEQ ID NO: 957670 - RNA, 22 nt, Human
uggcagcacaagguggcccaug

SEQ ID NO: 957671 - RNA, 19 nt, Human
cauuaggauuagagacaag

SEQ ID NO: 957672 - RNA, 22 nt, Human
uaacugauauugaaaaacauca

SEQ ID NO: 957673 - RNA, 22 nt, Human
aauguggaaucauggacuuuau

SEQ ID NO: 957674 - RNA, 22 nt, Human
aacucugcaaccuauguagacc

SEQ ID NO: 957675 - RNA, 22 nt, Human
aucaggauguuuggcugucaua

SEQ ID NO: 957676 - RNA, 22 nt, Human
acuccuggguucuaaauuugaa

SEQ ID NO: 957677 - RNA, 22 nt, Human
aggccaaauguguauaaaacau

SEQ ID NO: 957678 - RNA, 16 nt, Human
ucucugcuucauaggu

SEQ ID NO: 957679 - RNA, 22 nt, Human
aauucacaauguguagucaugc

SEQ ID NO: 957680 - RNA, 22 nt, Human
guuuauuaacugucaagugauu

SEQ ID NO: 957681 - RNA, 22 nt, Human
cugggcaauaugcugggccugg

SEQ ID NO: 957682 - RNA, 22 nt, Human
cuauuagguaugugguugcuau

SEQ ID NO: 957683 - RNA, 22 nt, Human
ccacucugcugugcuccaugau

SEQ ID NO: 957684 - RNA, 22 nt, Human
uaaagacaugguguaggugaac

SEQ ID NO: 957685 - RNA, 19 nt, Human
agcagcuggagguggagug

SEQ ID NO: 957686 - RNA, 22 nt, Human
auuaggaaauguguugcaagca

SEQ ID NO: 957687 - RNA, 22 nt, Human
uuuuaauacugcuauuguagga

SEQ ID NO: 957688 - RNA, 22 nt, Human
uacaaagagguaauugcauaua

SEQ ID NO: 957689 - RNA, 22 nt, Human
uugcaaauuccaauccaauauu

SEQ ID NO: 957690 - RNA, 22 nt, Human
ucuccuggcauuugguugagua

SEQ ID NO: 957691 - RNA, 22 nt, Human
uggccaagaaugauaugugaag

SEQ ID NO: 957692 - RNA, 20 nt, Human
aggauuugagaaggcgucuu

SEQ ID NO: 957693 - RNA, 21 nt, Human
uggaccaaaguaauuugccuu

SEQ ID NO: 957694 - RNA, 22 nt, Human
guuuuauuuccaugagagaccg

SEQ ID NO: 957695 - RNA, 19 nt, Human
cauuccuuugucugccaaa

SEQ ID NO: 957696 - RNA, 22 nt, Human
caauaagccagguguuuguguu

SEQ ID NO: 957697 - RNA, 21 nt, Human
gacucugcaccaaauuaagcc

SEQ ID NO: 957698 - RNA, 22 nt, Human
uaaaacugaauacauacugagg

SEQ ID NO: 957699 - RNA, 21 nt, Human
ucacauuucucauggguaaau

SEQ ID NO: 957700 - RNA, 22 nt, Human
auuagagaaauguugccaagau

SEQ ID NO: 957701 - RNA, 22 nt, Human
uucaccuugaauaugucuuaaa

SEQ ID NO: 957702 - RNA, 22 nt, Human
acaaaguaggucaucaaagcuc

SEQ ID NO: 957703 - RNA, 22 nt, Human
aggagacauaacuaugaugaga

SEQ ID NO: 957704 - RNA, 22 nt, Human
aauaguaaaagauacagcuaau

SEQ ID NO: 957705 - RNA, 22 nt, Human
ccuuuuauaaaguuguauugaa

SEQ ID NO: 957706 - RNA, 22 nt, Human
cagccuuugugaacaucaggug

SEQ ID NO: 957707 - RNA, 22 nt, Human
uggcagcacuugaacuugagcc

SEQ ID NO: 957708 - RNA, 22 nt, Human
agagugauccuaauugauuugg

SEQ ID NO: 957709 - RNA, 22 nt, Human
guuuauuauacaacaaaagcua

SEQ ID NO: 957710 - RNA, 22 nt, Human
acauuuaaauaccuauguuucu

SEQ ID NO: 957711 - RNA, 22 nt, Human
uaaagaacacagggaauagcac

SEQ ID NO: 957712 - RNA, 22 nt, Human
ggauuuggaagaccgggucaca

SEQ ID NO: 957713 - RNA, 22 nt, Human
guucacaagaugugguggggag

SEQ ID NO: 957714 - RNA, 22 nt, Human
cguggccagccauuuccuggaa

SEQ ID NO: 957715 - RNA, 22 nt, Human
augcacuacuagaugcaaaagu

SEQ ID NO: 957716 - RNA, 19 nt, Human
acauuuaaauucagaucuc

SEQ ID NO: 957717 - RNA, 22 nt, Human
ccugugccagcugggcccugcc

SEQ ID NO: 957718 - RNA, 22 nt, Human
gcucugcugauccgcagccauc

SEQ ID NO: 957719 - RNA, 18 nt, Human
ucauuagggauugcaaag

SEQ ID NO: 957720 - RNA, 22 nt, Human
aagcaugugcuggggcuuuuug

SEQ ID NO: 957721 - RNA, 22 nt, Human
cucaugucuucacccauucuaa

SEQ ID NO: 957722 - RNA, 22 nt, Human
auagauguucaaucagauauuu

SEQ ID NO: 957723 - RNA, 22 nt, Human
auucacaacaaaaggauaugag

SEQ ID NO: 957724 - RNA, 22 nt, Human
aaauauaauuucugccucaaua

SEQ ID NO: 957725 - RNA, 22 nt, Human
uaaaagacccucuagaguccca

SEQ ID NO: 957726 - RNA, 22 nt, Human
aaacagucaugguugcuguuca

SEQ ID NO: 957727 - RNA, 22 nt, Human
cuccuggcacugucuugaccca

SEQ ID NO: 957728 - RNA, 22 nt, Human
ucugcuguccuuuauauagauu

SEQ ID NO: 957729 - RNA, 22 nt, Human
auuaggaaacugaaugucagaa

SEQ ID NO: 957730 - RNA, 22 nt, Human
ccuuuuauacucagugauauca

SEQ ID NO: 957731 - RNA, 22 nt, Human
uacucugcucauuggagugugu

SEQ ID NO: 957732 - RNA, 22 nt, Human
ugacauaaaccagugagcaaaa

SEQ ID NO: 957733 - RNA, 22 nt, Human
agcuuguagaaggccacgagca

SEQ ID NO: 957734 - RNA, 22 nt, Human
augaggauuaacuguugucaua

SEQ ID NO: 957735 - RNA, 21 nt, Human
uggcagacuagaguauagaug

SEQ ID NO: 957736 - RNA, 22 nt, Human
uuggcagcauccaagucucggg

SEQ ID NO: 957737 - RNA, 22 nt, Human
uuuauuaauguagcauccaugg

SEQ ID NO: 957738 - RNA, 22 nt, Human
agacucugcuaagaauauaauu

SEQ ID NO: 957739 - RNA, 22 nt, Human
cagggucugaaacugaucacag

SEQ ID NO: 957740 - RNA, 19 nt, Human
uccucagugacaaccucag

SEQ ID NO: 957741 - RNA, 22 nt, Human
uaggauaugugaaaucauauua

SEQ ID NO: 957742 - RNA, 22 nt, Human
ucuccuggcucuaaaaggcugu

SEQ ID NO: 957743 - RNA, 22 nt, Human
ccuuuucaacuaagauucugca

SEQ ID NO: 957744 - RNA, 22 nt, Human
cagagacauuaagugccaugau

SEQ ID NO: 957745 - RNA, 22 nt, Human
cacucugagccaaaacuaauuc

SEQ ID NO: 957746 - RNA, 22 nt, Human
gaggaaagcugguuuaaaguau

SEQ ID NO: 957747 - RNA, 22 nt, Human
acagggaacaggaauauacaaa

SEQ ID NO: 957748 - RNA, 21 nt, Human
ugcauuccuccauccaacagg

SEQ ID NO: 957749 - RNA, 22 nt, Human
uuuacuguuuacagcuaaugca

SEQ ID NO: 957750 - RNA, 22 nt, Human
uuuauguaguuacggacuauca

SEQ ID NO: 957751 - RNA, 22 nt, Human
acucugcuuauugcugcaggca

SEQ ID NO: 957752 - RNA, 22 nt, Human
uagaacaugugaaaauauagcc

SEQ ID NO: 957753 - RNA, 22 nt, Human
ucacuaagugccgaguuuaguu

SEQ ID NO: 957754 - RNA, 22 nt, Human
guuaggauguggggacuuuggg

SEQ ID NO: 957755 - RNA, 22 nt, Human
aagucuguagaaaaacaguuua

SEQ ID NO: 957756 - RNA, 22 nt, Human
cuucacaaauggccuagaguuc

SEQ ID NO: 957757 - RNA, 22 nt, Human
caucuuuaacaauuuacaaugu

SEQ ID NO: 957758 - RNA, 22 nt, Human
agcuccugcucuuugucccuaa

SEQ ID NO: 957759 - RNA, 22 nt, Human
caucuuuuggccuauucugagg

SEQ ID NO: 957760 - RNA, 22 nt, Human
gcuggccaguguggugaccacc

SEQ ID NO: 957761 - RNA, 22 nt, Human
uuaggcauauggcacaugauag

SEQ ID NO: 957762 - RNA, 20 nt, Human
guguuucaugugauacaaug

SEQ ID NO: 957763 - RNA, 22 nt, Human
acuccaggcaucugcuucugcu

SEQ ID NO: 957764 - RNA, 22 nt, Human
uaaagcacgucuauuuaaugau

SEQ ID NO: 957765 - RNA, 22 nt, Human
uccuggccuagcucacccugga

SEQ ID NO: 957766 - RNA, 22 nt, Human
gacuccugccuccucuguuugc

SEQ ID NO: 957767 - RNA, 22 nt, Human
guuuauuauucaacuucauguu

SEQ ID NO: 957768 - RNA, 22 nt, Human
uggcacaugguaagugcuuaac

SEQ ID NO: 957769 - RNA, 22 nt, Human
uuggccaaggaaguagcaacgg

SEQ ID NO: 957770 - RNA, 22 nt, Human
ccuccuggcuuuucccauugaa

SEQ ID NO: 957771 - RNA, 22 nt, Human
auggccaaauaacagcuugcau

SEQ ID NO: 957772 - RNA, 22 nt, Human
uugcaaauauguucuccuauuc

SEQ ID NO: 957773 - RNA, 22 nt, Human
aggauuuguuuauaggucuuaa

SEQ ID NO: 957774 - RNA, 22 nt, Human
uccuugacugugaggaacuagc

SEQ ID NO: 957775 - RNA, 22 nt, Human
ucuguaaaacuucuuuguaaau

SEQ ID NO: 957776 - RNA, 22 nt, Human
acauacaucaaguaucacaaga

SEQ ID NO: 957777 - RNA, 22 nt, Human
cagacaggcaggugcugcuuug

SEQ ID NO: 957778 - RNA, 22 nt, Human
agccuugaguucaagugcuggc

SEQ ID NO: 957779 - RNA, 22 nt, Human
cauauuaaggucuguaaggggu

SEQ ID NO: 957780 - RNA, 22 nt, Human
cuuuuauuuugaauuaagggcu

SEQ ID NO: 957781 - RNA, 22 nt, Human
augaaauaucuugaagaaauuc

SEQ ID NO: 957782 - RNA, 22 nt, Human
cagaggaguucaguacacagcc

SEQ ID NO: 957783 - RNA, 22 nt, Human
aaaauauuuuagggccaggaga

SEQ ID NO: 957784 - RNA, 20 nt, Human
aggccaaacccagcgcgccc

SEQ ID NO: 957785 - RNA, 22 nt, Human
aagucauucuauuucucuaugu

SEQ ID NO: 957786 - RNA, 22 nt, Human
gaaucauagaacauuaauagaa

SEQ ID NO: 957787 - RNA, 22 nt, Human
guauuaggagguggagccuuug

SEQ ID NO: 957788 - RNA, 22 nt, Human
acaccuuugccccaagucauag

SEQ ID NO: 957789 - RNA, 22 nt, Human
uuccuggcugaacugaacuccu

SEQ ID NO: 957790 - RNA, 22 nt, Human
uuaaaugaacgagauaugcaac

SEQ ID NO: 957791 - RNA, 22 nt, Human
gaacccaaccucacuuggggua

SEQ ID NO: 957792 - RNA, 19 nt, Human
uccugggcugcgucuugcc

SEQ ID NO: 957793 - RNA, 22 nt, Human
ugaaacacuuucaauuacauau

SEQ ID NO: 957794 - RNA, 22 nt, Human
uggcacauagaaaaggaucaau

SEQ ID NO: 957795 - RNA, 22 nt, Human
augauguugauaaauuacuuua

SEQ ID NO: 957796 - RNA, 22 nt, Human
guggccaaggcagagaaagagc

SEQ ID NO: 957797 - RNA, 22 nt, Human
aauaaaaugaacugguagaguu

SEQ ID NO: 957798 - RNA, 20 nt, Human
aaaauauguauaacucuucu

SEQ ID NO: 957799 - RNA, 22 nt, Human
agcacauucuugccuuaaccuc

SEQ ID NO: 957800 - RNA, 22 nt, Human
uaaccaaagggccuaaggaaug

SEQ ID NO: 957801 - RNA, 22 nt, Human
ucuggccaggauggcaagacca

SEQ ID NO: 957802 - RNA, 22 nt, Human
auguggcacagcacaguaagag

SEQ ID NO: 957803 - RNA, 22 nt, Human
caacuccuccccagcaugccaa

SEQ ID NO: 957804 - RNA, 22 nt, Human
uuggccaagugguuaaucucca

SEQ ID NO: 957805 - RNA, 22 nt, Human
uggcaacaugucgaagugcugu

SEQ ID NO: 957806 - RNA, 22 nt, Human
uucaugcuuuuaccgcuguuaa

SEQ ID NO: 957807 - RNA, 22 nt, Human
uacagccucacauuuacuuaca

SEQ ID NO: 957808 - RNA, 21 nt, Human
uuuuauugaugaauggccacu

SEQ ID NO: 957809 - RNA, 19 nt, Human
uuucacaaagagagcguga

SEQ ID NO: 957810 - RNA, 22 nt, Human
uauucacauguacauaugcuca

SEQ ID NO: 957811 - RNA, 22 nt, Human
acuuccugcaaucguccacucc

SEQ ID NO: 957812 - RNA, 21 nt, Human
cggccaaauuccuccuaggga

SEQ ID NO: 957813 - RNA, 22 nt, Human
uugaaaaguuuugaaacacucu

SEQ ID NO: 957814 - RNA, 22 nt, Human
cuggccaauauagggaaaucuu

SEQ ID NO: 957815 - RNA, 22 nt, Human
ugacauaaguugguagaaagga

SEQ ID NO: 957816 - RNA, 22 nt, Human
uagaaacaucagcuaaccaaaa

SEQ ID NO: 957817 - RNA, 22 nt, Human
uucaacuagauuuauacaauuc

SEQ ID NO: 957818 - RNA, 22 nt, Human
uuggccaagggaucgagguugg

SEQ ID NO: 957819 - RNA, 22 nt, Human
cucuugaaaauuggaacacaga

SEQ ID NO: 957820 - RNA, 22 nt, Human
acagcaugucuaguuaaauacu

SEQ ID NO: 957821 - RNA, 22 nt, Human
auauuagguuggugcaaaagua

SEQ ID NO: 957822 - RNA, 22 nt, Human
uuucaacagcucucaaaugauc

SEQ ID NO: 957823 - RNA, 22 nt, Human
ucacucugacuuggccuccaac

SEQ ID NO: 957824 - RNA, 22 nt, Human
cuucacaaucaccuuuucggaa

SEQ ID NO: 957825 - RNA, 22 nt, Human
acucugacuggagugagagagg

SEQ ID NO: 957826 - RNA, 18 nt, Human
uacaucuauauaguguuu

SEQ ID NO: 957827 - RNA, 22 nt, Human
augugcaacuucagcagaaagg

SEQ ID NO: 957828 - RNA, 22 nt, Human
cuuugaauuccaguacaauaac

SEQ ID NO: 957829 - RNA, 22 nt, Human
ugcugaaauuagaacauugagg

SEQ ID NO: 957830 - RNA, 22 nt, Human
guucacaaaauucuggccagug

SEQ ID NO: 957831 - RNA, 22 nt, Human
uuaauuuuuauguauagugugu

SEQ ID NO: 957832 - RNA, 22 nt, Human
aaagcuauuuuauugcagcucu

SEQ ID NO: 957833 - RNA, 20 nt, Human
ucuccuggugacaguaccca

SEQ ID NO: 957834 - RNA, 22 nt, Human
aguauacauauauuagccuucg

SEQ ID NO: 957835 - RNA, 20 nt, Human
cacguuuuuccacuagcaaa

SEQ ID NO: 957836 - RNA, 21 nt, Human
ucacucugauuaggugucucu

SEQ ID NO: 957837 - RNA, 22 nt, Human
ucuggccagcaugagaccuggu

SEQ ID NO: 957838 - RNA, 22 nt, Human
acauaacaaucauaggacauag

SEQ ID NO: 957839 - RNA, 22 nt, Human
ucaauaaaauuguuuuccuauc

SEQ ID NO: 957840 - RNA, 22 nt, Human
gacaucaauauucugcagggau

SEQ ID NO: 957841 - RNA, 23 nt, Human
gcuguuagauuuaauaagcauuu

SEQ ID NO: 957842 - RNA, 22 nt, Human
uauccaaaguuucucagaaacu

SEQ ID NO: 957843 - RNA, 22 nt, Human
cucuugaagggcaucugaguua

SEQ ID NO: 957844 - RNA, 17 nt, Human
uagaauauggugggcug

SEQ ID NO: 957845 - RNA, 22 nt, Human
auggccaagaucacagacuuca

SEQ ID NO: 957846 - RNA, 22 nt, Human
ugaccaaaaaauucccugugag

SEQ ID NO: 957847 - RNA, 21 nt, Human
agacaguaacucuucuacucc

SEQ ID NO: 957848 - RNA, 22 nt, Human
ccuccuggaggcucuagggaaa

SEQ ID NO: 957849 - RNA, 22 nt, Human
uaaaaugacuuccuccaacauc

SEQ ID NO: 957850 - RNA, 22 nt, Human
uccugggcuuuguuucucuccu

SEQ ID NO: 957851 - RNA, 22 nt, Human
gaauuacaaagugagacaagcu

SEQ ID NO: 957852 - RNA, 22 nt, Human
uuauuuaaaauguagguuggga

SEQ ID NO: 957853 - RNA, 22 nt, Human
agucugcuuccuggagaacuca

SEQ ID NO: 957854 - RNA, 17 nt, Human
aaauaugaccucaaagu

SEQ ID NO: 957855 - RNA, 22 nt, Human
cugcccaaauccuucuuccucu

SEQ ID NO: 957856 - RNA, 22 nt, Human
gcuccuggauguucaagucggc

SEQ ID NO: 957857 - RNA, 22 nt, Human
ugaaagcagugccaugauuaug

SEQ ID NO: 957858 - RNA, 22 nt, Human
uaggaugagggguggccaagua

SEQ ID NO: 957859 - RNA, 22 nt, Human
cugagccaguagucagggacaa

SEQ ID NO: 957860 - RNA, 22 nt, Human
aaaaaugugaccacaggguguu

SEQ ID NO: 957861 - RNA, 22 nt, Human
uguguuaaguauuugauacacu

SEQ ID NO: 957862 - RNA, 20 nt, Human
ccuggccaaugagauaggaa

SEQ ID NO: 957863 - RNA, 22 nt, Human
accuuauuuugaaauagauugu

SEQ ID NO: 957864 - RNA, 22 nt, Human
ucugugccaccucuccaguguc

SEQ ID NO: 957865 - RNA, 22 nt, Human
aacuccagugucagcugcaaug

SEQ ID NO: 957866 - RNA, 22 nt, Human
acucugcucccuaagccaugau

SEQ ID NO: 957867 - RNA, 22 nt, Human
caugcaggcccgccugaauggg

SEQ ID NO: 957868 - RNA, 22 nt, Human
aaguuguauauaccgcuuuaag

SEQ ID NO: 957869 - RNA, 22 nt, Human
aauucacaaaaccagauugcuu

SEQ ID NO: 957870 - RNA, 22 nt, Human
acacauuauaggcaaucaaaag

SEQ ID NO: 957871 - RNA, 22 nt, Human
aaaacaguuauaaacagaguca

SEQ ID NO: 957872 - RNA, 22 nt, Human
gaaauauuacaguggaggggau

SEQ ID NO: 957873 - RNA, 22 nt, Human
ugcuugaggggaauaaaaagaa

SEQ ID NO: 957874 - RNA, 22 nt, Human
uuuuaugauugagcuggcuaca

SEQ ID NO: 957875 - RNA, 22 nt, Human
cauaacauccuugcuacuuuga

SEQ ID NO: 957876 - RNA, 22 nt, Human
uucagcaauuuuuuaagcuaau

SEQ ID NO: 957877 - RNA, 22 nt, Human
acuggccaugggauuuauauuu

SEQ ID NO: 957878 - RNA, 22 nt, Human
gacauaaaauucaauaauuugu

SEQ ID NO: 957879 - RNA, 22 nt, Human
auggccaagagucgauuugggg

SEQ ID NO: 957880 - RNA, 22 nt, Human
ccuggaccaaacacuggccugg

SEQ ID NO: 957881 - RNA, 22 nt, Human
uuugaaauguaucaguauaggu

SEQ ID NO: 957882 - RNA, 22 nt, Human
cacuggcccauuccugucuggc

SEQ ID NO: 957883 - RNA, 22 nt, Human
uacaucuauacugaucuacauu

SEQ ID NO: 957884 - RNA, 22 nt, Human
gagagcuguuuaucuucuucaa

SEQ ID NO: 957885 - RNA, 22 nt, Human
aaagucauacauggugcuuacu

SEQ ID NO: 957886 - RNA, 22 nt, Human
auacagcagugaauaagauaaa

SEQ ID NO: 957887 - RNA, 22 nt, Human
uagaaacagagagauaugcccc

SEQ ID NO: 957888 - RNA, 21 nt, Human
gggaaugagauucuuggagau

SEQ ID NO: 957889 - RNA, 22 nt, Human
aguuucuuuagauagaaaguuc

SEQ ID NO: 957890 - RNA, 22 nt, Human
gucaucuuugcccugugcagga

SEQ ID NO: 957891 - RNA, 22 nt, Human
uccaagggaaugugggcaaugc

SEQ ID NO: 957892 - RNA, 22 nt, Human
aaccaggugacucauggugagc

SEQ ID NO: 957893 - RNA, 22 nt, Human
uccuguuaguguuagacuuccc

SEQ ID NO: 957894 - RNA, 22 nt, Human
acucugcuuccacuuuugcuaa

SEQ ID NO: 957895 - RNA, 22 nt, Human
gcuccugggcucuaccuugcua

SEQ ID NO: 957896 - RNA, 22 nt, Human
augauugaaaaugacauugcca

SEQ ID NO: 957897 - RNA, 22 nt, Human
uaguuuaaaaguuagggaugau

SEQ ID NO: 957898 - RNA, 22 nt, Human
aauguuauuacacuugugaaau

SEQ ID NO: 957899 - RNA, 22 nt, Human
acugucuucaaaugaauauauu

SEQ ID NO: 957900 - RNA, 22 nt, Human
cagcuguggcugccacugcucc

SEQ ID NO: 957901 - RNA, 22 nt, Human
acucugcuaaauguguaggcuc

SEQ ID NO: 957902 - RNA, 22 nt, Human
caaauaguaugagcaaugauuc

SEQ ID NO: 957903 - RNA, 19 nt, Human
agucucacccaagcagucu

SEQ ID NO: 957904 - RNA, 22 nt, Human
ucuccuggccuuuagguuaagg

SEQ ID NO: 957905 - RNA, 22 nt, Human
uguuccuguguggaaaagggcc

SEQ ID NO: 957906 - RNA, 22 nt, Human
ucugcaagauggucuuagaggu

SEQ ID NO: 957907 - RNA, 22 nt, Human
gcuggccacacugcugauggag

SEQ ID NO: 957908 - RNA, 22 nt, Human
uugcauguagaauacucaacuu

SEQ ID NO: 957909 - RNA, 22 nt, Human
uuggccaauccuauuggguggg

SEQ ID NO: 957910 - RNA, 20 nt, Human
uccugagccuccaccauguc

SEQ ID NO: 957911 - RNA, 19 nt, Human
gcucugcuacuauuaccac

SEQ ID NO: 957912 - RNA, 22 nt, Human
uaugcacaacaugcagguuugu

SEQ ID NO: 957913 - RNA, 22 nt, Human
ucauaaaaugcuccugauauug

SEQ ID NO: 957914 - RNA, 22 nt, Human
uucagcaacauuuguugagugc

SEQ ID NO: 957915 - RNA, 22 nt, Human
caccuuguggcccagucagguu

SEQ ID NO: 957916 - RNA, 22 nt, Human
acaaaaagggagaugagguaga

SEQ ID NO: 957917 - RNA, 22 nt, Human
ucuggcaaaggcaaccacaguu

SEQ ID NO: 957918 - RNA, 22 nt, Human
uuuuauucuaaguaugauggga

SEQ ID NO: 957919 - RNA, 22 nt, Human
gaguuauuugguuugcaugcag

SEQ ID NO: 957920 - RNA, 22 nt, Human
accuuguuaaaaugaggauucu

SEQ ID NO: 957921 - RNA, 22 nt, Human
ucauguuuggaguuugcucacu

SEQ ID NO: 957922 - RNA, 21 nt, Human
gucaaacuugcaccagugccc

SEQ ID NO: 957923 - RNA, 20 nt, Human
auuaggauuuuaggucauca

SEQ ID NO: 957924 - RNA, 22 nt, Human
gcucugcugggugggcaguuau

SEQ ID NO: 957925 - RNA, 22 nt, Human
accuacccuuagaucacaaggg

SEQ ID NO: 957926 - RNA, 22 nt, Human
uaaaguauauuuuuucucaaua

SEQ ID NO: 957927 - RNA, 22 nt, Human
agggucuguggaugcaucuggg

SEQ ID NO: 957928 - RNA, 22 nt, Human
aauagaauguaaucuaauacau

SEQ ID NO: 957929 - RNA, 22 nt, Human
cacucugcaggccaaaccaaag

SEQ ID NO: 957930 - RNA, 22 nt, Human
ccuccuggccugugcagagccc

SEQ ID NO: 957931 - RNA, 22 nt, Human
gcucugcugacagcugggacag

SEQ ID NO: 957932 - RNA, 22 nt, Human
gucauggaggauugugaguggu

SEQ ID NO: 957933 - RNA, 22 nt, Human
gcuccuggcucucugagggcug

SEQ ID NO: 957934 - RNA, 22 nt, Human
uagaaacacagagagacccaug

SEQ ID NO: 957935 - RNA, 22 nt, Human
auaauguguucaucuuacaauu

SEQ ID NO: 957936 - RNA, 22 nt, Human
aaaguuuggauuagcaguuaga

SEQ ID NO: 957937 - RNA, 22 nt, Human
uaugcacacauguaugcaugug

SEQ ID NO: 957938 - RNA, 22 nt, Human
ugagccaaacuucuccuugguc

SEQ ID NO: 957939 - RNA, 22 nt, Human
accuucaaugaaaauaauaguc

SEQ ID NO: 957940 - RNA, 22 nt, Human
accucugcaacccuggaauggg

SEQ ID NO: 957941 - RNA, 22 nt, Human
acuccuggggcugccaucacag

SEQ ID NO: 957942 - RNA, 22 nt, Human
cuccuggaccagggcuauuggg

SEQ ID NO: 957943 - RNA, 22 nt, Human
cagcuuugcccuuugcccaauc

SEQ ID NO: 957944 - RNA, 23 nt, Human
ccagucucacguauacaggauuu

SEQ ID NO: 957945 - RNA, 22 nt, Human
cauauaaauacaacauguguua

SEQ ID NO: 957946 - RNA, 22 nt, Human
caaauaguuuuucauguauuau

SEQ ID NO: 957947 - RNA, 22 nt, Human
uaccuauagguacaauuacaag

SEQ ID NO: 957948 - RNA, 22 nt, Human
uacucugcaggauggacuaugg

SEQ ID NO: 957949 - RNA, 22 nt, Human
ugcucuucggggccacugcuug

SEQ ID NO: 957950 - RNA, 22 nt, Human
ucacucugcugcccgagggcug

SEQ ID NO: 957951 - RNA, 22 nt, Human
gucucuaucauagcugaacccu

SEQ ID NO: 957952 - RNA, 22 nt, Human
uccuggcccggccgggccugcu

SEQ ID NO: 957953 - RNA, 22 nt, Human
uuaauguggaaagcucuugagu

SEQ ID NO: 957954 - RNA, 22 nt, Human
gcucugcucuugacuuaccagg

SEQ ID NO: 957955 - RNA, 22 nt, Human
uugaauaauuaauuacacucag

SEQ ID NO: 957956 - RNA, 22 nt, Human
ucuccuggcccugucgccaucu

SEQ ID NO: 957957 - RNA, 22 nt, Human
gcauugaguccacucugucuuu

SEQ ID NO: 957958 - RNA, 22 nt, Human
uuucacaaagcauagcacuuua

SEQ ID NO: 957959 - RNA, 22 nt, Human
auagucaaccuuguaauuagcc

SEQ ID NO: 957960 - RNA, 22 nt, Human
uuaauaggcuucuaacauagcu

SEQ ID NO: 957961 - RNA, 22 nt, Human
ucuuugcacacaucccuucccg

SEQ ID NO: 957962 - RNA, 22 nt, Human
ccucugcucugguccaugugcu

SEQ ID NO: 957963 - RNA, 22 nt, Human
cuuauuagugucugucugaguu

SEQ ID NO: 957964 - RNA, 23 nt, Human
ccuccugggcacaggccugaugg

SEQ ID NO: 957965 - RNA, 22 nt, Human
aaauaaguuaaacuagaaugau

SEQ ID NO: 957966 - RNA, 22 nt, Human
cauugguagaguuuguuuuaua

SEQ ID NO: 957967 - RNA, 22 nt, Human
ucaucuaagagucuuacauuua

SEQ ID NO: 957968 - RNA, 22 nt, Human
uauaaagaaguguaaacaggaa

SEQ ID NO: 957969 - RNA, 22 nt, Human
ucacucugggcccuacugggcu

SEQ ID NO: 957970 - RNA, 22 nt, Human
acacuuuuguguauauccaguu

SEQ ID NO: 957971 - RNA, 22 nt, Human
uggcagcagaacaugaaaccca

SEQ ID NO: 957972 - RNA, 23 nt, Human
uuuuaauuuggacauaagaagau

SEQ ID NO: 957973 - RNA, 22 nt, Human
cccaaacaguuccugugguacu

SEQ ID NO: 957974 - RNA, 22 nt, Human
aaauauuagggagaacagggac

SEQ ID NO: 957975 - RNA, 22 nt, Human
cuuauuagaguuguguucuguu

SEQ ID NO: 957976 - RNA, 22 nt, Human
cugcugucauagccaucccucc

SEQ ID NO: 957977 - RNA, 22 nt, Human
gacacuaaaguauaggguaucu

SEQ ID NO: 957978 - RNA, 22 nt, Human
uaaaauguuugcaagagaccag

SEQ ID NO: 957979 - RNA, 22 nt, Human
ugauaauauuuugaaucauaag

SEQ ID NO: 957980 - RNA, 22 nt, Human
uccugagcugccgcaucagcag

SEQ ID NO: 957981 - RNA, 22 nt, Human
aagacagagacucugcaacagg

SEQ ID NO: 957982 - RNA, 22 nt, Human
cuggcucaauuuguacugcugu

SEQ ID NO: 957983 - RNA, 22 nt, Human
gagggcuccauuccccgugccc

SEQ ID NO: 957984 - RNA, 22 nt, Human
acuccuggugcugaugaagaga

SEQ ID NO: 957985 - RNA, 22 nt, Human
gaaauauugggacucagagcuu

SEQ ID NO: 957986 - RNA, 22 nt, Human
auucugagaaaugcauugucag

SEQ ID NO: 957987 - RNA, 18 nt, Human
ugcagcaagugcuaaaua

SEQ ID NO: 957988 - RNA, 22 nt, Human
acucugcuuaauuaaaaccagg

SEQ ID NO: 957989 - RNA, 22 nt, Human
uccaaagaagucacaaacgaag

SEQ ID NO: 957990 - RNA, 22 nt, Human
uuauguaggauaaugaauugcc

SEQ ID NO: 957991 - RNA, 22 nt, Human
aaauacagcagacuccuguugu

SEQ ID NO: 957992 - RNA, 22 nt, Human
uauucacauuaauaagucuuca

SEQ ID NO: 957993 - RNA, 22 nt, Human
agacagugcaagaagagcaggc

SEQ ID NO: 957994 - RNA, 22 nt, Human
agagacugcgugucagcgcugg

SEQ ID NO: 957995 - RNA, 22 nt, Human
uuguacacaauucuuaacauac

SEQ ID NO: 957996 - RNA, 22 nt, Human
ucugagccagccaccuccuuca

SEQ ID NO: 957997 - RNA, 22 nt, Human
acacucugcucugagcuucagg

SEQ ID NO: 957998 - RNA, 22 nt, Human
auucacaaagucacccuuacac

SEQ ID NO: 957999 - RNA, 22 nt, Human
uggcagcagcuaacuuaggcag

SEQ ID NO: 958000 - RNA, 22 nt, Human
gcaccuuuuucuaggagaaugu

SEQ ID NO: 958001 - RNA, 22 nt, Human
auucacaaaugcugccccauuc

SEQ ID NO: 958002 - RNA, 22 nt, Human
ugcccaaaccucuccuagcucu

SEQ ID NO: 958003 - RNA, 22 nt, Human
ccuccuggagcauuggugagga

SEQ ID NO: 958004 - RNA, 22 nt, Human
ucucugcuugguguaugugagu

SEQ ID NO: 958005 - RNA, 22 nt, Human
uagaaaugugauaauagcuuaa

SEQ ID NO: 958006 - RNA, 22 nt, Human
aacacugcugcuggguucugug

SEQ ID NO: 958007 - RNA, 22 nt, Human
augcugagugagugaaacccag

SEQ ID NO: 958008 - RNA, 22 nt, Human
ccuggccagcagccccuuccuc

SEQ ID NO: 958009 - RNA, 22 nt, Human
gcuggccagcccucuuccucca

SEQ ID NO: 958010 - RNA, 20 nt, Human
uuaggcauuuggauuggcuu

SEQ ID NO: 958011 - RNA, 23 nt, Human
uuucaacaaugcuuagagaaaac

SEQ ID NO: 958012 - RNA, 22 nt, Human
uuauucaggcucucuuuggcua

SEQ ID NO: 958013 - RNA, 22 nt, Human
aacacauaggcagagcaugaca

SEQ ID NO: 958014 - RNA, 22 nt, Human
aucaggaucugcaucauaagaa

SEQ ID NO: 958015 - RNA, 22 nt, Human
ucagggaacaauguuauggcuu

SEQ ID NO: 958016 - RNA, 22 nt, Human
uggucaacaggcagggaugaaa

SEQ ID NO: 958017 - RNA, 22 nt, Human
gcacucuguuucuccugucagc

SEQ ID NO: 958018 - RNA, 22 nt, Human
ucuggccaacaaaaacuaaguc

SEQ ID NO: 958019 - RNA, 22 nt, Human
ucugagaggcaucugcacuucu

SEQ ID NO: 958020 - RNA, 22 nt, Human
ucuuuuuauauugacaaaaggu

SEQ ID NO: 958021 - RNA, 22 nt, Human
aacugccuggccaggcugcaac

SEQ ID NO: 958022 - RNA, 22 nt, Human
cuuuauuagauguagacuuucu

SEQ ID NO: 958023 - RNA, 22 nt, Human
uggcaucauagccaaggugcuu

SEQ ID NO: 958024 - RNA, 22 nt, Human
cagcuuugucugauuccucuuu

SEQ ID NO: 958025 - RNA, 22 nt, Human
ucauugaagugacugaaagauu

SEQ ID NO: 958026 - RNA, 22 nt, Human
cucccuggugacucccaaagcu

SEQ ID NO: 958027 - RNA, 22 nt, Human
acauucaaggccuucugacaca

SEQ ID NO: 958028 - RNA, 22 nt, Human
aaaagagugacugauaaguaua

SEQ ID NO: 958029 - RNA, 21 nt, Human
gacaggacuagaccagagcuc

SEQ ID NO: 958030 - RNA, 22 nt, Human
uggucaaaagaaagcucagaac

SEQ ID NO: 958031 - RNA, 17 nt, Human
uucugagccacuuccuu

SEQ ID NO: 958032 - RNA, 22 nt, Human
acuccugggugcauuucugauu

SEQ ID NO: 958033 - RNA, 22 nt, Human
cuuuuacugugaaaagaaacug

SEQ ID NO: 958034 - RNA, 23 nt, Human
uucaaaacuggaaaaucagaugc

SEQ ID NO: 958035 - RNA, 22 nt, Human
acaguuauucuuuaugcaacca

SEQ ID NO: 958036 - RNA, 22 nt, Human
ugcugagguuucgucugcuugc

SEQ ID NO: 958037 - RNA, 22 nt, Human
uaggauaugguagaaaucauuc

SEQ ID NO: 958038 - RNA, 22 nt, Human
uucaggauggcggauguugggg

SEQ ID NO: 958039 - RNA, 22 nt, Human
cuccuggcuuucccagaccagg

SEQ ID NO: 958040 - RNA, 23 nt, Human
ugucuggcucauggugggucuca

SEQ ID NO: 958041 - RNA, 17 nt, Human
cagacaggcugucaccc

SEQ ID NO: 958042 - RNA, 20 nt, Human
aauauaauucucugaauuua

SEQ ID NO: 958043 - RNA, 22 nt, Human
uuaaaaugcagauuaugacuca

SEQ ID NO: 958044 - RNA, 22 nt, Human
uugauaaaaugaugaaaucacu

SEQ ID NO: 958045 - RNA, 22 nt, Human
cuuuguauucaguugggcugug

SEQ ID NO: 958046 - RNA, 22 nt, Human
guucacaagaguuacagacaga

SEQ ID NO: 958047 - RNA, 22 nt, Human
agaguucagcuacugcaaaugu

SEQ ID NO: 958048 - RNA, 22 nt, Human
cuggccauguugccucugagac

SEQ ID NO: 958049 - RNA, 22 nt, Human
uauauuaaaugaccaguuuuaa

SEQ ID NO: 958050 - RNA, 22 nt, Human
aacuucugggcuguccaaaacu

SEQ ID NO: 958051 - RNA, 22 nt, Human
uuuaggaucaaugagaaagucu

SEQ ID NO: 958052 - RNA, 22 nt, Human
aaaguaaccuaguaauaguguc

SEQ ID NO: 958053 - RNA, 22 nt, Human
aacaguaucuuuuaucagaaau

SEQ ID NO: 958054 - RNA, 22 nt, Human
ucuugcuaaagaccaacacauu

SEQ ID NO: 958055 - RNA, 22 nt, Human
aaaaugagauacaguuugaaag

SEQ ID NO: 958056 - RNA, 22 nt, Human
auuaggaagaggaugucagcau

SEQ ID NO: 958057 - RNA, 22 nt, Human
cauucacaucuuguuccaucac

SEQ ID NO: 958058 - RNA, 22 nt, Human
cugaagccaugugcucacuggu

SEQ ID NO: 958059 - RNA, 22 nt, Human
auauuaggaguuaaauguauua

SEQ ID NO: 958060 - RNA, 22 nt, Human
auucacauguugaagcccuaac

SEQ ID NO: 958061 - RNA, 20 nt, Human
agacaggagcccccauucag

SEQ ID NO: 958062 - RNA, 22 nt, Human
uguguuaacacugcaugauaau

SEQ ID NO: 958063 - RNA, 22 nt, Human
uuucacaaguaaaguccuaagu

SEQ ID NO: 958064 - RNA, 22 nt, Human
uucagcaagaccaccauguacc

SEQ ID NO: 958065 - RNA, 22 nt, Human
ccuggccaggcucucagcacug

SEQ ID NO: 958066 - RNA, 22 nt, Human
uaccucacugggccucaguuuu

SEQ ID NO: 958067 - RNA, 22 nt, Human
gcuguuaggugcccugaccuug

SEQ ID NO: 958068 - RNA, 22 nt, Human
uagauaaauuagaaaguuuacu

SEQ ID NO: 958069 - RNA, 22 nt, Human
auccauggaggacaagagcaau

SEQ ID NO: 958070 - RNA, 22 nt, Human
ugucuuaauuuggaugauguuu

SEQ ID NO: 958071 - RNA, 22 nt, Human
gcuccuggugcuguagagauuu

SEQ ID NO: 958072 - RNA, 23 nt, Human
ucuccuggcugcacuguggccac

SEQ ID NO: 958073 - RNA, 22 nt, Human
gcuuagaaguuccuauaaaaug

SEQ ID NO: 958074 - RNA, 22 nt, Human
cucaaauauguggucagaaagc

SEQ ID NO: 958075 - RNA, 22 nt, Human
aaagacauggaacuagagaugg

SEQ ID NO: 958076 - RNA, 18 nt, Human
ucuccuggguaggggccu

SEQ ID NO: 958077 - RNA, 22 nt, Human
uuggcacacaguaagcccuaag

SEQ ID NO: 958078 - RNA, 22 nt, Human
uuaaaacagcgugaaucuggca

SEQ ID NO: 958079 - RNA, 22 nt, Human
auuauggacguuaauuuuggaa

SEQ ID NO: 958080 - RNA, 22 nt, Human
uacaccuuaaucauaugugucu

SEQ ID NO: 958081 - RNA, 22 nt, Human
cugccuggcuaaacucaagucg

SEQ ID NO: 958082 - RNA, 22 nt, Human
cuauuaggcuuccauuucaugc

SEQ ID NO: 958083 - RNA, 23 nt, Human
uuggcagcgggucaggcuguggg

SEQ ID NO: 958084 - RNA, 22 nt, Human
ccugagccuggcucaugcacuc

SEQ ID NO: 958085 - RNA, 22 nt, Human
acagcauugcuccaucucaaga

SEQ ID NO: 958086 - RNA, 22 nt, Human
ccuccugggccuugcucuguga

SEQ ID NO: 958087 - RNA, 22 nt, Human
gcuggccaggaagagucucaga

SEQ ID NO: 958088 - RNA, 22 nt, Human
uuauuuagucuagaugaauuuu

SEQ ID NO: 958089 - RNA, 22 nt, Human
uuuaucagagauauguguggac

SEQ ID NO: 958090 - RNA, 22 nt, Human
aaugauguauuaguacaacaca

SEQ ID NO: 958091 - RNA, 22 nt, Human
auagacauuuugcauucaagca

SEQ ID NO: 958092 - RNA, 22 nt, Human
gcugaaauucagauuccuaggc

SEQ ID NO: 958093 - RNA, 22 nt, Human
cugccuggguucaaguccuguu

SEQ ID NO: 958094 - RNA, 23 nt, Human
gacaccuuugccagaucaagaug

SEQ ID NO: 958095 - RNA, 22 nt, Human
ugcaccuuguccauuuuuggcc

SEQ ID NO: 958096 - RNA, 23 nt, Human
uuauugaggguguagauuggugu

SEQ ID NO: 958097 - RNA, 22 nt, Human
uaagauaauaaguaugucuaug

SEQ ID NO: 958098 - RNA, 22 nt, Human
gcuccuggcauccugcuuuuaa

SEQ ID NO: 958099 - RNA, 22 nt, Human
ucuccuggccgggcuguccccu

SEQ ID NO: 958100 - RNA, 22 nt, Human
aagaacauucgaacuauuuucu

SEQ ID NO: 958101 - RNA, 22 nt, Human
uggcacaugguaagacucagua

SEQ ID NO: 958102 - RNA, 22 nt, Human
uccuaggcaguuggugcuccau

SEQ ID NO: 958103 - RNA, 22 nt, Human
uccuggccgccgcguggggccg

SEQ ID NO: 958104 - RNA, 22 nt, Human
aacuaacagucauuaaaagaac

SEQ ID NO: 958105 - RNA, 22 nt, Human
aggucaccauggcaugcuccac

SEQ ID NO: 958106 - RNA, 22 nt, Human
cuuuugauaguugcugagcagg

SEQ ID NO: 958107 - RNA, 22 nt, Human
gggaggagggugcuggcuaaac

SEQ ID NO: 958108 - RNA, 22 nt, Human
acauaaauagauuauugggagg

SEQ ID NO: 958109 - RNA, 18 nt, Human
augugcaauuuuguauuu

SEQ ID NO: 958110 - RNA, 22 nt, Human
guauuagguuggugcaaaauug

SEQ ID NO: 958111 - RNA, 21 nt, Human
auguaggguuugccuucucua

SEQ ID NO: 958112 - RNA, 22 nt, Human
uguuggcagauugucuaggguu

SEQ ID NO: 958113 - RNA, 22 nt, Human
augcuuccaaggcuaagacaag

SEQ ID NO: 958114 - RNA, 21 nt, Human
ucuccuggguccaacccaugc

SEQ ID NO: 958115 - RNA, 22 nt, Human
aaauaguaaagugguagccauc

SEQ ID NO: 958116 - RNA, 23 nt, Human
uauuagggccaggacuggcaaau

SEQ ID NO: 958117 - RNA, 22 nt, Human
uuaaagagucuacugcacaucc

SEQ ID NO: 958118 - RNA, 22 nt, Human
agacaggaugcauacucuuggu

SEQ ID NO: 958119 - RNA, 22 nt, Human
uagaacaugcucauguauaaau

SEQ ID NO: 958120 - RNA, 22 nt, Human
gcacucugugaucugcagagcc

SEQ ID NO: 958121 - RNA, 22 nt, Human
caauaagugcuuuuguuuagca

SEQ ID NO: 958122 - RNA, 20 nt, Human
aacacacugguggcaucagg

SEQ ID NO: 958123 - RNA, 22 nt, Human
aacaugucuggguauucacaag

SEQ ID NO: 958124 - RNA, 21 nt, Human
uuugaauagaaauagugcuua

SEQ ID NO: 958125 - RNA, 22 nt, Human
uuccuggcgccacggagccggu

SEQ ID NO: 958126 - RNA, 22 nt, Human
uuguuacuaagccuuuaaauag

SEQ ID NO: 958127 - RNA, 22 nt, Human
guggccaaggugcagagcagcu

SEQ ID NO: 958128 - RNA, 21 nt, Human
gugguucuagagaaacagaau

SEQ ID NO: 958129 - RNA, 22 nt, Human
ucuguaaauccugcucagcaac

SEQ ID NO: 958130 - RNA, 22 nt, Human
uuuauaagaagcaaugucugag

SEQ ID NO: 958131 - RNA, 19 nt, Human
acugccugaggcucacagg

SEQ ID NO: 958132 - RNA, 22 nt, Human
uuggcagauuugucaguaagcu

SEQ ID NO: 958133 - RNA, 22 nt, Human
caugcaggcacccagagcccac

SEQ ID NO: 958134 - RNA, 22 nt, Human
ggccaaaucuguaaggcaagau

SEQ ID NO: 958135 - RNA, 22 nt, Human
aauagaauuuguacuguguuuu

SEQ ID NO: 958136 - RNA, 22 nt, Human
agcagacauaucucaugucaca

SEQ ID NO: 958137 - RNA, 21 nt, Human
uggccaaacuggagcauuuga

SEQ ID NO: 958138 - RNA, 22 nt, Human
acucugcucaaaguccugaggc

SEQ ID NO: 958139 - RNA, 22 nt, Human
uaaccuuucaggcauguagguu

SEQ ID NO: 958140 - RNA, 22 nt, Human
uguuuaaucuauaaaauggaga

SEQ ID NO: 958141 - RNA, 22 nt, Human
ucuugaaggggggcaguguuga

SEQ ID NO: 958142 - RNA, 22 nt, Human
uuaauaaaguaugaauuggaaa

SEQ ID NO: 958143 - RNA, 22 nt, Human
uaaccuuuguucaauguaagau

SEQ ID NO: 958144 - RNA, 22 nt, Human
augugagguaucuaggucuucg

SEQ ID NO: 958145 - RNA, 22 nt, Human
cuaaauaaucccucuggucuua

SEQ ID NO: 958146 - RNA, 22 nt, Human
cuuaggauuuaauuucagacuc

SEQ ID NO: 958147 - RNA, 22 nt, Human
acuggccaggcagcaguagcuu

SEQ ID NO: 958148 - RNA, 22 nt, Human
uagaauaugauuaauuuucuua

SEQ ID NO: 958149 - RNA, 22 nt, Human
ucuggccaauguugugaucaca

SEQ ID NO: 958150 - RNA, 22 nt, Human
uuaguaggagagcuuguucauu

SEQ ID NO: 958151 - RNA, 19 nt, Human
auagaaaggguuaaagaca

SEQ ID NO: 958152 - RNA, 22 nt, Human
auauuagggucucuaaauucua

SEQ ID NO: 958153 - RNA, 22 nt, Human
acaccuuugugaagugaugaug

SEQ ID NO: 958154 - RNA, 22 nt, Human
gcagcauauuguacuggccugc

SEQ ID NO: 958155 - RNA, 22 nt, Human
aaacuccugggcucaagcaguu

SEQ ID NO: 958156 - RNA, 19 nt, Human
aauaauguucaugagauug

SEQ ID NO: 958157 - RNA, 22 nt, Human
ugaaagcacaaguucuaacagg

SEQ ID NO: 958158 - RNA, 22 nt, Human
cuaccuuucugacucuugggau

SEQ ID NO: 958159 - RNA, 22 nt, Human
caaaaguaauguaugcucaucg

SEQ ID NO: 958160 - RNA, 22 nt, Human
cuguuuauggagguaaggcauc

SEQ ID NO: 958161 - RNA, 18 nt, Human
gaaaggagagacaguagg

SEQ ID NO: 958162 - RNA, 22 nt, Human
agggaagaugucucaucuuagg

SEQ ID NO: 958163 - RNA, 22 nt, Human
cuucuuaaagauuacacaauga

SEQ ID NO: 958164 - RNA, 22 nt, Human
uauuggcagcaugagcuccugg

SEQ ID NO: 958165 - RNA, 20 nt, Human
uccagggcaacuagagugug

SEQ ID NO: 958166 - RNA, 22 nt, Human
aacucuggagcacgcccuggcc

SEQ ID NO: 958167 - RNA, 22 nt, Human
uuucacaacacaaucucguuaa

SEQ ID NO: 958168 - RNA, 22 nt, Human
ccuccuggguucaagcgauucu

SEQ ID NO: 958169 - RNA, 22 nt, Human
uauucacaggcuggagugaugu

SEQ ID NO: 958170 - RNA, 22 nt, Human
gacuccugggccucugagaggc

SEQ ID NO: 958171 - RNA, 22 nt, Human
cugagccagcuggcaugugcua

SEQ ID NO: 958172 - RNA, 22 nt, Human
acucugcuggcugcagggcagc

SEQ ID NO: 958173 - RNA, 22 nt, Human
uccaagggcuuuggcgugaagu

SEQ ID NO: 958174 - RNA, 22 nt, Human
cucucuggaccucaacuauuuu

SEQ ID NO: 958175 - RNA, 22 nt, Human
uggacaaaugauuucuaccuuu

SEQ ID NO: 958176 - RNA, 22 nt, Human
aggccaaagugcuccuuuuaga

SEQ ID NO: 958177 - RNA, 22 nt, Human
cuuagaaaugcagauucucagg

SEQ ID NO: 958178 - RNA, 22 nt, Human
aaauaaguaguuuaguguugug

SEQ ID NO: 958179 - RNA, 22 nt, Human
augauugguggucagcaguaug

SEQ ID NO: 958180 - RNA, 22 nt, Human
ucuggccagugaaaugcagaau

SEQ ID NO: 958181 - RNA, 22 nt, Human
aguuuaauauccuucaacuuuc

SEQ ID NO: 958182 - RNA, 22 nt, Human
ucaaaacaaucauuggaugugc

SEQ ID NO: 958183 - RNA, 22 nt, Human
cauuucauaguugucacaauaa

SEQ ID NO: 958184 - RNA, 22 nt, Human
agggaagugaaugacagauauc

SEQ ID NO: 958185 - RNA, 22 nt, Human
gcagcauacagggagaguacuc

SEQ ID NO: 958186 - RNA, 20 nt, Human
cugagccaacucucuucuug

SEQ ID NO: 958187 - RNA, 22 nt, Human
cacucugcugaaaucgccuugu

SEQ ID NO: 958188 - RNA, 22 nt, Human
guauuaggaaauaugaagaaag

SEQ ID NO: 958189 - RNA, 22 nt, Human
gccauaaauugcuggucaaaau

SEQ ID NO: 958190 - RNA, 22 nt, Human
accuauuuaugcaauuaugaaa

SEQ ID NO: 958191 - RNA, 17 nt, Human
ucugaagccagucugcu

SEQ ID NO: 958192 - RNA, 22 nt, Human
cugccacuagcuuucacaucuu

SEQ ID NO: 958193 - RNA, 22 nt, Human
acauaaugaaaugcagaaauca

SEQ ID NO: 958194 - RNA, 22 nt, Human
gucuggccugccagcucuggug

SEQ ID NO: 958195 - RNA, 22 nt, Human
uggaagaggcccaugacugccu

SEQ ID NO: 958196 - RNA, 22 nt, Human
cacucugcgcugggcgccagcg

SEQ ID NO: 958197 - RNA, 22 nt, Human
uaagccugguucauaauuugcu

SEQ ID NO: 958198 - RNA, 22 nt, Human
aaguuuguguaguuuagcaucc

SEQ ID NO: 958199 - RNA, 22 nt, Human
ccuuuucuaaucuuaagaaugu

SEQ ID NO: 958200 - RNA, 22 nt, Human
uagaguguuguaauugaaaagg

SEQ ID NO: 958201 - RNA, 22 nt, Human
cagucucagaggugggaguggg

SEQ ID NO: 958202 - RNA, 22 nt, Human
uuucacaagacagcuacuguug

SEQ ID NO: 958203 - RNA, 22 nt, Human
uauugaaauccauuacguucuu

SEQ ID NO: 958204 - RNA, 21 nt, Human
caugcaggauuuaaccuagaa

SEQ ID NO: 958205 - RNA, 22 nt, Human
uccuggccucacaguccugggu

SEQ ID NO: 958206 - RNA, 22 nt, Human
ucugccacuuuugcuuacuggg

SEQ ID NO: 958207 - RNA, 17 nt, Human
acucugcugaaguagaa

SEQ ID NO: 958208 - RNA, 17 nt, Human
acacagggagagggagc

SEQ ID NO: 958209 - RNA, 19 nt, Human
uauucaggaugauggcaca

SEQ ID NO: 958210 - RNA, 22 nt, Human
ugcaugugcccacucuggcuua

SEQ ID NO: 958211 - RNA, 22 nt, Human
acucugcucuuuggacaaugcc

SEQ ID NO: 958212 - RNA, 22 nt, Human
uggccacacccaccuagaggag

SEQ ID NO: 958213 - RNA, 22 nt, Human
uccuggcccacuaugccagcau

SEQ ID NO: 958214 - RNA, 21 nt, Human
cucucugcuuaugaauaguga

SEQ ID NO: 958215 - RNA, 22 nt, Human
aaaaguaauugaugcaaucgua

SEQ ID NO: 958216 - RNA, 22 nt, Human
guggccaagaaaauagaugcau

SEQ ID NO: 958217 - RNA, 18 nt, Human
uguuaggaagggcacaca

SEQ ID NO: 958218 - RNA, 22 nt, Human
ugugaaauucuugaaaugcaca

SEQ ID NO: 958219 - RNA, 18 nt, Human
accuucauuccuuugccu

SEQ ID NO: 958220 - RNA, 22 nt, Human
uguguuaauuccacaaacauuc

SEQ ID NO: 958221 - RNA, 22 nt, Human
uugaaugaccaugaugcaaggg

SEQ ID NO: 958222 - RNA, 22 nt, Human
auguuuaaauuuauagacagug

SEQ ID NO: 958223 - RNA, 22 nt, Human
acagggaauggagggaucagua

SEQ ID NO: 958224 - RNA, 20 nt, Human
uuggccaaaucuuagucaug

SEQ ID NO: 958225 - RNA, 22 nt, Human
cagcuccucacgagucuugaaa

SEQ ID NO: 958226 - RNA, 22 nt, Human
aacauguugcuuuaauaauauu

SEQ ID NO: 958227 - RNA, 22 nt, Human
auaaaaaggacagauguggucu

SEQ ID NO: 958228 - RNA, 22 nt, Human
uggccacaguguccagcagcag

SEQ ID NO: 958229 - RNA, 22 nt, Human
uuugcaauuugugcugcaaaug

SEQ ID NO: 958230 - RNA, 22 nt, Human
augaaauguuggucccaaucgc

SEQ ID NO: 958231 - RNA, 22 nt, Human
uuauugagcacauaguaugugg

SEQ ID NO: 958232 - RNA, 22 nt, Human
uuaggauagucuguuagaaaag

SEQ ID NO: 958233 - RNA, 22 nt, Human
uccaaggguucaugugcauuca

SEQ ID NO: 958234 - RNA, 22 nt, Human
ucuuuaaucauaaccaagaugg

SEQ ID NO: 958235 - RNA, 22 nt, Human
auaaugugaagauaaugcaaga

SEQ ID NO: 958236 - RNA, 22 nt, Human
agcacucuucugugauaguugu

SEQ ID NO: 958237 - RNA, 22 nt, Human
cuucacaaagcucucuuuaugu

SEQ ID NO: 958238 - RNA, 22 nt, Human
uuuauuauguacaggcacuaua

SEQ ID NO: 958239 - RNA, 22 nt, Human
cuguuuaucuaggaguugcagg

SEQ ID NO: 958240 - RNA, 22 nt, Human
acauuccugaggaaauacauuc

SEQ ID NO: 958241 - RNA, 22 nt, Human
cuggccaagcacuggggucaaa

SEQ ID NO: 958242 - RNA, 22 nt, Human
aaguuugugucagagcuguuac

SEQ ID NO: 958243 - RNA, 22 nt, Human
cacccacauggaaauucacagu

SEQ ID NO: 958244 - RNA, 22 nt, Human
ucuggccagaaagacuugaugu

SEQ ID NO: 958245 - RNA, 22 nt, Human
acacucugugaggcauguaaug

SEQ ID NO: 958246 - RNA, 22 nt, Human
ccuccugggacucauuagcacc

SEQ ID NO: 958247 - RNA, 17 nt, Human
acuccuggucugaaggg

SEQ ID NO: 958248 - RNA, 22 nt, Human
uuauguagcagaaagauguuug

SEQ ID NO: 958249 - RNA, 22 nt, Human
uauccaaacauauagucucucu

SEQ ID NO: 958250 - RNA, 21 nt, Human
ucugagagcaacugcccuuua

SEQ ID NO: 958251 - RNA, 22 nt, Human
gaaaaugugucaucccuacugu

SEQ ID NO: 958252 - RNA, 22 nt, Human
guggccaaacaccaguuuagga

SEQ ID NO: 958253 - RNA, 22 nt, Human
auuagguaagauaaagcagagg

SEQ ID NO: 958254 - RNA, 22 nt, Human
aagaguaugcaugcauguuugu

SEQ ID NO: 958255 - RNA, 22 nt, Human
ccucugcucccuggugucugag

SEQ ID NO: 958256 - RNA, 22 nt, Human
aaagcuauuugugaguuauaga

SEQ ID NO: 958257 - RNA, 22 nt, Human
uaaugaugugugcaaacugaau

SEQ ID NO: 958258 - RNA, 22 nt, Human
ugucccaguuggguauugaauu

SEQ ID NO: 958259 - RNA, 22 nt, Human
aggauuuugacuuauucaggga

SEQ ID NO: 958260 - RNA, 22 nt, Human
uuucuuaguccuagagugauuu

SEQ ID NO: 958261 - RNA, 22 nt, Human
ucauugaauuugguucaauaug

SEQ ID NO: 958262 - RNA, 22 nt, Human
aggagacaucuaacuguagguu

SEQ ID NO: 958263 - RNA, 22 nt, Human
aaacccaucugucugucugcag

SEQ ID NO: 958264 - RNA, 22 nt, Human
aaacauucucagcccugcuugc

SEQ ID NO: 958265 - RNA, 22 nt, Human
agaaguauaaagaauguuuaug

SEQ ID NO: 958266 - RNA, 22 nt, Human
uuauuuggguuugaguguggca

SEQ ID NO: 958267 - RNA, 22 nt, Human
guucacaauggcuuuaccuaag

SEQ ID NO: 958268 - RNA, 22 nt, Human
cauguguaugcauucauacaua

SEQ ID NO: 958269 - RNA, 22 nt, Human
cucucuggcacuucauugcugu

SEQ ID NO: 958270 - RNA, 22 nt, Human
auggccaagcaugccuguggcc

SEQ ID NO: 958271 - RNA, 22 nt, Human
uaaguauguuagaaaaucaagu

SEQ ID NO: 958272 - RNA, 22 nt, Human
gucugucuguuguugagaagca

SEQ ID NO: 958273 - RNA, 22 nt, Human
uaaaaguaggaaugaaacgcau

SEQ ID NO: 958274 - RNA, 22 nt, Human
uuggccaaacagaguucaacag

SEQ ID NO: 958275 - RNA, 22 nt, Human
gagaggggcgcgcagcucgcga

SEQ ID NO: 958276 - RNA, 22 nt, Human
ucugaagccuuuguacaggccu

SEQ ID NO: 958277 - RNA, 22 nt, Human
uucaggauucuuucagacuggg

SEQ ID NO: 958278 - RNA, 22 nt, Human
ucuggccaggggucccugaagg

SEQ ID NO: 958279 - RNA, 22 nt, Human
gauuuggccuuucgcaugguau

SEQ ID NO: 958280 - RNA, 22 nt, Human
aggauuugaaccugcauccagu

SEQ ID NO: 958281 - RNA, 22 nt, Human
uuggccaaauaaucuugcagau

SEQ ID NO: 958282 - RNA, 22 nt, Human
acagucauuagauacaaugucu

SEQ ID NO: 958283 - RNA, 22 nt, Human
ucacuaaguuacauuuaguauu

SEQ ID NO: 958284 - RNA, 20 nt, Human
uaacauaguccagagaacga

SEQ ID NO: 958285 - RNA, 22 nt, Human
uacuaggaagcagcugcauugg

SEQ ID NO: 958286 - RNA, 22 nt, Human
cagcuuuuuagaaucuagggca

SEQ ID NO: 958287 - RNA, 22 nt, Human
uucagcaacucaaaccuauuag

SEQ ID NO: 958288 - RNA, 22 nt, Human
aacauuucagcaaauaagaaca

SEQ ID NO: 958289 - RNA, 22 nt, Human
auggccaagcauauacagauug

SEQ ID NO: 958290 - RNA, 19 nt, Human
ccuggccagacuucugccc

SEQ ID NO: 958291 - RNA, 22 nt, Human
agacauuuggaagauacacaua

SEQ ID NO: 958292 - RNA, 22 nt, Human
aaacacagggauauauauucca

SEQ ID NO: 958293 - RNA, 22 nt, Human
caaaaguaauugugguuuuugc

SEQ ID NO: 958294 - RNA, 20 nt, Human
uacuuaggcuuguuuuggcc

SEQ ID NO: 958295 - RNA, 22 nt, Human
cugggccagaccuuguggucuu

SEQ ID NO: 958296 - RNA, 22 nt, Human
uaaaaaguagugagaauggcgc

SEQ ID NO: 958297 - RNA, 22 nt, Human
aauucacauguugaaguccuaa

SEQ ID NO: 958298 - RNA, 22 nt, Human
gcaauaaauaacauggaagaca

SEQ ID NO: 958299 - RNA, 22 nt, Human
guauuaggugguggaauuguag

SEQ ID NO: 958300 - RNA, 16 nt, Human
gucuggccuaccugcc

SEQ ID NO: 958301 - RNA, 22 nt, Human
uuauuagggugguuuauguucu

SEQ ID NO: 958302 - RNA, 22 nt, Human
aaacaccagcacuguuuacaaa

SEQ ID NO: 958303 - RNA, 22 nt, Human
uuagugauaggaagccagauug

SEQ ID NO: 958304 - RNA, 22 nt, Human
auucuuuucccaacugcuuuaa

SEQ ID NO: 958305 - RNA, 22 nt, Human
aucauuuaaaacaagucucuau

SEQ ID NO: 958306 - RNA, 22 nt, Human
gcuggccacauugugccguccu

SEQ ID NO: 958307 - RNA, 22 nt, Human
uuauuagguuauucucuguacu

SEQ ID NO: 958308 - RNA, 22 nt, Human
uuucaaauaccauaaaccuaau

SEQ ID NO: 958309 - RNA, 22 nt, Human
uauuuaaaaagaggccagcugg

SEQ ID NO: 958310 - RNA, 22 nt, Human
aaauauguauggaguucaugaa

SEQ ID NO: 958311 - RNA, 22 nt, Human
uuggcagcccagcuuacuagca

SEQ ID NO: 958312 - RNA, 22 nt, Human
uuuauuaaaacuguuggcucug

SEQ ID NO: 958313 - RNA, 22 nt, Human
ugguccaagugagguggccucu

SEQ ID NO: 958314 - RNA, 20 nt, Human
uuggcagcagcucagccacc

SEQ ID NO: 958315 - RNA, 22 nt, Human
ccuccugggcuccugucugcac

SEQ ID NO: 958316 - RNA, 22 nt, Human
uuucacaaacugaggagacaau

SEQ ID NO: 958317 - RNA, 23 nt, Human
cacuccuguuucuaagccagcau

SEQ ID NO: 958318 - RNA, 21 nt, Human
uuucacaaaaguaugugacaa

SEQ ID NO: 958319 - RNA, 22 nt, Human
guuuaaguuucagaagcuaaga

SEQ ID NO: 958320 - RNA, 21 nt, Human
auguaggaguuauuggaacag

SEQ ID NO: 958321 - RNA, 22 nt, Human
auuagagaaugugcugacauug

SEQ ID NO: 958322 - RNA, 22 nt, Human
uagggauguaaacauaguaauu

SEQ ID NO: 958323 - RNA, 22 nt, Human
guugaaaugagggauuaaucag

SEQ ID NO: 958324 - RNA, 22 nt, Human
auuuggauucuuauuuagcacu

SEQ ID NO: 958325 - RNA, 22 nt, Human
aguguacaguuuguaguacuac

SEQ ID NO: 958326 - RNA, 22 nt, Human
aacuaaaucuggcauuuagagc

SEQ ID NO: 958327 - RNA, 22 nt, Human
aauucacagcauuugcccaucu

SEQ ID NO: 958328 - RNA, 22 nt, Human
uuggccaaaggaaagacuacug

SEQ ID NO: 958329 - RNA, 22 nt, Human
uaaauaaguucuucauuguuug

SEQ ID NO: 958330 - RNA, 22 nt, Human
ucuccugguauguaugcaccug

SEQ ID NO: 958331 - RNA, 23 nt, Human
uuucacaaugagcauuacagaau

SEQ ID NO: 958332 - RNA, 22 nt, Human
acucugcuaaauguaaguuggu

SEQ ID NO: 958333 - RNA, 22 nt, Human
acuggccaggcacagcuguggg

SEQ ID NO: 958334 - RNA, 22 nt, Human
gucuggccuuuuuagcuugugg

SEQ ID NO: 958335 - RNA, 22 nt, Human
uguagaaagaauauguuucaua

SEQ ID NO: 958336 - RNA, 22 nt, Human
cagagagggcggcccuggcuuc

SEQ ID NO: 958337 - RNA, 20 nt, Human
guauuaggagguaaauguaa

SEQ ID NO: 958338 - RNA, 22 nt, Human
aacacaaagaagcugcaggauc

SEQ ID NO: 958339 - RNA, 22 nt, Human
ccuccugggagagcacggaggg

SEQ ID NO: 958340 - RNA, 22 nt, Human
agacaggagagggaacugccgg

SEQ ID NO: 958341 - RNA, 22 nt, Human
cuguuuauagcagagcaagccu

SEQ ID NO: 958342 - RNA, 22 nt, Human
aacaauaauugcgguucucuau

SEQ ID NO: 958343 - RNA, 22 nt, Human
uuuuauauggcacauugguugg

SEQ ID NO: 958344 - RNA, 22 nt, Human
cugaccaucauggugaaacccc

SEQ ID NO: 958345 - RNA, 22 nt, Human
uacaaaaaauugauacugacga

SEQ ID NO: 958346 - RNA, 22 nt, Human
acaccuuucagguccagacagu

SEQ ID NO: 958347 - RNA, 22 nt, Human
ggcagcauuuagagcacagugu

SEQ ID NO: 958348 - RNA, 22 nt, Human
uggagccagagcgcagccuggg

SEQ ID NO: 958349 - RNA, 23 nt, Human
ggccacaaauagucuccccuggc

SEQ ID NO: 958350 - RNA, 22 nt, Human
uaguuauuauuguuacuaucag

SEQ ID NO: 958351 - RNA, 22 nt, Human
cuccugggcucauaucauucag

SEQ ID NO: 958352 - RNA, 22 nt, Human
guggccaauuuccaucuguaag

SEQ ID NO: 958353 - RNA, 22 nt, Human
caaaaguagugaaguuguacau

SEQ ID NO: 958354 - RNA, 22 nt, Human
acauucuuaacaguuaaaaacu

SEQ ID NO: 958355 - RNA, 22 nt, Human
caauaaguaauaggcaucuaau

SEQ ID NO: 958356 - RNA, 23 nt, Human
uccugaggguuucccagccuugg

SEQ ID NO: 958357 - RNA, 22 nt, Human
uauuagguuggugcaacaguaa

SEQ ID NO: 958358 - RNA, 22 nt, Human
uguuggcaucucugagagaguu

SEQ ID NO: 958359 - RNA, 22 nt, Human
caacccaagguuaguuggucuu

SEQ ID NO: 958360 - RNA, 22 nt, Human
uagaauguaaauuccaagggca

SEQ ID NO: 958361 - RNA, 22 nt, Human
cuucugagcagaccuccugggg

SEQ ID NO: 958362 - RNA, 22 nt, Human
uaaaaaguugaaaggacuuauc

SEQ ID NO: 958363 - RNA, 21 nt, Human
acucugcugcgggcuuggccu

SEQ ID NO: 958364 - RNA, 22 nt, Human
uggcacauaguaggugcucaau

SEQ ID NO: 958365 - RNA, 22 nt, Human
ucuuggccccaccugugccagc

SEQ ID NO: 958366 - RNA, 22 nt, Human
uccugagcuucaaaacacuuug

SEQ ID NO: 958367 - RNA, 22 nt, Human
caacaaguggguacuuuacagg

SEQ ID NO: 958368 - RNA, 22 nt, Human
aaugugcagaugaauaaacaaa

SEQ ID NO: 958369 - RNA, 22 nt, Human
ucagggaaauuuccauguguuu

SEQ ID NO: 958370 - RNA, 22 nt, Human
aacauuucugagaauaucaguu

SEQ ID NO: 958371 - RNA, 22 nt, Human
auguuguagcauaugaaauaua

SEQ ID NO: 958372 - RNA, 22 nt, Human
uuggccaauuuagaacguguug

SEQ ID NO: 958373 - RNA, 22 nt, Human
auggccaagaaauugccgacug

SEQ ID NO: 958374 - RNA, 21 nt, Human
uuuauuaacaacuguggacgu

SEQ ID NO: 958375 - RNA, 22 nt, Human
ugcauguuauuguggcaagaau

SEQ ID NO: 958376 - RNA, 22 nt, Human
aggccaaagcucaccugcagcu

SEQ ID NO: 958377 - RNA, 22 nt, Human
agaauaugaggaaacugugaau

SEQ ID NO: 958378 - RNA, 22 nt, Human
cacaguuucuauaggucagaau

SEQ ID NO: 958379 - RNA, 22 nt, Human
gcucugcugucuucuugcaggc

SEQ ID NO: 958380 - RNA, 22 nt, Human
uggucuaaauauggcucuaaau

SEQ ID NO: 958381 - RNA, 22 nt, Human
auggccaaaucuaaacuguugg

SEQ ID NO: 958382 - RNA, 22 nt, Human
gaaaaagugaccuugguagcua

SEQ ID NO: 958383 - RNA, 22 nt, Human
aaacugccuccugggcaacuaa

SEQ ID NO: 958384 - RNA, 22 nt, Human
uaagucaugauucuguguuacu

SEQ ID NO: 958385 - RNA, 19 nt, Human
gcuccuggaugaccugugg

SEQ ID NO: 958386 - RNA, 22 nt, Human
ccagacaggaacacacaucucc

SEQ ID NO: 958387 - RNA, 22 nt, Human
cagucauuuuauuugaaaauua

SEQ ID NO: 958388 - RNA, 22 nt, Human
ucaaaacacuauuaccuuuaau

SEQ ID NO: 958389 - RNA, 22 nt, Human
ucagggaaucagacucugcagc

SEQ ID NO: 958390 - RNA, 22 nt, Human
ucacaagaauuuguagaugaaa

SEQ ID NO: 958391 - RNA, 22 nt, Human
caaaaguaccuugugugcuuug

SEQ ID NO: 958392 - RNA, 22 nt, Human
uuuucauuguuccucgagcauu

SEQ ID NO: 958393 - RNA, 22 nt, Human
ucuccugguuuguuaaauaauu

SEQ ID NO: 958394 - RNA, 22 nt, Human
gugauaaagacgugucauaauu

SEQ ID NO: 958395 - RNA, 18 nt, Human
aaguaugccuauguuauu

SEQ ID NO: 958396 - RNA, 22 nt, Human
uccuggcccgaucccugugaag

SEQ ID NO: 958397 - RNA, 22 nt, Human
cuuccugggcaauguucugcuu

SEQ ID NO: 958398 - RNA, 22 nt, Human
gcacucugccaggucuccugau

SEQ ID NO: 958399 - RNA, 22 nt, Human
gaaaaguaaacacuagggguca

SEQ ID NO: 958400 - RNA, 22 nt, Human
uggcucaagugauccuccugcc

SEQ ID NO: 958401 - RNA, 22 nt, Human
ggucuaaaaugagucuuccuag

SEQ ID NO: 958402 - RNA, 17 nt, Human
agcugaaauugcugaag

SEQ ID NO: 958403 - RNA, 22 nt, Human
acaccuuuuauucgccaggcac

SEQ ID NO: 958404 - RNA, 22 nt, Human
uaggaugaucuuguagagagau

SEQ ID NO: 958405 - RNA, 22 nt, Human
uguuggcauuagaggguuauug

SEQ ID NO: 958406 - RNA, 22 nt, Human
uguuuaauugggccaacagcgg

SEQ ID NO: 958407 - RNA, 22 nt, Human
auuuauuaugggauuuggcuca

SEQ ID NO: 958408 - RNA, 23 nt, Human
auauuagggagauuagcccucua

SEQ ID NO: 958409 - RNA, 22 nt, Human
augauguuaccaguacuuagag

SEQ ID NO: 958410 - RNA, 22 nt, Human
aaagcagcagcaccugcauuuc

SEQ ID NO: 958411 - RNA, 22 nt, Human
aacucugcagugacuuauaaag

SEQ ID NO: 958412 - RNA, 22 nt, Human
uauagcaagcaggacagucuca

SEQ ID NO: 958413 - RNA, 22 nt, Human
uggaagagaaaggaguggaucu

SEQ ID NO: 958414 - RNA, 22 nt, Human
acauuuuuuagagucccacauu

SEQ ID NO: 958415 - RNA, 22 nt, Human
uucagcaagugucucuacuguc

SEQ ID NO: 958416 - RNA, 22 nt, Human
aagggcugagcacagugagcca

SEQ ID NO: 958417 - RNA, 22 nt, Human
ggccaaaccgcaauuauuuuug

SEQ ID NO: 958418 - RNA, 22 nt, Human
uauuggucuuggaagguuuugu

SEQ ID NO: 958419 - RNA, 22 nt, Human
acuccugguuuguguccuggcu

SEQ ID NO: 958420 - RNA, 19 nt, Human
agucugcauuucuagcaag

SEQ ID NO: 958421 - RNA, 22 nt, Human
uguaggauguaaggcaggcauc

SEQ ID NO: 958422 - RNA, 22 nt, Human
ucuggccaacccucaaguugua

SEQ ID NO: 958423 - RNA, 22 nt, Human
ggccacaagugguccugagucc

SEQ ID NO: 958424 - RNA, 22 nt, Human
auucacaacugauccuugcuca

SEQ ID NO: 958425 - RNA, 22 nt, Human
uuuauauagagauuugugcaug

SEQ ID NO: 958426 - RNA, 22 nt, Human
ugcaaaugaguugcagaucagg

SEQ ID NO: 958427 - RNA, 22 nt, Human
cugggccaagaaguuguguaug

SEQ ID NO: 958428 - RNA, 22 nt, Human
uaaccuuuggugaaauauuaac

SEQ ID NO: 958429 - RNA, 22 nt, Human
cucauacauaugccauuccugc

SEQ ID NO: 958430 - RNA, 16 nt, Human
gcucugcugaggccca

SEQ ID NO: 958431 - RNA, 22 nt, Human
cugugccaggcccagcugacuu

SEQ ID NO: 958432 - RNA, 22 nt, Human
caauagaaaacucaauacuuaa

SEQ ID NO: 958433 - RNA, 22 nt, Human
agcuauguauaaauaggccacu

SEQ ID NO: 958434 - RNA, 22 nt, Human
cucucugcaaguuuugaaauag

SEQ ID NO: 958435 - RNA, 18 nt, Human
cugaggccaacuacacug

SEQ ID NO: 958436 - RNA, 22 nt, Human
aaguuuguucagggcuuacauu

SEQ ID NO: 958437 - RNA, 22 nt, Human
uuuuuuauaucaacugaagucu

SEQ ID NO: 958438 - RNA, 22 nt, Human
aaagauguuuuauaaguuaugg

SEQ ID NO: 958439 - RNA, 22 nt, Human
gaucuuggggggaucaccaugg

SEQ ID NO: 958440 - RNA, 22 nt, Human
aauaggcaguuggauaugcaag

SEQ ID NO: 958441 - RNA, 22 nt, Human
ccugguccuuacgucauugcuu

SEQ ID NO: 958442 - RNA, 22 nt, Human
cuggucaaggagagucucugca

SEQ ID NO: 958443 - RNA, 22 nt, Human
cugagccagggccacacaugga

SEQ ID NO: 958444 - RNA, 22 nt, Human
auggccaaggggccuaggcagg

SEQ ID NO: 958445 - RNA, 20 nt, Human
ugagccaaacgaugaagagc

SEQ ID NO: 958446 - RNA, 22 nt, Human
auguuauaguuauaaaaugagg

SEQ ID NO: 958447 - RNA, 22 nt, Human
ccugggcaggccggacgcuggg

SEQ ID NO: 958448 - RNA, 22 nt, Human
gggaagauaguguugagggccc

SEQ ID NO: 958449 - RNA, 22 nt, Human
cugggccaucuccuuugugugg

SEQ ID NO: 958450 - RNA, 22 nt, Human
gcagggaagggaaacagagacc

SEQ ID NO: 958451 - RNA, 22 nt, Human
uauauuaguggaaugauaugaa

SEQ ID NO: 958452 - RNA, 22 nt, Human
guuaauaaagguauagaaucag

SEQ ID NO: 958453 - RNA, 22 nt, Human
augguacaauguguuuguuagg

SEQ ID NO: 958454 - RNA, 22 nt, Human
gcagacaucaagcacaggccca

SEQ ID NO: 958455 - RNA, 22 nt, Human
uuuaguagugacagauucuggg

SEQ ID NO: 958456 - RNA, 18 nt, Human
ucuuggcagcaucuggca

SEQ ID NO: 958457 - RNA, 22 nt, Human
auggccaagaauauuucucaac

SEQ ID NO: 958458 - RNA, 22 nt, Human
aaugccuuggagagccuagagg

SEQ ID NO: 958459 - RNA, 22 nt, Human
cugggccacaagccugugugau

SEQ ID NO: 958460 - RNA, 22 nt, Human
acacuucuauucccugcacaaa

SEQ ID NO: 958461 - RNA, 20 nt, Human
acauggaaggucaaacuauc

SEQ ID NO: 958462 - RNA, 22 nt, Human
cgcaccacugaauuccagccug

SEQ ID NO: 958463 - RNA, 22 nt, Human
cugagccaccggcagggacauc

SEQ ID NO: 958464 - RNA, 22 nt, Human
aaacacuagcaggaagcacuga

SEQ ID NO: 958465 - RNA, 22 nt, Human
uuuuauuaucuuugaaugggac

SEQ ID NO: 958466 - RNA, 22 nt, Human
cuucacaaaauauuucauuaua

SEQ ID NO: 958467 - RNA, 22 nt, Human
gacuccuggcuuucccucuuag

SEQ ID NO: 958468 - RNA, 22 nt, Human
aaaauaacuucuacuauuugca

SEQ ID NO: 958469 - RNA, 22 nt, Human
aaaagagucuuaggcagucaua

SEQ ID NO: 958470 - RNA, 22 nt, Human
aaugauguauguauaaggcagg

SEQ ID NO: 958471 - RNA, 22 nt, Human
cagacauauguuuuaacagauu

SEQ ID NO: 958472 - RNA, 22 nt, Human
aguaugaagaugaugaaaaaua

SEQ ID NO: 958473 - RNA, 22 nt, Human
ggucugaguggggccugagauu

SEQ ID NO: 958474 - RNA, 22 nt, Human
cugcucacgccaccguucauca

SEQ ID NO: 958475 - RNA, 20 nt, Human
ucuguaaagacuccagaagc

SEQ ID NO: 958476 - RNA, 22 nt, Human
caaaacauucagagagcucacu

SEQ ID NO: 958477 - RNA, 22 nt, Human
uaacauuccucaaaguuuucag

SEQ ID NO: 958478 - RNA, 22 nt, Human
ucacucugggccagcgcaggua

SEQ ID NO: 958479 - RNA, 22 nt, Human
caaaaguaauugcgguuuuugc

SEQ ID NO: 958480 - RNA, 22 nt, Human
gaaaaguauguuuauuuugacu

SEQ ID NO: 958481 - RNA, 22 nt, Human
ucugagccguauggcuuggcua

SEQ ID NO: 958482 - RNA, 18 nt, Human
ucagggaaucuuggccuu

SEQ ID NO: 958483 - RNA, 22 nt, Human
ugaaauguaaauaggacuagaa

SEQ ID NO: 958484 - RNA, 22 nt, Human
gacagagaggcugagcaguaca

SEQ ID NO: 958485 - RNA, 22 nt, Human
aacuucuggauguuucaaaugu

SEQ ID NO: 958486 - RNA, 22 nt, Human
auaaaagaaguuuugguacuug

SEQ ID NO: 958487 - RNA, 22 nt, Human
uggcagacuuuagggucuacau

SEQ ID NO: 958488 - RNA, 22 nt, Human
uuauuaugguauuucuuugcag

SEQ ID NO: 958489 - RNA, 22 nt, Human
uggcaagccugagauccgggag

SEQ ID NO: 958490 - RNA, 22 nt, Human
acucugcuguuuacucucuaua

SEQ ID NO: 958491 - RNA, 22 nt, Human
cuucugaggcagcuauucaguu

SEQ ID NO: 958492 - RNA, 22 nt, Human
ugcaccuucauuuuaggcagcu

SEQ ID NO: 958493 - RNA, 22 nt, Human
acuccaggguuuugcaccugga

SEQ ID NO: 958494 - RNA, 22 nt, Human
aauguacaaaagucagccaacu

SEQ ID NO: 958495 - RNA, 22 nt, Human
caguuuaaaugagugacugcag

SEQ ID NO: 958496 - RNA, 22 nt, Human
acucucugguauuggcaaguuu

SEQ ID NO: 958497 - RNA, 22 nt, Human
uccaagggaauuuaaaguugcu

SEQ ID NO: 958498 - RNA, 22 nt, Human
auauugaacccuacagacugua

SEQ ID NO: 958499 - RNA, 22 nt, Human
aaguaugugauacauguuaauu

SEQ ID NO: 958500 - RNA, 22 nt, Human
aauauuaauagaagggguucua

SEQ ID NO: 958501 - RNA, 22 nt, Human
cuuuguaucuaaauaucuugaa

SEQ ID NO: 958502 - RNA, 18 nt, Human
uugauaaacaauuucauu

SEQ ID NO: 958503 - RNA, 22 nt, Human
auuauaaagaacaugugugugg

SEQ ID NO: 958504 - RNA, 19 nt, Human
uggcagcauugguaccuug

SEQ ID NO: 958505 - RNA, 20 nt, Human
uugaggagauauugaauacu

SEQ ID NO: 958506 - RNA, 22 nt, Human
gcucugcuugcaucaugacugc

SEQ ID NO: 958507 - RNA, 16 nt, Human
gcuccugggcccucga

SEQ ID NO: 958508 - RNA, 22 nt, Human
uccaagggcagcagccauagcc

SEQ ID NO: 958509 - RNA, 17 nt, Human
ccacucaguaauuucuc

SEQ ID NO: 958510 - RNA, 22 nt, Human
auuuacagaagcauguaauagc

SEQ ID NO: 958511 - RNA, 22 nt, Human
cuggcacaaugucacuuuugcu

SEQ ID NO: 958512 - RNA, 22 nt, Human
acuccagguuuuuucacugaag

SEQ ID NO: 958513 - RNA, 20 nt, Human
auucacaaagccaguguugc

SEQ ID NO: 958514 - RNA, 21 nt, Human
aaaaagcuggggcaugcaugc

SEQ ID NO: 958515 - RNA, 22 nt, Human
gcuccuggccagcacagggccc

SEQ ID NO: 958516 - RNA, 22 nt, Human
acauuucagcgugcaugacaug

SEQ ID NO: 958517 - RNA, 22 nt, Human
gaacccaaaccuggaccucccu

SEQ ID NO: 958518 - RNA, 22 nt, Human
cuggcacacaaguauuuccuuu

SEQ ID NO: 958519 - RNA, 19 nt, Human
gcuggccacgccccaguug

SEQ ID NO: 958520 - RNA, 22 nt, Human
ggcagcaucacuugucuccagc

SEQ ID NO: 958521 - RNA, 22 nt, Human
uuuaguagaaauauuugggccu

SEQ ID NO: 958522 - RNA, 22 nt, Human
cagccuuuuaggacuauuugug

SEQ ID NO: 958523 - RNA, 22 nt, Human
ucuccuggagcaggaagguggg

SEQ ID NO: 958524 - RNA, 22 nt, Human
aauaagaaagagucagcuucag

SEQ ID NO: 958525 - RNA, 22 nt, Human
uugcaguugucuuuccuaauuu

SEQ ID NO: 958526 - RNA, 22 nt, Human
auucacaaagaagggaaguaca

SEQ ID NO: 958527 - RNA, 22 nt, Human
gcucugcugagauaucugggag

SEQ ID NO: 958528 - RNA, 22 nt, Human
caccuugugauccucuugccuu

SEQ ID NO: 958529 - RNA, 22 nt, Human
aagccuugcagcauuaggcucu

SEQ ID NO: 958530 - RNA, 21 nt, Human
ccugggccaaauucccuggac

SEQ ID NO: 958531 - RNA, 20 nt, Human
ucaccuuuguugguauucau

SEQ ID NO: 958532 - RNA, 21 nt, Human
cuccugggcuaagauauagug

SEQ ID NO: 958533 - RNA, 22 nt, Human
uauuagugaaagaauuaguuug

SEQ ID NO: 958534 - RNA, 22 nt, Human
uagaauaugugguaggaucugg

SEQ ID NO: 958535 - RNA, 22 nt, Human
uuaguuaggaaacaaaguuguu

SEQ ID NO: 958536 - RNA, 22 nt, Human
gauuucuuuagguguaauagug

SEQ ID NO: 958537 - RNA, 22 nt, Human
ggaugcacgaaggcgccucgga

SEQ ID NO: 958538 - RNA, 22 nt, Human
cggccaaauugcagagagaagc

SEQ ID NO: 958539 - RNA, 22 nt, Human
uuauuaggaaaaggucagaugu

SEQ ID NO: 958540 - RNA, 22 nt, Human
uauauuaaacccucucuguagg

SEQ ID NO: 958541 - RNA, 19 nt, Human
cugaggcccauguaccaug

SEQ ID NO: 958542 - RNA, 22 nt, Human
aaguuuaagguggaaguggugg

SEQ ID NO: 958543 - RNA, 22 nt, Human
cuggccaguugccuuccugggu

SEQ ID NO: 958544 - RNA, 20 nt, Human
uguccuaauagacaagcaga

SEQ ID NO: 958545 - RNA, 22 nt, Human
auuauuagugauguuguuacug

SEQ ID NO: 958546 - RNA, 22 nt, Human
uggccacauccuuuccuuguca

SEQ ID NO: 958547 - RNA, 22 nt, Human
acuggccagaacuaagucacau

SEQ ID NO: 958548 - RNA, 22 nt, Human
aauuaggagaaaacuguugucu

SEQ ID NO: 958549 - RNA, 22 nt, Human
ucacucugguccauccgagagc

SEQ ID NO: 958550 - RNA, 22 nt, Human
uccuggccuuauccccaaacug

SEQ ID NO: 958551 - RNA, 22 nt, Human
uuaauguguguacaggauuuug

SEQ ID NO: 958552 - RNA, 22 nt, Human
gcuccugggcccugggcuaacu

SEQ ID NO: 958553 - RNA, 22 nt, Human
aaauauagcaauuaugccuacu

SEQ ID NO: 958554 - RNA, 22 nt, Human
auuaggacacauacauguacag

SEQ ID NO: 958555 - RNA, 22 nt, Human
auauauaaccuggauaaggcuu

SEQ ID NO: 958556 - RNA, 21 nt, Human
aaguuuguucuuguauagucu

SEQ ID NO: 958557 - RNA, 20 nt, Human
caguuuaacuuugagcaguu

SEQ ID NO: 958558 - RNA, 22 nt, Human
caaguaugagaaagcuauuacc

SEQ ID NO: 958559 - RNA, 22 nt, Human
uuuauuagugcuuguaucacug

SEQ ID NO: 958560 - RNA, 22 nt, Human
uaauaaaugaaagugcuggcau

SEQ ID NO: 958561 - RNA, 22 nt, Human
uggcacauagcagguacucagu

SEQ ID NO: 958562 - RNA, 22 nt, Human
agcaugcgcuugaucagcucca

SEQ ID NO: 958563 - RNA, 22 nt, Human
uccuggccuugcuccugaugcc

SEQ ID NO: 958564 - RNA, 22 nt, Human
aauccuggaauacaagagugaa

SEQ ID NO: 958565 - RNA, 21 nt, Human
uccuggcccacucuaucccca

SEQ ID NO: 958566 - RNA, 22 nt, Human
guuuauuagaguuuucugucug

SEQ ID NO: 958567 - RNA, 22 nt, Human
acuaacauguuaaucaaaagaa

SEQ ID NO: 958568 - RNA, 22 nt, Human
uagaauaaguugaugauauaug

SEQ ID NO: 958569 - RNA, 22 nt, Human
agcuuuguauuugagcauacga

SEQ ID NO: 958570 - RNA, 22 nt, Human
ugcugaaacaauaacauacugg

SEQ ID NO: 958571 - RNA, 22 nt, Human
uucaggaugaaagugugcaaca

SEQ ID NO: 958572 - RNA, 22 nt, Human
aaauauguaaccaaggugaagu

SEQ ID NO: 958573 - RNA, 22 nt, Human
auuagguugugcuuuguggaca

SEQ ID NO: 958574 - RNA, 22 nt, Human
ucuccugggcuugguugaaguu

SEQ ID NO: 958575 - RNA, 22 nt, Human
acuuugaaggggaacauuuuaa

SEQ ID NO: 958576 - RNA, 19 nt, Human
ucucacaguuuccuugccu

SEQ ID NO: 958577 - RNA, 22 nt, Human
guucacaagcugauugucuuuc

SEQ ID NO: 958578 - RNA, 18 nt, Human
auguauguacauauuuau

SEQ ID NO: 958579 - RNA, 22 nt, Human
gaaacacaugcagcuccauaga

SEQ ID NO: 958580 - RNA, 17 nt, Human
auucuuugaugucucug

SEQ ID NO: 958581 - RNA, 22 nt, Human
cuuauaguaugauguugagaau

SEQ ID NO: 958582 - RNA, 22 nt, Human
uauauuaacacccacuugccuc

SEQ ID NO: 958583 - RNA, 22 nt, Human
uuccuggcauagagagggcaca

SEQ ID NO: 958584 - RNA, 22 nt, Human
aaauguuagguuguacugaguc

SEQ ID NO: 958585 - RNA, 22 nt, Human
cuggcccagagcucuggccuuu

SEQ ID NO: 958586 - RNA, 22 nt, Human
ggcaagcauaaccuguacagcc

SEQ ID NO: 958587 - RNA, 22 nt, Human
uggcagcagggccccuggagga

SEQ ID NO: 958588 - RNA, 22 nt, Human
gacauacagcauggucuaugaa

SEQ ID NO: 958589 - RNA, 22 nt, Human
uccugggcuuaagugauccucc

SEQ ID NO: 958590 - RNA, 22 nt, Human
aggauaguugugaagauaggcu

SEQ ID NO: 958591 - RNA, 22 nt, Human
uuaggauaugaaacaguauaag

SEQ ID NO: 958592 - RNA, 22 nt, Human
aacacauauuuauauaugcaca

SEQ ID NO: 958593 - RNA, 22 nt, Human
aaauaguuagcccugcauauau

SEQ ID NO: 958594 - RNA, 20 nt, Human
ucuccuggucugguccgugc

SEQ ID NO: 958595 - RNA, 17 nt, Human
ugaagaugcauggcagc

SEQ ID NO: 958596 - RNA, 22 nt, Human
cagacagggaccucgcuccaga

SEQ ID NO: 958597 - RNA, 22 nt, Human
acauucuaacauuguacagaua

SEQ ID NO: 958598 - RNA, 22 nt, Human
cauuccuuaacguggggagucu

SEQ ID NO: 958599 - RNA, 22 nt, Human
cuucaaacccagauuaaaugca

SEQ ID NO: 958600 - RNA, 20 nt, Human
cauuggacuuggcuucaugg

SEQ ID NO: 958601 - RNA, 22 nt, Human
cuccuggaagcccgcccugcug

SEQ ID NO: 958602 - RNA, 22 nt, Human
guugaaauccuaacccccuagu

SEQ ID NO: 958603 - RNA, 21 nt, Human
uggccaaaaccauauuauuaa

SEQ ID NO: 958604 - RNA, 22 nt, Human
auuauuaggugcucucugacaa

SEQ ID NO: 958605 - RNA, 22 nt, Human
uggcaccaggcgggguggcugu

SEQ ID NO: 958606 - RNA, 19 nt, Human
ucauaaaaaugguaaccca

SEQ ID NO: 958607 - RNA, 22 nt, Human
auaugaaaguaagcaugugugu

SEQ ID NO: 958608 - RNA, 22 nt, Human
uugaaauacugcauuguucagu

SEQ ID NO: 958609 - RNA, 22 nt, Human
ugcauuccauguguuuccugag

SEQ ID NO: 958610 - RNA, 22 nt, Human
agccauuggcugccuggugcgu

SEQ ID NO: 958611 - RNA, 22 nt, Human
cagcugacgccagaguggaauu

SEQ ID NO: 958612 - RNA, 22 nt, Human
acauagaaccuggcacauagua

SEQ ID NO: 958613 - RNA, 22 nt, Human
augcccugaggaaugucacgcu

SEQ ID NO: 958614 - RNA, 22 nt, Human
gaaauauucuugucuuguuuuc

SEQ ID NO: 958615 - RNA, 22 nt, Human
aauuaggaaaugagaguauuug

SEQ ID NO: 958616 - RNA, 22 nt, Human
auuaaauacugcaggcuaagca

SEQ ID NO: 958617 - RNA, 22 nt, Human
gcaccuuuggaaugaaaaguug

SEQ ID NO: 958618 - RNA, 22 nt, Human
acuggccagguucaaaauacag

SEQ ID NO: 958619 - RNA, 22 nt, Human
uuccuggccccaccccuggaga

SEQ ID NO: 958620 - RNA, 22 nt, Human
cagggucuuauaaggccaauuu

SEQ ID NO: 958621 - RNA, 22 nt, Human
uaaaaguauacuuucaaaggag

SEQ ID NO: 958622 - RNA, 22 nt, Human
cugggccagggaggugucugua

SEQ ID NO: 958623 - RNA, 22 nt, Human
uuggcagagaguaugcugaaga

SEQ ID NO: 958624 - RNA, 22 nt, Human
auuaggacagagaugucaagag

SEQ ID NO: 958625 - RNA, 22 nt, Human
gaguuuaaagcauacauauuuu

SEQ ID NO: 958626 - RNA, 22 nt, Human
gauuaggacauggauguauguu

SEQ ID NO: 958627 - RNA, 22 nt, Human
aggccaaagcacagagcuggaa

SEQ ID NO: 958628 - RNA, 22 nt, Human
accaaacaaaauugugcacugu

SEQ ID NO: 958629 - RNA, 21 nt, Human
cauauuaaaucggugccuuua

SEQ ID NO: 958630 - RNA, 22 nt, Human
auuacaaaagaagggagaaggu

SEQ ID NO: 958631 - RNA, 22 nt, Human
cuggcccaggaagacguguccc

SEQ ID NO: 958632 - RNA, 22 nt, Human
aguaacucauguaaaccucaca

SEQ ID NO: 958633 - RNA, 22 nt, Human
gaguuauuuugagcagaugguu

SEQ ID NO: 958634 - RNA, 22 nt, Human
uaagucauaagucaugauguua

SEQ ID NO: 958635 - RNA, 22 nt, Human
uuguuuaaaauguagcaagaaa

SEQ ID NO: 958636 - RNA, 22 nt, Human
cgagcaugaugacggcuguggc

SEQ ID NO: 958637 - RNA, 22 nt, Human
aagaugcagcaaacuacuuuuu

SEQ ID NO: 958638 - RNA, 22 nt, Human
auuccaaagccugaauaaugga

SEQ ID NO: 958639 - RNA, 22 nt, Human
ucuccuggaagugauuccccug

SEQ ID NO: 958640 - RNA, 22 nt, Human
ccuguuuacaucaucaaggacu

SEQ ID NO: 958641 - RNA, 22 nt, Human
ccugggcaucucaugcaccugc

SEQ ID NO: 958642 - RNA, 22 nt, Human
uaacuccagagaauccauccau

SEQ ID NO: 958643 - RNA, 22 nt, Human
accuuauuaaaaugaugaugua

SEQ ID NO: 958644 - RNA, 22 nt, Human
guaaaauagaauaacguggcua

SEQ ID NO: 958645 - RNA, 22 nt, Human
gcuccuggguguggcugccccu

SEQ ID NO: 958646 - RNA, 23 nt, Human
uggccaagauaaucucaguuuuc

SEQ ID NO: 958647 - RNA, 23 nt, Human
ugauuaggucuacucuuggcucc

SEQ ID NO: 958648 - RNA, 22 nt, Human
uuucacaacguuguggugagag

SEQ ID NO: 958649 - RNA, 22 nt, Human
ccuccugguaauuagcgaaagg

SEQ ID NO: 958650 - RNA, 22 nt, Human
uuagauaacaguagaauaucaa

SEQ ID NO: 958651 - RNA, 22 nt, Human
gaaauguguuguucauuucuaa

SEQ ID NO: 958652 - RNA, 22 nt, Human
uccugggcaaaaguaucuguga

SEQ ID NO: 958653 - RNA, 22 nt, Human
ccacucugauuggucaccucug

SEQ ID NO: 958654 - RNA, 22 nt, Human
guuuaauaauguugaauuacua

SEQ ID NO: 958655 - RNA, 22 nt, Human
uaggauguagcuaugucaucau

SEQ ID NO: 958656 - RNA, 22 nt, Human
uuccuguuucauagaaaacuga

SEQ ID NO: 958657 - RNA, 22 nt, Human
aaguaugcaaaucgucuuagaa

SEQ ID NO: 958658 - RNA, 22 nt, Human
acaggacuguggaaggaucucu

SEQ ID NO: 958659 - RNA, 22 nt, Human
agcuccugaaaauccagacugg

SEQ ID NO: 958660 - RNA, 22 nt, Human
uaacuccacaccccucuuggug

SEQ ID NO: 958661 - RNA, 22 nt, Human
aaauaugugaucagugaauaaa

SEQ ID NO: 958662 - RNA, 22 nt, Human
ucuuaaaaguaugccaauugga

SEQ ID NO: 958663 - RNA, 22 nt, Human
auucacaaguucuagggauuag

SEQ ID NO: 958664 - RNA, 22 nt, Human
uccuggccagaggacaaagcug

SEQ ID NO: 958665 - RNA, 22 nt, Human
aauacugccugugagguaacuc

SEQ ID NO: 958666 - RNA, 22 nt, Human
aacauucaccucuaccuccuuc

SEQ ID NO: 958667 - RNA, 22 nt, Human
ccugggccugaaaacauuucuc

SEQ ID NO: 958668 - RNA, 22 nt, Human
cuggccaacaucuggggcacau

SEQ ID NO: 958669 - RNA, 22 nt, Human
acucugcaauguggcaagaaca

SEQ ID NO: 958670 - RNA, 22 nt, Human
cagcucugaggaacacuccuuu

SEQ ID NO: 958671 - RNA, 22 nt, Human
uuggcaucaguguaggaccugu

SEQ ID NO: 958672 - RNA, 22 nt, Human
gcuggccauggccugcgccauc

SEQ ID NO: 958673 - RNA, 22 nt, Human
ccuggccacucagguguggggc

SEQ ID NO: 958674 - RNA, 22 nt, Human
caaggugcagcguugucaagcu

SEQ ID NO: 958675 - RNA, 22 nt, Human
gaauauuaguaucaguuauacc

SEQ ID NO: 958676 - RNA, 19 nt, Human
cugggccagaaucagcuca

SEQ ID NO: 958677 - RNA, 22 nt, Human
uauuggauagcuugugcagaau

SEQ ID NO: 958678 - RNA, 22 nt, Human
aaaguauuuuugacaggcauua

SEQ ID NO: 958679 - RNA, 22 nt, Human
uugcaaaugaccauugccacau

SEQ ID NO: 958680 - RNA, 22 nt, Human
auuaggauguguauauuguguu

SEQ ID NO: 958681 - RNA, 18 nt, Human
aggauauuaagaguacag

SEQ ID NO: 958682 - RNA, 22 nt, Human
uuuuaauugcaauuaugguccc

SEQ ID NO: 958683 - RNA, 22 nt, Human
aagaacauuuaugauggcauuu

SEQ ID NO: 958684 - RNA, 22 nt, Human
gcuggccaggugcuuugguucu

SEQ ID NO: 958685 - RNA, 22 nt, Human
acuggccaugaacuugggaucu

SEQ ID NO: 958686 - RNA, 22 nt, Human
caaguuaucagaaggcacuuuu

SEQ ID NO: 958687 - RNA, 22 nt, Human
auuacacacucaaguccuguua

SEQ ID NO: 958688 - RNA, 22 nt, Human
cuccuggcucgcccccagcuga

SEQ ID NO: 958689 - RNA, 22 nt, Human
aaaaauguuaucuacuguccga

SEQ ID NO: 958690 - RNA, 22 nt, Human
augaaaaguucgaucuagaagg

SEQ ID NO: 958691 - RNA, 22 nt, Human
uccugggcgguuaugugaucug

SEQ ID NO: 958692 - RNA, 22 nt, Human
auggccaacugaaaugaaagau

SEQ ID NO: 958693 - RNA, 22 nt, Human
aagcuaugggggaguuucaacc

SEQ ID NO: 958694 - RNA, 21 nt, Human
auuguuaucauugugcugugu

SEQ ID NO: 958695 - RNA, 22 nt, Human
gaaauauuucucuugagccccu

SEQ ID NO: 958696 - RNA, 22 nt, Human
auuuauuaugggauuuggcaca

SEQ ID NO: 958697 - RNA, 22 nt, Human
acacauuaugagcaguugucuu

SEQ ID NO: 958698 - RNA, 22 nt, Human
cugcugagaaaagacugaggga

SEQ ID NO: 958699 - RNA, 22 nt, Human
ucuuggcaauuugaucucaguu

SEQ ID NO: 958700 - RNA, 22 nt, Human
uaugucuugcauuuuucaaacu

SEQ ID NO: 958701 - RNA, 22 nt, Human
guguugacucuuggacuucaag

SEQ ID NO: 958702 - RNA, 22 nt, Human
uaggauaggauggagacagaau

SEQ ID NO: 958703 - RNA, 22 nt, Human
uuggccaaggaccuuuuuggag

SEQ ID NO: 958704 - RNA, 22 nt, Human
uuucuauuuuaaaggcauaugg

SEQ ID NO: 958705 - RNA, 17 nt, Human
cagcucugcaucuuccu

SEQ ID NO: 958706 - RNA, 22 nt, Human
ggauuugggcuugcagcagagc

SEQ ID NO: 958707 - RNA, 22 nt, Human
gagggcuccucacauucucuau

SEQ ID NO: 958708 - RNA, 22 nt, Human
cuuuauauccagauguuuggug

SEQ ID NO: 958709 - RNA, 22 nt, Human
guccaaauaaguugcaaaauag

SEQ ID NO: 958710 - RNA, 22 nt, Human
ucugccaccaccuacacuagua

SEQ ID NO: 958711 - RNA, 20 nt, Human
caaguguagaaacuaauaag

SEQ ID NO: 958712 - RNA, 22 nt, Human
augucacauggccuguacuuug

SEQ ID NO: 958713 - RNA, 22 nt, Human
aauaauguuaugucauucuucu

SEQ ID NO: 958714 - RNA, 22 nt, Human
aagauguaucuuuccuuuaauu

SEQ ID NO: 958715 - RNA, 22 nt, Human
aaaagguaguugccaaauaagg

SEQ ID NO: 958716 - RNA, 21 nt, Human
ccucugcucgggcaugcguuu

SEQ ID NO: 958717 - RNA, 22 nt, Human
ccuccugguugcaaugaaaugg

SEQ ID NO: 958718 - RNA, 21 nt, Human
uuccuggcggcagaaacguga

SEQ ID NO: 958719 - RNA, 22 nt, Human
ccucugcugcuguugagcaccg

SEQ ID NO: 958720 - RNA, 22 nt, Human
uagggauggcagcauguagcuu

SEQ ID NO: 958721 - RNA, 22 nt, Human
gucugagcgcuggagcuugugu

SEQ ID NO: 958722 - RNA, 22 nt, Human
acauaaaguacugagagacucu

SEQ ID NO: 958723 - RNA, 22 nt, Human
ggucugaaaauggugaccacca

SEQ ID NO: 958724 - RNA, 17 nt, Human
cuccuggccaccccucu

SEQ ID NO: 958725 - RNA, 22 nt, Human
aauauccagguagaugucuucu

SEQ ID NO: 958726 - RNA, 22 nt, Human
augcaaaugaacauguugcuag

SEQ ID NO: 958727 - RNA, 22 nt, Human
acuugaaaggaagcucuaaaac

SEQ ID NO: 958728 - RNA, 22 nt, Human
uuucacaaacucagggugugug

SEQ ID NO: 958729 - RNA, 18 nt, Human
augcuuugcuuacguuau

SEQ ID NO: 958730 - RNA, 22 nt, Human
ccuccuggggugaaggauggga

SEQ ID NO: 958731 - RNA, 22 nt, Human
acucugcuauugcagugcaaaa

SEQ ID NO: 958732 - RNA, 22 nt, Human
cuccugaguaguagcauuguca

SEQ ID NO: 958733 - RNA, 22 nt, Human
auucaucaacugauagccauag

SEQ ID NO: 958734 - RNA, 22 nt, Human
augaaagaugauuuaaaguacu

SEQ ID NO: 958735 - RNA, 22 nt, Human
ugaaaaacuuuaauccauaaag

SEQ ID NO: 958736 - RNA, 22 nt, Human
uccuggccaaguuacucucugc

SEQ ID NO: 958737 - RNA, 22 nt, Human
cuuauuagaaagaaaagacaug

SEQ ID NO: 958738 - RNA, 22 nt, Human
cuuuagugguauuuuagcaagu

SEQ ID NO: 958739 - RNA, 22 nt, Human
uuuuacuuaauucuuggucaug

SEQ ID NO: 958740 - RNA, 22 nt, Human
ucacaaaucauuuuaucugugu

SEQ ID NO: 958741 - RNA, 22 nt, Human
aagugccaucauagcauggcug

SEQ ID NO: 958742 - RNA, 22 nt, Human
ccacucugauuuuggcuccacu

SEQ ID NO: 958743 - RNA, 19 nt, Human
cugggccagagcuguccuc

SEQ ID NO: 958744 - RNA, 21 nt, Human
uuuauuuauauaggacacaug

SEQ ID NO: 958745 - RNA, 21 nt, Human
uucagcaagcacucuggacac

SEQ ID NO: 958746 - RNA, 22 nt, Human
acuccugguucccaguugagau

SEQ ID NO: 958747 - RNA, 22 nt, Human
agagucuuuugucaguaauguu

SEQ ID NO: 958748 - RNA, 22 nt, Human
uaggaucucaccauagaaggaa

SEQ ID NO: 958749 - RNA, 22 nt, Human
uauuaggguaaauuugacaugc

SEQ ID NO: 958750 - RNA, 22 nt, Human
uuggccaaaaaagucauuagaa

SEQ ID NO: 958751 - RNA, 22 nt, Human
augcacuacuuggcuuuacuga

SEQ ID NO: 958752 - RNA, 22 nt, Human
aaagacagagcuguaggggaaa

SEQ ID NO: 958753 - RNA, 22 nt, Human
ccuccugguccagcaucucuuu

SEQ ID NO: 958754 - RNA, 22 nt, Human
uccuggccgcuggccccugaga

SEQ ID NO: 958755 - RNA, 22 nt, Human
ucuggccacuaauaggucucac

SEQ ID NO: 958756 - RNA, 22 nt, Human
uuuauagggacaguucuuggag

SEQ ID NO: 958757 - RNA, 22 nt, Human
gcaggagagucugugccagguu

SEQ ID NO: 958758 - RNA, 22 nt, Human
gcuccuggucuggagcuucaag

SEQ ID NO: 958759 - RNA, 22 nt, Human
cacuccuguuccacuaaaugag

SEQ ID NO: 958760 - RNA, 22 nt, Human
aauuaggaaauucagccauuuu

SEQ ID NO: 958761 - RNA, 22 nt, Human
ccuggccacagggcucugcauu

SEQ ID NO: 958762 - RNA, 22 nt, Human
cuccugcgguacuacugugcuu

SEQ ID NO: 958763 - RNA, 22 nt, Human
guuauauaagacaaaucagagu

SEQ ID NO: 958764 - RNA, 20 nt, Human
ucugccacugcacucugccc

SEQ ID NO: 958765 - RNA, 22 nt, Human
cacugucuuuugugaagacaau

SEQ ID NO: 958766 - RNA, 22 nt, Human
guaauaaugguccccaaacacu

SEQ ID NO: 958767 - RNA, 22 nt, Human
auuagggaaggauuuggccuga

SEQ ID NO: 958768 - RNA, 22 nt, Human
uccuggcccucugcaaacgcca

SEQ ID NO: 958769 - RNA, 22 nt, Human
aaagaacaauguggaaucuccu

SEQ ID NO: 958770 - RNA, 22 nt, Human
auggcaagcaagcugaagagau

SEQ ID NO: 958771 - RNA, 22 nt, Human
ucuucaaaaaauauccaucagu

SEQ ID NO: 958772 - RNA, 22 nt, Human
ccuggccauuugaacuucagac

SEQ ID NO: 958773 - RNA, 18 nt, Human
gcacucugacugcagagc

SEQ ID NO: 958774 - RNA, 22 nt, Human
cagagcagucuggagauccagc

SEQ ID NO: 958775 - RNA, 22 nt, Human
gucaucuucgcagagugauuuu

SEQ ID NO: 958776 - RNA, 22 nt, Human
auuaggauguuccuaugcacau

SEQ ID NO: 958777 - RNA, 22 nt, Human
uuuuauuaguggcuagaugggg

SEQ ID NO: 958778 - RNA, 22 nt, Human
auuuauuaagcaucugcuaugu

SEQ ID NO: 958779 - RNA, 22 nt, Human
ucagggaacuacuucucccuau

SEQ ID NO: 958780 - RNA, 22 nt, Human
aggauguugcuauuggcagucu

SEQ ID NO: 958781 - RNA, 22 nt, Human
gaugcaaagcauuuuugugugu

SEQ ID NO: 958782 - RNA, 22 nt, Human
aacauaaauuugaaguggcaaa

SEQ ID NO: 958783 - RNA, 22 nt, Human
aacauuucagcaccugauuccu

SEQ ID NO: 958784 - RNA, 22 nt, Human
cuggccacugguggucauaggc

SEQ ID NO: 958785 - RNA, 22 nt, Human
gcuccuggugcaaaguuucuuc

SEQ ID NO: 958786 - RNA, 22 nt, Human
uuaggcauuggaaggucagcuu

SEQ ID NO: 958787 - RNA, 22 nt, Human
auuggcaaggcugcggugucug

SEQ ID NO: 958788 - RNA, 22 nt, Human
acagggaaguucugcaacagga

SEQ ID NO: 958789 - RNA, 23 nt, Human
gcucugcucuguuucauagacag

SEQ ID NO: 958790 - RNA, 22 nt, Human
uuuuaucugugacaucuggcag

SEQ ID NO: 958791 - RNA, 22 nt, Human
agugaacaaagguagugagcau

SEQ ID NO: 958792 - RNA, 22 nt, Human
uuauuugguugcugacuuggaa

SEQ ID NO: 958793 - RNA, 22 nt, Human
uuugcaaaaugucuuguguuag

SEQ ID NO: 958794 - RNA, 20 nt, Human
ucugccacuuuuucugucac

SEQ ID NO: 958795 - RNA, 22 nt, Human
auuauuagacuuauaugguagu

SEQ ID NO: 958796 - RNA, 22 nt, Human
acauuuaaauaugccuuauauu

SEQ ID NO: 958797 - RNA, 22 nt, Human
uuucacaaaugucuuuaacuug

SEQ ID NO: 958798 - RNA, 22 nt, Human
agcuauguauuuguguguuaaa

SEQ ID NO: 958799 - RNA, 22 nt, Human
uauuggaugauucacuuggcag

SEQ ID NO: 958800 - RNA, 22 nt, Human
uuuauguaauuucauaggugug

SEQ ID NO: 958801 - RNA, 22 nt, Human
ucuggccauggcaagccgagug

SEQ ID NO: 958802 - RNA, 22 nt, Human
ccuggccauagggcccaggaaa

SEQ ID NO: 958803 - RNA, 22 nt, Human
acaaaaaccguggauucagcau

SEQ ID NO: 958804 - RNA, 22 nt, Human
uuucacaacugcuuauuugaga

SEQ ID NO: 958805 - RNA, 22 nt, Human
aauaaaauggucaguuuucuca

SEQ ID NO: 958806 - RNA, 22 nt, Human
cagcugugaauugucuuaucua

SEQ ID NO: 958807 - RNA, 22 nt, Human
uuuuauauugagugagaguucc

SEQ ID NO: 958808 - RNA, 22 nt, Human
uuaaguaagaccuuaugucuug

SEQ ID NO: 958809 - RNA, 19 nt, Human
gucaucuuuuaauaaugug

SEQ ID NO: 958810 - RNA, 22 nt, Human
uaaaugauaauaaugcuagugu

SEQ ID NO: 958811 - RNA, 22 nt, Human
aaagaauacccugggucauaaa

SEQ ID NO: 958812 - RNA, 22 nt, Human
aaaaguaauugcaauuuuguag

SEQ ID NO: 958813 - RNA, 22 nt, Human
ugcugaaaacucaaccauugug

SEQ ID NO: 958814 - RNA, 22 nt, Human
cacucugccugauguuacaugg

SEQ ID NO: 958815 - RNA, 22 nt, Human
aaacuccugcauacucagaagc

SEQ ID NO: 958816 - RNA, 21 nt, Human
uuauugagacauuuguggaaa

SEQ ID NO: 958817 - RNA, 22 nt, Human
uaaauaugcauguauccuuauc

SEQ ID NO: 958818 - RNA, 22 nt, Human
aguguacacuaaaugaauacaa

SEQ ID NO: 958819 - RNA, 22 nt, Human
acauccugaagucagucauuug

SEQ ID NO: 958820 - RNA, 20 nt, Human
uuucacaaugaacaugucuc

SEQ ID NO: 958821 - RNA, 22 nt, Human
gcucugcuggagggaaagagaa

SEQ ID NO: 958822 - RNA, 22 nt, Human
gagcacugauuuauuuuugucu

SEQ ID NO: 958823 - RNA, 22 nt, Human
auggccaagcuuacucuguugu

SEQ ID NO: 958824 - RNA, 20 nt, Human
uguuccaagcuaaugaauga

SEQ ID NO: 958825 - RNA, 22 nt, Human
uaaguuaucggaguguguuuca

SEQ ID NO: 958826 - RNA, 22 nt, Human
guggccaacucaauguuuuuca

SEQ ID NO: 958827 - RNA, 21 nt, Human
cucuuuauauaguaaagauau

SEQ ID NO: 958828 - RNA, 22 nt, Human
ugucuuaauaugugcauucugu

SEQ ID NO: 958829 - RNA, 22 nt, Human
ugagaauaggcauagaaccugg

SEQ ID NO: 958830 - RNA, 20 nt, Human
aggcucugcauuucugagug

SEQ ID NO: 958831 - RNA, 22 nt, Human
ccuccuggugacaaggcaaagc

SEQ ID NO: 958832 - RNA, 22 nt, Human
aaguaugcuaauuaacuagcac

SEQ ID NO: 958833 - RNA, 23 nt, Human
ucugggccacuugucugcacuuc

SEQ ID NO: 958834 - RNA, 23 nt, Human
aacuccugaaucgugagccaucu

SEQ ID NO: 958835 - RNA, 22 nt, Human
gucaucuuccuaguguuaacua

SEQ ID NO: 958836 - RNA, 20 nt, Human
uuggcagcuucaggguacua

SEQ ID NO: 958837 - RNA, 19 nt, Human
ccucugcuccaguuuccuu

SEQ ID NO: 958838 - RNA, 22 nt, Human
gcugauguuuaguugauguuac

SEQ ID NO: 958839 - RNA, 22 nt, Human
uuuaggaugcucuauucugacu

SEQ ID NO: 958840 - RNA, 22 nt, Human
auauauaagcugaugagccaca

SEQ ID NO: 958841 - RNA, 22 nt, Human
aguuuaaaucauguuuuguaac

SEQ ID NO: 958842 - RNA, 22 nt, Human
guuuuauuggaacacagccaug

SEQ ID NO: 958843 - RNA, 22 nt, Human
ucacucuggccucugcagcagu

SEQ ID NO: 958844 - RNA, 22 nt, Human
uuugaauaucacaaacuuucaa

SEQ ID NO: 958845 - RNA, 22 nt, Human
gcucugcugcuuacuagauggu

SEQ ID NO: 958846 - RNA, 22 nt, Human
acuccuggguuccggagauucu

SEQ ID NO: 958847 - RNA, 22 nt, Human
uucaaaacaaucuguuugcauu

SEQ ID NO: 958848 - RNA, 22 nt, Human
uugacaaugcacugugcuaagu

SEQ ID NO: 958849 - RNA, 22 nt, Human
uguuuaauucaccaucauguuc

SEQ ID NO: 958850 - RNA, 21 nt, Human
aacauuucaggauccaaauug

SEQ ID NO: 958851 - RNA, 22 nt, Human
aguuggcauuuuauuuaaguau

SEQ ID NO: 958852 - RNA, 22 nt, Human
aaauguggguaaugggacugga

SEQ ID NO: 958853 - RNA, 22 nt, Human
caacuccuggcuguuaggcaca

SEQ ID NO: 958854 - RNA, 22 nt, Human
ucaaauaaggagucaugaccau

SEQ ID NO: 958855 - RNA, 22 nt, Human
ugaaagcacugauucucaacuc

SEQ ID NO: 958856 - RNA, 22 nt, Human
uggcacaaaucuagucccuggu

SEQ ID NO: 958857 - RNA, 22 nt, Human
ccuggccacccagccuuggcca

SEQ ID NO: 958858 - RNA, 21 nt, Human
acacauuaugagcauagacuc

SEQ ID NO: 958859 - RNA, 22 nt, Human
ucacucuguggcccaggcagug

SEQ ID NO: 958860 - RNA, 22 nt, Human
cuguaaaacugcuuaaguaugc

SEQ ID NO: 958861 - RNA, 22 nt, Human
ugucuuaagaaauugcauuugu

SEQ ID NO: 958862 - RNA, 22 nt, Human
agauaaauuccuaagauuucag

SEQ ID NO: 958863 - RNA, 22 nt, Human
ucuccuggcaugugggucaucu

SEQ ID NO: 958864 - RNA, 22 nt, Human
ccugagccucuugcacgcucag

SEQ ID NO: 958865 - RNA, 22 nt, Human
gcucugcuguggaauccucucc

SEQ ID NO: 958866 - RNA, 22 nt, Human
aguuucaauucuuuucacaaag

SEQ ID NO: 958867 - RNA, 22 nt, Human
cagggaauccauggucauaagg

SEQ ID NO: 958868 - RNA, 22 nt, Human
aacacuuucuuccuugcucagg

SEQ ID NO: 958869 - RNA, 22 nt, Human
cggccaagccggggccccgaag

SEQ ID NO: 958870 - RNA, 22 nt, Human
aauuaggaauaaaugaguacuu

SEQ ID NO: 958871 - RNA, 22 nt, Human
cugguccauucucucccugaag

SEQ ID NO: 958872 - RNA, 22 nt, Human
gcuggccaaaguguaccuggag

SEQ ID NO: 958873 - RNA, 22 nt, Human
uuauuaguguugauauuaggau

SEQ ID NO: 958874 - RNA, 22 nt, Human
uggccaaauuugguguaacuug

SEQ ID NO: 958875 - RNA, 22 nt, Human
uuuuaugugcuggacuggcagu

SEQ ID NO: 958876 - RNA, 22 nt, Human
uucugagccucauucaugaggc

SEQ ID NO: 958877 - RNA, 22 nt, Human
ugcaacauuauuaaacuaagca

SEQ ID NO: 958878 - RNA, 22 nt, Human
agccaugugucuuuauucuguu

SEQ ID NO: 958879 - RNA, 22 nt, Human
augcaaaagacuauuuguugcu

SEQ ID NO: 958880 - RNA, 22 nt, Human
agacaugagaaacccaccagag

SEQ ID NO: 958881 - RNA, 22 nt, Human
aaauaguuguuuggaucaauaa

SEQ ID NO: 958882 - RNA, 22 nt, Human
aaauaguuacuucugcugucuu

SEQ ID NO: 958883 - RNA, 22 nt, Human
guuauaaaaugcacaguuguuu

SEQ ID NO: 958884 - RNA, 22 nt, Human
ucugugccuccguaacacacca

SEQ ID NO: 958885 - RNA, 22 nt, Human
ccuccuggaggcucuaagggag

SEQ ID NO: 958886 - RNA, 20 nt, Human
ccuccuggucaggugugcag

SEQ ID NO: 958887 - RNA, 22 nt, Human
uuucauuauucaugcuaguuau

SEQ ID NO: 958888 - RNA, 23 nt, Human
agacaguggccgagagguacuag

SEQ ID NO: 958889 - RNA, 22 nt, Human
aagucaaaccuugcucacagga

SEQ ID NO: 958890 - RNA, 22 nt, Human
gcuggccagggcugcucgcgga

SEQ ID NO: 958891 - RNA, 22 nt, Human
caccguuugguuuggauuuaca

SEQ ID NO: 958892 - RNA, 22 nt, Human
uccuggcccuguggccugcagu

SEQ ID NO: 958893 - RNA, 23 nt, Human
uuccuggcagguacaacuuuuac

SEQ ID NO: 958894 - RNA, 22 nt, Human
aguuauagaaccagguccucac

SEQ ID NO: 958895 - RNA, 22 nt, Human
ugaggccagucucaucacaggc

SEQ ID NO: 958896 - RNA, 21 nt, Human
uggcagacaggaggagcucac

SEQ ID NO: 958897 - RNA, 22 nt, Human
aaacacaucauucaugucguca

SEQ ID NO: 958898 - RNA, 22 nt, Human
uuaaaaugaauauugauuagca

SEQ ID NO: 958899 - RNA, 22 nt, Human
auuuggcaaauaauuugagggu

SEQ ID NO: 958900 - RNA, 22 nt, Human
uggcagcacuagguacugagcu

SEQ ID NO: 958901 - RNA, 22 nt, Human
gugcaagguacauccuugaugu

SEQ ID NO: 958902 - RNA, 22 nt, Human
ucuauuuacagaaagcagaauu

SEQ ID NO: 958903 - RNA, 22 nt, Human
ucuuggccagguguggugccuc

SEQ ID NO: 958904 - RNA, 22 nt, Human
auuggucaggacuggcaugugg

SEQ ID NO: 958905 - RNA, 22 nt, Human
ucacucuguguuugaacucaag

SEQ ID NO: 958906 - RNA, 22 nt, Human
uacuccugcugauccugccagc

SEQ ID NO: 958907 - RNA, 22 nt, Human
aauucacauauacauuauuccu

SEQ ID NO: 958908 - RNA, 22 nt, Human
auaaacaucuguuucucuucug

SEQ ID NO: 958909 - RNA, 22 nt, Human
agggucugcauuccaacuuggg

SEQ ID NO: 958910 - RNA, 22 nt, Human
uuucauuauaaaaaguuggcuu

SEQ ID NO: 958911 - RNA, 22 nt, Human
ugucaucuuuuuaaagaagaga

SEQ ID NO: 958912 - RNA, 22 nt, Human
cugggccauggaagucucugcc

SEQ ID NO: 958913 - RNA, 22 nt, Human
ucuucaaacugaaaauuuagaa

SEQ ID NO: 958914 - RNA, 22 nt, Human
uuuaugagcaccuuggcccaga

SEQ ID NO: 958915 - RNA, 22 nt, Human
agcuagaauguuccuuuucauu

SEQ ID NO: 958916 - RNA, 22 nt, Human
ucucugcucaggcaccagcccu

SEQ ID NO: 958917 - RNA, 22 nt, Human
uuccuggccucucucugagcag

SEQ ID NO: 958918 - RNA, 22 nt, Human
uacaguauggaaaauguauagu

SEQ ID NO: 958919 - RNA, 22 nt, Human
cucuggccugcagauccaugcu

SEQ ID NO: 958920 - RNA, 22 nt, Human
aggccaaagcaagacccuguaa

SEQ ID NO: 958921 - RNA, 18 nt, Human
acaguaaagaaaggaauu

SEQ ID NO: 958922 - RNA, 22 nt, Human
aacugcuguggccuaguacuua

SEQ ID NO: 958923 - RNA, 22 nt, Human
ccuucuuaaacaucauuuuggc

SEQ ID NO: 958924 - RNA, 22 nt, Human
cauuaaauuccuuguucucaaa

SEQ ID NO: 958925 - RNA, 22 nt, Human
uagaaaugauugguugagcucu

SEQ ID NO: 958926 - RNA, 22 nt, Human
augcaaaaguaacugugauuuu

SEQ ID NO: 958927 - RNA, 19 nt, Human
uuuaggauaaagucuggac

SEQ ID NO: 958928 - RNA, 22 nt, Human
auuacacaggauuugccuuacu

SEQ ID NO: 958929 - RNA, 22 nt, Human
ucacucugucccccauugagau

SEQ ID NO: 958930 - RNA, 22 nt, Human
uuuaggauaacuccaguuuucc

SEQ ID NO: 958931 - RNA, 22 nt, Human
acuuccugaauggggcuaauua

SEQ ID NO: 958932 - RNA, 22 nt, Human
aaaucagucccucuuggaauuu

SEQ ID NO: 958933 - RNA, 22 nt, Human
cuguuuaucccuuuggucagca

SEQ ID NO: 958934 - RNA, 22 nt, Human
guuugaaugcaguaugcauuuu

SEQ ID NO: 958935 - RNA, 22 nt, Human
uccugugccuccaccugcuccg

SEQ ID NO: 958936 - RNA, 22 nt, Human
ucacucuggaguccgcuaccag

SEQ ID NO: 958937 - RNA, 22 nt, Human
aaagucauugcuguuaucaaug

SEQ ID NO: 958938 - RNA, 22 nt, Human
accuguuuuccuaucuagauug

SEQ ID NO: 958939 - RNA, 20 nt, Human
acuccugguaacuuuuguga

SEQ ID NO: 958940 - RNA, 22 nt, Human
uauuagagaaaagauggaugug

SEQ ID NO: 958941 - RNA, 22 nt, Human
uuucaagagggaacugaacaca

SEQ ID NO: 958942 - RNA, 22 nt, Human
ucaaaaaguugaagaguugggg

SEQ ID NO: 958943 - RNA, 22 nt, Human
aacucugccagguuucaggagc

SEQ ID NO: 958944 - RNA, 22 nt, Human
aaagacauuagauuaacguaca

SEQ ID NO: 958945 - RNA, 22 nt, Human
cugugccaucugcacucucguc

SEQ ID NO: 958946 - RNA, 22 nt, Human
auaaagacaugcuuacuugccc

SEQ ID NO: 958947 - RNA, 22 nt, Human
gcuggccauucucuuugagaug

SEQ ID NO: 958948 - RNA, 22 nt, Human
uaccuucaccagcgaauguuug

SEQ ID NO: 958949 - RNA, 22 nt, Human
auagucacucuguuagguguuu

SEQ ID NO: 958950 - RNA, 22 nt, Human
ugaaauguguaauguggaugcc

SEQ ID NO: 958951 - RNA, 22 nt, Human
auuuggcauaggcagaggccca

SEQ ID NO: 958952 - RNA, 22 nt, Human
ccuggccaaucuagggcuguua

SEQ ID NO: 958953 - RNA, 22 nt, Human
caguuuaaccuauccauuaugu

SEQ ID NO: 958954 - RNA, 22 nt, Human
aacuccugaggaaauggucuca

SEQ ID NO: 958955 - RNA, 22 nt, Human
uagcuuuguuagaaugucuuca

SEQ ID NO: 958956 - RNA, 22 nt, Human
ugaauaagaauuauuauaauga

SEQ ID NO: 958957 - RNA, 22 nt, Human
uaggauuuggcuuuagucaggu

SEQ ID NO: 958958 - RNA, 22 nt, Human
uauauuaaccauaggguucuag

SEQ ID NO: 958959 - RNA, 22 nt, Human
uuauuagagugcuuugagaaag

SEQ ID NO: 958960 - RNA, 17 nt, Human
cuccuggcagccucagg

SEQ ID NO: 958961 - RNA, 22 nt, Human
acucugcugucugauggcagga

SEQ ID NO: 958962 - RNA, 22 nt, Human
aaauaacuuaugaucgucuggc

SEQ ID NO: 958963 - RNA, 22 nt, Human
uauucacauucucaggccuggu

SEQ ID NO: 958964 - RNA, 22 nt, Human
aaacagaaauuuccucaugcuc

SEQ ID NO: 958965 - RNA, 22 nt, Human
augcacuaugaugagcuagucu

SEQ ID NO: 958966 - RNA, 22 nt, Human
agucauguguucaucuuucauu

SEQ ID NO: 958967 - RNA, 22 nt, Human
uuuaggauauuaauguucagag

SEQ ID NO: 958968 - RNA, 22 nt, Human
aggaucuugcuguagaggauag

SEQ ID NO: 958969 - RNA, 22 nt, Human
uaaauacuuuuacuccacugau

SEQ ID NO: 958970 - RNA, 22 nt, Human
gccaugaggaacuguaagacaa

SEQ ID NO: 958971 - RNA, 22 nt, Human
ucuccuggauagauacuaucca

SEQ ID NO: 958972 - RNA, 19 nt, Human
auuagcaugcuugaggaug

SEQ ID NO: 958973 - RNA, 22 nt, Human
guacacauugucuguuuacuuc

SEQ ID NO: 958974 - RNA, 22 nt, Human
auucacaaauaacaggugcaga

SEQ ID NO: 958975 - RNA, 22 nt, Human
ucuuguuacaguuuauuacaug

SEQ ID NO: 958976 - RNA, 22 nt, Human
guaauguguuuugaaaaacagu

SEQ ID NO: 958977 - RNA, 22 nt, Human
uuguuaguuuauauaauguagu

SEQ ID NO: 958978 - RNA, 22 nt, Human
gcuccuggcaggcagugugugu

SEQ ID NO: 958979 - RNA, 22 nt, Human
uaaaccuugguagcaucuugcu

SEQ ID NO: 958980 - RNA, 22 nt, Human
cuguuuauuacacuggauagca

SEQ ID NO: 958981 - RNA, 22 nt, Human
caaaaguaauuaugguuuuugc

SEQ ID NO: 958982 - RNA, 20 nt, Human
ugaaauaaggaguuguccuu

SEQ ID NO: 958983 - RNA, 22 nt, Human
acacauaagaaacuacaaagag

SEQ ID NO: 958984 - RNA, 22 nt, Human
ucucuggcagggauaucuggcu

SEQ ID NO: 958985 - RNA, 22 nt, Human
gaaauauuguacuggagauguu

SEQ ID NO: 958986 - RNA, 22 nt, Human
ucuccugggaggacaaggaagg

SEQ ID NO: 958987 - RNA, 22 nt, Human
aggauauuugcuuaagauagcu

SEQ ID NO: 958988 - RNA, 22 nt, Human
aggcauguauaugugcacaugu

SEQ ID NO: 958989 - RNA, 22 nt, Human
ucuccugguacccuuccuagca

SEQ ID NO: 958990 - RNA, 22 nt, Human
gagaaggaguagcugaccuggg

SEQ ID NO: 958991 - RNA, 22 nt, Human
ugcucccagggacucuggcugg

SEQ ID NO: 958992 - RNA, 22 nt, Human
uauuaugagguauuuggacuuu

SEQ ID NO: 958993 - RNA, 22 nt, Human
cuugaaaugacaggagcacauc

SEQ ID NO: 958994 - RNA, 22 nt, Human
auuaggcaauucugggcaucuc

SEQ ID NO: 958995 - RNA, 20 nt, Human
cugggccauccuuuuacaau

SEQ ID NO: 958996 - RNA, 22 nt, Human
acauuucuuucuauucaguagc

SEQ ID NO: 958997 - RNA, 22 nt, Human
uggcaacaccuggaagacaugg

SEQ ID NO: 958998 - RNA, 22 nt, Human
uggcagcaccagcaguguccuu

SEQ ID NO: 958999 - RNA, 22 nt, Human
uuuauuauccaguguugucaug

SEQ ID NO: 959000 - RNA, 22 nt, Human
uauuuaauaaaacuauggcaug

SEQ ID NO: 959001 - RNA, 16 nt, Human
aggccaaaaaggggca

SEQ ID NO: 959002 - RNA, 22 nt, Human
uuccuggcaccaccacuucuag

SEQ ID NO: 959003 - RNA, 22 nt, Human
uggcaccagcaccuagaugggg

SEQ ID NO: 959004 - RNA, 22 nt, Human
uaggaugacacagcaaguauag

SEQ ID NO: 959005 - RNA, 21 nt, Human
auucugaguugucagucuuca

SEQ ID NO: 959006 - RNA, 22 nt, Human
cuggccuagcucucugcuugaa

SEQ ID NO: 959007 - RNA, 22 nt, Human
cuauuagguuggugcaaaagua

SEQ ID NO: 959008 - RNA, 22 nt, Human
ucuccuggguaaaaggguugau

SEQ ID NO: 959009 - RNA, 22 nt, Human
cuccacagcucaggcucagagu

SEQ ID NO: 959010 - RNA, 15 nt, Human
ucacucuggaaggga

SEQ ID NO: 959011 - RNA, 23 nt, Human
uacuuaggaauggggacggcaag

SEQ ID NO: 959012 - RNA, 22 nt, Human
caacugagcaguagcgucugga

SEQ ID NO: 959013 - RNA, 22 nt, Human
gggccaaggggagcuggaaggg

SEQ ID NO: 959014 - RNA, 22 nt, Human
gggaggaggaauguuuugugua

SEQ ID NO: 959015 - RNA, 22 nt, Human
uuagagaugucccaaaaugaag

SEQ ID NO: 959016 - RNA, 22 nt, Human
caacccaaaagcguuuccauuu

SEQ ID NO: 959017 - RNA, 20 nt, Human
auggccaaccugcuuaugac

SEQ ID NO: 959018 - RNA, 22 nt, Human
uauucacagguucuggggauca

SEQ ID NO: 959019 - RNA, 22 nt, Human
uuuuaauucaaagugaauagug

SEQ ID NO: 959020 - RNA, 22 nt, Human
guggccaaaaggaagaagguua

SEQ ID NO: 959021 - RNA, 22 nt, Human
uagcacugaaucacaugcugcu

SEQ ID NO: 959022 - RNA, 22 nt, Human
uauugaggauugaggaaagcac

SEQ ID NO: 959023 - RNA, 22 nt, Human
guggccaagaggggacuggaua

SEQ ID NO: 959024 - RNA, 22 nt, Human
aaagucauuguaauauaugcua

SEQ ID NO: 959025 - RNA, 22 nt, Human
cugggccaaaagaaguguucuu

SEQ ID NO: 959026 - RNA, 22 nt, Human
uuacuggcugggccugagggcu

SEQ ID NO: 959027 - RNA, 22 nt, Human
ucacaaagggagggauagcugg

SEQ ID NO: 959028 - RNA, 22 nt, Human
cuaagccacucaaaucuugugg

SEQ ID NO: 959029 - RNA, 22 nt, Human
uugcuucagagggagacacuuu

SEQ ID NO: 959030 - RNA, 22 nt, Human
aaagauuaaaucaaauugguca

SEQ ID NO: 959031 - RNA, 22 nt, Human
gaguuuaaaacgcuuguauuua

SEQ ID NO: 959032 - RNA, 22 nt, Human
aaauauuauugcuuaaggggag

SEQ ID NO: 959033 - RNA, 22 nt, Human
cugagccagcgggcucacuuuu

SEQ ID NO: 959034 - RNA, 22 nt, Human
aaugauguuuuuaaagaacaua

SEQ ID NO: 959035 - RNA, 22 nt, Human
agacauuuauugaacaccuagc

SEQ ID NO: 959036 - RNA, 21 nt, Human
ccuggccaaucugauaggguu

SEQ ID NO: 959037 - RNA, 22 nt, Human
aaauauaguaaaugcauaguuc

SEQ ID NO: 959038 - RNA, 22 nt, Human
cuccugugggucaccaauaggc

SEQ ID NO: 959039 - RNA, 22 nt, Human
ugucaucuucaucauaaguaaa

SEQ ID NO: 959040 - RNA, 19 nt, Human
aggucuaaucauaagacaa

SEQ ID NO: 959041 - RNA, 22 nt, Human
ucugagccaccugccagugcug

SEQ ID NO: 959042 - RNA, 22 nt, Human
aaaugaugcucacagauuagug

SEQ ID NO: 959043 - RNA, 21 nt, Human
ucuuggccuaaguucacugaa

SEQ ID NO: 959044 - RNA, 22 nt, Human
uaaaacuagugguugggacuaa

SEQ ID NO: 959045 - RNA, 20 nt, Human
ccagucucuaucagaaauaa

SEQ ID NO: 959046 - RNA, 22 nt, Human
aacucacuuuguggcuucugaa

SEQ ID NO: 959047 - RNA, 22 nt, Human
uacucugccccagccaauaaug

SEQ ID NO: 959048 - RNA, 22 nt, Human
acaaacagcuaacauauguuaa

SEQ ID NO: 959049 - RNA, 22 nt, Human
aaagauaugucuccaaagagau

SEQ ID NO: 959050 - RNA, 22 nt, Human
aggauguucgggucacauagcc

SEQ ID NO: 959051 - RNA, 22 nt, Human
ccuggccaggcauggagucaca

SEQ ID NO: 959052 - RNA, 22 nt, Human
auuauuaggacuacugggguug

SEQ ID NO: 959053 - RNA, 22 nt, Human
uauuagcgcuuacugaguugcc

SEQ ID NO: 959054 - RNA, 22 nt, Human
caaaaguaauugcaguuuuugc

SEQ ID NO: 959055 - RNA, 22 nt, Human
cuucacaauucuaacagggcaa

SEQ ID NO: 959056 - RNA, 22 nt, Human
aggauuuuagauaagacagcaa

SEQ ID NO: 959057 - RNA, 22 nt, Human
uggcaaacuggaggaagcccug

SEQ ID NO: 959058 - RNA, 22 nt, Human
uaguuuaauggucaacuaauga

SEQ ID NO: 959059 - RNA, 22 nt, Human
uuuauuagauuaucaaagaggu

SEQ ID NO: 959060 - RNA, 22 nt, Human
gagccaggggucagcuccgagg

SEQ ID NO: 959061 - RNA, 22 nt, Human
gaggaaggucccaucagaauuu

SEQ ID NO: 959062 - RNA, 22 nt, Human
ccuccuggaaaaauucccuggc

SEQ ID NO: 959063 - RNA, 22 nt, Human
ugucaucuuggucuggaauaag

SEQ ID NO: 959064 - RNA, 22 nt, Human
gcagggaaggggcaugcuggag

SEQ ID NO: 959065 - RNA, 22 nt, Human
aauucacaggagguauuugucc

SEQ ID NO: 959066 - RNA, 22 nt, Human
cuuaauaaaugguagcuguuau

SEQ ID NO: 959067 - RNA, 22 nt, Human
ucugccaccuucauccuccacu

SEQ ID NO: 959068 - RNA, 22 nt, Human
auauuaggugcucaauacaugc

SEQ ID NO: 959069 - RNA, 19 nt, Human
cuuauuagagugagagcuu

SEQ ID NO: 959070 - RNA, 22 nt, Human
guuaggauauggugaaauggag

SEQ ID NO: 959071 - RNA, 23 nt, Human
cuucacaaucaaaaucaguucug

SEQ ID NO: 959072 - RNA, 22 nt, Human
aauaauguacauacauauuucg

SEQ ID NO: 959073 - RNA, 22 nt, Human
agcugaaagugcuuugaggacu

SEQ ID NO: 959074 - RNA, 20 nt, Human
uccuggccuucucgggcagu

SEQ ID NO: 959075 - RNA, 18 nt, Human
uuuaugagcugugggacc

SEQ ID NO: 959076 - RNA, 22 nt, Human
uauuagguaaaggacuugcagg

SEQ ID NO: 959077 - RNA, 22 nt, Human
uggccacaugcgucugugaggc

SEQ ID NO: 959078 - RNA, 22 nt, Human
uauauuaaagugcuuugcagug

SEQ ID NO: 959079 - RNA, 22 nt, Human
uuuauuuggcaucucugccaag

SEQ ID NO: 959080 - RNA, 22 nt, Human
aauaagauugacacaaguaccu

SEQ ID NO: 959081 - RNA, 22 nt, Human
auguuuaaucggcugccuuucc

SEQ ID NO: 959082 - RNA, 22 nt, Human
cuuucacacacauacauuugga

SEQ ID NO: 959083 - RNA, 22 nt, Human
uaugcauuuuauagugcaaagc

SEQ ID NO: 959084 - RNA, 22 nt, Human
uaacuaacuaguguucaaaaua

SEQ ID NO: 959085 - RNA, 22 nt, Human
aaaaguauuuauggcuauguaa

SEQ ID NO: 959086 - RNA, 22 nt, Human
guucacaauuuuuacugauugg

SEQ ID NO: 959087 - RNA, 20 nt, Human
auguaaaauuauaaggcuga

SEQ ID NO: 959088 - RNA, 22 nt, Human
uccuggccuugcgucuugggag

SEQ ID NO: 959089 - RNA, 22 nt, Human
gaaaaguacacagcccaaacau

SEQ ID NO: 959090 - RNA, 22 nt, Human
uuggccaagacucauguccuau

SEQ ID NO: 959091 - RNA, 22 nt, Human
ucugagccaauuucugugucca

SEQ ID NO: 959092 - RNA, 22 nt, Human
cugagggugcuauucuugccuu

SEQ ID NO: 959093 - RNA, 22 nt, Human
ugaaacaggaaguaaacagaca

SEQ ID NO: 959094 - RNA, 22 nt, Human
auauuaggcaaggagauuauuu

SEQ ID NO: 959095 - RNA, 22 nt, Human
gcuagaaaucgacuucagaauu

SEQ ID NO: 959096 - RNA, 22 nt, Human
uaguuaggguucugcagagaca

SEQ ID NO: 959097 - RNA, 22 nt, Human
cugccuugguuucuagcagggc

SEQ ID NO: 959098 - RNA, 22 nt, Human
gaauuacauuguuagccuuccu

SEQ ID NO: 959099 - RNA, 22 nt, Human
auuuauuauugugguuacuucu

SEQ ID NO: 959100 - RNA, 22 nt, Human
uuuaauguucaucucaaaggau

SEQ ID NO: 959101 - RNA, 22 nt, Human
aaacucaaauuaaacuagcuua

SEQ ID NO: 959102 - RNA, 22 nt, Human
aaguuuguuguacauguuagua

SEQ ID NO: 959103 - RNA, 22 nt, Human
ggccaaaugaaggcaaugggac

SEQ ID NO: 959104 - RNA, 22 nt, Human
ucacucuguguuucccugggac

SEQ ID NO: 959105 - RNA, 22 nt, Human
auuagguuagugugcaagagaa

SEQ ID NO: 959106 - RNA, 22 nt, Human
auuauuagauucuuaauuguaa

SEQ ID NO: 959107 - RNA, 22 nt, Human
uucuuaggacuaguauagcaug

SEQ ID NO: 959108 - RNA, 17 nt, Human
auuagguuuugucauga

SEQ ID NO: 959109 - RNA, 22 nt, Human
ucuuuuaaaagcccugcugucu

SEQ ID NO: 959110 - RNA, 22 nt, Human
auguuuaagaaagucuuccaua

SEQ ID NO: 959111 - RNA, 18 nt, Human
ugucaucuguuuaaaacc

SEQ ID NO: 959112 - RNA, 19 nt, Human
ugcuagaaauucugugacu

SEQ ID NO: 959113 - RNA, 22 nt, Human
aaaucaguaaauguucauuaac

SEQ ID NO: 959114 - RNA, 22 nt, Human
uggcaacauggacaggucugcc

SEQ ID NO: 959115 - RNA, 22 nt, Human
ucacucuguuuuacucacuguu

SEQ ID NO: 959116 - RNA, 22 nt, Human
ucugagccacagauguccuguu

SEQ ID NO: 959117 - RNA, 22 nt, Human
acuuugaaacuaaaauucauua

SEQ ID NO: 959118 - RNA, 22 nt, Human
auguggcauucuuggucauuuc

SEQ ID NO: 959119 - RNA, 21 nt, Human
gauguuggaggcuggggucug

SEQ ID NO: 959120 - RNA, 22 nt, Human
uuucacaaugcaauccuacuuc

SEQ ID NO: 959121 - RNA, 22 nt, Human
ugcauguggaccccuggugccu

SEQ ID NO: 959122 - RNA, 22 nt, Human
gcucugcuaauauuguaguacc

SEQ ID NO: 959123 - RNA, 22 nt, Human
uugcaaauuauuuuagucccuu

SEQ ID NO: 959124 - RNA, 22 nt, Human
auuuauuaccucggaguuucug

SEQ ID NO: 959125 - RNA, 22 nt, Human
acaugaaaccugagucuaacuc

SEQ ID NO: 959126 - RNA, 22 nt, Human
uggucaaauuuagucucuggaa

SEQ ID NO: 959127 - RNA, 22 nt, Human
uucagcaaugacagccuauaua

SEQ ID NO: 959128 - RNA, 22 nt, Human
auacauacauguacacauaaau

SEQ ID NO: 959129 - RNA, 22 nt, Human
aaacccugcccuucccaagaug

SEQ ID NO: 959130 - RNA, 22 nt, Human
uuccuggcaugaaaaauaucac

SEQ ID NO: 959131 - RNA, 22 nt, Human
cuucaugcugauauccucgaug

SEQ ID NO: 959132 - RNA, 22 nt, Human
ggaagugaggaauuagguuuau

SEQ ID NO: 959133 - RNA, 22 nt, Human
uuagugauuacuacauagauga

SEQ ID NO: 959134 - RNA, 23 nt, Human
uucuuauuuacuuuggaaucucc

SEQ ID NO: 959135 - RNA, 22 nt, Human
uauuuauucauucagcaagcau

SEQ ID NO: 959136 - RNA, 22 nt, Human
aaaaagcuuaaaugagcaguuc

SEQ ID NO: 959137 - RNA, 18 nt, Human
uuaauguggcuuacuaug

SEQ ID NO: 959138 - RNA, 22 nt, Human
aacauuucauuggaagcuaugu

SEQ ID NO: 959139 - RNA, 22 nt, Human
acagacauucagcuaagucuau

SEQ ID NO: 959140 - RNA, 22 nt, Human
ucuuuauuuuaugcuugugcaa

SEQ ID NO: 959141 - RNA, 22 nt, Human
cagacaggaauucuggcguggu

SEQ ID NO: 959142 - RNA, 22 nt, Human
aaugauggucauggcaacuuuu

SEQ ID NO: 959143 - RNA, 22 nt, Human
aaacaccaagagcuagcuauua

SEQ ID NO: 959144 - RNA, 22 nt, Human
guggccaagagauaaaauugug

SEQ ID NO: 959145 - RNA, 22 nt, Human
uuggccaaagcucaccagugcu

SEQ ID NO: 959146 - RNA, 22 nt, Human
guuccaguaugauuccacccau

SEQ ID NO: 959147 - RNA, 22 nt, Human
auaaaacuuauuagaauugugu

SEQ ID NO: 959148 - RNA, 22 nt, Human
uuuuauugucaaugaagacaga

SEQ ID NO: 959149 - RNA, 22 nt, Human
ucauaaaaauagacucuaaagu

SEQ ID NO: 959150 - RNA, 22 nt, Human
cugagccuguguuucucuggca

SEQ ID NO: 959151 - RNA, 21 nt, Human
cuggccgaccccucugugcuc

SEQ ID NO: 959152 - RNA, 18 nt, Human
gcuccuggagucugacuc

SEQ ID NO: 959153 - RNA, 22 nt, Human
cagcugcaguucaaugcuugcu

SEQ ID NO: 959154 - RNA, 22 nt, Human
uucugagcugcaacacuaacau

SEQ ID NO: 959155 - RNA, 18 nt, Human
uuaaggauaagcagacua

SEQ ID NO: 959156 - RNA, 22 nt, Human
ggccacaacuugcuccuagccc

SEQ ID NO: 959157 - RNA, 22 nt, Human
caccuuuugugucugcguuugu

SEQ ID NO: 959158 - RNA, 22 nt, Human
uagagcugggcagugcucugag

SEQ ID NO: 959159 - RNA, 22 nt, Human
uuggccaaccagaacggagguc

SEQ ID NO: 959160 - RNA, 22 nt, Human
uccugucuaaagaccugcaggc

SEQ ID NO: 959161 - RNA, 22 nt, Human
aauucacaaaaguuagauccau

SEQ ID NO: 959162 - RNA, 22 nt, Human
uaugucacauuguaacagugug

SEQ ID NO: 959163 - RNA, 22 nt, Human
ccuguuuagugaggugaggagu

SEQ ID NO: 959164 - RNA, 22 nt, Human
auagaguccaaaguaugaauau

SEQ ID NO: 959165 - RNA, 22 nt, Human
ggucugaguagagggcuggcga

SEQ ID NO: 959166 - RNA, 22 nt, Human
aauuucaaguggcaucuuugau

SEQ ID NO: 959167 - RNA, 22 nt, Human
ucauugaaugcucugcagguug

SEQ ID NO: 959168 - RNA, 22 nt, Human
ccuccuggcccugggccuggaa

SEQ ID NO: 959169 - RNA, 22 nt, Human
gcucugcuggaaguucucugga

SEQ ID NO: 959170 - RNA, 22 nt, Human
ggcaacauucuccagauccuuu

SEQ ID NO: 959171 - RNA, 22 nt, Human
aaaugaguuuccucaauguccu

SEQ ID NO: 959172 - RNA, 22 nt, Human
cugggccagcaacugcaaugga

SEQ ID NO: 959173 - RNA, 19 nt, Human
ugaggccaaggucacagau

SEQ ID NO: 959174 - RNA, 23 nt, Human
agggcacugaagcuggaauuggg

SEQ ID NO: 959175 - RNA, 22 nt, Human
uuuaauugauucacagucugua

SEQ ID NO: 959176 - RNA, 22 nt, Human
ugaagggggagauauaugugug

SEQ ID NO: 959177 - RNA, 22 nt, Human
uuaaaugaugcauaucauuuag

SEQ ID NO: 959178 - RNA, 22 nt, Human
uuaauaaacaggugcagcugaa

SEQ ID NO: 959179 - RNA, 22 nt, Human
uccuggccuccguucucugcau

SEQ ID NO: 959180 - RNA, 22 nt, Human
aggauuucugugccuggaaaau

SEQ ID NO: 959181 - RNA, 22 nt, Human
agaaaugacacacaugagacau

SEQ ID NO: 959182 - RNA, 22 nt, Human
gcuggccagugucccagggauc

SEQ ID NO: 959183 - RNA, 22 nt, Human
agaaauguggaggaacagggcu

SEQ ID NO: 959184 - RNA, 22 nt, Human
uaggaugaaaauccagcuuaua

SEQ ID NO: 959185 - RNA, 22 nt, Human
uaacuccaucucugugucugcu

SEQ ID NO: 959186 - RNA, 22 nt, Human
cuccugggagucuuccuggaug

SEQ ID NO: 959187 - RNA, 22 nt, Human
cacaugugugcugaggacugug

SEQ ID NO: 959188 - RNA, 22 nt, Human
ugaauauguuccucacaaguuc

SEQ ID NO: 959189 - RNA, 22 nt, Human
cuggccaaugccuggggaauag

SEQ ID NO: 959190 - RNA, 22 nt, Human
acuggccaggcgaaccacacug

SEQ ID NO: 959191 - RNA, 23 nt, Human
ccagucucuuuccaaaaucacau

SEQ ID NO: 959192 - RNA, 21 nt, Human
cauuucaugauuauagaaaug

SEQ ID NO: 959193 - RNA, 23 nt, Human
acagaaaguucugcuggacagag

SEQ ID NO: 959194 - RNA, 22 nt, Human
uggaagagacacuuacauucag

SEQ ID NO: 959195 - RNA, 22 nt, Human
guucacaagcuggguuucugca

SEQ ID NO: 959196 - RNA, 22 nt, Human
ccuggccagaggcgugccugug

SEQ ID NO: 959197 - RNA, 22 nt, Human
uccaagggaaacugcacuucua

SEQ ID NO: 959198 - RNA, 22 nt, Human
uugaaauauggauugaccuuga

SEQ ID NO: 959199 - RNA, 21 nt, Human
auuuggcaaaggcgaugcaca

SEQ ID NO: 959200 - RNA, 20 nt, Human
acugggcauaccuguccugu

SEQ ID NO: 959201 - RNA, 22 nt, Human
uaggcaauauuagacuuugucu

SEQ ID NO: 959202 - RNA, 22 nt, Human
cuggcacaugcucccugagugg

SEQ ID NO: 959203 - RNA, 22 nt, Human
augugcuaaacucaacaaaucu

SEQ ID NO: 959204 - RNA, 22 nt, Human
uuggccaagucacugguuaaug

SEQ ID NO: 959205 - RNA, 22 nt, Human
ugcugaaagucccaaaucucau

SEQ ID NO: 959206 - RNA, 22 nt, Human
aauguacaauaagacaaagagg

SEQ ID NO: 959207 - RNA, 22 nt, Human
acgcuuuuacuauuuugagcuc

SEQ ID NO: 959208 - RNA, 22 nt, Human
auucacaaugauacauaagcga

SEQ ID NO: 959209 - RNA, 22 nt, Human
cucugcuaagcaugaacaauua

SEQ ID NO: 959210 - RNA, 22 nt, Human
uggccaaaguagaaaauaauag

SEQ ID NO: 959211 - RNA, 18 nt, Human
uggcagcaggaagccauu

SEQ ID NO: 959212 - RNA, 22 nt, Human
gcaaaacagucgaugccuccca

SEQ ID NO: 959213 - RNA, 22 nt, Human
cagggucuuggcgccaucaccc

SEQ ID NO: 959214 - RNA, 21 nt, Human
agggaaagaaaaugagcuaau

SEQ ID NO: 959215 - RNA, 22 nt, Human
auucugagacaauugccgucag

SEQ ID NO: 959216 - RNA, 23 nt, Human
agucuuaauacagcucuuuucua

SEQ ID NO: 959217 - RNA, 22 nt, Human
ugucaucugauauuacuuauag

SEQ ID NO: 959218 - RNA, 22 nt, Human
uuuaggaucucucuuguuacau

SEQ ID NO: 959219 - RNA, 22 nt, Human
aaacaugagcacuugcuucaua

SEQ ID NO: 959220 - RNA, 22 nt, Human
aaauaugaaugauaagaguuau

SEQ ID NO: 959221 - RNA, 22 nt, Human
auauaauaguuucauaaaggcu

SEQ ID NO: 959222 - RNA, 22 nt, Human
gaccuuuuuacuguguacgcug

SEQ ID NO: 959223 - RNA, 22 nt, Human
uucaucaauguguuuaauaaug

SEQ ID NO: 959224 - RNA, 22 nt, Human
cacucugcagcugaagggcugg

SEQ ID NO: 959225 - RNA, 22 nt, Human
ugcuuccuauccacacaaugcc

SEQ ID NO: 959226 - RNA, 22 nt, Human
augaggcaaucaugguccaguu

SEQ ID NO: 959227 - RNA, 22 nt, Human
aauaagauugacacaaguaccu

SEQ ID NO: 959228 - RNA, 23 nt, Human
cuuugccacccagagccugacag

SEQ ID NO: 959229 - RNA, 22 nt, Human
caggagcccagaguccucagcu

SEQ ID NO: 959230 - RNA, 22 nt, Human
uacuuugucaugcuaagaguga

SEQ ID NO: 959231 - RNA, 22 nt, Human
uucuuaagcguaugauaaugaa

SEQ ID NO: 959232 - RNA, 22 nt, Human
ugucacauaggcaaaauguuuu

SEQ ID NO: 959233 - RNA, 22 nt, Human
ccuguuuagugaggugaggagu

SEQ ID NO: 959234 - RNA, 22 nt, Human
guccucugcccaggucaagguu

SEQ ID NO: 959235 - RNA, 22 nt, Human
uuagucuucuuccuuauauguu

SEQ ID NO: 959236 - RNA, 22 nt, Human
agcaggcuccuuccuucucugg

SEQ ID NO: 959237 - RNA, 22 nt, Human
ggucaggggcugcucuacagag

SEQ ID NO: 959238 - RNA, 22 nt, Human
ucuccuggccuuuagguuaagg

SEQ ID NO: 959239 - RNA, 22 nt, Human
cacugaaauauuaauaucuuau

SEQ ID NO: 959240 - RNA, 22 nt, Human
gccccucccagucaggagcacu

SEQ ID NO: 959241 - RNA, 19 nt, Human
gcagccaggugcucuaccu

SEQ ID NO: 959242 - RNA, 22 nt, Human
uguguuuuacaaauucucuuaa

SEQ ID NO: 959243 - RNA, 22 nt, Human
uuuuauucuaaguaugauggga

SEQ ID NO: 959244 - RNA, 20 nt, Human
ugugcccaauguccagguuc

SEQ ID NO: 959245 - RNA, 22 nt, Human
auuugaauggcuuaacacaacg

SEQ ID NO: 959246 - RNA, 22 nt, Human
auggaaagugcauggaagucau

SEQ ID NO: 959247 - RNA, 22 nt, Human
cugccgaguacagccauagaaa

SEQ ID NO: 959248 - RNA, 22 nt, Human
caggccagugugcuucccaggc

SEQ ID NO: 959249 - RNA, 22 nt, Human
augaaggauggcuggcugcccu

SEQ ID NO: 959250 - RNA, 22 nt, Human
uaagaacaucuguccccagauu

SEQ ID NO: 959251 - RNA, 22 nt, Human
caccucuuugauuugaggcaag

SEQ ID NO: 959252 - RNA, 20 nt, Human
aauauaauucucugaauuua

SEQ ID NO: 959253 - RNA, 22 nt, Human
gcugucuguggugucagcugac

SEQ ID NO: 959254 - RNA, 22 nt, Human
uucuacaugguugcucagaggg

SEQ ID NO: 959255 - RNA, 22 nt, Human
ccucugcagcagagagccagag

SEQ ID NO: 959256 - RNA, 22 nt, Human
aacagaaaucauuuagggcucu

SEQ ID NO: 959257 - RNA, 22 nt, Human
agagugaaguaauuguuaggau

SEQ ID NO: 959258 - RNA, 21 nt, Human
cucacaggaugcaguguuacu

SEQ ID NO: 959259 - RNA, 21 nt, Human
uuugcauuuuacaugugggga

SEQ ID NO: 959260 - RNA, 19 nt, Human
auuuacugccuaaaaucuc

SEQ ID NO: 959261 - RNA, 23 nt, Human
gggagccaggaccucgcgcccca

SEQ ID NO: 959262 - RNA, 22 nt, Human
cagcccugcacgcugccuccgc

SEQ ID NO: 959263 - RNA, 21 nt, Human
agcagaggcagaauguaugca

SEQ ID NO: 959264 - RNA, 22 nt, Human
ucugucugagggagugacauuu

SEQ ID NO: 959265 - RNA, 22 nt, Human
agggugcauguuugcaagagug

SEQ ID NO: 959266 - RNA, 23 nt, Human
gguggcaggaguggaugcugagc

SEQ ID NO: 959267 - RNA, 22 nt, Human
cccagcaguaaccaguggaaau

SEQ ID NO: 959268 - RNA, 22 nt, Human
guaucuuuugguggaaaaauaa

SEQ ID NO: 959269 - RNA, 22 nt, Human
ugaggcaguauuuuagugacuu

SEQ ID NO: 959270 - RNA, 22 nt, Human
agucccagcucagaaccacuag

SEQ ID NO: 959271 - RNA, 22 nt, Human
ucucagggagggcgagucagcg

SEQ ID NO: 959272 - RNA, 22 nt, Human
ugcuggccgugagcucucggga

SEQ ID NO: 959273 - RNA, 22 nt, Human
gugcauauaugugcagcaucaa

SEQ ID NO: 959274 - RNA, 22 nt, Human
ugcaguggaaagacucagacuu

SEQ ID NO: 959275 - RNA, 22 nt, Human
caggauggagggagggcuguua

SEQ ID NO: 959276 - RNA, 22 nt, Human
acacuuuuagcuaugaguuaau

SEQ ID NO: 959277 - RNA, 22 nt, Human
ugaggcagguggauuacaaggu

SEQ ID NO: 959278 - RNA, 22 nt, Human
ccuguggcacaugcagggauuc

SEQ ID NO: 959279 - RNA, 22 nt, Human
aagcaauaagccagauuuggau

SEQ ID NO: 959280 - RNA, 22 nt, Human
aaguaaaauguuuccuuuauua

SEQ ID NO: 959281 - RNA, 22 nt, Human
agagccaggugcugcuguuuga

SEQ ID NO: 959282 - RNA, 22 nt, Human
gcagaagucagaccaucugaau

SEQ ID NO: 959283 - RNA, 19 nt, Human
uuugaaagaguuuuauugg

SEQ ID NO: 959284 - RNA, 22 nt, Human
ucuggaguccagauccauuugg

SEQ ID NO: 959285 - RNA, 22 nt, Human
cugcugagcaucagggcugccc

SEQ ID NO: 959286 - RNA, 22 nt, Human
ucccagagcucugacaccagcu

SEQ ID NO: 959287 - RNA, 22 nt, Human
uguaugcaccauuguauuaccu

SEQ ID NO: 959288 - RNA, 22 nt, Human
cugcagaggucuugcugauggu

SEQ ID NO: 959289 - RNA, 22 nt, Human
caggcugggaacgccacccgcu

SEQ ID NO: 959290 - RNA, 22 nt, Human
agguggccggugccagccgggc

SEQ ID NO: 959291 - RNA, 22 nt, Human
ccagggcaaaugagaucauagc

SEQ ID NO: 959292 - RNA, 22 nt, Human
agaacagaagggaggaaggccu

SEQ ID NO: 959293 - RNA, 22 nt, Human
aaauuauucucauguguuucuu

SEQ ID NO: 959294 - RNA, 22 nt, Human
agaggccaucugcucugugggg

SEQ ID NO: 959295 - RNA, 22 nt, Human
ugggaggaaugucacugagcca

SEQ ID NO: 959296 - RNA, 22 nt, Human
cugcagcugucucuacugggca

SEQ ID NO: 959297 - RNA, 22 nt, Human
gaggcccugguaggucagagug

SEQ ID NO: 959298 - RNA, 23 nt, Human
ggccuguguuuugucugaaguac

SEQ ID NO: 959299 - RNA, 22 nt, Human
gaagaggaugacaggagccggu

SEQ ID NO: 959300 - RNA, 22 nt, Human
cuuuggcaugguccucacuaua

SEQ ID NO: 959301 - RNA, 22 nt, Human
uuuuggucagguuggucucgaa

SEQ ID NO: 959302 - RNA, 22 nt, Human
ccucagaugucuuaaggcacug

SEQ ID NO: 959303 - RNA, 19 nt, Human
ggcugucuggcguguggau

SEQ ID NO: 959304 - RNA, 22 nt, Human
accagcucagaagccagaaaga

SEQ ID NO: 959305 - RNA, 22 nt, Human
agccagcugccuuucacaucug

SEQ ID NO: 959306 - RNA, 22 nt, Human
ucuccugguuuguuaaauaauu

SEQ ID NO: 959307 - RNA, 22 nt, Human
gcucccagcauugcuucccagg

SEQ ID NO: 959308 - RNA, 22 nt, Human
caggaucuuuuaaugucuccag

SEQ ID NO: 959309 - RNA, 18 nt, Human
gggcauggaugcagcauc

SEQ ID NO: 959310 - RNA, 22 nt, Human
ggcagcuuucucacccaugacc

SEQ ID NO: 959311 - RNA, 22 nt, Human
uuggaaagcaagcuggacauac

SEQ ID NO: 959312 - RNA, 22 nt, Human
ggcagggaagcuggcaucacgg

SEQ ID NO: 959313 - RNA, 23 nt, Human
agccucuuuucuccugcccugca

SEQ ID NO: 959314 - RNA, 22 nt, Human
cuucuggggauggagcccagaa

SEQ ID NO: 959315 - RNA, 22 nt, Human
cugggaggcggagguuguagug

SEQ ID NO: 959316 - RNA, 22 nt, Human
uugggagcuggaagcaaggccu

SEQ ID NO: 959317 - RNA, 22 nt, Human
uuuccucauuuaucugcuggga

SEQ ID NO: 959318 - RNA, 22 nt, Human
aggcucagagagcuguguccau

SEQ ID NO: 959319 - RNA, 22 nt, Human
augggaggcagcagagcccagc

SEQ ID NO: 959320 - RNA, 22 nt, Human
ugaaggcuguuggauggggaag

SEQ ID NO: 959321 - RNA, 22 nt, Human
acaucugaggagaccagccucu

SEQ ID NO: 959322 - RNA, 22 nt, Human
cauuuguuaaccaguguggauu

SEQ ID NO: 959323 - RNA, 20 nt, Human
ugacucugcaaccgucucuc

SEQ ID NO: 959324 - RNA, 22 nt, Human
ucucagagauuuauggaaaacu

SEQ ID NO: 959325 - RNA, 22 nt, Human
acaggggaauuuacugucauua

SEQ ID NO: 959326 - RNA, 19 nt, Human
ucaggacugacuugaaguc

SEQ ID NO: 959327 - RNA, 20 nt, Human
aggcugggguguuuugccca

SEQ ID NO: 959328 - RNA, 22 nt, Human
cagucccagacccagaaggugg

SEQ ID NO: 959329 - RNA, 22 nt, Human
auuucuuccucugucaguaacu

SEQ ID NO: 959330 - RNA, 22 nt, Human
gaaauuauugcuagagacugca

SEQ ID NO: 959331 - RNA, 22 nt, Human
ucucagagccuaacuaaccuaa

SEQ ID NO: 959332 - RNA, 22 nt, Human
auccaggcuggguguggcuacu

SEQ ID NO: 959333 - RNA, 22 nt, Human
acaggcuuacaggcugcaagua

SEQ ID NO: 959334 - RNA, 22 nt, Human
ucagucucagcaccuagucaca

SEQ ID NO: 959335 - RNA, 22 nt, Human
ccugcugggccugagcaaugag

SEQ ID NO: 959336 - RNA, 22 nt, Human
gaagagcugcaguuuccugggc

SEQ ID NO: 959337 - RNA, 22 nt, Human
caguacuuuucaaccaguauga

SEQ ID NO: 959338 - RNA, 22 nt, Human
ccagggcuccauugcucauccu

SEQ ID NO: 959339 - RNA, 19 nt, Human
uggcuccugccugccuucu

SEQ ID NO: 959340 - RNA, 22 nt, Human
gaccauuucuaggaaucagacu

SEQ ID NO: 959341 - RNA, 22 nt, Human
aggcaagcauugggaacagggc

SEQ ID NO: 959342 - RNA, 22 nt, Human
uguaugcagcaaaacaauuagu

SEQ ID NO: 959343 - RNA, 23 nt, Human
gccugccugaccugugcaaaguc

SEQ ID NO: 959344 - RNA, 22 nt, Human
ggagccagcagggugacacuga

SEQ ID NO: 959345 - RNA, 22 nt, Human
cagggcaugaggugugcuucuc

SEQ ID NO: 959346 - RNA, 22 nt, Human
uucuucucagggucccacaugg

SEQ ID NO: 959347 - RNA, 22 nt, Human
uggucaggcugcucugcggcgu

SEQ ID NO: 959348 - RNA, 22 nt, Human
uuuguuuugaacuagcucagaa

SEQ ID NO: 959349 - RNA, 22 nt, Human
ucucagggcagcaaggaagcau

SEQ ID NO: 959350 - RNA, 22 nt, Human
acucucugguauuggcaaguuu

SEQ ID NO: 959351 - RNA, 22 nt, Human
uggggcugugagacuacaggau

SEQ ID NO: 959352 - RNA, 22 nt, Human
aggacccugagcgggcaugccg

SEQ ID NO: 959353 - RNA, 22 nt, Human
uccauuuucuaaguaucacuua

SEQ ID NO: 959354 - RNA, 22 nt, Human
ugaagcaacuggacaaguuggc

SEQ ID NO: 959355 - RNA, 21 nt, Human
agcagagugcuuugacuuugu

SEQ ID NO: 959356 - RNA, 22 nt, Human
gggucuggacggcugcaggaag

SEQ ID NO: 959357 - RNA, 22 nt, Human
ugugucccuuggaaccucagcu

SEQ ID NO: 959358 - RNA, 22 nt, Human
ucagacuucuacuuugcagagc

SEQ ID NO: 959359 - RNA, 22 nt, Human
aacaguaucuuuuaucagaaau

SEQ ID NO: 959360 - RNA, 22 nt, Human
agggaguguaaauggugcucag

SEQ ID NO: 959361 - RNA, 22 nt, Human
cagagugaaaacugagcucaaa

SEQ ID NO: 959362 - RNA, 22 nt, Human
uucuccaacacaagcaugaugu

SEQ ID NO: 959363 - RNA, 22 nt, Human
uccaggcaggguuaaggguccu

SEQ ID NO: 959364 - RNA, 22 nt, Human
gguggggucacgacagagggaa

SEQ ID NO: 959365 - RNA, 22 nt, Human
gcucaagggaugggagugggug

SEQ ID NO: 959366 - RNA, 23 nt, Human
ccaggccucucagagggugugcc

SEQ ID NO: 959367 - RNA, 23 nt, Human
ugucauugugacuacagaaccag

SEQ ID NO: 959368 - RNA, 22 nt, Human
gccuugggggugaaagaggcua

SEQ ID NO: 959369 - RNA, 22 nt, Human
gggcugcugccaaucacagccu

SEQ ID NO: 959370 - RNA, 22 nt, Human
uuuaacagaugugaaauuuuca

SEQ ID NO: 959371 - RNA, 22 nt, Human
gcucagagaaucagcagacacc

SEQ ID NO: 959372 - RNA, 22 nt, Human
gcaggaugaaggcagaggcuga

SEQ ID NO: 959373 - RNA, 23 nt, Human
gggcagcuuaagcuuguuuuucu

SEQ ID NO: 959374 - RNA, 22 nt, Human
uaaaguucuggugagagguaag

SEQ ID NO: 959375 - RNA, 22 nt, Human
ggccugcacagagguggcucua

SEQ ID NO: 959376 - RNA, 22 nt, Human
ccucacugcuauguguuugcuc

SEQ ID NO: 959377 - RNA, 22 nt, Human
gaggaaaagagacagguuauug

SEQ ID NO: 959378 - RNA, 22 nt, Human
agccaggcugcaguuggcuggc

SEQ ID NO: 959379 - RNA, 22 nt, Human
auucuucagcaggggacacuau

SEQ ID NO: 959380 - RNA, 23 nt, Human
aaccuagacuacuuacuaugugg

SEQ ID NO: 959381 - RNA, 22 nt, Human
ucaauucaacacaugcacauug

SEQ ID NO: 959382 - RNA, 22 nt, Human
ccugugcccucagccuggcucu

SEQ ID NO: 959383 - RNA, 19 nt, Human
aggaaagguggccuuagca

SEQ ID NO: 959384 - RNA, 23 nt, Human
gaggcacucaggaaaugugagug

SEQ ID NO: 959385 - RNA, 22 nt, Human
gacaaaggaucagagguuggga

SEQ ID NO: 959386 - RNA, 22 nt, Human
acauaacaaucauaggacauag

SEQ ID NO: 959387 - RNA, 22 nt, Human
uaagacaauucuucagucacaa

SEQ ID NO: 959388 - RNA, 22 nt, Human
auucacaaguucuagggauuag

SEQ ID NO: 959389 - RNA, 22 nt, Human
uagggauggcagcauguagcuu

SEQ ID NO: 959390 - RNA, 22 nt, Human
aagccuuccugagugcaaggcc

SEQ ID NO: 959391 - RNA, 22 nt, Human
auuuucuauucugcugguuuag

SEQ ID NO: 959392 - RNA, 22 nt, Human
cagaggcagccgggggagaacg

SEQ ID NO: 959393 - RNA, 21 nt, Human
agagucugcauuucugacaag

SEQ ID NO: 959394 - RNA, 22 nt, Human
agccucugcacgggcacgggug

SEQ ID NO: 959395 - RNA, 22 nt, Human
agguggagaagagaugggcagu

SEQ ID NO: 959396 - RNA, 22 nt, Human
cucaugauguagcgaaugagaa

SEQ ID NO: 959397 - RNA, 22 nt, Human
uugucuuaaauggauggacaau

SEQ ID NO: 959398 - RNA, 22 nt, Human
guuguauucuucaauaucagag

SEQ ID NO: 959399 - RNA, 22 nt, Human
gagagggccgggggccagcucc

SEQ ID NO: 959400 - RNA, 22 nt, Human
cugcagagcauaaaucugaaua

SEQ ID NO: 959401 - RNA, 22 nt, Human
ucacacguccuugcuacuccuc

SEQ ID NO: 959402 - RNA, 22 nt, Human
uacucugcaggauggacuaugg

SEQ ID NO: 959403 - RNA, 22 nt, Human
caggacaguuugcuuugcccug

SEQ ID NO: 959404 - RNA, 22 nt, Human
aauucacaaaaguuagauccau

SEQ ID NO: 959405 - RNA, 22 nt, Human
cugcaggauucucccaguugga

SEQ ID NO: 959406 - RNA, 22 nt, Human
caggaagagaacauggaggcug

SEQ ID NO: 959407 - RNA, 22 nt, Human
auguaguauuuggaaauguaaa

SEQ ID NO: 959408 - RNA, 22 nt, Human
ugugucagagguagagauggca

SEQ ID NO: 959409 - RNA, 21 nt, Human
aaucauacaaaacaugucagg

SEQ ID NO: 959410 - RNA, 22 nt, Human
ugaaggccagcagagugaaggc

SEQ ID NO: 959411 - RNA, 23 nt, Human
uggccaagauaaucucaguuuuc

SEQ ID NO: 959412 - RNA, 22 nt, Human
cuuagcaugugguguccuugua

SEQ ID NO: 959413 - RNA, 22 nt, Human
agugugucugaucacuugugag

SEQ ID NO: 959414 - RNA, 22 nt, Human
guccucugggcuuugagcaguc

SEQ ID NO: 959415 - RNA, 22 nt, Human
ucauuucuauugcuacugucug

SEQ ID NO: 959416 - RNA, 22 nt, Human
gcccaggauucuuucuuccuua

SEQ ID NO: 959417 - RNA, 20 nt, Human
uggcccuguuuucuccaggc

SEQ ID NO: 959418 - RNA, 22 nt, Human
ccucagaggugaacaucagugc

SEQ ID NO: 959419 - RNA, 22 nt, Human
aaugcacauguuguaauaaaua

SEQ ID NO: 959420 - RNA, 22 nt, Human
caccuagcagaacagaggugcu

SEQ ID NO: 959421 - RNA, 22 nt, Human
aggugcagcugguggagucugg

SEQ ID NO: 959422 - RNA, 22 nt, Human
agcugauuccacuuuuucccca

SEQ ID NO: 959423 - RNA, 22 nt, Human
uggggcuggcuauugucucccu

SEQ ID NO: 959424 - RNA, 22 nt, Human
uggccauagcucagcuccuuca

SEQ ID NO: 959425 - RNA, 22 nt, Human
ugggcagauguggcucuccuug

SEQ ID NO: 959426 - RNA, 20 nt, Human
gcauccauauaugcaugugu

SEQ ID NO: 959427 - RNA, 22 nt, Human
ucauugcaguagggagagaccc

SEQ ID NO: 959428 - RNA, 22 nt, Human
ccugggaggcggagguugcagg

SEQ ID NO: 959429 - RNA, 22 nt, Human
auguccuucuccucuuaccugc

SEQ ID NO: 959430 - RNA, 22 nt, Human
aaaugcuguguuuuaacauaga

SEQ ID NO: 959431 - RNA, 19 nt, Human
uccuuugaauaucaguuga

SEQ ID NO: 959432 - RNA, 22 nt, Human
ucgugcuccuggugaggcucug

SEQ ID NO: 959433 - RNA, 22 nt, Human
cugcaguguucuggaaugcauu

SEQ ID NO: 959434 - RNA, 22 nt, Human
cugggugaguugaugaaggaga

SEQ ID NO: 959435 - RNA, 21 nt, Human
uccaggaguggcugggcaggg

SEQ ID NO: 959436 - RNA, 23 nt, Human
gggagccauggguggucauggag

SEQ ID NO: 959437 - RNA, 22 nt, Human
cagagccaugguaugggcuugu

SEQ ID NO: 959438 - RNA, 19 nt, Human
aggcagaggcuuggcuagc

SEQ ID NO: 959439 - RNA, 22 nt, Human
aggcagcccacaggacacagga

SEQ ID NO: 959440 - RNA, 22 nt, Human
gauuucuuugcaagcuguguuc

SEQ ID NO: 959441 - RNA, 22 nt, Human
uauuuccauguuagaacuaagu

SEQ ID NO: 959442 - RNA, 22 nt, Human
cauuuuaaaugauuuaagccaa

SEQ ID NO: 959443 - RNA, 22 nt, Human
gggacuggaacuacuggugcag

SEQ ID NO: 959444 - RNA, 22 nt, Human
aucaguuuuuauuaauguagcu

SEQ ID NO: 959445 - RNA, 22 nt, Human
aguguuccugcucucaggaagc

SEQ ID NO: 959446 - RNA, 22 nt, Human
ucagaagaagagacuccacagc

SEQ ID NO: 959447 - RNA, 22 nt, Human
uuguugguggaauugaugcuag

SEQ ID NO: 959448 - RNA, 22 nt, Human
ucacagaaauaagauaguuauu

SEQ ID NO: 959449 - RNA, 22 nt, Human
ucuguucaucucaugggagaau

SEQ ID NO: 959450 - RNA, 22 nt, Human
ggcagcauauauucagugggca

SEQ ID NO: 959451 - RNA, 22 nt, Human
gugagcagaacagguggcuucu

SEQ ID NO: 959452 - RNA, 22 nt, Human
aucuggcucaccuggguaaaua

SEQ ID NO: 959453 - RNA, 22 nt, Human
caggaaccuaaagagacauuac

SEQ ID NO: 959454 - RNA, 22 nt, Human
ucaggauguccaaaauccagcc

SEQ ID NO: 959455 - RNA, 22 nt, Human
uuuuuaagcuccuuugauguca

SEQ ID NO: 959456 - RNA, 22 nt, Human
cugaaugaggaaaagagugagg

SEQ ID NO: 959457 - RNA, 22 nt, Human
cuguguggacugguugaggccc

SEQ ID NO: 959458 - RNA, 22 nt, Human
gggcucugguacuuccuggcuc

SEQ ID NO: 959459 - RNA, 22 nt, Human
aucuuucuauuucuaaaaacua

SEQ ID NO: 959460 - RNA, 18 nt, Human
agucucagcggaggagua

SEQ ID NO: 959461 - RNA, 22 nt, Human
ccaggagagcaggcgugcagcu

SEQ ID NO: 959462 - RNA, 22 nt, Human
uuuaguagugacagauucuggg

SEQ ID NO: 959463 - RNA, 22 nt, Human
aucaggaucugggagccugaaa

SEQ ID NO: 959464 - RNA, 22 nt, Human
gaggcugucuguuagccuggga

SEQ ID NO: 959465 - RNA, 22 nt, Human
augcaaaaguaacugugauuuu

SEQ ID NO: 959466 - RNA, 22 nt, Human
cccagcucucugcucuuagccu

SEQ ID NO: 959467 - RNA, 22 nt, Human
auugacaagacaauggcucuua

SEQ ID NO: 959468 - RNA, 19 nt, Human
aagcagcccuggcaagagc

SEQ ID NO: 959469 - RNA, 22 nt, Human
aaaaaugugaccacaggguguu

SEQ ID NO: 959470 - RNA, 22 nt, Human
cccaggaggcggagguuguggu

SEQ ID NO: 959471 - RNA, 18 nt, Human
gcuccugguuggaaagaa

SEQ ID NO: 959472 - RNA, 22 nt, Human
ccugggaggcggagguugcagu

SEQ ID NO: 959473 - RNA, 22 nt, Human
uagggcagccacccaggcugcu

SEQ ID NO: 959474 - RNA, 22 nt, Human
aauaagaaagagucagcuucag

SEQ ID NO: 959475 - RNA, 20 nt, Human
ccuuuauuauuuguaugaug

SEQ ID NO: 959476 - RNA, 22 nt, Human
ccugagaccaaguugcagccau

SEQ ID NO: 959477 - RNA, 22 nt, Human
cccaggaguuggaggcuacggu

SEQ ID NO: 959478 - RNA, 22 nt, Human
gcuggguggaucggaggcucug

SEQ ID NO: 959479 - RNA, 22 nt, Human
agcuugccucuuaaucaccuca

SEQ ID NO: 959480 - RNA, 20 nt, Human
agaggaggauuauuuuauuc

SEQ ID NO: 959481 - RNA, 22 nt, Human
ggaggccuugaggccaggagcu

SEQ ID NO: 959482 - RNA, 22 nt, Human
cagggaguuuuuguuccucuag

SEQ ID NO: 959483 - RNA, 22 nt, Human
gcucccugcacucugcagcccu

SEQ ID NO: 959484 - RNA, 22 nt, Human
cagggcaguuugugccuaugag

SEQ ID NO: 959485 - RNA, 21 nt, Human
gcagcagaggcuugacagaca

SEQ ID NO: 959486 - RNA, 22 nt, Human
cuggggaggcagggcugccccu

SEQ ID NO: 959487 - RNA, 18 nt, Human
aauuuccauaugaauugc

SEQ ID NO: 959488 - RNA, 22 nt, Human
aggcagcugcccucuccuuccu

SEQ ID NO: 959489 - RNA, 22 nt, Human
gggccucucccuucucacgcau

SEQ ID NO: 959490 - RNA, 22 nt, Human
caaaugcuggcccugcuacuua

SEQ ID NO: 959491 - RNA, 22 nt, Human
acuggccaggcagcaguagcuu

SEQ ID NO: 959492 - RNA, 20 nt, Human
guaaaauauggucuuugggu

SEQ ID NO: 959493 - RNA, 17 nt, Human
ucuguccagggagugug

SEQ ID NO: 959494 - RNA, 22 nt, Human
cuuccuggccauugccauggca

SEQ ID NO: 959495 - RNA, 22 nt, Human
aucugccuccaaguccaugugu

SEQ ID NO: 959496 - RNA, 22 nt, Human
cccuggagcuagucugagcaga

SEQ ID NO: 959497 - RNA, 22 nt, Human
agcaccuguugcacuucauaau

SEQ ID NO: 959498 - RNA, 21 nt, Human
ugcagcugacacugguaugcc

SEQ ID NO: 959499 - RNA, 22 nt, Human
ggcagggugccuggcuccuguu

SEQ ID NO: 959500 - RNA, 21 nt, Human
uuaagagcuuagcaguaggcc

SEQ ID NO: 959501 - RNA, 22 nt, Human
agaauaaaucaaauguccugag

SEQ ID NO: 959502 - RNA, 22 nt, Human
aaguucaagcucugccuaaaau

SEQ ID NO: 959503 - RNA, 22 nt, Human
ccggggacuuaaagugaaggaa

SEQ ID NO: 959504 - RNA, 22 nt, Human
ccucccaccauuuagagagagc

SEQ ID NO: 959505 - RNA, 22 nt, Human
ucuggccuuaucuguccaagcc

SEQ ID NO: 959506 - RNA, 22 nt, Human
agauuuagugguggaauuuugg

SEQ ID NO: 959507 - RNA, 22 nt, Human
aggcagcugaggucuggcgccc

SEQ ID NO: 959508 - RNA, 16 nt, Human
agcagggcgggaagga

SEQ ID NO: 959509 - RNA, 22 nt, Human
ggggaaggauugaguugaccca

SEQ ID NO: 959510 - RNA, 16 nt, Human
ccacagggcaaggggc

SEQ ID NO: 959511 - RNA, 22 nt, Human
augcccugcaucaagugacacu

SEQ ID NO: 959512 - RNA, 23 nt, Human
ccagucucuuuccaaaaucacau

SEQ ID NO: 959513 - RNA, 22 nt, Human
uggcagagcaaaaagauagaau

SEQ ID NO: 959514 - RNA, 22 nt, Human
aggcagcuuaagcccuggccca

SEQ ID NO: 959515 - RNA, 22 nt, Human
uaaccuuuguucaauguaagau

SEQ ID NO: 959516 - RNA, 22 nt, Human
ugccagcuccgaggagcugcag

SEQ ID NO: 959517 - RNA, 22 nt, Human
agaaauguggaggaacagggcu

SEQ ID NO: 959518 - RNA, 22 nt, Human
aagccucaccuuuuagaagcua

SEQ ID NO: 959519 - RNA, 22 nt, Human
aggcaagggggcgccaccuucc

SEQ ID NO: 959520 - RNA, 22 nt, Human
aguauuucugcucaugaaagag

SEQ ID NO: 959521 - RNA, 21 nt, Human
aggcagcucaggcccagagag

SEQ ID NO: 959522 - RNA, 22 nt, Human
ccaugcaauuucuguaaaacca

SEQ ID NO: 959523 - RNA, 22 nt, Human
acuguguggaccacucugaggc

SEQ ID NO: 959524 - RNA, 22 nt, Human
gggagcugguuccugcccucca

SEQ ID NO: 959525 - RNA, 21 nt, Human
agugaaauugcaucagaggga

SEQ ID NO: 959526 - RNA, 22 nt, Human
ugcaguggaagagguggagauc

SEQ ID NO: 959527 - RNA, 22 nt, Human
uggcagcugguacagugggucu

SEQ ID NO: 959528 - RNA, 22 nt, Human
cucaaggaaagucuggagaaga

SEQ ID NO: 959529 - RNA, 22 nt, Human
accagagaaaacacagcaggcu

SEQ ID NO: 959530 - RNA, 22 nt, Human
gccaagaguuuccagcugcaag

SEQ ID NO: 959531 - RNA, 22 nt, Human
cuagaaauauuuuacagucaag

SEQ ID NO: 959532 - RNA, 22 nt, Human
cagcccugagagaaccaucuau

SEQ ID NO: 959533 - RNA, 22 nt, Human
ucugguuagccaauaaugccaa

SEQ ID NO: 959534 - RNA, 23 nt, Human
agccuucaggcaaugucaguaga

SEQ ID NO: 959535 - RNA, 22 nt, Human
accuugggcaaguuggaaacug

SEQ ID NO: 959536 - RNA, 22 nt, Human
gggccucugugcagaggggccu

SEQ ID NO: 959537 - RNA, 22 nt, Human
uuuuuugucuugaagaaauggu

SEQ ID NO: 959538 - RNA, 22 nt, Human
ugaggcaggacuugcauaaagu

SEQ ID NO: 959539 - RNA, 22 nt, Human
cauuuauuggcauguaguaggu

SEQ ID NO: 959540 - RNA, 22 nt, Human
aggaggccgcugaugggcuccc

SEQ ID NO: 959541 - RNA, 22 nt, Human
gaggguccccaugcagagcuca

SEQ ID NO: 959542 - RNA, 22 nt, Human
agggccuggugaccuggguccu

SEQ ID NO: 959543 - RNA, 22 nt, Human
ugggcagaggacagggaagauc

SEQ ID NO: 959544 - RNA, 22 nt, Human
uccccagccgugaaggagagga

SEQ ID NO: 959545 - RNA, 20 nt, Human
auuucaguguuugcaauuuc

SEQ ID NO: 959546 - RNA, 22 nt, Human
ugggcugcugucugcacaugcu

SEQ ID NO: 959547 - RNA, 22 nt, Human
acuguacuguguauuguagaau

SEQ ID NO: 959548 - RNA, 22 nt, Human
ucccaggaaggauucggcauuu

SEQ ID NO: 959549 - RNA, 22 nt, Human
uggcucagaaggcugccuucac

SEQ ID NO: 959550 - RNA, 22 nt, Human
ucauugcagcuucagguguuca

SEQ ID NO: 959551 - RNA, 22 nt, Human
auauucacugagcauaaagcca

SEQ ID NO: 959552 - RNA, 22 nt, Human
ccuuucagaugggcauggaccg

SEQ ID NO: 959553 - RNA, 22 nt, Human
ucuggcuccuggcuccacugcc

SEQ ID NO: 959554 - RNA, 22 nt, Human
aucauuuaaaacaagucucuau

SEQ ID NO: 959555 - RNA, 22 nt, Human
auugaaagcacaaagaacaagu

SEQ ID NO: 959556 - RNA, 22 nt, Human
agagugauccuaauugauuugg

SEQ ID NO: 959557 - RNA, 22 nt, Human
aacaugaaguuuucuauaguga

SEQ ID NO: 959558 - RNA, 15 nt, Human
cccaggaguucgaga

SEQ ID NO: 959559 - RNA, 22 nt, Human
cacagggccacuuucccaguaa

SEQ ID NO: 959560 - RNA, 22 nt, Human
auguagcaugaggcacugugcc

SEQ ID NO: 959561 - RNA, 22 nt, Human
ucugccugccagucugguccuc

SEQ ID NO: 959562 - RNA, 22 nt, Human
uaagcugugggagauuggcaua

SEQ ID NO: 959563 - RNA, 22 nt, Human
gucucagaccacccucuuuggc

SEQ ID NO: 959564 - RNA, 22 nt, Human
gagagugaugaaugguuaaaca

SEQ ID NO: 959565 - RNA, 22 nt, Human
gcugccacuuggucaugucaug

SEQ ID NO: 959566 - RNA, 22 nt, Human
agcucccagaguccucugccca

SEQ ID NO: 959567 - RNA, 22 nt, Human
cuggguggcgucuggggccagu

SEQ ID NO: 959568 - RNA, 22 nt, Human
auuauuagauucuuaauuguaa

SEQ ID NO: 959569 - RNA, 19 nt, Human
ggagccuggagcacgugcc

SEQ ID NO: 959570 - RNA, 22 nt, Human
cucuuaguaaugccaugaagca

SEQ ID NO: 959571 - RNA, 22 nt, Human
ggaugcaggggcagcagagccu

SEQ ID NO: 959572 - RNA, 22 nt, Human
ucugcagauuuaucagcagcug

SEQ ID NO: 959573 - RNA, 22 nt, Human
ucugccacuagugguuaccuua

SEQ ID NO: 959574 - RNA, 22 nt, Human
ugggaccaagucauuucuuuag

SEQ ID NO: 959575 - RNA, 20 nt, Human
ccagcugagccaaggggaga

SEQ ID NO: 959576 - RNA, 22 nt, Human
gccagagcaugcacugccugca

SEQ ID NO: 959577 - RNA, 22 nt, Human
cagggcugugcccaucuucccc

SEQ ID NO: 959578 - RNA, 17 nt, Human
acacagggagagggagc

SEQ ID NO: 959579 - RNA, 22 nt, Human
ccugcccagcuucaccucaggc

SEQ ID NO: 959580 - RNA, 22 nt, Human
cugccucuccccagaguggccc

SEQ ID NO: 959581 - RNA, 22 nt, Human
gucugucuguuguugagaagca

SEQ ID NO: 959582 - RNA, 22 nt, Human
accagagcuuacaugcuagaaa

SEQ ID NO: 959583 - RNA, 22 nt, Human
ugaggcagcauucuucaagaca

SEQ ID NO: 959584 - RNA, 22 nt, Human
uggcagcuacagacagagguga

SEQ ID NO: 959585 - RNA, 22 nt, Human
ugggacacccucacgccugcac

SEQ ID NO: 959586 - RNA, 22 nt, Human
caguagcacuagauaugugugg

SEQ ID NO: 959587 - RNA, 23 nt, Human
gcucugcucuguuucauagacag

SEQ ID NO: 959588 - RNA, 22 nt, Human
gccuggagagcacugugcgcuu

SEQ ID NO: 959589 - RNA, 22 nt, Human
uucuuuggggaauauucugguu

SEQ ID NO: 959590 - RNA, 22 nt, Human
auuucauugaaguuaauucuuc

SEQ ID NO: 959591 - RNA, 22 nt, Human
uggcagcugucagaaugcaaau

SEQ ID NO: 959592 - RNA, 22 nt, Human
cuggcucucugagauauugagu

SEQ ID NO: 959593 - RNA, 20 nt, Human
gcucccugguagaaauguuu

SEQ ID NO: 959594 - RNA, 22 nt, Human
uauucaaaguaccuucauugcc

SEQ ID NO: 959595 - RNA, 22 nt, Human
uuccagauuucuacacaagacc

SEQ ID NO: 959596 - RNA, 22 nt, Human
ugaaggccacuuccugugagcu

SEQ ID NO: 959597 - RNA, 18 nt, Human
ucuuuggacaacuacugg

SEQ ID NO: 959598 - RNA, 22 nt, Human
uggcagucggacuucuaucuca

SEQ ID NO: 959599 - RNA, 22 nt, Human
aguaucaaggaucuccagcacc

SEQ ID NO: 959600 - RNA, 22 nt, Human
ccagaggugccacagaaagagc

SEQ ID NO: 959601 - RNA, 22 nt, Human
auccagggauaaaaguaagguu

SEQ ID NO: 959602 - RNA, 20 nt, Human
ggcacuggaagcacacagga

SEQ ID NO: 959603 - RNA, 22 nt, Human
gccugggaaaugguggggucag

SEQ ID NO: 959604 - RNA, 22 nt, Human
aaaaaguuucaacugccaacuc

SEQ ID NO: 959605 - RNA, 22 nt, Human
aauuugcaugaugagaacaaua

SEQ ID NO: 959606 - RNA, 20 nt, Human
uucacagaggacucagguca

SEQ ID NO: 959607 - RNA, 22 nt, Human
cuucucucccuggcacucagac

SEQ ID NO: 959608 - RNA, 22 nt, Human
uggcagaguucgcuccuauuca

SEQ ID NO: 959609 - RNA, 22 nt, Human
cugacuguaauucuguucuuaa

SEQ ID NO: 959610 - RNA, 22 nt, Human
uucagaauauuuguuuuacaug

SEQ ID NO: 959611 - RNA, 22 nt, Human
uuagucaauagugaauauagag

SEQ ID NO: 959612 - RNA, 22 nt, Human
cugguccauucucucccugaag

SEQ ID NO: 959613 - RNA, 22 nt, Human
aaacaaugaaauucauucuuca

SEQ ID NO: 959614 - RNA, 22 nt, Human
agccucugcuuaugcaaaggua

SEQ ID NO: 959615 - RNA, 22 nt, Human
aauagguagccagauauauaaa

SEQ ID NO: 959616 - RNA, 22 nt, Human
aucagcaagauugugucuugua

SEQ ID NO: 959617 - RNA, 22 nt, Human
ccugggaggcagagguugcagu

SEQ ID NO: 959618 - RNA, 22 nt, Human
gcagcugagcgugaggaagagu

SEQ ID NO: 959619 - RNA, 22 nt, Human
ucaagagacaggacguguuuca

SEQ ID NO: 959620 - RNA, 22 nt, Human
aagcagcuggaagaguaagaug

SEQ ID NO: 959621 - RNA, 20 nt, Human
ccucucugaagaggucaucu

SEQ ID NO: 959622 - RNA, 22 nt, Human
uucuuaagcaguuuggcauguu

SEQ ID NO: 959623 - RNA, 22 nt, Human
agagucugaggcagcugcagcc

SEQ ID NO: 959624 - RNA, 22 nt, Human
ggcaggcaaugaggaugggaag

SEQ ID NO: 959625 - RNA, 22 nt, Human
gcugagcucccagcaguaucug

SEQ ID NO: 959626 - RNA, 22 nt, Human
caguucuuauuuggccaguguc

SEQ ID NO: 959627 - RNA, 22 nt, Human
uguucucacuggaugcuucaca

SEQ ID NO: 959628 - RNA, 22 nt, Human
ugagccagauaagggcucacgc

SEQ ID NO: 959629 - RNA, 22 nt, Human
uaucuaaaggauuuaauuuagu

SEQ ID NO: 959630 - RNA, 22 nt, Human
uaagaacauuuucggaaagaua

SEQ ID NO: 959631 - RNA, 20 nt, Human
ugcagggcucugcuucucuc

SEQ ID NO: 959632 - RNA, 23 nt, Human
ugauuaggucuacucuuggcucc

SEQ ID NO: 959633 - RNA, 22 nt, Human
gcaggccugacuguagggggca

SEQ ID NO: 959634 - RNA, 22 nt, Human
ucucuggcagggauaucuggcu

SEQ ID NO: 959635 - RNA, 22 nt, Human
ugcccaggguuucuaagagcag

SEQ ID NO: 959636 - RNA, 22 nt, Human
ucaguggauauuucuguggcug

SEQ ID NO: 959637 - RNA, 22 nt, Human
cugugcuugacagugggaagca

SEQ ID NO: 959638 - RNA, 22 nt, Human
acuaugcucauuguuaauauuu

SEQ ID NO: 959639 - RNA, 22 nt, Human
uccugggcccaggcugccaggg

SEQ ID NO: 959640 - RNA, 23 nt, Human
ggcacugaagcuacaauggugag

SEQ ID NO: 959641 - RNA, 20 nt, Human
gggcaguucaaugccacucu

SEQ ID NO: 959642 - RNA, 22 nt, Human
aucuggcuauuucuggucgggg

SEQ ID NO: 959643 - RNA, 22 nt, Human
gggagcugagggaccucugugg

SEQ ID NO: 959644 - RNA, 22 nt, Human
ugccaggccucaggagucucca

SEQ ID NO: 959645 - RNA, 21 nt, Human
ugcugccauagaccugaggga

SEQ ID NO: 959646 - RNA, 22 nt, Human
cugggccugguagggcuugaaa

SEQ ID NO: 959647 - RNA, 22 nt, Human
ugcaggaacugggagggauagu

SEQ ID NO: 959648 - RNA, 22 nt, Human
ucagcugaguucuagagcacuc

SEQ ID NO: 959649 - RNA, 22 nt, Human
guucuucagucacaucacagaa

SEQ ID NO: 959650 - RNA, 22 nt, Human
ugaccaaaggugguuuauuugg

SEQ ID NO: 959651 - RNA, 22 nt, Human
ugcagcuguaacagaggccuca

SEQ ID NO: 959652 - RNA, 22 nt, Human
agacucaagacugcagaagacg

SEQ ID NO: 959653 - RNA, 22 nt, Human
gcucagagauggggaaugaaaa

SEQ ID NO: 959654 - RNA, 22 nt, Human
uuuucauuguuccucgagcauu

SEQ ID NO: 959655 - RNA, 22 nt, Human
cccaggagaauauuuuuggguc

SEQ ID NO: 959656 - RNA, 22 nt, Human
cucucuucccgugaguguugca

SEQ ID NO: 959657 - RNA, 22 nt, Human
gagcucaggagcaucagaagaa

SEQ ID NO: 959658 - RNA, 22 nt, Human
guccaaauaaguugcaaaauag

SEQ ID NO: 959659 - RNA, 22 nt, Human
aaauauguauggaguucaugaa

SEQ ID NO: 959660 - RNA, 22 nt, Human
ccagaggaggggggucuuucug

SEQ ID NO: 959661 - RNA, 22 nt, Human
aggcccugggcaguucuguagc

SEQ ID NO: 959662 - RNA, 22 nt, Human
aacuagaacgucuaguugcugg

SEQ ID NO: 959663 - RNA, 22 nt, Human
gaagcagcaaguauaggacagg

SEQ ID NO: 959664 - RNA, 22 nt, Human
auuucaguagaaaaucuugauu

SEQ ID NO: 959665 - RNA, 22 nt, Human
uuugaaguucccccauaucaga

SEQ ID NO: 959666 - RNA, 22 nt, Human
agaugcuucaguguuuaauuua

SEQ ID NO: 959667 - RNA, 22 nt, Human
uggcugggccgggccuugugcc

SEQ ID NO: 959668 - RNA, 22 nt, Human
cacagaggaaaggcaguuggua

SEQ ID NO: 959669 - RNA, 23 nt, Human
agccacuucuaucuugcuccugg

SEQ ID NO: 959670 - RNA, 22 nt, Human
ugcaaucucggcacuuugggag

SEQ ID NO: 959671 - RNA, 22 nt, Human
accaucagucauugucaguggg

SEQ ID NO: 959672 - RNA, 22 nt, Human
gucacaggccuggaugaggggc

SEQ ID NO: 959673 - RNA, 22 nt, Human
uucuuaaaacuuauggacaggu

SEQ ID NO: 959674 - RNA, 22 nt, Human
cucuccagccacagaagcugcu

SEQ ID NO: 959675 - RNA, 22 nt, Human
ggcaggcaggagcgugcuuggg

SEQ ID NO: 959676 - RNA, 22 nt, Human
auuauggacguuaauuuuggaa

SEQ ID NO: 959677 - RNA, 22 nt, Human
agcuggugcugaagcucuugag

SEQ ID NO: 959678 - RNA, 22 nt, Human
aagggcagaauagagaagaugg

SEQ ID NO: 959679 - RNA, 22 nt, Human
cuucuugcugggggccucagug

SEQ ID NO: 959680 - RNA, 18 nt, Human
gggcucugauccuucacc

SEQ ID NO: 959681 - RNA, 20 nt, Human
ucauuguguugccaauuccc

SEQ ID NO: 959682 - RNA, 22 nt, Human
uuucuucauagaccuugucuug

SEQ ID NO: 959683 - RNA, 22 nt, Human
cucaggacccgguccagguggg

SEQ ID NO: 959684 - RNA, 22 nt, Human
caguuaaaggcccaauaucugg

SEQ ID NO: 959685 - RNA, 23 nt, Human
uggaaagcggaccuggggcagag

SEQ ID NO: 959686 - RNA, 22 nt, Human
ucuccuggccgggcuguccccu

SEQ ID NO: 959687 - RNA, 22 nt, Human
acacagggcugcgccugacccc

SEQ ID NO: 959688 - RNA, 22 nt, Human
uaacagaauccuguuauugcca

SEQ ID NO: 959689 - RNA, 22 nt, Human
auuggcaguuagugacgaggcu

SEQ ID NO: 959690 - RNA, 22 nt, Human
aaaguguaaaagcauguuaggg

SEQ ID NO: 959691 - RNA, 22 nt, Human
ugggccugaguuugggaacugg

SEQ ID NO: 959692 - RNA, 22 nt, Human
uuccuuguuuguagcucuggga

SEQ ID NO: 959693 - RNA, 22 nt, Human
cuucuuuacuuucuagaaauaa

SEQ ID NO: 959694 - RNA, 22 nt, Human
auuggcagaaacagcagggcca

SEQ ID NO: 959695 - RNA, 22 nt, Human
ucucccaggcugcccuguggac

SEQ ID NO: 959696 - RNA, 22 nt, Human
uuauguuugaguauaugacuca

SEQ ID NO: 959697 - RNA, 18 nt, Human
auuuugaacaaugcugua

SEQ ID NO: 959698 - RNA, 22 nt, Human
aggcccaguagugcugccuuua

SEQ ID NO: 959699 - RNA, 22 nt, Human
caguagcauguaauaaagacag

SEQ ID NO: 959700 - RNA, 22 nt, Human
ugaagcccugugucagcuucca

SEQ ID NO: 959701 - RNA, 22 nt, Human
ugacacagauuagagacauacc

SEQ ID NO: 959702 - RNA, 22 nt, Human
augaggcaucugcagucacuag

SEQ ID NO: 959703 - RNA, 23 nt, Human
uaagaacagacaagcauuuacau

SEQ ID NO: 959704 - RNA, 22 nt, Human
guggccaggccgacugccaggc

SEQ ID NO: 959705 - RNA, 17 nt, Human
aagauuucauuagcuga

SEQ ID NO: 959706 - RNA, 22 nt, Human
aggcuauuuccacucuucucau

SEQ ID NO: 959707 - RNA, 22 nt, Human
aggaagcuccaugaaggcagag

SEQ ID NO: 959708 - RNA, 22 nt, Human
gagcugugaaaagugccugggg

SEQ ID NO: 959709 - RNA, 22 nt, Human
caaguaaagaaucacauuucuu

SEQ ID NO: 959710 - RNA, 22 nt, Human
gcugucaguuuuacccacagac

SEQ ID NO: 959711 - RNA, 22 nt, Human
ccagucccaucucugucgcuua

SEQ ID NO: 959712 - RNA, 22 nt, Human
caugucuggguauaugcauaug

SEQ ID NO: 959713 - RNA, 18 nt, Human
uguuaggaagggcacaca

SEQ ID NO: 959714 - RNA, 22 nt, Human
cugaagccacgauagcuuccua

SEQ ID NO: 959715 - RNA, 22 nt, Human
gccagggagucugggccacaga

SEQ ID NO: 959716 - RNA, 21 nt, Human
ugucauuaaucgcuauagaag

SEQ ID NO: 959717 - RNA, 22 nt, Human
ugccaggcccagcuccagagcu

SEQ ID NO: 959718 - RNA, 22 nt, Human
ucucagagauucagggagaagu

SEQ ID NO: 959719 - RNA, 20 nt, Human
ucacaggggaccaggagcag

SEQ ID NO: 959720 - RNA, 22 nt, Human
gaguuauuaauggcugaguuug

SEQ ID NO: 959721 - RNA, 22 nt, Human
uguggccagcagguggcugugu

SEQ ID NO: 959722 - RNA, 22 nt, Human
gcucagagauguucaguagcuu

SEQ ID NO: 959723 - RNA, 22 nt, Human
uggcucugucaaacugcacaca

SEQ ID NO: 959724 - RNA, 22 nt, Human
ggcggggguccaggagccugca

SEQ ID NO: 959725 - RNA, 22 nt, Human
caggccucccggugcacacuga

SEQ ID NO: 959726 - RNA, 22 nt, Human
gccaggcugcuggcugcugucc

SEQ ID NO: 959727 - RNA, 22 nt, Human
agggcagcagcggcccaggccu

SEQ ID NO: 959728 - RNA, 22 nt, Human
gcugagguaggagguugcagug

SEQ ID NO: 959729 - RNA, 22 nt, Human
ucccaggauguuuauggcuggu

SEQ ID NO: 959730 - RNA, 22 nt, Human
aacauacauauuucagugucca

SEQ ID NO: 959731 - RNA, 22 nt, Human
ucuccuccuuuuuucaacauag

SEQ ID NO: 959732 - RNA, 22 nt, Human
cggcagcucgagggccacccgu

SEQ ID NO: 959733 - RNA, 22 nt, Human
auucacauguugaagcccuaac

SEQ ID NO: 959734 - RNA, 22 nt, Human
caaauguauucucacuucaggg

SEQ ID NO: 959735 - RNA, 22 nt, Human
auguuuuacccuuugcacaaac

SEQ ID NO: 959736 - RNA, 22 nt, Human
acccagcucuuugauggucuug

SEQ ID NO: 959737 - RNA, 22 nt, Human
uaagauguuuugguuugauaag

SEQ ID NO: 959738 - RNA, 22 nt, Human
cacacagaugguaagggaggga

SEQ ID NO: 959739 - RNA, 22 nt, Human
agccagggagguggagguugca

SEQ ID NO: 959740 - RNA, 22 nt, Human
ucuguucauacagaguauagua

SEQ ID NO: 959741 - RNA, 22 nt, Human
cccagcacaggcaauuccauac

SEQ ID NO: 959742 - RNA, 22 nt, Human
aaggccaugaccacuugcugug

SEQ ID NO: 959743 - RNA, 22 nt, Human
ugcagggccagacuggguugga

SEQ ID NO: 959744 - RNA, 22 nt, Human
ugcagaagaccuuccagggcug

SEQ ID NO: 959745 - RNA, 22 nt, Human
ugaaaaacuuuaauccauaaag

SEQ ID NO: 959746 - RNA, 22 nt, Human
gcagaggagcaaguugcuacag

SEQ ID NO: 959747 - RNA, 21 nt, Human
uggagcugccacuuguccucc

SEQ ID NO: 959748 - RNA, 22 nt, Human
cacaaugcguacauauaucaaa

SEQ ID NO: 959749 - RNA, 22 nt, Human
cugcagggcccgccugagcccu

SEQ ID NO: 959750 - RNA, 22 nt, Human
ucugagagguuaagcaauuuga

SEQ ID NO: 959751 - RNA, 22 nt, Human
uggcccugcuggccaaaggcua

SEQ ID NO: 959752 - RNA, 22 nt, Human
uucuaguguccuuggacuugcu

SEQ ID NO: 959753 - RNA, 22 nt, Human
uuacaugguuguuggaaaugcu

SEQ ID NO: 959754 - RNA, 22 nt, Human
ucccagggugcgccugcccucg

SEQ ID NO: 959755 - RNA, 21 nt, Human
agagagaaggccauauggucc

SEQ ID NO: 959756 - RNA, 22 nt, Human
cugggaggugcagcaaaaauca

SEQ ID NO: 959757 - RNA, 22 nt, Human
auuuacagaagcauguaauagc

SEQ ID NO: 959758 - RNA, 22 nt, Human
ugcagaagauggucugagcacc

SEQ ID NO: 959759 - RNA, 22 nt, Human
cucaguuucugacauuaaaauc

SEQ ID NO: 959760 - RNA, 22 nt, Human
aaauacuagaauucagaguuga

SEQ ID NO: 959761 - RNA, 22 nt, Human
aggcagcuggaggcagagacua

SEQ ID NO: 959762 - RNA, 20 nt, Human
aggagccauugacugcagca

SEQ ID NO: 959763 - RNA, 22 nt, Human
gguggccucgguggugcacagg

SEQ ID NO: 959764 - RNA, 19 nt, Human
uacauuuguguacacuugu

SEQ ID NO: 959765 - RNA, 22 nt, Human
agcgggugcugugucagcccuc

SEQ ID NO: 959766 - RNA, 22 nt, Human
uuucuuccuuaccuuacuagag

SEQ ID NO: 959767 - RNA, 22 nt, Human
aguacauauaguaauuuagcca

SEQ ID NO: 959768 - RNA, 22 nt, Human
uguuugaauuuugcuaacgugu

SEQ ID NO: 959769 - RNA, 22 nt, Human
uuugcauuccugccugcauuca

SEQ ID NO: 959770 - RNA, 22 nt, Human
caggagagcccggguccgggcu

SEQ ID NO: 959771 - RNA, 22 nt, Human
auggcagccugagcagaggaau

SEQ ID NO: 959772 - RNA, 22 nt, Human
ccaggcuggagugcaauggugc

SEQ ID NO: 959773 - RNA, 21 nt, Human
uccacaaguuagaaggaaauu

SEQ ID NO: 959774 - RNA, 22 nt, Human
uggaaugacagagagucugaau

SEQ ID NO: 959775 - RNA, 22 nt, Human
ucagggcauccauugccuguug

SEQ ID NO: 959776 - RNA, 22 nt, Human
uaaaugcaaugugcuuuaccag

SEQ ID NO: 959777 - RNA, 22 nt, Human
ucucugaguaagugacaguuca

SEQ ID NO: 959778 - RNA, 20 nt, Human
uuccuguauacaaagaguuc

SEQ ID NO: 959779 - RNA, 23 nt, Human
ugauuuccagugagucaguggga

SEQ ID NO: 959780 - RNA, 23 nt, Human
uuuggacuugugacucuucuccu

SEQ ID NO: 959781 - RNA, 22 nt, Human
uggggccugagguggagcugca

SEQ ID NO: 959782 - RNA, 22 nt, Human
uacaaaugaguuguaugaacca

SEQ ID NO: 959783 - RNA, 22 nt, Human
uccaggagguagugcuuaauuu

SEQ ID NO: 959784 - RNA, 22 nt, Human
ccuccugggccuugcucuguga

SEQ ID NO: 959785 - RNA, 19 nt, Human
agggaaggauucugucauu

SEQ ID NO: 959786 - RNA, 22 nt, Human
gaauuguacgcuuuacauaggu

SEQ ID NO: 959787 - RNA, 22 nt, Human
uggcucagaugcucuuccagug

SEQ ID NO: 959788 - RNA, 22 nt, Human
cuggggcucacuuuggucaggc

SEQ ID NO: 959789 - RNA, 22 nt, Human
ccuggcuuccuggagcucacaa

SEQ ID NO: 959790 - RNA, 22 nt, Human
ggccagaggccacagcuguguc

SEQ ID NO: 959791 - RNA, 19 nt, Human
auuugaaagcugugcuugc

SEQ ID NO: 959792 - RNA, 22 nt, Human
ccagcagcuguggcuuugccuc

SEQ ID NO: 959793 - RNA, 22 nt, Human
uuauuucauguaaaauuuaugu

SEQ ID NO: 959794 - RNA, 22 nt, Human
uggccucugcaauggauucacc

SEQ ID NO: 959795 - RNA, 22 nt, Human
gguggaaggccuggaaggaggc

SEQ ID NO: 959796 - RNA, 22 nt, Human
ugggcagcagcaaagccagacu

SEQ ID NO: 959797 - RNA, 22 nt, Human
uggaagccaggcccgcuccuaa

SEQ ID NO: 959798 - RNA, 22 nt, Human
uggcuucugcuuucaguggagg

SEQ ID NO: 959799 - RNA, 22 nt, Human
acuguguccucauguggcagaa

SEQ ID NO: 959800 - RNA, 19 nt, Human
ugagugggccccugcagac

SEQ ID NO: 959801 - RNA, 22 nt, Human
ggccucggcccacugcugcggu

SEQ ID NO: 959802 - RNA, 22 nt, Human
uagaaaugauuuugaugcuuca

SEQ ID NO: 959803 - RNA, 22 nt, Human
uggcucagcugacucggcuucu

SEQ ID NO: 959804 - RNA, 22 nt, Human
gcugucacaaauauuucucagc

SEQ ID NO: 959805 - RNA, 22 nt, Human
caguuucuacgacuuaagcaca

SEQ ID NO: 959806 - RNA, 22 nt, Human
cagcugggagcuccauuagaua

SEQ ID NO: 959807 - RNA, 18 nt, Human
agggucagugucacuggc

SEQ ID NO: 959808 - RNA, 22 nt, Human
acucacauuucaucaggccaag

SEQ ID NO: 959809 - RNA, 22 nt, Human
aaggccauuauucugauauauu

SEQ ID NO: 959810 - RNA, 22 nt, Human
aagcuaugggggaguuucaacc

SEQ ID NO: 959811 - RNA, 22 nt, Human
cucaggauccaucuccugcccu

SEQ ID NO: 959812 - RNA, 20 nt, Human
gggguuggcuggcacaggga

SEQ ID NO: 959813 - RNA, 22 nt, Human
aaguucaaguaguguuacaugg

SEQ ID NO: 959814 - RNA, 22 nt, Human
ccuggccagcgccggcugcucg

SEQ ID NO: 959815 - RNA, 22 nt, Human
cccaggcagagagcuggugagc

SEQ ID NO: 959816 - RNA, 22 nt, Human
caaaguauauuggauugaaugg

SEQ ID NO: 959817 - RNA, 21 nt, Human
agccuggcccagggggaggcu

SEQ ID NO: 959818 - RNA, 21 nt, Human
ccacucugaguguugaacaga

SEQ ID NO: 959819 - RNA, 22 nt, Human
aucuguuuaauucauuuucaca

SEQ ID NO: 959820 - RNA, 22 nt, Human
ccaaaugugccuguuucaacaa

SEQ ID NO: 959821 - RNA, 22 nt, Human
guacaguuuucaguguucacug

SEQ ID NO: 959822 - RNA, 22 nt, Human
cacacaugaaucccuaguaccu

SEQ ID NO: 959823 - RNA, 21 nt, Human
ggugucaguuuuggucauuag

SEQ ID NO: 959824 - RNA, 22 nt, Human
caauagaaaacucaauacuuaa

SEQ ID NO: 959825 - RNA, 22 nt, Human
acugccuugaaagauuguugag

SEQ ID NO: 959826 - RNA, 22 nt, Human
agggcugggcugcuuguuguca

SEQ ID NO: 959827 - RNA, 22 nt, Human
gcuggagccauuggcuuggccu

SEQ ID NO: 959828 - RNA, 22 nt, Human
auuaaauacugcaggcuaagca

SEQ ID NO: 959829 - RNA, 22 nt, Human
ugucccauggacacaacuucuu

SEQ ID NO: 959830 - RNA, 22 nt, Human
ugaggcaggaauggggaaaagu

SEQ ID NO: 959831 - RNA, 22 nt, Human
uggcagacuuuagggucuacau

SEQ ID NO: 959832 - RNA, 22 nt, Human
ucccuggggauguuggccugcc

SEQ ID NO: 959833 - RNA, 22 nt, Human
ugguggcuguugcagaacugag

SEQ ID NO: 959834 - RNA, 22 nt, Human
cugggccuggcguuccaggcug

SEQ ID NO: 959835 - RNA, 22 nt, Human
aggcagguuggugagaagacug

SEQ ID NO: 959836 - RNA, 22 nt, Human
agagcuggggccagagucaagg

SEQ ID NO: 959837 - RNA, 22 nt, Human
cagaagaguagcugaacaaguu

SEQ ID NO: 959838 - RNA, 22 nt, Human
cuucuucauguauugauagucu

SEQ ID NO: 959839 - RNA, 22 nt, Human
caggcagcguccugcuuccugu

SEQ ID NO: 959840 - RNA, 22 nt, Human
guuauguauugggaaauccaag

SEQ ID NO: 959841 - RNA, 22 nt, Human
uuguccuuaccucaaucuggaa

SEQ ID NO: 959842 - RNA, 22 nt, Human
guggcagagguuccucagugug

SEQ ID NO: 959843 - RNA, 22 nt, Human
uuugaaaggguuaugagacuga

SEQ ID NO: 959844 - RNA, 22 nt, Human
agagcagagggcucugggacaa

SEQ ID NO: 959845 - RNA, 22 nt, Human
accauguuggccaagcuggucu

SEQ ID NO: 959846 - RNA, 22 nt, Human
uggcacugggacagaugcucuc

SEQ ID NO: 959847 - RNA, 22 nt, Human
ugugggcaggcccgggucugag

SEQ ID NO: 959848 - RNA, 22 nt, Human
auucuggauuaucaguccacca

SEQ ID NO: 959849 - RNA, 22 nt, Human
gagggcagagacagugauucac

SEQ ID NO: 959850 - RNA, 22 nt, Human
ggcagcagggcugucucccuac

SEQ ID NO: 959851 - RNA, 22 nt, Human
gaacagcugcuagagaucugug

SEQ ID NO: 959852 - RNA, 22 nt, Human
aggaaaggccuuugcauuuggu

SEQ ID NO: 959853 - RNA, 22 nt, Human
ggcugggcaaacaagacucuuc

SEQ ID NO: 959854 - RNA, 22 nt, Human
auuuccaggagaaaggauuuua

SEQ ID NO: 959855 - RNA, 23 nt, Human
uccuuccuuugagaggcuccauc

SEQ ID NO: 959856 - RNA, 22 nt, Human
ugcucuggagggugaagcuuuu

SEQ ID NO: 959857 - RNA, 22 nt, Human
cacaguuucuauaggucagaau

SEQ ID NO: 959858 - RNA, 22 nt, Human
agccaaggcagcuagagcucug

SEQ ID NO: 959859 - RNA, 22 nt, Human
gaggcagccucaguggaccucg

SEQ ID NO: 959860 - RNA, 22 nt, Human
gcacagggagcaggucucuggu

SEQ ID NO: 959861 - RNA, 23 nt, Human
ccagccucugggucuucauccag

SEQ ID NO: 959862 - RNA, 22 nt, Human
uuggcagcauccaagucucggg

SEQ ID NO: 959863 - RNA, 22 nt, Human
acuuguguaacacagaaagaac

SEQ ID NO: 959864 - RNA, 22 nt, Human
aaaaaucacuuuuauaggcagc

SEQ ID NO: 959865 - RNA, 22 nt, Human
aagucacacuagacaacugagg

SEQ ID NO: 959866 - RNA, 22 nt, Human
gcuguguccucacacagccuuu

SEQ ID NO: 959867 - RNA, 22 nt, Human
agggggcaggagagaccugcug

SEQ ID NO: 959868 - RNA, 22 nt, Human
uagacacaucaaguauaguuaa

SEQ ID NO: 959869 - RNA, 22 nt, Human
ccuguucauuuguauuugucuu

SEQ ID NO: 959870 - RNA, 22 nt, Human
acugcuuuucuaagauucugug

SEQ ID NO: 959871 - RNA, 22 nt, Human
cuggccaacuugcuuguuggca

SEQ ID NO: 959872 - RNA, 22 nt, Human
cuggagcauccaugcccagggu

SEQ ID NO: 959873 - RNA, 22 nt, Human
cuucuucagcacaauauugaug

SEQ ID NO: 959874 - RNA, 22 nt, Human
aucaguuuugggggacauacug

SEQ ID NO: 959875 - RNA, 22 nt, Human
ccuguguggccaggcuggaguc

SEQ ID NO: 959876 - RNA, 22 nt, Human
gucccaggugggcuccaccucu

SEQ ID NO: 959877 - RNA, 21 nt, Human
gggcagcucuguuuuauuuuc

SEQ ID NO: 959878 - RNA, 22 nt, Human
aaggacuccaauucuuucaucu

SEQ ID NO: 959879 - RNA, 22 nt, Human
aggagaguaccauugggccgca

SEQ ID NO: 959880 - RNA, 22 nt, Human
ccugccuggcuuccagaagaga

SEQ ID NO: 959881 - RNA, 22 nt, Human
uauuugcaacauaaaacucuga

SEQ ID NO: 959882 - RNA, 22 nt, Human
acagaauacuacagacugguua

SEQ ID NO: 959883 - RNA, 22 nt, Human
ggccugaggcgucccagcugug

SEQ ID NO: 959884 - RNA, 22 nt, Human
acagagaaagugggcugaagau

SEQ ID NO: 959885 - RNA, 22 nt, Human
acacaaguucuaaagauugcgc

SEQ ID NO: 959886 - RNA, 22 nt, Human
uggcccugugugcaggcugcac

SEQ ID NO: 959887 - RNA, 22 nt, Human
ccaggcaggcagcguucucagg

SEQ ID NO: 959888 - RNA, 22 nt, Human
ccuguguguaggccaggggagu

SEQ ID NO: 959889 - RNA, 22 nt, Human
gaguguggugaacaggagcacc

SEQ ID NO: 959890 - RNA, 22 nt, Human
uuuuucaagacaaccugcaugu

SEQ ID NO: 959891 - RNA, 22 nt, Human
cucuccuggggagcacacacac

SEQ ID NO: 959892 - RNA, 22 nt, Human
acucugcucaaaguccugaggc

SEQ ID NO: 959893 - RNA, 22 nt, Human
auaguaacuggcauguuuauga

SEQ ID NO: 959894 - RNA, 22 nt, Human
ugggggucaggaugaggccuug

SEQ ID NO: 959895 - RNA, 22 nt, Human
cagucccaucucccagguggcu

SEQ ID NO: 959896 - RNA, 22 nt, Human
ggagcagccuguguagacgggg

SEQ ID NO: 959897 - RNA, 22 nt, Human
cccagagccucauucuguuggg

SEQ ID NO: 959898 - RNA, 22 nt, Human
uguucaauccccagguccugaa

SEQ ID NO: 959899 - RNA, 22 nt, Human
acagauauaaacuauaguagug

SEQ ID NO: 959900 - RNA, 22 nt, Human
ggugggugagcccugggagcug

SEQ ID NO: 959901 - RNA, 22 nt, Human
cuuugaaagcucccaggacuua

SEQ ID NO: 959902 - RNA, 22 nt, Human
auccaggguguggagagagcuc

SEQ ID NO: 959903 - RNA, 22 nt, Human
uguaugcuuguguauaauauaa

SEQ ID NO: 959904 - RNA, 22 nt, Human
agcuggcauacuuugcuaggaa

SEQ ID NO: 959905 - RNA, 22 nt, Human
ggcugggagcuggacaggccgg

SEQ ID NO: 959906 - RNA, 22 nt, Human
cuggccuggagccucugggugg

SEQ ID NO: 959907 - RNA, 22 nt, Human
uggcagagagagugcagucgac

SEQ ID NO: 959908 - RNA, 22 nt, Human
aagauuuaccacuuuauucaag

SEQ ID NO: 959909 - RNA, 19 nt, Human
cauuaggauuagagacaag

SEQ ID NO: 959910 - RNA, 22 nt, Human
gcacugcagccucagauggugg

SEQ ID NO: 959911 - RNA, 22 nt, Human
aucugccugcaguggagguggg

SEQ ID NO: 959912 - RNA, 22 nt, Human
gcaccugggcaaggauucagag

SEQ ID NO: 959913 - RNA, 22 nt, Human
uuuaauugauucacagucugua

SEQ ID NO: 959914 - RNA, 22 nt, Human
ugcugccuuagcagccaggcaa

SEQ ID NO: 959915 - RNA, 17 nt, Human
aggaaacauuuucuuuc

SEQ ID NO: 959916 - RNA, 22 nt, Human
augggaggaucacuugaggcca

SEQ ID NO: 959917 - RNA, 22 nt, Human
caggugccgggaaugcagcaau

SEQ ID NO: 959918 - RNA, 22 nt, Human
aagccaggcaugcuuggacagu

SEQ ID NO: 959919 - RNA, 22 nt, Human
uggcucaggagggaucuuugcu

SEQ ID NO: 959920 - RNA, 19 nt, Human
ccucugcgcuguccugcuc

SEQ ID NO: 959921 - RNA, 22 nt, Human
ugccaggaggaggugggacaga

SEQ ID NO: 959922 - RNA, 22 nt, Human
ucucaggguuuccugggggcug

SEQ ID NO: 959923 - RNA, 22 nt, Human
ggaagaggcugaggccaugcug

SEQ ID NO: 959924 - RNA, 22 nt, Human
gccuggaggggacagucucugg

SEQ ID NO: 959925 - RNA, 22 nt, Human
ggcugcucuucuuggcgaccuc

SEQ ID NO: 959926 - RNA, 22 nt, Human
ugaaaucuuuaguuucuguccc

SEQ ID NO: 959927 - RNA, 20 nt, Human
gaacauuuggccauacugag

SEQ ID NO: 959928 - RNA, 22 nt, Human
uguuuauuuucaggauggauug

SEQ ID NO: 959929 - RNA, 22 nt, Human
ccugccucaucaacuugucgug

SEQ ID NO: 959930 - RNA, 22 nt, Human
aaauauguaagauuagcacuag

SEQ ID NO: 959931 - RNA, 22 nt, Human
uguguuccuucgucuucccuuc

SEQ ID NO: 959932 - RNA, 22 nt, Human
ucacaaagggagggauagcugg

SEQ ID NO: 959933 - RNA, 17 nt, Human
ucugaagccagucugcu

SEQ ID NO: 959934 - RNA, 22 nt, Human
ggagagcugguagcuggcucca

SEQ ID NO: 959935 - RNA, 22 nt, Human
ccucccucuuucagucccacag

SEQ ID NO: 959936 - RNA, 22 nt, Human
agaacuuaggaacaacagcuua

SEQ ID NO: 959937 - RNA, 22 nt, Human
gcacugcaucuacuggcaagua

SEQ ID NO: 959938 - RNA, 22 nt, Human
uagcagggucucaggagucagg

SEQ ID NO: 959939 - RNA, 18 nt, Human
gcuccuggaccaggucac

SEQ ID NO: 959940 - RNA, 22 nt, Human
aaagagcuucauuuccauuuau

SEQ ID NO: 959941 - RNA, 22 nt, Human
ggugcagaucuuucucuucagg

SEQ ID NO: 959942 - RNA, 22 nt, Human
cuuagaaauuguuacucauuca

SEQ ID NO: 959943 - RNA, 22 nt, Human
augcuuccaaggcuaagacaag

SEQ ID NO: 959944 - RNA, 20 nt, Human
agcugaggcaccugagguua

SEQ ID NO: 959945 - RNA, 22 nt, Human
agaguucagcuacugcaaaugu

SEQ ID NO: 959946 - RNA, 22 nt, Human
aggccugcagcaggagcaaacc

SEQ ID NO: 959947 - RNA, 22 nt, Human
caggaugagguagaggcagaua

SEQ ID NO: 959948 - RNA, 22 nt, Human
uaccuuuugcuuauuaugacac

SEQ ID NO: 959949 - RNA, 22 nt, Human
acauuucuaucauccuguaaug

SEQ ID NO: 959950 - RNA, 22 nt, Human
uaaauguaccuucugccuuacu

SEQ ID NO: 959951 - RNA, 22 nt, Human
uagaaauaaaucugcagcuggg

SEQ ID NO: 959952 - RNA, 22 nt, Human
cagggucuuggcgccaucaccc

SEQ ID NO: 959953 - RNA, 22 nt, Human
gcaauaaauaacauggaagaca

SEQ ID NO: 959954 - RNA, 22 nt, Human
ucucugaguauccugaacugcc

SEQ ID NO: 959955 - RNA, 22 nt, Human
agcagccauccuuagagaaaga

SEQ ID NO: 959956 - RNA, 20 nt, Human
ugugaaagcaguagaaugac

SEQ ID NO: 959957 - RNA, 22 nt, Human
cacucugcgcugggcgccagcg

SEQ ID NO: 959958 - RNA, 22 nt, Human
ucuggcucucaacaaauauuua

SEQ ID NO: 959959 - RNA, 22 nt, Human
gagauggggaauaggagcaagc

SEQ ID NO: 959960 - RNA, 22 nt, Human
cuguccuuacugcuucuggcuu

SEQ ID NO: 959961 - RNA, 22 nt, Human
agguuauaugucauacugaagu

SEQ ID NO: 959962 - RNA, 22 nt, Human
acucaggaaaugaagacugguu

SEQ ID NO: 959963 - RNA, 22 nt, Human
cugcucugaagccaggauucug

SEQ ID NO: 959964 - RNA, 22 nt, Human
acaaaguccugguguauggcca

SEQ ID NO: 959965 - RNA, 22 nt, Human
gcaggggcaggagaucucaggc

SEQ ID NO: 959966 - RNA, 22 nt, Human
gccuggaguggacuuggccccu

SEQ ID NO: 959967 - RNA, 22 nt, Human
uauuuagaacagacaauagaaa

SEQ ID NO: 959968 - RNA, 22 nt, Human
uaaaguucagugcaugaaugug

SEQ ID NO: 959969 - RNA, 22 nt, Human
cugggcacauuuugacuagugu

SEQ ID NO: 959970 - RNA, 23 nt, Human
uaauucacauauacauugcuuca

SEQ ID NO: 959971 - RNA, 22 nt, Human
ugaaaucuacccuauucagggu

SEQ ID NO: 959972 - RNA, 22 nt, Human
aggcuuauuuuaggucucucuu

SEQ ID NO: 959973 - RNA, 20 nt, Human
ucauccaguugguuuauggu

SEQ ID NO: 959974 - RNA, 22 nt, Human
uaaaucucacuggguauauugg

SEQ ID NO: 959975 - RNA, 22 nt, Human
ggcuucuccagguacugagcau

SEQ ID NO: 959976 - RNA, 22 nt, Human
ccugguggacagcagccagcag

SEQ ID NO: 959977 - RNA, 22 nt, Human
aaaagguuuugaguacaaauau

SEQ ID NO: 959978 - RNA, 18 nt, Human
uggguggcuagggaguuu

SEQ ID NO: 959979 - RNA, 22 nt, Human
ccugucauacuaacguaguggg

SEQ ID NO: 959980 - RNA, 22 nt, Human
ugcugcugauggcaccuaggca

SEQ ID NO: 959981 - RNA, 22 nt, Human
gugauuucaaauauagagugag

SEQ ID NO: 959982 - RNA, 22 nt, Human
cccaggcugaugggaugggcca

SEQ ID NO: 959983 - RNA, 22 nt, Human
uuugugaagggaacagaagugu

SEQ ID NO: 959984 - RNA, 22 nt, Human
gugccugggcaugagcuuguug

SEQ ID NO: 959985 - RNA, 22 nt, Human
agagcugaaaaagcugacccgg

SEQ ID NO: 959986 - RNA, 22 nt, Human
cugggaggacaacuuggagcuc

SEQ ID NO: 959987 - RNA, 22 nt, Human
uucaggauuguguuuuuccuga

SEQ ID NO: 959988 - RNA, 22 nt, Human
gcgucugaguugcgggggcuca

SEQ ID NO: 959989 - RNA, 19 nt, Human
aaggcagcaguagcaucca

SEQ ID NO: 959990 - RNA, 22 nt, Human
uaaauucccaacucugcucuuc

SEQ ID NO: 959991 - RNA, 22 nt, Human
agcuggccuuagugagcaccug

SEQ ID NO: 959992 - RNA, 22 nt, Human
acucagaguuugcguuccauac

SEQ ID NO: 959993 - RNA, 22 nt, Human
guaggcagauaggagugcagcc

SEQ ID NO: 959994 - RNA, 19 nt, Human
uggucuaaaugugugcccc

SEQ ID NO: 959995 - RNA, 22 nt, Human
cggggacacacuggcagcuccu

SEQ ID NO: 959996 - RNA, 22 nt, Human
acacuaaugagaaaggaauuaa

SEQ ID NO: 959997 - RNA, 22 nt, Human
ugaaaauuguuguacuugauaa

SEQ ID NO: 959998 - RNA, 22 nt, Human
uuccaugugaguacacugugau

SEQ ID NO: 959999 - RNA, 22 nt, Human
ucccagggacugggcuaggcuu

SEQ ID NO: 960000 - RNA, 22 nt, Human
uuaaaugaugcauaucauuuag

SEQ ID NO: 960001 - RNA, 22 nt, Human
gccuggguccacugaucaugcu

SEQ ID NO: 960002 - RNA, 23 nt, Human
gaguguucauagcaggcucuugc

SEQ ID NO: 960003 - RNA, 22 nt, Human
uguagcacagagcuuugacacu

SEQ ID NO: 960004 - RNA, 22 nt, Human
acacucugcucugagcuucagg

SEQ ID NO: 960005 - RNA, 23 nt, Human
ccagucucacguauacaggauuu

SEQ ID NO: 960006 - RNA, 18 nt, Human
uacaugcauaaaugaagc

SEQ ID NO: 960007 - RNA, 23 nt, Human
ccaggcaguagcuauugaaguga

SEQ ID NO: 960008 - RNA, 22 nt, Human
cuuccagguccuucuugagaag

SEQ ID NO: 960009 - RNA, 22 nt, Human
ucaucuaagagucuuacauuua

SEQ ID NO: 960010 - RNA, 22 nt, Human
ccagcugcuugggaaaaugucu

SEQ ID NO: 960011 - RNA, 22 nt, Human
agaggccaggcugcagagggau

SEQ ID NO: 960012 - RNA, 22 nt, Human
agaggacagacggaaagugcca

SEQ ID NO: 960013 - RNA, 22 nt, Human
guccucugacucagccuuggga

SEQ ID NO: 960014 - RNA, 22 nt, Human
aggcacuggguaauuaguagcu

SEQ ID NO: 960015 - RNA, 23 nt, Human
gccugggacucaggaggagcuca

SEQ ID NO: 960016 - RNA, 22 nt, Human
cugugcuggcagaccuggaguu

SEQ ID NO: 960017 - RNA, 22 nt, Human
aaaggucaagcuggacucaggu

SEQ ID NO: 960018 - RNA, 22 nt, Human
gcugccucaggcaccuccuggc

SEQ ID NO: 960019 - RNA, 22 nt, Human
cagggacaugacuggucucugu

SEQ ID NO: 960020 - RNA, 22 nt, Human
aucucagacauguuguccauga

SEQ ID NO: 960021 - RNA, 22 nt, Human
acucuucuugcugcucauuaau

SEQ ID NO: 960022 - RNA, 21 nt, Human
uggcugcuggcccucucucca

SEQ ID NO: 960023 - RNA, 22 nt, Human
uguuacacagcagaauagcaag

SEQ ID NO: 960024 - RNA, 22 nt, Human
aaaaauguuaucuacuguccga

SEQ ID NO: 960025 - RNA, 22 nt, Human
uggagcagccaugaugacagag

SEQ ID NO: 960026 - RNA, 22 nt, Human
uauuuccaagcugaauccaaug

SEQ ID NO: 960027 - RNA, 22 nt, Human
uuucagaaaacuuaucaucagu

SEQ ID NO: 960028 - RNA, 22 nt, Human
gaggagcacaugaggcugaggg

SEQ ID NO: 960029 - RNA, 20 nt, Human
cagagaccugucuucacaga

SEQ ID NO: 960030 - RNA, 22 nt, Human
ccugcccuagagaugacacaau

SEQ ID NO: 960031 - RNA, 22 nt, Human
ccugccuguacuagagacccag

SEQ ID NO: 960032 - RNA, 22 nt, Human
ccugccugucccucaguccaca

SEQ ID NO: 960033 - RNA, 22 nt, Human
ccugccugaaggucagccaccc

SEQ ID NO: 960034 - RNA, 22 nt, Human
cagcucugugggagcguaugug

SEQ ID NO: 960035 - RNA, 22 nt, Human
ucauccagagcuucauaaguaa

SEQ ID NO: 960036 - RNA, 20 nt, Human
ucagugauuaucucugagug

SEQ ID NO: 960037 - RNA, 22 nt, Human
gaaaucugucuuuguuugaaua

SEQ ID NO: 960038 - RNA, 22 nt, Human
gcucugugccacaugcaguguu

SEQ ID NO: 960039 - RNA, 22 nt, Human
auuucacucauucauguuacuu

SEQ ID NO: 960040 - RNA, 22 nt, Human
ggggcagagucuggacuguugu

SEQ ID NO: 960041 - RNA, 22 nt, Human
ucuuagaaaugaaguucuuucu

SEQ ID NO: 960042 - RNA, 22 nt, Human
guguugaugacauuuuagaaac

SEQ ID NO: 960043 - RNA, 22 nt, Human
uagagcugauaaugaggccaag

SEQ ID NO: 960044 - RNA, 21 nt, Human
agcagccauuucacagagacu

SEQ ID NO: 960045 - RNA, 22 nt, Human
ccacuugugaaauaaucaaaua

SEQ ID NO: 960046 - RNA, 22 nt, Human
ggagugacucucggggccacua

SEQ ID NO: 960047 - RNA, 22 nt, Human
uggcagagucucuccuuuccag

SEQ ID NO: 960048 - RNA, 22 nt, Human
agugcucauaaaaaugugaaac

SEQ ID NO: 960049 - RNA, 22 nt, Human
ggcaggagaaaggucucuucuu

SEQ ID NO: 960050 - RNA, 17 nt, Human
aaugaaugaauucuuug

SEQ ID NO: 960051 - RNA, 22 nt, Human
cagagaaacucagauagcugau

SEQ ID NO: 960052 - RNA, 22 nt, Human
uguguauuucuggaacagacua

SEQ ID NO: 960053 - RNA, 22 nt, Human
ggcuucccaaggagccaggaug

SEQ ID NO: 960054 - RNA, 22 nt, Human
aaauauaguaaaugcauaguuc

SEQ ID NO: 960055 - RNA, 22 nt, Human
ccuuggaggacugcugcuucuu

SEQ ID NO: 960056 - RNA, 22 nt, Human
cagggccuuauccugccauuga

SEQ ID NO: 960057 - RNA, 22 nt, Human
aacuagaaaacaagaugcugau

SEQ ID NO: 960058 - RNA, 22 nt, Human
cuugauguauaaguugauaugu

SEQ ID NO: 960059 - RNA, 20 nt, Human
uguauauuuucugguguaaa

SEQ ID NO: 960060 - RNA, 22 nt, Human
agaauucugacaauagaauugg

SEQ ID NO: 960061 - RNA, 22 nt, Human
uggcucaggggucuggcucugu

SEQ ID NO: 960062 - RNA, 22 nt, Human
cuggcccagagagcagagcuua

SEQ ID NO: 960063 - RNA, 19 nt, Human
cugggacaaugaaagcauc

SEQ ID NO: 960064 - RNA, 19 nt, Human
gcaggcaguggcauucgga

SEQ ID NO: 960065 - RNA, 22 nt, Human
uaaacagaaagcagauguacuu

SEQ ID NO: 960066 - RNA, 22 nt, Human
cuggaaggcucugcugccuguc

SEQ ID NO: 960067 - RNA, 22 nt, Human
auuguaauuuuagagaaagugg

SEQ ID NO: 960068 - RNA, 22 nt, Human
ugaacuccaaauacugcugauu

SEQ ID NO: 960069 - RNA, 22 nt, Human
gggaguguugagcgcccugcca

SEQ ID NO: 960070 - RNA, 22 nt, Human
uuuauguacauauccacaagga

SEQ ID NO: 960071 - RNA, 22 nt, Human
uuggcagauuugucaguaagcu

SEQ ID NO: 960072 - RNA, 22 nt, Human
aaaggccaagcaugagguggac

SEQ ID NO: 960073 - RNA, 22 nt, Human
cugugcugauucagcacaggcc

SEQ ID NO: 960074 - RNA, 22 nt, Human
uucauuaguucugaagaugucu

SEQ ID NO: 960075 - RNA, 20 nt, Human
uauauguguacauacacaca

SEQ ID NO: 960076 - RNA, 22 nt, Human
agauuguagaaacuguagcauu

SEQ ID NO: 960077 - RNA, 22 nt, Human
gaaaugcaaauucucucucgcu

SEQ ID NO: 960078 - RNA, 22 nt, Human
ggcucugccugcccagcagcac

SEQ ID NO: 960079 - RNA, 22 nt, Human
acaaaaguguaggaauuccuua

SEQ ID NO: 960080 - RNA, 17 nt, Human
cucagaguugcuuuguc

SEQ ID NO: 960081 - RNA, 22 nt, Human
cugccaggcagcagagggagaa

SEQ ID NO: 960082 - RNA, 20 nt, Human
cccaggaguuugcucuuacu

SEQ ID NO: 960083 - RNA, 22 nt, Human
uuucuguagggauuucacaguu

SEQ ID NO: 960084 - RNA, 22 nt, Human
agggcagagacaugcuuccuga

SEQ ID NO: 960085 - RNA, 22 nt, Human
cucagagaggcaguggaaguca

SEQ ID NO: 960086 - RNA, 18 nt, Human
cucucuggucuggauccc

SEQ ID NO: 960087 - RNA, 22 nt, Human
ccacagggacuguuaaaacccu

SEQ ID NO: 960088 - RNA, 22 nt, Human
cagggcuguggcuuugugcugu

SEQ ID NO: 960089 - RNA, 22 nt, Human
gggccacacagaaccuccuggu

SEQ ID NO: 960090 - RNA, 19 nt, Human
ucucagagcccuagaggcc

SEQ ID NO: 960091 - RNA, 22 nt, Human
cacugccuccccaggcuccaca

SEQ ID NO: 960092 - RNA, 22 nt, Human
cuggcaggaagaggaaagguca

SEQ ID NO: 960093 - RNA, 22 nt, Human
cagggccugcuuccuucuuguu

SEQ ID NO: 960094 - RNA, 18 nt, Human
gagacacaagggccugga

SEQ ID NO: 960095 - RNA, 22 nt, Human
acagggcaaccucugggagacu

SEQ ID NO: 960096 - RNA, 22 nt, Human
augcacagcagugaguucagug

SEQ ID NO: 960097 - RNA, 22 nt, Human
cuuuuauuuugaauuaagggcu

SEQ ID NO: 960098 - RNA, 22 nt, Human
ucaggagcagcaugggugagag

SEQ ID NO: 960099 - RNA, 22 nt, Human
gcagcuuuguggagaggcccau

SEQ ID NO: 960100 - RNA, 22 nt, Human
gaugguuugguaaaaguauguu

SEQ ID NO: 960101 - RNA, 20 nt, Human
gaagcagcuucauguagaca

SEQ ID NO: 960102 - RNA, 22 nt, Human
uaaguucauuagacuacagaua

SEQ ID NO: 960103 - RNA, 20 nt, Human
agucccuuuggucagguauu

SEQ ID NO: 960104 - RNA, 22 nt, Human
ggcaguggguggaucucaggga

SEQ ID NO: 960105 - RNA, 22 nt, Human
gcucuggagauggagccuugag

SEQ ID NO: 960106 - RNA, 22 nt, Human
cugggacccugcccuguggccu

SEQ ID NO: 960107 - RNA, 22 nt, Human
agcagggccaacaguaaacacc

SEQ ID NO: 960108 - RNA, 22 nt, Human
ugcauauuguccuugauauuau

SEQ ID NO: 960109 - RNA, 22 nt, Human
uagcacauaacuuagaauaguu

SEQ ID NO: 960110 - RNA, 22 nt, Human
ugugacaucgcugugucuguuu

SEQ ID NO: 960111 - RNA, 21 nt, Human
ugcaggagucugugagucagg

SEQ ID NO: 960112 - RNA, 23 nt, Human
aaugauuucaugaugauagcagc

SEQ ID NO: 960113 - RNA, 22 nt, Human
uugacaauugggagauauaaag

SEQ ID NO: 960114 - RNA, 22 nt, Human
uccucagacuucccuuugugua

SEQ ID NO: 960115 - RNA, 22 nt, Human
gagagaagaauguuccgaggcc

SEQ ID NO: 960116 - RNA, 20 nt, Human
cugagcccccagccugcagg

SEQ ID NO: 960117 - RNA, 22 nt, Human
gcagcucccaucagggcacaga

SEQ ID NO: 960118 - RNA, 22 nt, Human
ggaucauuaacacauccaucac

SEQ ID NO: 960119 - RNA, 20 nt, Human
uguuucuuuuaaugagcggc

SEQ ID NO: 960120 - RNA, 22 nt, Human
aauucacaugcaugucugugca

SEQ ID NO: 960121 - RNA, 22 nt, Human
ccauggaguuccucuggucuau

SEQ ID NO: 960122 - RNA, 22 nt, Human
aucuggcucacuuagucuagga

SEQ ID NO: 960123 - RNA, 22 nt, Human
uucuuucacucaagaaggaucu

SEQ ID NO: 960124 - RNA, 22 nt, Human
ucaggauguuaauauagcauua

SEQ ID NO: 960125 - RNA, 22 nt, Human
cacagaauuaagggagaaauau

SEQ ID NO: 960126 - RNA, 22 nt, Human
acuaagugauucuaagcaucuu

SEQ ID NO: 960127 - RNA, 22 nt, Human
auucuucaccugagucagucua

SEQ ID NO: 960128 - RNA, 22 nt, Human
agagggcugcugcacagugcuc

SEQ ID NO: 960129 - RNA, 22 nt, Human
ccaaggagcaaggcucaacaag

SEQ ID NO: 960130 - RNA, 22 nt, Human
aucaggauccaccuugagccug

SEQ ID NO: 960131 - RNA, 22 nt, Human
ccaggagacuguacugauauuu

SEQ ID NO: 960132 - RNA, 22 nt, Human
cagccagggucaggcagcuucu

SEQ ID NO: 960133 - RNA, 22 nt, Human
ugggccuggcccuguggaggag

SEQ ID NO: 960134 - RNA, 22 nt, Human
gcagagccagaauggccaggac

SEQ ID NO: 960135 - RNA, 22 nt, Human
cagggcagaaggcacucuacuc

SEQ ID NO: 960136 - RNA, 22 nt, Human
aguucucaggucagcugagucu

SEQ ID NO: 960137 - RNA, 22 nt, Human
caugggcuacagaagcaugcug

SEQ ID NO: 960138 - RNA, 22 nt, Human
ugguccagacauuucugaggua

SEQ ID NO: 960139 - RNA, 22 nt, Human
caagauggaguccgggaaugug

SEQ ID NO: 960140 - RNA, 22 nt, Human
agaggcugggaaggguccccgg

SEQ ID NO: 960141 - RNA, 22 nt, Human
gacagcugugcaggagaagggg

SEQ ID NO: 960142 - RNA, 22 nt, Human
ggcucaagcagucugccugccu

SEQ ID NO: 960143 - RNA, 22 nt, Human
gagagugaggcaucaggggcag

SEQ ID NO: 960144 - RNA, 22 nt, Human
uuucacaaguaaaguccuaagu

SEQ ID NO: 960145 - RNA, 17 nt, Human
cagugcagagcccuuuc

SEQ ID NO: 960146 - RNA, 22 nt, Human
aagauuucugcuccugagagaa

SEQ ID NO: 960147 - RNA, 22 nt, Human
auggccaagaaguauuccugac

SEQ ID NO: 960148 - RNA, 22 nt, Human
gauggggaugagaagugagcag

SEQ ID NO: 960149 - RNA, 22 nt, Human
gcuggagccuucugcucuguug

SEQ ID NO: 960150 - RNA, 22 nt, Human
cagaguguauucugcaguugca

SEQ ID NO: 960151 - RNA, 22 nt, Human
ggccgggcaggucucagccagc

SEQ ID NO: 960152 - RNA, 22 nt, Human
uaaugucaaggugauagauuug

SEQ ID NO: 960153 - RNA, 22 nt, Human
uuucucuguucucuaacuguaa

SEQ ID NO: 960154 - RNA, 22 nt, Human
uuccuguccgcaauggccuggg

SEQ ID NO: 960155 - RNA, 22 nt, Human
agcagcugccagagagaguucc

SEQ ID NO: 960156 - RNA, 22 nt, Human
uagcagggguagauagagugug

SEQ ID NO: 960157 - RNA, 22 nt, Human
ucugggaaguccucugucaugc

SEQ ID NO: 960158 - RNA, 23 nt, Human
cuguggcugaguccuguuggagu

SEQ ID NO: 960159 - RNA, 22 nt, Human
uccaugagaacccuuggagaua

SEQ ID NO: 960160 - RNA, 22 nt, Human
ugccuugguucucuacuuggag

SEQ ID NO: 960161 - RNA, 22 nt, Human
uccagcucuaacaugcugggcc

SEQ ID NO: 960162 - RNA, 22 nt, Human
uaaugugugucaucaguagagu

SEQ ID NO: 960163 - RNA, 20 nt, Human
gugggcagaugugugcaugg

SEQ ID NO: 960164 - RNA, 22 nt, Human
uauuucugaggcccaggaagug

SEQ ID NO: 960165 - RNA, 18 nt, Human
uucagcagcagacacacu

SEQ ID NO: 960166 - RNA, 22 nt, Human
uccauuuacuauucucauaucg

SEQ ID NO: 960167 - RNA, 22 nt, Human
agcugucuccagauacaggauu

SEQ ID NO: 960168 - RNA, 23 nt, Human
agaggggagcaucugcuggcuga

SEQ ID NO: 960169 - RNA, 22 nt, Human
cacguuuuaugacagaagaagc

SEQ ID NO: 960170 - RNA, 22 nt, Human
ccagccucaucgccugccuguc

SEQ ID NO: 960171 - RNA, 22 nt, Human
uacaguaucuucuggcaagcau

SEQ ID NO: 960172 - RNA, 22 nt, Human
uuugaguugcuuauuuaauagg

SEQ ID NO: 960173 - RNA, 22 nt, Human
caagaugaucccugaaggcagc

SEQ ID NO: 960174 - RNA, 22 nt, Human
ccagagacgucggucagggcgc

SEQ ID NO: 960175 - RNA, 22 nt, Human
uauuauuauaguuauugggaag

SEQ ID NO: 960176 - RNA, 22 nt, Human
ggccucugcccucacuccuguc

SEQ ID NO: 960177 - RNA, 22 nt, Human
gcugucccgcugacuuccagcu

SEQ ID NO: 960178 - RNA, 22 nt, Human
uuugaaaggaaguuaauacuuu

SEQ ID NO: 960179 - RNA, 22 nt, Human
ucugcagcuuuuugguggggug

SEQ ID NO: 960180 - RNA, 22 nt, Human
ucacaguaucacacaaggauua

SEQ ID NO: 960181 - RNA, 16 nt, Human
gggcugggggauucug

SEQ ID NO: 960182 - RNA, 22 nt, Human
aggcagcuuucuguaggggugu

SEQ ID NO: 960183 - RNA, 22 nt, Human
ggucccaggaagugcggcggcg

SEQ ID NO: 960184 - RNA, 22 nt, Human
cuggacagaaagggcugcugug

SEQ ID NO: 960185 - RNA, 22 nt, Human
caggagaagguuuggagugcag

SEQ ID NO: 960186 - RNA, 23 nt, Human
agcuggaggcugucuacucccaa

SEQ ID NO: 960187 - RNA, 22 nt, Human
gguguccaucaggcugugcuuc

SEQ ID NO: 960188 - RNA, 22 nt, Human
uugcucuguaauaaucuggggu

SEQ ID NO: 960189 - RNA, 21 nt, Human
gggaaauuaggauugcucauc

SEQ ID NO: 960190 - RNA, 22 nt, Human
uuuuuaagagauucuccagucu

SEQ ID NO: 960191 - RNA, 18 nt, Human
uccugccugcgggcuccc

SEQ ID NO: 960192 - RNA, 22 nt, Human
ucaggggacuuaggagagaagu

SEQ ID NO: 960193 - RNA, 22 nt, Human
gcagggccagguacaagaagca

SEQ ID NO: 960194 - RNA, 22 nt, Human
uauguguaggaggaggacaggg

SEQ ID NO: 960195 - RNA, 22 nt, Human
ccucuggcuguaccacuggcac

SEQ ID NO: 960196 - RNA, 22 nt, Human
cucugucccagacccaccucuc

SEQ ID NO: 960197 - RNA, 22 nt, Human
augugcuaaacucaacaaaucu

SEQ ID NO: 960198 - RNA, 22 nt, Human
uauaagaaacaaggcaaauuuu

SEQ ID NO: 960199 - RNA, 22 nt, Human
uggcagcagcuaacuuaggcag

SEQ ID NO: 960200 - RNA, 22 nt, Human
ccucugcucugguccaugugcu

SEQ ID NO: 960201 - RNA, 22 nt, Human
cugcuucuccaaaguaggacuu

SEQ ID NO: 960202 - RNA, 22 nt, Human
aggagucaggaccaaauggaaa

SEQ ID NO: 960203 - RNA, 19 nt, Human
aggccugggguuuugcacu

SEQ ID NO: 960204 - RNA, 22 nt, Human
auaaggcauauagucacuuuuu

SEQ ID NO: 960205 - RNA, 22 nt, Human
agcaugcacaugacuggcuuaa

SEQ ID NO: 960206 - RNA, 22 nt, Human
ugccucugggugaccaaggagc

SEQ ID NO: 960207 - RNA, 22 nt, Human
gcuguucucuguaacaugcauu

SEQ ID NO: 960208 - RNA, 22 nt, Human
gcguaaggccucuggucucgga

SEQ ID NO: 960209 - RNA, 22 nt, Human
uaucuguuugcucacagguguu

SEQ ID NO: 960210 - RNA, 22 nt, Human
gcuggccugcgagggcaggcug

SEQ ID NO: 960211 - RNA, 22 nt, Human
ggucucagcuggaguccuuggu

SEQ ID NO: 960212 - RNA, 22 nt, Human
ucugagcccucuuuugcagccc

SEQ ID NO: 960213 - RNA, 21 nt, Human
ucugucugguuuuagaguggc

SEQ ID NO: 960214 - RNA, 22 nt, Human
cagcauggggaucacuguaggc

SEQ ID NO: 960215 - RNA, 22 nt, Human
cacaaaugguuguagacauuaa

SEQ ID NO: 960216 - RNA, 22 nt, Human
uauuauuaaauggcagaauuuu

SEQ ID NO: 960217 - RNA, 22 nt, Human
cgaggcagggaagcugcaaaag

SEQ ID NO: 960218 - RNA, 22 nt, Human
uccaugagacagauacuguaag

SEQ ID NO: 960219 - RNA, 22 nt, Human
ucucagagcucacaccuccugg

SEQ ID NO: 960220 - RNA, 22 nt, Human
aaguguuaaaagauuaaaugcu

SEQ ID NO: 960221 - RNA, 22 nt, Human
cagcuccucacgagucuugaaa

SEQ ID NO: 960222 - RNA, 22 nt, Human
gggaguggagagcaauggauga

SEQ ID NO: 960223 - RNA, 22 nt, Human
caggugggccaugaaaaaugac

SEQ ID NO: 960224 - RNA, 22 nt, Human
uguuucaagcaauagcauuuca

SEQ ID NO: 960225 - RNA, 22 nt, Human
ggacuggccggcgcugaggccc

SEQ ID NO: 960226 - RNA, 22 nt, Human
uuaaaguucauuaaaugagcca

SEQ ID NO: 960227 - RNA, 20 nt, Human
gucucagaauggauuugcau

SEQ ID NO: 960228 - RNA, 18 nt, Human
ccauuucaugauuauuac

SEQ ID NO: 960229 - RNA, 22 nt, Human
gcaaaugcucuccuuggucagg

SEQ ID NO: 960230 - RNA, 22 nt, Human
uuucuagucagccauaucuagu

SEQ ID NO: 960231 - RNA, 23 nt, Human
aaauuauugcucuucaauugccu

SEQ ID NO: 960232 - RNA, 22 nt, Human
gggcuggcucugucuagaaagg

SEQ ID NO: 960233 - RNA, 22 nt, Human
agggcagaaaccaccuugaugg

SEQ ID NO: 960234 - RNA, 22 nt, Human
acuccugguucccaguugagau

SEQ ID NO: 960235 - RNA, 22 nt, Human
uauaaagaaguguaaacaggaa

SEQ ID NO: 960236 - RNA, 22 nt, Human
gcucugagauugagccuuuggu

SEQ ID NO: 960237 - RNA, 22 nt, Human
uauguguuugacacccugcaag

SEQ ID NO: 960238 - RNA, 17 nt, Human
uucugagccacuuccuu

SEQ ID NO: 960239 - RNA, 22 nt, Human
uauuuaauuugcucauugugau

SEQ ID NO: 960240 - RNA, 22 nt, Human
uaaaaugaucucucauguucuu

SEQ ID NO: 960241 - RNA, 22 nt, Human
cguggccuuugagugagcuccc

SEQ ID NO: 960242 - RNA, 22 nt, Human
cugcccugucuuuuucugauga

SEQ ID NO: 960243 - RNA, 22 nt, Human
ugugaugguucacugggcauga

SEQ ID NO: 960244 - RNA, 20 nt, Human
cugggaggucuuccaaauca

SEQ ID NO: 960245 - RNA, 22 nt, Human
gccaugaggaacuguaagacaa

SEQ ID NO: 960246 - RNA, 22 nt, Human
uaguacuuaucucugucauugu

SEQ ID NO: 960247 - RNA, 22 nt, Human
aaaguuucaauagaggaagugg

SEQ ID NO: 960248 - RNA, 22 nt, Human
gcagcauauuguacuggccugc

SEQ ID NO: 960249 - RNA, 22 nt, Human
guuuuuccuugcugaggacccg

SEQ ID NO: 960250 - RNA, 22 nt, Human
uuuugcuugagugcacaaaaug

SEQ ID NO: 960251 - RNA, 22 nt, Human
ucuuuucaucauuuaauaggua

SEQ ID NO: 960252 - RNA, 22 nt, Human
uuaaacagguuuuugaauggcc

SEQ ID NO: 960253 - RNA, 22 nt, Human
aaguuuuaacaaguacuuacua

SEQ ID NO: 960254 - RNA, 22 nt, Human
uaccuauagguacaauuacaag

SEQ ID NO: 960255 - RNA, 22 nt, Human
ggauccuuaacuaucacaguga

SEQ ID NO: 960256 - RNA, 22 nt, Human
ugauuuccuagcugacaugaaa

SEQ ID NO: 960257 - RNA, 22 nt, Human
ucaagagaagugcuccacagua

SEQ ID NO: 960258 - RNA, 18 nt, Human
cagaugagaugcaaucuc

SEQ ID NO: 960259 - RNA, 22 nt, Human
uccaaauucuagggccuugguu

SEQ ID NO: 960260 - RNA, 22 nt, Human
ccagcuggagccaagguggacu

SEQ ID NO: 960261 - RNA, 22 nt, Human
uagaucugauacaauucaucug

SEQ ID NO: 960262 - RNA, 22 nt, Human
cuguacaucucugaggacagua

SEQ ID NO: 960263 - RNA, 21 nt, Human
auguaggguuugccuucucua

SEQ ID NO: 960264 - RNA, 22 nt, Human
gggugaggagcugccagucaug

SEQ ID NO: 960265 - RNA, 22 nt, Human
acaguuucuccauuuacaccuu

SEQ ID NO: 960266 - RNA, 22 nt, Human
ccucagggucugaggagaccgu

SEQ ID NO: 960267 - RNA, 22 nt, Human
ccagguaggagagagggauccu

SEQ ID NO: 960268 - RNA, 22 nt, Human
aauuucagaacccaaauuagcg

SEQ ID NO: 960269 - RNA, 22 nt, Human
agggggugcccagaugaaggau

SEQ ID NO: 960270 - RNA, 22 nt, Human
uaauacagaaguguauuaaaau

SEQ ID NO: 960271 - RNA, 19 nt, Human
cagcaauaaugccagaugg

SEQ ID NO: 960272 - RNA, 22 nt, Human
gccuaauaugcaaaauugauac

SEQ ID NO: 960273 - RNA, 20 nt, Human
uuuuuccuucucuacaggca

SEQ ID NO: 960274 - RNA, 22 nt, Human
uauauguaagcuauguaagagu

SEQ ID NO: 960275 - RNA, 22 nt, Human
uaugcacacaggcuuaauucau

SEQ ID NO: 960276 - RNA, 22 nt, Human
caaauagugucacauugugagg

SEQ ID NO: 960277 - RNA, 22 nt, Human
ucauugcaccccagucccagcu

SEQ ID NO: 960278 - RNA, 22 nt, Human
gcagcuggcccugacacgcaga

SEQ ID NO: 960279 - RNA, 22 nt, Human
auuugcuuucagguauaaaagg

SEQ ID NO: 960280 - RNA, 22 nt, Human
uagaaacauguucuguucuguu

SEQ ID NO: 960281 - RNA, 22 nt, Human
acugggaggcaucuggagcuga

SEQ ID NO: 960282 - RNA, 22 nt, Human
ucacugcugcugccaugaugga

SEQ ID NO: 960283 - RNA, 22 nt, Human
gcagcugauggaaguccuauug

SEQ ID NO: 960284 - RNA, 22 nt, Human
gaggugggaugugugugcuacu

SEQ ID NO: 960285 - RNA, 22 nt, Human
ggcagcuuucaauaggguuaug

SEQ ID NO: 960286 - RNA, 22 nt, Human
augucuuucucacagccaguuc

SEQ ID NO: 960287 - RNA, 20 nt, Human
auaaaauaacugccacaaga

SEQ ID NO: 960288 - RNA, 22 nt, Human
uccagggaugccagccauguug

SEQ ID NO: 960289 - RNA, 22 nt, Human
guggugcauccuugaguaagcu

SEQ ID NO: 960290 - RNA, 22 nt, Human
auguaaggcugccuaugacacu

SEQ ID NO: 960291 - RNA, 22 nt, Human
uaugugcaaaaugcuagacuag

SEQ ID NO: 960292 - RNA, 22 nt, Human
auccuugaaugacucugcccuc

SEQ ID NO: 960293 - RNA, 22 nt, Human
ucagaggacgcacuaggguugu

SEQ ID NO: 960294 - RNA, 22 nt, Human
ccuccugggacaggcuggcaca

SEQ ID NO: 960295 - RNA, 23 nt, Human
cuccccaguguccucaugcaucu

SEQ ID NO: 960296 - RNA, 22 nt, Human
uagaaauccccagucucauagu

SEQ ID NO: 960297 - RNA, 17 nt, Human
ugaaggaaggaugaugu

SEQ ID NO: 960298 - RNA, 22 nt, Human
ggcagacuguaauaggagaauu

SEQ ID NO: 960299 - RNA, 22 nt, Human
auucuuuucccaacugcuuuaa

SEQ ID NO: 960300 - RNA, 22 nt, Human
agcugcugcggaaagaugccac

SEQ ID NO: 960301 - RNA, 22 nt, Human
agggagcuucuggccucagccu

SEQ ID NO: 960302 - RNA, 20 nt, Human
ugcuuccuggccacugcggg

SEQ ID NO: 960303 - RNA, 22 nt, Human
auacaaagacaaaucucaaucu

SEQ ID NO: 960304 - RNA, 22 nt, Human
aauaugcauuaacuguguacau

SEQ ID NO: 960305 - RNA, 22 nt, Human
auuagguugugcuuuguggaca

SEQ ID NO: 960306 - RNA, 22 nt, Human
uacauauacugagugauuugcu

SEQ ID NO: 960307 - RNA, 22 nt, Human
uuuccucugcugccauugcccc

SEQ ID NO: 960308 - RNA, 19 nt, Human
cccaaggcccugggcaggc

SEQ ID NO: 960309 - RNA, 22 nt, Human
uggcagcuccggguaggggcug

SEQ ID NO: 960310 - RNA, 22 nt, Human
uaagaaauuuaguuauagaaug

SEQ ID NO: 960311 - RNA, 22 nt, Human
gcagguggauuaucagaagugc

SEQ ID NO: 960312 - RNA, 21 nt, Human
ccucugcucgggcaugcguuu

SEQ ID NO: 960313 - RNA, 22 nt, Human
uuggcagugucugcaaaaugga

SEQ ID NO: 960314 - RNA, 22 nt, Human
gggauggggucaacauguaccu

SEQ ID NO: 960315 - RNA, 22 nt, Human
uucaacuaauguuuauuuuaug

SEQ ID NO: 960316 - RNA, 22 nt, Human
guugaaauccuaacccccuagu

SEQ ID NO: 960317 - RNA, 22 nt, Human
caguggcagagaacagagaccu

SEQ ID NO: 960318 - RNA, 22 nt, Human
ggcugcuggcauugagguaggu

SEQ ID NO: 960319 - RNA, 22 nt, Human
agggagagguugaaaccucagu

SEQ ID NO: 960320 - RNA, 22 nt, Human
uuuaggauauuaauguucagag

SEQ ID NO: 960321 - RNA, 22 nt, Human
ccagggcugcugugggacucca

SEQ ID NO: 960322 - RNA, 22 nt, Human
uuugaaaguucuucugacacua

SEQ ID NO: 960323 - RNA, 23 nt, Human
agagcuuagggaauucacaugag

SEQ ID NO: 960324 - RNA, 22 nt, Human
aaugcacagcuaaagugguucc

SEQ ID NO: 960325 - RNA, 22 nt, Human
uuugaaauguaucaguauaggu

SEQ ID NO: 960326 - RNA, 22 nt, Human
gagguacagaguguuccaaugu

SEQ ID NO: 960327 - RNA, 22 nt, Human
augcacuacuuggcuuuacuga

SEQ ID NO: 960328 - RNA, 21 nt, Human
agcagaacagucgagcacugc

SEQ ID NO: 960329 - RNA, 22 nt, Human
cagaaagaccugggcucaagag

SEQ ID NO: 960330 - RNA, 22 nt, Human
uacaggaggauuaucaaaggau

SEQ ID NO: 960331 - RNA, 22 nt, Human
gugauugcccagcaccauuguu

SEQ ID NO: 960332 - RNA, 22 nt, Human
ugcaccauuuugucaggcuacu

SEQ ID NO: 960333 - RNA, 22 nt, Human
gcaggagagccagcaggcuucc

SEQ ID NO: 960334 - RNA, 22 nt, Human
caggaaagggaugggcugccac

SEQ ID NO: 960335 - RNA, 17 nt, Human
ggagagugggaauggcc

SEQ ID NO: 960336 - RNA, 22 nt, Human
gcauuuagcuuuaaaauauuuc

SEQ ID NO: 960337 - RNA, 22 nt, Human
uugaauaggacucagcagugau

SEQ ID NO: 960338 - RNA, 21 nt, Human
acagagccgggcacaaagcug

SEQ ID NO: 960339 - RNA, 22 nt, Human
gcccucuggcagccuuggcugg

SEQ ID NO: 960340 - RNA, 22 nt, Human
ccugggcaacauagugagaccc

SEQ ID NO: 960341 - RNA, 22 nt, Human
cggcagcuccgcgccguaggac

SEQ ID NO: 960342 - RNA, 22 nt, Human
ccuggcaguuuugcccaggauu

SEQ ID NO: 960343 - RNA, 22 nt, Human
uggcucaggauaauuuucccaa

SEQ ID NO: 960344 - RNA, 22 nt, Human
ggagaugguggaagcuggugca

SEQ ID NO: 960345 - RNA, 22 nt, Human
cuucuucaaccugaaaguuuca

SEQ ID NO: 960346 - RNA, 22 nt, Human
aaugaugguuaaacacuggagg

SEQ ID NO: 960347 - RNA, 19 nt, Human
gucucugcuccagggucuc

SEQ ID NO: 960348 - RNA, 22 nt, Human
ggcugcuuuaucggcugcugaa

SEQ ID NO: 960349 - RNA, 22 nt, Human
auuuccauagagcgucucacag

SEQ ID NO: 960350 - RNA, 22 nt, Human
caaggaaacaugaaaugcauug

SEQ ID NO: 960351 - RNA, 22 nt, Human
ggcaggcucagcagccaaggag

SEQ ID NO: 960352 - RNA, 22 nt, Human
agagugauggguugugcugacc

SEQ ID NO: 960353 - RNA, 22 nt, Human
uucuguguggguagcuccuguu

SEQ ID NO: 960354 - RNA, 22 nt, Human
agcagagcccuuccauggccuu

SEQ ID NO: 960355 - RNA, 22 nt, Human
aaaugcaggaaauuaugcuuuu

SEQ ID NO: 960356 - RNA, 18 nt, Human
uuaagagcugaaagggga

SEQ ID NO: 960357 - RNA, 18 nt, Human
ugucaucuguuuaaaacc

SEQ ID NO: 960358 - RNA, 22 nt, Human
gauaugaaguggcauugugaag

SEQ ID NO: 960359 - RNA, 22 nt, Human
acaggagacccugcugguucug

SEQ ID NO: 960360 - RNA, 22 nt, Human
gucugcccucacgccagcuggg

SEQ ID NO: 960361 - RNA, 22 nt, Human
gcuccuggcucucugagggcug

SEQ ID NO: 960362 - RNA, 22 nt, Human
uggcagaggaggcucagauuga

SEQ ID NO: 960363 - RNA, 22 nt, Human
ggguccagaguugaagagguua

SEQ ID NO: 960364 - RNA, 22 nt, Human
caggauggccccggggcugugc

SEQ ID NO: 960365 - RNA, 22 nt, Human
aaagcaaugaugguagacacgu

SEQ ID NO: 960366 - RNA, 22 nt, Human
uugugaaacauucauggauuug

SEQ ID NO: 960367 - RNA, 22 nt, Human
acuggcagcuguaggaugcaug

SEQ ID NO: 960368 - RNA, 22 nt, Human
agcugccaggccccugagaacc

SEQ ID NO: 960369 - RNA, 17 nt, Human
gcucccugaggacagcu

SEQ ID NO: 960370 - RNA, 22 nt, Human
agggagacacaugaggaaguca

SEQ ID NO: 960371 - RNA, 22 nt, Human
aaaguaaccuaguaauaguguc

SEQ ID NO: 960372 - RNA, 22 nt, Human
uaugcacagaaguuugcugaau

SEQ ID NO: 960373 - RNA, 22 nt, Human
gaggaugugucuggucugggca

SEQ ID NO: 960374 - RNA, 22 nt, Human
uuggccaagacucauguccuau

SEQ ID NO: 960375 - RNA, 21 nt, Human
ugaagccugaggcauagcccc

SEQ ID NO: 960376 - RNA, 22 nt, Human
ugcuggcccuggcucagggaac

SEQ ID NO: 960377 - RNA, 22 nt, Human
aggcuucccagcugagcucagc

SEQ ID NO: 960378 - RNA, 22 nt, Human
uggggcuguccuuagucugaga

SEQ ID NO: 960379 - RNA, 22 nt, Human
caggaggcuccuagggcucugu

SEQ ID NO: 960380 - RNA, 22 nt, Human
aagugacaccucuucccuuucc

SEQ ID NO: 960381 - RNA, 22 nt, Human
uggagagguugaauaacuuguc

SEQ ID NO: 960382 - RNA, 22 nt, Human
uacauuguuuuuucuugccauc

SEQ ID NO: 960383 - RNA, 22 nt, Human
ccaaggaggccccaggucagcu

SEQ ID NO: 960384 - RNA, 22 nt, Human
aggcccugcaggaguggggaca

SEQ ID NO: 960385 - RNA, 22 nt, Human
cucccagggucuaggcugcugg

SEQ ID NO: 960386 - RNA, 22 nt, Human
gcagggcaugggcccugucugc

SEQ ID NO: 960387 - RNA, 22 nt, Human
gcucuguguugucagaggcacc

SEQ ID NO: 960388 - RNA, 22 nt, Human
uggcccuguggaggucagugag

SEQ ID NO: 960389 - RNA, 22 nt, Human
ugccuggauucgguuguuguca

SEQ ID NO: 960390 - RNA, 22 nt, Human
caagcuccuuacauccacaggg

SEQ ID NO: 960391 - RNA, 22 nt, Human
aagccaggaagagagccuucac

SEQ ID NO: 960392 - RNA, 22 nt, Human
uguuuaaauagaacauacugca

SEQ ID NO: 960393 - RNA, 20 nt, Human
ccagagcugauggcugcccg

SEQ ID NO: 960394 - RNA, 22 nt, Human
uguacaguaggaacuuguuauu

SEQ ID NO: 960395 - RNA, 22 nt, Human
cuggcugguuacuauuucuggu

SEQ ID NO: 960396 - RNA, 22 nt, Human
aggugcuuggcucgugcacaca

SEQ ID NO: 960397 - RNA, 22 nt, Human
ugcucccaggcucuguggucug

SEQ ID NO: 960398 - RNA, 22 nt, Human
gggagagagagcucauguugaa

SEQ ID NO: 960399 - RNA, 22 nt, Human
guauucuugguuaucaaaauac

SEQ ID NO: 960400 - RNA, 22 nt, Human
caugaaaaugucaaguucugcu

SEQ ID NO: 960401 - RNA, 22 nt, Human
acagaccaaaaaaggauauugg

SEQ ID NO: 960402 - RNA, 22 nt, Human
gaggagagaugguagauugggu

SEQ ID NO: 960403 - RNA, 22 nt, Human
agcuuuguauuugagcauacga

SEQ ID NO: 960404 - RNA, 22 nt, Human
accaggagguguuugcucaagu

SEQ ID NO: 960405 - RNA, 22 nt, Human
gacacagcacuguacaaggaau

SEQ ID NO: 960406 - RNA, 22 nt, Human
auauuaaugagcaaguaaguga

SEQ ID NO: 960407 - RNA, 22 nt, Human
uauguuaaauguuugauguuua

SEQ ID NO: 960408 - RNA, 22 nt, Human
uacuuugcagcuugauaaaaug

SEQ ID NO: 960409 - RNA, 22 nt, Human
acauauauuacuaguaaagaca

SEQ ID NO: 960410 - RNA, 22 nt, Human
ugugucaaguggaauuucaggg

SEQ ID NO: 960411 - RNA, 22 nt, Human
aaaaugugcaguuuuuaagcug

SEQ ID NO: 960412 - RNA, 22 nt, Human
ugcacccucaucagucaaaugg

SEQ ID NO: 960413 - RNA, 22 nt, Human
ccccuuccgucucuugaguguc

SEQ ID NO: 960414 - RNA, 20 nt, Human
acuuucucgguuucucaccu

SEQ ID NO: 960415 - RNA, 22 nt, Human
ugccaaggguaugggcaagaua

SEQ ID NO: 960416 - RNA, 21 nt, Human
gacaaagugaagcaggcagga

SEQ ID NO: 960417 - RNA, 22 nt, Human
cagagugaaauaggggaucaag

SEQ ID NO: 960418 - RNA, 22 nt, Human
augcuauacucaaagaaauuca

SEQ ID NO: 960419 - RNA, 22 nt, Human
gugccugugccaggggugugcu

SEQ ID NO: 960420 - RNA, 22 nt, Human
ugugaaagucaaauuaauugaa

SEQ ID NO: 960421 - RNA, 22 nt, Human
aaaacaguuauaaacagaguca

SEQ ID NO: 960422 - RNA, 22 nt, Human
uuauuagguuuacauaaagguu

SEQ ID NO: 960423 - RNA, 22 nt, Human
caugaagcauguuuugucauga

SEQ ID NO: 960424 - RNA, 22 nt, Human
ggccugugagcccuugcaugua

SEQ ID NO: 960425 - RNA, 22 nt, Human
uggaguuccuuugaaaggcucu

SEQ ID NO: 960426 - RNA, 22 nt, Human
ugggccugggcuccuguccucu

SEQ ID NO: 960427 - RNA, 20 nt, Human
cugggcucgguggcccuggc

SEQ ID NO: 960428 - RNA, 22 nt, Human
augaguaaaaccacuauuuaca

SEQ ID NO: 960429 - RNA, 22 nt, Human
acuggaagccaguugacaauca

SEQ ID NO: 960430 - RNA, 22 nt, Human
ggccugcuccgggggcugagcu

SEQ ID NO: 960431 - RNA, 22 nt, Human
gggaggucagggugccugcugg

SEQ ID NO: 960432 - RNA, 22 nt, Human
aucaguuuggaacauucaggcc

SEQ ID NO: 960433 - RNA, 22 nt, Human
ccagucccgcaugguccagaau

SEQ ID NO: 960434 - RNA, 22 nt, Human
ucuucuuccuccacagggccca

SEQ ID NO: 960435 - RNA, 22 nt, Human
cagucuuauccugaaaacaaca

SEQ ID NO: 960436 - RNA, 22 nt, Human
cucagcagagaccagggaggaa

SEQ ID NO: 960437 - RNA, 22 nt, Human
ugugcucugaagagugcauguc

SEQ ID NO: 960438 - RNA, 22 nt, Human
ccucccucuguuagagcugucu

SEQ ID NO: 960439 - RNA, 22 nt, Human
ccuccuggcccugggccuggaa

SEQ ID NO: 960440 - RNA, 23 nt, Human
ucccagggaaggugagcgaggcu

SEQ ID NO: 960441 - RNA, 22 nt, Human
gggccugugcacaguucuguua

SEQ ID NO: 960442 - RNA, 22 nt, Human
cagaaguaagauuacugugagu

SEQ ID NO: 960443 - RNA, 22 nt, Human
ugcuggaggaguuuacuguggc

SEQ ID NO: 960444 - RNA, 22 nt, Human
uccugugccuccaccugcuccg

SEQ ID NO: 960445 - RNA, 20 nt, Human
gcccaggaucucugaggcau

SEQ ID NO: 960446 - RNA, 22 nt, Human
agaaacugaauuauuucugagg

SEQ ID NO: 960447 - RNA, 21 nt, Human
cacugcagccuugaccugggc

SEQ ID NO: 960448 - RNA, 22 nt, Human
caggccucuccuuagucuggca

SEQ ID NO: 960449 - RNA, 22 nt, Human
ucucuucugaaaccugucuuua

SEQ ID NO: 960450 - RNA, 22 nt, Human
aguaacuaugcuugagaaucag

SEQ ID NO: 960451 - RNA, 22 nt, Human
aaaaugagauacaguuugaaag

SEQ ID NO: 960452 - RNA, 22 nt, Human
uaagucaugauucuguguuacu

SEQ ID NO: 960453 - RNA, 21 nt, Human
ccugggagaucagcugccuuc

SEQ ID NO: 960454 - RNA, 22 nt, Human
cagcccaaagccccaggcuaga

SEQ ID NO: 960455 - RNA, 22 nt, Human
aucuauuaugcugagaaacugu

SEQ ID NO: 960456 - RNA, 18 nt, Human
gccugggaggaggaaaug

SEQ ID NO: 960457 - RNA, 22 nt, Human
gcucccagauuucagccuugug

SEQ ID NO: 960458 - RNA, 22 nt, Human
ggcagggaaacagcugauccca

SEQ ID NO: 960459 - RNA, 22 nt, Human
ucucugucugagccuggcagac

SEQ ID NO: 960460 - RNA, 22 nt, Human
uugggguguuggauggagcaag

SEQ ID NO: 960461 - RNA, 22 nt, Human
guggcaggagagacacagccau

SEQ ID NO: 960462 - RNA, 22 nt, Human
augugcaugcacuuacaugugu

SEQ ID NO: 960463 - RNA, 22 nt, Human
cuuuggcagccucugcuauuga

SEQ ID NO: 960464 - RNA, 19 nt, Human
uucacauuggaagaaguag

SEQ ID NO: 960465 - RNA, 22 nt, Human
ccuuuuaugaacuugagcaggu

SEQ ID NO: 960466 - RNA, 22 nt, Human
auaaacacuucuagggcacaca

SEQ ID NO: 960467 - RNA, 22 nt, Human
gcugagaggcacuaucuccgga

SEQ ID NO: 960468 - RNA, 22 nt, Human
cuggcucauuuuagcaucaggu

SEQ ID NO: 960469 - RNA, 22 nt, Human
gacccaggggcagggagaaagu

SEQ ID NO: 960470 - RNA, 22 nt, Human
guuauguaugggggccuuauga

SEQ ID NO: 960471 - RNA, 22 nt, Human
uaugaacuuuugaugugacaug

SEQ ID NO: 960472 - RNA, 22 nt, Human
ucugagcuuuuauuaucaaccu

SEQ ID NO: 960473 - RNA, 22 nt, Human
agaggggagagcuaagcaauuc

SEQ ID NO: 960474 - RNA, 22 nt, Human
cccagcauggagugaggacuca

SEQ ID NO: 960475 - RNA, 22 nt, Human
acacaguaccccaaggcugggc

SEQ ID NO: 960476 - RNA, 22 nt, Human
acagaccaaguuuccagcaggu

SEQ ID NO: 960477 - RNA, 22 nt, Human
aguucuuauuuuggaacugagg

SEQ ID NO: 960478 - RNA, 22 nt, Human
gugcauuugacgaauacucacu

SEQ ID NO: 960479 - RNA, 22 nt, Human
gggcugcuuccuggggaaugcu

SEQ ID NO: 960480 - RNA, 22 nt, Human
cuuccugggcaauguucugcuu

SEQ ID NO: 960481 - RNA, 20 nt, Human
agacaggagcccccauucag

SEQ ID NO: 960482 - RNA, 22 nt, Human
cagagcuggagggaacccuggc

SEQ ID NO: 960483 - RNA, 22 nt, Human
augcccugcugcuggggcagug

SEQ ID NO: 960484 - RNA, 22 nt, Human
gccuucaggaggguuccagaca

SEQ ID NO: 960485 - RNA, 22 nt, Human
aaguuuuccuguguccaagaug

SEQ ID NO: 960486 - RNA, 22 nt, Human
uaugugcauaugcauacacaca

SEQ ID NO: 960487 - RNA, 22 nt, Human
ucaaaugcugccuuugugugcc

SEQ ID NO: 960488 - RNA, 22 nt, Human
uuuaagaugguauuuuauaaag

SEQ ID NO: 960489 - RNA, 22 nt, Human
uacaucauaauaauacuuagaa

SEQ ID NO: 960490 - RNA, 22 nt, Human
gaggagagaagcuaacggugcu

SEQ ID NO: 960491 - RNA, 22 nt, Human
uacuuccagcaaucugcauauu

SEQ ID NO: 960492 - RNA, 22 nt, Human
aagcccagcugaaagcauuuuu

SEQ ID NO: 960493 - RNA, 22 nt, Human
aauuaacaaauguagcugugau

SEQ ID NO: 960494 - RNA, 22 nt, Human
gcaugcugcaccagagccucuc

SEQ ID NO: 960495 - RNA, 22 nt, Human
cuguccuggagggcauaggacg

SEQ ID NO: 960496 - RNA, 22 nt, Human
ccaggguguagggauuccagau

SEQ ID NO: 960497 - RNA, 22 nt, Human
ucagaacagaagcuggcuauaa

SEQ ID NO: 960498 - RNA, 22 nt, Human
aggagcagaauuuaaugugcag

SEQ ID NO: 960499 - RNA, 22 nt, Human
acaggagugaaucuggcacuua

SEQ ID NO: 960500 - RNA, 22 nt, Human
aguagaaagaaggcacugggcc

SEQ ID NO: 960501 - RNA, 22 nt, Human
gagcacagccaaaguaagaagg

SEQ ID NO: 960502 - RNA, 22 nt, Human
uuacaggggacauuggggacau

SEQ ID NO: 960503 - RNA, 22 nt, Human
guguguccaggcgggagucaag

SEQ ID NO: 960504 - RNA, 22 nt, Human
ucugaagccuuuguacaggccu

SEQ ID NO: 960505 - RNA, 22 nt, Human
uccuccaggucuaggguggcuu

SEQ ID NO: 960506 - RNA, 22 nt, Human
ugucucagauacgccaucaagg

SEQ ID NO: 960507 - RNA, 22 nt, Human
cagcugccaagaaucuuuucua

SEQ ID NO: 960508 - RNA, 22 nt, Human
agaauuguaagcaauuugauua

SEQ ID NO: 960509 - RNA, 22 nt, Human
gccagagccacuuuugggugau

SEQ ID NO: 960510 - RNA, 22 nt, Human
aaggcugccucugccagaggag

SEQ ID NO: 960511 - RNA, 22 nt, Human
gggagccuugggagugccagcc

SEQ ID NO: 960512 - RNA, 22 nt, Human
ggccaggcugcccugggagcag

SEQ ID NO: 960513 - RNA, 22 nt, Human
ucuguucaguugauguaguuuu

SEQ ID NO: 960514 - RNA, 22 nt, Human
ugccagccagguucugaggcua

SEQ ID NO: 960515 - RNA, 22 nt, Human
auuuuuaugacaaaccauccuc

SEQ ID NO: 960516 - RNA, 22 nt, Human
cacauuuaauccuuuauaagua

SEQ ID NO: 960517 - RNA, 19 nt, Human
ccaggccuccugggagguc

SEQ ID NO: 960518 - RNA, 22 nt, Human
uggaaagucucuuuugacugua

SEQ ID NO: 960519 - RNA, 22 nt, Human
auucuucauguugaagcuguca

SEQ ID NO: 960520 - RNA, 22 nt, Human
uugaagcauuguggcuuguauu

SEQ ID NO: 960521 - RNA, 20 nt, Human
ucagaggcugccagcugggg

SEQ ID NO: 960522 - RNA, 22 nt, Human
aagucacagcuaaauagcuaag

SEQ ID NO: 960523 - RNA, 22 nt, Human
guguuccauguuugagguaguu

SEQ ID NO: 960524 - RNA, 22 nt, Human
ugcuuuguguuugaauagauaa

SEQ ID NO: 960525 - RNA, 22 nt, Human
aauacauauggaauuccauguu

SEQ ID NO: 960526 - RNA, 22 nt, Human
ugcuggaggggccugaccagga

SEQ ID NO: 960527 - RNA, 22 nt, Human
aaaaugcaugagaaugugcucg

SEQ ID NO: 960528 - RNA, 22 nt, Human
auaugagagaggaaagauuuua

SEQ ID NO: 960529 - RNA, 22 nt, Human
acuggcagcagcagcccuuggg

SEQ ID NO: 960530 - RNA, 22 nt, Human
cuccccagguucaggagguggg

SEQ ID NO: 960531 - RNA, 20 nt, Human
ccagucccugagcaccaggg

SEQ ID NO: 960532 - RNA, 22 nt, Human
ccuggcugaaccaaugaagugg

SEQ ID NO: 960533 - RNA, 22 nt, Human
ugcuugugagaguuuuuucaga

SEQ ID NO: 960534 - RNA, 21 nt, Human
gagcugggcgaggcuccgggg

SEQ ID NO: 960535 - RNA, 22 nt, Human
aauuucaaguggcaucuuugau

SEQ ID NO: 960536 - RNA, 22 nt, Human
auauuucucucagacauggaag

SEQ ID NO: 960537 - RNA, 20 nt, Human
cugagcgucuaagaggugag

SEQ ID NO: 960538 - RNA, 19 nt, Human
ugggccugcaucugggucu

SEQ ID NO: 960539 - RNA, 22 nt, Human
agaaaaggauugauggaucaga

SEQ ID NO: 960540 - RNA, 20 nt, Human
uauuaggaaggaggaaggaa

SEQ ID NO: 960541 - RNA, 17 nt, Human
gggcagggacuccuggg

SEQ ID NO: 960542 - RNA, 22 nt, Human
uucuuaagaaaccaucacauuc

SEQ ID NO: 960543 - RNA, 22 nt, Human
ucaaaagucugcauucuucaca

SEQ ID NO: 960544 - RNA, 22 nt, Human
aggggcugcuggguccgccccu

SEQ ID NO: 960545 - RNA, 22 nt, Human
ugaauggucacugagcaucugu

SEQ ID NO: 960546 - RNA, 22 nt, Human
agccuucauaaucuugggcuuu

SEQ ID NO: 960547 - RNA, 22 nt, Human
aggagaggcucuaacucugugu

SEQ ID NO: 960548 - RNA, 22 nt, Human
caggacagcucaacaccuccuc

SEQ ID NO: 960549 - RNA, 22 nt, Human
ggucauugaaaucagaaggguu

SEQ ID NO: 960550 - RNA, 22 nt, Human
uucacaaaacacuauuuucugg

SEQ ID NO: 960551 - RNA, 22 nt, Human
gcucugagaggugcagcaguaa

SEQ ID NO: 960552 - RNA, 22 nt, Human
uauuuaauuagugauuguagag

SEQ ID NO: 960553 - RNA, 19 nt, Human
gcaggguguugacuguccc

SEQ ID NO: 960554 - RNA, 22 nt, Human
agccuguggaucccugcacugg

SEQ ID NO: 960555 - RNA, 22 nt, Human
accccagcucugagccacacca

SEQ ID NO: 960556 - RNA, 22 nt, Human
gcucugucuucagcacacagua

SEQ ID NO: 960557 - RNA, 22 nt, Human
cagcuccugccugggcagcugu

SEQ ID NO: 960558 - RNA, 18 nt, Human
ugggcugccuggccucug

SEQ ID NO: 960559 - RNA, 22 nt, Human
ggaugcacgaaggcgccucgga

SEQ ID NO: 960560 - RNA, 22 nt, Human
ggacucagcagccaggaguggc

SEQ ID NO: 960561 - RNA, 21 nt, Human
agagagggagaugaaacaucc

SEQ ID NO: 960562 - RNA, 22 nt, Human
gaacccaggcuuuugaggcugu

SEQ ID NO: 960563 - RNA, 22 nt, Human
cagggccuccuaaggcaucuaa

SEQ ID NO: 960564 - RNA, 22 nt, Human
ugucaaauuuuuauugcaguau

SEQ ID NO: 960565 - RNA, 21 nt, Human
ggccugaguauaggacaggcc

SEQ ID NO: 960566 - RNA, 22 nt, Human
ccugcagguccccggaugcgca

SEQ ID NO: 960567 - RNA, 22 nt, Human
aggcacaggccucagcacccag

SEQ ID NO: 960568 - RNA, 22 nt, Human
cagcaauaguguguuuguuuca

SEQ ID NO: 960569 - RNA, 22 nt, Human
gagaaagauguaggcugggagg

SEQ ID NO: 960570 - RNA, 22 nt, Human
uguucauuuggcccuuuuguau

SEQ ID NO: 960571 - RNA, 22 nt, Human
uagagcuagcuucaaaaugcga

SEQ ID NO: 960572 - RNA, 22 nt, Human
ucccaaagcuacucuucugacu

SEQ ID NO: 960573 - RNA, 19 nt, Human
ccagucccauacaggagau

SEQ ID NO: 960574 - RNA, 21 nt, Human
ugguuugcggccaaaguuaaa

SEQ ID NO: 960575 - RNA, 22 nt, Human
uagggcaggggaggaaucugaa

SEQ ID NO: 960576 - RNA, 22 nt, Human
gggcugcuuuuaagggucucag

SEQ ID NO: 960577 - RNA, 22 nt, Human
cuugcugucccuugguaugaac

SEQ ID NO: 960578 - RNA, 19 nt, Human
cuggcucuuggguggagga

SEQ ID NO: 960579 - RNA, 17 nt, Human
cccagcuggcagugccg

SEQ ID NO: 960580 - RNA, 22 nt, Human
uguccucacaggaaugaacuuu

SEQ ID NO: 960581 - RNA, 22 nt, Human
uguuuuguuuaugagagcacag

SEQ ID NO: 960582 - RNA, 22 nt, Human
acccuggggguggccagugcca

SEQ ID NO: 960583 - RNA, 22 nt, Human
gccuggagugguccugcugccc

SEQ ID NO: 960584 - RNA, 21 nt, Human
aagagcuggaucaaggauaag

SEQ ID NO: 960585 - RNA, 22 nt, Human
ggagggagucagcugauuagaa

SEQ ID NO: 960586 - RNA, 23 nt, Human
ucacagggcacuggcugggguug

SEQ ID NO: 960587 - RNA, 22 nt, Human
uauuccaguccuauccucuuuu

SEQ ID NO: 960588 - RNA, 18 nt, Human
gagcugccauauuuaguu

SEQ ID NO: 960589 - RNA, 22 nt, Human
cagcucugggugacaggagggc

SEQ ID NO: 960590 - RNA, 22 nt, Human
ccuggcagcccagagcgccgcu

SEQ ID NO: 960591 - RNA, 22 nt, Human
uuaauuuuaaccuguuuguguc

SEQ ID NO: 960592 - RNA, 22 nt, Human
gggugggacugaagucugaggg

SEQ ID NO: 960593 - RNA, 22 nt, Human
aaugcugcucucauaauuauag

SEQ ID NO: 960594 - RNA, 22 nt, Human
cuggggugucucgucugccauu

SEQ ID NO: 960595 - RNA, 22 nt, Human
aauaauuuuagcucagaguugu

SEQ ID NO: 960596 - RNA, 22 nt, Human
uccagccaagccuugguagcug

SEQ ID NO: 960597 - RNA, 22 nt, Human
ucuacuguagugaugcugcagu

SEQ ID NO: 960598 - RNA, 22 nt, Human
ggaggcugcugccucacguggg

SEQ ID NO: 960599 - RNA, 22 nt, Human
caagcagacaguaggccuagaa

SEQ ID NO: 960600 - RNA, 22 nt, Human
uaucaucuuguugucaugcagc

SEQ ID NO: 960601 - RNA, 22 nt, Human
caguagcaggcacucagcacgu

SEQ ID NO: 960602 - RNA, 22 nt, Human
ucaggggcuugaggugcauguc

SEQ ID NO: 960603 - RNA, 22 nt, Human
ugcguugcgcuccugcagcagg

SEQ ID NO: 960604 - RNA, 22 nt, Human
cuagaaauacaggcacgugcca

SEQ ID NO: 960605 - RNA, 22 nt, Human
cugcugucuuuauuucacugcu

SEQ ID NO: 960606 - RNA, 22 nt, Human
agcagaacugaugagacuugag

SEQ ID NO: 960607 - RNA, 22 nt, Human
cugcuguggguuaagacacugu

SEQ ID NO: 960608 - RNA, 22 nt, Human
aaauauguaaccaaggugaagu

SEQ ID NO: 960609 - RNA, 22 nt, Human
ggcuggcuugccaagcucaggg

SEQ ID NO: 960610 - RNA, 22 nt, Human
agcaaagucaguggaaccaucc

SEQ ID NO: 960611 - RNA, 22 nt, Human
cccaggagacauauagaaggac

SEQ ID NO: 960612 - RNA, 22 nt, Human
aagcagugcgcucaucuaaggg

SEQ ID NO: 960613 - RNA, 22 nt, Human
auugaaagaguuuucugcugca

SEQ ID NO: 960614 - RNA, 22 nt, Human
ugaggcagggagaguggauaug

SEQ ID NO: 960615 - RNA, 22 nt, Human
gcaguucuacuuauccauagac

SEQ ID NO: 960616 - RNA, 22 nt, Human
uucuuagaugauuaaugauggg

SEQ ID NO: 960617 - RNA, 22 nt, Human
ugcugucccccgugucugggcu

SEQ ID NO: 960618 - RNA, 22 nt, Human
ugcagagggacagccacagcuc

SEQ ID NO: 960619 - RNA, 22 nt, Human
ugaaagguuauuuaggucugcu

SEQ ID NO: 960620 - RNA, 22 nt, Human
uauuuuguuuuguauccacugu

SEQ ID NO: 960621 - RNA, 22 nt, Human
cuuucacagcugugcuuaugau

SEQ ID NO: 960622 - RNA, 22 nt, Human
uuguuaaaaugcauauucuggu

SEQ ID NO: 960623 - RNA, 22 nt, Human
ccugcuggccaguggagggcug

SEQ ID NO: 960624 - RNA, 22 nt, Human
ccaggacucaguggggaaaggg

SEQ ID NO: 960625 - RNA, 22 nt, Human
ugcuuccuauccacacaaugcc

SEQ ID NO: 960626 - RNA, 22 nt, Human
agcagccagaaauccagaggug

SEQ ID NO: 960627 - RNA, 22 nt, Human
ggccugugcacaugugcaggaa

SEQ ID NO: 960628 - RNA, 22 nt, Human
ugacaccacaacuagccauuga

SEQ ID NO: 960629 - RNA, 19 nt, Human
cagagcagugguuccugaa

SEQ ID NO: 960630 - RNA, 22 nt, Human
cauuuagaaacuguuuuuaaca

SEQ ID NO: 960631 - RNA, 22 nt, Human
aagauacauaaagguagagucu

SEQ ID NO: 960632 - RNA, 22 nt, Human
uuuucuauucauugucuauggu

SEQ ID NO: 960633 - RNA, 22 nt, Human
uggcacugaaaaaggagagguu

SEQ ID NO: 960634 - RNA, 22 nt, Human
cuggagcuggcuuccuuccacu

SEQ ID NO: 960635 - RNA, 21 nt, Human
uaaagaagaugaaugugauca

SEQ ID NO: 960636 - RNA, 22 nt, Human
cccaggagaugcacuccauugg

SEQ ID NO: 960637 - RNA, 22 nt, Human
agcagcuucuuucacuccugga

SEQ ID NO: 960638 - RNA, 22 nt, Human
cuacuuuaauuuucugcagaga

SEQ ID NO: 960639 - RNA, 22 nt, Human
cagggcccauggcucagguagg

SEQ ID NO: 960640 - RNA, 22 nt, Human
gcagcugccuauucagggcuug

SEQ ID NO: 960641 - RNA, 22 nt, Human
cuggcucccagcuuucagggag

SEQ ID NO: 960642 - RNA, 21 nt, Human
auuguuaucauugugcugugu

SEQ ID NO: 960643 - RNA, 22 nt, Human
cccuguacagucucuguggcac

SEQ ID NO: 960644 - RNA, 22 nt, Human
cuggcugcaggaugaggcugcc

SEQ ID NO: 960645 - RNA, 22 nt, Human
agcagcugguaggaguggccac

SEQ ID NO: 960646 - RNA, 22 nt, Human
uucagagcaucucuaaagccag

SEQ ID NO: 960647 - RNA, 22 nt, Human
caguuucuacgaaggucaaccc

SEQ ID NO: 960648 - RNA, 22 nt, Human
agugcacagcgugauguauugg

SEQ ID NO: 960649 - RNA, 22 nt, Human
ccugagagagaagcgaccuggu

SEQ ID NO: 960650 - RNA, 22 nt, Human
aggggcuggaguucgagguuac

SEQ ID NO: 960651 - RNA, 22 nt, Human
gaggcugcuguuagcccugggc

SEQ ID NO: 960652 - RNA, 22 nt, Human
auaaggcagaaaugauucuagu

SEQ ID NO: 960653 - RNA, 22 nt, Human
ugaggcagggaguuuaauuguc

SEQ ID NO: 960654 - RNA, 22 nt, Human
gagcccuggcagucugggaugg

SEQ ID NO: 960655 - RNA, 22 nt, Human
uggccacauccuuuccuuguca

SEQ ID NO: 960656 - RNA, 22 nt, Human
uccugggcaaaaguaucuguga

SEQ ID NO: 960657 - RNA, 17 nt, Human
uggcagcugaaagcucu

SEQ ID NO: 960658 - RNA, 22 nt, Human
gcaaagucucaagacccaagug

SEQ ID NO: 960659 - RNA, 22 nt, Human
ugcaauaaagugcuauaaaucc

SEQ ID NO: 960660 - RNA, 22 nt, Human
uaauuuaauuccauggauucua

SEQ ID NO: 960661 - RNA, 22 nt, Human
cucagaauuuagggcucugagg

SEQ ID NO: 960662 - RNA, 22 nt, Human
ggcaacauucuccagauccuuu

SEQ ID NO: 960663 - RNA, 22 nt, Human
ccugccuguaagauggguacaa

SEQ ID NO: 960664 - RNA, 22 nt, Human
gacagguggggaaacuaaggua

SEQ ID NO: 960665 - RNA, 22 nt, Human
auuguaaguagaaauguuaugg

SEQ ID NO: 960666 - RNA, 22 nt, Human
aggcagcuuucagugucucuca

SEQ ID NO: 960667 - RNA, 22 nt, Human
ugggcuguggagcaccuuugca

SEQ ID NO: 960668 - RNA, 22 nt, Human
gcagaggacagggauuuagauu

SEQ ID NO: 960669 - RNA, 22 nt, Human
agugcuuugugcucucacugca

SEQ ID NO: 960670 - RNA, 22 nt, Human
gaaggaaaaauacucuguaagg

SEQ ID NO: 960671 - RNA, 22 nt, Human
gcacugaaauuauaugcauuug

SEQ ID NO: 960672 - RNA, 22 nt, Human
uacauuugcuuugauuuucagc

SEQ ID NO: 960673 - RNA, 22 nt, Human
gcagcccagagcgcaggacccc

SEQ ID NO: 960674 - RNA, 22 nt, Human
ggccagaaguuggaaaagagcc

SEQ ID NO: 960675 - RNA, 19 nt, Human
guuuuucccagacgaggca

SEQ ID NO: 960676 - RNA, 22 nt, Human
gcagcuuuuuggaugucaguua

SEQ ID NO: 960677 - RNA, 22 nt, Human
gccaugcuugguaugcugugag

SEQ ID NO: 960678 - RNA, 22 nt, Human
gaacagaagaggcuggugccac

SEQ ID NO: 960679 - RNA, 22 nt, Human
ggcaggugugagaucgaggcca

SEQ ID NO: 960680 - RNA, 23 nt, Human
ccacagagcugccaauuccugug

SEQ ID NO: 960681 - RNA, 20 nt, Human
uggcaucucucaauuguagg

SEQ ID NO: 960682 - RNA, 22 nt, Human
uacccagggcuuuucugaugca

SEQ ID NO: 960683 - RNA, 22 nt, Human
uugcaaauguuucauaacagua

SEQ ID NO: 960684 - RNA, 22 nt, Human
uuuaacagguaaaguaaaugug

SEQ ID NO: 960685 - RNA, 21 nt, Human
ugccagcauuaaacagucauu

SEQ ID NO: 960686 - RNA, 22 nt, Human
agucccaguucgguucuuccuc

SEQ ID NO: 960687 - RNA, 22 nt, Human
aggcaggcccucuggaaaggua

SEQ ID NO: 960688 - RNA, 23 nt, Human
agcagccagagauccucggcccu

SEQ ID NO: 960689 - RNA, 22 nt, Human
auguaucaauuaucugucugca

SEQ ID NO: 960690 - RNA, 21 nt, Human
ccuucucuugcuucagcuuca

SEQ ID NO: 960691 - RNA, 22 nt, Human
auagaauagcauagaaaauuga

SEQ ID NO: 960692 - RNA, 22 nt, Human
gcagcugcagguggucccaugc

SEQ ID NO: 960693 - RNA, 22 nt, Human
aaacccugcccuucccaagaug

SEQ ID NO: 960694 - RNA, 22 nt, Human
ugaggcagguaagcaaguuuug

SEQ ID NO: 960695 - RNA, 23 nt, Human
agggcccaagccuggacagcagg

SEQ ID NO: 960696 - RNA, 22 nt, Human
gcuuccugauauucauacuguu

SEQ ID NO: 960697 - RNA, 22 nt, Human
cauggcccucuucuggagcaau

SEQ ID NO: 960698 - RNA, 22 nt, Human
ucuguucauguugggcuuuucc

SEQ ID NO: 960699 - RNA, 22 nt, Human
auagugcaguggacugaguuaa

SEQ ID NO: 960700 - RNA, 22 nt, Human
ggagcugucuguagggcacagg

SEQ ID NO: 960701 - RNA, 22 nt, Human
agagcagauggccagggggccu

SEQ ID NO: 960702 - RNA, 22 nt, Human
agaaacuucagcuauucuuuug

SEQ ID NO: 960703 - RNA, 21 nt, Human
cuccugggcuaagauauagug

SEQ ID NO: 960704 - RNA, 21 nt, Human
cacucaggguaugugccaggc

SEQ ID NO: 960705 - RNA, 22 nt, Human
ucacauuuuaucuauuuuaagu

SEQ ID NO: 960706 - RNA, 22 nt, Human
cuuauuagugucugucugaguu

SEQ ID NO: 960707 - RNA, 22 nt, Human
cugggagccuggcaguugcuga

SEQ ID NO: 960708 - RNA, 22 nt, Human
auccuugacacacuccaguacu

SEQ ID NO: 960709 - RNA, 22 nt, Human
ggcucugggucuguggggagcg

SEQ ID NO: 960710 - RNA, 22 nt, Human
ucucagagaucuuucugcaugu

SEQ ID NO: 960711 - RNA, 22 nt, Human
ugggccaggauuucaagacccu

SEQ ID NO: 960712 - RNA, 22 nt, Human
ucuuuccucugagcuccuguag

SEQ ID NO: 960713 - RNA, 22 nt, Human
ccccaggaagccucagauuugc

SEQ ID NO: 960714 - RNA, 19 nt, Human
gugcuuuuuaagagcucag

SEQ ID NO: 960715 - RNA, 22 nt, Human
uggcagcaguggagguagaaag

SEQ ID NO: 960716 - RNA, 22 nt, Human
acacagaaccucauagccucuc

SEQ ID NO: 960717 - RNA, 22 nt, Human
uccaggcccauggagcagagcu

SEQ ID NO: 960718 - RNA, 22 nt, Human
uaauaaaugaaagugcuggcau

SEQ ID NO: 960719 - RNA, 22 nt, Human
ggccaagauggaaggagagaug

SEQ ID NO: 960720 - RNA, 17 nt, Human
uccuggcucugccacug

SEQ ID NO: 960721 - RNA, 22 nt, Human
uguuuuauuucuccaagaggga

SEQ ID NO: 960722 - RNA, 22 nt, Human
uauuucaugugcaccauaauuc

SEQ ID NO: 960723 - RNA, 22 nt, Human
ucuggcucucucaucacccaau

SEQ ID NO: 960724 - RNA, 22 nt, Human
gagcugccagacaugggaauga

SEQ ID NO: 960725 - RNA, 20 nt, Human
acuguucaagggccuggugg

SEQ ID NO: 960726 - RNA, 22 nt, Human
aggagaaguaaggcuagaugau

SEQ ID NO: 960727 - RNA, 22 nt, Human
cugugcauugucuugucuguag

SEQ ID NO: 960728 - RNA, 22 nt, Human
uuuuauauggcacauugguugg

SEQ ID NO: 960729 - RNA, 21 nt, Human
gggcagaggggccuccugggu

SEQ ID NO: 960730 - RNA, 22 nt, Human
gugcugugcgcuuuuucuguau

SEQ ID NO: 960731 - RNA, 22 nt, Human
gagcucugacugcugggugaca

SEQ ID NO: 960732 - RNA, 22 nt, Human
acguguucaauuuccaucugac

SEQ ID NO: 960733 - RNA, 22 nt, Human
augccuguaaucccagugcuuu

SEQ ID NO: 960734 - RNA, 22 nt, Human
aggcggcuccgggagugugggc

SEQ ID NO: 960735 - RNA, 22 nt, Human
cuugaauccaaaugggagauga

SEQ ID NO: 960736 - RNA, 22 nt, Human
agccuccaucccaugcacaaag

SEQ ID NO: 960737 - RNA, 22 nt, Human
accagcuguguccuggcugcag

SEQ ID NO: 960738 - RNA, 22 nt, Human
gcaagcugaugugauagugaaa

SEQ ID NO: 960739 - RNA, 22 nt, Human
ucaguuuucucaucuguaauuu

SEQ ID NO: 960740 - RNA, 22 nt, Human
aggcagagcugauguucuguga

SEQ ID NO: 960741 - RNA, 22 nt, Human
agcagccaggaaucugcagagc

SEQ ID NO: 960742 - RNA, 19 nt, Human
uccugggcugcgucuugcc

SEQ ID NO: 960743 - RNA, 22 nt, Human
uccugucugcucacagagcugg

SEQ ID NO: 960744 - RNA, 22 nt, Human
ggccucugccccagccacaccu

SEQ ID NO: 960745 - RNA, 22 nt, Human
ccagcucuggcuucuugcuggg

SEQ ID NO: 960746 - RNA, 22 nt, Human
auucaaguggcugcuauguuaa

SEQ ID NO: 960747 - RNA, 22 nt, Human
aacucugcuuauaguuugucca

SEQ ID NO: 960748 - RNA, 22 nt, Human
ugggagcacccugaggagcuuc

SEQ ID NO: 960749 - RNA, 22 nt, Human
cagcuuuguccugcaaaccuga

SEQ ID NO: 960750 - RNA, 22 nt, Human
cacucccuucaggagccuagga

SEQ ID NO: 960751 - RNA, 22 nt, Human
gagagcuggauucuggauaggu

SEQ ID NO: 960752 - RNA, 22 nt, Human
gccuccugguugcuucuccaac

SEQ ID NO: 960753 - RNA, 19 nt, Human
ucuggcuccugccaggcug

SEQ ID NO: 960754 - RNA, 22 nt, Human
acaccauacucauguugguucc

SEQ ID NO: 960755 - RNA, 22 nt, Human
aaagaugucauacacauuaaga

SEQ ID NO: 960756 - RNA, 22 nt, Human
cuggccaagcacuggggucaaa

SEQ ID NO: 960757 - RNA, 22 nt, Human
aggagcuggguuccuuuggugg

SEQ ID NO: 960758 - RNA, 22 nt, Human
ucagaggugguaaaggacagca

SEQ ID NO: 960759 - RNA, 22 nt, Human
auaaauuuauaauuguuuccug

SEQ ID NO: 960760 - RNA, 22 nt, Human
ccuccagggcagacggggagca

SEQ ID NO: 960761 - RNA, 22 nt, Human
agguauagaauugaaaggguuu

SEQ ID NO: 960762 - RNA, 22 nt, Human
gagccuccuccuggugugccga

SEQ ID NO: 960763 - RNA, 22 nt, Human
cuacauuuguucuauagcuuuu

SEQ ID NO: 960764 - RNA, 22 nt, Human
cuguccuguggaccugaggacg

SEQ ID NO: 960765 - RNA, 22 nt, Human
aaaauacacauacuaggggaaa

SEQ ID NO: 960766 - RNA, 22 nt, Human
auucuucaguauguguggauug

SEQ ID NO: 960767 - RNA, 22 nt, Human
cagcugaggucaaagaagcagg

SEQ ID NO: 960768 - RNA, 22 nt, Human
aagcagaggaccgacggaggga

SEQ ID NO: 960769 - RNA, 22 nt, Human
gcugauguaagacuuuugguuu

SEQ ID NO: 960770 - RNA, 22 nt, Human
guaacagaaagucaugcucauu

SEQ ID NO: 960771 - RNA, 20 nt, Human
ccugccugccucggcucauu

SEQ ID NO: 960772 - RNA, 22 nt, Human
cuccagggagcugcgggagcca

SEQ ID NO: 960773 - RNA, 22 nt, Human
uuauucuucuucucuugccagg

SEQ ID NO: 960774 - RNA, 22 nt, Human
gggauggcuuuguggcugacuc

SEQ ID NO: 960775 - RNA, 23 nt, Human
ucugucacuuucugcuguggagu

SEQ ID NO: 960776 - RNA, 22 nt, Human
gaaggccacaagagaaguuaag

SEQ ID NO: 960777 - RNA, 17 nt, Human
agagggaaaaugcgguu

SEQ ID NO: 960778 - RNA, 21 nt, Human
gugcucugggcagcagagggc

SEQ ID NO: 960779 - RNA, 22 nt, Human
ucagacuuuaaaggcuaacagg

SEQ ID NO: 960780 - RNA, 22 nt, Human
cagugcuccugauguacccuug

SEQ ID NO: 960781 - RNA, 22 nt, Human
uagggauguccugagacuuggc

SEQ ID NO: 960782 - RNA, 22 nt, Human
ucacucuggaguccgcuaccag

SEQ ID NO: 960783 - RNA, 22 nt, Human
cacagcugcccuacuccaugug

SEQ ID NO: 960784 - RNA, 22 nt, Human
auucagcauaaucaguagcuug

SEQ ID NO: 960785 - RNA, 22 nt, Human
cucuggccugcagauccaugcu

SEQ ID NO: 960786 - RNA, 17 nt, Human
ugaaggccaugaccacg

SEQ ID NO: 960787 - RNA, 22 nt, Human
ucacagacaauuguuuuggugu

SEQ ID NO: 960788 - RNA, 22 nt, Human
ugaaagguagcuggccucauag

SEQ ID NO: 960789 - RNA, 22 nt, Human
uaaagguaacaugaacugcuuu

SEQ ID NO: 960790 - RNA, 22 nt, Human
ugaggcaggaaguuauauaaug

SEQ ID NO: 960791 - RNA, 16 nt, Human
aaggagggaagagaau

SEQ ID NO: 960792 - RNA, 22 nt, Human
agaugcugccucuccucacaag

SEQ ID NO: 960793 - RNA, 22 nt, Human
ucugagccacagauguccuguu

SEQ ID NO: 960794 - RNA, 22 nt, Human
cucugugcucccaugcuaguaa

SEQ ID NO: 960795 - RNA, 22 nt, Human
ucagagccaaucauggugcauu

SEQ ID NO: 960796 - RNA, 22 nt, Human
auggcaggcccagguguucauu

SEQ ID NO: 960797 - RNA, 21 nt, Human
ucuuguccuugcucucccacu

SEQ ID NO: 960798 - RNA, 22 nt, Human
cuggccacaugugugcugagca

SEQ ID NO: 960799 - RNA, 22 nt, Human
ucaaaguaaaaguauagaguuu

SEQ ID NO: 960800 - RNA, 22 nt, Human
ugcuguguucuccugacucacc

SEQ ID NO: 960801 - RNA, 22 nt, Human
guuaggauauggugaaauggag

SEQ ID NO: 960802 - RNA, 21 nt, Human
auacacauacacauaaaugug

SEQ ID NO: 960803 - RNA, 23 nt, Human
gcagacagagcagacuaagacaa

SEQ ID NO: 960804 - RNA, 17 nt, Human
uagagcugguucaggag

SEQ ID NO: 960805 - RNA, 22 nt, Human
aagguacaaaguauuauuuaaa

SEQ ID NO: 960806 - RNA, 22 nt, Human
uaaaucaguuucucuuauuggu

SEQ ID NO: 960807 - RNA, 22 nt, Human
uauuucagcccuacuacuuggc

SEQ ID NO: 960808 - RNA, 22 nt, Human
uccugccucuuuucuuauucca

SEQ ID NO: 960809 - RNA, 22 nt, Human
cuaaucaucuuucucuuaaagc

SEQ ID NO: 960810 - RNA, 22 nt, Human
uacuuccuguuuccaugucugu

SEQ ID NO: 960811 - RNA, 22 nt, Human
acauuuaaauaugccuuauauu

SEQ ID NO: 960812 - RNA, 19 nt, Human
gguaaaagugagcuucagg

SEQ ID NO: 960813 - RNA, 17 nt, Human
aucuggcugcuucuaga

SEQ ID NO: 960814 - RNA, 22 nt, Human
uuggcuuccaggaucucagcag

SEQ ID NO: 960815 - RNA, 22 nt, Human
auuguacaugcagugagucauc

SEQ ID NO: 960816 - RNA, 22 nt, Human
cacauccuucagcugagcccag

SEQ ID NO: 960817 - RNA, 22 nt, Human
aggauuuguuuauaggucuuaa

SEQ ID NO: 960818 - RNA, 22 nt, Human
uuugcauugcagugguuuacag

SEQ ID NO: 960819 - RNA, 22 nt, Human
aggcaggccccugagaauagac

SEQ ID NO: 960820 - RNA, 23 nt, Human
uggcccugugcaugcugcuuccc

SEQ ID NO: 960821 - RNA, 22 nt, Human
ggcugcugcccaccccugcaug

SEQ ID NO: 960822 - RNA, 22 nt, Human
cagcugccuaugaccuagccuc

SEQ ID NO: 960823 - RNA, 22 nt, Human
cagcugaacauguagagcaucu

SEQ ID NO: 960824 - RNA, 22 nt, Human
guauuuucaagagcaguaguau

SEQ ID NO: 960825 - RNA, 22 nt, Human
ccugaagcaaggguaggcaggu

SEQ ID NO: 960826 - RNA, 18 nt, Human
uggagccauugccaccau

SEQ ID NO: 960827 - RNA, 20 nt, Human
uguacacaguacuuuacaau

SEQ ID NO: 960828 - RNA, 22 nt, Human
agucuucccugugccagagugu

SEQ ID NO: 960829 - RNA, 22 nt, Human
ucucuuccaguaagagucuuua

SEQ ID NO: 960830 - RNA, 22 nt, Human
cucugcuuggaacuggacagaa

SEQ ID NO: 960831 - RNA, 22 nt, Human
ggagcugugcagugacuacaga

SEQ ID NO: 960832 - RNA, 22 nt, Human
cagcuucugagcaagccagggg

SEQ ID NO: 960833 - RNA, 22 nt, Human
gcccucagaugggaaaggaggg

SEQ ID NO: 960834 - RNA, 22 nt, Human
aaugcaguuucauuuguagaau

SEQ ID NO: 960835 - RNA, 22 nt, Human
uugagaagaaauaguuugcaau

SEQ ID NO: 960836 - RNA, 22 nt, Human
cugggcacuugcucacagcucu

SEQ ID NO: 960837 - RNA, 22 nt, Human
cucccagagaccaagcugagaa

SEQ ID NO: 960838 - RNA, 22 nt, Human
cuggagccuagguugaccuggg

SEQ ID NO: 960839 - RNA, 22 nt, Human
cccaggagaccuagaucuguuu

SEQ ID NO: 960840 - RNA, 22 nt, Human
aagcugccuagaguugaauguc

SEQ ID NO: 960841 - RNA, 22 nt, Human
ucaaugauuagaguuuagugug

SEQ ID NO: 960842 - RNA, 22 nt, Human
ggguacaaagauuucauaagau

SEQ ID NO: 960843 - RNA, 22 nt, Human
agacuuucuugaccuaguuaau

SEQ ID NO: 960844 - RNA, 22 nt, Human
uggcaaggccacaggugcaguu

SEQ ID NO: 960845 - RNA, 22 nt, Human
uggcagcuagauaguguguuua

SEQ ID NO: 960846 - RNA, 22 nt, Human
uccaaggguucaugugcauuca

SEQ ID NO: 960847 - RNA, 22 nt, Human
agaacagcagcacgucaagcug

SEQ ID NO: 960848 - RNA, 22 nt, Human
cuacccaggcuuagagggcugg

SEQ ID NO: 960849 - RNA, 22 nt, Human
agcagcucuggcacuguagcau

SEQ ID NO: 960850 - RNA, 22 nt, Human
uuuccucugggcccugccaccc

SEQ ID NO: 960851 - RNA, 22 nt, Human
uggaggaaguggcuggccagaa

SEQ ID NO: 960852 - RNA, 22 nt, Human
uuucaaagaguuguaaauuacu

SEQ ID NO: 960853 - RNA, 22 nt, Human
ccaguugguuucaaugggacag

SEQ ID NO: 960854 - RNA, 19 nt, Human
uggagacugagagugagca

SEQ ID NO: 960855 - RNA, 22 nt, Human
guuccaguaugauuccacccau

SEQ ID NO: 960856 - RNA, 22 nt, Human
augcauaauguauguauugacu

SEQ ID NO: 960857 - RNA, 22 nt, Human
aggggcugggacagagccaagc

SEQ ID NO: 960858 - RNA, 22 nt, Human
uuauuaggaacucaggauuuuu

SEQ ID NO: 960859 - RNA, 22 nt, Human
aaguuugagagccuuuaguaua

SEQ ID NO: 960860 - RNA, 19 nt, Human
uggggccuccugucccugg

SEQ ID NO: 960861 - RNA, 22 nt, Human
gaggggcugggguugacuccaa

SEQ ID NO: 960862 - RNA, 22 nt, Human
ggccccacgggggaguccuagu

SEQ ID NO: 960863 - RNA, 22 nt, Human
accuucaaugaaaauaauaguc

SEQ ID NO: 960864 - RNA, 22 nt, Human
cuugaaaugacaggagcacauc

SEQ ID NO: 960865 - RNA, 22 nt, Human
gcuuucucuucacugauguuca

SEQ ID NO: 960866 - RNA, 22 nt, Human
gccucugcaauuacauugugcc

SEQ ID NO: 960867 - RNA, 22 nt, Human
gcugucuggguugagggcccug

SEQ ID NO: 960868 - RNA, 22 nt, Human
ugagccaggcucaagugauccu

SEQ ID NO: 960869 - RNA, 22 nt, Human
gcuccagaugaaaggccagagg

SEQ ID NO: 960870 - RNA, 19 nt, Human
caugcugaccugcuguggu

SEQ ID NO: 960871 - RNA, 22 nt, Human
guggccaaaaggaagaagguua

SEQ ID NO: 960872 - RNA, 22 nt, Human
acucucagaggguggcagcaau

SEQ ID NO: 960873 - RNA, 22 nt, Human
acauguguauagccuguauaga

SEQ ID NO: 960874 - RNA, 22 nt, Human
guguccagagaaacucacagcu

SEQ ID NO: 960875 - RNA, 22 nt, Human
uccugcaggccuguucccagua

SEQ ID NO: 960876 - RNA, 22 nt, Human
uauuccaguucaccuuuucauc

SEQ ID NO: 960877 - RNA, 22 nt, Human
gagcugccuguugcauagcaac

SEQ ID NO: 960878 - RNA, 22 nt, Human
uuuucuuaggugcuccaaguag

SEQ ID NO: 960879 - RNA, 20 nt, Human
uacauucaaaacaaacucug

SEQ ID NO: 960880 - RNA, 22 nt, Human
ggccacuccgcugcuacuggaa

SEQ ID NO: 960881 - RNA, 22 nt, Human
uuguggcucgugagauguuagg

SEQ ID NO: 960882 - RNA, 22 nt, Human
ggugcagugguguggcaaaggg

SEQ ID NO: 960883 - RNA, 22 nt, Human
cagcucccaguggcagcuccuu

SEQ ID NO: 960884 - RNA, 22 nt, Human
guuuuaguggguggccacugau

SEQ ID NO: 960885 - RNA, 22 nt, Human
ucacaggcuccagggccuggau

SEQ ID NO: 960886 - RNA, 22 nt, Human
agggcagacuaggauggaagug

SEQ ID NO: 960887 - RNA, 22 nt, Human
ccagcuggcaggagagucaggg

SEQ ID NO: 960888 - RNA, 22 nt, Human
uuuguaaauagcaguacucaug

SEQ ID NO: 960889 - RNA, 22 nt, Human
ccagaagucaggaaugagucuu

SEQ ID NO: 960890 - RNA, 22 nt, Human
auggcaagcaagcugaagagau

SEQ ID NO: 960891 - RNA, 22 nt, Human
gaucuucucuuuaguagaaaca

SEQ ID NO: 960892 - RNA, 22 nt, Human
uccaggucuggccugcuaggca

SEQ ID NO: 960893 - RNA, 22 nt, Human
gaaaccucuuagccucucuuug

SEQ ID NO: 960894 - RNA, 22 nt, Human
cuggccuggcaggggaccucua

SEQ ID NO: 960895 - RNA, 22 nt, Human
agcaggagagcagugcgugguc

SEQ ID NO: 960896 - RNA, 22 nt, Human
gccaguuccuguggagucagag

SEQ ID NO: 960897 - RNA, 22 nt, Human
augccacugacauggacaauuu

SEQ ID NO: 960898 - RNA, 18 nt, Human
aguaaagcuuauuacaug

SEQ ID NO: 960899 - RNA, 22 nt, Human
uuuaggaugcucuauucugacu

SEQ ID NO: 960900 - RNA, 22 nt, Human
acagcuggaggucugugagcac

SEQ ID NO: 960901 - RNA, 22 nt, Human
agcuggagaucaugcugauacu

SEQ ID NO: 960902 - RNA, 21 nt, Human
gauguuggaggcuggggucug

SEQ ID NO: 960903 - RNA, 22 nt, Human
cagaccagaaggaagccgacaa

SEQ ID NO: 960904 - RNA, 22 nt, Human
ucucagaguaauucuuuaaggu

SEQ ID NO: 960905 - RNA, 22 nt, Human
aaggcgacacaggcagcaggcc

SEQ ID NO: 960906 - RNA, 22 nt, Human
gccagcugcaucuccugggcug

SEQ ID NO: 960907 - RNA, 22 nt, Human
auuuccaguccuaaugaucugg

SEQ ID NO: 960908 - RNA, 22 nt, Human
agggcuggaggguacuaguuua

SEQ ID NO: 960909 - RNA, 22 nt, Human
cugccaggcagggagauggcug

SEQ ID NO: 960910 - RNA, 22 nt, Human
guggccaagaaaauagaugcau

SEQ ID NO: 960911 - RNA, 20 nt, Human
gugggcagcaggcauacugg

SEQ ID NO: 960912 - RNA, 22 nt, Human
uuauuauuggugaguuaaggaa

SEQ ID NO: 960913 - RNA, 22 nt, Human
uggaagcagugauucuugucug

SEQ ID NO: 960914 - RNA, 22 nt, Human
acauuccugaggaaauacauuc

SEQ ID NO: 960915 - RNA, 22 nt, Human
aaagacauggaacuagagaugg

SEQ ID NO: 960916 - RNA, 22 nt, Human
aauuucagaccauuugcaauua

SEQ ID NO: 960917 - RNA, 22 nt, Human
cccuccagccauggacccaggu

SEQ ID NO: 960918 - RNA, 19 nt, Human
uggggcuguguuuugaccc

SEQ ID NO: 960919 - RNA, 22 nt, Human
gauuuccuaauguggaucucug

SEQ ID NO: 960920 - RNA, 18 nt, Human
gaggccugagaaccaggu

SEQ ID NO: 960921 - RNA, 22 nt, Human
ccagaggcuggcaagggcuccu

SEQ ID NO: 960922 - RNA, 22 nt, Human
ggacacagauaaucacacagau

SEQ ID NO: 960923 - RNA, 23 nt, Human
uggagaugccccacucccugucu

SEQ ID NO: 960924 - RNA, 22 nt, Human
cacugaaggacaguaggaaggg

SEQ ID NO: 960925 - RNA, 22 nt, Human
uucaagaugcacaguggcauuc

SEQ ID NO: 960926 - RNA, 22 nt, Human
cagagagagugggguguggauu

SEQ ID NO: 960927 - RNA, 22 nt, Human
caucuuuuggccuauucugagg

SEQ ID NO: 960928 - RNA, 22 nt, Human
cuggggcugcgguggaggagcc

SEQ ID NO: 960929 - RNA, 22 nt, Human
cauuuguaguuaaaaaugucuc

SEQ ID NO: 960930 - RNA, 22 nt, Human
agucucagaaaagaagcaugga

SEQ ID NO: 960931 - RNA, 22 nt, Human
gcagaggccaucaacuuugcca

SEQ ID NO: 960932 - RNA, 22 nt, Human
uggcuccuucauucuccugcca

SEQ ID NO: 960933 - RNA, 22 nt, Human
agcaauauuuaaagguuugcaa

SEQ ID NO: 960934 - RNA, 22 nt, Human
auaagaaacauuauucuuucca

SEQ ID NO: 960935 - RNA, 22 nt, Human
gggaucagcaagccacugcacc

SEQ ID NO: 960936 - RNA, 22 nt, Human
aacaugauggggaagaacaaga

SEQ ID NO: 960937 - RNA, 22 nt, Human
gagccugaaauacaggucacug

SEQ ID NO: 960938 - RNA, 22 nt, Human
uagugcuuaauaaauuucagaa

SEQ ID NO: 960939 - RNA, 22 nt, Human
caggcagaagaaguggaaggac

SEQ ID NO: 960940 - RNA, 22 nt, Human
cagccugacaccagcuuugggc

SEQ ID NO: 960941 - RNA, 22 nt, Human
gggcuucucccuaaggacucug

SEQ ID NO: 960942 - RNA, 22 nt, Human
agaggucauaucucagaagaga

SEQ ID NO: 960943 - RNA, 22 nt, Human
uuccuggcauagagagggcaca

SEQ ID NO: 960944 - RNA, 22 nt, Human
uccuuguaacguugggcugggg

SEQ ID NO: 960945 - RNA, 22 nt, Human
gaggcgagaagcuggagauggu

SEQ ID NO: 960946 - RNA, 22 nt, Human
uaggcacugaggggagcaaggu

SEQ ID NO: 960947 - RNA, 19 nt, Human
agucucaguguacagaggc

SEQ ID NO: 960948 - RNA, 22 nt, Human
augggcuguccuaguccagccc

SEQ ID NO: 960949 - RNA, 22 nt, Human
auguguagaacuguaaugccca

SEQ ID NO: 960950 - RNA, 22 nt, Human
gcaggcagagaaggaacauuua

SEQ ID NO: 960951 - RNA, 22 nt, Human
cccagcucaagcagagagcuaa

SEQ ID NO: 960952 - RNA, 22 nt, Human
caggagcucuuaaggaugugau

SEQ ID NO: 960953 - RNA, 22 nt, Human
uguuccaauaaggaguugaaau

SEQ ID NO: 960954 - RNA, 22 nt, Human
caggagacaaguuagcagcuga

SEQ ID NO: 960955 - RNA, 21 nt, Human
uuuuauugaugaauggccacu

SEQ ID NO: 960956 - RNA, 22 nt, Human
uagaacaugugaaaauauagcc

SEQ ID NO: 960957 - RNA, 22 nt, Human
aaagcagaacugagagagcugg

SEQ ID NO: 960958 - RNA, 23 nt, Human
ugccagaggcagucacaguggug

SEQ ID NO: 960959 - RNA, 22 nt, Human
ucugggcugggagcguguggac

SEQ ID NO: 960960 - RNA, 22 nt, Human
cuccuggcucugccacuuacua

SEQ ID NO: 960961 - RNA, 22 nt, Human
aaugagcugcugcuguuccacc

SEQ ID NO: 960962 - RNA, 22 nt, Human
ucaucugucccaggcuuuuuuc

SEQ ID NO: 960963 - RNA, 22 nt, Human
agagccaggaucuguuuugggg

SEQ ID NO: 960964 - RNA, 22 nt, Human
auguuuccgugagcauccuuga

SEQ ID NO: 960965 - RNA, 22 nt, Human
guauguauguauauguuuaaga

SEQ ID NO: 960966 - RNA, 20 nt, Human
ccuggccaaugagauaggaa

SEQ ID NO: 960967 - RNA, 22 nt, Human
cagcuggcccuuugguagccuu

SEQ ID NO: 960968 - RNA, 22 nt, Human
ucuguucagguuucagagaacu

SEQ ID NO: 960969 - RNA, 17 nt, Human
gcagugaaaagagauca

SEQ ID NO: 960970 - RNA, 22 nt, Human
aggccuuuguggagcucauggc

SEQ ID NO: 960971 - RNA, 22 nt, Human
aaauugcauuuuaaagguagau

SEQ ID NO: 960972 - RNA, 19 nt, Human
agaaguuagacauugcaau

SEQ ID NO: 960973 - RNA, 22 nt, Human
ugguggccuugauggcaucugc

SEQ ID NO: 960974 - RNA, 22 nt, Human
ccagugcuaagguagccucugc

SEQ ID NO: 960975 - RNA, 20 nt, Human
aggaacuggaagggaggaaa

SEQ ID NO: 960976 - RNA, 22 nt, Human
agcugcagauucuaucuagaag

SEQ ID NO: 960977 - RNA, 22 nt, Human
cccaagggagugccuggucaac

SEQ ID NO: 960978 - RNA, 22 nt, Human
gccugcagugagugcagaaggu

SEQ ID NO: 960979 - RNA, 22 nt, Human
ugcucaguccuaccuuggcucc

SEQ ID NO: 960980 - RNA, 22 nt, Human
cugaggccuaagacaugaauga

SEQ ID NO: 960981 - RNA, 22 nt, Human
ggacagcugcuuucaggccaca

SEQ ID NO: 960982 - RNA, 22 nt, Human
caggccucaggggcucaggcug

SEQ ID NO: 960983 - RNA, 22 nt, Human
agccuggagaagauguguauug

SEQ ID NO: 960984 - RNA, 22 nt, Human
uggccacuuggcaugugugcca

SEQ ID NO: 960985 - RNA, 22 nt, Human
uaacagaaaagaacugaguuug

SEQ ID NO: 960986 - RNA, 22 nt, Human
ucucagucagccuugauguccc

SEQ ID NO: 960987 - RNA, 23 nt, Human
ugcucccaggugacgcugcuguu

SEQ ID NO: 960988 - RNA, 22 nt, Human
uguaaauaaugcauguaaauca

SEQ ID NO: 960989 - RNA, 22 nt, Human
agaacuguccuuggaggagagu

SEQ ID NO: 960990 - RNA, 22 nt, Human
uggcccuguguccugcugccag

SEQ ID NO: 960991 - RNA, 22 nt, Human
uuacaaagagugccagagugug

SEQ ID NO: 960992 - RNA, 22 nt, Human
ugggcaggauaauaucucaugu

SEQ ID NO: 960993 - RNA, 22 nt, Human
aagcugcccucauucccagugc

SEQ ID NO: 960994 - RNA, 22 nt, Human
uggccuggcugcccugucugga

SEQ ID NO: 960995 - RNA, 22 nt, Human
agcagccuuugaucaucuggga

SEQ ID NO: 960996 - RNA, 22 nt, Human
agucaguguagaaagcccaggc

SEQ ID NO: 960997 - RNA, 22 nt, Human
uauucugugugauauguaaaug

SEQ ID NO: 960998 - RNA, 22 nt, Human
ucauuauccuaguaucuugaau

SEQ ID NO: 960999 - RNA, 22 nt, Human
gucauauacacugcauguaauc

SEQ ID NO: 961000 - RNA, 22 nt, Human
uacauuuggaugugcuuaagug

SEQ ID NO: 961001 - RNA, 23 nt, Human
gcugucugucaucucugcgggag

SEQ ID NO: 961002 - RNA, 22 nt, Human
agcaccauugcaaauauggcag

SEQ ID NO: 961003 - RNA, 22 nt, Human
aucugccucuucuucauugcga

SEQ ID NO: 961004 - RNA, 22 nt, Human
uuggccaaauaaucuugcagau

SEQ ID NO: 961005 - RNA, 22 nt, Human
uuucagauggagguuuaggaca

SEQ ID NO: 961006 - RNA, 22 nt, Human
uuggcacugugccuggcacauu

SEQ ID NO: 961007 - RNA, 22 nt, Human
agugugugcaugcauucgugca

SEQ ID NO: 961008 - RNA, 23 nt, Human
gucagggcuggggucagagugac

SEQ ID NO: 961009 - RNA, 22 nt, Human
uucaggauccccuugaugggcu

SEQ ID NO: 961010 - RNA, 22 nt, Human
uaauucagggccagaaucccca

SEQ ID NO: 961011 - RNA, 22 nt, Human
gucccugggaugcccuucuggg

SEQ ID NO: 961012 - RNA, 22 nt, Human
ggaggacacuggcucugccuuc

SEQ ID NO: 961013 - RNA, 22 nt, Human
ggggcugggauuugaacccagg

SEQ ID NO: 961014 - RNA, 22 nt, Human
gaaauaguacagcauaguucuu

SEQ ID NO: 961015 - RNA, 22 nt, Human
cagcaaaagccagcauaagcuc

SEQ ID NO: 961016 - RNA, 20 nt, Human
guauuagguguuccucuuuc

SEQ ID NO: 961017 - RNA, 22 nt, Human
cugaggcuuugugugcaugccu

SEQ ID NO: 961018 - RNA, 21 nt, Human
gcaggguccuuuccauuccua

SEQ ID NO: 961019 - RNA, 22 nt, Human
ugcaccauuaauuuaugugaga

SEQ ID NO: 961020 - RNA, 22 nt, Human
ccuguucacgguguguuguuag

SEQ ID NO: 961021 - RNA, 22 nt, Human
ugcugccagggcucugcccaca

SEQ ID NO: 961022 - RNA, 22 nt, Human
agggcagcauugccuuucucca

SEQ ID NO: 961023 - RNA, 22 nt, Human
cucuucagauaaaagggauauu

SEQ ID NO: 961024 - RNA, 20 nt, Human
guauauaaccauagugacua

SEQ ID NO: 961025 - RNA, 22 nt, Human
augccagucaaagaagaugaca

SEQ ID NO: 961026 - RNA, 17 nt, Human
aaauaugaccucaaagu

SEQ ID NO: 961027 - RNA, 22 nt, Human
acuuucuccagaaaaccaagga

SEQ ID NO: 961028 - RNA, 22 nt, Human
aauaucagcacuuuugugguau

SEQ ID NO: 961029 - RNA, 22 nt, Human
uuugaauagcauaggauuacau

SEQ ID NO: 961030 - RNA, 22 nt, Human
ugaggcacaggcagugcccccg

SEQ ID NO: 961031 - RNA, 22 nt, Human
cacugcuucuggaggaauuugg

SEQ ID NO: 961032 - RNA, 22 nt, Human
ugcucacugaacucuugcuguc

SEQ ID NO: 961033 - RNA, 22 nt, Human
auguaacuguuauauuuuguug

SEQ ID NO: 961034 - RNA, 22 nt, Human
uauuggucuuggaagguuuugu

SEQ ID NO: 961035 - RNA, 22 nt, Human
aguaugaagaugaugaaaaaua

SEQ ID NO: 961036 - RNA, 22 nt, Human
acaguguuuuaugagaauuguu

SEQ ID NO: 961037 - RNA, 22 nt, Human
acugaaggaagcgggcaggggu

SEQ ID NO: 961038 - RNA, 22 nt, Human
gcucugggcugcccucuggaca

SEQ ID NO: 961039 - RNA, 22 nt, Human
gcaggugggggucggugcaucu

SEQ ID NO: 961040 - RNA, 22 nt, Human
gaaaagcuaggccaguucagcu

SEQ ID NO: 961041 - RNA, 22 nt, Human
auuucagaugaccaaauggaaa

SEQ ID NO: 961042 - RNA, 22 nt, Human
ucaguuuuuaagaguuaugcga

SEQ ID NO: 961043 - RNA, 22 nt, Human
ucaggagaaaauaucaggaagu

SEQ ID NO: 961044 - RNA, 22 nt, Human
accaggagcauuuuuuauuagu

SEQ ID NO: 961045 - RNA, 22 nt, Human
uggaggaugagugugggcucug

SEQ ID NO: 961046 - RNA, 22 nt, Human
ucugcuguccuuuauauagauu

SEQ ID NO: 961047 - RNA, 22 nt, Human
ugccuggguucccaccccaaag

SEQ ID NO: 961048 - RNA, 18 nt, Human
gaugggagcaagagaaga

SEQ ID NO: 961049 - RNA, 22 nt, Human
ugagcuucuuuauuuggccaga

SEQ ID NO: 961050 - RNA, 19 nt, Human
guucaaacacugauucagc

SEQ ID NO: 961051 - RNA, 22 nt, Human
uaucuguugucuuuuacaugua

SEQ ID NO: 961052 - RNA, 22 nt, Human
ucauuguuucugcuuuucauga

SEQ ID NO: 961053 - RNA, 22 nt, Human
uggcaggggaggugcuugcuua

SEQ ID NO: 961054 - RNA, 22 nt, Human
agucccagcccaguccuguaag

SEQ ID NO: 961055 - RNA, 22 nt, Human
cuacccagcaccuaggcugccu

SEQ ID NO: 961056 - RNA, 22 nt, Human
ccagcugcaggggagcagugga

SEQ ID NO: 961057 - RNA, 22 nt, Human
agucucuuauucccuauugcug

SEQ ID NO: 961058 - RNA, 22 nt, Human
acuugaauuauauuucuagaga

SEQ ID NO: 961059 - RNA, 22 nt, Human
uuaaaacagcgugaaucuggca

SEQ ID NO: 961060 - RNA, 20 nt, Human
gcugccuguuucuguaagua

SEQ ID NO: 961061 - RNA, 22 nt, Human
ggcugagcacuuuaggcaggag

SEQ ID NO: 961062 - RNA, 22 nt, Human
gagccagguuugaaucucaguc

SEQ ID NO: 961063 - RNA, 22 nt, Human
ggcugaguugagaggauuacuu

SEQ ID NO: 961064 - RNA, 22 nt, Human
gaaggccuagggaugcucugcg

SEQ ID NO: 961065 - RNA, 22 nt, Human
cagacagaaggcuccuugaggu

SEQ ID NO: 961066 - RNA, 22 nt, Human
gcauguguuauuuuauguauga

SEQ ID NO: 961067 - RNA, 22 nt, Human
uggagcugauacagcuggcuuu

SEQ ID NO: 961068 - RNA, 22 nt, Human
uagcugccaaaagggugggcua

SEQ ID NO: 961069 - RNA, 22 nt, Human
gaaaaugugccuuuggguauug

SEQ ID NO: 961070 - RNA, 22 nt, Human
auucugauaucuuauucuagcu

SEQ ID NO: 961071 - RNA, 22 nt, Human
cugggcacaaguggcccuggau

SEQ ID NO: 961072 - RNA, 22 nt, Human
uggcccugcuuaugucucucuu

SEQ ID NO: 961073 - RNA, 22 nt, Human
augcaguacagauaauucuaca

SEQ ID NO: 961074 - RNA, 22 nt, Human
gucaggaugacaagugcuuuca

SEQ ID NO: 961075 - RNA, 22 nt, Human
cugccagccaggccagguaggc

SEQ ID NO: 961076 - RNA, 21 nt, Human
ccuccaggagcagagcccuga

SEQ ID NO: 961077 - RNA, 22 nt, Human
gacagaguuguugauguaugcu

SEQ ID NO: 961078 - RNA, 22 nt, Human
uacagcuaggcaaaaaugacau

SEQ ID NO: 961079 - RNA, 22 nt, Human
ugugaacuggcagguggacggg

SEQ ID NO: 961080 - RNA, 22 nt, Human
uaauuucaccguugcuagaaau

SEQ ID NO: 961081 - RNA, 22 nt, Human
ccucaugguacuuacuguagcu

SEQ ID NO: 961082 - RNA, 22 nt, Human
agggcagaaguacagacacuua

SEQ ID NO: 961083 - RNA, 22 nt, Human
cuuguccuuuacuugagacuca

SEQ ID NO: 961084 - RNA, 22 nt, Human
agggccaggaacaccugaaggg

SEQ ID NO: 961085 - RNA, 22 nt, Human
caggcagcuagauuuauaacaa

SEQ ID NO: 961086 - RNA, 22 nt, Human
ccagagcaauucucacagaacu

SEQ ID NO: 961087 - RNA, 22 nt, Human
auucccaucgucaacuucacug

SEQ ID NO: 961088 - RNA, 22 nt, Human
caaggagaaaacggcuucugaa

SEQ ID NO: 961089 - RNA, 22 nt, Human
aagauggaguaguguaaugguu

SEQ ID NO: 961090 - RNA, 22 nt, Human
ccagggugagugucauggguua

SEQ ID NO: 961091 - RNA, 20 nt, Human
acuugcugggcuuuguuacc

SEQ ID NO: 961092 - RNA, 22 nt, Human
gcugcugguccucagagcucau

SEQ ID NO: 961093 - RNA, 22 nt, Human
acagccuggacuggcucucugc

SEQ ID NO: 961094 - RNA, 22 nt, Human
uggugaagucagcggagcccgg

SEQ ID NO: 961095 - RNA, 22 nt, Human
guggccagcaagugcugccucu

SEQ ID NO: 961096 - RNA, 20 nt, Human
augcaaacccugcuuugugg

SEQ ID NO: 961097 - RNA, 22 nt, Human
ggggauggaggcgugugguccu

SEQ ID NO: 961098 - RNA, 22 nt, Human
cauuuucagcacccaucugaaa

SEQ ID NO: 961099 - RNA, 22 nt, Human
agacagagauacuauguuguca

SEQ ID NO: 961100 - RNA, 22 nt, Human
cuuucacacacauacauuugga

SEQ ID NO: 961101 - RNA, 22 nt, Human
gccaagagaaugugagagaaau

SEQ ID NO: 961102 - RNA, 22 nt, Human
uauccagggaguuuuagggcuu

SEQ ID NO: 961103 - RNA, 22 nt, Human
agcaggcuaagggaccuguuua

SEQ ID NO: 961104 - RNA, 22 nt, Human
aggcagugccuggaccccagcu

SEQ ID NO: 961105 - RNA, 22 nt, Human
cuugccuucuuuuccuauagaa

SEQ ID NO: 961106 - RNA, 22 nt, Human
ggcuucuccccuuugagucuuc

SEQ ID NO: 961107 - RNA, 22 nt, Human
uccaggagugauaaggccacug

SEQ ID NO: 961108 - RNA, 22 nt, Human
cacagggccuugugugacugca

SEQ ID NO: 961109 - RNA, 22 nt, Human
auggcugggaugggguagagaa

SEQ ID NO: 961110 - RNA, 22 nt, Human
uugcaggauuuuagagaugaca

SEQ ID NO: 961111 - RNA, 22 nt, Human
ucucacugggucacagcagagg

SEQ ID NO: 961112 - RNA, 19 nt, Human
uugcauuguaguuggacug

SEQ ID NO: 961113 - RNA, 22 nt, Human
agggccagcugaugagaaugag

SEQ ID NO: 961114 - RNA, 20 nt, Human
caccacagaauuggggacag

SEQ ID NO: 961115 - RNA, 22 nt, Human
agugguaacuaaguccugcuua

SEQ ID NO: 961116 - RNA, 22 nt, Human
agacaguguguguauauauggu

SEQ ID NO: 961117 - RNA, 22 nt, Human
uccucaggcggugaggaggggc

SEQ ID NO: 961118 - RNA, 22 nt, Human
agagcagccugugaugaugcac

SEQ ID NO: 961119 - RNA, 22 nt, Human
ccagcagaagcucccgcugggu

SEQ ID NO: 961120 - RNA, 22 nt, Human
uggcuggggccacaguuuuccu

SEQ ID NO: 961121 - RNA, 19 nt, Human
gggcuucugggaucaagag

SEQ ID NO: 961122 - RNA, 19 nt, Human
ugaaggagggggauggcca

SEQ ID NO: 961123 - RNA, 22 nt, Human
acccagaggcggagguugcagu

SEQ ID NO: 961124 - RNA, 22 nt, Human
uuccauaauuaaguggagagaa

SEQ ID NO: 961125 - RNA, 22 nt, Human
uuacaaagaguguucuuuucca

SEQ ID NO: 961126 - RNA, 22 nt, Human
guccucuguguaggcugcagac

SEQ ID NO: 961127 - RNA, 22 nt, Human
uagucuuuuuaauaaauaaugc

SEQ ID NO: 961128 - RNA, 22 nt, Human
gcaccuuucuauauucaguggc

SEQ ID NO: 961129 - RNA, 23 nt, Human
agggugagcaagcuauggagacc

SEQ ID NO: 961130 - RNA, 22 nt, Human
uucaggaugacaccauguccag

SEQ ID NO: 961131 - RNA, 22 nt, Human
auuuagaaauuccaaaaguauu

SEQ ID NO: 961132 - RNA, 22 nt, Human
ugguaaagaaggcuagaucuga

SEQ ID NO: 961133 - RNA, 19 nt, Human
ugccugucaguagaucuca

SEQ ID NO: 961134 - RNA, 22 nt, Human
uugacagcaaagauugugccua

SEQ ID NO: 961135 - RNA, 22 nt, Human
ccucagagguuuucauucugua

SEQ ID NO: 961136 - RNA, 22 nt, Human
agcagggcagugaucagaaagg

SEQ ID NO: 961137 - RNA, 18 nt, Human
uuaauguggcuuacuaug

SEQ ID NO: 961138 - RNA, 16 nt, Human
gcccaggacgggaggc

SEQ ID NO: 961139 - RNA, 22 nt, Human
cauuuguuuagaagucuuuaua

SEQ ID NO: 961140 - RNA, 22 nt, Human
uuuucacacaaggugauaaguu

SEQ ID NO: 961141 - RNA, 20 nt, Human
ugcagcuucaccugugucau

SEQ ID NO: 961142 - RNA, 22 nt, Human
aaauaugaaugauaagaguuau

SEQ ID NO: 961143 - RNA, 22 nt, Human
agccacagcauguguguaugua

SEQ ID NO: 961144 - RNA, 23 nt, Human
aacuccugaaucgugagccaucu

SEQ ID NO: 961145 - RNA, 22 nt, Human
cacagcuuguuuagugacucac

SEQ ID NO: 961146 - RNA, 22 nt, Human
gugacaguggucacuuguaguu

SEQ ID NO: 961147 - RNA, 22 nt, Human
guggccuggcgagcuggcgcgg

SEQ ID NO: 961148 - RNA, 22 nt, Human
uguuauugagguuacuuauaag

SEQ ID NO: 961149 - RNA, 22 nt, Human
cuuuugauaguugcugagcagg

SEQ ID NO: 961150 - RNA, 22 nt, Human
cagccagcuucagauccaagcc

SEQ ID NO: 961151 - RNA, 22 nt, Human
aucauguuccagaaacagugau

SEQ ID NO: 961152 - RNA, 22 nt, Human
ccucaggaaccacauugcugcu

SEQ ID NO: 961153 - RNA, 22 nt, Human
caguacuuaguucucaugguuu

SEQ ID NO: 961154 - RNA, 22 nt, Human
ccuuggagcggucagcacuggu

SEQ ID NO: 961155 - RNA, 19 nt, Human
gucaucuuuuaauaaugug

SEQ ID NO: 961156 - RNA, 22 nt, Human
agauggcaggcccugugggggu

SEQ ID NO: 961157 - RNA, 22 nt, Human
acuuucuauuguuuagauucug

SEQ ID NO: 961158 - RNA, 22 nt, Human
ucagcuccagaguugcacagug

SEQ ID NO: 961159 - RNA, 22 nt, Human
ugcugucccuaagucucuucaa

SEQ ID NO: 961160 - RNA, 22 nt, Human
agagcugugcuuugcaccacgu

SEQ ID NO: 961161 - RNA, 22 nt, Human
ucagagaacacagaggugaugu

SEQ ID NO: 961162 - RNA, 22 nt, Human
ggcacugagaggcucuuccuaa

SEQ ID NO: 961163 - RNA, 22 nt, Human
aggccagcucacccuggcuccu

SEQ ID NO: 961164 - RNA, 22 nt, Human
aggacagcagugcuggcacuug

SEQ ID NO: 961165 - RNA, 21 nt, Human
agacagaacaacugcucucca

SEQ ID NO: 961166 - RNA, 22 nt, Human
ugccuggcugggcugcucaugg

SEQ ID NO: 961167 - RNA, 22 nt, Human
agauaacuuuuggguauucaug

SEQ ID NO: 961168 - RNA, 22 nt, Human
uagaaacugauagucuugugcu

SEQ ID NO: 961169 - RNA, 22 nt, Human
acuguugucaggcugcuuugga

SEQ ID NO: 961170 - RNA, 22 nt, Human
ugccagugggugugcagagacu

SEQ ID NO: 961171 - RNA, 22 nt, Human
gugcuuuccauccucccugcug

SEQ ID NO: 961172 - RNA, 22 nt, Human
cugggaguugacgaggcuugua

SEQ ID NO: 961173 - RNA, 22 nt, Human
gcucugcuguggaauccucucc

SEQ ID NO: 961174 - RNA, 22 nt, Human
agaacagaggccuuauguuuca

SEQ ID NO: 961175 - RNA, 22 nt, Human
caagccugucucaccagugcua

SEQ ID NO: 961176 - RNA, 22 nt, Human
gcuggcucagggacuagaguuu

SEQ ID NO: 961177 - RNA, 22 nt, Human
uuaaaucaguaggcuacuccuu

SEQ ID NO: 961178 - RNA, 22 nt, Human
ucuuuggauaucgcuagaccgu

SEQ ID NO: 961179 - RNA, 22 nt, Human
ccaggagagcauugcacagagg

SEQ ID NO: 961180 - RNA, 22 nt, Human
ugcuggccaauggcagaggcgg

SEQ ID NO: 961181 - RNA, 22 nt, Human
gguguccuacagggccgcaggc

SEQ ID NO: 961182 - RNA, 22 nt, Human
cagaggccucacuuccagccag

SEQ ID NO: 961183 - RNA, 22 nt, Human
gaauuacaaagugagacaagcu

SEQ ID NO: 961184 - RNA, 22 nt, Human
cuacccagauccaggauggcua

SEQ ID NO: 961185 - RNA, 22 nt, Human
aagguacaccaaaguucaaguu

SEQ ID NO: 961186 - RNA, 22 nt, Human
ucaggagacauucuuaaaguag

SEQ ID NO: 961187 - RNA, 19 nt, Human
cugguccugacugaggggu

SEQ ID NO: 961188 - RNA, 22 nt, Human
auucaagagcccauguuuccug

SEQ ID NO: 961189 - RNA, 22 nt, Human
aggcagagcuggguuuugaaau

SEQ ID NO: 961190 - RNA, 22 nt, Human
uaguuacagcaggcaggauaua

SEQ ID NO: 961191 - RNA, 22 nt, Human
uaugaagacaaugauagcauga

SEQ ID NO: 961192 - RNA, 22 nt, Human
cugguggggaguccuggucucc

SEQ ID NO: 961193 - RNA, 18 nt, Human
augugucuuucuuguuug

SEQ ID NO: 961194 - RNA, 22 nt, Human
uuucucaucuggaaacagugcu

SEQ ID NO: 961195 - RNA, 22 nt, Human
gaauuguagagggaacagaagc

SEQ ID NO: 961196 - RNA, 22 nt, Human
ggucucagcccucgccagcagc

SEQ ID NO: 961197 - RNA, 22 nt, Human
gcuggcucccauugguccuucc

SEQ ID NO: 961198 - RNA, 22 nt, Human
aaaagagucuuaggcagucaua

SEQ ID NO: 961199 - RNA, 22 nt, Human
uaaaugugagugaugcggugaa

SEQ ID NO: 961200 - RNA, 22 nt, Human
ccaggacuuuaaguccagcacu

SEQ ID NO: 961201 - RNA, 22 nt, Human
uuccuugguagagagaauauuu

SEQ ID NO: 961202 - RNA, 22 nt, Human
gagcugccugaacaagcagcag

SEQ ID NO: 961203 - RNA, 22 nt, Human
ucaugcuuaaaagacacuugag

SEQ ID NO: 961204 - RNA, 19 nt, Human
ggcucucuuaaagcuguuu

SEQ ID NO: 961205 - RNA, 22 nt, Human
aaugcacaaaaauuguauguaa

SEQ ID NO: 961206 - RNA, 22 nt, Human
ggccuuggugccauggccaguu

SEQ ID NO: 961207 - RNA, 22 nt, Human
cccagggauuauaaaggugaaa

SEQ ID NO: 961208 - RNA, 22 nt, Human
gaccagagaaaggcacuggaag

SEQ ID NO: 961209 - RNA, 22 nt, Human
cucccaggacucagaggagaag

SEQ ID NO: 961210 - RNA, 22 nt, Human
ggaggcccagagaggugaagug

SEQ ID NO: 961211 - RNA, 22 nt, Human
caggauggucucgaucuccuga

SEQ ID NO: 961212 - RNA, 22 nt, Human
aguaaaauuucugcugaggaga

SEQ ID NO: 961213 - RNA, 22 nt, Human
caauagcagcuucugaaugcaa

SEQ ID NO: 961214 - RNA, 22 nt, Human
cugccucuauucacugaggcag

SEQ ID NO: 961215 - RNA, 22 nt, Human
uacauggguagguuaagucaua

SEQ ID NO: 961216 - RNA, 22 nt, Human
uuccauaaaggugauaguauac

SEQ ID NO: 961217 - RNA, 22 nt, Human
aggagggagcuuaagccaggca

SEQ ID NO: 961218 - RNA, 22 nt, Human
uggcagaggcucugugauguug

SEQ ID NO: 961219 - RNA, 22 nt, Human
augcacagacccaaaggccauc

SEQ ID NO: 961220 - RNA, 22 nt, Human
ccaagggcugcugaggugucca

SEQ ID NO: 961221 - RNA, 22 nt, Human
gcugucuccauagcuguguguc

SEQ ID NO: 961222 - RNA, 22 nt, Human
agaaauacuaggaauauucaua

SEQ ID NO: 961223 - RNA, 22 nt, Human
cacugccugugagcugugugcc

SEQ ID NO: 961224 - RNA, 22 nt, Human
cugacagucucauugauuugcu

SEQ ID NO: 961225 - RNA, 17 nt, Human
ucuguucaugcauaccu

SEQ ID NO: 961226 - RNA, 22 nt, Human
aggcuccuaucgcuuucagcaa

SEQ ID NO: 961227 - RNA, 22 nt, Human
acauccauguuguaauguuccu

SEQ ID NO: 961228 - RNA, 22 nt, Human
cacaugaguccugccagguaug

SEQ ID NO: 961229 - RNA, 22 nt, Human
guuugucuuaauuaggcaucga

SEQ ID NO: 961230 - RNA, 22 nt, Human
auacauauaugguacuuccugg

SEQ ID NO: 961231 - RNA, 20 nt, Human
cagcugccuggcucugggau

SEQ ID NO: 961232 - RNA, 22 nt, Human
gugugucuuucauuucaugagg

SEQ ID NO: 961233 - RNA, 22 nt, Human
aaacugccuccugggcaacuaa

SEQ ID NO: 961234 - RNA, 22 nt, Human
ucuuugaaagcuguucuagagu

SEQ ID NO: 961235 - RNA, 22 nt, Human
agagcuggccagggaucacucu

SEQ ID NO: 961236 - RNA, 22 nt, Human
aguuuagaguucaaauuaguuc

SEQ ID NO: 961237 - RNA, 22 nt, Human
uauuucugaauccaaaagguca

SEQ ID NO: 961238 - RNA, 22 nt, Human
uggcucagcauucacuggucuu

SEQ ID NO: 961239 - RNA, 22 nt, Human
uaucuguuaggaucagagcugg

SEQ ID NO: 961240 - RNA, 22 nt, Human
aggcugcuuucauggccgcccc

SEQ ID NO: 961241 - RNA, 22 nt, Human
aggccagguggucaugcuugcu

SEQ ID NO: 961242 - RNA, 22 nt, Human
cuccuggcucgcccccagcuga

SEQ ID NO: 961243 - RNA, 22 nt, Human
ccuggaaggugaugguacagca

SEQ ID NO: 961244 - RNA, 23 nt, Human
auugaugacuugauuacacuuuu

SEQ ID NO: 961245 - RNA, 20 nt, Human
cugagagucugugcuuaguc

SEQ ID NO: 961246 - RNA, 22 nt, Human
gggauggacuuggggacuccag

SEQ ID NO: 961247 - RNA, 22 nt, Human
accagccugucugagucguggg

SEQ ID NO: 961248 - RNA, 22 nt, Human
cugccugugcaugcagucagaa

SEQ ID NO: 961249 - RNA, 22 nt, Human
acauauuuccaugcagcauguc

SEQ ID NO: 961250 - RNA, 22 nt, Human
ccaggccuuccaguacgcagaa

SEQ ID NO: 961251 - RNA, 22 nt, Human
uugcuuccucgaggccagcgug

SEQ ID NO: 961252 - RNA, 22 nt, Human
cccuggagggcagacagaugcc

SEQ ID NO: 961253 - RNA, 22 nt, Human
ucucagagaugucaagagucua

SEQ ID NO: 961254 - RNA, 22 nt, Human
cuuuccaaugcauuuccaaugu

SEQ ID NO: 961255 - RNA, 22 nt, Human
cccagcucuuuuagcggcaucu

SEQ ID NO: 961256 - RNA, 22 nt, Human
uucucuggaacugaaacaagau

SEQ ID NO: 961257 - RNA, 22 nt, Human
cugagccacugcuuguucagug

SEQ ID NO: 961258 - RNA, 22 nt, Human
ucugaaaguaucuggaucuuuu

SEQ ID NO: 961259 - RNA, 22 nt, Human
guccacauaggaacccagcuuc

SEQ ID NO: 961260 - RNA, 22 nt, Human
aggccuguuccaggccccuuuu

SEQ ID NO: 961261 - RNA, 22 nt, Human
ggcucaggacugcagcguagag

SEQ ID NO: 961262 - RNA, 22 nt, Human
aagcaccugcaguugacaaaaa

SEQ ID NO: 961263 - RNA, 22 nt, Human
cugggccagaccuuguggucuu

SEQ ID NO: 961264 - RNA, 22 nt, Human
auagaacagaaacagaugcaca

SEQ ID NO: 961265 - RNA, 22 nt, Human
ucagaguguggugagaugugca

SEQ ID NO: 961266 - RNA, 22 nt, Human
ugugaaaggagccauagacagu

SEQ ID NO: 961267 - RNA, 22 nt, Human
uuccaguuaaggaagcuauucu

SEQ ID NO: 961268 - RNA, 22 nt, Human
uugcucugacuggagugcagug

SEQ ID NO: 961269 - RNA, 22 nt, Human
uacugcaugguggaguggagcu

SEQ ID NO: 961270 - RNA, 22 nt, Human
uuucaguguaucuuccaaaagc

SEQ ID NO: 961271 - RNA, 22 nt, Human
agguggggaaaccagcgauccc

SEQ ID NO: 961272 - RNA, 22 nt, Human
ccugggagugcacagguuucgu

SEQ ID NO: 961273 - RNA, 18 nt, Human
ggagccagucugucucug

SEQ ID NO: 961274 - RNA, 22 nt, Human
ugcaccauguaaguggccacgu

SEQ ID NO: 961275 - RNA, 23 nt, Human
gacagagugagaccuugucuuac

SEQ ID NO: 961276 - RNA, 22 nt, Human
ugacauaaguugguagaaagga

SEQ ID NO: 961277 - RNA, 22 nt, Human
ugugccugaguuggcugaguac

SEQ ID NO: 961278 - RNA, 22 nt, Human
ugaggcagauauuuauuggguu

SEQ ID NO: 961279 - RNA, 22 nt, Human
ggccaggagcaagccaggcucu

SEQ ID NO: 961280 - RNA, 22 nt, Human
uuggccaaaggaaagacuacug

SEQ ID NO: 961281 - RNA, 22 nt, Human
caccagcagaagacugagggug

SEQ ID NO: 961282 - RNA, 18 nt, Human
acauuucuccuucugacc

SEQ ID NO: 961283 - RNA, 22 nt, Human
ugcauaaagugccauaguauua

SEQ ID NO: 961284 - RNA, 22 nt, Human
ggccagggggcuucagacucca

SEQ ID NO: 961285 - RNA, 22 nt, Human
uuugaauagaggccccucagaa

SEQ ID NO: 961286 - RNA, 22 nt, Human
ggcagcucugcuccacaugagu

SEQ ID NO: 961287 - RNA, 22 nt, Human
agcuccugcucuuugucccuaa

SEQ ID NO: 961288 - RNA, 22 nt, Human
cccugcagccuugcaugccuuc

SEQ ID NO: 961289 - RNA, 18 nt, Human
ggaaaaggagugucuagc

SEQ ID NO: 961290 - RNA, 22 nt, Human
gaacagcccuguuaagucuguu

SEQ ID NO: 961291 - RNA, 22 nt, Human
augacagaggagugcaggugau

SEQ ID NO: 961292 - RNA, 22 nt, Human
ucuggccacccgaggccccugc

SEQ ID NO: 961293 - RNA, 22 nt, Human
auucuagaugcuguaaguagca

SEQ ID NO: 961294 - RNA, 22 nt, Human
cugggaggauacacaagaucag

SEQ ID NO: 961295 - RNA, 22 nt, Human
aagaacauuuuguagaaugaca

SEQ ID NO: 961296 - RNA, 22 nt, Human
cagaaggcuggcagauugagau

SEQ ID NO: 961297 - RNA, 22 nt, Human
aaaucaguucacguucugaggu

SEQ ID NO: 961298 - RNA, 22 nt, Human
aaggcaguaaaaucuaccuugc

SEQ ID NO: 961299 - RNA, 22 nt, Human
uguguuaaguauuugauacacu

SEQ ID NO: 961300 - RNA, 19 nt, Human
ggcccaaguacugagugcc

SEQ ID NO: 961301 - RNA, 22 nt, Human
cccuggcaaaacacucucuuga

SEQ ID NO: 961302 - RNA, 22 nt, Human
gugauacaaauaaacauaugcu

SEQ ID NO: 961303 - RNA, 22 nt, Human
uucugggagagaaagggccuug

SEQ ID NO: 961304 - RNA, 22 nt, Human
guucauauuacuuugagugcag

SEQ ID NO: 961305 - RNA, 22 nt, Human
cacuaaguaagcuccucuacaa

SEQ ID NO: 961306 - RNA, 22 nt, Human
cuggccuggcagggagggcaug

SEQ ID NO: 961307 - RNA, 22 nt, Human
uggagcuggaauuugagcugga

SEQ ID NO: 961308 - RNA, 22 nt, Human
ucauuuguugcuguuaccugag

SEQ ID NO: 961309 - RNA, 22 nt, Human
uaaggcacccgugagcugccag

SEQ ID NO: 961310 - RNA, 21 nt, Human
gcccucaggggaggauggccu

SEQ ID NO: 961311 - RNA, 20 nt, Human
acauugauuauguuuguaga

SEQ ID NO: 961312 - RNA, 22 nt, Human
ucugucuucaucagcaugugau

SEQ ID NO: 961313 - RNA, 22 nt, Human
guggccaaggugcagagcagcu

SEQ ID NO: 961314 - RNA, 22 nt, Human
agcagagucugugugcacuuua

SEQ ID NO: 961315 - RNA, 22 nt, Human
auugaaucugcacuaguauuuu

SEQ ID NO: 961316 - RNA, 22 nt, Human
aggagccaagauggggcaagua

SEQ ID NO: 961317 - RNA, 22 nt, Human
gcccagcaccucucucaggguu

SEQ ID NO: 961318 - RNA, 22 nt, Human
caguggcuguuucuggaaggca

SEQ ID NO: 961319 - RNA, 22 nt, Human
guuauuaguaagacucgcacau

SEQ ID NO: 961320 - RNA, 22 nt, Human
agaaaaaucuuggcgcuugucu

SEQ ID NO: 961321 - RNA, 22 nt, Human
aguuggcauuuuauuuaaguau

SEQ ID NO: 961322 - RNA, 22 nt, Human
gagccaagggcgugcuggagag

SEQ ID NO: 961323 - RNA, 20 nt, Human
aauuuacucacagaaugaau

SEQ ID NO: 961324 - RNA, 22 nt, Human
aagacugucuuuucugagugac

SEQ ID NO: 961325 - RNA, 22 nt, Human
aaaauaacuucuacuauuugca

SEQ ID NO: 961326 - RNA, 22 nt, Human
uuuguaaaagcccaagcuguag

SEQ ID NO: 961327 - RNA, 22 nt, Human
agaguguuucagucuuccuaga

SEQ ID NO: 961328 - RNA, 22 nt, Human
ugggcuggugagggaucauuua

SEQ ID NO: 961329 - RNA, 22 nt, Human
gaggccuggugugucucccgcu

SEQ ID NO: 961330 - RNA, 22 nt, Human
uccagcagcccgaaggcccauc

SEQ ID NO: 961331 - RNA, 22 nt, Human
ucugagccagccaccuccuuca

SEQ ID NO: 961332 - RNA, 22 nt, Human
cuccuuggccguuaaugucaca

SEQ ID NO: 961333 - RNA, 22 nt, Human
cucaggcacgggucagugagcg

SEQ ID NO: 961334 - RNA, 18 nt, Human
caggaugagugaugggga

SEQ ID NO: 961335 - RNA, 19 nt, Human
augucccaccgccccugag

SEQ ID NO: 961336 - RNA, 22 nt, Human
cuuugaagagauuacugugcuc

SEQ ID NO: 961337 - RNA, 22 nt, Human
auguuuuauuaccaacuuguac

SEQ ID NO: 961338 - RNA, 22 nt, Human
ucauggcacuuagcacaguccu

SEQ ID NO: 961339 - RNA, 20 nt, Human
ucagccagcuaacaugggga

SEQ ID NO: 961340 - RNA, 22 nt, Human
aaauuacuuuacacuuucaucu

SEQ ID NO: 961341 - RNA, 22 nt, Human
cuuguccccagcagguugguuu

SEQ ID NO: 961342 - RNA, 22 nt, Human
guacuuccguggacuaauuguu

SEQ ID NO: 961343 - RNA, 22 nt, Human
uccuucagauuccugcuucugg

SEQ ID NO: 961344 - RNA, 22 nt, Human
caaggccaagguuuugugaacu

SEQ ID NO: 961345 - RNA, 22 nt, Human
cugagccaaccacagcaggagc

SEQ ID NO: 961346 - RNA, 22 nt, Human
uugcaaauuccaauccaauauu

SEQ ID NO: 961347 - RNA, 22 nt, Human
aauucacauauacauuauuccu

SEQ ID NO: 961348 - RNA, 22 nt, Human
ugaaucugauuucccuggaggc

SEQ ID NO: 961349 - RNA, 22 nt, Human
cucaggaugaaagucaugguga

SEQ ID NO: 961350 - RNA, 19 nt, Human
cucugccucccuccugggu

SEQ ID NO: 961351 - RNA, 22 nt, Human
guugaaaguagaugcuauuugg

SEQ ID NO: 961352 - RNA, 22 nt, Human
ucuggagcgaggucccugucug

SEQ ID NO: 961353 - RNA, 22 nt, Human
gucccacaccuugaggggucuu

SEQ ID NO: 961354 - RNA, 22 nt, Human
ggcaggaggaagaguuagcacc

SEQ ID NO: 961355 - RNA, 22 nt, Human
aggaccaacauagcagcagugg

SEQ ID NO: 961356 - RNA, 22 nt, Human
agcaccugcuugugacuaggga

SEQ ID NO: 961357 - RNA, 22 nt, Human
uacucugcaaguugaagguggc

SEQ ID NO: 961358 - RNA, 22 nt, Human
guccuggggaauacagaagccg

SEQ ID NO: 961359 - RNA, 23 nt, Human
gagagcugacugucaagacuguu

SEQ ID NO: 961360 - RNA, 22 nt, Human
cuguggcuuucucugccuccuu

SEQ ID NO: 961361 - RNA, 22 nt, Human
ccagagcuucggggcggcugua

SEQ ID NO: 961362 - RNA, 22 nt, Human
acucugcuaucuuagcaaaagg

SEQ ID NO: 961363 - RNA, 22 nt, Human
aaacacuagcaggaagcacuga

SEQ ID NO: 961364 - RNA, 22 nt, Human
ugcccuguuccugccuccagcu

SEQ ID NO: 961365 - RNA, 22 nt, Human
uagcuauuuagcccagauaagu

SEQ ID NO: 961366 - RNA, 22 nt, Human
cuggagagaaaugacaaagcua

SEQ ID NO: 961367 - RNA, 22 nt, Human
cucuucuuuaguccagaccauc

SEQ ID NO: 961368 - RNA, 20 nt, Human
uccaguuuuggagacauucu

SEQ ID NO: 961369 - RNA, 22 nt, Human
ucuagaaauuuugccuuguauu

SEQ ID NO: 961370 - RNA, 22 nt, Human
ccaggccuagccccugagggua

SEQ ID NO: 961371 - RNA, 22 nt, Human
ucccagagcccaaguuggagag

SEQ ID NO: 961372 - RNA, 22 nt, Human
acuuuugguucuguaacuguga

SEQ ID NO: 961373 - RNA, 22 nt, Human
cagaagcauuccagcaaauagu

SEQ ID NO: 961374 - RNA, 22 nt, Human
gaaggccucacucugcagcaua

SEQ ID NO: 961375 - RNA, 22 nt, Human
ugaaacacuuucaauuacauau

SEQ ID NO: 961376 - RNA, 22 nt, Human
ggcaaaaaccauaauuacuuuu

SEQ ID NO: 961377 - RNA, 20 nt, Human
agcuggagaagggcccuucc

SEQ ID NO: 961378 - RNA, 19 nt, Human
gaagaagcuugagaaguag

SEQ ID NO: 961379 - RNA, 22 nt, Human
uuagauaauguagagauaugag

SEQ ID NO: 961380 - RNA, 22 nt, Human
ccuuucucuaucgacccaucgc

SEQ ID NO: 961381 - RNA, 23 nt, Human
uuguuuuuagagguggcaugaga

SEQ ID NO: 961382 - RNA, 22 nt, Human
aggcagcuuuguaguaaagcua

SEQ ID NO: 961383 - RNA, 21 nt, Human
agagccugagaucuuccagca

SEQ ID NO: 961384 - RNA, 20 nt, Human
augccucuaauuuugcaaac

SEQ ID NO: 961385 - RNA, 19 nt, Human
uggcaggcccaggauggac

SEQ ID NO: 961386 - RNA, 22 nt, Human
gggcuguggagccgcgagggcu

SEQ ID NO: 961387 - RNA, 21 nt, Human
acaguucaugauaacuccauc

SEQ ID NO: 961388 - RNA, 22 nt, Human
gggggcucugacucccucagcu

SEQ ID NO: 961389 - RNA, 22 nt, Human
uagaacagaguuccagugauca

SEQ ID NO: 961390 - RNA, 22 nt, Human
caucaguguggcaguucacugu

SEQ ID NO: 961391 - RNA, 18 nt, Human
ccugagcccugcuuacuu

SEQ ID NO: 961392 - RNA, 22 nt, Human
uggcagagaacacggcugaucu

SEQ ID NO: 961393 - RNA, 22 nt, Human
cuucucuucccagggacacagg

SEQ ID NO: 961394 - RNA, 22 nt, Human
uccuggaggcaaaugaagacuc

SEQ ID NO: 961395 - RNA, 22 nt, Human
agccucuguagaaagcagugug

SEQ ID NO: 961396 - RNA, 22 nt, Human
acaaaugcaaguuuuaugucaa

SEQ ID NO: 961397 - RNA, 23 nt, Human
cuccuggaggguccggcccugcc

SEQ ID NO: 961398 - RNA, 22 nt, Human
uucaaugauuuuuagggaucau

SEQ ID NO: 961399 - RNA, 22 nt, Human
agccuggcccugcugaacucug

SEQ ID NO: 961400 - RNA, 22 nt, Human
aggcagauuacuugaggccagg

SEQ ID NO: 961401 - RNA, 22 nt, Human
aggcaggcuggucugaagagug

SEQ ID NO: 961402 - RNA, 22 nt, Human
gaggcugguaggaaaggaaaca

SEQ ID NO: 961403 - RNA, 22 nt, Human
ucccagccuuccagucugguuu

SEQ ID NO: 961404 - RNA, 22 nt, Human
agaaaugaaaccaaagccuaga

SEQ ID NO: 961405 - RNA, 22 nt, Human
cacaggcuugucagcaugaggc

SEQ ID NO: 961406 - RNA, 22 nt, Human
aggguagguguaagauagcccu

SEQ ID NO: 961407 - RNA, 22 nt, Human
uccugucugucuuuggucccuu

SEQ ID NO: 961408 - RNA, 22 nt, Human
uccuggccucgcuguccaccuu

SEQ ID NO: 961409 - RNA, 22 nt, Human
ccuggagcccaaggcagugaga

SEQ ID NO: 961410 - RNA, 22 nt, Human
cuuugaaaacuuaaauaacagc

SEQ ID NO: 961411 - RNA, 22 nt, Human
cugugucucccaaggaggguca

SEQ ID NO: 961412 - RNA, 22 nt, Human
gaaaugcauaaucuuaguagau

SEQ ID NO: 961413 - RNA, 22 nt, Human
uguguccuucugggagucccag

SEQ ID NO: 961414 - RNA, 22 nt, Human
uucaggaucauuuguuuuaucu

SEQ ID NO: 961415 - RNA, 22 nt, Human
agcccagccggauucccaguuc

SEQ ID NO: 961416 - RNA, 22 nt, Human
gccaccagugggggccugggca

SEQ ID NO: 961417 - RNA, 22 nt, Human
gaggcagcugggauacaaggga

SEQ ID NO: 961418 - RNA, 22 nt, Human
gcacacccucucaccagcacug

SEQ ID NO: 961419 - RNA, 22 nt, Human
caggauggucagaugcauuguc

SEQ ID NO: 961420 - RNA, 22 nt, Human
ggcagugacuguucagacgucc

SEQ ID NO: 961421 - RNA, 22 nt, Human
aauuuccagaucagaugacuca

SEQ ID NO: 961422 - RNA, 22 nt, Human
accuuuuccagcuucuagaggc

SEQ ID NO: 961423 - RNA, 22 nt, Human
cacuggaauucaagauacugag

SEQ ID NO: 961424 - RNA, 22 nt, Human
cagggcccaggccacuggguug

SEQ ID NO: 961425 - RNA, 22 nt, Human
aggccagcucuacccuuggacu

SEQ ID NO: 961426 - RNA, 22 nt, Human
agagccuugaagaucuggaaaa

SEQ ID NO: 961427 - RNA, 22 nt, Human
ugggcagauuaaugcaguggcu

SEQ ID NO: 961428 - RNA, 22 nt, Human
gggcacuggaaggcucucaggc

SEQ ID NO: 961429 - RNA, 22 nt, Human
auucuuggagcagucaaagaag

SEQ ID NO: 961430 - RNA, 22 nt, Human
ugucccagacacaguaugcgcu

SEQ ID NO: 961431 - RNA, 22 nt, Human
uuugcaaaaugucuuguguuag

SEQ ID NO: 961432 - RNA, 22 nt, Human
gaauauuuuuaaagggacuaau

SEQ ID NO: 961433 - RNA, 22 nt, Human
gcugcagcagcugcaggguugu

SEQ ID NO: 961434 - RNA, 22 nt, Human
uucuucaacaaggacacuguua

SEQ ID NO: 961435 - RNA, 22 nt, Human
cucuggagguggagguugcagu

SEQ ID NO: 961436 - RNA, 22 nt, Human
uggcagcuggaucccaaggcag

SEQ ID NO: 961437 - RNA, 22 nt, Human
ugcuggaauaauuucauguuaa

SEQ ID NO: 961438 - RNA, 22 nt, Human
cugugucccaguaccuugggua

SEQ ID NO: 961439 - RNA, 22 nt, Human
uaucuacuccucuuucagaugc

SEQ ID NO: 961440 - RNA, 22 nt, Human
aauaggcaguuggauaugcaag

SEQ ID NO: 961441 - RNA, 22 nt, Human
ccacagugguucucaaccaggg

SEQ ID NO: 961442 - RNA, 22 nt, Human
cugagccagggccacacaugga

SEQ ID NO: 961443 - RNA, 22 nt, Human
aggagccuccuucucaugugca

SEQ ID NO: 961444 - RNA, 22 nt, Human
uccuauugguagacauuucugu

SEQ ID NO: 961445 - RNA, 19 nt, Human
aaagcagaggagcaucuga

SEQ ID NO: 961446 - RNA, 22 nt, Human
ccugccaggccagugagcuucc

SEQ ID NO: 961447 - RNA, 22 nt, Human
cagucacauugcccugcauuua

SEQ ID NO: 961448 - RNA, 22 nt, Human
cccaggagccaucugucuuggc

SEQ ID NO: 961449 - RNA, 22 nt, Human
uugcauaaaugcuuaaaauuug

SEQ ID NO: 961450 - RNA, 22 nt, Human
aucagaauaauuagauuucaga

SEQ ID NO: 961451 - RNA, 22 nt, Human
uuuuccuaguaggccuauuaga

SEQ ID NO: 961452 - RNA, 22 nt, Human
gagcugccggcccacaguacua

SEQ ID NO: 961453 - RNA, 22 nt, Human
ggaaaaggccauuguuucucug

SEQ ID NO: 961454 - RNA, 22 nt, Human
cuggcagauuggggucagcagu

SEQ ID NO: 961455 - RNA, 22 nt, Human
uaaggccaaguucauauacaac

SEQ ID NO: 961456 - RNA, 22 nt, Human
gaggacagagccgccuggcaag

SEQ ID NO: 961457 - RNA, 22 nt, Human
gcugcagcaagcccuccagggg

SEQ ID NO: 961458 - RNA, 22 nt, Human
cuggaagguucuuugugugccu

SEQ ID NO: 961459 - RNA, 22 nt, Human
ugaacucgggaggaggcugcag

SEQ ID NO: 961460 - RNA, 22 nt, Human
aauacaguagguaauaguucau

SEQ ID NO: 961461 - RNA, 19 nt, Human
ccuggaggugaagguucuc

SEQ ID NO: 961462 - RNA, 22 nt, Human
gaggagaggccaucguuguuau

SEQ ID NO: 961463 - RNA, 23 nt, Human
ggagccuggcauaugagacgcau

SEQ ID NO: 961464 - RNA, 22 nt, Human
ugcagaagaaugagcuuggagu

SEQ ID NO: 961465 - RNA, 23 nt, Human
cuggggcuuucaaaucugggcag

SEQ ID NO: 961466 - RNA, 22 nt, Human
cccaguccuaaagcagacgcca

SEQ ID NO: 961467 - RNA, 22 nt, Human
uccugcagagacagaggccuca

SEQ ID NO: 961468 - RNA, 22 nt, Human
caauaagugcuuuuguuuagca

SEQ ID NO: 961469 - RNA, 22 nt, Human
ggacccugggcuugcuccuggg

SEQ ID NO: 961470 - RNA, 22 nt, Human
ugugcagggaagggcaugcuau

SEQ ID NO: 961471 - RNA, 22 nt, Human
ggagcugaaggggugggcucag

SEQ ID NO: 961472 - RNA, 22 nt, Human
guccucuggugaaagcauuccc

SEQ ID NO: 961473 - RNA, 22 nt, Human
cugaaggauuuaguucuuugcu

SEQ ID NO: 961474 - RNA, 22 nt, Human
cagugccaugucugagccccua

SEQ ID NO: 961475 - RNA, 22 nt, Human
ccagggccaguaagauuggcau

SEQ ID NO: 961476 - RNA, 22 nt, Human
cauuugaugacucaacucauaa

SEQ ID NO: 961477 - RNA, 22 nt, Human
uugcauugcuuggucuucaaga

SEQ ID NO: 961478 - RNA, 22 nt, Human
uuuguuuagaugguaaaucagu

SEQ ID NO: 961479 - RNA, 22 nt, Human
cccugcagcuuuugcauaguca

SEQ ID NO: 961480 - RNA, 22 nt, Human
uauuccuaagucccaacuacau

SEQ ID NO: 961481 - RNA, 22 nt, Human
ggcacugacacuagcauggcac

SEQ ID NO: 961482 - RNA, 20 nt, Human
uccagggcuagggagcucau

SEQ ID NO: 961483 - RNA, 23 nt, Human
acacaaggguaacugccagccau

SEQ ID NO: 961484 - RNA, 22 nt, Human
cuggccagcugacagcagggcu

SEQ ID NO: 961485 - RNA, 22 nt, Human
aucaggauuacacggggaugcu

SEQ ID NO: 961486 - RNA, 22 nt, Human
uauuuucuguggaggaccagau

SEQ ID NO: 961487 - RNA, 22 nt, Human
cuggccagacuacacaugugug

SEQ ID NO: 961488 - RNA, 22 nt, Human
agaaagaacgcacuugugcugc

SEQ ID NO: 961489 - RNA, 22 nt, Human
aaagaacagauguguggugcau

SEQ ID NO: 961490 - RNA, 22 nt, Human
caggcagccugcggucugcaca

SEQ ID NO: 961491 - RNA, 22 nt, Human
ucuuguuacaguuuauuacaug

SEQ ID NO: 961492 - RNA, 22 nt, Human
auuuucugguugagguuuaaca

SEQ ID NO: 961493 - RNA, 22 nt, Human
aagcagccuggacuugggcugg

SEQ ID NO: 961494 - RNA, 22 nt, Human
gccaggcuggugcaaggauauu

SEQ ID NO: 961495 - RNA, 22 nt, Human
cugucccuucauuauucacuac

SEQ ID NO: 961496 - RNA, 22 nt, Human
uuuccuaguucuaagaaaugua

SEQ ID NO: 961497 - RNA, 22 nt, Human
uugcuuuguuacugcaguuucc

SEQ ID NO: 961498 - RNA, 22 nt, Human
ggucagggcucuuccaguggcu

SEQ ID NO: 961499 - RNA, 22 nt, Human
uggcagcuguuaauguuuuguu

SEQ ID NO: 961500 - RNA, 18 nt, Human
agaggggagguaagucug

SEQ ID NO: 961501 - RNA, 22 nt, Human
acagagcauauaaagugcuuug

SEQ ID NO: 961502 - RNA, 22 nt, Human
accaggaggccuugguucugag

SEQ ID NO: 961503 - RNA, 22 nt, Human
acaguaauaaguguuggugagg

SEQ ID NO: 961504 - RNA, 22 nt, Human
cauacauuuugcauauuuacca

SEQ ID NO: 961505 - RNA, 22 nt, Human
cccaggaggacauuccauaccc

SEQ ID NO: 961506 - RNA, 22 nt, Human
cagggacugagauccagacugu

SEQ ID NO: 961507 - RNA, 22 nt, Human
gaaucacgguauucugcacggg

SEQ ID NO: 961508 - RNA, 22 nt, Human
cagagcugggaucccaugggcg

SEQ ID NO: 961509 - RNA, 22 nt, Human
gcacucugugaucugcagagcc

SEQ ID NO: 961510 - RNA, 22 nt, Human
uggagcugguaaacagugacau

SEQ ID NO: 961511 - RNA, 22 nt, Human
cucuguccacagguuugucccu

SEQ ID NO: 961512 - RNA, 22 nt, Human
cauugaaauauggaaacugaug

SEQ ID NO: 961513 - RNA, 22 nt, Human
aggguauguuuuuaucuacugu

SEQ ID NO: 961514 - RNA, 22 nt, Human
auaacaugaccugugcuucaca

SEQ ID NO: 961515 - RNA, 22 nt, Human
acagagcuuaggaugacuccca

SEQ ID NO: 961516 - RNA, 22 nt, Human
cagagccucagaauccugugga

SEQ ID NO: 961517 - RNA, 22 nt, Human
gggaagaguaacuagcccaugu

SEQ ID NO: 961518 - RNA, 22 nt, Human
aaauaguaaagugguagccauc

SEQ ID NO: 961519 - RNA, 22 nt, Human
aggcaagcgcagaagcggagga

SEQ ID NO: 961520 - RNA, 22 nt, Human
aggccagguuccucaaucuuga

SEQ ID NO: 961521 - RNA, 22 nt, Human
aagggcugaaugaaggguugaa

SEQ ID NO: 961522 - RNA, 22 nt, Human
gcccagcugcacccuggugggu

SEQ ID NO: 961523 - RNA, 22 nt, Human
gcaggaugagugaguacauuua

SEQ ID NO: 961524 - RNA, 22 nt, Human
ugcuucaaguugaaauauucuu

SEQ ID NO: 961525 - RNA, 22 nt, Human
agaggcugaaugaugucaucau

SEQ ID NO: 961526 - RNA, 22 nt, Human
ccucacugaagaggugacauuu

SEQ ID NO: 961527 - RNA, 22 nt, Human
aauuaaauugguuuagagagga

SEQ ID NO: 961528 - RNA, 22 nt, Human
ucagggacugcagagggaagcu

SEQ ID NO: 961529 - RNA, 22 nt, Human
agcugagcugcagaugacugua

SEQ ID NO: 961530 - RNA, 22 nt, Human
ggaggguuagcaaaggcacaga

SEQ ID NO: 961531 - RNA, 22 nt, Human
ccuggcagaauauuaaagugca

SEQ ID NO: 961532 - RNA, 22 nt, Human
cauuaucucuucuauaugcuag

SEQ ID NO: 961533 - RNA, 22 nt, Human
gaugcagggcuggcaggagcuu

SEQ ID NO: 961534 - RNA, 22 nt, Human
uaugauuuguagacauuugauu

SEQ ID NO: 961535 - RNA, 22 nt, Human
uuacaagcagcuacauaucaca

SEQ ID NO: 961536 - RNA, 22 nt, Human
gccaggcuggugucacaacucu

SEQ ID NO: 961537 - RNA, 22 nt, Human
gcugaaggaggcucugguacua

SEQ ID NO: 961538 - RNA, 22 nt, Human
aaucuguuuaguucugcguaug

SEQ ID NO: 961539 - RNA, 20 nt, Human
cagggccacgcuccaaggca

SEQ ID NO: 961540 - RNA, 22 nt, Human
uaugagaaaauaaauaucuguu

SEQ ID NO: 961541 - RNA, 22 nt, Human
cugugucuuuccuacuuugugg

SEQ ID NO: 961542 - RNA, 22 nt, Human
cacagggcagugcugcccacuc

SEQ ID NO: 961543 - RNA, 22 nt, Human
gagaggucaucucccaucagca

SEQ ID NO: 961544 - RNA, 22 nt, Human
ugguaauuaauuugauagguuc

SEQ ID NO: 961545 - RNA, 22 nt, Human
aaguaugcuaauuaacuagcac

SEQ ID NO: 961546 - RNA, 22 nt, Human
caugugugacaaacugccugca

SEQ ID NO: 961547 - RNA, 22 nt, Human
uacuaugugaaaauacuauagu

SEQ ID NO: 961548 - RNA, 22 nt, Human
guuauguacuuuuuaaaucuug

SEQ ID NO: 961549 - RNA, 22 nt, Human
ggugucccaggccagcugugug

SEQ ID NO: 961550 - RNA, 22 nt, Human
ccuuucucauuuuaagcauuag

SEQ ID NO: 961551 - RNA, 22 nt, Human
auucuccagcucacuguccaua

SEQ ID NO: 961552 - RNA, 22 nt, Human
gguucacauauugagaguauuc

SEQ ID NO: 961553 - RNA, 19 nt, Human
ccucugcuccaguuuccuu

SEQ ID NO: 961554 - RNA, 22 nt, Human
cuguggcuaugguguacauacu

SEQ ID NO: 961555 - RNA, 22 nt, Human
uggccugcccagagcagcucug

SEQ ID NO: 961556 - RNA, 22 nt, Human
gaggcccaggucaagcagccac

SEQ ID NO: 961557 - RNA, 23 nt, Human
agaugagccaacaccuccaugcc

SEQ ID NO: 961558 - RNA, 22 nt, Human
ucugugacuugcgggaggagaa

SEQ ID NO: 961559 - RNA, 22 nt, Human
agggacuuguguccuauguaug

SEQ ID NO: 961560 - RNA, 22 nt, Human
aagacagagacucugcaacagg

SEQ ID NO: 961561 - RNA, 22 nt, Human
aagccaagaguuaacuauuugu

SEQ ID NO: 961562 - RNA, 22 nt, Human
agccagggauggcagugcccag

SEQ ID NO: 961563 - RNA, 22 nt, Human
cacagggcuuugauggcugagu

SEQ ID NO: 961564 - RNA, 18 nt, Human
ggagagugacagagucgu

SEQ ID NO: 961565 - RNA, 22 nt, Human
gcaaggcugcugccacccaucu

SEQ ID NO: 961566 - RNA, 22 nt, Human
agagagcauugaggaaaucuuc

SEQ ID NO: 961567 - RNA, 21 nt, Human
uggccaaaaccauauuauuaa

SEQ ID NO: 961568 - RNA, 22 nt, Human
uccagggaagagcagaggcuac

SEQ ID NO: 961569 - RNA, 22 nt, Human
ggaugggagcagaggacgacca

SEQ ID NO: 961570 - RNA, 22 nt, Human
aagcagagcaagcguauuuauu

SEQ ID NO: 961571 - RNA, 22 nt, Human
agggcagaaauauugauacugu

SEQ ID NO: 961572 - RNA, 19 nt, Human
agauggggaagagugugag

SEQ ID NO: 961573 - RNA, 22 nt, Human
auuggucaggacuggcaugugg

SEQ ID NO: 961574 - RNA, 22 nt, Human
gcucucugggugugucuagaua

SEQ ID NO: 961575 - RNA, 19 nt, Human
gccaggagggcucuggcug

SEQ ID NO: 961576 - RNA, 22 nt, Human
aggcaguuguugcugagcagcu

SEQ ID NO: 961577 - RNA, 22 nt, Human
uggggacacagagccaaacuau

SEQ ID NO: 961578 - RNA, 22 nt, Human
ucaguuuuuacggucacaggga

SEQ ID NO: 961579 - RNA, 23 nt, Human
aggcagcagguuguccaggguga

SEQ ID NO: 961580 - RNA, 22 nt, Human
ccagcuccccucagcagguaau

SEQ ID NO: 961581 - RNA, 22 nt, Human
ggugacugguuuaucuggcagu

SEQ ID NO: 961582 - RNA, 22 nt, Human
aucuaagaguuaacaucaagaa

SEQ ID NO: 961583 - RNA, 22 nt, Human
aucccaugagaccacguuggcu

SEQ ID NO: 961584 - RNA, 22 nt, Human
ucucaggcuaccuugcacaagg

SEQ ID NO: 961585 - RNA, 22 nt, Human
augaagcuaaacccugcagcca

SEQ ID NO: 961586 - RNA, 22 nt, Human
aagccuugcagcauuaggcucu

SEQ ID NO: 961587 - RNA, 22 nt, Human
acugcuuuagaccuagagcucu

SEQ ID NO: 961588 - RNA, 22 nt, Human
ugagcaguaggucugaauagug

SEQ ID NO: 961589 - RNA, 23 nt, Human
aguuuuucugcaugguucuguau

SEQ ID NO: 961590 - RNA, 22 nt, Human
ggugagaggcagaggacagcuu

SEQ ID NO: 961591 - RNA, 22 nt, Human
cccuggagggacagcugcucua

SEQ ID NO: 961592 - RNA, 22 nt, Human
ggaggccuagccagcuccaguu

SEQ ID NO: 961593 - RNA, 22 nt, Human
acauuuaggauguuuugagaga

SEQ ID NO: 961594 - RNA, 22 nt, Human
gucuggccugccagcucuggug

SEQ ID NO: 961595 - RNA, 22 nt, Human
ucgagcucuggagccaaggaug

SEQ ID NO: 961596 - RNA, 22 nt, Human
gagccaggguuugaaacuagac

SEQ ID NO: 961597 - RNA, 21 nt, Human
uccauuguuuucccaggguuu

SEQ ID NO: 961598 - RNA, 22 nt, Human
aauguugagcuugaaaguaggu

SEQ ID NO: 961599 - RNA, 22 nt, Human
ucuggagccacaaaccucagcu

SEQ ID NO: 961600 - RNA, 22 nt, Human
ugggcugcccaagguggccaug

SEQ ID NO: 961601 - RNA, 22 nt, Human
aaaauuauagaucuagugccug

SEQ ID NO: 961602 - RNA, 22 nt, Human
gcacacagauuaggaaacagaa

SEQ ID NO: 961603 - RNA, 22 nt, Human
cagucccaaggaggaagcaguc

SEQ ID NO: 961604 - RNA, 22 nt, Human
uaugcauaugaccccaagcuug

SEQ ID NO: 961605 - RNA, 22 nt, Human
aaaugcuguaacugauauucug

SEQ ID NO: 961606 - RNA, 22 nt, Human
gauccuugcacuugacuuggca

SEQ ID NO: 961607 - RNA, 22 nt, Human
agggaagaugucucaucuuagg

SEQ ID NO: 961608 - RNA, 22 nt, Human
gggagagagaaaacguggcgca

SEQ ID NO: 961609 - RNA, 22 nt, Human
ccaggagcauuaagagaacaua

SEQ ID NO: 961610 - RNA, 22 nt, Human
ggccauggaccccgagcugacc

SEQ ID NO: 961611 - RNA, 22 nt, Human
aauaauguugacgauagucuua

SEQ ID NO: 961612 - RNA, 22 nt, Human
gacccaggcucgugggacggcu

SEQ ID NO: 961613 - RNA, 22 nt, Human
caaauucucacccuguuugauu

SEQ ID NO: 961614 - RNA, 22 nt, Human
ucuuuggaucccaacuggcugg

SEQ ID NO: 961615 - RNA, 22 nt, Human
ugugccagccucuggcuguguc

SEQ ID NO: 961616 - RNA, 22 nt, Human
ugagccuggggccugggcagcg

SEQ ID NO: 961617 - RNA, 22 nt, Human
ggcucuggaaaguguccuugau

SEQ ID NO: 961618 - RNA, 22 nt, Human
auauuaggcaaggagauuauuu

SEQ ID NO: 961619 - RNA, 22 nt, Human
uggccuggcccugaggcccugu

SEQ ID NO: 961620 - RNA, 22 nt, Human
cagcuggcagaaccugcaucca

SEQ ID NO: 961621 - RNA, 22 nt, Human
gcagcugccccgacugugaguc

SEQ ID NO: 961622 - RNA, 19 nt, Human
agggagaauuccaagagga

SEQ ID NO: 961623 - RNA, 22 nt, Human
aauaacaggcucaucagaugcu

SEQ ID NO: 961624 - RNA, 22 nt, Human
uagcaguggaaucuuuugucca

SEQ ID NO: 961625 - RNA, 22 nt, Human
uggccuggggaagaccaugggc

SEQ ID NO: 961626 - RNA, 22 nt, Human
ggggcagauggaacagagcaca

SEQ ID NO: 961627 - RNA, 22 nt, Human
uaauccacaauagagauuaucu

SEQ ID NO: 961628 - RNA, 22 nt, Human
ucaacagaagugauagcuauua

SEQ ID NO: 961629 - RNA, 22 nt, Human
gagggcaguagccucguacccu

SEQ ID NO: 961630 - RNA, 22 nt, Human
cagcugagaccagaaugcaggu

SEQ ID NO: 961631 - RNA, 22 nt, Human
auacaucuaugccuuucugaca

SEQ ID NO: 961632 - RNA, 22 nt, Human
ggcagagcugcaugagcacuca

SEQ ID NO: 961633 - RNA, 22 nt, Human
ugucccagaucacaggagggga

SEQ ID NO: 961634 - RNA, 22 nt, Human
auuuaguguguauugcuauuau

SEQ ID NO: 961635 - RNA, 22 nt, Human
ugccagggcugcuacuggcuga

SEQ ID NO: 961636 - RNA, 22 nt, Human
augcaguacauacaaacacuga

SEQ ID NO: 961637 - RNA, 22 nt, Human
ccucccacuucuugcugagguc

SEQ ID NO: 961638 - RNA, 22 nt, Human
gagucuuaggcaaaaauaaugg

SEQ ID NO: 961639 - RNA, 22 nt, Human
agcugccauggccugaauuuac

SEQ ID NO: 961640 - RNA, 22 nt, Human
aaggcagcuuuaaaaaagaugc

SEQ ID NO: 961641 - RNA, 22 nt, Human
ugcuagaaaucugaaacuagca

SEQ ID NO: 961642 - RNA, 22 nt, Human
acuccuggggcugccaucacag

SEQ ID NO: 961643 - RNA, 22 nt, Human
cugcccugugaggguccuuggg

SEQ ID NO: 961644 - RNA, 22 nt, Human
gcagagaagaugcccaggcuuc

SEQ ID NO: 961645 - RNA, 22 nt, Human
ccaggcagagugcuccagaaag

SEQ ID NO: 961646 - RNA, 22 nt, Human
ucucaggggauucacuggcacc

SEQ ID NO: 961647 - RNA, 22 nt, Human
uauaugcagauuuucaucaucg

SEQ ID NO: 961648 - RNA, 22 nt, Human
uuggcuucucuuaacccuaaag

SEQ ID NO: 961649 - RNA, 22 nt, Human
cauaucccauuggccaggacau

SEQ ID NO: 961650 - RNA, 22 nt, Human
ccuccaggcugaauaucuagaa

SEQ ID NO: 961651 - RNA, 22 nt, Human
uggcugugggaugagagccuca

SEQ ID NO: 961652 - RNA, 22 nt, Human
cggagaggaccugcaacucgcu

SEQ ID NO: 961653 - RNA, 22 nt, Human
ccagggucucugcugccugaga

SEQ ID NO: 961654 - RNA, 18 nt, Human
gucacuguguuucugagc

SEQ ID NO: 961655 - RNA, 17 nt, Human
ucccaggaacagggaau

SEQ ID NO: 961656 - RNA, 22 nt, Human
aggcagaauguuggaaaggaag

SEQ ID NO: 961657 - RNA, 19 nt, Human
caaggguugggucugucau

SEQ ID NO: 961658 - RNA, 22 nt, Human
caagggugguauugggagcaua

SEQ ID NO: 961659 - RNA, 22 nt, Human
aagacauugucauuuuauaauu

SEQ ID NO: 961660 - RNA, 22 nt, Human
gagccauacaaccuauaaagug

SEQ ID NO: 961661 - RNA, 22 nt, Human
gagcaggccagcaauggaaggg

SEQ ID NO: 961662 - RNA, 22 nt, Human
uggcagcaccagcaguguccuu

SEQ ID NO: 961663 - RNA, 20 nt, Human
augugucuuagagcaucagg

SEQ ID NO: 961664 - RNA, 22 nt, Human
cccgggaggaggaaguugcagu

SEQ ID NO: 961665 - RNA, 22 nt, Human
ucacagggcauuauggcuccag

SEQ ID NO: 961666 - RNA, 22 nt, Human
gauggacagccuggaaggaaag

SEQ ID NO: 961667 - RNA, 22 nt, Human
auagucaaccuuguaauuagcc

SEQ ID NO: 961668 - RNA, 22 nt, Human
ggccagaggccauccuccugcu

SEQ ID NO: 961669 - RNA, 22 nt, Human
cugcuguguggauucaauggcu

SEQ ID NO: 961670 - RNA, 22 nt, Human
aauguguacaugacagauagaa

SEQ ID NO: 961671 - RNA, 22 nt, Human
uuuguuaauucuuauguuagag

SEQ ID NO: 961672 - RNA, 22 nt, Human
uccagucaggcugaauucaagg

SEQ ID NO: 961673 - RNA, 19 nt, Human
ugaggggaggagaggccug

SEQ ID NO: 961674 - RNA, 22 nt, Human
agugcugucccgacaacugagg

SEQ ID NO: 961675 - RNA, 22 nt, Human
uguacacugcaggaugcauugc

SEQ ID NO: 961676 - RNA, 22 nt, Human
gagccuggauugucaccgacuu

SEQ ID NO: 961677 - RNA, 22 nt, Human
gccuggagcagacgugucccgg

SEQ ID NO: 961678 - RNA, 20 nt, Human
gugcauuucaccuguacugu

SEQ ID NO: 961679 - RNA, 22 nt, Human
ugcucccagggacucuggcugg

SEQ ID NO: 961680 - RNA, 22 nt, Human
aagcccagaugggagcauuuca

SEQ ID NO: 961681 - RNA, 22 nt, Human
ggcucaggaugagccuucucau

SEQ ID NO: 961682 - RNA, 22 nt, Human
gagggaauggugugcaagaggu

SEQ ID NO: 961683 - RNA, 20 nt, Human
uuucaguugguuaauggcau

SEQ ID NO: 961684 - RNA, 22 nt, Human
cgaugguucuggcugcuuguau

SEQ ID NO: 961685 - RNA, 22 nt, Human
agauuucccaaauacuuguuau

SEQ ID NO: 961686 - RNA, 22 nt, Human
cagggccucuccuccaggaacu

SEQ ID NO: 961687 - RNA, 22 nt, Human
aaugggaggauuuucucucuug

SEQ ID NO: 961688 - RNA, 22 nt, Human
caggacagguguucuagaucag

SEQ ID NO: 961689 - RNA, 22 nt, Human
auucuucacaccuguuccuguu

SEQ ID NO: 961690 - RNA, 19 nt, Human
ugagagugaggaaggcuuc

SEQ ID NO: 961691 - RNA, 22 nt, Human
cacuaugcuuacaugcuuauau

SEQ ID NO: 961692 - RNA, 22 nt, Human
ccagcugaggcagccacacagg

SEQ ID NO: 961693 - RNA, 22 nt, Human
aggcacugugcuucuuauaugu

SEQ ID NO: 961694 - RNA, 19 nt, Human
ccuuggaguuccaggugga

SEQ ID NO: 961695 - RNA, 22 nt, Human
uugaggagucaggggcacggaa

SEQ ID NO: 961696 - RNA, 22 nt, Human
acuuucucaggaauucacagac

SEQ ID NO: 961697 - RNA, 22 nt, Human
ccuggcaggcuggggacagugc

SEQ ID NO: 961698 - RNA, 22 nt, Human
gaggucaggggagaggcugaug

SEQ ID NO: 961699 - RNA, 18 nt, Human
cauuaugugguuauagaa

SEQ ID NO: 961700 - RNA, 22 nt, Human
uccagggagagccgcugcucca

SEQ ID NO: 961701 - RNA, 20 nt, Human
gcagcugcccccagucccug

SEQ ID NO: 961702 - RNA, 22 nt, Human
gaaugcacuuccaacaucuauu

SEQ ID NO: 961703 - RNA, 22 nt, Human
acugucacuccaacugagucgu

SEQ ID NO: 961704 - RNA, 20 nt, Human
gcagcugaaaguaugacacc

SEQ ID NO: 961705 - RNA, 22 nt, Human
uuucuauaaaaagugcuaggau

SEQ ID NO: 961706 - RNA, 22 nt, Human
uauauuaacuugugauccugga

SEQ ID NO: 961707 - RNA, 23 nt, Human
agagcuuucuaaaauguaaaucu

SEQ ID NO: 961708 - RNA, 22 nt, Human
cugcccugcccaggccuugggc

SEQ ID NO: 961709 - RNA, 22 nt, Human
ggcagcucugugucugggaagc

SEQ ID NO: 961710 - RNA, 22 nt, Human
guauuuauaggggaaugagagu

SEQ ID NO: 961711 - RNA, 22 nt, Human
gguuugaacagcuuuggagaag

SEQ ID NO: 961712 - RNA, 22 nt, Human
ggcagaggaggggugaauuugc

SEQ ID NO: 961713 - RNA, 22 nt, Human
ugauacagucagcucacaauug

SEQ ID NO: 961714 - RNA, 22 nt, Human
uucucagagugaccaagucuuu

SEQ ID NO: 961715 - RNA, 23 nt, Human
caugggagugagaaugccagcuc

SEQ ID NO: 961716 - RNA, 22 nt, Human
gccaggcagcugggagggugcc

SEQ ID NO: 961717 - RNA, 22 nt, Human
gauuuucauuauagcuaguuuc

SEQ ID NO: 961718 - RNA, 22 nt, Human
uccuggaggggacagcaugggc

SEQ ID NO: 961719 - RNA, 22 nt, Human
aucaaaguccaucagaagguag

SEQ ID NO: 961720 - RNA, 19 nt, Human
ggccuggauuuagggcucc

SEQ ID NO: 961721 - RNA, 22 nt, Human
uuccucaugggguuccuucaga

SEQ ID NO: 961722 - RNA, 19 nt, Human
acaaagcugugagcagcuu

SEQ ID NO: 961723 - RNA, 22 nt, Human
cacaggagcuguggggcagugu

SEQ ID NO: 961724 - RNA, 22 nt, Human
ucugggagacguguguugucag

SEQ ID NO: 961725 - RNA, 22 nt, Human
gaggagcuggcugucgggaggc

SEQ ID NO: 961726 - RNA, 22 nt, Human
uugcagcagggugaauucacuc

SEQ ID NO: 961727 - RNA, 22 nt, Human
ccuugcguuuuacagcuucuag

SEQ ID NO: 961728 - RNA, 22 nt, Human
cagcuuugauucuuucugccau

SEQ ID NO: 961729 - RNA, 22 nt, Human
aagauuuccauuucuagcucau

SEQ ID NO: 961730 - RNA, 20 nt, Human
cccaggagcugugccccauc

SEQ ID NO: 961731 - RNA, 22 nt, Human
ucaggcaggcagagggcaaaug

SEQ ID NO: 961732 - RNA, 22 nt, Human
uccaggagguugagugaguucc

SEQ ID NO: 961733 - RNA, 22 nt, Human
ucacagugaugacgugggagca

SEQ ID NO: 961734 - RNA, 22 nt, Human
ugcugcauuuaucuucucaaac

SEQ ID NO: 961735 - RNA, 22 nt, Human
cugaagcacagcauauaaauaa

SEQ ID NO: 961736 - RNA, 22 nt, Human
agagccaggcggcugggcaccu

SEQ ID NO: 961737 - RNA, 22 nt, Human
gucccugcaucaccacgggacu

SEQ ID NO: 961738 - RNA, 22 nt, Human
cccaggucuaugccagcucuga

SEQ ID NO: 961739 - RNA, 22 nt, Human
gggccaaggggagcuggaaggg

SEQ ID NO: 961740 - RNA, 22 nt, Human
caguggccugagccaggcuucc

SEQ ID NO: 961741 - RNA, 22 nt, Human
gcccauggcagaacugugagca

SEQ ID NO: 961742 - RNA, 22 nt, Human
uaaagugcugggauuauaggcc

SEQ ID NO: 961743 - RNA, 22 nt, Human
uuuguagaggguaauugacaga

SEQ ID NO: 961744 - RNA, 22 nt, Human
acauaaaguacugagagacucu

SEQ ID NO: 961745 - RNA, 22 nt, Human
agacucaagcagauaggaauua

SEQ ID NO: 961746 - RNA, 22 nt, Human
cuucaugcugauauccucgaug

SEQ ID NO: 961747 - RNA, 19 nt, Human
cccagcuugaccaccugcu

SEQ ID NO: 961748 - RNA, 22 nt, Human
uccuggagauaauugcagugaa

SEQ ID NO: 961749 - RNA, 22 nt, Human
cuggcagcaguuaugaaacaau

SEQ ID NO: 961750 - RNA, 22 nt, Human
agcccaggagguggagguugca

SEQ ID NO: 961751 - RNA, 22 nt, Human
uggacagcgaaagugccuggga

SEQ ID NO: 961752 - RNA, 22 nt, Human
uagagcaguuggcagcuguauu

SEQ ID NO: 961753 - RNA, 22 nt, Human
acucaggaaaugagaggcucuc

SEQ ID NO: 961754 - RNA, 22 nt, Human
ggagccagagggaugcaguuga

SEQ ID NO: 961755 - RNA, 16 nt, Human
ugggcagaugagaaga

SEQ ID NO: 961756 - RNA, 22 nt, Human
agcugguggauuaugcuguaca

SEQ ID NO: 961757 - RNA, 22 nt, Human
auguuacagaaagcaaagauga

SEQ ID NO: 961758 - RNA, 22 nt, Human
uggacucagaaguguucuuuua

SEQ ID NO: 961759 - RNA, 22 nt, Human
uuucacauuuaggcgugaauug

SEQ ID NO: 961760 - RNA, 18 nt, Human
uggcagagugucuguucu

SEQ ID NO: 961761 - RNA, 21 nt, Human
gcagccacugccuucaacaau

SEQ ID NO: 961762 - RNA, 21 nt, Human
aauaaaacaguuggugucaau

SEQ ID NO: 961763 - RNA, 22 nt, Human
uguggcucucaugcacucccag

SEQ ID NO: 961764 - RNA, 22 nt, Human
caugagauaauuuuucuccagu

SEQ ID NO: 961765 - RNA, 22 nt, Human
aggcucagagaugaguaagcac

SEQ ID NO: 961766 - RNA, 22 nt, Human
uccaggccuaggccaagugauu

SEQ ID NO: 961767 - RNA, 22 nt, Human
gagcagcuuaugucaagccaga

SEQ ID NO: 961768 - RNA, 22 nt, Human
uguacacaauucuuaacauaca

SEQ ID NO: 961769 - RNA, 22 nt, Human
ucugcagcgugcaggcuggugc

SEQ ID NO: 961770 - RNA, 22 nt, Human
aggaugagccgcgcaagcugac

SEQ ID NO: 961771 - RNA, 20 nt, Human
uacugggcaagcccacagac

SEQ ID NO: 961772 - RNA, 22 nt, Human
uccuguaguugcuaaguuuguu

SEQ ID NO: 961773 - RNA, 22 nt, Human
uucuucuucuggcugcaccugg

SEQ ID NO: 961774 - RNA, 22 nt, Human
gcaugugucuccccaguggagg

SEQ ID NO: 961775 - RNA, 22 nt, Human
uugugucccccuuugagagcca

SEQ ID NO: 961776 - RNA, 23 nt, Human
guuguaauggauaaugcaaauug

SEQ ID NO: 961777 - RNA, 22 nt, Human
guuagaaagugucugcuugggu

SEQ ID NO: 961778 - RNA, 22 nt, Human
ucugagaguagagcugccucuu

SEQ ID NO: 961779 - RNA, 22 nt, Human
ugucucaguucccuucucugga

SEQ ID NO: 961780 - RNA, 22 nt, Human
cauuugaaccuggauguucuua

SEQ ID NO: 961781 - RNA, 22 nt, Human
uuugcagucuggccugcuuugg

SEQ ID NO: 961782 - RNA, 22 nt, Human
uucaaagugcauguuccucaga

SEQ ID NO: 961783 - RNA, 22 nt, Human
uuuuaugugcuggacuggcagu

SEQ ID NO: 961784 - RNA, 19 nt, Human
ccaggccaucccaguuccc

SEQ ID NO: 961785 - RNA, 22 nt, Human
uuucacauaugguuguugauug

SEQ ID NO: 961786 - RNA, 22 nt, Human
gccuggcugcuagccagaggca

SEQ ID NO: 961787 - RNA, 22 nt, Human
auguagagcaguguuguccaau

SEQ ID NO: 961788 - RNA, 22 nt, Human
acaaauguggacauggauaaug

SEQ ID NO: 961789 - RNA, 22 nt, Human
ucauuuaauagcuuuugucuuu

SEQ ID NO: 961790 - RNA, 22 nt, Human
aagagcuggaugaagaaaucaa

SEQ ID NO: 961791 - RNA, 22 nt, Human
gggcugggaauggcuaaguaug

SEQ ID NO: 961792 - RNA, 22 nt, Human
aggaggccccuccuggguugcu

SEQ ID NO: 961793 - RNA, 22 nt, Human
uggccucuuaggacauccucua

SEQ ID NO: 961794 - RNA, 22 nt, Human
gugccagcucuccccacaucug

SEQ ID NO: 961795 - RNA, 20 nt, Human
auccaugagagucuggauuc

SEQ ID NO: 961796 - RNA, 22 nt, Human
acaaagucacaauaauuaaccu

SEQ ID NO: 961797 - RNA, 22 nt, Human
gaggcccuccagcugucagcug

SEQ ID NO: 961798 - RNA, 21 nt, Human
acugggagaacgagccuuucc

SEQ ID NO: 961799 - RNA, 22 nt, Human
caccuugugauccucuugccuu

SEQ ID NO: 961800 - RNA, 22 nt, Human
uccuucagcucucuauuuagau

SEQ ID NO: 961801 - RNA, 22 nt, Human
agaacagaugugggcagaccug

SEQ ID NO: 961802 - RNA, 22 nt, Human
ugcaauaaggaguaauaguaaa

SEQ ID NO: 961803 - RNA, 22 nt, Human
uucacagucacccuucuccaug

SEQ ID NO: 961804 - RNA, 22 nt, Human
cagaggccccagaacuagcucu

SEQ ID NO: 961805 - RNA, 22 nt, Human
acucugaggcaggucagggcag

SEQ ID NO: 961806 - RNA, 22 nt, Human
uccagagguauguagagaguau

SEQ ID NO: 961807 - RNA, 22 nt, Human
gcagccaccucccauggcgggg

SEQ ID NO: 961808 - RNA, 22 nt, Human
gagguacaugaggauacacagg

SEQ ID NO: 961809 - RNA, 22 nt, Human
ggcuucaccaggugcaugcaug

SEQ ID NO: 961810 - RNA, 22 nt, Human
uuagaaaggaaucuucauuuca

SEQ ID NO: 961811 - RNA, 22 nt, Human
ugcucuggaguggcuugugcac

SEQ ID NO: 961812 - RNA, 22 nt, Human
agggcugcaccggggcuucgcg

SEQ ID NO: 961813 - RNA, 22 nt, Human
gucuucaauagagccucaauuu

SEQ ID NO: 961814 - RNA, 22 nt, Human
gccuucagcccugacuggccag

SEQ ID NO: 961815 - RNA, 22 nt, Human
cacauuugaaggaauuagcauu

SEQ ID NO: 961816 - RNA, 19 nt, Human
gcaugcuugguggcuucug

SEQ ID NO: 961817 - RNA, 22 nt, Human
ucucagagaagugaugagcaau

SEQ ID NO: 961818 - RNA, 22 nt, Human
uaaagguaugucuuaaucaaac

SEQ ID NO: 961819 - RNA, 19 nt, Human
ccucccacggauuccuucc

SEQ ID NO: 961820 - RNA, 16 nt, Human
gggagggaguuggugg

SEQ ID NO: 961821 - RNA, 22 nt, Human
augcuguggaaguuccugaagc

SEQ ID NO: 961822 - RNA, 21 nt, Human
aggagggcacaaggccaggaa

SEQ ID NO: 961823 - RNA, 22 nt, Human
uugaaagucacaauggcauuaa

SEQ ID NO: 961824 - RNA, 22 nt, Human
aacauguugcuuuaauaauauu

SEQ ID NO: 961825 - RNA, 22 nt, Human
ugaagcaggaucguuugcuuca

SEQ ID NO: 961826 - RNA, 20 nt, Human
uccaggagaacugggagccg

SEQ ID NO: 961827 - RNA, 22 nt, Human
cugcagcuguagaggacagugg

SEQ ID NO: 961828 - RNA, 22 nt, Human
auugaaagauuuugggcucaug

SEQ ID NO: 961829 - RNA, 20 nt, Human
uccaggagguuaguguggcu

SEQ ID NO: 961830 - RNA, 22 nt, Human
augaguucaauuguuucaguca

SEQ ID NO: 961831 - RNA, 22 nt, Human
cugggagcuuguuaggaaugca

SEQ ID NO: 961832 - RNA, 22 nt, Human
ugagccugcaauaagcacagcc

SEQ ID NO: 961833 - RNA, 22 nt, Human
aacaucuacagugagauguuag

SEQ ID NO: 961834 - RNA, 22 nt, Human
gcuugggacuggagaauagggu

SEQ ID NO: 961835 - RNA, 22 nt, Human
ugggcugccagcucuccagaug

SEQ ID NO: 961836 - RNA, 22 nt, Human
gcccagcuccucugcagacccu

SEQ ID NO: 961837 - RNA, 22 nt, Human
caggcuugggagcagagccacu

SEQ ID NO: 961838 - RNA, 19 nt, Human
ugugaaagcuaguguucuu

SEQ ID NO: 961839 - RNA, 22 nt, Human
gugcucuccuggcugcccugac

SEQ ID NO: 961840 - RNA, 22 nt, Human
aagugaaacauguaucucuuua

SEQ ID NO: 961841 - RNA, 22 nt, Human
uauuuccaggccccacucuaga

SEQ ID NO: 961842 - RNA, 22 nt, Human
auguuaaaugguuuauuauuaa

SEQ ID NO: 961843 - RNA, 21 nt, Human
uccauaagagaccaucuccua

SEQ ID NO: 961844 - RNA, 22 nt, Human
ucauaaaaugcuccugauauug

SEQ ID NO: 961845 - RNA, 22 nt, Human
aguuucuuuagauagaaaguuc

SEQ ID NO: 961846 - RNA, 22 nt, Human
agauggaguuaguaccagaguc

SEQ ID NO: 961847 - RNA, 22 nt, Human
ugcuucucccaaccagggccug

SEQ ID NO: 961848 - RNA, 22 nt, Human
caaggccagggaauuuuucugg

SEQ ID NO: 961849 - RNA, 19 nt, Human
ccucuccgcccaccagccc

SEQ ID NO: 961850 - RNA, 22 nt, Human
uugcuucagagggagacacuuu

SEQ ID NO: 961851 - RNA, 22 nt, Human
ucacucuguguuugaacucaag

SEQ ID NO: 961852 - RNA, 22 nt, Human
aagaacaacugcuuuaaaagca

SEQ ID NO: 961853 - RNA, 22 nt, Human
ccugugccauccugagcauccc

SEQ ID NO: 961854 - RNA, 22 nt, Human
uucuucaguguagcaacuguau

SEQ ID NO: 961855 - RNA, 22 nt, Human
gauggguggucucagacuugcc

SEQ ID NO: 961856 - RNA, 22 nt, Human
uucaagucaaggaaagaggucu

SEQ ID NO: 961857 - RNA, 23 nt, Human
uggccuggagagaaaagaugagu

SEQ ID NO: 961858 - RNA, 23 nt, Human
uugcauagacauccucauagauu

SEQ ID NO: 961859 - RNA, 22 nt, Human
ugacccauggucugaucauagg

SEQ ID NO: 961860 - RNA, 22 nt, Human
cuauuuaugugcuauuuuguau

SEQ ID NO: 961861 - RNA, 22 nt, Human
cauuuguaggaugcuucuuguu

SEQ ID NO: 961862 - RNA, 22 nt, Human
gucucagaguccuacuuauucc

SEQ ID NO: 961863 - RNA, 22 nt, Human
ucccagcgcggggggaggaucc

SEQ ID NO: 961864 - RNA, 22 nt, Human
ggcugaaguguaguggcucacu

SEQ ID NO: 961865 - RNA, 22 nt, Human
cugaggccucuguucaccagaa

SEQ ID NO: 961866 - RNA, 22 nt, Human
uugggagcuuggccgagaugua

SEQ ID NO: 961867 - RNA, 22 nt, Human
auuauguaacugugguucagca

SEQ ID NO: 961868 - RNA, 22 nt, Human
gcuggcuguguuccuucugcca

SEQ ID NO: 961869 - RNA, 22 nt, Human
uucuucaguuugguaaauguaa

SEQ ID NO: 961870 - RNA, 20 nt, Human
uucaggauucuagaccacac

SEQ ID NO: 961871 - RNA, 22 nt, Human
uaaauguggagacucaggaguc

SEQ ID NO: 961872 - RNA, 22 nt, Human
uuguaacaaucugucauaaaug

SEQ ID NO: 961873 - RNA, 22 nt, Human
cuggagagggagcccuggcagu

SEQ ID NO: 961874 - RNA, 22 nt, Human
uguccacaucacucacuuguca

SEQ ID NO: 961875 - RNA, 21 nt, Human
aggugcagagccagggaccag

SEQ ID NO: 961876 - RNA, 22 nt, Human
uauucacauucucaggccuggu

SEQ ID NO: 961877 - RNA, 22 nt, Human
ugggcugcugagaaugagagag

SEQ ID NO: 961878 - RNA, 22 nt, Human
cuuaacauccugcauuuuucuu

SEQ ID NO: 961879 - RNA, 22 nt, Human
cccaggagcuucucucugccuc

SEQ ID NO: 961880 - RNA, 22 nt, Human
ggcccuguccuggcugucuccg

SEQ ID NO: 961881 - RNA, 22 nt, Human
uauuuugacuauuaaaccaaca

SEQ ID NO: 961882 - RNA, 22 nt, Human
ggagaaggugcuggucacugug

SEQ ID NO: 961883 - RNA, 22 nt, Human
ucacucugcaggaaggagcagc

SEQ ID NO: 961884 - RNA, 22 nt, Human
gagauucuguagucaggcaucu

SEQ ID NO: 961885 - RNA, 22 nt, Human
ugucucugguauuaggugaaaa

SEQ ID NO: 961886 - RNA, 22 nt, Human
gcuggugccuuguuguuguuac

SEQ ID NO: 961887 - RNA, 22 nt, Human
auugaaagcauggauuuggauu

SEQ ID NO: 961888 - RNA, 22 nt, Human
uggcuggcccugggagugcaga

SEQ ID NO: 961889 - RNA, 22 nt, Human
uaaaguuuggcagacaauaaca

SEQ ID NO: 961890 - RNA, 22 nt, Human
uaagccugguucauaauuugcu

SEQ ID NO: 961891 - RNA, 22 nt, Human
cuuauaguaugauguugagaau

SEQ ID NO: 961892 - RNA, 17 nt, Human
agcagcuggcacaggag

SEQ ID NO: 961893 - RNA, 22 nt, Human
ccauggcauuuuaugugucuua

SEQ ID NO: 961894 - RNA, 22 nt, Human
ccuccuggcuuuucccauugaa

SEQ ID NO: 961895 - RNA, 22 nt, Human
aauucacagcauuugcccaucu

SEQ ID NO: 961896 - RNA, 22 nt, Human
agccucugucaagcuuuucaaa

SEQ ID NO: 961897 - RNA, 22 nt, Human
cucuggacacuggcaugggguc

SEQ ID NO: 961898 - RNA, 22 nt, Human
uuguaaauaguaguaagaugcc

SEQ ID NO: 961899 - RNA, 22 nt, Human
aagggagacaguugugugagga

SEQ ID NO: 961900 - RNA, 22 nt, Human
uuugcagucaaauuugcuaaau

SEQ ID NO: 961901 - RNA, 20 nt, Human
gucugaggagcagugggaaa

SEQ ID NO: 961902 - RNA, 22 nt, Human
ccagcucugccaagcgucagcu

SEQ ID NO: 961903 - RNA, 22 nt, Human
ugaggcagaaaauagcaguuca

SEQ ID NO: 961904 - RNA, 22 nt, Human
uguauuuucuucuggaagcuua

SEQ ID NO: 961905 - RNA, 22 nt, Human
aguuauucauuuauucuguaca

SEQ ID NO: 961906 - RNA, 22 nt, Human
aagaaauguagagccuaguaaa

SEQ ID NO: 961907 - RNA, 22 nt, Human
agcugccagaugacagugcuau

SEQ ID NO: 961908 - RNA, 22 nt, Human
ugggccuccaauuccagcggga

SEQ ID NO: 961909 - RNA, 22 nt, Human
agccuggaagaaccugaagucu

SEQ ID NO: 961910 - RNA, 22 nt, Human
cccaggaggcagauguugcagu

SEQ ID NO: 961911 - RNA, 21 nt, Human
ccauaccuaccucaccugguu

SEQ ID NO: 961912 - RNA, 22 nt, Human
cuccugagcucugaggaagcuu

SEQ ID NO: 961913 - RNA, 20 nt, Human
caguagcaauaauuagaagc

SEQ ID NO: 961914 - RNA, 22 nt, Human
guuucuaugguuuauauuacug

SEQ ID NO: 961915 - RNA, 18 nt, Human
aguguuaaguaaguagca

SEQ ID NO: 961916 - RNA, 22 nt, Human
gcugcuccgucugagcucuggu

SEQ ID NO: 961917 - RNA, 22 nt, Human
gccaggagaaugcuagcagagg

SEQ ID NO: 961918 - RNA, 22 nt, Human
ugucagugguagacccagaggu

SEQ ID NO: 961919 - RNA, 22 nt, Human
aagauucucagagugaaagaau

SEQ ID NO: 961920 - RNA, 22 nt, Human
uagccucucuccuccacaaccu

SEQ ID NO: 961921 - RNA, 22 nt, Human
ugggagcaggugugcuagggaa

SEQ ID NO: 961922 - RNA, 22 nt, Human
agugaguggacccugcaaggaa

SEQ ID NO: 961923 - RNA, 22 nt, Human
ucagcuccucaugcaggggaua

SEQ ID NO: 961924 - RNA, 22 nt, Human
cagagcagggugcaccuugggc

SEQ ID NO: 961925 - RNA, 22 nt, Human
auucuucauaccuacugagguu

SEQ ID NO: 961926 - RNA, 22 nt, Human
ugggaggacuugugggcuucau

SEQ ID NO: 961927 - RNA, 22 nt, Human
caguuuuuagauuaguuggugg

SEQ ID NO: 961928 - RNA, 22 nt, Human
uuggccaacauggugaaacccc

SEQ ID NO: 961929 - RNA, 22 nt, Human
ccagcuccagguagaugggcag

SEQ ID NO: 961930 - RNA, 22 nt, Human
uugcacagaugagggugaugcu

SEQ ID NO: 961931 - RNA, 22 nt, Human
aaaaguucccugguuagaaaag

SEQ ID NO: 961932 - RNA, 22 nt, Human
ggccugagucacaucaggagag

SEQ ID NO: 961933 - RNA, 21 nt, Human
acaugucucuaaucucaguga

SEQ ID NO: 961934 - RNA, 22 nt, Human
aggcacagagaaugcccuccau

SEQ ID NO: 961935 - RNA, 22 nt, Human
ugcauccuuaaccagcaucacu

SEQ ID NO: 961936 - RNA, 22 nt, Human
cucacuguccaacaggcuuuac

SEQ ID NO: 961937 - RNA, 23 nt, Human
uucaagauacgguuuccaggcug

SEQ ID NO: 961938 - RNA, 22 nt, Human
aaaggccaccaacaugaagcau

SEQ ID NO: 961939 - RNA, 22 nt, Human
gucuugaucuccugaccuugug

SEQ ID NO: 961940 - RNA, 22 nt, Human
aagcuggcaauuaucaaaacug

SEQ ID NO: 961941 - RNA, 21 nt, Human
gcagcaguguucuagaauacu

SEQ ID NO: 961942 - RNA, 22 nt, Human
gcagacauuuugaaucuaggcu

SEQ ID NO: 961943 - RNA, 22 nt, Human
uucuuuuccuacacagcgauuu

SEQ ID NO: 961944 - RNA, 22 nt, Human
ucauugcagaaauaaaggugaa

SEQ ID NO: 961945 - RNA, 21 nt, Human
aaagagguuaauauuguaagu

SEQ ID NO: 961946 - RNA, 22 nt, Human
gcacucugccaggucuccugau

SEQ ID NO: 961947 - RNA, 22 nt, Human
ucccagccuuccuuguggugaa

SEQ ID NO: 961948 - RNA, 22 nt, Human
ucaguauccacaaaugcucaaa

SEQ ID NO: 961949 - RNA, 22 nt, Human
guaacagaggguuugcagauau

SEQ ID NO: 961950 - RNA, 22 nt, Human
uugaagcaggaaaauuucuauu

SEQ ID NO: 961951 - RNA, 22 nt, Human
ggaggccaucuggcuggaggcu

SEQ ID NO: 961952 - RNA, 22 nt, Human
uacauagcaaggaaaugacaga

SEQ ID NO: 961953 - RNA, 22 nt, Human
gaagagcuuaguuguccuagaa

SEQ ID NO: 961954 - RNA, 22 nt, Human
gccuucugcgcucgugucuccg

SEQ ID NO: 961955 - RNA, 22 nt, Human
gccaggcacaguucuaggugcu

SEQ ID NO: 961956 - RNA, 22 nt, Human
gucccagggagguucagggcuu

SEQ ID NO: 961957 - RNA, 22 nt, Human
ugauuuccuggcuuuggaguuc

SEQ ID NO: 961958 - RNA, 22 nt, Human
caggaugggugucggccagcac

SEQ ID NO: 961959 - RNA, 22 nt, Human
agcacucuucugugauaguugu

SEQ ID NO: 961960 - RNA, 22 nt, Human
acuuuggaucugauguaaucag

SEQ ID NO: 961961 - RNA, 22 nt, Human
auugaaagguuuugagcagaua

SEQ ID NO: 961962 - RNA, 19 nt, Human
ugaagcagcaaacucucag

SEQ ID NO: 961963 - RNA, 19 nt, Human
gagcgcagagggcagggga

SEQ ID NO: 961964 - RNA, 22 nt, Human
cacauaaguggguuccauugca

SEQ ID NO: 961965 - RNA, 22 nt, Human
ugacaauacagagagagcaaaa

SEQ ID NO: 961966 - RNA, 22 nt, Human
gcucuggcuacuguggcuaccg

SEQ ID NO: 961967 - RNA, 22 nt, Human
cuaauacacccuauugcuuguu

SEQ ID NO: 961968 - RNA, 22 nt, Human
ucuuucaaugagcauucuuucc

SEQ ID NO: 961969 - RNA, 21 nt, Human
ucuggagcccuaagcugagaa

SEQ ID NO: 961970 - RNA, 22 nt, Human
ccagcuggucugugcucauguu

SEQ ID NO: 961971 - RNA, 22 nt, Human
cccaggagagggaaccaaaugu

SEQ ID NO: 961972 - RNA, 22 nt, Human
ccuggccagaggcgugccugug

SEQ ID NO: 961973 - RNA, 22 nt, Human
ccagcccuccuccaucagagga

SEQ ID NO: 961974 - RNA, 22 nt, Human
ggcagcugugaagugccucaca

SEQ ID NO: 961975 - RNA, 22 nt, Human
caguggguaggaaaggcucuuc

SEQ ID NO: 961976 - RNA, 22 nt, Human
auucauaacggcaaaugucacc

SEQ ID NO: 961977 - RNA, 22 nt, Human
cagcagagcuuauguuggguca

SEQ ID NO: 961978 - RNA, 22 nt, Human
gccucaggacuggcauacucau

SEQ ID NO: 961979 - RNA, 22 nt, Human
uuacacaacaucuguauuauua

SEQ ID NO: 961980 - RNA, 22 nt, Human
ggagccugugcccaagcccaga

SEQ ID NO: 961981 - RNA, 22 nt, Human
gugcugggauuacaggugugag

SEQ ID NO: 961982 - RNA, 22 nt, Human
agggccagaggcaccuugcagc

SEQ ID NO: 961983 - RNA, 22 nt, Human
uuccauaaugagauucccagcc

SEQ ID NO: 961984 - RNA, 22 nt, Human
gaggcccucuugccacaaugaa

SEQ ID NO: 961985 - RNA, 22 nt, Human
acuuugaaacuaaaauucauua

SEQ ID NO: 961986 - RNA, 22 nt, Human
gaaauacaaaugccuagauccu

SEQ ID NO: 961987 - RNA, 22 nt, Human
cagcuacuccucccaugacuuc

SEQ ID NO: 961988 - RNA, 22 nt, Human
ugccuguccugaggaugagggu

SEQ ID NO: 961989 - RNA, 22 nt, Human
uucucuuauucuggauaugcag

SEQ ID NO: 961990 - RNA, 22 nt, Human
uuauuagagugcuuugagaaag

SEQ ID NO: 961991 - RNA, 22 nt, Human
uucaggauggaguaccuuuuau

SEQ ID NO: 961992 - RNA, 22 nt, Human
ucucuggaauuuugagagugac

SEQ ID NO: 961993 - RNA, 22 nt, Human
auuucuguaacuuaugaaaguu

SEQ ID NO: 961994 - RNA, 22 nt, Human
uggaaggaaagguagcagagaa

SEQ ID NO: 961995 - RNA, 22 nt, Human
cugccagcucgccacaaugaca

SEQ ID NO: 961996 - RNA, 22 nt, Human
ggucccaggcugcgggcuggug

SEQ ID NO: 961997 - RNA, 22 nt, Human
cucagcucuuuauacuagcugu

SEQ ID NO: 961998 - RNA, 22 nt, Human
ccuggccacucagguguggggc

SEQ ID NO: 961999 - RNA, 22 nt, Human
augucacagucugacucaguga

SEQ ID NO: 962000 - RNA, 22 nt, Human
caagaugugccuaaucagaccu

SEQ ID NO: 962001 - RNA, 22 nt, Human
uuauuuaaaagugguaagauuc

SEQ ID NO: 962002 - RNA, 22 nt, Human
uuccauaauaaccugagagaaa

SEQ ID NO: 962003 - RNA, 22 nt, Human
cuaugaaaugucagauucugca

SEQ ID NO: 962004 - RNA, 22 nt, Human
ggucucagcaguugcuuugacu

SEQ ID NO: 962005 - RNA, 22 nt, Human
ugcagggcuacaggacuacaac

SEQ ID NO: 962006 - RNA, 22 nt, Human
aagauguguccauucuuugcuc

SEQ ID NO: 962007 - RNA, 22 nt, Human
aaauaguuacuucugcugucuu

SEQ ID NO: 962008 - RNA, 19 nt, Human
uuggaaggagccagagugg

SEQ ID NO: 962009 - RNA, 22 nt, Human
ucagcagcagcucagcauguuu

SEQ ID NO: 962010 - RNA, 22 nt, Human
gcugcucugugacagccuccgg

SEQ ID NO: 962011 - RNA, 22 nt, Human
ucaguuuuaagguuugagaauu

SEQ ID NO: 962012 - RNA, 22 nt, Human
acugagcucuugacugggaguu

SEQ ID NO: 962013 - RNA, 19 nt, Human
uugaggggccaggggagau

SEQ ID NO: 962014 - RNA, 22 nt, Human
uguguguauaugcauuuaucua

SEQ ID NO: 962015 - RNA, 22 nt, Human
gaaggagagggucaaggauaau

SEQ ID NO: 962016 - RNA, 22 nt, Human
agagcuguuuggacaucugagu

SEQ ID NO: 962017 - RNA, 22 nt, Human
uuucuuuaucauagcaucuuug

SEQ ID NO: 962018 - RNA, 22 nt, Human
uucuuuccccauggaguucgga

SEQ ID NO: 962019 - RNA, 22 nt, Human
gugcaguggcagauccuagcuc

SEQ ID NO: 962020 - RNA, 22 nt, Human
uuuuaugauugagcuggcuaca

SEQ ID NO: 962021 - RNA, 22 nt, Human
gugcucuggcuggucucccggu

SEQ ID NO: 962022 - RNA, 17 nt, Human
caaggccagcaucuuca

SEQ ID NO: 962023 - RNA, 22 nt, Human
gagcuuggugaugccuccuggu

SEQ ID NO: 962024 - RNA, 22 nt, Human
gggugacauuucccaaugagcc

SEQ ID NO: 962025 - RNA, 22 nt, Human
uagcuuuguuagaaugucuuca

SEQ ID NO: 962026 - RNA, 22 nt, Human
cugcagugcaagcccagaugga

SEQ ID NO: 962027 - RNA, 22 nt, Human
acaggugauucaggcucuggga

SEQ ID NO: 962028 - RNA, 22 nt, Human
uucuuguaauuuggagaaauga

SEQ ID NO: 962029 - RNA, 20 nt, Human
cagagacccaggcuucagcu

SEQ ID NO: 962030 - RNA, 22 nt, Human
cuggccaaugccuggggaauag

SEQ ID NO: 962031 - RNA, 23 nt, Human
cauuugauccucacaauaaaugg

SEQ ID NO: 962032 - RNA, 22 nt, Human
cagggagcuggcuggcgugagu

SEQ ID NO: 962033 - RNA, 22 nt, Human
auuaaaauuccaagguaugcca

SEQ ID NO: 962034 - RNA, 22 nt, Human
agaaaaggcuugaagagguuuu

SEQ ID NO: 962035 - RNA, 22 nt, Human
cuccagaagacccauccucaug

SEQ ID NO: 962036 - RNA, 19 nt, Human
ugcuuccucaccaucuccc

SEQ ID NO: 962037 - RNA, 22 nt, Human
agagcuggguggacuuguaguu

SEQ ID NO: 962038 - RNA, 22 nt, Human
gcaggggcuacucugagcuucc

SEQ ID NO: 962039 - RNA, 22 nt, Human
ggaggggucucuagcgaggaga

SEQ ID NO: 962040 - RNA, 22 nt, Human
caggagcuacucagguuggguu

SEQ ID NO: 962041 - RNA, 22 nt, Human
uaauuauuaugacaacaauugc

SEQ ID NO: 962042 - RNA, 22 nt, Human
ggcccucccugagccagguggg

SEQ ID NO: 962043 - RNA, 22 nt, Human
cggggcugcucguccuccugug

SEQ ID NO: 962044 - RNA, 22 nt, Human
agcuggccuucggugucacugg

SEQ ID NO: 962045 - RNA, 22 nt, Human
gccuguguggaugcgccggugc

SEQ ID NO: 962046 - RNA, 22 nt, Human
uuggcacacaguaagcccuaag

SEQ ID NO: 962047 - RNA, 22 nt, Human
ucugcugugggucuauauuuua

SEQ ID NO: 962048 - RNA, 22 nt, Human
cuggacagaaaaggccacugga

SEQ ID NO: 962049 - RNA, 22 nt, Human
ugugugcagccucugucuuugg

SEQ ID NO: 962050 - RNA, 22 nt, Human
ucucucagcuuugagaccugcu

SEQ ID NO: 962051 - RNA, 22 nt, Human
cagagcagugaggaguugugua

SEQ ID NO: 962052 - RNA, 22 nt, Human
uaccucacugggccucaguuuu

SEQ ID NO: 962053 - RNA, 22 nt, Human
ggcugaaggaugaaagcugcag

SEQ ID NO: 962054 - RNA, 22 nt, Human
cuggccuaaaauugcuucugca

SEQ ID NO: 962055 - RNA, 22 nt, Human
cuuaggauuuaauuucagacuc

SEQ ID NO: 962056 - RNA, 22 nt, Human
uauagcaagcaggacagucuca

SEQ ID NO: 962057 - RNA, 22 nt, Human
acagcugggugcugcucagagc

SEQ ID NO: 962058 - RNA, 22 nt, Human
ggaggccaguccuggccgggcu

SEQ ID NO: 962059 - RNA, 22 nt, Human
ucccaggacaugggcucugcuc

SEQ ID NO: 962060 - RNA, 22 nt, Human
uaccaggcagcugcacagaggc

SEQ ID NO: 962061 - RNA, 22 nt, Human
ugaaggaaaugacggcagaaga

SEQ ID NO: 962062 - RNA, 20 nt, Human
caggccucugggggcccugg

SEQ ID NO: 962063 - RNA, 22 nt, Human
aaaugucuuuaucucauguaac

SEQ ID NO: 962064 - RNA, 19 nt, Human
uccugggcugggccagguc

SEQ ID NO: 962065 - RNA, 22 nt, Human
aagcccagaugugagaacugag

SEQ ID NO: 962066 - RNA, 22 nt, Human
gccuggugcuaugagggccagc

SEQ ID NO: 962067 - RNA, 22 nt, Human
acccacgaagaugagcggcaug

SEQ ID NO: 962068 - RNA, 22 nt, Human
agagccugcaucaggcuugggg

SEQ ID NO: 962069 - RNA, 22 nt, Human
uggcagggccuaccccaauauc

SEQ ID NO: 962070 - RNA, 22 nt, Human
gaggaaaauggaguguaauuaa

SEQ ID NO: 962071 - RNA, 22 nt, Human
uucuacaauaugaauaaugaag

SEQ ID NO: 962072 - RNA, 22 nt, Human
acacaggagauauguaauggcu

SEQ ID NO: 962073 - RNA, 22 nt, Human
aggaagccuggggcugcccucg

SEQ ID NO: 962074 - RNA, 22 nt, Human
ucccagaggcuccagucucuau

SEQ ID NO: 962075 - RNA, 22 nt, Human
agucucagcaagcauggcuagu

SEQ ID NO: 962076 - RNA, 17 nt, Human
uccaugagacaugaaga

SEQ ID NO: 962077 - RNA, 22 nt, Human
cacagaggacuguagcggggag

SEQ ID NO: 962078 - RNA, 23 nt, Human
uggauaaagcugugcugcauagg

SEQ ID NO: 962079 - RNA, 19 nt, Human
uagcagcugccaaaggaga

SEQ ID NO: 962080 - RNA, 22 nt, Human
aggcagcugaccacaguaugau

SEQ ID NO: 962081 - RNA, 19 nt, Human
ugagaaggcaguggggagc

SEQ ID NO: 962082 - RNA, 22 nt, Human
aagggcugccagggggugccag

SEQ ID NO: 962083 - RNA, 20 nt, Human
gcccaagguccagaaggggg

SEQ ID NO: 962084 - RNA, 22 nt, Human
agcuggaggggccagcaggugu

SEQ ID NO: 962085 - RNA, 22 nt, Human
gccaggguggcagaaggcccca

SEQ ID NO: 962086 - RNA, 22 nt, Human
cacccacccacugcucauuggc

SEQ ID NO: 962087 - RNA, 22 nt, Human
ggccugugucugugccuguccu

SEQ ID NO: 962088 - RNA, 22 nt, Human
uguguacuugaaagggcagguc

SEQ ID NO: 962089 - RNA, 22 nt, Human
caaaauugauuguggugauggu

SEQ ID NO: 962090 - RNA, 22 nt, Human
acauuucuuugcuagacagcag

SEQ ID NO: 962091 - RNA, 23 nt, Human
ggccauggagacuuagaaugggc

SEQ ID NO: 962092 - RNA, 22 nt, Human
accugaggcuguuagucuaggu

SEQ ID NO: 962093 - RNA, 22 nt, Human
auuucccaugugaaucaauugg

SEQ ID NO: 962094 - RNA, 17 nt, Human
uucucuuccuggauagu

SEQ ID NO: 962095 - RNA, 22 nt, Human
ggcuccagggaguggagagaag

SEQ ID NO: 962096 - RNA, 22 nt, Human
agcagcucuguuuaccuggagg

SEQ ID NO: 962097 - RNA, 22 nt, Human
aggauuuugacuuauucaggga

SEQ ID NO: 962098 - RNA, 22 nt, Human
acagcaagccagcuugucacug

SEQ ID NO: 962099 - RNA, 22 nt, Human
aggcagcagugauaagauagga

SEQ ID NO: 962100 - RNA, 22 nt, Human
caaggccagagccagcgauaag

SEQ ID NO: 962101 - RNA, 22 nt, Human
aaucagaaagaggucauguugc

SEQ ID NO: 962102 - RNA, 22 nt, Human
ggccugagcuugggcagcguau

SEQ ID NO: 962103 - RNA, 22 nt, Human
cagucccagcugcucagaaggc

SEQ ID NO: 962104 - RNA, 22 nt, Human
gcugcccucccagggcaagcuu

SEQ ID NO: 962105 - RNA, 22 nt, Human
aggcuggagggcaauggcaaga

SEQ ID NO: 962106 - RNA, 22 nt, Human
gcagcuccuucaaucucaccau

SEQ ID NO: 962107 - RNA, 21 nt, Human
guuuuaagggagaaaaccuag

SEQ ID NO: 962108 - RNA, 21 nt, Human
gcaaauguucaggaaaaaaga

SEQ ID NO: 962109 - RNA, 22 nt, Human
agugaaauccuggucaacaggu

SEQ ID NO: 962110 - RNA, 22 nt, Human
gggcugcugcccaggaggcacc

SEQ ID NO: 962111 - RNA, 22 nt, Human
aggcagcuggcaaauucuagag

SEQ ID NO: 962112 - RNA, 22 nt, Human
acacauauucauauguacuuac

SEQ ID NO: 962113 - RNA, 22 nt, Human
uauguacagggauagaacuuga

SEQ ID NO: 962114 - RNA, 22 nt, Human
cccaggaggucgaagcugcagu

SEQ ID NO: 962115 - RNA, 22 nt, Human
cccagaaggucgaggcugcagu

SEQ ID NO: 962116 - RNA, 22 nt, Human
ugggggugugccagggaccucc

SEQ ID NO: 962117 - RNA, 22 nt, Human
uuguuacacauaauaacauuuu

SEQ ID NO: 962118 - RNA, 22 nt, Human
aacuccuguucuaugacaagag

SEQ ID NO: 962119 - RNA, 22 nt, Human
gcccaggaagccaccgggaagu

SEQ ID NO: 962120 - RNA, 22 nt, Human
uacuuacagagcuuauaaguua

SEQ ID NO: 962121 - RNA, 19 nt, Human
cuggugcuugagugaguca

SEQ ID NO: 962122 - RNA, 22 nt, Human
auguuacauaguccuuauuugu

SEQ ID NO: 962123 - RNA, 22 nt, Human
aaggccagaguacuagaggcug

SEQ ID NO: 962124 - RNA, 22 nt, Human
aguguacauguuuacagcaucu

SEQ ID NO: 962125 - RNA, 22 nt, Human
uccuggaguugugcagugcaca

SEQ ID NO: 962126 - RNA, 22 nt, Human
auuuaagacugacuucaccagu

SEQ ID NO: 962127 - RNA, 22 nt, Human
gcugugugaaaacugggccugg

SEQ ID NO: 962128 - RNA, 22 nt, Human
agcagcucacaggauuccugaa

SEQ ID NO: 962129 - RNA, 20 nt, Human
gccagcccugacacaggagc

SEQ ID NO: 962130 - RNA, 21 nt, Human
guggcccugccgcagugucca

SEQ ID NO: 962131 - RNA, 22 nt, Human
ugggguggauagaaagugaugu

SEQ ID NO: 962132 - RNA, 22 nt, Human
auaucacaguaguuguuuaguu

SEQ ID NO: 962133 - RNA, 22 nt, Human
gaggaaagcugguuuaaaguau

SEQ ID NO: 962134 - RNA, 22 nt, Human
caccagagugggugagggugau

SEQ ID NO: 962135 - RNA, 22 nt, Human
gcagagugagccgaggcugcuc

SEQ ID NO: 962136 - RNA, 22 nt, Human
uauugacaauuugugaaacuau

SEQ ID NO: 962137 - RNA, 22 nt, Human
ugagccagccuugcagcugugc

SEQ ID NO: 962138 - RNA, 22 nt, Human
uuuccucuuauacaguguuuau

SEQ ID NO: 962139 - RNA, 21 nt, Human
cuugaaagguagagucuacag

SEQ ID NO: 962140 - RNA, 22 nt, Human
ucuucagagugaaagucuguga

SEQ ID NO: 962141 - RNA, 22 nt, Human
uggcucagagccuugagagcug

SEQ ID NO: 962142 - RNA, 22 nt, Human
ccagcgcuucccaucagggagg

SEQ ID NO: 962143 - RNA, 22 nt, Human
caaggccauauugccuguaugu

SEQ ID NO: 962144 - RNA, 22 nt, Human
uuuauuuggcaucucugccaag

SEQ ID NO: 962145 - RNA, 22 nt, Human
agugcugucaguuuuauagaua

SEQ ID NO: 962146 - RNA, 22 nt, Human
guaauuuuuaguucauucuauc

SEQ ID NO: 962147 - RNA, 22 nt, Human
ucaggagucugugcaguuccac

SEQ ID NO: 962148 - RNA, 22 nt, Human
ucagaggaauaaugcugcauuu

SEQ ID NO: 962149 - RNA, 22 nt, Human
cagaggaguucaguacacagcc

SEQ ID NO: 962150 - RNA, 22 nt, Human
ggaggacaggggcugcagcaca

SEQ ID NO: 962151 - RNA, 22 nt, Human
aguucucauugcaugagacaga

SEQ ID NO: 962152 - RNA, 22 nt, Human
cugcuuuggacaacuauucuug

SEQ ID NO: 962153 - RNA, 22 nt, Human
aucagacucagaaaugacgugg

SEQ ID NO: 962154 - RNA, 22 nt, Human
ugcugucuuccaggauggugaa

SEQ ID NO: 962155 - RNA, 22 nt, Human
ucaaaaguuucacauagagaua

SEQ ID NO: 962156 - RNA, 22 nt, Human
aggccuggcaugagaccugaga

SEQ ID NO: 962157 - RNA, 20 nt, Human
ucuggcucuuugcuccuccc

SEQ ID NO: 962158 - RNA, 22 nt, Human
cuccauugaacauccucucaga

SEQ ID NO: 962159 - RNA, 19 nt, Human
uucccaggaaaggggugca

SEQ ID NO: 962160 - RNA, 22 nt, Human
uuauuuaaugugaucugaagag

SEQ ID NO: 962161 - RNA, 22 nt, Human
acugccugugucccuucagugc

SEQ ID NO: 962162 - RNA, 22 nt, Human
gaaaaguacacagcccaaacau

SEQ ID NO: 962163 - RNA, 22 nt, Human
uucacauuaucaggauuguuuc

SEQ ID NO: 962164 - RNA, 22 nt, Human
gcagcuccuggcacaguuuuuu

SEQ ID NO: 962165 - RNA, 22 nt, Human
agagggagugaaauggaauaga

SEQ ID NO: 962166 - RNA, 20 nt, Human
auuuggcaugaaguauugau

SEQ ID NO: 962167 - RNA, 22 nt, Human
uugcaaauuauuuuagucccuu

SEQ ID NO: 962168 - RNA, 22 nt, Human
gggcaguuuauucuagaugguu

SEQ ID NO: 962169 - RNA, 22 nt, Human
aggcacuguggguguggccgga

SEQ ID NO: 962170 - RNA, 22 nt, Human
aauaaaauggucaguuuucuca

SEQ ID NO: 962171 - RNA, 22 nt, Human
caggcagcucaaccuugggagc

SEQ ID NO: 962172 - RNA, 22 nt, Human
acacaggaagucagcacugaug

SEQ ID NO: 962173 - RNA, 22 nt, Human
gcagccacugggagugcuuaua

SEQ ID NO: 962174 - RNA, 22 nt, Human
uugugcauuucucugagugugu

SEQ ID NO: 962175 - RNA, 22 nt, Human
ggagucagccugucagagugua

SEQ ID NO: 962176 - RNA, 18 nt, Human
gagcccugagucugcaca

SEQ ID NO: 962177 - RNA, 22 nt, Human
ccuggcuccugccucugcaggg

SEQ ID NO: 962178 - RNA, 22 nt, Human
agcaggcuuucaagagucuucu

SEQ ID NO: 962179 - RNA, 22 nt, Human
cauagcaacagcaucaagucaa

SEQ ID NO: 962180 - RNA, 22 nt, Human
cacauguacagaagcaggcugg

SEQ ID NO: 962181 - RNA, 22 nt, Human
aggaagcugcuggaguagugug

SEQ ID NO: 962182 - RNA, 22 nt, Human
uuggccaaacagaguucaacag

SEQ ID NO: 962183 - RNA, 22 nt, Human
gccggggcuggggagagacaug

SEQ ID NO: 962184 - RNA, 22 nt, Human
uggcacauagcagguacucagu

SEQ ID NO: 962185 - RNA, 19 nt, Human
cucuggccucuggaugcug

SEQ ID NO: 962186 - RNA, 22 nt, Human
cuuauguauauuuggaacguac

SEQ ID NO: 962187 - RNA, 22 nt, Human
gugcucacugugagacguccug

SEQ ID NO: 962188 - RNA, 21 nt, Human
auggagggaccagggaagcag

SEQ ID NO: 962189 - RNA, 22 nt, Human
agugucugccagcugccaggug

SEQ ID NO: 962190 - RNA, 22 nt, Human
ugucccagcacuuugggagucu

SEQ ID NO: 962191 - RNA, 18 nt, Human
cuguucuagaacuccugu

SEQ ID NO: 962192 - RNA, 22 nt, Human
ucucuggaagcgcagaucuguu

SEQ ID NO: 962193 - RNA, 22 nt, Human
uuagcugacugugugauuuggc

SEQ ID NO: 962194 - RNA, 22 nt, Human
ugcacagagagaugagacacgu

SEQ ID NO: 962195 - RNA, 22 nt, Human
aggccuggccuuuauguucaag

SEQ ID NO: 962196 - RNA, 22 nt, Human
aaauccuaaggagaauaugauu

SEQ ID NO: 962197 - RNA, 22 nt, Human
agaagcaguuauuuuuugcaca

SEQ ID NO: 962198 - RNA, 22 nt, Human
agccaaagaucagugugcaagu

SEQ ID NO: 962199 - RNA, 21 nt, Human
ccagcagcucaaggaucucuu

SEQ ID NO: 962200 - RNA, 22 nt, Human
ucagucuuugcuuaugacaaua

SEQ ID NO: 962201 - RNA, 21 nt, Human
aggucccagguuugggcagca

SEQ ID NO: 962202 - RNA, 22 nt, Human
uugcauuuuuagaugcuucugu

SEQ ID NO: 962203 - RNA, 22 nt, Human
ugcauguguuugccacagugag

SEQ ID NO: 962204 - RNA, 22 nt, Human
gagagcugggcuuugggugaag

SEQ ID NO: 962205 - RNA, 22 nt, Human
cuuccugguuugaagcucgccg

SEQ ID NO: 962206 - RNA, 22 nt, Human
gcagcugggacacugaggccag

SEQ ID NO: 962207 - RNA, 22 nt, Human
gugcagcugcaggagucagguc

SEQ ID NO: 962208 - RNA, 21 nt, Human
ugcaggaaagugcugcgaccc

SEQ ID NO: 962209 - RNA, 19 nt, Human
acagggcagcaauaggaua

SEQ ID NO: 962210 - RNA, 22 nt, Human
uauacagaaccgccugaagucu

SEQ ID NO: 962211 - RNA, 22 nt, Human
cuccugggcucauaucauucag

SEQ ID NO: 962212 - RNA, 22 nt, Human
gagccaggggucagcuccgagg

SEQ ID NO: 962213 - RNA, 22 nt, Human
gaaauauuucucuugagccccu

SEQ ID NO: 962214 - RNA, 22 nt, Human
acguuuucagccuuaauguaga

SEQ ID NO: 962215 - RNA, 22 nt, Human
ucugccuugagguccucagcuc

SEQ ID NO: 962216 - RNA, 22 nt, Human
uucuuaacucaaauauauaucc

SEQ ID NO: 962217 - RNA, 22 nt, Human
aggcugaggcagguggaucacu

SEQ ID NO: 962218 - RNA, 22 nt, Human
uuugaagugggcauuagaaccu

SEQ ID NO: 962219 - RNA, 22 nt, Human
uuugcaaagaaauuauugcugu

SEQ ID NO: 962220 - RNA, 19 nt, Human
gcugggagcagacccuccc

SEQ ID NO: 962221 - RNA, 22 nt, Human
auguguauugagcaccuacugc

SEQ ID NO: 962222 - RNA, 21 nt, Human
cuggccgaccccucugugcuc

SEQ ID NO: 962223 - RNA, 20 nt, Human
uggccuuggggagcucacac

SEQ ID NO: 962224 - RNA, 20 nt, Human
uaucaaucagaaagaagacu

SEQ ID NO: 962225 - RNA, 22 nt, Human
aaagaacaaaugauauaugguu

SEQ ID NO: 962226 - RNA, 22 nt, Human
agcugcugaaugacacugcaag

SEQ ID NO: 962227 - RNA, 22 nt, Human
ggcucuggucagugaggggccu

SEQ ID NO: 962228 - RNA, 22 nt, Human
ugcugccaagcccgugcuccug

SEQ ID NO: 962229 - RNA, 22 nt, Human
guaaaucccauccuuucucugg

SEQ ID NO: 962230 - RNA, 23 nt, Human
ugccucugccucccuagucugca

SEQ ID NO: 962231 - RNA, 22 nt, Human
cccagcagaaucugaugagggc

SEQ ID NO: 962232 - RNA, 22 nt, Human
augcuguguccuagugaaagaa

SEQ ID NO: 962233 - RNA, 18 nt, Human
aggcuucuuggcucaguc

SEQ ID NO: 962234 - RNA, 22 nt, Human
gagagcugggggacuguggaug

SEQ ID NO: 962235 - RNA, 22 nt, Human
acucugccaucccaggugcugu

SEQ ID NO: 962236 - RNA, 22 nt, Human
uuuuaagaugcuaguauuucag

SEQ ID NO: 962237 - RNA, 22 nt, Human
cauuaagucuguuaacuggaga

SEQ ID NO: 962238 - RNA, 22 nt, Human
aggcucuggcuacuacagagcu

SEQ ID NO: 962239 - RNA, 22 nt, Human
gaugguuuggaaugaaguagcu

SEQ ID NO: 962240 - RNA, 19 nt, Human
ucuuuggcuaaauugggug

SEQ ID NO: 962241 - RNA, 22 nt, Human
caggcugaucagggcugggaug

SEQ ID NO: 962242 - RNA, 22 nt, Human
cccuggaagguucucuggcuca

SEQ ID NO: 962243 - RNA, 22 nt, Human
uguggcuuaagaaugccuuuaa

SEQ ID NO: 962244 - RNA, 22 nt, Human
cggcuggguucggcugcaggcc

SEQ ID NO: 962245 - RNA, 18 nt, Human
cucagggcaucagucugg

SEQ ID NO: 962246 - RNA, 22 nt, Human
cuucccagacgggguggcagcc

SEQ ID NO: 962247 - RNA, 22 nt, Human
uguuugaacugaauaacauagu

SEQ ID NO: 962248 - RNA, 22 nt, Human
cagaagcuuugcucauaaccau

SEQ ID NO: 962249 - RNA, 22 nt, Human
ccugucuguaucgguucagagu

SEQ ID NO: 962250 - RNA, 22 nt, Human
augcagguugggcaaguguggg

SEQ ID NO: 962251 - RNA, 22 nt, Human
cccugccuucuuggccuuuaaa

SEQ ID NO: 962252 - RNA, 22 nt, Human
acagaacugcaggaggaaaagc

SEQ ID NO: 962253 - RNA, 22 nt, Human
guuauaaauaccuaauaggauu

SEQ ID NO: 962254 - RNA, 22 nt, Human
augucuuucgcaucaguagcua

SEQ ID NO: 962255 - RNA, 22 nt, Human
gcuucccagcagaggaaagacu

SEQ ID NO: 962256 - RNA, 22 nt, Human
cugggagaggaaccucgagggu

SEQ ID NO: 962257 - RNA, 22 nt, Human
cugcucuggcguacucggcauc

SEQ ID NO: 962258 - RNA, 23 nt, Human
cugcagucgccggccugggugcc

SEQ ID NO: 962259 - RNA, 22 nt, Human
aaaauugaagugaucaggaacu

SEQ ID NO: 962260 - RNA, 22 nt, Human
ucugccuggauuccauucucca

SEQ ID NO: 962261 - RNA, 22 nt, Human
gcugggcugagcuagacuuggc

SEQ ID NO: 962262 - RNA, 22 nt, Human
ggcuuccuggggccuccugcaa

SEQ ID NO: 962263 - RNA, 22 nt, Human
ugaacagaucaauagaacugac

SEQ ID NO: 962264 - RNA, 22 nt, Human
cugccuggcuaaacucaagucg

SEQ ID NO: 962265 - RNA, 20 nt, Human
ugcucugucuaaaacuuccc

SEQ ID NO: 962266 - RNA, 22 nt, Human
ucagccagguaauguggagaug

SEQ ID NO: 962267 - RNA, 22 nt, Human
cugaggugcuauggaggauacg

SEQ ID NO: 962268 - RNA, 22 nt, Human
cuggccaacaucuggggcacau

SEQ ID NO: 962269 - RNA, 22 nt, Human
gccuccugagaagccacaggcu

SEQ ID NO: 962270 - RNA, 22 nt, Human
cugagggcaugaacauuccaua

SEQ ID NO: 962271 - RNA, 22 nt, Human
gggcagagacucagaaacagaa

SEQ ID NO: 962272 - RNA, 22 nt, Human
ggaccagagaagugagcaccug

SEQ ID NO: 962273 - RNA, 22 nt, Human
gccucugcaucaucacuccagc

SEQ ID NO: 962274 - RNA, 21 nt, Human
uccuccuucaaguccuggccu

SEQ ID NO: 962275 - RNA, 18 nt, Human
ugucauugccagggaagc

SEQ ID NO: 962276 - RNA, 22 nt, Human
gcugggcaccucucccagauug

SEQ ID NO: 962277 - RNA, 22 nt, Human
ugauuuuuagcuauucugaaga

SEQ ID NO: 962278 - RNA, 22 nt, Human
acagugcuggcuacaacccugg

SEQ ID NO: 962279 - RNA, 22 nt, Human
caguuuuucaaaauuacaugau

SEQ ID NO: 962280 - RNA, 22 nt, Human
gcucuccaaacccuguggcuuu

SEQ ID NO: 962281 - RNA, 20 nt, Human
auauguguacguguauacau

SEQ ID NO: 962282 - RNA, 22 nt, Human
acagcugugaaaauccacagga

SEQ ID NO: 962283 - RNA, 20 nt, Human
uccuucaggcagggccuagu

SEQ ID NO: 962284 - RNA, 22 nt, Human
uuauuuucagcuaggaaagcca

SEQ ID NO: 962285 - RNA, 22 nt, Human
acuccugggugcugaccagcgu

SEQ ID NO: 962286 - RNA, 22 nt, Human
gcaggccucuguugagggccuu

SEQ ID NO: 962287 - RNA, 22 nt, Human
aggcuggcuggcaggggacaca

SEQ ID NO: 962288 - RNA, 22 nt, Human
gggcagcugcagggauggugac

SEQ ID NO: 962289 - RNA, 22 nt, Human
ucaaggcuaaacuuucagagua

SEQ ID NO: 962290 - RNA, 22 nt, Human
aggcagcaugcucugcuucuac

SEQ ID NO: 962291 - RNA, 22 nt, Human
cugagaaggaagccuccacucu

SEQ ID NO: 962292 - RNA, 22 nt, Human
agcaccuugcucuuggccuucc

SEQ ID NO: 962293 - RNA, 22 nt, Human
gcucacagccggcuggcagggg

SEQ ID NO: 962294 - RNA, 18 nt, Human
uuuaugagcugugggacc

SEQ ID NO: 962295 - RNA, 22 nt, Human
gaacccaguccaggugcagccu

SEQ ID NO: 962296 - RNA, 22 nt, Human
uccuugggaaaucacuagcacu

SEQ ID NO: 962297 - RNA, 22 nt, Human
aggggagaguuaaugugaaugu

SEQ ID NO: 962298 - RNA, 22 nt, Human
uaaggccaauuaacaaccaggg

SEQ ID NO: 962299 - RNA, 22 nt, Human
uuuacuuugugucaagucaaga

SEQ ID NO: 962300 - RNA, 22 nt, Human
cagccccucccucaggcaggug

SEQ ID NO: 962301 - RNA, 22 nt, Human
ugcacagugaccccuggugacu

SEQ ID NO: 962302 - RNA, 22 nt, Human
ugucucugugacuccuuccgcc

SEQ ID NO: 962303 - RNA, 17 nt, Human
agcagcuggguugaucu

SEQ ID NO: 962304 - RNA, 22 nt, Human
gaggaggcuuccgggaggcacg

SEQ ID NO: 962305 - RNA, 22 nt, Human
uagcaggguaaauguagaugga

SEQ ID NO: 962306 - RNA, 22 nt, Human
acauuucucccugcaugccugc

SEQ ID NO: 962307 - RNA, 22 nt, Human
agggagcuuccgaacuacagcu

SEQ ID NO: 962308 - RNA, 22 nt, Human
ggcagcucacgggcauggggug

SEQ ID NO: 962309 - RNA, 22 nt, Human
agauguguuucuaguuccugca

SEQ ID NO: 962310 - RNA, 22 nt, Human
guucuccauucagcuuccugug

SEQ ID NO: 962311 - RNA, 22 nt, Human
gugaggugggcuggccagagac

SEQ ID NO: 962312 - RNA, 22 nt, Human
guggccuggaguuugauguagg

SEQ ID NO: 962313 - RNA, 22 nt, Human
cuccaugaauuugagcuuugug

SEQ ID NO: 962314 - RNA, 22 nt, Human
agcugcucucacuggacgccug

SEQ ID NO: 962315 - RNA, 22 nt, Human
ggaguucacugugcaggcucug

SEQ ID NO: 962316 - RNA, 22 nt, Human
aucacaaaggcugcuucaugau

SEQ ID NO: 962317 - RNA, 22 nt, Human
caggaaauaucuccuggcagag

SEQ ID NO: 962318 - RNA, 22 nt, Human
gcagagcauguccucaggacag

SEQ ID NO: 962319 - RNA, 22 nt, Human
gguggcagaggugcaucagccc

SEQ ID NO: 962320 - RNA, 22 nt, Human
cuacauuuuaauaagcugcuua

SEQ ID NO: 962321 - RNA, 22 nt, Human
cccagcucugcagaccugcccu

SEQ ID NO: 962322 - RNA, 22 nt, Human
uucacauuugcccuuaugugug

SEQ ID NO: 962323 - RNA, 20 nt, Human
uccugagccuccaccauguc

SEQ ID NO: 962324 - RNA, 19 nt, Human
aggucuaaucauaagacaa

SEQ ID NO: 962325 - RNA, 22 nt, Human
cagcccagcacuaaguagauuu

SEQ ID NO: 962326 - RNA, 22 nt, Human
aaggcccuggcaggaagcagga

SEQ ID NO: 962327 - RNA, 22 nt, Human
cucaccaggaacagcugcggag

SEQ ID NO: 962328 - RNA, 22 nt, Human
uuuuccagagcugucucuugca

SEQ ID NO: 962329 - RNA, 22 nt, Human
cacugaagaugcgacuagugcu

SEQ ID NO: 962330 - RNA, 22 nt, Human
ucaggcugcccguucagggcuc

SEQ ID NO: 962331 - RNA, 22 nt, Human
agccaggaaccagcuacagucu

SEQ ID NO: 962332 - RNA, 17 nt, Human
auucuuugaugucucug

SEQ ID NO: 962333 - RNA, 22 nt, Human
aggcuccaugcaaaggcuguuu

SEQ ID NO: 962334 - RNA, 22 nt, Human
guugaaagagcauggacuugaa

SEQ ID NO: 962335 - RNA, 22 nt, Human
uucucagaggagucgggagcug

SEQ ID NO: 962336 - RNA, 20 nt, Human
ccagaagagaugaucaucca

SEQ ID NO: 962337 - RNA, 22 nt, Human
auaagagcuagucuuuuccuug

SEQ ID NO: 962338 - RNA, 22 nt, Human
auauguguauuugguuagccua

SEQ ID NO: 962339 - RNA, 22 nt, Human
aaaguguagagacuuuggaacc

SEQ ID NO: 962340 - RNA, 22 nt, Human
aacuuucagcaaguaauucugg

SEQ ID NO: 962341 - RNA, 22 nt, Human
aggagcugcaaauauuaguaau

SEQ ID NO: 962342 - RNA, 22 nt, Human
uccuugaaugaagagaggugac

SEQ ID NO: 962343 - RNA, 23 nt, Human
agggagcuaaaaggcuggagcag

SEQ ID NO: 962344 - RNA, 22 nt, Human
gaggaggcuaagugggcucugg

SEQ ID NO: 962345 - RNA, 22 nt, Human
cuguccagcugaccagagcagc

SEQ ID NO: 962346 - RNA, 22 nt, Human
uuugcauugcauacaaggaacu

SEQ ID NO: 962347 - RNA, 22 nt, Human
ggcugccugccuccaagccggg

SEQ ID NO: 962348 - RNA, 22 nt, Human
agggcagaggcggacacggaag

SEQ ID NO: 962349 - RNA, 22 nt, Human
uugcaggggaaggagcagagcu

SEQ ID NO: 962350 - RNA, 20 nt, Human
cuucuucagccuaugcuuca

SEQ ID NO: 962351 - RNA, 21 nt, Human
agaggcaggcauuaaguacac

SEQ ID NO: 962352 - RNA, 22 nt, Human
agccuuguuggucugaguuugg

SEQ ID NO: 962353 - RNA, 22 nt, Human
uggcucagugaagagauaacuu

SEQ ID NO: 962354 - RNA, 19 nt, Human
ggaccagguccugggcagc

SEQ ID NO: 962355 - RNA, 22 nt, Human
cagugggaagggcagaggcuuu

SEQ ID NO: 962356 - RNA, 22 nt, Human
ggcaaggccugcagcucagugu

SEQ ID NO: 962357 - RNA, 22 nt, Human
gaagcccacguuuggugaugua

SEQ ID NO: 962358 - RNA, 22 nt, Human
cccaucacagacacuggguuau

SEQ ID NO: 962359 - RNA, 22 nt, Human
ggugggcacauucagucucugu

SEQ ID NO: 962360 - RNA, 22 nt, Human
guuaaauucgaugauggauaaa

SEQ ID NO: 962361 - RNA, 22 nt, Human
caagaauuguacaaacugggug

SEQ ID NO: 962362 - RNA, 22 nt, Human
ucccaggaggugcuuccuagga

SEQ ID NO: 962363 - RNA, 22 nt, Human
uguacaugugucuguauaucuu

SEQ ID NO: 962364 - RNA, 22 nt, Human
uuucaguuacugcuauaucauu

SEQ ID NO: 962365 - RNA, 22 nt, Human
uuccagugaugggcaauuuggu

SEQ ID NO: 962366 - RNA, 22 nt, Human
cuugaaagucagcagaguggau

SEQ ID NO: 962367 - RNA, 22 nt, Human
acugugugaaacaucaaugugu

SEQ ID NO: 962368 - RNA, 22 nt, Human
gaggccugcagcguggucccug

SEQ ID NO: 962369 - RNA, 22 nt, Human
cucucuguuaugcuuucaugaa

SEQ ID NO: 962370 - RNA, 22 nt, Human
ggcagcugaccuagcaccaucc

SEQ ID NO: 962371 - RNA, 22 nt, Human
ugucccagggaaggcccagcac

SEQ ID NO: 962372 - RNA, 22 nt, Human
ggcaaaaaccgcaauaacuucu

SEQ ID NO: 962373 - RNA, 22 nt, Human
aagacuuucaaaccuauguuug

SEQ ID NO: 962374 - RNA, 22 nt, Human
aauucacagaaccauggugcuc

SEQ ID NO: 962375 - RNA, 22 nt, Human
acuuuguaauaguuuaagguca

SEQ ID NO: 962376 - RNA, 22 nt, Human
uucagcaacucaaaccuauuag

SEQ ID NO: 962377 - RNA, 22 nt, Human
gaggcagcauucgcauagacag

SEQ ID NO: 962378 - RNA, 23 nt, Human
agcagccauagggaagcaauaca

SEQ ID NO: 962379 - RNA, 22 nt, Human
cggagaggugggggcagcaucu

SEQ ID NO: 962380 - RNA, 21 nt, Human
cgcagagcgaacuugcggcgc

SEQ ID NO: 962381 - RNA, 22 nt, Human
uuauuauagauuaugcaagauu

SEQ ID NO: 962382 - RNA, 22 nt, Human
caggguggaaaagcuaguugga

SEQ ID NO: 962383 - RNA, 21 nt, Human
uucuucuuggacuguuuuggc

SEQ ID NO: 962384 - RNA, 22 nt, Human
ggaggaggggugacugaaugcu

SEQ ID NO: 962385 - RNA, 22 nt, Human
agugaaaugacugaaucagaua

SEQ ID NO: 962386 - RNA, 22 nt, Human
ccuauugacaauucucuucucc

SEQ ID NO: 962387 - RNA, 22 nt, Human
cugggcugucaauggcccucug

SEQ ID NO: 962388 - RNA, 22 nt, Human
ugccaggagucaggccaggcag

SEQ ID NO: 962389 - RNA, 22 nt, Human
acacagccaggguaguaaggcu

SEQ ID NO: 962390 - RNA, 20 nt, Human
gcucccagccugcagucccc

SEQ ID NO: 962391 - RNA, 22 nt, Human
auucauuugcuauuguguaugg

SEQ ID NO: 962392 - RNA, 22 nt, Human
caugugguucaaguacuccaca

SEQ ID NO: 962393 - RNA, 20 nt, Human
aaucagaaagugugagcucu

SEQ ID NO: 962394 - RNA, 22 nt, Human
uaaggcacgcauaagagggggc

SEQ ID NO: 962395 - RNA, 22 nt, Human
gcucugugcaguucagggacac

SEQ ID NO: 962396 - RNA, 22 nt, Human
agcagggggaguuagacuagau

SEQ ID NO: 962397 - RNA, 22 nt, Human
uuucuuguaagauguuuauuaa

SEQ ID NO: 962398 - RNA, 22 nt, Human
auuucuauaggaggacaguauu

SEQ ID NO: 962399 - RNA, 22 nt, Human
cacugaaucucaaggggagggu

SEQ ID NO: 962400 - RNA, 22 nt, Human
cucccagggccaucgagucacu

SEQ ID NO: 962401 - RNA, 22 nt, Human
gaggucaauaauaugugcuuua

SEQ ID NO: 962402 - RNA, 22 nt, Human
cccuggguucuggcugggcugc

SEQ ID NO: 962403 - RNA, 22 nt, Human
caccuuguggcccagucagguu

SEQ ID NO: 962404 - RNA, 22 nt, Human
uugaggagcacuagucagguau

SEQ ID NO: 962405 - RNA, 22 nt, Human
uccugccucuugccuucuucac

SEQ ID NO: 962406 - RNA, 22 nt, Human
ucuguggccuguguccaagugc

SEQ ID NO: 962407 - RNA, 22 nt, Human
uaucuauuccaaauaucagcgu

SEQ ID NO: 962408 - RNA, 22 nt, Human
gggacagacccaugggccaggu

SEQ ID NO: 962409 - RNA, 22 nt, Human
agucccagacuccaguuuucug

SEQ ID NO: 962410 - RNA, 22 nt, Human
aacaguaaagacagaauuuauc

SEQ ID NO: 962411 - RNA, 21 nt, Human
aggugggagaccauguagguc

SEQ ID NO: 962412 - RNA, 22 nt, Human
gaaaguuuauagguuauauaau

SEQ ID NO: 962413 - RNA, 22 nt, Human
uaaggcacccuucugaguagag

SEQ ID NO: 962414 - RNA, 22 nt, Human
aagcugccaaugguaagcugcu

SEQ ID NO: 962415 - RNA, 22 nt, Human
uccugcagagccgcccucaggu

SEQ ID NO: 962416 - RNA, 18 nt, Human
gggaucaggcugccuagg

SEQ ID NO: 962417 - RNA, 22 nt, Human
caggaggaacaagagguucugg

SEQ ID NO: 962418 - RNA, 22 nt, Human
ccuggagcaaaaaucuaaggag

SEQ ID NO: 962419 - RNA, 22 nt, Human
ggcuucagugacuggugcccuc

SEQ ID NO: 962420 - RNA, 19 nt, Human
cuucuucuuggcagccaag

SEQ ID NO: 962421 - RNA, 22 nt, Human
aucagcaaaaaugccuucagaa

SEQ ID NO: 962422 - RNA, 22 nt, Human
uaaauuguuuucuagaaguugu

SEQ ID NO: 962423 - RNA, 22 nt, Human
cccccuggcaggcuggccucuc

SEQ ID NO: 962424 - RNA, 22 nt, Human
ggcccugugguuuugcaaaguc

SEQ ID NO: 962425 - RNA, 22 nt, Human
aaguuauugcagcaauccaagu

SEQ ID NO: 962426 - RNA, 22 nt, Human
uaugcugaauuugguuugcuau

SEQ ID NO: 962427 - RNA, 22 nt, Human
auuguucaaagugcuuugcaug

SEQ ID NO: 962428 - RNA, 22 nt, Human
gcugcagcccggcgcgccugag

SEQ ID NO: 962429 - RNA, 22 nt, Human
uggcucugugucucccagcagc

SEQ ID NO: 962430 - RNA, 22 nt, Human
uggcucugcaccucaguguacc

SEQ ID NO: 962431 - RNA, 22 nt, Human
cauuucuguacauguuuuggug

SEQ ID NO: 962432 - RNA, 22 nt, Human
cagagggcucaguccugcugga

SEQ ID NO: 962433 - RNA, 20 nt, Human
aagcaauauagugcaaaugu

SEQ ID NO: 962434 - RNA, 22 nt, Human
accugccuauggagccacaugg

SEQ ID NO: 962435 - RNA, 22 nt, Human
ucagaagcugguguccuuugaa

SEQ ID NO: 962436 - RNA, 22 nt, Human
ugugucaugugugaggcucccu

SEQ ID NO: 962437 - RNA, 22 nt, Human
uagcagcugugaguaaaagcca

SEQ ID NO: 962438 - RNA, 22 nt, Human
aggcccuguccauggugcugaa

SEQ ID NO: 962439 - RNA, 17 nt, Human
cuggagccaagagggcc

SEQ ID NO: 962440 - RNA, 22 nt, Human
auucauuuagguauucacuuac

SEQ ID NO: 962441 - RNA, 22 nt, Human
ucacuguugaccuggaaguggg

SEQ ID NO: 962442 - RNA, 22 nt, Human
ccagcuggagcucgcagauagg

SEQ ID NO: 962443 - RNA, 17 nt, Human
ggugagaccucccacuc

SEQ ID NO: 962444 - RNA, 23 nt, Human
agaugaggcuucuccauguuggu

SEQ ID NO: 962445 - RNA, 22 nt, Human
uccuugaauccuagcauccuau

SEQ ID NO: 962446 - RNA, 21 nt, Human
agcugccacccuagcuucuga

SEQ ID NO: 962447 - RNA, 22 nt, Human
cacauuucuaggaaauuaaaug

SEQ ID NO: 962448 - RNA, 18 nt, Human
gcaggugccacugcuguu

SEQ ID NO: 962449 - RNA, 22 nt, Human
gucuuuaugguaugaaaacuga

SEQ ID NO: 962450 - RNA, 22 nt, Human
agaaagaacguugguuaucuua

SEQ ID NO: 962451 - RNA, 22 nt, Human
uucaagaugccagggacgcggc

SEQ ID NO: 962452 - RNA, 22 nt, Human
aggauauuugcuuaagauagcu

SEQ ID NO: 962453 - RNA, 22 nt, Human
aggugccagugcuguggucccc

SEQ ID NO: 962454 - RNA, 22 nt, Human
uuaacauuguccuuagcagauu

SEQ ID NO: 962455 - RNA, 21 nt, Human
ccuauugaauauaggaagauu

SEQ ID NO: 962456 - RNA, 22 nt, Human
gcagagccugacgggauuuuuc

SEQ ID NO: 962457 - RNA, 22 nt, Human
ucccagcagagccagcaagccg

SEQ ID NO: 962458 - RNA, 22 nt, Human
gcaggagagucugugccagguu

SEQ ID NO: 962459 - RNA, 22 nt, Human
caucugcuguuccuuggacuca

SEQ ID NO: 962460 - RNA, 18 nt, Human
gagucuuuguuacugcug

SEQ ID NO: 962461 - RNA, 22 nt, Human
cucugagcuccuggaagcgugc

SEQ ID NO: 962462 - RNA, 20 nt, Human
gggugggagagucugagggu

SEQ ID NO: 962463 - RNA, 22 nt, Human
gccagacacuccccugggcagg

SEQ ID NO: 962464 - RNA, 22 nt, Human
gaaccaaguaggauacaaggag

SEQ ID NO: 962465 - RNA, 22 nt, Human
gcuccuggcauccugcuuuuaa

SEQ ID NO: 962466 - RNA, 18 nt, Human
gcuccuggagucugacuc

SEQ ID NO: 962467 - RNA, 22 nt, Human
uguggcuguguccaccugcugc

SEQ ID NO: 962468 - RNA, 22 nt, Human
gaggggcucuuuaauaguaaca

SEQ ID NO: 962469 - RNA, 22 nt, Human
uuggcaguagucucggcuaccc

SEQ ID NO: 962470 - RNA, 22 nt, Human
ccuggcagcuccuccccggcgg

SEQ ID NO: 962471 - RNA, 20 nt, Human
accuuucaaaugauucagca

SEQ ID NO: 962472 - RNA, 22 nt, Human
uuggaaggcccugccuagcagg

SEQ ID NO: 962473 - RNA, 22 nt, Human
ccucagaguaggucucagcugu

SEQ ID NO: 962474 - RNA, 22 nt, Human
ucccaggagcaccuuuugagcc

SEQ ID NO: 962475 - RNA, 22 nt, Human
ucccaggaauugaagccagugu

SEQ ID NO: 962476 - RNA, 22 nt, Human
ccugucucccuggcauggcuca

SEQ ID NO: 962477 - RNA, 22 nt, Human
aagcgccaugguuccugcgcag

SEQ ID NO: 962478 - RNA, 22 nt, Human
caggccugauacacugaacucu

SEQ ID NO: 962479 - RNA, 22 nt, Human
agaauccugaugaaaaggagag

SEQ ID NO: 962480 - RNA, 22 nt, Human
ccacccugagccgcaagagcag

SEQ ID NO: 962481 - RNA, 22 nt, Human
auaugccauuagcuagaaauaa

SEQ ID NO: 962482 - RNA, 22 nt, Human
ggaagagagggcugggccucaa

SEQ ID NO: 962483 - RNA, 22 nt, Human
uuaguaauguguuaauaugaau

SEQ ID NO: 962484 - RNA, 22 nt, Human
agagugaaggccagguuacagu

SEQ ID NO: 962485 - RNA, 22 nt, Human
uccuucaaagcuccuagugagc

SEQ ID NO: 962486 - RNA, 22 nt, Human
uaaaugugucuauggacccgcc

SEQ ID NO: 962487 - RNA, 22 nt, Human
gugguuuucuccaacccagaac

SEQ ID NO: 962488 - RNA, 22 nt, Human
cauugguagaguuuguuuuaua

SEQ ID NO: 962489 - RNA, 20 nt, Human
aggaggggauagaaucaaag

SEQ ID NO: 962490 - RNA, 22 nt, Human
ucuccucugcgcggcagugccc

SEQ ID NO: 962491 - RNA, 22 nt, Human
ggaaaguggugguggaaagagg

SEQ ID NO: 962492 - RNA, 22 nt, Human
agcugcucccuauccuuuccuu

SEQ ID NO: 962493 - RNA, 22 nt, Human
accucugcaacccuggaauggg

SEQ ID NO: 962494 - RNA, 22 nt, Human
gcuggcagccaagugaagaggg

SEQ ID NO: 962495 - RNA, 22 nt, Human
uuguggaaauacagacuccaag

SEQ ID NO: 962496 - RNA, 22 nt, Human
acaggcugccuaccaaguauca

SEQ ID NO: 962497 - RNA, 22 nt, Human
cggcagagacggcgcuuugaac

SEQ ID NO: 962498 - RNA, 22 nt, Human
gagggcauaguuaaauaggagg

SEQ ID NO: 962499 - RNA, 22 nt, Human
cagggccaugaggcacaggguc

SEQ ID NO: 962500 - RNA, 22 nt, Human
uuucauuauguuccuggaagag

SEQ ID NO: 962501 - RNA, 19 nt, Human
ugggcuuccccagggcaga

SEQ ID NO: 962502 - RNA, 22 nt, Human
aauaucaguauauuguaucagu

SEQ ID NO: 962503 - RNA, 22 nt, Human
aucaggaugcugucaguuacca

SEQ ID NO: 962504 - RNA, 22 nt, Human
cuccucugucuaccacgagggu

SEQ ID NO: 962505 - RNA, 20 nt, Human
guggccuguccuguuguggg

SEQ ID NO: 962506 - RNA, 22 nt, Human
ugucucuggcccaugagcagag

SEQ ID NO: 962507 - RNA, 18 nt, Human
agcagcugugccacacug

SEQ ID NO: 962508 - RNA, 22 nt, Human
uuugcauuuauaaguuggugga

SEQ ID NO: 962509 - RNA, 22 nt, Human
aaauuauaggugccaccuugga

SEQ ID NO: 962510 - RNA, 22 nt, Human
uuugcaguuucauugcugaaau

SEQ ID NO: 962511 - RNA, 22 nt, Human
gccagcagguugucaaggagcu

SEQ ID NO: 962512 - RNA, 22 nt, Human
uggcagcaaguucuugggaggu

SEQ ID NO: 962513 - RNA, 22 nt, Human
gagaaggaguagcugaccuggg

SEQ ID NO: 962514 - RNA, 22 nt, Human
uagggcagagcuuguacacgau

SEQ ID NO: 962515 - RNA, 22 nt, Human
aaaguggucaccuucucauuuc

SEQ ID NO: 962516 - RNA, 22 nt, Human
auuuggauucuuauuuagcacu

SEQ ID NO: 962517 - RNA, 22 nt, Human
cccaggaguuugaguucagcau

SEQ ID NO: 962518 - RNA, 22 nt, Human
ccagagccggcucccucagcuu

SEQ ID NO: 962519 - RNA, 22 nt, Human
acucugccuuucagcagaugaa

SEQ ID NO: 962520 - RNA, 22 nt, Human
cugagcugguggaagcaugcag

SEQ ID NO: 962521 - RNA, 22 nt, Human
ccaucuccacugucccugucaa

SEQ ID NO: 962522 - RNA, 22 nt, Human
ucugggaguuguaguccggugg

SEQ ID NO: 962523 - RNA, 20 nt, Human
aggaaaaggguggugguaga

SEQ ID NO: 962524 - RNA, 21 nt, Human
ugaaaucugaugggacaaaug

SEQ ID NO: 962525 - RNA, 22 nt, Human
ugccuugcgggcguuucuguug

SEQ ID NO: 962526 - RNA, 22 nt, Human
uaucuguuggcuccuaguugua

SEQ ID NO: 962527 - RNA, 22 nt, Human
ucacaugccacagaugaggcaa

SEQ ID NO: 962528 - RNA, 22 nt, Human
auggacagugugucuguuucca

SEQ ID NO: 962529 - RNA, 22 nt, Human
ccugggcucuauccugacccag

SEQ ID NO: 962530 - RNA, 22 nt, Human
gagaggcaggcgcugcaauggu

SEQ ID NO: 962531 - RNA, 22 nt, Human
ccagcagaggggcggagugcag

SEQ ID NO: 962532 - RNA, 22 nt, Human
gugccugguuuggggaguguuc

SEQ ID NO: 962533 - RNA, 20 nt, Human
guugaaaguaauaugaugcu

SEQ ID NO: 962534 - RNA, 22 nt, Human
ucagggaaucagacucugcagc

SEQ ID NO: 962535 - RNA, 22 nt, Human
ugggacagggaaucugaucccc

SEQ ID NO: 962536 - RNA, 22 nt, Human
acuggcaggcugcuggccggcg

SEQ ID NO: 962537 - RNA, 22 nt, Human
ugaggcagugcugggaagccug

SEQ ID NO: 962538 - RNA, 22 nt, Human
acaacauuauacauagaaagcu

SEQ ID NO: 962539 - RNA, 22 nt, Human
aggcacugaagugguaaaugua

SEQ ID NO: 962540 - RNA, 22 nt, Human
ccugggcaggccggacgcuggg

SEQ ID NO: 962541 - RNA, 22 nt, Human
ccucagcugcuucccuggagcc

SEQ ID NO: 962542 - RNA, 22 nt, Human
uggcucagagagggagugugga

SEQ ID NO: 962543 - RNA, 19 nt, Human
guaagggcuaauggacuau

SEQ ID NO: 962544 - RNA, 22 nt, Human
uauguacaucguugaauucaaa

SEQ ID NO: 962545 - RNA, 22 nt, Human
gaggccaggagugcuguaaguu

SEQ ID NO: 962546 - RNA, 22 nt, Human
gcagcugcagagaccggguggg

SEQ ID NO: 962547 - RNA, 22 nt, Human
ggcugugcgggcagccguggga

SEQ ID NO: 962548 - RNA, 22 nt, Human
cacuggaauauggcguugaacc

SEQ ID NO: 962549 - RNA, 22 nt, Human
cagcuuugucugauuccucuuu

SEQ ID NO: 962550 - RNA, 19 nt, Human
uggcagcauugguaccuug

SEQ ID NO: 962551 - RNA, 22 nt, Human
cuggcagguccagcuggacuca

SEQ ID NO: 962552 - RNA, 22 nt, Human
cuauaauuaugcucaaaaugua

SEQ ID NO: 962553 - RNA, 22 nt, Human
caugcacuuaccugaaauucaa

SEQ ID NO: 962554 - RNA, 22 nt, Human
ucuucaaguuccaaagugcagg

SEQ ID NO: 962555 - RNA, 22 nt, Human
acucugcuuauugcugcaggca

SEQ ID NO: 962556 - RNA, 22 nt, Human
agccauugaauuuagugccuuu

SEQ ID NO: 962557 - RNA, 22 nt, Human
ugcagcugauuaaagggcagac

SEQ ID NO: 962558 - RNA, 22 nt, Human
caaaugcaugagaaauaagagg

SEQ ID NO: 962559 - RNA, 22 nt, Human
cagccacguagcccuuggccgu

SEQ ID NO: 962560 - RNA, 22 nt, Human
ucccagccuuucuuuucugcug

SEQ ID NO: 962561 - RNA, 21 nt, Human
uuguucuuccagaagcaaagu

SEQ ID NO: 962562 - RNA, 22 nt, Human
gagugugucggucagcguggcg

SEQ ID NO: 962563 - RNA, 22 nt, Human
augcugugguagacagcauucc

SEQ ID NO: 962564 - RNA, 22 nt, Human
ucacugaagacugggcucuaaa

SEQ ID NO: 962565 - RNA, 22 nt, Human
guccucagagugggcagguccu

SEQ ID NO: 962566 - RNA, 22 nt, Human
cagcauggcuugaguguuuccu

SEQ ID NO: 962567 - RNA, 22 nt, Human
augaugguggguaauguguaaa

SEQ ID NO: 962568 - RNA, 22 nt, Human
cuggcaggagcauucacagagg

SEQ ID NO: 962569 - RNA, 22 nt, Human
ucuggcucccuggagcuccaca

SEQ ID NO: 962570 - RNA, 20 nt, Human
uaugcuuuuuauaagauuga

SEQ ID NO: 962571 - RNA, 21 nt, Human
gaaaggucuuaacuuacagag

SEQ ID NO: 962572 - RNA, 22 nt, Human
ccagggugggaggcugaaggcg

SEQ ID NO: 962573 - RNA, 22 nt, Human
uuugaauguuuuagguacuuaa

SEQ ID NO: 962574 - RNA, 17 nt, Human
accagccucuccugggg

SEQ ID NO: 962575 - RNA, 19 nt, Human
gucacauuugucucccagg

SEQ ID NO: 962576 - RNA, 19 nt, Human
uccucagugacaaccucag

SEQ ID NO: 962577 - RNA, 22 nt, Human
aaggcagcaagaauuccagguu

SEQ ID NO: 962578 - RNA, 16 nt, Human
gcuccugggcccucga

SEQ ID NO: 962579 - RNA, 22 nt, Human
gcccugugccagucacgcugug

SEQ ID NO: 962580 - RNA, 22 nt, Human
cuguacaucccgagagccagua

SEQ ID NO: 962581 - RNA, 22 nt, Human
cagucucucugaaguauuaaga

SEQ ID NO: 962582 - RNA, 22 nt, Human
accugagaaugggggcaugugu

SEQ ID NO: 962583 - RNA, 22 nt, Human
aagcaaaagguuacacuucugg

SEQ ID NO: 962584 - RNA, 22 nt, Human
gggcugcuuuuuucuuagcaga

SEQ ID NO: 962585 - RNA, 22 nt, Human
aaggcagcaggauuuggugacu

SEQ ID NO: 962586 - RNA, 22 nt, Human
gcuccuggcucuggccaaggga

SEQ ID NO: 962587 - RNA, 22 nt, Human
aguccaugguucugacucaucu

SEQ ID NO: 962588 - RNA, 21 nt, Human
agacaguaacucuucuacucc

SEQ ID NO: 962589 - RNA, 22 nt, Human
cugcuucugggaugauggagua

SEQ ID NO: 962590 - RNA, 22 nt, Human
gugcccugaguggguaggagag

SEQ ID NO: 962591 - RNA, 19 nt, Human
cugcugggugcugagggag

SEQ ID NO: 962592 - RNA, 22 nt, Human
uaggcagcagugcuaugauucu

SEQ ID NO: 962593 - RNA, 17 nt, Human
ccuguguuugcuccuuc

SEQ ID NO: 962594 - RNA, 21 nt, Human
ccuguucacagaucuguaacu

SEQ ID NO: 962595 - RNA, 22 nt, Human
ugugaaaugaagauaauucuug

SEQ ID NO: 962596 - RNA, 22 nt, Human
uuccaugaaggagacugagaag

SEQ ID NO: 962597 - RNA, 18 nt, Human
caugggugacagguggau

SEQ ID NO: 962598 - RNA, 22 nt, Human
uggcucaguuccaucaucugga

SEQ ID NO: 962599 - RNA, 21 nt, Human
acagaguaguugaaacagaga

SEQ ID NO: 962600 - RNA, 22 nt, Human
uggcucaggccacuucuuuuau

SEQ ID NO: 962601 - RNA, 22 nt, Human
ggccucugcaacuggcuguggc

SEQ ID NO: 962602 - RNA, 22 nt, Human
ucugaggcuauguucaggcuaa

SEQ ID NO: 962603 - RNA, 22 nt, Human
gcugggcacugucccauaggcu

SEQ ID NO: 962604 - RNA, 22 nt, Human
cuggcaguuggcagggcugcca

SEQ ID NO: 962605 - RNA, 22 nt, Human
ccaccagcagugugcaaggauu

SEQ ID NO: 962606 - RNA, 21 nt, Human
ugggcagauggcaguguggcu

SEQ ID NO: 962607 - RNA, 22 nt, Human
agcucccaggcagucaugagga

SEQ ID NO: 962608 - RNA, 22 nt, Human
aggccagcuguuacuagagcca

SEQ ID NO: 962609 - RNA, 22 nt, Human
uacauaguuccauuuacaggaa

SEQ ID NO: 962610 - RNA, 22 nt, Human
ucacugcaaucucugccuucca

SEQ ID NO: 962611 - RNA, 22 nt, Human
gcucccaggcauggagguaauu

SEQ ID NO: 962612 - RNA, 22 nt, Human
aaaugcaauuguauguacucca

SEQ ID NO: 962613 - RNA, 22 nt, Human
agcaccuggucuccuggcgcug

SEQ ID NO: 962614 - RNA, 22 nt, Human
cucuucaauagauuguugaggg

SEQ ID NO: 962615 - RNA, 22 nt, Human
aucacauucuuucaaagcaguc

SEQ ID NO: 962616 - RNA, 22 nt, Human
aauguucaaacagaucacuuag

SEQ ID NO: 962617 - RNA, 22 nt, Human
uuuucaguuccaucucugcucu

SEQ ID NO: 962618 - RNA, 22 nt, Human
agaaaagggcaggagggauaca

SEQ ID NO: 962619 - RNA, 22 nt, Human
uuucuucugagaucagggagaa

SEQ ID NO: 962620 - RNA, 22 nt, Human
gauauagguucauaguguuaca

SEQ ID NO: 962621 - RNA, 21 nt, Human
ugcugccaucaugcagagaug

SEQ ID NO: 962622 - RNA, 22 nt, Human
uguauuuucugaagauaaucaa

SEQ ID NO: 962623 - RNA, 22 nt, Human
aaggaaccauuugugugcaugg

SEQ ID NO: 962624 - RNA, 22 nt, Human
cugggagaucuccugagggcag

SEQ ID NO: 962625 - RNA, 22 nt, Human
acccaggagacagguugcagug

SEQ ID NO: 962626 - RNA, 22 nt, Human
uugaaauacugcauuguucagu

SEQ ID NO: 962627 - RNA, 22 nt, Human
ucacugggagaugugggaaggg

SEQ ID NO: 962628 - RNA, 22 nt, Human
agccaggacguugcucagcucc

SEQ ID NO: 962629 - RNA, 22 nt, Human
uucaaugagcccggggccauag

SEQ ID NO: 962630 - RNA, 22 nt, Human
guggaggagaggcgccuugcgg

SEQ ID NO: 962631 - RNA, 22 nt, Human
cugacucagcagcugaugaucc

SEQ ID NO: 962632 - RNA, 22 nt, Human
gaaaucugcuucuugcauagua

SEQ ID NO: 962633 - RNA, 22 nt, Human
augaaggcuguguggagccccc

SEQ ID NO: 962634 - RNA, 22 nt, Human
agggccuggaacugugggcagg

SEQ ID NO: 962635 - RNA, 22 nt, Human
gucugagcgcuggagcuugugu

SEQ ID NO: 962636 - RNA, 22 nt, Human
cuugggagacacaagaagacau

SEQ ID NO: 962637 - RNA, 22 nt, Human
aaaucaguuggaacacaagcag

SEQ ID NO: 962638 - RNA, 22 nt, Human
gacccaggaagcuacuucuggu

SEQ ID NO: 962639 - RNA, 22 nt, Human
gcaccaggcuuagagccccagg

SEQ ID NO: 962640 - RNA, 22 nt, Human
ggagaggguguggaaaguuauc

SEQ ID NO: 962641 - RNA, 22 nt, Human
gggcagcucggaagugggaaag

SEQ ID NO: 962642 - RNA, 22 nt, Human
gagccaaggguugccauggaga

SEQ ID NO: 962643 - RNA, 22 nt, Human
cuggcaguggggccucaguguu

SEQ ID NO: 962644 - RNA, 22 nt, Human
cccaggcucccaggugggacaa

SEQ ID NO: 962645 - RNA, 22 nt, Human
ugagccugguugcagugucugg

SEQ ID NO: 962646 - RNA, 22 nt, Human
ggcagccauacucagaccuggg

SEQ ID NO: 962647 - RNA, 22 nt, Human
aggcagaggaaggguggauuug

SEQ ID NO: 962648 - RNA, 22 nt, Human
uggcagagcccagaacugagca

SEQ ID NO: 962649 - RNA, 22 nt, Human
cagccuuuaagcuuggauaggu

SEQ ID NO: 962650 - RNA, 22 nt, Human
gaggcaguuccugagugacaag

SEQ ID NO: 962651 - RNA, 22 nt, Human
aauaguguuguucacucaggag

SEQ ID NO: 962652 - RNA, 22 nt, Human
aacaggagaguaaauauaugau

SEQ ID NO: 962653 - RNA, 22 nt, Human
acauugaucagccucccaugca

SEQ ID NO: 962654 - RNA, 22 nt, Human
cugagggccuuggcuccugccc

SEQ ID NO: 962655 - RNA, 22 nt, Human
ggugguggagccagcugggagu

SEQ ID NO: 962656 - RNA, 22 nt, Human
uccagugguacauggagacacu

SEQ ID NO: 962657 - RNA, 22 nt, Human
ugcauuguugaccaguugugca

SEQ ID NO: 962658 - RNA, 22 nt, Human
auuacacacucaaguccuguua

SEQ ID NO: 962659 - RNA, 22 nt, Human
uuucugugguggguaguucaga

SEQ ID NO: 962660 - RNA, 22 nt, Human
gggcuggaucuccugcaggcag

SEQ ID NO: 962661 - RNA, 22 nt, Human
cagagccauuauggagacuugc

SEQ ID NO: 962662 - RNA, 22 nt, Human
guagccauuggcaaugaagccu

SEQ ID NO: 962663 - RNA, 22 nt, Human
caggaguggugugagggacucc

SEQ ID NO: 962664 - RNA, 22 nt, Human
auaaggcagaaauagggaaagu

SEQ ID NO: 962665 - RNA, 22 nt, Human
cagggccuuuuagcaucuucuc

SEQ ID NO: 962666 - RNA, 22 nt, Human
gggcuggaggugagcaggacag

SEQ ID NO: 962667 - RNA, 22 nt, Human
uccuucaggguugaggccgacu

SEQ ID NO: 962668 - RNA, 22 nt, Human
agccucugauggcucccaagga

SEQ ID NO: 962669 - RNA, 22 nt, Human
ugucuuaagaaauugcauuugu

SEQ ID NO: 962670 - RNA, 22 nt, Human
ggcugccauaacugauaccaua

SEQ ID NO: 962671 - RNA, 22 nt, Human
uauuuagaugcauuuggauugc

SEQ ID NO: 962672 - RNA, 22 nt, Human
accuuucacgguaucagacauc

SEQ ID NO: 962673 - RNA, 22 nt, Human
uggccuugggcagguggccugc

SEQ ID NO: 962674 - RNA, 22 nt, Human
augugucaauuuucaaaugcuu

SEQ ID NO: 962675 - RNA, 22 nt, Human
auggccaagaucacagacuuca

SEQ ID NO: 962676 - RNA, 22 nt, Human
ccugugcauccgguggucauug

SEQ ID NO: 962677 - RNA, 22 nt, Human
ugagguggcuagggaggcacuc

SEQ ID NO: 962678 - RNA, 22 nt, Human
ggccugagaaccauggggccaa

SEQ ID NO: 962679 - RNA, 22 nt, Human
cucagaaguucagccuagagua

SEQ ID NO: 962680 - RNA, 22 nt, Human
uuagggcuuuucugaauaggcc

SEQ ID NO: 962681 - RNA, 22 nt, Human
cccaggcagccugcagggaagg

SEQ ID NO: 962682 - RNA, 22 nt, Human
accacugggcgggcagccugcu

SEQ ID NO: 962683 - RNA, 22 nt, Human
uggccugccuucgcugagcuga

SEQ ID NO: 962684 - RNA, 22 nt, Human
uccaugugccaaggggcagagg

SEQ ID NO: 962685 - RNA, 19 nt, Human
uuuuccuucuauauguuuc

SEQ ID NO: 962686 - RNA, 22 nt, Human
aaggcugagacagcacaggucc

SEQ ID NO: 962687 - RNA, 22 nt, Human
ucugggagccaugccuuggagu

SEQ ID NO: 962688 - RNA, 22 nt, Human
uuacauuuuaguuaaccuguga

SEQ ID NO: 962689 - RNA, 22 nt, Human
caguggucugugcuucuguaca

SEQ ID NO: 962690 - RNA, 19 nt, Human
ggacacagaaagcugcauu

SEQ ID NO: 962691 - RNA, 22 nt, Human
uagagaaaagcagggaucagga

SEQ ID NO: 962692 - RNA, 22 nt, Human
cuuuaagacucugcucuuggug

SEQ ID NO: 962693 - RNA, 22 nt, Human
ucuggccaguagauguggguug

SEQ ID NO: 962694 - RNA, 19 nt, Human
ucugucacuggggguauuc

SEQ ID NO: 962695 - RNA, 19 nt, Human
agagaggcugugugaggga

SEQ ID NO: 962696 - RNA, 22 nt, Human
cagucccaggguugguucagcu

SEQ ID NO: 962697 - RNA, 22 nt, Human
cagggcagggagcuuagaauga

SEQ ID NO: 962698 - RNA, 22 nt, Human
cagagcaguccuugucaaucag

SEQ ID NO: 962699 - RNA, 22 nt, Human
cagcaguggaacuacccaggga

SEQ ID NO: 962700 - RNA, 22 nt, Human
augcacaagaggcuagaaaaga

SEQ ID NO: 962701 - RNA, 22 nt, Human
ucaucacucauuggacaacaga

SEQ ID NO: 962702 - RNA, 22 nt, Human
uuguuuuaaugagggagguuga

SEQ ID NO: 962703 - RNA, 22 nt, Human
gaggccugcuuuggcacucugg

SEQ ID NO: 962704 - RNA, 22 nt, Human
gacccaggagugcagagagugg

SEQ ID NO: 962705 - RNA, 22 nt, Human
ucugugccucaucugguucagg

SEQ ID NO: 962706 - RNA, 22 nt, Human
aggaaagggguagguguggacg

SEQ ID NO: 962707 - RNA, 22 nt, Human
gcuggaaggcuaggcucaguug

SEQ ID NO: 962708 - RNA, 22 nt, Human
caaaacauucagagagcucacu

SEQ ID NO: 962709 - RNA, 22 nt, Human
caggggcucugagauugucuaa

SEQ ID NO: 962710 - RNA, 22 nt, Human
gucagcugucuccccagagugg

SEQ ID NO: 962711 - RNA, 17 nt, Human
acaagcaguggccaugg

SEQ ID NO: 962712 - RNA, 21 nt, Human
cagugcucaaucugacagugg

SEQ ID NO: 962713 - RNA, 22 nt, Human
gccaggcaaauuaaggaaugca

SEQ ID NO: 962714 - RNA, 22 nt, Human
ugcccacaggaagacaccagcg

SEQ ID NO: 962715 - RNA, 22 nt, Human
ucagaguggugguuuugccuuc

SEQ ID NO: 962716 - RNA, 22 nt, Human
gagggaugguaguugacacuga

SEQ ID NO: 962717 - RNA, 22 nt, Human
uucaggauaguggugaguggca

SEQ ID NO: 962718 - RNA, 20 nt, Human
gccaggagggugugaugagc

SEQ ID NO: 962719 - RNA, 22 nt, Human
gggcuggcaucaguugccgaga

SEQ ID NO: 962720 - RNA, 22 nt, Human
gcagugguccaguucacaccca

SEQ ID NO: 962721 - RNA, 22 nt, Human
acuguauuuuugaaucauugug

SEQ ID NO: 962722 - RNA, 21 nt, Human
cccaggaguccuauuuaaaug

SEQ ID NO: 962723 - RNA, 22 nt, Human
augugucugaccacuguauugg

SEQ ID NO: 962724 - RNA, 19 nt, Human
agcuuccauauucucuagu

SEQ ID NO: 962725 - RNA, 22 nt, Human
gcagagcucaagguguucagcu

SEQ ID NO: 962726 - RNA, 22 nt, Human
ugcaggaaucagaggggaagcg

SEQ ID NO: 962727 - RNA, 22 nt, Human
uucauagugauuguucagauag

SEQ ID NO: 962728 - RNA, 22 nt, Human
ugaggcaggaugcuugcacagg

SEQ ID NO: 962729 - RNA, 22 nt, Human
cugccagcucaaagcgcagcua

SEQ ID NO: 962730 - RNA, 22 nt, Human
uggaggugagugugguacagca

SEQ ID NO: 962731 - RNA, 22 nt, Human
aggcagacugugcgggaagagu

SEQ ID NO: 962732 - RNA, 22 nt, Human
uaaauacagucauuugagccau

SEQ ID NO: 962733 - RNA, 22 nt, Human
uagaaaugugauaauagcuuaa

SEQ ID NO: 962734 - RNA, 22 nt, Human
gaagcagcuaggaucuucauuu

SEQ ID NO: 962735 - RNA, 22 nt, Human
agggaggagaauggacuccuuc

SEQ ID NO: 962736 - RNA, 22 nt, Human
ucugagccuauuucaaauuccu

SEQ ID NO: 962737 - RNA, 22 nt, Human
ccucagccuuggccccaggcag

SEQ ID NO: 962738 - RNA, 22 nt, Human
aagcaggcauuccagagacaau

SEQ ID NO: 962739 - RNA, 22 nt, Human
uuggcuucuggcagucuggacg

SEQ ID NO: 962740 - RNA, 22 nt, Human
augaaaaguucgaucuagaagg

SEQ ID NO: 962741 - RNA, 22 nt, Human
ucagagugaggcccagcaaucu

SEQ ID NO: 962742 - RNA, 22 nt, Human
uugggcucaggaguuugagacc

SEQ ID NO: 962743 - RNA, 22 nt, Human
uuugacaugcaaagcacuuuag

SEQ ID NO: 962744 - RNA, 22 nt, Human
gcacugggggcagcagugaggg

SEQ ID NO: 962745 - RNA, 22 nt, Human
ccaccuccaccuauugccagcc

SEQ ID NO: 962746 - RNA, 22 nt, Human
ccagucacuggaaaaugggaau

SEQ ID NO: 962747 - RNA, 22 nt, Human
ugaggcagaaauuccuguuuuc

SEQ ID NO: 962748 - RNA, 22 nt, Human
cagcagcuuugccaagucagcc

SEQ ID NO: 962749 - RNA, 22 nt, Human
ugcagcaggcacaggacggaag

SEQ ID NO: 962750 - RNA, 21 nt, Human
gggugggaggacacagcaggc

SEQ ID NO: 962751 - RNA, 22 nt, Human
gcagugcugaucccauggcaga

SEQ ID NO: 962752 - RNA, 22 nt, Human
ugugugaauggauuauucuauu

SEQ ID NO: 962753 - RNA, 21 nt, Human
aggcagaaagagcccaggcug

SEQ ID NO: 962754 - RNA, 22 nt, Human
aaaucaguuaagaugaggccau

SEQ ID NO: 962755 - RNA, 22 nt, Human
ggcacagagcccagcuuccuag

SEQ ID NO: 962756 - RNA, 22 nt, Human
uuugaauaucacaaacuuucaa

SEQ ID NO: 962757 - RNA, 22 nt, Human
acuguucaaguuuuaugcugga

SEQ ID NO: 962758 - RNA, 23 nt, Human
ugcauuauccucucugaagacca

SEQ ID NO: 962759 - RNA, 22 nt, Human
gggcacagagggucuugaagaa

SEQ ID NO: 962760 - RNA, 22 nt, Human
cagcagagggagccauugaaau

SEQ ID NO: 962761 - RNA, 22 nt, Human
ggcacugagcugccuuggggca

SEQ ID NO: 962762 - RNA, 22 nt, Human
uaagauaugguaggaaguuugg

SEQ ID NO: 962763 - RNA, 22 nt, Human
auaaggcagucacuggaauguu

SEQ ID NO: 962764 - RNA, 22 nt, Human
gcagccacuuugcaaccaagag

SEQ ID NO: 962765 - RNA, 22 nt, Human
ggcucaggacacagugguuuag

SEQ ID NO: 962766 - RNA, 22 nt, Human
agugggcaugaucuggugucug

SEQ ID NO: 962767 - RNA, 22 nt, Human
cugaaggaagcagguggccugu

SEQ ID NO: 962768 - RNA, 22 nt, Human
uccuggagaauccugccaccug

SEQ ID NO: 962769 - RNA, 22 nt, Human
ugccuggaaggcccaugggaag

SEQ ID NO: 962770 - RNA, 22 nt, Human
aaauauuauugcuuaaggggag

SEQ ID NO: 962771 - RNA, 22 nt, Human
uagggauggaaacuaggaaucu

SEQ ID NO: 962772 - RNA, 22 nt, Human
cccuggggcugagggauggccg

SEQ ID NO: 962773 - RNA, 22 nt, Human
ucuggcuuucauuuguuuaaag

SEQ ID NO: 962774 - RNA, 22 nt, Human
gcucucuggguggugggcaaca

SEQ ID NO: 962775 - RNA, 21 nt, Human
uuauugagacauuuguggaaa

SEQ ID NO: 962776 - RNA, 22 nt, Human
uuucuucucacccaggacagag

SEQ ID NO: 962777 - RNA, 22 nt, Human
augaaauuugcugcuaaguucc

SEQ ID NO: 962778 - RNA, 22 nt, Human
ugauggcuaucccuggaagggc

SEQ ID NO: 962779 - RNA, 23 nt, Human
aguguuccaguugguugagagug

SEQ ID NO: 962780 - RNA, 22 nt, Human
ugaaagcacugauucucaacuc

SEQ ID NO: 962781 - RNA, 22 nt, Human
cugugucucauccgccucuggc

SEQ ID NO: 962782 - RNA, 22 nt, Human
agucccagugacuuggccagaa

SEQ ID NO: 962783 - RNA, 22 nt, Human
uccugcagaccucagucagguc

SEQ ID NO: 962784 - RNA, 22 nt, Human
uuggccuucccuaccugggcca

SEQ ID NO: 962785 - RNA, 22 nt, Human
caugggcuuuggaggcuggagg

SEQ ID NO: 962786 - RNA, 22 nt, Human
cugggcacagcguugggcucuu

SEQ ID NO: 962787 - RNA, 22 nt, Human
cugucucucuaggacacugggg

SEQ ID NO: 962788 - RNA, 22 nt, Human
cugcccaaauccuucuuccucu

SEQ ID NO: 962789 - RNA, 22 nt, Human
acagccugcugccugcuucuug

SEQ ID NO: 962790 - RNA, 22 nt, Human
agugagggaugaagaacugcgg

SEQ ID NO: 962791 - RNA, 22 nt, Human
ccuuuugcucucccauccagaa

SEQ ID NO: 962792 - RNA, 22 nt, Human
gugaaaauaaggcugguucuug

SEQ ID NO: 962793 - RNA, 22 nt, Human
cugcugugggcaggguagcugg

SEQ ID NO: 962794 - RNA, 22 nt, Human
ugcugccaccccucaccagagc

SEQ ID NO: 962795 - RNA, 22 nt, Human
gauuuguagcuuuucagucugu

SEQ ID NO: 962796 - RNA, 22 nt, Human
auucuucaucagagaugcacua

SEQ ID NO: 962797 - RNA, 20 nt, Human
gcugccuuguccugcuuggu

SEQ ID NO: 962798 - RNA, 22 nt, Human
gccuuuuuuguugcucugucac

SEQ ID NO: 962799 - RNA, 22 nt, Human
aaaggucauugaaaaggaggaa

SEQ ID NO: 962800 - RNA, 22 nt, Human
ccagcagccaccuucucgaaau

SEQ ID NO: 962801 - RNA, 22 nt, Human
uagaaacauauaggauggcagg

SEQ ID NO: 962802 - RNA, 22 nt, Human
ugaggccagcuucagcagugga

SEQ ID NO: 962803 - RNA, 22 nt, Human
gcccagcagcugguggagaagg

SEQ ID NO: 962804 - RNA, 22 nt, Human
cugccugcugccuguggagggu

SEQ ID NO: 962805 - RNA, 20 nt, Human
cacguuuuuccacuagcaaa

SEQ ID NO: 962806 - RNA, 22 nt, Human
caccagggacaaugcuaggggu

SEQ ID NO: 962807 - RNA, 22 nt, Human
ugaagcaguucucagaaguggg

SEQ ID NO: 962808 - RNA, 22 nt, Human
agcagccauagauagcaugcaa

SEQ ID NO: 962809 - RNA, 22 nt, Human
caggagacuauggcccaaggcc

SEQ ID NO: 962810 - RNA, 17 nt, Human
gagagcugcugcuuccg

SEQ ID NO: 962811 - RNA, 22 nt, Human
ugcaagaggaauucuagaagca

SEQ ID NO: 962812 - RNA, 22 nt, Human
gaguuuaaaacgcuuguauuua

SEQ ID NO: 962813 - RNA, 22 nt, Human
auuuaaugucgagcuauuguag

SEQ ID NO: 962814 - RNA, 22 nt, Human
agauacauagcugugagcacac

SEQ ID NO: 962815 - RNA, 17 nt, Human
auuuccucagggcugag

SEQ ID NO: 962816 - RNA, 22 nt, Human
uccuggccaaguuacucucugc

SEQ ID NO: 962817 - RNA, 22 nt, Human
caguccaggccuggaggagcca

SEQ ID NO: 962818 - RNA, 22 nt, Human
ggcccugggcagaggagugggc

SEQ ID NO: 962819 - RNA, 21 nt, Human
ugucagaaauaagcaugugau

SEQ ID NO: 962820 - RNA, 22 nt, Human
agccagacauggcuccugcucc

SEQ ID NO: 962821 - RNA, 22 nt, Human
acugcaucugaaacauggguca

SEQ ID NO: 962822 - RNA, 22 nt, Human
cucagaguccccacaucugggu

SEQ ID NO: 962823 - RNA, 22 nt, Human
agcagccauuuaaaaugaauug

SEQ ID NO: 962824 - RNA, 22 nt, Human
ggcuucagugagcugagcucac

SEQ ID NO: 962825 - RNA, 22 nt, Human
cauggcaggaggcugcuggcag

SEQ ID NO: 962826 - RNA, 22 nt, Human
uccucacagucaacacuuugag

SEQ ID NO: 962827 - RNA, 22 nt, Human
gagcucagcccaaagagcagug

SEQ ID NO: 962828 - RNA, 22 nt, Human
aacuuuaaggcuauaaauuaug

SEQ ID NO: 962829 - RNA, 22 nt, Human
agggcuggcuaggugcguuccc

SEQ ID NO: 962830 - RNA, 22 nt, Human
gcugguuaggugagggugcgcc

SEQ ID NO: 962831 - RNA, 22 nt, Human
uaauuccaaguugagacaugca

SEQ ID NO: 962832 - RNA, 22 nt, Human
agaggcccucucugcucagucu

SEQ ID NO: 962833 - RNA, 22 nt, Human
ugggccacuugaaaguggaugu

SEQ ID NO: 962834 - RNA, 22 nt, Human
uggcgugcccuccagacuuggc

SEQ ID NO: 962835 - RNA, 22 nt, Human
agagcugugaaaaugagguuug

SEQ ID NO: 962836 - RNA, 22 nt, Human
ugcauuugucuugucucaugaa

SEQ ID NO: 962837 - RNA, 22 nt, Human
cauuaugugggaaaauguucuu

SEQ ID NO: 962838 - RNA, 22 nt, Human
agcugcuaugacaacaccagcc

SEQ ID NO: 962839 - RNA, 22 nt, Human
ggagaaggaagaaagcuacuau

SEQ ID NO: 962840 - RNA, 22 nt, Human
ggugaaggcacaagagggcaag

SEQ ID NO: 962841 - RNA, 21 nt, Human
gccaccccuggcacaggugcu

SEQ ID NO: 962842 - RNA, 22 nt, Human
uccaggagaggccugaccaggu

SEQ ID NO: 962843 - RNA, 22 nt, Human
cggagcugccugccaagccugc

SEQ ID NO: 962844 - RNA, 22 nt, Human
uuggccaaauacacaccuuuug

SEQ ID NO: 962845 - RNA, 22 nt, Human
aucugaagcuaucugcacuuca

SEQ ID NO: 962846 - RNA, 22 nt, Human
ucaauaaaauuguuuuccuauc

SEQ ID NO: 962847 - RNA, 21 nt, Human
uugaaaguaaauucagcagcu

SEQ ID NO: 962848 - RNA, 22 nt, Human
cauuaucugccauugacaccau

SEQ ID NO: 962849 - RNA, 22 nt, Human
auugaggcagcauaguucaggg

SEQ ID NO: 962850 - RNA, 22 nt, Human
uguguuccugccuggcucuggu

SEQ ID NO: 962851 - RNA, 22 nt, Human
gaggaaccacucugagaagcca

SEQ ID NO: 962852 - RNA, 19 nt, Human
uggaggagaggaaaaguca

SEQ ID NO: 962853 - RNA, 22 nt, Human
aaggucauugguucugaauucu

SEQ ID NO: 962854 - RNA, 22 nt, Human
ccuucuucuguguggcccaaga

SEQ ID NO: 962855 - RNA, 22 nt, Human
gagcagggagacaacucuggug

SEQ ID NO: 962856 - RNA, 22 nt, Human
ggcagcuaggggcagggaauuc

SEQ ID NO: 962857 - RNA, 22 nt, Human
uaaaugcaguuaguacuugcca

SEQ ID NO: 962858 - RNA, 22 nt, Human
agugcauauaugaagaguauga

SEQ ID NO: 962859 - RNA, 22 nt, Human
agccacgucccugucaggguca

SEQ ID NO: 962860 - RNA, 22 nt, Human
gggcuccaacggugagcaugga

SEQ ID NO: 962861 - RNA, 23 nt, Human
cuuuuaacuagaguaucagcugc

SEQ ID NO: 962862 - RNA, 22 nt, Human
gccaccucggcuuucucugcuc

SEQ ID NO: 962863 - RNA, 22 nt, Human
uggagcauauucuggagcuugg

SEQ ID NO: 962864 - RNA, 22 nt, Human
cagaaaauaaaguuucuacgca

SEQ ID NO: 962865 - RNA, 22 nt, Human
uuugcauuguaauauuuaguuc

SEQ ID NO: 962866 - RNA, 22 nt, Human
uugaaaguuuauggagucugca

SEQ ID NO: 962867 - RNA, 19 nt, Human
ccugggaggcggagguugc

SEQ ID NO: 962868 - RNA, 22 nt, Human
gcauuuguacaaaaugcaguag

SEQ ID NO: 962869 - RNA, 22 nt, Human
ugggcagagaguagaggcaacg

SEQ ID NO: 962870 - RNA, 22 nt, Human
cccaggagaccugugaaaggac

SEQ ID NO: 962871 - RNA, 22 nt, Human
uucauucccuuauauuagcauu

SEQ ID NO: 962872 - RNA, 22 nt, Human
acagaaauaacuuuuuauguuu

SEQ ID NO: 962873 - RNA, 22 nt, Human
guggcagcugguaugcagacag

SEQ ID NO: 962874 - RNA, 21 nt, Human
acagccugucaucucaugguc

SEQ ID NO: 962875 - RNA, 22 nt, Human
caguguguggauccucccagga

SEQ ID NO: 962876 - RNA, 22 nt, Human
ugcagucuuccagcugcacaaa

SEQ ID NO: 962877 - RNA, 22 nt, Human
ggucugaguggggccugagauu

SEQ ID NO: 962878 - RNA, 21 nt, Human
gagcauggcuuacaucagcag

SEQ ID NO: 962879 - RNA, 22 nt, Human
ccugucuguauugguuugcuau

SEQ ID NO: 962880 - RNA, 22 nt, Human
ucaacugcaaguuugcuuaguu

SEQ ID NO: 962881 - RNA, 22 nt, Human
gccuuggccaacaccuugcaaa

SEQ ID NO: 962882 - RNA, 22 nt, Human
ucaggcagagcuguggagcucu

SEQ ID NO: 962883 - RNA, 18 nt, Human
cucaccauucugcccaau

SEQ ID NO: 962884 - RNA, 22 nt, Human
gggugggagucuggcccucaaa

SEQ ID NO: 962885 - RNA, 22 nt, Human
gccuggccgcuccgagcuccgc

SEQ ID NO: 962886 - RNA, 22 nt, Human
gcugauguuuaguugauguuac

SEQ ID NO: 962887 - RNA, 22 nt, Human
ugcugcucaaugagaugccauc

SEQ ID NO: 962888 - RNA, 22 nt, Human
uuuuuauaugaaggauagugcg

SEQ ID NO: 962889 - RNA, 22 nt, Human
ugggccuguugccugaguccau

SEQ ID NO: 962890 - RNA, 22 nt, Human
cugcccugaccugccucagagu

SEQ ID NO: 962891 - RNA, 23 nt, Human
gcagaggagcaagcuggacacca

SEQ ID NO: 962892 - RNA, 22 nt, Human
uuugaaagaaaccagugaguga

SEQ ID NO: 962893 - RNA, 22 nt, Human
aaaugucugagacuucugaacu

SEQ ID NO: 962894 - RNA, 22 nt, Human
gcacagcucgagcucaggaggg

SEQ ID NO: 962895 - RNA, 22 nt, Human
gaugugagugguagcugggauu

SEQ ID NO: 962896 - RNA, 22 nt, Human
aaguccaugaucaagauguggc

SEQ ID NO: 962897 - RNA, 22 nt, Human
ugcuucugggcaaaugugugug

SEQ ID NO: 962898 - RNA, 22 nt, Human
caguuucuuggaugccaauuuc

SEQ ID NO: 962899 - RNA, 22 nt, Human
uccuugaauauaauaacaguag

SEQ ID NO: 962900 - RNA, 22 nt, Human
aaggcacuuaacgugggaggau

SEQ ID NO: 962901 - RNA, 22 nt, Human
uggcaagccugagauccgggag

SEQ ID NO: 962902 - RNA, 22 nt, Human
caguacuugggggguucuaagu

SEQ ID NO: 962903 - RNA, 22 nt, Human
aucauuucccuuuagaucacaa

SEQ ID NO: 962904 - RNA, 19 nt, Human
ucccagagucuagagguug

SEQ ID NO: 962905 - RNA, 22 nt, Human
cuucuucaagagaaugggagac

SEQ ID NO: 962906 - RNA, 22 nt, Human
gggcugccuuucuucugggagc

SEQ ID NO: 962907 - RNA, 22 nt, Human
cuggcugccacuucagggucuu

SEQ ID NO: 962908 - RNA, 22 nt, Human
ucagcaaugagaacuggcauuu

SEQ ID NO: 962909 - RNA, 22 nt, Human
acacucugugaggcauguaaug

SEQ ID NO: 962910 - RNA, 22 nt, Human
caagagcuggguggcaagcuag

SEQ ID NO: 962911 - RNA, 22 nt, Human
gcucuuccauuucucuugaacu

SEQ ID NO: 962912 - RNA, 22 nt, Human
aguaaagcagaguugcaguaca

SEQ ID NO: 962913 - RNA, 22 nt, Human
aggccagcuuccagaggggcag

SEQ ID NO: 962914 - RNA, 22 nt, Human
cccugccuuguuggagccuaug

SEQ ID NO: 962915 - RNA, 22 nt, Human
ugucuucaucuccaugcacaga

SEQ ID NO: 962916 - RNA, 22 nt, Human
agcagccacagucugggacagg

SEQ ID NO: 962917 - RNA, 20 nt, Human
ccacaggaguccagucgacc

SEQ ID NO: 962918 - RNA, 22 nt, Human
cagccugggcuccagagucccu

SEQ ID NO: 962919 - RNA, 22 nt, Human
ucugagaggcagaccuuccuaa

SEQ ID NO: 962920 - RNA, 20 nt, Human
ggccuuggccucuuugcagc

SEQ ID NO: 962921 - RNA, 22 nt, Human
acugaaggaaacuuuuguguuu

SEQ ID NO: 962922 - RNA, 22 nt, Human
ccugagugaauucccucacugu

SEQ ID NO: 962923 - RNA, 22 nt, Human
cuguggaaaauuuguauguaau

SEQ ID NO: 962924 - RNA, 22 nt, Human
acagggccagccugggaccugg

SEQ ID NO: 962925 - RNA, 22 nt, Human
cagaggcccagugagagggcug

SEQ ID NO: 962926 - RNA, 22 nt, Human
uggccaaaguagaaaauaauag

SEQ ID NO: 962927 - RNA, 22 nt, Human
uccaaagggaagcgcuuucugu

SEQ ID NO: 962928 - RNA, 22 nt, Human
uuugaacaugcugcaugauaau

SEQ ID NO: 962929 - RNA, 22 nt, Human
auaaagaggauguauuuacagc

SEQ ID NO: 962930 - RNA, 22 nt, Human
gauuuagagaauguuuuguaag

SEQ ID NO: 962931 - RNA, 20 nt, Human
cugcucagaccaacucuucu

SEQ ID NO: 962932 - RNA, 22 nt, Human
aucuagaaguggcaugaauuac

SEQ ID NO: 962933 - RNA, 22 nt, Human
cacugggcaauucugagccuaa

SEQ ID NO: 962934 - RNA, 22 nt, Human
acaggcugcugagccauuugcu

SEQ ID NO: 962935 - RNA, 22 nt, Human
cagaguguuucuuugggugggu

SEQ ID NO: 962936 - RNA, 22 nt, Human
aaaggccacugcaagggaaggu

SEQ ID NO: 962937 - RNA, 22 nt, Human
caccaggcuggagugcagaggu

SEQ ID NO: 962938 - RNA, 22 nt, Human
ucaggccacggcucacugagac

SEQ ID NO: 962939 - RNA, 22 nt, Human
gggcucuguccauuccuucaua

SEQ ID NO: 962940 - RNA, 22 nt, Human
auuaggaaacugaaugucagaa

SEQ ID NO: 962941 - RNA, 22 nt, Human
caaauaguuuuucauguauuau

SEQ ID NO: 962942 - RNA, 22 nt, Human
gcagggacaccuuugugaagcu

SEQ ID NO: 962943 - RNA, 22 nt, Human
aggccaaaccggauggaaaagg

SEQ ID NO: 962944 - RNA, 22 nt, Human
cagagcucuauguucauggagg

SEQ ID NO: 962945 - RNA, 22 nt, Human
aaguuguauauaccgcuuuaag

SEQ ID NO: 962946 - RNA, 22 nt, Human
cuggagcccaggccuggugucu

SEQ ID NO: 962947 - RNA, 22 nt, Human
ggcugccucuggaagcuggaga

SEQ ID NO: 962948 - RNA, 20 nt, Human
ugugcaggagagugaggcug

SEQ ID NO: 962949 - RNA, 22 nt, Human
aaucgguugaacccaggaagug

SEQ ID NO: 962950 - RNA, 19 nt, Human
auagaaaggguuaaagaca

SEQ ID NO: 962951 - RNA, 22 nt, Human
cacacauugaauucauucuugu

SEQ ID NO: 962952 - RNA, 22 nt, Human
aaugcuguauaucuuagcuaau

SEQ ID NO: 962953 - RNA, 22 nt, Human
gaaacugugaggaucuuaacuu

SEQ ID NO: 962954 - RNA, 22 nt, Human
agagguagagguugcagugagc

SEQ ID NO: 962955 - RNA, 15 nt, Human
uggcagcuuguuaag

SEQ ID NO: 962956 - RNA, 22 nt, Human
caacugugaauuuuaugauacc

SEQ ID NO: 962957 - RNA, 20 nt, Human
ggggcugcaugcagagaaga

SEQ ID NO: 962958 - RNA, 17 nt, Human
uuagcaaaauagcacuu

SEQ ID NO: 962959 - RNA, 22 nt, Human
auuaggauguguauauuguguu

SEQ ID NO: 962960 - RNA, 22 nt, Human
auuuuucucuuuccacugagau

SEQ ID NO: 962961 - RNA, 21 nt, Human
ugggagagggcucagcuaccc

SEQ ID NO: 962962 - RNA, 22 nt, Human
gcucugagccgggggccugucc

SEQ ID NO: 962963 - RNA, 22 nt, Human
uuuaaagaaauuccucaucuuu

SEQ ID NO: 962964 - RNA, 22 nt, Human
aucuggcucucucauuuacaaa

SEQ ID NO: 962965 - RNA, 22 nt, Human
gaggcccugaagacagcugggg

SEQ ID NO: 962966 - RNA, 23 nt, Human
ugauuuuaaaaaguaaguuauca

SEQ ID NO: 962967 - RNA, 22 nt, Human
ucugucacaauuugcuuacucu

SEQ ID NO: 962968 - RNA, 22 nt, Human
cagaggcaggauaagaacugcg

SEQ ID NO: 962969 - RNA, 23 nt, Human
cuucucagaagucugugccagga

SEQ ID NO: 962970 - RNA, 22 nt, Human
ccugcugugaaacuggcauaug

SEQ ID NO: 962971 - RNA, 18 nt, Human
ccagaggcccgggcaggc

SEQ ID NO: 962972 - RNA, 22 nt, Human
aaauguauccuacuuccugagu

SEQ ID NO: 962973 - RNA, 22 nt, Human
ggcuggccuguguggccgccac

SEQ ID NO: 962974 - RNA, 22 nt, Human
aguacauacuucaaauguacuu

SEQ ID NO: 962975 - RNA, 20 nt, Human
acuggcagccugccugcugu

SEQ ID NO: 962976 - RNA, 22 nt, Human
cugcugucauagccaucccucc

SEQ ID NO: 962977 - RNA, 22 nt, Human
cugggacagcugagacaggaga

SEQ ID NO: 962978 - RNA, 22 nt, Human
cugggccaagaaguuguguaug

SEQ ID NO: 962979 - RNA, 21 nt, Human
cccagggaagccgcagucacc

SEQ ID NO: 962980 - RNA, 22 nt, Human
cagccugcuagggcaaugccuu

SEQ ID NO: 962981 - RNA, 22 nt, Human
ccagggugaccagcuggccuag

SEQ ID NO: 962982 - RNA, 18 nt, Human
acccucuggcuucugagc

SEQ ID NO: 962983 - RNA, 22 nt, Human
aaggaggaauuucagggugaau

SEQ ID NO: 962984 - RNA, 22 nt, Human
agucccagaugacccagcuacu

SEQ ID NO: 962985 - RNA, 22 nt, Human
acguuuucagugacugugcuuc

SEQ ID NO: 962986 - RNA, 23 nt, Human
gcagagcugcccuauugccuugg

SEQ ID NO: 962987 - RNA, 20 nt, Human
cgugcugugaccuugagcau

SEQ ID NO: 962988 - RNA, 22 nt, Human
ucucagaguuuagagcugagcc

SEQ ID NO: 962989 - RNA, 22 nt, Human
ggcugggcuccgggagcaugcg

SEQ ID NO: 962990 - RNA, 22 nt, Human
uaaaucacuccuaauaaucagu

SEQ ID NO: 962991 - RNA, 22 nt, Human
ccaggcagcaaauuuucugaau

SEQ ID NO: 962992 - RNA, 22 nt, Human
cugccuguuuucugauagauuu

SEQ ID NO: 962993 - RNA, 22 nt, Human
agugaaauuccuggucuuuguu

SEQ ID NO: 962994 - RNA, 22 nt, Human
ugucugucugcaagccagaaag

SEQ ID NO: 962995 - RNA, 22 nt, Human
aaaucugggucaagguggagug

SEQ ID NO: 962996 - RNA, 22 nt, Human
acuccuggguuccggagauucu

SEQ ID NO: 962997 - RNA, 22 nt, Human
auaacagaugugaagugcuaau

SEQ ID NO: 962998 - RNA, 22 nt, Human
ggauggcagucugcaugagaaa

SEQ ID NO: 962999 - RNA, 22 nt, Human
ggcccugagcugaaguacugug

SEQ ID NO: 963000 - RNA, 22 nt, Human
acauuucuugaugccucuguga

SEQ ID NO: 963001 - RNA, 22 nt, Human
cacaugggcguaauguccaugg

SEQ ID NO: 963002 - RNA, 22 nt, Human
ggucagguuuuuaggagugacc

SEQ ID NO: 963003 - RNA, 22 nt, Human
gagggcagaaaauuaugcggug

SEQ ID NO: 963004 - RNA, 22 nt, Human
agcugcuguggggcucggccug

SEQ ID NO: 963005 - RNA, 22 nt, Human
cugccaaggcuggggaggacaa

SEQ ID NO: 963006 - RNA, 22 nt, Human
guuuuauaggugaaauauuacu

SEQ ID NO: 963007 - RNA, 22 nt, Human
cccuuucccuucuggcucaggg

SEQ ID NO: 963008 - RNA, 22 nt, Human
ucacauucucagcaucuauaca

SEQ ID NO: 963009 - RNA, 22 nt, Human
gccagccccuuagggcucuccc

SEQ ID NO: 963010 - RNA, 22 nt, Human
caggccugggcuucggggcuga

SEQ ID NO: 963011 - RNA, 22 nt, Human
uuugaaaggugucgagaugugu

SEQ ID NO: 963012 - RNA, 22 nt, Human
gggcacugugcuaggugcugag

SEQ ID NO: 963013 - RNA, 22 nt, Human
uuuaaaaucagaugggaguugg

SEQ ID NO: 963014 - RNA, 17 nt, Human
gcaaucucagucuccuu

SEQ ID NO: 963015 - RNA, 22 nt, Human
caggcagcugacugucagauau

SEQ ID NO: 963016 - RNA, 22 nt, Human
ugccuggaugugcuggccucac

SEQ ID NO: 963017 - RNA, 22 nt, Human
gcagggcucauucuaguacaau

SEQ ID NO: 963018 - RNA, 22 nt, Human
cacagggcagaggguccguggc

SEQ ID NO: 963019 - RNA, 22 nt, Human
cagcagagcauuugguaggagg

SEQ ID NO: 963020 - RNA, 22 nt, Human
acuuccugcagcuucucagccc

SEQ ID NO: 963021 - RNA, 22 nt, Human
cuguaugaggaucagacuggac

SEQ ID NO: 963022 - RNA, 22 nt, Human
uuuauuguuguuagucauaagu

SEQ ID NO: 963023 - RNA, 22 nt, Human
uggccuccccuaacagccucuu

SEQ ID NO: 963024 - RNA, 22 nt, Human
gcagcuccuccugggcuggaga

SEQ ID NO: 963025 - RNA, 17 nt, Human
ugagacagggcaggccc

SEQ ID NO: 963026 - RNA, 22 nt, Human
uuucacauaaauauuaugccua

SEQ ID NO: 963027 - RNA, 22 nt, Human
gcagccaggaaagcuggacccu

SEQ ID NO: 963028 - RNA, 22 nt, Human
ucacacagauugguagagcuga

SEQ ID NO: 963029 - RNA, 22 nt, Human
cuggcagcuggaggcuagaggc

SEQ ID NO: 963030 - RNA, 22 nt, Human
uuucuguagugugguauguagg

SEQ ID NO: 963031 - RNA, 22 nt, Human
ucacuuauaaaaugcaagaucu

SEQ ID NO: 963032 - RNA, 22 nt, Human
gggcuggggcucaauaauuugu

SEQ ID NO: 963033 - RNA, 22 nt, Human
gaaaucaggaugauguuccaga

SEQ ID NO: 963034 - RNA, 22 nt, Human
caggagaaauguggcugcuacc

SEQ ID NO: 963035 - RNA, 22 nt, Human
caugcacaaagguaagaugcgu

SEQ ID NO: 963036 - RNA, 21 nt, Human
auccauccaucuuggccuaac

SEQ ID NO: 963037 - RNA, 22 nt, Human
uuuuauguaauccuuacugucg

SEQ ID NO: 963038 - RNA, 22 nt, Human
auugcuguggaaauauaagaug

SEQ ID NO: 963039 - RNA, 22 nt, Human
cugagaggcacaaggcauuucg

SEQ ID NO: 963040 - RNA, 22 nt, Human
gagcagugggaaggaacagggu

SEQ ID NO: 963041 - RNA, 22 nt, Human
cugcuuuguaaaauagacauaa

SEQ ID NO: 963042 - RNA, 22 nt, Human
ugguuuugcuaaaauagaaaga

SEQ ID NO: 963043 - RNA, 22 nt, Human
uuaugauuugccacagauuggu

SEQ ID NO: 963044 - RNA, 22 nt, Human
agccuggaccaggggccucaga

SEQ ID NO: 963045 - RNA, 22 nt, Human
cagggaauccauggucauaagg

SEQ ID NO: 963046 - RNA, 22 nt, Human
cauugcccaguaggaucaccag

SEQ ID NO: 963047 - RNA, 22 nt, Human
ugggaguguucuuggcuugcuu

SEQ ID NO: 963048 - RNA, 22 nt, Human
gaugcugaagugaagugaucuu

SEQ ID NO: 963049 - RNA, 22 nt, Human
ucagaacauuuaaaaagugguu

SEQ ID NO: 963050 - RNA, 22 nt, Human
gugguuuugccauuacaaguaa

SEQ ID NO: 963051 - RNA, 20 nt, Human
cccagccccuaccuguugcc

SEQ ID NO: 963052 - RNA, 22 nt, Human
aacaaaccuucccuauacgucu

SEQ ID NO: 963053 - RNA, 22 nt, Human
ugagccaaugauuugaauagag

SEQ ID NO: 963054 - RNA, 22 nt, Human
uggaagcuguggcauaacugag

SEQ ID NO: 963055 - RNA, 22 nt, Human
gaugcagaaaguagacaccauc

SEQ ID NO: 963056 - RNA, 22 nt, Human
ugaagcaggugaauggaugucg

SEQ ID NO: 963057 - RNA, 22 nt, Human
ucugggcuugguuagggcuguu

SEQ ID NO: 963058 - RNA, 22 nt, Human
gccugcuggcuguccauugcag

SEQ ID NO: 963059 - RNA, 22 nt, Human
guggggggacguuggucacuuu

SEQ ID NO: 963060 - RNA, 22 nt, Human
ggagccuggccuggcucugugu

SEQ ID NO: 963061 - RNA, 18 nt, Human
ccugccagucuggagcag

SEQ ID NO: 963062 - RNA, 22 nt, Human
agagccugaggcccugagaggg

SEQ ID NO: 963063 - RNA, 22 nt, Human
ucugagagcuguagaagccuau

SEQ ID NO: 963064 - RNA, 22 nt, Human
gugucccagcagcacauuggcu

SEQ ID NO: 963065 - RNA, 22 nt, Human
agcaccugcacaguggaggaaa

SEQ ID NO: 963066 - RNA, 22 nt, Human
cagagccaaaccucagggcccg

SEQ ID NO: 963067 - RNA, 22 nt, Human
agaaaacauuacauaggugugu

SEQ ID NO: 963068 - RNA, 22 nt, Human
ucccagagcugauaagccuuua

SEQ ID NO: 963069 - RNA, 22 nt, Human
uauuaucauugguaauaugguc

SEQ ID NO: 963070 - RNA, 22 nt, Human
gucaggaugggcagccaaacua

SEQ ID NO: 963071 - RNA, 22 nt, Human
gcuggccugggcucaagaccag

SEQ ID NO: 963072 - RNA, 22 nt, Human
ggcagcacugcagcuuguuggg

SEQ ID NO: 963073 - RNA, 22 nt, Human
agcuuguuagaaauguagacuc

SEQ ID NO: 963074 - RNA, 22 nt, Human
guacauuggcaacucucuuaga

SEQ ID NO: 963075 - RNA, 17 nt, Human
ucuguucaagugagagg

SEQ ID NO: 963076 - RNA, 22 nt, Human
agaaaucucaguaucucaggga

SEQ ID NO: 963077 - RNA, 22 nt, Human
cagcuucugucugauuagcaag

SEQ ID NO: 963078 - RNA, 22 nt, Human
aggcagccaaucagaggcugac

SEQ ID NO: 963079 - RNA, 22 nt, Human
aagggcugaaagaccuugggca

SEQ ID NO: 963080 - RNA, 22 nt, Human
aaacugaauucccaagggcaug

SEQ ID NO: 963081 - RNA, 16 nt, Human
ucccaggaggcggaac

SEQ ID NO: 963082 - RNA, 22 nt, Human
uugucugugaaauggaaauagu

SEQ ID NO: 963083 - RNA, 22 nt, Human
uaauguguugaauauuuguaca

SEQ ID NO: 963084 - RNA, 22 nt, Human
gcccaggaguugaaugcagcag

SEQ ID NO: 963085 - RNA, 22 nt, Human
gggacuucauagcuaggcacuu

SEQ ID NO: 963086 - RNA, 22 nt, Human
uuccuguauucuaaagggaaag

SEQ ID NO: 963087 - RNA, 22 nt, Human
acagggcagagaggcaggcuug

SEQ ID NO: 963088 - RNA, 22 nt, Human
aggcagcagggccacuggcuga

SEQ ID NO: 963089 - RNA, 22 nt, Human
agcuuccaauuucuccaagaga

SEQ ID NO: 963090 - RNA, 22 nt, Human
cagggaggcugucuuaugccug

SEQ ID NO: 963091 - RNA, 22 nt, Human
acacauauauacauauuugugc

SEQ ID NO: 963092 - RNA, 22 nt, Human
acagaggccccgugggagagcc

SEQ ID NO: 963093 - RNA, 22 nt, Human
cugagcucuaaugucagccuug

SEQ ID NO: 963094 - RNA, 22 nt, Human
gcugucccaugguugcaagaug

SEQ ID NO: 963095 - RNA, 22 nt, Human
ucacucugauagauaagcuaac

SEQ ID NO: 963096 - RNA, 22 nt, Human
ccucaggggugcccacagcugc

SEQ ID NO: 963097 - RNA, 22 nt, Human
ugccuggguguaaagggccaac

SEQ ID NO: 963098 - RNA, 22 nt, Human
cagcaguggccaucuguguggu

SEQ ID NO: 963099 - RNA, 22 nt, Human
ggguagcaugugucagaguuug

SEQ ID NO: 963100 - RNA, 22 nt, Human
ucccugggcaucacguugcuuc

SEQ ID NO: 963101 - RNA, 22 nt, Human
uauuugagcgaagcaguguuuu

SEQ ID NO: 963102 - RNA, 22 nt, Human
cccauuuaaacacaagcuuuca

SEQ ID NO: 963103 - RNA, 22 nt, Human
ccugagagcgaguggccucaug

SEQ ID NO: 963104 - RNA, 17 nt, Human
agagagagcaugccacc

SEQ ID NO: 963105 - RNA, 22 nt, Human
uacauucuacuuuuucacuccc

SEQ ID NO: 963106 - RNA, 22 nt, Human
uucuuuuacauuaagauuucag

SEQ ID NO: 963107 - RNA, 22 nt, Human
ccuaggcccauuaauuccccuu

SEQ ID NO: 963108 - RNA, 22 nt, Human
cugagaggaugcugcaguggag

SEQ ID NO: 963109 - RNA, 22 nt, Human
acacagccgugaaucugcuucu

SEQ ID NO: 963110 - RNA, 22 nt, Human
cagcugaguuacucugaggucu

SEQ ID NO: 963111 - RNA, 22 nt, Human
cagcuggcgggcagagccgcca

SEQ ID NO: 963112 - RNA, 22 nt, Human
uguuucauuaguacugacaaua

SEQ ID NO: 963113 - RNA, 22 nt, Human
aauauccagguagaugucuucu

SEQ ID NO: 963114 - RNA, 22 nt, Human
ugcucugaugggguggacauag

SEQ ID NO: 963115 - RNA, 22 nt, Human
cucucugguacauagaguuugg

SEQ ID NO: 963116 - RNA, 22 nt, Human
cuuccucccccacacacucacu

SEQ ID NO: 963117 - RNA, 22 nt, Human
gagcaacaguuuaugguuuuuc

SEQ ID NO: 963118 - RNA, 22 nt, Human
gggggcuguccugugcauugua

SEQ ID NO: 963119 - RNA, 22 nt, Human
uguguacucaauugagccauuu

SEQ ID NO: 963120 - RNA, 22 nt, Human
caggagugagaugcgaucacuu

SEQ ID NO: 963121 - RNA, 22 nt, Human
agcagccaaccuuacauucauc

SEQ ID NO: 963122 - RNA, 22 nt, Human
ggggcagcucccgagggcagga

SEQ ID NO: 963123 - RNA, 22 nt, Human
guuacacaggaaaacauuagca

SEQ ID NO: 963124 - RNA, 22 nt, Human
caacuccuccccagcaugccaa

SEQ ID NO: 963125 - RNA, 22 nt, Human
uugucuguaaagacggccacca

SEQ ID NO: 963126 - RNA, 22 nt, Human
gaucuuggggggaucaccaugg

SEQ ID NO: 963127 - RNA, 22 nt, Human
cuucuuaucaaguggcaaaucu

SEQ ID NO: 963128 - RNA, 22 nt, Human
uguaaauugaaggaaauuugug

SEQ ID NO: 963129 - RNA, 22 nt, Human
aaggcagccauagcaccaucca

SEQ ID NO: 963130 - RNA, 22 nt, Human
cauguaaaacacucagaacagu

SEQ ID NO: 963131 - RNA, 22 nt, Human
guucuucaggcugugcucuaga

SEQ ID NO: 963132 - RNA, 22 nt, Human
uccaggagugugugcuaauggg

SEQ ID NO: 963133 - RNA, 22 nt, Human
uagaaaucagguuuuuagaaag

SEQ ID NO: 963134 - RNA, 21 nt, Human
auaagcaugcugauuacauuu

SEQ ID NO: 963135 - RNA, 22 nt, Human
acauaaugaaaugcagaaauca

SEQ ID NO: 963136 - RNA, 21 nt, Human
ccagagccugcugagcccccu

SEQ ID NO: 963137 - RNA, 22 nt, Human
agaugaagacucaggagcaggu

SEQ ID NO: 963138 - RNA, 22 nt, Human
ucuuuauuuuaugcuugugcaa

SEQ ID NO: 963139 - RNA, 22 nt, Human
agugaaauugcuguaagaggaa

SEQ ID NO: 963140 - RNA, 22 nt, Human
uggcugggggugcuauagcugc

SEQ ID NO: 963141 - RNA, 22 nt, Human
ugucagggcaugcgguccagcc

SEQ ID NO: 963142 - RNA, 20 nt, Human
gcuuuuucuaauagcagucc

SEQ ID NO: 963143 - RNA, 22 nt, Human
ugugaaggagaugaagggagug

SEQ ID NO: 963144 - RNA, 22 nt, Human
gaccaggacacaguggcaaggu

SEQ ID NO: 963145 - RNA, 18 nt, Human
ugggcacaaugaacagca

SEQ ID NO: 963146 - RNA, 22 nt, Human
cagcugccacaccucuuucucu

SEQ ID NO: 963147 - RNA, 22 nt, Human
gccuggcuccuaagagcacaac

SEQ ID NO: 963148 - RNA, 22 nt, Human
aggcccuggcccccagagauuc

SEQ ID NO: 963149 - RNA, 22 nt, Human
uuguuuuaucuuucuacagacu

SEQ ID NO: 963150 - RNA, 22 nt, Human
cuuuccaaugucacuaugaauc

SEQ ID NO: 963151 - RNA, 23 nt, Human
ugcucugugaauaguuggugacu

SEQ ID NO: 963152 - RNA, 23 nt, Human
uugcuuucaucaugagaugcucc

SEQ ID NO: 963153 - RNA, 23 nt, Human
ucuccagugucucuucauugagu

SEQ ID NO: 963154 - RNA, 22 nt, Human
uaggcagccagcaucaguuggg

SEQ ID NO: 963155 - RNA, 22 nt, Human
ucugggaaaugcuguuccuugu

SEQ ID NO: 963156 - RNA, 18 nt, Human
acagacaaaauggaaaug

SEQ ID NO: 963157 - RNA, 22 nt, Human
uauguacacauacacuuguaau

SEQ ID NO: 963158 - RNA, 22 nt, Human
aagacagagggaagcaaugaug

SEQ ID NO: 963159 - RNA, 22 nt, Human
uaauaggagccaggucacauag

SEQ ID NO: 963160 - RNA, 22 nt, Human
ucaaauaccagcuuuuccagaa

SEQ ID NO: 963161 - RNA, 22 nt, Human
ccuggaaggcaggcauggauug

SEQ ID NO: 963162 - RNA, 22 nt, Human
uagagcauuuagaggggcagga

SEQ ID NO: 963163 - RNA, 22 nt, Human
caugcaggcacccagagcccac

SEQ ID NO: 963164 - RNA, 22 nt, Human
ucucucagaggccaggguccug

SEQ ID NO: 963165 - RNA, 20 nt, Human
gggaguggugguagccugug

SEQ ID NO: 963166 - RNA, 20 nt, Human
ccuguucacugcgcaguuuc

SEQ ID NO: 963167 - RNA, 22 nt, Human
uacucugcucauuggagugugu

SEQ ID NO: 963168 - RNA, 22 nt, Human
ccaggagaugggagcaucuaaa

SEQ ID NO: 963169 - RNA, 22 nt, Human
ccugaggcuuaaucugucccaa

SEQ ID NO: 963170 - RNA, 23 nt, Human
cagggcugggcuugguguuaggc

SEQ ID NO: 963171 - RNA, 21 nt, Human
ccugugugucugacugggcua

SEQ ID NO: 963172 - RNA, 22 nt, Human
ccuggcugggguagaagugagg

SEQ ID NO: 963173 - RNA, 22 nt, Human
gucccagaggacagggucacau

SEQ ID NO: 963174 - RNA, 22 nt, Human
uuaucacuuaugagcuuuuugc

SEQ ID NO: 963175 - RNA, 19 nt, Human
agcuccugggcucugggcc

SEQ ID NO: 963176 - RNA, 19 nt, Human
gcuggcagauguggccgug

SEQ ID NO: 963177 - RNA, 23 nt, Human
gccuggccaccccagggcugcuu

SEQ ID NO: 963178 - RNA, 22 nt, Human
aaagucauugcuguuaucaaug

SEQ ID NO: 963179 - RNA, 22 nt, Human
cugagacuuucaugugcuuuua

SEQ ID NO: 963180 - RNA, 22 nt, Human
gcaggccagcugugcagauggg

SEQ ID NO: 963181 - RNA, 22 nt, Human
uuuggacuuagccugcagaauu

SEQ ID NO: 963182 - RNA, 22 nt, Human
ugcuggggagugauugaccauc

SEQ ID NO: 963183 - RNA, 22 nt, Human
aucagcaaucucguguauuagg

SEQ ID NO: 963184 - RNA, 22 nt, Human
gcccaugcucucaggcgggccu

SEQ ID NO: 963185 - RNA, 22 nt, Human
aaagauuugaguucugcuuaua

SEQ ID NO: 963186 - RNA, 22 nt, Human
aagcaccucuaugauugcuuuu

SEQ ID NO: 963187 - RNA, 20 nt, Human
agacaaaaugacuucaugca

SEQ ID NO: 963188 - RNA, 22 nt, Human
ucacaugcccuguauuuaccag

SEQ ID NO: 963189 - RNA, 18 nt, Human
uggcucagauggcuuuaa

SEQ ID NO: 963190 - RNA, 22 nt, Human
ggcuuggaaauugcaggacaca

SEQ ID NO: 963191 - RNA, 22 nt, Human
aaaaguuuaagacucauucuag

SEQ ID NO: 963192 - RNA, 22 nt, Human
gcugagagcggccagcugggaa

SEQ ID NO: 963193 - RNA, 22 nt, Human
augaaauaucuugaagaaauuc

SEQ ID NO: 963194 - RNA, 20 nt, Human
cagagaccaggccagguguc

SEQ ID NO: 963195 - RNA, 22 nt, Human
ucaggagauguaaccuuagcug

SEQ ID NO: 963196 - RNA, 22 nt, Human
agcacaggcuuuggugugaggg

SEQ ID NO: 963197 - RNA, 22 nt, Human
cuguggaaggccuguccugaaa

SEQ ID NO: 963198 - RNA, 22 nt, Human
aagcagccagccaucaugcccg

SEQ ID NO: 963199 - RNA, 22 nt, Human
auguucuuucagccagugcauc

SEQ ID NO: 963200 - RNA, 22 nt, Human
gccuggagcuacuggacacuga

SEQ ID NO: 963201 - RNA, 22 nt, Human
ucucaggaagugauauugagac

SEQ ID NO: 963202 - RNA, 16 nt, Human
aggccaaaaaggggca

SEQ ID NO: 963203 - RNA, 22 nt, Human
uuuuccucaggaaugcuaagcu

SEQ ID NO: 963204 - RNA, 22 nt, Human
cugugucuaaucuuauacauca

SEQ ID NO: 963205 - RNA, 22 nt, Human
ucugucaggagauuggcagcug

SEQ ID NO: 963206 - RNA, 22 nt, Human
gcacuugguaggacuucaguga

SEQ ID NO: 963207 - RNA, 22 nt, Human
cacagaagaaucaugcuguguu

SEQ ID NO: 963208 - RNA, 22 nt, Human
gaggagcuugugagaagauguc

SEQ ID NO: 963209 - RNA, 22 nt, Human
aagauauuuuagaacauucacu

SEQ ID NO: 963210 - RNA, 22 nt, Human
auaaaaguaggaccaacuuaca

SEQ ID NO: 963211 - RNA, 22 nt, Human
auaaaagaaguuuugguacuug

SEQ ID NO: 963212 - RNA, 22 nt, Human
aaaacaguuuaggcaucacagu

SEQ ID NO: 963213 - RNA, 22 nt, Human
uggcagaguaggauggcccugu

SEQ ID NO: 963214 - RNA, 22 nt, Human
uccuucagcuuauuucuuagga

SEQ ID NO: 963215 - RNA, 20 nt, Human
guauuaggagguaaauguaa

SEQ ID NO: 963216 - RNA, 22 nt, Human
uuggccaacagcgacagggcca

SEQ ID NO: 963217 - RNA, 22 nt, Human
gcugccugcucggcuccuggga

SEQ ID NO: 963218 - RNA, 22 nt, Human
uggccacaguguccagcagcag

SEQ ID NO: 963219 - RNA, 22 nt, Human
uuggccaagggcucuuuaggcu

SEQ ID NO: 963220 - RNA, 22 nt, Human
auuuucauggcuucugcucagu

SEQ ID NO: 963221 - RNA, 23 nt, Human
ucuggcuccauccuuggggaucc

SEQ ID NO: 963222 - RNA, 22 nt, Human
caguuucucucaauaagcaucg

SEQ ID NO: 963223 - RNA, 22 nt, Human
ucacaggacccugaggguggcg

SEQ ID NO: 963224 - RNA, 22 nt, Human
auaaacagcuccauuuagugcc

SEQ ID NO: 963225 - RNA, 22 nt, Human
cacucugagaaguacaagcucc

SEQ ID NO: 963226 - RNA, 20 nt, Human
ccaccuggccaaggcugugc

SEQ ID NO: 963227 - RNA, 22 nt, Human
caaaguuaucaacugcaacauu

SEQ ID NO: 963228 - RNA, 22 nt, Human
cucuuuccucagccacagucua

SEQ ID NO: 963229 - RNA, 22 nt, Human
cucagaagaacaaaggcucuac

SEQ ID NO: 963230 - RNA, 22 nt, Human
gaugaggggucauuggcuggga

SEQ ID NO: 963231 - RNA, 22 nt, Human
agggacagaugaaugacugagu

SEQ ID NO: 963232 - RNA, 22 nt, Human
acagugucugacacauuguagc

SEQ ID NO: 963233 - RNA, 21 nt, Human
ccacaggggcuccccugucag

SEQ ID NO: 963234 - RNA, 22 nt, Human
ccaggcugcucacaagcugccc

SEQ ID NO: 963235 - RNA, 22 nt, Human
agucccuguacuuuccacugcc

SEQ ID NO: 963236 - RNA, 22 nt, Human
augggaggaagagaagaugucu

SEQ ID NO: 963237 - RNA, 18 nt, Human
gguggcucagucaugggg

SEQ ID NO: 963238 - RNA, 21 nt, Human
aggccucuucauggccaugau

SEQ ID NO: 963239 - RNA, 22 nt, Human
aaaggugacacucugccagcug

SEQ ID NO: 963240 - RNA, 22 nt, Human
gaggcaucugggcacagaagug

SEQ ID NO: 963241 - RNA, 22 nt, Human
uccagggaugguaaugagcagu

SEQ ID NO: 963242 - RNA, 22 nt, Human
cccuggaggaaaaucugaggcu

SEQ ID NO: 963243 - RNA, 22 nt, Human
cagcaauaaugucuacaaaucu

SEQ ID NO: 963244 - RNA, 22 nt, Human
agguacagcaauauaagagguc

SEQ ID NO: 963245 - RNA, 18 nt, Human
aaagaaggauuggagagc

SEQ ID NO: 963246 - RNA, 22 nt, Human
agggccugacacccuugccagc

SEQ ID NO: 963247 - RNA, 20 nt, Human
ugcagggcugccucccagcu

SEQ ID NO: 963248 - RNA, 22 nt, Human
ccugauggagcccugcugcaug

SEQ ID NO: 963249 - RNA, 22 nt, Human
aaggcagcaugaaucccuguac

SEQ ID NO: 963250 - RNA, 22 nt, Human
ggagggugcauuuuacccugug

SEQ ID NO: 963251 - RNA, 18 nt, Human
uccucucuuuccccaggg

SEQ ID NO: 963252 - RNA, 22 nt, Human
ucauuaagauuacgugccagaa

SEQ ID NO: 963253 - RNA, 22 nt, Human
ccaaggagcucauauucuuguu

SEQ ID NO: 963254 - RNA, 22 nt, Human
gcuggcagaauuucuucuugcu

SEQ ID NO: 963255 - RNA, 22 nt, Human
gccuccugaaaggaagagcucc

SEQ ID NO: 963256 - RNA, 22 nt, Human
ugaggggaaggcaugauaaaua

SEQ ID NO: 963257 - RNA, 22 nt, Human
gguggcuggaggagcugaugga

SEQ ID NO: 963258 - RNA, 22 nt, Human
ccagcuucucucugaugcagcu

SEQ ID NO: 963259 - RNA, 22 nt, Human
gggcagcucuuugguauccuuc

SEQ ID NO: 963260 - RNA, 22 nt, Human
aaauucaguuuuaauaaucacu

SEQ ID NO: 963261 - RNA, 22 nt, Human
aggccugggacgggagccguga

SEQ ID NO: 963262 - RNA, 22 nt, Human
aucuugcauuugcuaaaaugca

SEQ ID NO: 963263 - RNA, 22 nt, Human
uguggagcacuguuccuggcau

SEQ ID NO: 963264 - RNA, 22 nt, Human
gccugugcauagcagcggacuc

SEQ ID NO: 963265 - RNA, 22 nt, Human
aucuuccuucacuuucucccac

SEQ ID NO: 963266 - RNA, 22 nt, Human
ccucaggauccgcaggugcagu

SEQ ID NO: 963267 - RNA, 22 nt, Human
gauugaaacauaggcagucgag

SEQ ID NO: 963268 - RNA, 22 nt, Human
caacaaguggguacuuuacagg

SEQ ID NO: 963269 - RNA, 22 nt, Human
ucugccuuccccauaaucugau

SEQ ID NO: 963270 - RNA, 22 nt, Human
aacagcagggggaccugcuggu

SEQ ID NO: 963271 - RNA, 22 nt, Human
cauauaaauacaacauguguua

SEQ ID NO: 963272 - RNA, 22 nt, Human
uuguuuucuccacugcaucuua

SEQ ID NO: 963273 - RNA, 22 nt, Human
uauaauccauucauugauuucu

SEQ ID NO: 963274 - RNA, 22 nt, Human
uuuaaaauuuagaccucuccac

SEQ ID NO: 963275 - RNA, 22 nt, Human
uggaaggagacugggaagugug

SEQ ID NO: 963276 - RNA, 19 nt, Human
cuucuggcccugagccacc

SEQ ID NO: 963277 - RNA, 22 nt, Human
ggccaaaugaaggcaaugggac

SEQ ID NO: 963278 - RNA, 18 nt, Human
cagaaaucacaccagcac

SEQ ID NO: 963279 - RNA, 22 nt, Human
cacaggaggaggugcccgggcc

SEQ ID NO: 963280 - RNA, 22 nt, Human
uggcaucauagccaaggugcuu

SEQ ID NO: 963281 - RNA, 22 nt, Human
cuggcuccuccaaggccuggag

SEQ ID NO: 963282 - RNA, 22 nt, Human
ccagccaggcuggcuguggagg

SEQ ID NO: 963283 - RNA, 22 nt, Human
aagcucugcucagcagacuagg

SEQ ID NO: 963284 - RNA, 22 nt, Human
gugauuucuaaucaucugaaug

SEQ ID NO: 963285 - RNA, 22 nt, Human
acccaggagagagcuauaaaau

SEQ ID NO: 963286 - RNA, 20 nt, Human
auacaaagagauugauguau

SEQ ID NO: 963287 - RNA, 22 nt, Human
agauacaugucaagagacuuau

SEQ ID NO: 963288 - RNA, 22 nt, Human
cuucacaauucuaacagggcaa

SEQ ID NO: 963289 - RNA, 22 nt, Human
cucaggccauucuuccagcugc

SEQ ID NO: 963290 - RNA, 21 nt, Human
acuggccaccacuggcagggg

SEQ ID NO: 963291 - RNA, 20 nt, Human
agcccuguuuccuggagaga

SEQ ID NO: 963292 - RNA, 22 nt, Human
agaauucuccuucagggcagga

SEQ ID NO: 963293 - RNA, 22 nt, Human
gcugccuugaacuuggccuggg

SEQ ID NO: 963294 - RNA, 22 nt, Human
gcuggccaaaguguaccuggag

SEQ ID NO: 963295 - RNA, 22 nt, Human
gaaggagagagacaucgucccu

SEQ ID NO: 963296 - RNA, 22 nt, Human
caggcacugugcugagcucugc

SEQ ID NO: 963297 - RNA, 22 nt, Human
agggaagcuuguuacugagaag

SEQ ID NO: 963298 - RNA, 22 nt, Human
gggacuggaguagaggccggug

SEQ ID NO: 963299 - RNA, 22 nt, Human
uacaaaaaauugauacugacga

SEQ ID NO: 963300 - RNA, 22 nt, Human
uuuccaauaaagugucauuguu

SEQ ID NO: 963301 - RNA, 22 nt, Human
uaauaucuacuucauagaguuu

SEQ ID NO: 963302 - RNA, 22 nt, Human
accuugaugccuuuccaagaug

SEQ ID NO: 963303 - RNA, 22 nt, Human
accuguuuggaggagguguuag

SEQ ID NO: 963304 - RNA, 22 nt, Human
caggcacucauucagagaggug

SEQ ID NO: 963305 - RNA, 22 nt, Human
augcaguaaauguuaagaaaaa

SEQ ID NO: 963306 - RNA, 22 nt, Human
cauugcacgggcgucugucugu

SEQ ID NO: 963307 - RNA, 22 nt, Human
uggcacugaccccaggccugug

SEQ ID NO: 963308 - RNA, 22 nt, Human
gaaggccauuagagccugugcc

SEQ ID NO: 963309 - RNA, 17 nt, Human
cucacggaggaugaauc

SEQ ID NO: 963310 - RNA, 20 nt, Human
ugcuggggacauacagggug

SEQ ID NO: 963311 - RNA, 22 nt, Human
gaauucuuuucuuucugaaagu

SEQ ID NO: 963312 - RNA, 22 nt, Human
ucucacuuuccagacuuuucaa

SEQ ID NO: 963313 - RNA, 22 nt, Human
cggcuggggcuguccccaugac

SEQ ID NO: 963314 - RNA, 22 nt, Human
agaaaugacaagacugaucagg

SEQ ID NO: 963315 - RNA, 22 nt, Human
cuauugaauagcccaaaucauu

SEQ ID NO: 963316 - RNA, 22 nt, Human
uuauucuuuucuccagaauccc

SEQ ID NO: 963317 - RNA, 22 nt, Human
agcuggcagcucucagggguac

SEQ ID NO: 963318 - RNA, 22 nt, Human
accaucaguacuggaugcugac

SEQ ID NO: 963319 - RNA, 22 nt, Human
ugggcagaaaucaguaucagau

SEQ ID NO: 963320 - RNA, 22 nt, Human
ucaaugauaguacaaucagccu

SEQ ID NO: 963321 - RNA, 22 nt, Human
cuauuacauuucuggacauuca

SEQ ID NO: 963322 - RNA, 22 nt, Human
cugggcucagcccaugcugucc

SEQ ID NO: 963323 - RNA, 20 nt, Human
ccagucucuaucagaaauaa

SEQ ID NO: 963324 - RNA, 21 nt, Human
ccugagccuguuuauccagaa

SEQ ID NO: 963325 - RNA, 22 nt, Human
gcuggcugaggucuagcucuuu

SEQ ID NO: 963326 - RNA, 22 nt, Human
aaggccugcucagcugucugug

SEQ ID NO: 963327 - RNA, 22 nt, Human
cuggcuggucaucagcaguacg

SEQ ID NO: 963328 - RNA, 22 nt, Human
acuuccuggcugggugaccugg

SEQ ID NO: 963329 - RNA, 22 nt, Human
aaugugcagaugaauaaacaaa

SEQ ID NO: 963330 - RNA, 22 nt, Human
augucccaagauacagcuagag

SEQ ID NO: 963331 - RNA, 17 nt, Human
cuccuggcagccucagg

SEQ ID NO: 963332 - RNA, 22 nt, Human
acagccagggucucaggaggcg

SEQ ID NO: 963333 - RNA, 22 nt, Human
ucuugcuaaagaccaacacauu

SEQ ID NO: 963334 - RNA, 22 nt, Human
aaauguuuugcucccauguggu

SEQ ID NO: 963335 - RNA, 22 nt, Human
gcagggcaaugaucccgagagg

SEQ ID NO: 963336 - RNA, 22 nt, Human
ucugucaccgagggcauccaaa

SEQ ID NO: 963337 - RNA, 22 nt, Human
ugaaggcccuaucuccauauac

SEQ ID NO: 963338 - RNA, 22 nt, Human
ccucacuggccagccaggggug

SEQ ID NO: 963339 - RNA, 20 nt, Human
gcauugaguauagacagaug

SEQ ID NO: 963340 - RNA, 22 nt, Human
cugggguggauggguccaaguu

SEQ ID NO: 963341 - RNA, 22 nt, Human
cuuuucaugagucuguuauggg

SEQ ID NO: 963342 - RNA, 22 nt, Human
aguccuucaagaaaucuggaaa

SEQ ID NO: 963343 - RNA, 22 nt, Human
cugagccaguagucagggacaa

SEQ ID NO: 963344 - RNA, 22 nt, Human
gccagguggcugagcagcugca

SEQ ID NO: 963345 - RNA, 23 nt, Human
acacauuuuucccguucugaggu

SEQ ID NO: 963346 - RNA, 22 nt, Human
gcccaggauaaugcugucccug

SEQ ID NO: 963347 - RNA, 22 nt, Human
ugaagcaguuacuggguguuaa

SEQ ID NO: 963348 - RNA, 22 nt, Human
uuuaaauuuguguuuagagggu

SEQ ID NO: 963349 - RNA, 21 nt, Human
guauugcagaguuaugugcuc

SEQ ID NO: 963350 - RNA, 22 nt, Human
uucuuacuaguauguuucagca

SEQ ID NO: 963351 - RNA, 22 nt, Human
cccaggagguggagguugcggu

SEQ ID NO: 963352 - RNA, 22 nt, Human
cugugucucuccuuacaagacu

SEQ ID NO: 963353 - RNA, 22 nt, Human
uuucacaaaugucuuuaacuug

SEQ ID NO: 963354 - RNA, 22 nt, Human
uccaggagaccagauguaggcc

SEQ ID NO: 963355 - RNA, 23 nt, Human
ucucagaggauuccugggccuug

SEQ ID NO: 963356 - RNA, 22 nt, Human
gcucucugccauaugaggauac

SEQ ID NO: 963357 - RNA, 23 nt, Human
ucagaaugcacugaauuuacccu

SEQ ID NO: 963358 - RNA, 22 nt, Human
cugccucugguuuuggucccug

SEQ ID NO: 963359 - RNA, 22 nt, Human
cccuggaguagcacugggucgc

SEQ ID NO: 963360 - RNA, 23 nt, Human
cccagcuuucccacugccgagag

SEQ ID NO: 963361 - RNA, 22 nt, Human
cuuaggaugaguuuuugcguuu

SEQ ID NO: 963362 - RNA, 21 nt, Human
ccuggcugcacaguugcuggu

SEQ ID NO: 963363 - RNA, 21 nt, Human
gaugaagcaaucuuucuguug

SEQ ID NO: 963364 - RNA, 22 nt, Human
agacagugauguaagcaggagu

SEQ ID NO: 963365 - RNA, 22 nt, Human
ucaaaugcuucuacuccuaaga

SEQ ID NO: 963366 - RNA, 22 nt, Human
ucaggagaguguucaguggagg

SEQ ID NO: 963367 - RNA, 20 nt, Human
ggcagagggccugggagaag

SEQ ID NO: 963368 - RNA, 22 nt, Human
caguacuugggaaugcugggga

SEQ ID NO: 963369 - RNA, 20 nt, Human
ucucagcauaagaacccuuc

SEQ ID NO: 963370 - RNA, 22 nt, Human
cugcccaggaaggagaggaugg

SEQ ID NO: 963371 - RNA, 19 nt, Human
uguguguuuauauauguau

SEQ ID NO: 963372 - RNA, 22 nt, Human
gaaucucaguggaagcaggaag

SEQ ID NO: 963373 - RNA, 22 nt, Human
ccucuuugugccugcaggcugc

SEQ ID NO: 963374 - RNA, 22 nt, Human
aacaaguaaguuuauauauauu

SEQ ID NO: 963375 - RNA, 22 nt, Human
ucucacuggguauaaaugagua

SEQ ID NO: 963376 - RNA, 22 nt, Human
gccaaagcagucuugccucugc

SEQ ID NO: 963377 - RNA, 22 nt, Human
gcuguggguccggaccccacgg

SEQ ID NO: 963378 - RNA, 22 nt, Human
caggugggccgggguuuguucu

SEQ ID NO: 963379 - RNA, 22 nt, Human
agagugcaaccgaaacaagcag

SEQ ID NO: 963380 - RNA, 22 nt, Human
cuguagccagaagcagaaggcc

SEQ ID NO: 963381 - RNA, 22 nt, Human
ugggcagaauugugguaguuaa

SEQ ID NO: 963382 - RNA, 18 nt, Human
gggcuguguucaugccca

SEQ ID NO: 963383 - RNA, 22 nt, Human
gcagaggauagcauaugaaccu

SEQ ID NO: 963384 - RNA, 23 nt, Human
uaguuauuuucucuguaauuugc

SEQ ID NO: 963385 - RNA, 18 nt, Human
ucuauauggacauagaga

SEQ ID NO: 963386 - RNA, 22 nt, Human
ugguaucagagccaucuguauu

SEQ ID NO: 963387 - RNA, 22 nt, Human
gccucugcaacuccgccuuggu

SEQ ID NO: 963388 - RNA, 22 nt, Human
accaaggagacaaagguguauu

SEQ ID NO: 963389 - RNA, 21 nt, Human
ugaaacacucuuuccaugaga

SEQ ID NO: 963390 - RNA, 22 nt, Human
cagcugaguguuggcauguuca

SEQ ID NO: 963391 - RNA, 22 nt, Human
ugcugccagccaggccauggag

SEQ ID NO: 963392 - RNA, 23 nt, Human
gccuggagaaaagcugcaguuca

SEQ ID NO: 963393 - RNA, 22 nt, Human
cauuucuagggaucauaaagua

SEQ ID NO: 963394 - RNA, 22 nt, Human
ccuggggcucaagauggcgccg

SEQ ID NO: 963395 - RNA, 19 nt, Human
auacagauguauccaugau

SEQ ID NO: 963396 - RNA, 22 nt, Human
cagcccucagguccucagcagc

SEQ ID NO: 963397 - RNA, 22 nt, Human
cugggccagggaggugucugua

SEQ ID NO: 963398 - RNA, 22 nt, Human
uugaaauaucaaguuauuagug

SEQ ID NO: 963399 - RNA, 22 nt, Human
ugcauguguguguauuuauaaa

SEQ ID NO: 963400 - RNA, 22 nt, Human
uuguuugaggucacugauauuu

SEQ ID NO: 963401 - RNA, 22 nt, Human
ugggagucagacagccugagau

SEQ ID NO: 963402 - RNA, 22 nt, Human
auuacaaaagaagggagaaggu

SEQ ID NO: 963403 - RNA, 22 nt, Human
caaaaguaauugugguuuucac

SEQ ID NO: 963404 - RNA, 20 nt, Human
ccagagcagccacugaaguu

SEQ ID NO: 963405 - RNA, 22 nt, Human
ucccuggacaacagacuucacu

SEQ ID NO: 963406 - RNA, 22 nt, Human
augggaguuuucucugaugcuc

SEQ ID NO: 963407 - RNA, 22 nt, Human
cugcugugcaggugccuaugau

SEQ ID NO: 963408 - RNA, 22 nt, Human
uccagcagguccgagacaaguu

SEQ ID NO: 963409 - RNA, 22 nt, Human
agcagcuggugagcaagcucag

SEQ ID NO: 963410 - RNA, 22 nt, Human
ggcagagguagcuggaaccagg

SEQ ID NO: 963411 - RNA, 22 nt, Human
cuaggaggcgggggcugcagua

SEQ ID NO: 963412 - RNA, 22 nt, Human
uggucaguugcaucagagaagu

SEQ ID NO: 963413 - RNA, 22 nt, Human
agcugagcucaggcugauguaa

SEQ ID NO: 963414 - RNA, 22 nt, Human
agaggcuguuacacucccagau

SEQ ID NO: 963415 - RNA, 22 nt, Human
ucugggaacugagcuccccuag

SEQ ID NO: 963416 - RNA, 21 nt, Human
gggccacaccuucugcagacc

SEQ ID NO: 963417 - RNA, 22 nt, Human
gaaggccacuuuguguugagaa

SEQ ID NO: 963418 - RNA, 22 nt, Human
gcugagugagguccagagcuug

SEQ ID NO: 963419 - RNA, 22 nt, Human
uaggggugaggccaggcaucag

SEQ ID NO: 963420 - RNA, 22 nt, Human
caggagcucucaucgucagggc

SEQ ID NO: 963421 - RNA, 22 nt, Human
aguggggagguccaggccaccc

SEQ ID NO: 963422 - RNA, 22 nt, Human
ugagggaguuggguguauagga

SEQ ID NO: 963423 - RNA, 15 nt, Human
ugggcagaucacuug

SEQ ID NO: 963424 - RNA, 22 nt, Human
uggccugccugggagcagcagg

SEQ ID NO: 963425 - RNA, 22 nt, Human
ggccucagugggccgcugcagg

SEQ ID NO: 963426 - RNA, 18 nt, Human
ucugagggugcgggagcu

SEQ ID NO: 963427 - RNA, 22 nt, Human
uucucucauucaaauuaaagug

SEQ ID NO: 963428 - RNA, 22 nt, Human
ugauaauauuuugaaucauaag

SEQ ID NO: 963429 - RNA, 19 nt, Human
gcuucccaccagccagccc

SEQ ID NO: 963430 - RNA, 22 nt, Human
gggccugacugagagcuccuca

SEQ ID NO: 963431 - RNA, 22 nt, Human
uccaguucuaggucacucucug

SEQ ID NO: 963432 - RNA, 19 nt, Human
uggccagguacugucugcu

SEQ ID NO: 963433 - RNA, 22 nt, Human
uuauuaaugaguacaaguuauu

SEQ ID NO: 963434 - RNA, 22 nt, Human
gcagccacacuguuacagaaug

SEQ ID NO: 963435 - RNA, 22 nt, Human
ugucucaguacacuccgauguu

SEQ ID NO: 963436 - RNA, 22 nt, Human
cucaggauggaagccuacagga

SEQ ID NO: 963437 - RNA, 22 nt, Human
agacaggcagaggcugcagagg

SEQ ID NO: 963438 - RNA, 22 nt, Human
agauacaucuugaacuucuaga

SEQ ID NO: 963439 - RNA, 22 nt, Human
gccugggaagacuaagugggag

SEQ ID NO: 963440 - RNA, 22 nt, Human
ggagcugggguuggcaucuucc

SEQ ID NO: 963441 - RNA, 22 nt, Human
aaagauuucagaagccugugcc

SEQ ID NO: 963442 - RNA, 22 nt, Human
ggcagcuuguccuggaggaugg

SEQ ID NO: 963443 - RNA, 22 nt, Human
uccuggccuagcucacccugga

SEQ ID NO: 963444 - RNA, 22 nt, Human
auuugaagaaaguuuucuagau

SEQ ID NO: 963445 - RNA, 22 nt, Human
ucagaggaccuuacugagaacc

SEQ ID NO: 963446 - RNA, 22 nt, Human
ucaggaauccagacagggcaca

SEQ ID NO: 963447 - RNA, 22 nt, Human
ucacucugccuccauauuacua

SEQ ID NO: 963448 - RNA, 19 nt, Human
cuccucagucccagagguc

SEQ ID NO: 963449 - RNA, 22 nt, Human
uccuggagggaggcggugcuac

SEQ ID NO: 963450 - RNA, 22 nt, Human
aaguuuguucagggcuuacauu

SEQ ID NO: 963451 - RNA, 22 nt, Human
ucaagcaucuuggucuacgauc

SEQ ID NO: 963452 - RNA, 20 nt, Human
cacaggccuugugagcagac

SEQ ID NO: 963453 - RNA, 22 nt, Human
ugcccagcacugugccagucac

SEQ ID NO: 963454 - RNA, 22 nt, Human
guggcuucacauggcauuuggc

SEQ ID NO: 963455 - RNA, 22 nt, Human
ugugauauuugaguauugucaa

SEQ ID NO: 963456 - RNA, 22 nt, Human
cugcuuuguguggucccuccag

SEQ ID NO: 963457 - RNA, 22 nt, Human
aggagcugucagagugccagag

SEQ ID NO: 963458 - RNA, 22 nt, Human
guaagcaucugucucuucugca

SEQ ID NO: 963459 - RNA, 22 nt, Human
ugggccugacucaccugccucc

SEQ ID NO: 963460 - RNA, 22 nt, Human
auagucuuagucuauaguuuug

SEQ ID NO: 963461 - RNA, 22 nt, Human
accuuucaaaguggcuaucacu

SEQ ID NO: 963462 - RNA, 19 nt, Human
uagucuuuauucuuaauuu

SEQ ID NO: 963463 - RNA, 20 nt, Human
cucucccagcacagcuuccu

SEQ ID NO: 963464 - RNA, 22 nt, Human
caaugugugcuuacaggccagu

SEQ ID NO: 963465 - RNA, 22 nt, Human
uacauuuguuauagaaaugaag

SEQ ID NO: 963466 - RNA, 22 nt, Human
ggcugccugaggcugaggcccg

SEQ ID NO: 963467 - RNA, 22 nt, Human
ucucuucuauuugagacuauuu

SEQ ID NO: 963468 - RNA, 22 nt, Human
ucaguuuucucauuuaugagau

SEQ ID NO: 963469 - RNA, 22 nt, Human
ugucucagaggcaggaagagcc

SEQ ID NO: 963470 - RNA, 17 nt, Human
cacaggugugguuugag

SEQ ID NO: 963471 - RNA, 22 nt, Human
ucugccugcuaacuccugcacc

SEQ ID NO: 963472 - RNA, 22 nt, Human
aagaaucauccugcaagagucu

SEQ ID NO: 963473 - RNA, 22 nt, Human
uuuguuuucaaugugucauuca

SEQ ID NO: 963474 - RNA, 22 nt, Human
auaauguguucaucuuacaauu

SEQ ID NO: 963475 - RNA, 22 nt, Human
agaggggacagccaccugcccg

SEQ ID NO: 963476 - RNA, 22 nt, Human
ucugucacuauuggccagaaca

SEQ ID NO: 963477 - RNA, 22 nt, Human
cugcaggcucgaagacacggau

SEQ ID NO: 963478 - RNA, 22 nt, Human
cacagaggcaaccuucuggggu

SEQ ID NO: 963479 - RNA, 22 nt, Human
auugcaccuuggguuuugaaag

SEQ ID NO: 963480 - RNA, 22 nt, Human
acagagcaauucuuggguguuu

SEQ ID NO: 963481 - RNA, 22 nt, Human
aguggcagagcaggugcuggaa

SEQ ID NO: 963482 - RNA, 22 nt, Human
auggccaaauaacagcuugcau

SEQ ID NO: 963483 - RNA, 22 nt, Human
uaaaugagggcugacaugauug

SEQ ID NO: 963484 - RNA, 23 nt, Human
gcucugagggcuuaucccuccca

SEQ ID NO: 963485 - RNA, 22 nt, Human
aggcuggcgacaucuggcgggc

SEQ ID NO: 963486 - RNA, 22 nt, Human
agaaaugacacacaugagacau

SEQ ID NO: 963487 - RNA, 22 nt, Human
augaaggcaguuaaacgucauc

SEQ ID NO: 963488 - RNA, 23 nt, Human
aaccagauaaauggcuccagggc

SEQ ID NO: 963489 - RNA, 22 nt, Human
ccucugcugcuguugagcaccg

SEQ ID NO: 963490 - RNA, 22 nt, Human
uuuuccucuguauuugaaaugc

SEQ ID NO: 963491 - RNA, 22 nt, Human
uaaagguagcaugaaacugcaa

SEQ ID NO: 963492 - RNA, 23 nt, Human
uggagcugggcucagacccuggg

SEQ ID NO: 963493 - RNA, 22 nt, Human
cagaggcugaugugggaugggc

SEQ ID NO: 963494 - RNA, 22 nt, Human
ccacaggggucucuguagcuga

SEQ ID NO: 963495 - RNA, 22 nt, Human
ggucccaggaaucuguguucua

SEQ ID NO: 963496 - RNA, 22 nt, Human
ugucaugcuuauguuacauacu

SEQ ID NO: 963497 - RNA, 22 nt, Human
uagggcaguuauaacauuagug

SEQ ID NO: 963498 - RNA, 22 nt, Human
aaaggucagacuuaggcugggc

SEQ ID NO: 963499 - RNA, 22 nt, Human
aacagcaauagcacuauucauu

SEQ ID NO: 963500 - RNA, 22 nt, Human
aguaaaaucuuaagcacagugg

SEQ ID NO: 963501 - RNA, 22 nt, Human
agcuccuccugugccaggccag

SEQ ID NO: 963502 - RNA, 22 nt, Human
uuacaaagcguugagacaagua

SEQ ID NO: 963503 - RNA, 18 nt, Human
agggaucaucacugcagc

SEQ ID NO: 963504 - RNA, 22 nt, Human
auaaggcagugacuucaucuau

SEQ ID NO: 963505 - RNA, 22 nt, Human
acuuccugggcaugcagagucc

SEQ ID NO: 963506 - RNA, 22 nt, Human
cuguuuauggagguaaggcauc

SEQ ID NO: 963507 - RNA, 22 nt, Human
guucacaaaauucuggccagug

SEQ ID NO: 963508 - RNA, 22 nt, Human
ccagagcugauuccugggacuu

SEQ ID NO: 963509 - RNA, 21 nt, Human
cagcuuugucugucuucgggg

SEQ ID NO: 963510 - RNA, 22 nt, Human
gccaggcuggccagcaccuucu

SEQ ID NO: 963511 - RNA, 22 nt, Human
accaggagggacccugguggcc

SEQ ID NO: 963512 - RNA, 21 nt, Human
agaugcugugcuccaggagca

SEQ ID NO: 963513 - RNA, 22 nt, Human
gccugggugaauuugauccuaa

SEQ ID NO: 963514 - RNA, 22 nt, Human
ugggcugcagggguugagagcu

SEQ ID NO: 963515 - RNA, 22 nt, Human
uuaaaagagcagcccagcauau

SEQ ID NO: 963516 - RNA, 22 nt, Human
caggggcagucugugugcgugg

SEQ ID NO: 963517 - RNA, 22 nt, Human
aguguuucccaguaggaugaaa

SEQ ID NO: 963518 - RNA, 22 nt, Human
cugcgcagcaaucagagaggag

SEQ ID NO: 963519 - RNA, 22 nt, Human
auguguguauauauagucauuu

SEQ ID NO: 963520 - RNA, 18 nt, Human
ugcuggcaacuacuauug

SEQ ID NO: 963521 - RNA, 22 nt, Human
auaaggcaucucucaguuagca

SEQ ID NO: 963522 - RNA, 22 nt, Human
cugagcugggaguggauagugg

SEQ ID NO: 963523 - RNA, 17 nt, Human
aggagucucagaugagc

SEQ ID NO: 963524 - RNA, 22 nt, Human
gaggaacccagcugggguugcc

SEQ ID NO: 963525 - RNA, 20 nt, Human
auugucagccuucagaggag

SEQ ID NO: 963526 - RNA, 22 nt, Human
ggucccaguugcccaggucagg

SEQ ID NO: 963527 - RNA, 22 nt, Human
aggucacauggauaaugaucag

SEQ ID NO: 963528 - RNA, 22 nt, Human
uauucacagguucuggggauca

SEQ ID NO: 963529 - RNA, 22 nt, Human
ucucugguggcuccaucaguag

SEQ ID NO: 963530 - RNA, 22 nt, Human
caggggcuuuuccucuauaagg

SEQ ID NO: 963531 - RNA, 20 nt, Human
aacuuguucuaccuguuuca

SEQ ID NO: 963532 - RNA, 18 nt, Human
gcuggcugcacuucugcu

SEQ ID NO: 963533 - RNA, 22 nt, Human
acacuuuuguguauauccaguu

SEQ ID NO: 963534 - RNA, 20 nt, Human
cucugcuuuaggagagucag

SEQ ID NO: 963535 - RNA, 22 nt, Human
ugcauuauaacugaauguuguu

SEQ ID NO: 963536 - RNA, 22 nt, Human
aagaggaagucuccauggagag

SEQ ID NO: 963537 - RNA, 22 nt, Human
gccuggagaauuaaaaggaagg

SEQ ID NO: 963538 - RNA, 21 nt, Human
guccaguggaggaggacagga

SEQ ID NO: 963539 - RNA, 22 nt, Human
cuucccacuaguaucacagagc

SEQ ID NO: 963540 - RNA, 22 nt, Human
uugcagggaccugcagaaagcu

SEQ ID NO: 963541 - RNA, 22 nt, Human
aagcagcuuaaauuagagccug

SEQ ID NO: 963542 - RNA, 22 nt, Human
uggguucagaucccagcucugu

SEQ ID NO: 963543 - RNA, 22 nt, Human
ucagggcaaagggcagaguuug

SEQ ID NO: 963544 - RNA, 22 nt, Human
gcuccugucuuggggcacuggc

SEQ ID NO: 963545 - RNA, 22 nt, Human
cugcccuguggcucugagucau

SEQ ID NO: 963546 - RNA, 20 nt, Human
ggcugccuccuuccuuuccu

SEQ ID NO: 963547 - RNA, 22 nt, Human
cugcuguguuagcagguuuagu

SEQ ID NO: 963548 - RNA, 22 nt, Human
cagcucccuauggugaggcgac

SEQ ID NO: 963549 - RNA, 23 nt, Human
cccagcagauuguaaagugucca

SEQ ID NO: 963550 - RNA, 22 nt, Human
cucauggauauaagaacuguuu

SEQ ID NO: 963551 - RNA, 22 nt, Human
uccaggaggguuuucugccuuc

SEQ ID NO: 963552 - RNA, 22 nt, Human
cauuuccacuucugaaaacugg

SEQ ID NO: 963553 - RNA, 19 nt, Human
cauuccuuugucugccaaa

SEQ ID NO: 963554 - RNA, 22 nt, Human
aaaguguacuaugucaugaaca

SEQ ID NO: 963555 - RNA, 22 nt, Human
aaggcagccuuuguuugauuga

SEQ ID NO: 963556 - RNA, 22 nt, Human
uagugcacacgcauguagcagu

SEQ ID NO: 963557 - RNA, 22 nt, Human
gaaacugugaucguguucuggg

SEQ ID NO: 963558 - RNA, 22 nt, Human
gagcaccucaauuugcuauuug

SEQ ID NO: 963559 - RNA, 22 nt, Human
cuauuuucauucuuacauuguc

SEQ ID NO: 963560 - RNA, 22 nt, Human
acagccagguaaaggcauggca

SEQ ID NO: 963561 - RNA, 22 nt, Human
ccagggcuggugggagaugcug

SEQ ID NO: 963562 - RNA, 22 nt, Human
uggcagcugaggggaggcuuug

SEQ ID NO: 963563 - RNA, 22 nt, Human
uuagagaugucccaaaaugaag

SEQ ID NO: 963564 - RNA, 22 nt, Human
ucuuccucucuaauugaucaga

SEQ ID NO: 963565 - RNA, 22 nt, Human
cagagcagaaaccugggugauu

SEQ ID NO: 963566 - RNA, 22 nt, Human
uccaggagcucauccacgucaa

SEQ ID NO: 963567 - RNA, 22 nt, Human
aaguucuaauuuugcauucagg

SEQ ID NO: 963568 - RNA, 22 nt, Human
uguacauugucacucaucaagu

SEQ ID NO: 963569 - RNA, 22 nt, Human
agcugggaugauaaccucaguc

SEQ ID NO: 963570 - RNA, 22 nt, Human
cugccacuuacuaggcauggug

SEQ ID NO: 963571 - RNA, 22 nt, Human
ccuguggggccaucucagucac

SEQ ID NO: 963572 - RNA, 22 nt, Human
ucuccuucgaggcccagcuccc

SEQ ID NO: 963573 - RNA, 22 nt, Human
aaaucaguuagugguaggauug

SEQ ID NO: 963574 - RNA, 22 nt, Human
caggguggcaggcaccauggcc

SEQ ID NO: 963575 - RNA, 22 nt, Human
ggucccugguucccucugagcu

SEQ ID NO: 963576 - RNA, 22 nt, Human
uugaacaguccuaagagacccu

SEQ ID NO: 963577 - RNA, 22 nt, Human
ucaauucugguccucaggaacu

SEQ ID NO: 963578 - RNA, 22 nt, Human
ucccagcagucagagcuaugug

SEQ ID NO: 963579 - RNA, 22 nt, Human
uccugggcuugcuccuccagcu

SEQ ID NO: 963580 - RNA, 22 nt, Human
acuguggggggcuuugcucagu

SEQ ID NO: 963581 - RNA, 22 nt, Human
auggacagugugaagcagauag

SEQ ID NO: 963582 - RNA, 22 nt, Human
ggugggcaggcgaggcccaggu

SEQ ID NO: 963583 - RNA, 20 nt, Human
ugagccaaacgaugaagagc

SEQ ID NO: 963584 - RNA, 20 nt, Human
ucagagucaucaaagauggu

SEQ ID NO: 963585 - RNA, 22 nt, Human
agaggccugugugcuccagugg

SEQ ID NO: 963586 - RNA, 22 nt, Human
caagagcugugaccucauucac

SEQ ID NO: 963587 - RNA, 22 nt, Human
ggcuuccuaauacucccuacac

SEQ ID NO: 963588 - RNA, 21 nt, Human
uucagcaguccucuagagaua

SEQ ID NO: 963589 - RNA, 22 nt, Human
uauuucuuucagguauguguug

SEQ ID NO: 963590 - RNA, 22 nt, Human
acaugcauacacguacauaccu

SEQ ID NO: 963591 - RNA, 22 nt, Human
aaggcacuacgcugcuggggcg

SEQ ID NO: 963592 - RNA, 22 nt, Human
gcagggcugcagagggcacugu

SEQ ID NO: 963593 - RNA, 22 nt, Human
gucagcagugucagcucugggg

SEQ ID NO: 963594 - RNA, 22 nt, Human
ggcucuggagacauguggagag

SEQ ID NO: 963595 - RNA, 22 nt, Human
cauuucacaaauggccacauca

SEQ ID NO: 963596 - RNA, 22 nt, Human
gcagagccaugggagguuuuug

SEQ ID NO: 963597 - RNA, 22 nt, Human
uugaauaauuaauuacacucag

SEQ ID NO: 963598 - RNA, 22 nt, Human
ugccucugguuaucugguaccu

SEQ ID NO: 963599 - RNA, 22 nt, Human
uucucagagcacugcugacaaa

SEQ ID NO: 963600 - RNA, 22 nt, Human
aagggcagcuauuaucgucauc

SEQ ID NO: 963601 - RNA, 22 nt, Human
guucuugccagcauccucaggu

SEQ ID NO: 963602 - RNA, 22 nt, Human
uuuugaaagaguccugcuacag

SEQ ID NO: 963603 - RNA, 22 nt, Human
accaggagucuagccuagucaa

SEQ ID NO: 963604 - RNA, 22 nt, Human
ugcugccaaaugcgagcucugu

SEQ ID NO: 963605 - RNA, 22 nt, Human
ucugccaccaccuacacuagua

SEQ ID NO: 963606 - RNA, 22 nt, Human
cccagggacagcuagguggggc

SEQ ID NO: 963607 - RNA, 22 nt, Human
acacaggggaaaguggagcuga

SEQ ID NO: 963608 - RNA, 22 nt, Human
cagcugcccugccuugcccuua

SEQ ID NO: 963609 - RNA, 22 nt, Human
guuucacagucugcagaauuuu

SEQ ID NO: 963610 - RNA, 22 nt, Human
ggugcagaaggaagggagcugg

SEQ ID NO: 963611 - RNA, 22 nt, Human
ccaggaagcggugagggcugcc

SEQ ID NO: 963612 - RNA, 22 nt, Human
ucagugaucuaaggguauggcc

SEQ ID NO: 963613 - RNA, 22 nt, Human
caggaugagaggcccagggaag

SEQ ID NO: 963614 - RNA, 22 nt, Human
auggaagguccuacagagcgca

SEQ ID NO: 963615 - RNA, 22 nt, Human
ucugcaagauggucuuagaggu

SEQ ID NO: 963616 - RNA, 22 nt, Human
ugcugccuccaacuccugggcu

SEQ ID NO: 963617 - RNA, 22 nt, Human
uucucuagguuuuagaugaaga

SEQ ID NO: 963618 - RNA, 22 nt, Human
agccuguccagaggacagggcu

SEQ ID NO: 963619 - RNA, 23 nt, Human
ugucuggcucauggugggucuca

SEQ ID NO: 963620 - RNA, 22 nt, Human
agcacagaguugcagagagcgu

SEQ ID NO: 963621 - RNA, 22 nt, Human
cugcuuugggcagcuuuguggc

SEQ ID NO: 963622 - RNA, 22 nt, Human
ugacagggcuagaggcaaugca

SEQ ID NO: 963623 - RNA, 22 nt, Human
cuguggaauugaugcuuagugu

SEQ ID NO: 963624 - RNA, 22 nt, Human
uggcucaguagcagugugguca

SEQ ID NO: 963625 - RNA, 22 nt, Human
cugggaggcccacguugggaag

SEQ ID NO: 963626 - RNA, 22 nt, Human
ucauccaggaaaagauuuggaa

SEQ ID NO: 963627 - RNA, 22 nt, Human
ucaaaacaaucauuggaugugc

SEQ ID NO: 963628 - RNA, 22 nt, Human
gcuggagcugaguucccugggc

SEQ ID NO: 963629 - RNA, 22 nt, Human
ggcacugaaccaggacacaagc

SEQ ID NO: 963630 - RNA, 20 nt, Human
ggcagcucacuacuuucugu

SEQ ID NO: 963631 - RNA, 22 nt, Human
uggccucaagucugagggccuu

SEQ ID NO: 963632 - RNA, 17 nt, Human
caggcagacauguaagc

SEQ ID NO: 963633 - RNA, 22 nt, Human
ugucaugccauuuaaaauguuu

SEQ ID NO: 963634 - RNA, 19 nt, Human
cuguccuuggcugcacugu

SEQ ID NO: 963635 - RNA, 22 nt, Human
gcugucacacaugggaucucag

SEQ ID NO: 963636 - RNA, 20 nt, Human
gaggcugcggacugcuggac

SEQ ID NO: 963637 - RNA, 22 nt, Human
uauguacaccggggaagguggg

SEQ ID NO: 963638 - RNA, 19 nt, Human
auaaggcaauuggauuugg

SEQ ID NO: 963639 - RNA, 22 nt, Human
auggggcuguucucugcccugc

SEQ ID NO: 963640 - RNA, 22 nt, Human
guccucuguagggcugggccac

SEQ ID NO: 963641 - RNA, 21 nt, Human
agggagcuuuagguagaaguu

SEQ ID NO: 963642 - RNA, 22 nt, Human
cugcaggcccccuuccuggagu

SEQ ID NO: 963643 - RNA, 20 nt, Human
cccucugcuacacugggagc

SEQ ID NO: 963644 - RNA, 22 nt, Human
uuauguaggauaaugaauugcc

SEQ ID NO: 963645 - RNA, 22 nt, Human
ggcugccaggagggaggccagu

SEQ ID NO: 963646 - RNA, 22 nt, Human
ucucagagaaaugugucaccau

SEQ ID NO: 963647 - RNA, 22 nt, Human
agggccuggcgcguggccgccg

SEQ ID NO: 963648 - RNA, 20 nt, Human
gacaggagaguuagguaggu

SEQ ID NO: 963649 - RNA, 22 nt, Human
ugcaucuuacguuuugaaaggg

SEQ ID NO: 963650 - RNA, 22 nt, Human
cugggacacccagagcugcaga

SEQ ID NO: 963651 - RNA, 22 nt, Human
cggagccugcuuguugcagcug

SEQ ID NO: 963652 - RNA, 22 nt, Human
gggagcuguaguccagauaccg

SEQ ID NO: 963653 - RNA, 22 nt, Human
gaaugugugacucuauugagca

SEQ ID NO: 963654 - RNA, 22 nt, Human
ucuuagaaugucaacugauguu

SEQ ID NO: 963655 - RNA, 22 nt, Human
gcagcaggagaguuuguccugc

SEQ ID NO: 963656 - RNA, 22 nt, Human
aaguauauuuuuugaagcauau

SEQ ID NO: 963657 - RNA, 22 nt, Human
gcucagagcuugaaguuccacu

SEQ ID NO: 963658 - RNA, 22 nt, Human
aucaguuuguauaugaaacacu

SEQ ID NO: 963659 - RNA, 22 nt, Human
uucuaaauggggauccuuucug

SEQ ID NO: 963660 - RNA, 22 nt, Human
auuucuguuugcuacuauaagu

SEQ ID NO: 963661 - RNA, 22 nt, Human
ccaggcucugucuggucagaag

SEQ ID NO: 963662 - RNA, 22 nt, Human
cccagguggcagaagcugcagu

SEQ ID NO: 963663 - RNA, 22 nt, Human
agacgagggcccccaggacagc

SEQ ID NO: 963664 - RNA, 22 nt, Human
cugugcuuccaggauggcagcu

SEQ ID NO: 963665 - RNA, 22 nt, Human
ggaggccaaggcagguggaucg

SEQ ID NO: 963666 - RNA, 22 nt, Human
agcaauaugacauugcuacauc

SEQ ID NO: 963667 - RNA, 22 nt, Human
ccugccagugaagcugacgggc

SEQ ID NO: 963668 - RNA, 22 nt, Human
gaggcaugcagagcuggagcag

SEQ ID NO: 963669 - RNA, 22 nt, Human
uuucacaaagcauagcacuuua

SEQ ID NO: 963670 - RNA, 22 nt, Human
uacaugaacaaaauagcagaaa

SEQ ID NO: 963671 - RNA, 22 nt, Human
cugcugcugcuaucuacccagg

SEQ ID NO: 963672 - RNA, 20 nt, Human
cguaaggcaagugcugcauc

SEQ ID NO: 963673 - RNA, 21 nt, Human
cagaggcugagagggcaaucu

SEQ ID NO: 963674 - RNA, 22 nt, Human
agggccuggaacuggagaccac

SEQ ID NO: 963675 - RNA, 22 nt, Human
agagugaaaagcuagagcagua

SEQ ID NO: 963676 - RNA, 22 nt, Human
uccaagggcaugcugaaauaag

SEQ ID NO: 963677 - RNA, 22 nt, Human
uucaauucuaaacuaauauucu

SEQ ID NO: 963678 - RNA, 22 nt, Human
guggcugcucgggcuccggccc

SEQ ID NO: 963679 - RNA, 22 nt, Human
augauauuugcaaugugcuugc

SEQ ID NO: 963680 - RNA, 22 nt, Human
aaacugcuuuccacaguggcua

SEQ ID NO: 963681 - RNA, 22 nt, Human
gcucagaggcacgaccucuugg

SEQ ID NO: 963682 - RNA, 22 nt, Human
ugaaaucuccucuuuauauauc

SEQ ID NO: 963683 - RNA, 21 nt, Human
aggcccagcuuuccucuugcu

SEQ ID NO: 963684 - RNA, 22 nt, Human
cuggcucaauuuguacugcugu

SEQ ID NO: 963685 - RNA, 22 nt, Human
aaaagagugacugauaaguaua

SEQ ID NO: 963686 - RNA, 22 nt, Human
gcucagaaaagugaggcucagu

SEQ ID NO: 963687 - RNA, 22 nt, Human
uccagucaagcuugagaauuuc

SEQ ID NO: 963688 - RNA, 22 nt, Human
uguugaagauaaaguucucauu

SEQ ID NO: 963689 - RNA, 19 nt, Human
ccuuugaaucaggacacuu

SEQ ID NO: 963690 - RNA, 22 nt, Human
caggauggugugagugugagga

SEQ ID NO: 963691 - RNA, 22 nt, Human
aagcugccagcugagcugaggc

SEQ ID NO: 963692 - RNA, 22 nt, Human
gaggccagaaugagcugaaugc

SEQ ID NO: 963693 - RNA, 22 nt, Human
ggccuguccagccugccuggcu

SEQ ID NO: 963694 - RNA, 22 nt, Human
auauucguggucaaguaaggcc

SEQ ID NO: 963695 - RNA, 22 nt, Human
uagaaaucuacuuagacuuucu

SEQ ID NO: 963696 - RNA, 22 nt, Human
acuccaggcaucugcuucugcu

SEQ ID NO: 963697 - RNA, 22 nt, Human
aggagcugaaacuucucauaug

SEQ ID NO: 963698 - RNA, 22 nt, Human
ggaggcagaacuucccgucagu

SEQ ID NO: 963699 - RNA, 22 nt, Human
aggcgcugcgcuggggccagaa

SEQ ID NO: 963700 - RNA, 22 nt, Human
gcuguguuuuauguuagguuaa

SEQ ID NO: 963701 - RNA, 22 nt, Human
uauucacauuaauaagucuuca

SEQ ID NO: 963702 - RNA, 22 nt, Human
ccucagagguguggcaucucug

SEQ ID NO: 963703 - RNA, 23 nt, Human
aaggccagaauuucaauggugcc

SEQ ID NO: 963704 - RNA, 22 nt, Human
aggauccuguauggagaagcug

SEQ ID NO: 963705 - RNA, 16 nt, Human
uguuagcugugcauua

SEQ ID NO: 963706 - RNA, 22 nt, Human
ugccuugccacugcucuuaaug

SEQ ID NO: 963707 - RNA, 22 nt, Human
gggaaggagccugcuugcuaga

SEQ ID NO: 963708 - RNA, 22 nt, Human
caggagaggaggcuacuucuua

SEQ ID NO: 963709 - RNA, 22 nt, Human
cuccugaggggacaggacucau

SEQ ID NO: 963710 - RNA, 22 nt, Human
uucuuuccaaccagauauuggu

SEQ ID NO: 963711 - RNA, 22 nt, Human
agauacaucauuuauaccuuca

SEQ ID NO: 963712 - RNA, 22 nt, Human
uaugugaauacagcaguggaug

SEQ ID NO: 963713 - RNA, 22 nt, Human
ugaggcaguauucuccauucca

SEQ ID NO: 963714 - RNA, 22 nt, Human
ggcagccaugcacgcugccugg

SEQ ID NO: 963715 - RNA, 22 nt, Human
ucuguaucuaauuuuacaguag

SEQ ID NO: 963716 - RNA, 22 nt, Human
ggaggugaggccguagggugug

SEQ ID NO: 963717 - RNA, 20 nt, Human
gcagcuacucugucucgcuc

SEQ ID NO: 963718 - RNA, 22 nt, Human
cacuccagccucagugacagag

SEQ ID NO: 963719 - RNA, 22 nt, Human
uaauuauaacaguuacaucuua

SEQ ID NO: 963720 - RNA, 22 nt, Human
ucauccaguuguggagagggaa

SEQ ID NO: 963721 - RNA, 22 nt, Human
uguuccaucaguuuuugguuga

SEQ ID NO: 963722 - RNA, 22 nt, Human
aaaaugugaucuacaaaugcaa

SEQ ID NO: 963723 - RNA, 22 nt, Human
ucaagaaggaguuauuuauuca

SEQ ID NO: 963724 - RNA, 22 nt, Human
cauggcugcgagaagagugggu

SEQ ID NO: 963725 - RNA, 22 nt, Human
acagggaauggagggaucagua

SEQ ID NO: 963726 - RNA, 23 nt, Human
uggccugcagaguuucugcuggg

SEQ ID NO: 963727 - RNA, 22 nt, Human
ugggagcaaaugacugggagau

SEQ ID NO: 963728 - RNA, 22 nt, Human
acuuccuguguuggucuugcug

SEQ ID NO: 963729 - RNA, 22 nt, Human
cugggccagcaacugcaaugga

SEQ ID NO: 963730 - RNA, 20 nt, Human
uuucacagucccuguuuccu

SEQ ID NO: 963731 - RNA, 23 nt, Human
gggaccagcuagggcugugaccu

SEQ ID NO: 963732 - RNA, 22 nt, Human
aacauuucuucugaaacugagu

SEQ ID NO: 963733 - RNA, 19 nt, Human
cagaguacaccagauagga

SEQ ID NO: 963734 - RNA, 22 nt, Human
aucuuugaagaggacuugaagu

SEQ ID NO: 963735 - RNA, 22 nt, Human
aggucauuguuaagucaccaua

SEQ ID NO: 963736 - RNA, 22 nt, Human
gaguuauuucagaaggaaagau

SEQ ID NO: 963737 - RNA, 22 nt, Human
guggccugucagaagccguggg

SEQ ID NO: 963738 - RNA, 22 nt, Human
guaggcagucucucaggugauc

SEQ ID NO: 963739 - RNA, 22 nt, Human
ugcaccuuguugcuuuuacgaa

SEQ ID NO: 963740 - RNA, 22 nt, Human
uggcaggagguuuucuccagga

SEQ ID NO: 963741 - RNA, 22 nt, Human
aaagacuagcauuuauauguac

SEQ ID NO: 963742 - RNA, 22 nt, Human
cccaagaucuuucgugcacuaa

SEQ ID NO: 963743 - RNA, 22 nt, Human
gagguuagaggucagugcaguc

SEQ ID NO: 963744 - RNA, 22 nt, Human
cacccaggcuggagugcagggg

SEQ ID NO: 963745 - RNA, 22 nt, Human
gaggcaacacauuuggaaagca

SEQ ID NO: 963746 - RNA, 22 nt, Human
gcuggcagggugguugagagag

SEQ ID NO: 963747 - RNA, 22 nt, Human
uccaaacacccuccaugcugca

SEQ ID NO: 963748 - RNA, 22 nt, Human
uguuucaugauugcugucauuu

SEQ ID NO: 963749 - RNA, 22 nt, Human
caaaaguaauugcgguuuuugc

SEQ ID NO: 963750 - RNA, 22 nt, Human
ucugcaggaaaaaagugccugg

SEQ ID NO: 963751 - RNA, 22 nt, Human
cacccuggcuggaggugcagug

SEQ ID NO: 963752 - RNA, 22 nt, Human
uggcugugaacaaagagaauaa

SEQ ID NO: 963753 - RNA, 22 nt, Human
uauuuuguuaauaauccagucc

SEQ ID NO: 963754 - RNA, 18 nt, Human
aggccugggaagcugagg

SEQ ID NO: 963755 - RNA, 22 nt, Human
ugugcaaaguguacaaauuaau

SEQ ID NO: 963756 - RNA, 22 nt, Human
gguaacaguauguagaguaaga

SEQ ID NO: 963757 - RNA, 22 nt, Human
ggagucccagcaaagccuuccc

SEQ ID NO: 963758 - RNA, 22 nt, Human
uccugcagccacugcaggcaga

SEQ ID NO: 963759 - RNA, 22 nt, Human
cuuucucuguguuucacaugcu

SEQ ID NO: 963760 - RNA, 19 nt, Human
ugaagcaauaccauuuuug

SEQ ID NO: 963761 - RNA, 22 nt, Human
uaaauaugcauguauccuuauc

SEQ ID NO: 963762 - RNA, 22 nt, Human
guucacaaauaugcacuuacga

SEQ ID NO: 963763 - RNA, 22 nt, Human
agggcagcccuucugggagggc

SEQ ID NO: 963764 - RNA, 22 nt, Human
gcaccacaucaaugaggggagc

SEQ ID NO: 963765 - RNA, 22 nt, Human
ucucauguauugcccuggugug

SEQ ID NO: 963766 - RNA, 22 nt, Human
ccugagccucuugcacgcucag

SEQ ID NO: 963767 - RNA, 22 nt, Human
aggcagguccccuggaaggcac

SEQ ID NO: 963768 - RNA, 21 nt, Human
acaugcauagagagauuucug

SEQ ID NO: 963769 - RNA, 20 nt, Human
uggagcuguaaucuugucug

SEQ ID NO: 963770 - RNA, 18 nt, Human
uggcucuggacuugcucc

SEQ ID NO: 963771 - RNA, 22 nt, Human
uucaauucaauucuaaauauau

SEQ ID NO: 963772 - RNA, 19 nt, Human
gcaggcacagcccugggug

SEQ ID NO: 963773 - RNA, 22 nt, Human
caacuccuggcuguuaggcaca

SEQ ID NO: 963774 - RNA, 22 nt, Human
cagagcugggcauggugaaagg

SEQ ID NO: 963775 - RNA, 22 nt, Human
cacagcugccauggcugcacuu

SEQ ID NO: 963776 - RNA, 22 nt, Human
ccagugugggcccggccuccuc

SEQ ID NO: 963777 - RNA, 22 nt, Human
gaggcugaggguuagagaguca

SEQ ID NO: 963778 - RNA, 22 nt, Human
cugccaggcgauggauuggcug

SEQ ID NO: 963779 - RNA, 22 nt, Human
agggcugcuccuccuucaggcc

SEQ ID NO: 963780 - RNA, 22 nt, Human
uaaaaugacuuccuccaacauc

SEQ ID NO: 963781 - RNA, 22 nt, Human
ccauuguaaauucuguggaagu

SEQ ID NO: 963782 - RNA, 22 nt, Human
aaaugaacucuuccugcauccc

SEQ ID NO: 963783 - RNA, 22 nt, Human
gccugcagggugaugggcugcc

SEQ ID NO: 963784 - RNA, 22 nt, Human
ugaaguuauauauguugaaaau

SEQ ID NO: 963785 - RNA, 22 nt, Human
cugggagcugaggcugacgcug

SEQ ID NO: 963786 - RNA, 22 nt, Human
ggcaggcugcuugggucauguc

SEQ ID NO: 963787 - RNA, 20 nt, Human
ccucaagcagacugacagcu

SEQ ID NO: 963788 - RNA, 22 nt, Human
augggaugaacuugaucugcuu

SEQ ID NO: 963789 - RNA, 22 nt, Human
ugggccugauucuugaauccug

SEQ ID NO: 963790 - RNA, 22 nt, Human
cagcuccccucuguggggcagu

SEQ ID NO: 963791 - RNA, 22 nt, Human
guccucugggagccuugagccu

SEQ ID NO: 963792 - RNA, 22 nt, Human
ugggccuggagcccuggagagu

SEQ ID NO: 963793 - RNA, 21 nt, Human
aggcacuguuugugguuuggg

SEQ ID NO: 963794 - RNA, 22 nt, Human
ugucacauugaauaugauuuau

SEQ ID NO: 963795 - RNA, 19 nt, Human
ucccuggcgccucucgggc

SEQ ID NO: 963796 - RNA, 22 nt, Human
ucagcagggccuccuugugcag

SEQ ID NO: 963797 - RNA, 22 nt, Human
gaagcagcuggugagauggagc

SEQ ID NO: 963798 - RNA, 22 nt, Human
caguacuuggucaaggaagcag

SEQ ID NO: 963799 - RNA, 22 nt, Human
gcagugguggagcuuacauauc

SEQ ID NO: 963800 - RNA, 22 nt, Human
acuucuggugucauacugcauu

SEQ ID NO: 963801 - RNA, 22 nt, Human
gggaguggauuauguggaccca

SEQ ID NO: 963802 - RNA, 22 nt, Human
gcgcaggagccgcggagggccg

SEQ ID NO: 963803 - RNA, 22 nt, Human
gagggggcgugcaaggcuccgc

SEQ ID NO: 963804 - RNA, 18 nt, Human
acaaauguagugucuuaa

SEQ ID NO: 963805 - RNA, 22 nt, Human
agagcagcugugacauggacag

SEQ ID NO: 963806 - RNA, 22 nt, Human
ccagcucucugcagaaaggacu

SEQ ID NO: 963807 - RNA, 22 nt, Human
acacauuucucuuuuuguaagu

SEQ ID NO: 963808 - RNA, 22 nt, Human
cugccucaugcugccugcagcc

SEQ ID NO: 963809 - RNA, 22 nt, Human
aaaguauuugugauuuuuacca

SEQ ID NO: 963810 - RNA, 21 nt, Human
ugcuccuuagcugccccugcc

SEQ ID NO: 963811 - RNA, 22 nt, Human
aaagccuugcccgucacuggga

SEQ ID NO: 963812 - RNA, 22 nt, Human
gagggagucugugcaaagaauu

SEQ ID NO: 963813 - RNA, 22 nt, Human
cccaggaaaguggaggcggcug

SEQ ID NO: 963814 - RNA, 22 nt, Human
ugaggcaggaguucaggcugcg

SEQ ID NO: 963815 - RNA, 22 nt, Human
acauuucucauaggagagccac

SEQ ID NO: 963816 - RNA, 22 nt, Human
agcaaaguagcugcuguucuua

SEQ ID NO: 963817 - RNA, 22 nt, Human
agccccaguccgcugcgggcgg

SEQ ID NO: 963818 - RNA, 22 nt, Human
gcugcaggcgccugcggucucu

SEQ ID NO: 963819 - RNA, 22 nt, Human
caggguggcacucagcgcaucu

SEQ ID NO: 963820 - RNA, 22 nt, Human
gccuggagcucuccacuugggg

SEQ ID NO: 963821 - RNA, 22 nt, Human
ccacugucuuuuccaggcugaa

SEQ ID NO: 963822 - RNA, 22 nt, Human
ggaagaggcugagccagguccc

SEQ ID NO: 963823 - RNA, 22 nt, Human
gccaggugggagacagacagca

SEQ ID NO: 963824 - RNA, 22 nt, Human
uggagcaggugccaggugugug

SEQ ID NO: 963825 - RNA, 22 nt, Human
cugcccugagggccuguguguu

SEQ ID NO: 963826 - RNA, 21 nt, Human
auggagccuaagaguggaggu

SEQ ID NO: 963827 - RNA, 20 nt, Human
auucacaaagccaguguugc

SEQ ID NO: 963828 - RNA, 22 nt, Human
gccagcucagugccaggccccu

SEQ ID NO: 963829 - RNA, 22 nt, Human
cuuuauguuggggugucuuagu

SEQ ID NO: 963830 - RNA, 22 nt, Human
cuucucagucaccugugagucu

SEQ ID NO: 963831 - RNA, 22 nt, Human
acagacauuuucuguauugccu

SEQ ID NO: 963832 - RNA, 22 nt, Human
ucucuggggauggaccugggag

SEQ ID NO: 963833 - RNA, 22 nt, Human
caggugggcuugggagaacacu

SEQ ID NO: 963834 - RNA, 22 nt, Human
gagggcuccucacauucucuau

SEQ ID NO: 963835 - RNA, 22 nt, Human
gggcagcagaggaucccuuaau

SEQ ID NO: 963836 - RNA, 22 nt, Human
cuauguuuaucuguauuucugu

SEQ ID NO: 963837 - RNA, 16 nt, Human
agaggccuugaggaag

SEQ ID NO: 963838 - RNA, 22 nt, Human
ccugagcuggaagagcuugugc

SEQ ID NO: 963839 - RNA, 22 nt, Human
cuucccagaccuuagagugcag

SEQ ID NO: 963840 - RNA, 22 nt, Human
cguggccagccauuuccuggaa

SEQ ID NO: 963841 - RNA, 19 nt, Human
gcagcugugggaagagcca

SEQ ID NO: 963842 - RNA, 22 nt, Human
aagcuccccgaaacccaccucu

SEQ ID NO: 963843 - RNA, 22 nt, Human
ccagcuuguuugaagcucguca

SEQ ID NO: 963844 - RNA, 19 nt, Human
ccugucugucuucagcuag

SEQ ID NO: 963845 - RNA, 22 nt, Human
accuuauuaaaaugaugaugua

SEQ ID NO: 963846 - RNA, 22 nt, Human
gagcuuaggccagggacaggga

SEQ ID NO: 963847 - RNA, 22 nt, Human
uaggcacugguuguggauaguu

SEQ ID NO: 963848 - RNA, 22 nt, Human
cagugguuauacuuacuguuuc

SEQ ID NO: 963849 - RNA, 15 nt, Human
cagucccagggaccc

SEQ ID NO: 963850 - RNA, 22 nt, Human
aagagcauauuaauaguggaga

SEQ ID NO: 963851 - RNA, 22 nt, Human
aucaaaaugcuccagugauggu

SEQ ID NO: 963852 - RNA, 22 nt, Human
aaaagguagauucuccuucuau

SEQ ID NO: 963853 - RNA, 22 nt, Human
accaggggugucaacagcauuu

SEQ ID NO: 963854 - RNA, 22 nt, Human
cugugccuuuguagcugugccu

SEQ ID NO: 963855 - RNA, 22 nt, Human
cagaguguaucuguguaagcau

SEQ ID NO: 963856 - RNA, 22 nt, Human
ugcauaguucuccuuccuccuc

SEQ ID NO: 963857 - RNA, 22 nt, Human
ucccugggguaacauuagaggg

SEQ ID NO: 963858 - RNA, 22 nt, Human
aacccuggggcagcugcuaggg

SEQ ID NO: 963859 - RNA, 22 nt, Human
gucaggaugagggaugaggagu

SEQ ID NO: 963860 - RNA, 22 nt, Human
cacuggcaugugaggcgguggc

SEQ ID NO: 963861 - RNA, 22 nt, Human
accuuuuuguucuguucucagc

SEQ ID NO: 963862 - RNA, 22 nt, Human
auugucuucuggucuuaucuuu

SEQ ID NO: 963863 - RNA, 22 nt, Human
uugcagggcaggaccauggaca

SEQ ID NO: 963864 - RNA, 22 nt, Human
uggcagcuggagggcaauggcc

SEQ ID NO: 963865 - RNA, 22 nt, Human
uuucagaaagcugaacauauga

SEQ ID NO: 963866 - RNA, 22 nt, Human
agucuuauguuugugaagaacu

SEQ ID NO: 963867 - RNA, 22 nt, Human
ugaggggaacugaugcccauug

SEQ ID NO: 963868 - RNA, 17 nt, Human
aguggcaggcagauggg

SEQ ID NO: 963869 - RNA, 21 nt, Human
ccugcagcaccagaaggagau

SEQ ID NO: 963870 - RNA, 22 nt, Human
ugagccaggcuccaugccaccu

SEQ ID NO: 963871 - RNA, 22 nt, Human
auguucuuccaaaucuguaaca

SEQ ID NO: 963872 - RNA, 22 nt, Human
uuugugaacaaacaugaagaug

SEQ ID NO: 963873 - RNA, 22 nt, Human
ggucacugcucuaaacaaaagu

SEQ ID NO: 963874 - RNA, 22 nt, Human
acacauaagaaacuacaaagag

SEQ ID NO: 963875 - RNA, 22 nt, Human
ugaggcaggagaauggcgggaa

SEQ ID NO: 963876 - RNA, 22 nt, Human
auguuucaccagcaaauuaccu

SEQ ID NO: 963877 - RNA, 22 nt, Human
auuauuauauagggaaaguccc

SEQ ID NO: 963878 - RNA, 22 nt, Human
ucaaugauagacaagaucuaag

SEQ ID NO: 963879 - RNA, 22 nt, Human
gggcuucuagaccagcagugag

SEQ ID NO: 963880 - RNA, 22 nt, Human
cuucaggauuuaggaagaugaa

SEQ ID NO: 963881 - RNA, 22 nt, Human
cugcuggagguuggagcaugca

SEQ ID NO: 963882 - RNA, 22 nt, Human
gcccucucggcauagcaggggc

SEQ ID NO: 963883 - RNA, 22 nt, Human
uucucuaagcuggcugaggucu

SEQ ID NO: 963884 - RNA, 22 nt, Human
cuggcugaguuacuccacugag

SEQ ID NO: 963885 - RNA, 22 nt, Human
cagcaggguagguuguaucagu

SEQ ID NO: 963886 - RNA, 22 nt, Human
cacagccuccuucagagagcau

SEQ ID NO: 963887 - RNA, 22 nt, Human
gugugcagaagacacaagacau

SEQ ID NO: 963888 - RNA, 22 nt, Human
cauugcacaucugagaagagau

SEQ ID NO: 963889 - RNA, 22 nt, Human
ccuguuuaucuaucuagagaug

SEQ ID NO: 963890 - RNA, 22 nt, Human
caaauucagaaaauugguagag

SEQ ID NO: 963891 - RNA, 22 nt, Human
uaaggcagaaauaugagcaggg

SEQ ID NO: 963892 - RNA, 22 nt, Human
caaagguaguauauauauuguu

SEQ ID NO: 963893 - RNA, 22 nt, Human
aaauguguuucuuugugaaugg

SEQ ID NO: 963894 - RNA, 22 nt, Human
ccucccacauccuagcucugcu

SEQ ID NO: 963895 - RNA, 22 nt, Human
gccucacugcagccccaggaag

SEQ ID NO: 963896 - RNA, 22 nt, Human
gccacugcacuccagcccaggc

SEQ ID NO: 963897 - RNA, 22 nt, Human
gugcuuuuaaaggcaauuagua

SEQ ID NO: 963898 - RNA, 22 nt, Human
gagguagcaugcuggaagggac

SEQ ID NO: 963899 - RNA, 22 nt, Human
aagucuguagaaaaacaguuua

SEQ ID NO: 963900 - RNA, 22 nt, Human
cagccagguaugggcgugcggg

SEQ ID NO: 963901 - RNA, 22 nt, Human
ccuucuuaaacaucauuuuggc

SEQ ID NO: 963902 - RNA, 22 nt, Human
ugcuguuauacuuagcugguua

SEQ ID NO: 963903 - RNA, 22 nt, Human
gcugccugucccaggaugagga

SEQ ID NO: 963904 - RNA, 22 nt, Human
auagaaaacagauguccuuaaa

SEQ ID NO: 963905 - RNA, 20 nt, Human
uauuuacaacuuagagccuc

SEQ ID NO: 963906 - RNA, 22 nt, Human
aggcugucugaccccagagccc

SEQ ID NO: 963907 - RNA, 22 nt, Human
cagcacugcugcuguacacaca

SEQ ID NO: 963908 - RNA, 22 nt, Human
agcucagcuuccucuccaugcu

SEQ ID NO: 963909 - RNA, 19 nt, Human
ugucuuaauuaacucagag

SEQ ID NO: 963910 - RNA, 22 nt, Human
acacagggcggaaagcaugaga

SEQ ID NO: 963911 - RNA, 22 nt, Human
aggcugcugccuuggagagugu

SEQ ID NO: 963912 - RNA, 22 nt, Human
uugaacagcuguuacauuguua

SEQ ID NO: 963913 - RNA, 22 nt, Human
gccaggagagcuccuucagguu

SEQ ID NO: 963914 - RNA, 19 nt, Human
cugaggugcaguaagaggc

SEQ ID NO: 963915 - RNA, 22 nt, Human
ggcugccuccugcugggcugga

SEQ ID NO: 963916 - RNA, 22 nt, Human
aaacaccaagagcuagcuauua

SEQ ID NO: 963917 - RNA, 22 nt, Human
ggagaguggauuccagcuguau

SEQ ID NO: 963918 - RNA, 20 nt, Human
aguagcagugugacauugac

SEQ ID NO: 963919 - RNA, 22 nt, Human
ucaggggagguugaaucgucuc

SEQ ID NO: 963920 - RNA, 18 nt, Human
cagauccaggcagcuauu

SEQ ID NO: 963921 - RNA, 22 nt, Human
gggcacuguacacugugcaugg

SEQ ID NO: 963922 - RNA, 22 nt, Human
aggguggcaguuacuggagcaa

SEQ ID NO: 963923 - RNA, 22 nt, Human
caguggaggccuugggaccuuu

SEQ ID NO: 963924 - RNA, 22 nt, Human
acuguucaucucuuagaaagua

SEQ ID NO: 963925 - RNA, 22 nt, Human
ugccucagcugaggccgcucca

SEQ ID NO: 963926 - RNA, 22 nt, Human
gagcagcucugggugacccagu

SEQ ID NO: 963927 - RNA, 22 nt, Human
uuugacauuggcuuauucuguu

SEQ ID NO: 963928 - RNA, 22 nt, Human
aaguucaaggaagccuccaguu

SEQ ID NO: 963929 - RNA, 17 nt, Human
agcagaagucagaggga

SEQ ID NO: 963930 - RNA, 22 nt, Human
gagcagcugcagugcagacccu

SEQ ID NO: 963931 - RNA, 22 nt, Human
uggcagcuuuuuguuucaggcu

SEQ ID NO: 963932 - RNA, 22 nt, Human
acauuucugcauguaggguaau

SEQ ID NO: 963933 - RNA, 22 nt, Human
gcaguggcuaagcucgcaugca

SEQ ID NO: 963934 - RNA, 21 nt, Human
gccagggaagagaguuggcug

SEQ ID NO: 963935 - RNA, 22 nt, Human
ucaugacaacuauauuauucca

SEQ ID NO: 963936 - RNA, 22 nt, Human
ucuuugcaugugcuucuuggcc

SEQ ID NO: 963937 - RNA, 22 nt, Human
gcuggggagggcgucaaggcca

SEQ ID NO: 963938 - RNA, 22 nt, Human
ucaaauaccagcaauuucaugu

SEQ ID NO: 963939 - RNA, 22 nt, Human
gagaggagucccuaucacaguu

SEQ ID NO: 963940 - RNA, 20 nt, Human
acccagcucugugcccuggg

SEQ ID NO: 963941 - RNA, 22 nt, Human
uuccagcaggcagacaggagau

SEQ ID NO: 963942 - RNA, 22 nt, Human
aagagcuggaagugaagauaac

SEQ ID NO: 963943 - RNA, 22 nt, Human
ucagggcauguauguuucuuua

SEQ ID NO: 963944 - RNA, 22 nt, Human
cccauugugguuguugaggaua

SEQ ID NO: 963945 - RNA, 22 nt, Human
agcaguggccuggggcucugug

SEQ ID NO: 963946 - RNA, 21 nt, Human
agcugggccucagccugcagu

SEQ ID NO: 963947 - RNA, 22 nt, Human
auguuacacauaggcauaaaug

SEQ ID NO: 963948 - RNA, 22 nt, Human
uauccaaacauauagucucucu

SEQ ID NO: 963949 - RNA, 18 nt, Human
agggagagaccgcggguc

SEQ ID NO: 963950 - RNA, 19 nt, Human
ugaggggcucacagucuca

SEQ ID NO: 963951 - RNA, 22 nt, Human
gauuucuucauuuguggugaau

SEQ ID NO: 963952 - RNA, 17 nt, Human
acuccuggucugaaggg

SEQ ID NO: 963953 - RNA, 22 nt, Human
aauucuauaggcaagcuauuuu

SEQ ID NO: 963954 - RNA, 22 nt, Human
agacagcauggagcugauaaca

SEQ ID NO: 963955 - RNA, 22 nt, Human
cuuugcaaacugucacacuuuc

SEQ ID NO: 963956 - RNA, 22 nt, Human
gcauuuauuucuuuacugcauc

SEQ ID NO: 963957 - RNA, 22 nt, Human
uauauuaaacccucucuguagg

SEQ ID NO: 963958 - RNA, 22 nt, Human
ugugaaauucuugaaaugcaca

SEQ ID NO: 963959 - RNA, 22 nt, Human
uggaaagacauucagccgcugg

SEQ ID NO: 963960 - RNA, 22 nt, Human
uuugaaaguguuuacuugggaa

SEQ ID NO: 963961 - RNA, 20 nt, Human
uguucacaguaguugcugcu

SEQ ID NO: 963962 - RNA, 22 nt, Human
aaaugaacaguugcauucucug

SEQ ID NO: 963963 - RNA, 22 nt, Human
acauuucuuccuaauuaucccu

SEQ ID NO: 963964 - RNA, 22 nt, Human
augucuaaaagauaaaguuuaa

SEQ ID NO: 963965 - RNA, 22 nt, Human
uggcccugcagaacuagccugg

SEQ ID NO: 963966 - RNA, 22 nt, Human
guaaauaacugguaauuggggu

SEQ ID NO: 963967 - RNA, 22 nt, Human
ggcugccaggagaagcucagug

SEQ ID NO: 963968 - RNA, 21 nt, Human
gcugcaucaaucuacccaggg

SEQ ID NO: 963969 - RNA, 22 nt, Human
uggaagagacacuuacauucag

SEQ ID NO: 963970 - RNA, 22 nt, Human
acaccuuugccccaagucauag

SEQ ID NO: 963971 - RNA, 19 nt, Human
agcagccaucgaccaugga

SEQ ID NO: 963972 - RNA, 22 nt, Human
cccagccucuguuugcuccucu

SEQ ID NO: 963973 - RNA, 22 nt, Human
cccccaaggccaggcugagacc

SEQ ID NO: 963974 - RNA, 22 nt, Human
aggcucagaggugagcaucugc

SEQ ID NO: 963975 - RNA, 22 nt, Human
ggagcagagcucuucaucugca

SEQ ID NO: 963976 - RNA, 22 nt, Human
ggucauuguucuuuucugugau

SEQ ID NO: 963977 - RNA, 18 nt, Human
uggcagcaggaagccauu

SEQ ID NO: 963978 - RNA, 22 nt, Human
ggggcagagcauagcuccaauu

SEQ ID NO: 963979 - RNA, 22 nt, Human
aggugcagaaaaaaguccuuua

SEQ ID NO: 963980 - RNA, 22 nt, Human
guugaaaguggagaaccugguu

SEQ ID NO: 963981 - RNA, 22 nt, Human
ugcagcucugaacagucaugaa

SEQ ID NO: 963982 - RNA, 22 nt, Human
ggaggagguggguuaaguugua

SEQ ID NO: 963983 - RNA, 22 nt, Human
agcuuuauuugucauucacggc

SEQ ID NO: 963984 - RNA, 22 nt, Human
caguggugaagagcaggggcuc

SEQ ID NO: 963985 - RNA, 22 nt, Human
ugcccacauucaaaaggugaug

SEQ ID NO: 963986 - RNA, 22 nt, Human
acacauuauagagaguauaaua

SEQ ID NO: 963987 - RNA, 22 nt, Human
cugggaggugaacagaaaaacu

SEQ ID NO: 963988 - RNA, 22 nt, Human
aggagcagaacuguuguggagg

SEQ ID NO: 963989 - RNA, 22 nt, Human
accaggaguuuugaccaggggc

SEQ ID NO: 963990 - RNA, 22 nt, Human
cucaguuucuucauauuguagg

SEQ ID NO: 963991 - RNA, 22 nt, Human
acaagagauuaucuacagauga

SEQ ID NO: 963992 - RNA, 17 nt, Human
ugaggccugcaucagug

SEQ ID NO: 963993 - RNA, 22 nt, Human
cuacauggagaagaaaauucuu

SEQ ID NO: 963994 - RNA, 20 nt, Human
uugcagcagugaggugaagg

SEQ ID NO: 963995 - RNA, 22 nt, Human
gccagggcaggggagcaucugc

SEQ ID NO: 963996 - RNA, 22 nt, Human
ugcagggcuuccucuuggaguu

SEQ ID NO: 963997 - RNA, 22 nt, Human
agucaguggcuccgagccuggu

SEQ ID NO: 963998 - RNA, 22 nt, Human
aguauguauuuuauacuuacag

SEQ ID NO: 963999 - RNA, 18 nt, Human
ugcucuggucucacuugg

SEQ ID NO: 964000 - RNA, 22 nt, Human
gaggggcugcccuggugucagg

SEQ ID NO: 964001 - RNA, 22 nt, Human
ucccacucccaggcaggccucu

SEQ ID NO: 964002 - RNA, 22 nt, Human
auagacuugguuaguaaauuug

SEQ ID NO: 964003 - RNA, 22 nt, Human
guauccuuugcggaaauuucua

SEQ ID NO: 964004 - RNA, 22 nt, Human
agcugagccagcagcaacagga

SEQ ID NO: 964005 - RNA, 22 nt, Human
uguuuaagcugaugagguaucg

SEQ ID NO: 964006 - RNA, 22 nt, Human
accugccuaucagcugccugcu

SEQ ID NO: 964007 - RNA, 22 nt, Human
auguguauacuugugcuuacuc

SEQ ID NO: 964008 - RNA, 22 nt, Human
ucaccacugaacagaccuuugg

SEQ ID NO: 964009 - RNA, 22 nt, Human
ugaugggaggugcugcaggacc

SEQ ID NO: 964010 - RNA, 19 nt, Human
gcauuucucuuuacagcca

SEQ ID NO: 964011 - RNA, 22 nt, Human
aaugauuuccccuacacagaag

SEQ ID NO: 964012 - RNA, 22 nt, Human
uggcccucagucuugcuccugc

SEQ ID NO: 964013 - RNA, 22 nt, Human
gaugcacuugccccuccucaga

SEQ ID NO: 964014 - RNA, 22 nt, Human
aaaugucuuugaguauuucugc

SEQ ID NO: 964015 - RNA, 23 nt, Human
guggagccacaucacaggcuccu

SEQ ID NO: 964016 - RNA, 22 nt, Human
ggugaaggucuacugugugcca

SEQ ID NO: 964017 - RNA, 22 nt, Human
caggcagagugagguggucuaa

SEQ ID NO: 964018 - RNA, 22 nt, Human
gaaggagggugcggaucugagc

SEQ ID NO: 964019 - RNA, 22 nt, Human
ucucaagaucucaagauggccc

SEQ ID NO: 964020 - RNA, 22 nt, Human
aacagacaacuccuguggcuca

SEQ ID NO: 964021 - RNA, 22 nt, Human
aggaguguggccagggcucugg

SEQ ID NO: 964022 - RNA, 22 nt, Human
augaagucugcacaugcaugug

SEQ ID NO: 964023 - RNA, 22 nt, Human
aaacaacucggcaacugcuuuu

SEQ ID NO: 964024 - RNA, 22 nt, Human
gugacagucaaagacaugacuu

SEQ ID NO: 964025 - RNA, 22 nt, Human
agccuggcacugaggcagggcg

SEQ ID NO: 964026 - RNA, 22 nt, Human
agccacagucugaugccugaga

SEQ ID NO: 964027 - RNA, 22 nt, Human
uauuccuauggccacugcuacu

SEQ ID NO: 964028 - RNA, 22 nt, Human
gcugucacacauggccccagcu

SEQ ID NO: 964029 - RNA, 22 nt, Human
auguuucagauacagaucaaau

SEQ ID NO: 964030 - RNA, 22 nt, Human
cucaggaugucggugacuauug

SEQ ID NO: 964031 - RNA, 22 nt, Human
agcuuccuuggcgcugaggccu

SEQ ID NO: 964032 - RNA, 22 nt, Human
gcuccaggagagggaagcagau

SEQ ID NO: 964033 - RNA, 22 nt, Human
aaaagagguuaaccaggugugu

SEQ ID NO: 964034 - RNA, 22 nt, Human
aggcaggugggucacuugaguc

SEQ ID NO: 964035 - RNA, 22 nt, Human
gguccccagcaguggcugcuuc

SEQ ID NO: 964036 - RNA, 21 nt, Human
gacaggacuagaccagagcuc

SEQ ID NO: 964037 - RNA, 22 nt, Human
uggccuguggcuuaaggucugu

SEQ ID NO: 964038 - RNA, 22 nt, Human
guuauuagaagugaaggauugu

SEQ ID NO: 964039 - RNA, 22 nt, Human
ggugaagguggaacgcagagca

SEQ ID NO: 964040 - RNA, 23 nt, Human
acagaaaguucugcuggacagag

SEQ ID NO: 964041 - RNA, 22 nt, Human
ggcaaaaaguucccaucagugu

SEQ ID NO: 964042 - RNA, 21 nt, Human
aaaguucaugcuuuaauauuc

SEQ ID NO: 964043 - RNA, 22 nt, Human
ggaggccaaggcgggcggauca

SEQ ID NO: 964044 - RNA, 22 nt, Human
gagagcacaugaacauggagga

SEQ ID NO: 964045 - RNA, 22 nt, Human
cauggcauugcauaacggggcu

SEQ ID NO: 964046 - RNA, 23 nt, Human
cagcccuuccugcauguuuuugu

SEQ ID NO: 964047 - RNA, 22 nt, Human
uuuuccagauuggacuuagucc

SEQ ID NO: 964048 - RNA, 22 nt, Human
cccaccccuggacaggugagug

SEQ ID NO: 964049 - RNA, 22 nt, Human
guugaaaugagggauuaaucag

SEQ ID NO: 964050 - RNA, 22 nt, Human
ucaucacauaugucaugauuug

SEQ ID NO: 964051 - RNA, 21 nt, Human
ucaggcaggcgcagagggaag

SEQ ID NO: 964052 - RNA, 22 nt, Human
aagacccacaaggcugaauguu

SEQ ID NO: 964053 - RNA, 22 nt, Human
agcccagaggcugggcgugcau

SEQ ID NO: 964054 - RNA, 22 nt, Human
cauucauuuaugaaauaucuau

SEQ ID NO: 964055 - RNA, 22 nt, Human
gggcccacuggcugucugaccc

SEQ ID NO: 964056 - RNA, 19 nt, Human
uguggccaugguucagcug

SEQ ID NO: 964057 - RNA, 22 nt, Human
auugucugaauccaaagcucug

SEQ ID NO: 964058 - RNA, 22 nt, Human
cucuggaggccuaaggaagugg

SEQ ID NO: 964059 - RNA, 22 nt, Human
uuccuuaguguuagauucugug

SEQ ID NO: 964060 - RNA, 22 nt, Human
auucagagcacuggguagaauu

SEQ ID NO: 964061 - RNA, 22 nt, Human
uauuuagaaugcguguacgugu

SEQ ID NO: 964062 - RNA, 23 nt, Human
ugcaggggaggcuuaaagcaggu

SEQ ID NO: 964063 - RNA, 22 nt, Human
aagagaggacauggugaaccug

SEQ ID NO: 964064 - RNA, 22 nt, Human
cugggcaauaugcugggccugg

SEQ ID NO: 964065 - RNA, 22 nt, Human
ugcugcuccugccuggcuccca

SEQ ID NO: 964066 - RNA, 22 nt, Human
acaggccugagauuuugcauuu

SEQ ID NO: 964067 - RNA, 22 nt, Human
aggaagcugccugggaugggaa

SEQ ID NO: 964068 - RNA, 23 nt, Human
aucagucuugguagcugugccca

SEQ ID NO: 964069 - RNA, 22 nt, Human
auacauuagcucauaugauuaa

SEQ ID NO: 964070 - RNA, 22 nt, Human
uagcccagcaugagcagagcug

SEQ ID NO: 964071 - RNA, 22 nt, Human
ugcuggggguucagaugaguaa

SEQ ID NO: 964072 - RNA, 22 nt, Human
ggcacuguguacacacagagac

SEQ ID NO: 964073 - RNA, 20 nt, Human
caaguguagaaacuaauaag

SEQ ID NO: 964074 - RNA, 22 nt, Human
cuggcagcuucaggacacucgg

SEQ ID NO: 964075 - RNA, 22 nt, Human
ugucuuuaugcacacugacuug

SEQ ID NO: 964076 - RNA, 22 nt, Human
ucccuggaacagagagacaacg

SEQ ID NO: 964077 - RNA, 22 nt, Human
acugggaguucuccaugucccu

SEQ ID NO: 964078 - RNA, 22 nt, Human
aagauuucucuccuggaaagca

SEQ ID NO: 964079 - RNA, 22 nt, Human
augcacgccccacacuggugug

SEQ ID NO: 964080 - RNA, 22 nt, Human
uuguuucauggggauguuuauu

SEQ ID NO: 964081 - RNA, 22 nt, Human
aaaugguguuucuaaugcuaga

SEQ ID NO: 964082 - RNA, 22 nt, Human
agccuucacugggaccuuggau

SEQ ID NO: 964083 - RNA, 22 nt, Human
uacaaaaguaauuacgguuuuu

SEQ ID NO: 964084 - RNA, 22 nt, Human
guggcuugaccaucccugcuac

SEQ ID NO: 964085 - RNA, 21 nt, Human
ucccucagaagcucuugguca

SEQ ID NO: 964086 - RNA, 22 nt, Human
uuagccauugucagcacauggc

SEQ ID NO: 964087 - RNA, 23 nt, Human
ugggaguguugggaucucugcuc

SEQ ID NO: 964088 - RNA, 22 nt, Human
caggcuugcugcuagagcacuu

SEQ ID NO: 964089 - RNA, 22 nt, Human
gccagcaguauguccuggcagu

SEQ ID NO: 964090 - RNA, 22 nt, Human
ggcagggguccugguguugacu

SEQ ID NO: 964091 - RNA, 22 nt, Human
augugaggaagaaagagguaag

SEQ ID NO: 964092 - RNA, 22 nt, Human
aaggcacugagccagccgucuc

SEQ ID NO: 964093 - RNA, 22 nt, Human
cuggcucagacagcugugcagu

SEQ ID NO: 964094 - RNA, 17 nt, Human
uuccacaauaguuuguc

SEQ ID NO: 964095 - RNA, 22 nt, Human
ucagcaggcgguuccuuguggg

SEQ ID NO: 964096 - RNA, 22 nt, Human
augcuguggggagugaggguag

SEQ ID NO: 964097 - RNA, 22 nt, Human
uguagcauguaaauugguuauu

SEQ ID NO: 964098 - RNA, 22 nt, Human
caauaagccagguguuuguguu

SEQ ID NO: 964099 - RNA, 22 nt, Human
auucagaaaguugucauauuug

SEQ ID NO: 964100 - RNA, 22 nt, Human
uggcagcuauggucuaagggcc

SEQ ID NO: 964101 - RNA, 22 nt, Human
gccuaggagacaagcgugaaag

SEQ ID NO: 964102 - RNA, 22 nt, Human
auagucuuagaucagauaaagu

SEQ ID NO: 964103 - RNA, 22 nt, Human
gcacaauuauuuaugcaguaug

SEQ ID NO: 964104 - RNA, 22 nt, Human
ugucucugauaaguaguucagu

SEQ ID NO: 964105 - RNA, 22 nt, Human
caggauggucuucauuuggcuc

SEQ ID NO: 964106 - RNA, 22 nt, Human
acugcuuuuagaaaucuauaga

SEQ ID NO: 964107 - RNA, 23 nt, Human
agcacacuuguacaaugcccuag

SEQ ID NO: 964108 - RNA, 22 nt, Human
gugcagggcuggcaccggaggc

SEQ ID NO: 964109 - RNA, 22 nt, Human
ucccugggaacaaaggaugaga

SEQ ID NO: 964110 - RNA, 22 nt, Human
gcucccacgcaauucuuuucag

SEQ ID NO: 964111 - RNA, 21 nt, Human
aucuuuauuacgcagagaaga

SEQ ID NO: 964112 - RNA, 22 nt, Human
cagcuggccccacaguagaggc

SEQ ID NO: 964113 - RNA, 22 nt, Human
uuucaacaggaugauaauaggc

SEQ ID NO: 964114 - RNA, 22 nt, Human
cucucuggaagggggagcugau

SEQ ID NO: 964115 - RNA, 22 nt, Human
agugggaggcggcugacgggcg

SEQ ID NO: 964116 - RNA, 22 nt, Human
cccuggcaugcaugucccuggc

SEQ ID NO: 964117 - RNA, 22 nt, Human
agagugauucuaguuagggaau

SEQ ID NO: 964118 - RNA, 22 nt, Human
uuagagucaaaauggcauguua

SEQ ID NO: 964119 - RNA, 22 nt, Human
ccagagccucgcccggagccuc

SEQ ID NO: 964120 - RNA, 22 nt, Human
uggccucuggcugaggacuaac

SEQ ID NO: 964121 - RNA, 22 nt, Human
uuggcugagagaggaaaagggc

SEQ ID NO: 964122 - RNA, 23 nt, Human
ugcuucucugcuugacaguucug

SEQ ID NO: 964123 - RNA, 20 nt, Human
uguuccaugacuauuuggau

SEQ ID NO: 964124 - RNA, 22 nt, Human
ugcuugggaauguggagucaga

SEQ ID NO: 964125 - RNA, 22 nt, Human
gaggggaaagugugaggcugcg

SEQ ID NO: 964126 - RNA, 18 nt, Human
ucaggagacacagacgca

SEQ ID NO: 964127 - RNA, 22 nt, Human
gcucccaccuccagccugaguu

SEQ ID NO: 964128 - RNA, 22 nt, Human
ggggagugacgcagggccauag

SEQ ID NO: 964129 - RNA, 18 nt, Human
aacuucaacuacaaugga

SEQ ID NO: 964130 - RNA, 21 nt, Human
uuccuggcggcagaaacguga

SEQ ID NO: 964131 - RNA, 22 nt, Human
gcuccucuauuccccacauuuu

SEQ ID NO: 964132 - RNA, 22 nt, Human
ugcaugugcccacucuggcuua

SEQ ID NO: 964133 - RNA, 22 nt, Human
ggcaaaaacagcaaugacuuuu

SEQ ID NO: 964134 - RNA, 22 nt, Human
uaacccaauaauugguggccuu

SEQ ID NO: 964135 - RNA, 23 nt, Human
uccagggauuaaugaagucaguc

SEQ ID NO: 964136 - RNA, 22 nt, Human
caagagcuagaaauugguuaga

SEQ ID NO: 964137 - RNA, 22 nt, Human
caaggccauaagagauacaaaa

SEQ ID NO: 964138 - RNA, 22 nt, Human
ugcugccuucuaggcgugcccu

SEQ ID NO: 964139 - RNA, 22 nt, Human
ugcuugaaagggguuucccagu

SEQ ID NO: 964140 - RNA, 22 nt, Human
aaucauucuuauuucacagcaa

SEQ ID NO: 964141 - RNA, 17 nt, Human
uucucugagcuguauug

SEQ ID NO: 964142 - RNA, 22 nt, Human
aaaggccaugguuggaguguuu

SEQ ID NO: 964143 - RNA, 22 nt, Human
uucauucuuugaaucugaggua

SEQ ID NO: 964144 - RNA, 22 nt, Human
ccacagggcucuaggcgcuucc

SEQ ID NO: 964145 - RNA, 22 nt, Human
aagccaggggcugcuuaggaga

SEQ ID NO: 964146 - RNA, 22 nt, Human
agaggccagcagugccuaucug

SEQ ID NO: 964147 - RNA, 22 nt, Human
ccccaggagcuuguuuuagaga

SEQ ID NO: 964148 - RNA, 22 nt, Human
ucugucacugagcucaggauuc

SEQ ID NO: 964149 - RNA, 22 nt, Human
aggcuucuacguggucccaggg

SEQ ID NO: 964150 - RNA, 22 nt, Human
auucuuggcaaggagauuuaaa

SEQ ID NO: 964151 - RNA, 22 nt, Human
auuuauuaagcaucugcuaugu

SEQ ID NO: 964152 - RNA, 23 nt, Human
gggauauggaccuuggaggaguc

SEQ ID NO: 964153 - RNA, 23 nt, Human
agcuggguggccugcgugaagcu

SEQ ID NO: 964154 - RNA, 22 nt, Human
ccagcucucagcgggagacuca

SEQ ID NO: 964155 - RNA, 22 nt, Human
cugggagucuggccucuggucc

SEQ ID NO: 964156 - RNA, 22 nt, Human
cuggagccacuuuuuauccuuu

SEQ ID NO: 964157 - RNA, 22 nt, Human
uauguagaagcugcucaaagaa

SEQ ID NO: 964158 - RNA, 22 nt, Human
uggggcuggcacagucucuauu

SEQ ID NO: 964159 - RNA, 22 nt, Human
uuuggaaaguugucacuuuaga

SEQ ID NO: 964160 - RNA, 22 nt, Human
cuagagaggcagauguccugug

SEQ ID NO: 964161 - RNA, 22 nt, Human
gcaguggggaaugcuggggaga

SEQ ID NO: 964162 - RNA, 22 nt, Human
uggaaagcgaggaguuggcauu

SEQ ID NO: 964163 - RNA, 22 nt, Human
caccaggcugaaccagagggga

SEQ ID NO: 964164 - RNA, 22 nt, Human
cagggucuuauaaggccaauuu

SEQ ID NO: 964165 - RNA, 22 nt, Human
uucaugaauggaaucaaugcuc

SEQ ID NO: 964166 - RNA, 22 nt, Human
gacagaggcuggagcaccuccu

SEQ ID NO: 964167 - RNA, 22 nt, Human
ccuccugguugcaaugaaaugg

SEQ ID NO: 964168 - RNA, 22 nt, Human
uuugcauuuugauaagaucacu

SEQ ID NO: 964169 - RNA, 22 nt, Human
uccagccaugacucggacagug

SEQ ID NO: 964170 - RNA, 23 nt, Human
cagaccuggcagucauccucaac

SEQ ID NO: 964171 - RNA, 22 nt, Human
guugaaauuugugauaauuuag

SEQ ID NO: 964172 - RNA, 22 nt, Human
uauaugcuaauggugccauucc

SEQ ID NO: 964173 - RNA, 22 nt, Human
ucugcagggaugugagggguga

SEQ ID NO: 964174 - RNA, 22 nt, Human
gagguggccucaagcagucuuc

SEQ ID NO: 964175 - RNA, 22 nt, Human
agcucccaauugacuugaacua

SEQ ID NO: 964176 - RNA, 22 nt, Human
acauuugucuucuuucagauua

SEQ ID NO: 964177 - RNA, 22 nt, Human
gccuuggccuuccuaggccuga

SEQ ID NO: 964178 - RNA, 22 nt, Human
uuggccaaggucacugggugag

SEQ ID NO: 964179 - RNA, 22 nt, Human
ucuucaucucagauuaacagga

SEQ ID NO: 964180 - RNA, 22 nt, Human
uaauuucacugauaugaaguca

SEQ ID NO: 964181 - RNA, 22 nt, Human
gccuuugcaccaucagugcaau

SEQ ID NO: 964182 - RNA, 22 nt, Human
ucuuucagccacuuaccugucu

SEQ ID NO: 964183 - RNA, 22 nt, Human
cagcagagacgguaagcagaac

SEQ ID NO: 964184 - RNA, 22 nt, Human
ccuuucucuuugcugaucaugu

SEQ ID NO: 964185 - RNA, 22 nt, Human
cuggaaugccucccugucagag

SEQ ID NO: 964186 - RNA, 22 nt, Human
ccuggaaguuggagguugcagu

SEQ ID NO: 964187 - RNA, 22 nt, Human
gaaugcacucacccaucacuca

SEQ ID NO: 964188 - RNA, 19 nt, Human
cccaggaggcggagguugc

SEQ ID NO: 964189 - RNA, 22 nt, Human
ccucucuguguggccucuccau

SEQ ID NO: 964190 - RNA, 22 nt, Human
uuggccaaggaaguagcaacgg

SEQ ID NO: 964191 - RNA, 22 nt, Human
gcugggagaggcccugaaguga

SEQ ID NO: 964192 - RNA, 22 nt, Human
cugcuguuccaccucugaaugc

SEQ ID NO: 964193 - RNA, 22 nt, Human
uuguuuuggagaugagcuaaaa

SEQ ID NO: 964194 - RNA, 22 nt, Human
cuuaugcugagaaugaaagaau

SEQ ID NO: 964195 - RNA, 22 nt, Human
uggcucagagcagggacucugg

SEQ ID NO: 964196 - RNA, 18 nt, Human
ugaggcagucagugaugg

SEQ ID NO: 964197 - RNA, 22 nt, Human
agggaauguagcaagaugccaa

SEQ ID NO: 964198 - RNA, 22 nt, Human
cugugagcuggguggccaggac

SEQ ID NO: 964199 - RNA, 21 nt, Human
ugcuggccucaagggugacuu

SEQ ID NO: 964200 - RNA, 22 nt, Human
ggagcugaugacgucaccaugg

SEQ ID NO: 964201 - RNA, 22 nt, Human
uaagugcaauguuuuacuuaaa

SEQ ID NO: 964202 - RNA, 22 nt, Human
agccaacuaggagauuaaggua

SEQ ID NO: 964203 - RNA, 22 nt, Human
acccugccgugggcugcuugug

SEQ ID NO: 964204 - RNA, 22 nt, Human
ugggacagagugagcuuuggcc

SEQ ID NO: 964205 - RNA, 22 nt, Human
agccagcuggagaccacuguuu

SEQ ID NO: 964206 - RNA, 16 nt, Human
uggaaggggucuccgg

SEQ ID NO: 964207 - RNA, 22 nt, Human
gcccaggaguucaaggcugcag

SEQ ID NO: 964208 - RNA, 22 nt, Human
uagcugcugcagcacagggagg

SEQ ID NO: 964209 - RNA, 22 nt, Human
aaggaagggaaauagugauguc

SEQ ID NO: 964210 - RNA, 22 nt, Human
acugccaggauggcacuagagg

SEQ ID NO: 964211 - RNA, 22 nt, Human
accuuucauuaaagucuguagu

SEQ ID NO: 964212 - RNA, 22 nt, Human
ugcacuggggucccagcgcacg

SEQ ID NO: 964213 - RNA, 17 nt, Human
gcugagugcagggaguc

SEQ ID NO: 964214 - RNA, 22 nt, Human
auccaaaucaugucagaagaac

SEQ ID NO: 964215 - RNA, 22 nt, Human
auacuguuucucuucuacauga

SEQ ID NO: 964216 - RNA, 22 nt, Human
uugaacauuaacuucagucuau

SEQ ID NO: 964217 - RNA, 22 nt, Human
aaaugcacaaaguaaguguaau

SEQ ID NO: 964218 - RNA, 22 nt, Human
uccugccuguuuaccuguacuu

SEQ ID NO: 964219 - RNA, 23 nt, Human
ucugggcaccuuguugacaugau

SEQ ID NO: 964220 - RNA, 22 nt, Human
ggccuuggggaggauggugucc

SEQ ID NO: 964221 - RNA, 22 nt, Human
uucuuaacuggaaaaugucaga

SEQ ID NO: 964222 - RNA, 19 nt, Human
aaaagucuauucaauuaca

SEQ ID NO: 964223 - RNA, 22 nt, Human
cagaggccuggcuuggacaccu

SEQ ID NO: 964224 - RNA, 23 nt, Human
aggugccaacugagagcugagag

SEQ ID NO: 964225 - RNA, 22 nt, Human
ugcugucaguuggcaggaugag

SEQ ID NO: 964226 - RNA, 22 nt, Human
aggucauuccagccauuccccu

SEQ ID NO: 964227 - RNA, 23 nt, Human
gagguacagcaccagugaauagg

SEQ ID NO: 964228 - RNA, 21 nt, Human
ugcuggaaaaagugguucuag

SEQ ID NO: 964229 - RNA, 22 nt, Human
agcagggcagguaaggaucaga

SEQ ID NO: 964230 - RNA, 22 nt, Human
cugccuccucacguccacagug

SEQ ID NO: 964231 - RNA, 22 nt, Human
gaggccaaguuggagaccaggu

SEQ ID NO: 964232 - RNA, 22 nt, Human
auuauauugaguauaaccagag

SEQ ID NO: 964233 - RNA, 22 nt, Human
gcugugcacuaccuauacaucc

SEQ ID NO: 964234 - RNA, 22 nt, Human
uggcagcugcaggccuccugag

SEQ ID NO: 964235 - RNA, 22 nt, Human
ugcagccaucuuucuuggagga

SEQ ID NO: 964236 - RNA, 22 nt, Human
uggcacugaagcuggaaagccu

SEQ ID NO: 964237 - RNA, 22 nt, Human
ggcuguccuuggccaaggcacu

SEQ ID NO: 964238 - RNA, 22 nt, Human
cuauuucaaggcccagauauga

SEQ ID NO: 964239 - RNA, 22 nt, Human
augcuuuacaguuuuccaaaca

SEQ ID NO: 964240 - RNA, 22 nt, Human
accucugccaagaugugcuccc

SEQ ID NO: 964241 - RNA, 22 nt, Human
auauaaaguguuuagaaagcug

SEQ ID NO: 964242 - RNA, 22 nt, Human
cugugucucguuaaagcauugg

SEQ ID NO: 964243 - RNA, 22 nt, Human
gcccuggaaucucuccauggga

SEQ ID NO: 964244 - RNA, 22 nt, Human
cucacugugccuuuucccaaac

SEQ ID NO: 964245 - RNA, 22 nt, Human
uuugaacaagagcuucacauua

SEQ ID NO: 964246 - RNA, 22 nt, Human
agcuucuuggcucagcacuugg

SEQ ID NO: 964247 - RNA, 22 nt, Human
gcagagccccucaagccagccu

SEQ ID NO: 964248 - RNA, 22 nt, Human
cuggagcuccagggucuccucu

SEQ ID NO: 964249 - RNA, 22 nt, Human
cucagucugucuugucuguguu

SEQ ID NO: 964250 - RNA, 22 nt, Human
ugagcccagagaucugagcuau

SEQ ID NO: 964251 - RNA, 22 nt, Human
aucuuguuauaagagauaaugg

SEQ ID NO: 964252 - RNA, 23 nt, Human
uuucauaugguguggaugaagaa

SEQ ID NO: 964253 - RNA, 22 nt, Human
ccuggcagcaggugggcccgug

SEQ ID NO: 964254 - RNA, 22 nt, Human
uguccucaaggagcuucagucu

SEQ ID NO: 964255 - RNA, 22 nt, Human
uucuucuccuaaggagaguccu

SEQ ID NO: 964256 - RNA, 21 nt, Human
ccaccaggucuucugcucggg

SEQ ID NO: 964257 - RNA, 22 nt, Human
auucacaacugauccuugcuca

SEQ ID NO: 964258 - RNA, 22 nt, Human
gcuggagguuucaccugaguuu

SEQ ID NO: 964259 - RNA, 22 nt, Human
ucuucagagacucugagccccu

SEQ ID NO: 964260 - RNA, 22 nt, Human
ggcugcugguagggguaggaag

SEQ ID NO: 964261 - RNA, 22 nt, Human
gagugguaggcaguguuaggaa

SEQ ID NO: 964262 - RNA, 22 nt, Human
cauuccuuaacguggggagucu

SEQ ID NO: 964263 - RNA, 22 nt, Human
auggcccaggccuccuguggcu

SEQ ID NO: 964264 - RNA, 22 nt, Human
gcagauggcagcccaggcuggg

SEQ ID NO: 964265 - RNA, 22 nt, Human
ccuggcugguggcagcgacaag

SEQ ID NO: 964266 - RNA, 22 nt, Human
auacacaugcacacaugugugu

SEQ ID NO: 964267 - RNA, 18 nt, Human
ugacagaaccuggagccu

SEQ ID NO: 964268 - RNA, 22 nt, Human
ugcagcucauugcuggggucug

SEQ ID NO: 964269 - RNA, 22 nt, Human
aacagacagaaaaaugugaucu

SEQ ID NO: 964270 - RNA, 22 nt, Human
cagcugcuuuaguuuuccaucc

SEQ ID NO: 964271 - RNA, 22 nt, Human
aagcaccuggguuauaucuuag

SEQ ID NO: 964272 - RNA, 22 nt, Human
ccagaggucuccugcacgggau

SEQ ID NO: 964273 - RNA, 22 nt, Human
ugucagaacucuauugaugucc

SEQ ID NO: 964274 - RNA, 22 nt, Human
agggaggucuuugaggggcuua

SEQ ID NO: 964275 - RNA, 22 nt, Human
gccucugcaugcucagcaccca

SEQ ID NO: 964276 - RNA, 22 nt, Human
agugucauuccagggacccucg

SEQ ID NO: 964277 - RNA, 22 nt, Human
aggcucugacgucacacguggc

SEQ ID NO: 964278 - RNA, 22 nt, Human
uuaacaugucuugacuucaucu

SEQ ID NO: 964279 - RNA, 20 nt, Human
aggcccugccagggacggag

SEQ ID NO: 964280 - RNA, 22 nt, Human
gcagagcugucuaagucacuuc

SEQ ID NO: 964281 - RNA, 22 nt, Human
uugugucugggggagugacauc

SEQ ID NO: 964282 - RNA, 22 nt, Human
gucagugucuuaacagagauua

SEQ ID NO: 964283 - RNA, 22 nt, Human
uuugaagucaggcuuucuaccc

SEQ ID NO: 964284 - RNA, 22 nt, Human
aaggccugggaguacugggaca

SEQ ID NO: 964285 - RNA, 22 nt, Human
uuuuaucuucauuccuaucuac

SEQ ID NO: 964286 - RNA, 22 nt, Human
cuccucagacuuuccuuguccg

SEQ ID NO: 964287 - RNA, 23 nt, Human
acagggcauugcuggccucgagg

SEQ ID NO: 964288 - RNA, 22 nt, Human
agcaauauuucagcuagcaggu

SEQ ID NO: 964289 - RNA, 22 nt, Human
gccacaggcacuuaagggcugg

SEQ ID NO: 964290 - RNA, 22 nt, Human
agugaaaucagguuuugacugc

SEQ ID NO: 964291 - RNA, 22 nt, Human
gagagcuguguucauucuacca

SEQ ID NO: 964292 - RNA, 22 nt, Human
ccagcagacacacaggcguggg

SEQ ID NO: 964293 - RNA, 22 nt, Human
ucaggcugccuaucagacugug

SEQ ID NO: 964294 - RNA, 23 nt, Human
cucccuggaguuucuggaagaug

SEQ ID NO: 964295 - RNA, 22 nt, Human
gcagcuggggaggucgugggga

SEQ ID NO: 964296 - RNA, 22 nt, Human
cugggcucagaugagaggaagg

SEQ ID NO: 964297 - RNA, 22 nt, Human
aggagagaauguuccaggcuug

SEQ ID NO: 964298 - RNA, 22 nt, Human
agucucagaguaccugagggac

SEQ ID NO: 964299 - RNA, 22 nt, Human
uggaaauggaucugaugagucu

SEQ ID NO: 964300 - RNA, 22 nt, Human
ccuggugccacuagagaauguc

SEQ ID NO: 964301 - RNA, 22 nt, Human
ccagggugcucuguggcgucgc

SEQ ID NO: 964302 - RNA, 22 nt, Human
cuggguggcagagccugcagug

SEQ ID NO: 964303 - RNA, 21 nt, Human
gcagcuggucucagagcuugc

SEQ ID NO: 964304 - RNA, 22 nt, Human
cagcaggauuugaaaggaagag

SEQ ID NO: 964305 - RNA, 22 nt, Human
cacaggggcaaacuguagggga

SEQ ID NO: 964306 - RNA, 22 nt, Human
ugaaagguguccaauauuucuc

SEQ ID NO: 964307 - RNA, 22 nt, Human
uucauuacugcgguagucacac

SEQ ID NO: 964308 - RNA, 21 nt, Human
ccagcuccaggaccuuggauc

SEQ ID NO: 964309 - RNA, 22 nt, Human
ugucuuccucuuggcuugagcu

SEQ ID NO: 964310 - RNA, 22 nt, Human
ccaggagacccagggaaggagc

SEQ ID NO: 964311 - RNA, 22 nt, Human
aggcacugagaggcuguguugc

SEQ ID NO: 964312 - RNA, 22 nt, Human
aauguguagggugccuguuuuu

SEQ ID NO: 964313 - RNA, 22 nt, Human
gcagcucccagcuugaaagguc

SEQ ID NO: 964314 - RNA, 22 nt, Human
agguguguauaaacauacauau

SEQ ID NO: 964315 - RNA, 22 nt, Human
ccagggagccuggugugucagc

SEQ ID NO: 964316 - RNA, 22 nt, Human
uaaggccagcaugaaugcagca

SEQ ID NO: 964317 - RNA, 20 nt, Human
aagcagaagcugcucucagc

SEQ ID NO: 964318 - RNA, 22 nt, Human
aguuauaaucugcuacugauau

SEQ ID NO: 964319 - RNA, 22 nt, Human
gagcuggcaggaggcuccccga

SEQ ID NO: 964320 - RNA, 22 nt, Human
ucacaggagagcugaugcuggu

SEQ ID NO: 964321 - RNA, 22 nt, Human
cuggcagcugugugaagaacug

SEQ ID NO: 964322 - RNA, 22 nt, Human
aaagacugguguguuacauaua

SEQ ID NO: 964323 - RNA, 22 nt, Human
uccugccuuagagcaaggaaaa

SEQ ID NO: 964324 - RNA, 22 nt, Human
aaauuccauuaugauaauuucg

SEQ ID NO: 964325 - RNA, 22 nt, Human
agggguggccugccuuacuccc

SEQ ID NO: 964326 - RNA, 22 nt, Human
guggcacuaaauacagcauuuc

SEQ ID NO: 964327 - RNA, 22 nt, Human
ugcaacagacuuuauuaacucu

SEQ ID NO: 964328 - RNA, 22 nt, Human
uccuguuaguguuagacuuccc

SEQ ID NO: 964329 - RNA, 22 nt, Human
cuucugagcagaccuccugggg

SEQ ID NO: 964330 - RNA, 22 nt, Human
agagcugcaccuaugcagaccu

SEQ ID NO: 964331 - RNA, 22 nt, Human
gcagcugcuguggcaucaagcu

SEQ ID NO: 964332 - RNA, 22 nt, Human
uucagagccacuucaagucuaa

SEQ ID NO: 964333 - RNA, 22 nt, Human
caaugaaauugagauccagaga

SEQ ID NO: 964334 - RNA, 22 nt, Human
acaaaggugcgucccuucagcu

SEQ ID NO: 964335 - RNA, 22 nt, Human
agccuggaauuaaggaaaugca

SEQ ID NO: 964336 - RNA, 22 nt, Human
cuggugagacgguugacaggag

SEQ ID NO: 964337 - RNA, 22 nt, Human
cuguggcuaggaagcuguggga

SEQ ID NO: 964338 - RNA, 22 nt, Human
cagccaggagcucccccugcuc

SEQ ID NO: 964339 - RNA, 22 nt, Human
ccagagccggauugugaagugc

SEQ ID NO: 964340 - RNA, 22 nt, Human
caggcugggacugaccccugcu

SEQ ID NO: 964341 - RNA, 22 nt, Human
agaaacauuuagauuauauguc

SEQ ID NO: 964342 - RNA, 22 nt, Human
guggcccucugauagggucagg

SEQ ID NO: 964343 - RNA, 22 nt, Human
aaggcacuagcagaauuaguga

SEQ ID NO: 964344 - RNA, 22 nt, Human
ugaccaaagaguugcuuguauu

SEQ ID NO: 964345 - RNA, 22 nt, Human
uucuccagagggcucugcagga

SEQ ID NO: 964346 - RNA, 22 nt, Human
cgucuuccucuuacgaugcgcu

SEQ ID NO: 964347 - RNA, 22 nt, Human
cugcuguguaucauuuuagaug

SEQ ID NO: 964348 - RNA, 22 nt, Human
guaauuuuggaguauaaccugg

SEQ ID NO: 964349 - RNA, 22 nt, Human
auuauguagcuaaaaauugugu

SEQ ID NO: 964350 - RNA, 23 nt, Human
acagagaucuugacuuguaugga

SEQ ID NO: 964351 - RNA, 22 nt, Human
gcauuucuuccuggugugagcc

SEQ ID NO: 964352 - RNA, 22 nt, Human
cccaggugcugcgugaagccuc

SEQ ID NO: 964353 - RNA, 22 nt, Human
uggcagcuagcuguuuucaugc

SEQ ID NO: 964354 - RNA, 22 nt, Human
uauguguauguacauacauaca

SEQ ID NO: 964355 - RNA, 22 nt, Human
cccaggagacugagcuguaacc

SEQ ID NO: 964356 - RNA, 23 nt, Human
uggggccaagugaggaagggucu

SEQ ID NO: 964357 - RNA, 22 nt, Human
uuugcuaaugccucugaaauca

SEQ ID NO: 964358 - RNA, 22 nt, Human
caaauaucuuuggcaaagagaa

SEQ ID NO: 964359 - RNA, 22 nt, Human
cuucuucaauagcaagcgcaua

SEQ ID NO: 964360 - RNA, 22 nt, Human
uuuccucuuugugacacagcug

SEQ ID NO: 964361 - RNA, 22 nt, Human
uccaagaucuacagcaguuuag

SEQ ID NO: 964362 - RNA, 22 nt, Human
uacaucuauacugaucuacauu

SEQ ID NO: 964363 - RNA, 22 nt, Human
cuggcaggcggcagagcccagg

SEQ ID NO: 964364 - RNA, 22 nt, Human
caugggagcuaucuccaucacu

SEQ ID NO: 964365 - RNA, 22 nt, Human
ugcucugggcaacagccucccu

SEQ ID NO: 964366 - RNA, 19 nt, Human
aagaagcaauaagcuguga

SEQ ID NO: 964367 - RNA, 20 nt, Human
gaaaugugaccucuucugug

SEQ ID NO: 964368 - RNA, 22 nt, Human
aucaggauggguuuggcuuagg

SEQ ID NO: 964369 - RNA, 22 nt, Human
ggccuggaagaggacagagaaa

SEQ ID NO: 964370 - RNA, 22 nt, Human
gccaguggucacugaggaagaa

SEQ ID NO: 964371 - RNA, 22 nt, Human
cuccuggcccugagcucccagg

SEQ ID NO: 964372 - RNA, 21 nt, Human
uguaaguuucaucugaauugg

SEQ ID NO: 964373 - RNA, 22 nt, Human
caguagccacuagacacaugua

SEQ ID NO: 964374 - RNA, 22 nt, Human
uggagaagucaaagugaacagg

SEQ ID NO: 964375 - RNA, 23 nt, Human
gcucagagguuuuucucuggaug

SEQ ID NO: 964376 - RNA, 22 nt, Human
uggcugaauaauauucuguugu

SEQ ID NO: 964377 - RNA, 22 nt, Human
ccaaggcuucccagagaugcuc

SEQ ID NO: 964378 - RNA, 22 nt, Human
ccacacagggggaugaguuauu

SEQ ID NO: 964379 - RNA, 22 nt, Human
cagugggcugugauggauucac

SEQ ID NO: 964380 - RNA, 22 nt, Human
uggccuggaagagaggucgagg

SEQ ID NO: 964381 - RNA, 22 nt, Human
cagauaaaggcuuacuaguagu

SEQ ID NO: 964382 - RNA, 22 nt, Human
aggauuuuagauaagacagcaa

SEQ ID NO: 964383 - RNA, 17 nt, Human
agguggcugcugcgccu

SEQ ID NO: 964384 - RNA, 23 nt, Human
uccaugagaugugggcuucuagu

SEQ ID NO: 964385 - RNA, 22 nt, Human
gggccugucucacucccugguu

SEQ ID NO: 964386 - RNA, 22 nt, Human
cugguuuagcuguaagguuccc

SEQ ID NO: 964387 - RNA, 22 nt, Human
ucaguuuuuaaaugauauaauu

SEQ ID NO: 964388 - RNA, 22 nt, Human
gagagguccauuccccugucag

SEQ ID NO: 964389 - RNA, 22 nt, Human
ugaguucucacccauucuucuu

SEQ ID NO: 964390 - RNA, 22 nt, Human
guacacucccccugugaaguug

SEQ ID NO: 964391 - RNA, 22 nt, Human
uaaauucagugaguaauuucug

SEQ ID NO: 964392 - RNA, 17 nt, Human
uggagcugcguguguuc

SEQ ID NO: 964393 - RNA, 22 nt, Human
uccagggcugacuugggagagg

SEQ ID NO: 964394 - RNA, 22 nt, Human
ggaggugggagacauaggcggc

SEQ ID NO: 964395 - RNA, 22 nt, Human
aagcugcccaagacugaagcau

SEQ ID NO: 964396 - RNA, 22 nt, Human
cagggucugaaacugaucacag

SEQ ID NO: 964397 - RNA, 19 nt, Human
ugccagcauuaggcugaag

SEQ ID NO: 964398 - RNA, 22 nt, Human
aggcucugucaggcggagcagc

SEQ ID NO: 964399 - RNA, 22 nt, Human
ucuggcuccaggaccgggcaca

SEQ ID NO: 964400 - RNA, 22 nt, Human
ucucuucacaugcuugcuccaa

SEQ ID NO: 964401 - RNA, 22 nt, Human
ggcccaucucuugcucuggguu

SEQ ID NO: 964402 - RNA, 22 nt, Human
accaggcuggagugcaguggcg

SEQ ID NO: 964403 - RNA, 22 nt, Human
gaggagcugggucagggagaca

SEQ ID NO: 964404 - RNA, 22 nt, Human
auugugcaaauauuaucuguag

SEQ ID NO: 964405 - RNA, 22 nt, Human
cagggcuguuagcugcugcucu

SEQ ID NO: 964406 - RNA, 22 nt, Human
gcccgcagagaucuuuaacaaa

SEQ ID NO: 964407 - RNA, 21 nt, Human
ggcuccugcuuugugaggggc

SEQ ID NO: 964408 - RNA, 22 nt, Human
ugaugcuucacgcugaauaugc

SEQ ID NO: 964409 - RNA, 22 nt, Human
ccaguccagugccaugcauggc

SEQ ID NO: 964410 - RNA, 23 nt, Human
ucccuggaggcagguccagggcc

SEQ ID NO: 964411 - RNA, 22 nt, Human
gcacacaggcaguuuccagcca

SEQ ID NO: 964412 - RNA, 22 nt, Human
gaaaggcaguacagcugagccu

SEQ ID NO: 964413 - RNA, 22 nt, Human
guggcagcggcccaggccgucu

SEQ ID NO: 964414 - RNA, 22 nt, Human
acaauguguuuuuauacauuug

SEQ ID NO: 964415 - RNA, 22 nt, Human
aggacucaucccugcuugucag

SEQ ID NO: 964416 - RNA, 22 nt, Human
cuggcaaguacugggccagcuc

SEQ ID NO: 964417 - RNA, 22 nt, Human
uaggaucucaccauagaaggaa

SEQ ID NO: 964418 - RNA, 19 nt, Human
ucauuguugguuugucggg

SEQ ID NO: 964419 - RNA, 22 nt, Human
uucuuguauguaugcaaaauca

SEQ ID NO: 964420 - RNA, 22 nt, Human
ugcaaaugaguugcagaucagg

SEQ ID NO: 964421 - RNA, 19 nt, Human
caggaaugagguaauggcu

SEQ ID NO: 964422 - RNA, 20 nt, Human
agcagcuguguuuucauccu

SEQ ID NO: 964423 - RNA, 22 nt, Human
ucagggcaaugucccucagaag

SEQ ID NO: 964424 - RNA, 22 nt, Human
acauacaucaaguaucacaaga

SEQ ID NO: 964425 - RNA, 22 nt, Human
ccacagggcacaagggagguug

SEQ ID NO: 964426 - RNA, 22 nt, Human
cuagccaugggcauuaaaggua

SEQ ID NO: 964427 - RNA, 22 nt, Human
aagagguaaccauagcaaccac

SEQ ID NO: 964428 - RNA, 22 nt, Human
aagaggagacuucagcaacuug

SEQ ID NO: 964429 - RNA, 22 nt, Human
agagcagcacguuguccccaca

SEQ ID NO: 964430 - RNA, 22 nt, Human
cagggcuggcuguggcaaucuc

SEQ ID NO: 964431 - RNA, 22 nt, Human
uaccuugggcuauuaucuuuga

SEQ ID NO: 964432 - RNA, 22 nt, Human
aaggcacugacugugcagggga

SEQ ID NO: 964433 - RNA, 22 nt, Human
agccaugugucuuuauucuguu

SEQ ID NO: 964434 - RNA, 22 nt, Human
cuggugccuccucccugugcuu

SEQ ID NO: 964435 - RNA, 22 nt, Human
acauccugaagucagucauuug

SEQ ID NO: 964436 - RNA, 22 nt, Human
auguuuuaugcuucagaugagg

SEQ ID NO: 964437 - RNA, 22 nt, Human
agacagcaggggagucugguuu

SEQ ID NO: 964438 - RNA, 22 nt, Human
ugggagcaguucagguguggcu

SEQ ID NO: 964439 - RNA, 22 nt, Human
gcucccagcaauugaggcagcc

SEQ ID NO: 964440 - RNA, 22 nt, Human
agagaauuuuaaaagccuugaa

SEQ ID NO: 964441 - RNA, 22 nt, Human
cugccugugccaccgccucauu

SEQ ID NO: 964442 - RNA, 22 nt, Human
uaaauuaugucacaugacucug

SEQ ID NO: 964443 - RNA, 22 nt, Human
guaacaaaguuucuaggugcug

SEQ ID NO: 964444 - RNA, 22 nt, Human
agagccugaggccaggaaaaug

SEQ ID NO: 964445 - RNA, 22 nt, Human
cagcuggccaaucagggcgccc

SEQ ID NO: 964446 - RNA, 17 nt, Human
agcuccugcccauggcu

SEQ ID NO: 964447 - RNA, 22 nt, Human
ccagucugaggccuggugaggg

SEQ ID NO: 964448 - RNA, 22 nt, Human
aauucuagcauugugaaaauau

SEQ ID NO: 964449 - RNA, 19 nt, Human
ucccuuccugucgggcucc

SEQ ID NO: 964450 - RNA, 22 nt, Human
ucuguuccaguagaaaggugca

SEQ ID NO: 964451 - RNA, 21 nt, Human
uccagggaacuucucaggaau

SEQ ID NO: 964452 - RNA, 22 nt, Human
gaggccuggcugucagucccca

SEQ ID NO: 964453 - RNA, 22 nt, Human
ucaggaucggccuuuuuuuaag

SEQ ID NO: 964454 - RNA, 22 nt, Human
ggagcauguggggugagcaggg

SEQ ID NO: 964455 - RNA, 22 nt, Human
ccagagcccgggaccuggacuu

SEQ ID NO: 964456 - RNA, 22 nt, Human
ugaaaaggagccuuagguaggu

SEQ ID NO: 964457 - RNA, 22 nt, Human
uaagaacuucggacauguuauc

SEQ ID NO: 964458 - RNA, 22 nt, Human
uggcagcugugcuucauucuuu

SEQ ID NO: 964459 - RNA, 22 nt, Human
uuauuagggugguuuauguucu

SEQ ID NO: 964460 - RNA, 22 nt, Human
ccugucugcaugagugagcaua

SEQ ID NO: 964461 - RNA, 22 nt, Human
uuugaacuucuaccugucauau

SEQ ID NO: 964462 - RNA, 19 nt, Human
auaaggcaggaggaaauuu

SEQ ID NO: 964463 - RNA, 22 nt, Human
cucaggagacaguguccacaug

SEQ ID NO: 964464 - RNA, 22 nt, Human
auucggaucauguguauguguu

SEQ ID NO: 964465 - RNA, 18 nt, Human
acaguaaagaaaggaauu

SEQ ID NO: 964466 - RNA, 22 nt, Human
cuagaaaaauacuuuauuguga

SEQ ID NO: 964467 - RNA, 18 nt, Human
augggaggggccaagaga

SEQ ID NO: 964468 - RNA, 22 nt, Human
uccauguguuuuccuguccaca

SEQ ID NO: 964469 - RNA, 22 nt, Human
gcuuggaaguaggauugggaga

SEQ ID NO: 964470 - RNA, 22 nt, Human
ucaguguagcagacuuguagcc

SEQ ID NO: 964471 - RNA, 22 nt, Human
ggcagcucugaugaugcucugg

SEQ ID NO: 964472 - RNA, 22 nt, Human
guucuucaucuuaaccaucugu

SEQ ID NO: 964473 - RNA, 22 nt, Human
aauugugcuaugauuaugaaag

SEQ ID NO: 964474 - RNA, 22 nt, Human
uuucuaggcacagugucuuccc

SEQ ID NO: 964475 - RNA, 22 nt, Human
agauuucccucuuguauuugca

SEQ ID NO: 964476 - RNA, 22 nt, Human
gcagagccaggcuggggcaggu

SEQ ID NO: 964477 - RNA, 23 nt, Human
uggcccugaaucuguccuggagg

SEQ ID NO: 964478 - RNA, 22 nt, Human
agcagggcagugcuucagcucu

SEQ ID NO: 964479 - RNA, 22 nt, Human
cugaaaugguugccuggagaau

SEQ ID NO: 964480 - RNA, 22 nt, Human
cccagcauccucagggagcggg

SEQ ID NO: 964481 - RNA, 22 nt, Human
uaacagaagaaaacauauugga

SEQ ID NO: 964482 - RNA, 22 nt, Human
ggguccaggucuucaggcagag

SEQ ID NO: 964483 - RNA, 22 nt, Human
accugccucuaagcagcaggug

SEQ ID NO: 964484 - RNA, 19 nt, Human
aucugccuuagugcugcug

SEQ ID NO: 964485 - RNA, 22 nt, Human
auuauuaggacuacugggguug

SEQ ID NO: 964486 - RNA, 22 nt, Human
gcucccuguucucagccaugau

SEQ ID NO: 964487 - RNA, 22 nt, Human
gggcuacauugugagagaaguu

SEQ ID NO: 964488 - RNA, 22 nt, Human
gcacugaaugcuuuuacuguaa

SEQ ID NO: 964489 - RNA, 22 nt, Human
aaaugugucauauucaaaguca

SEQ ID NO: 964490 - RNA, 22 nt, Human
aagauaugaggucaccugcugg

SEQ ID NO: 964491 - RNA, 22 nt, Human
cagggcaguaccgcccucuggc

SEQ ID NO: 964492 - RNA, 22 nt, Human
gucaccagugcuaagaggugga

SEQ ID NO: 964493 - RNA, 22 nt, Human
ugugcagcuaguccuggacuug

SEQ ID NO: 964494 - RNA, 22 nt, Human
ugcuucaggagaugucaccaug

SEQ ID NO: 964495 - RNA, 20 nt, Human
aagagaggaaguuauacuag

SEQ ID NO: 964496 - RNA, 22 nt, Human
cauuucuguucucuuccuguac

SEQ ID NO: 964497 - RNA, 22 nt, Human
caagaugaaacuacagggagga

SEQ ID NO: 964498 - RNA, 17 nt, Human
ccacucaguaauuucuc

SEQ ID NO: 964499 - RNA, 17 nt, Human
gcacugaacaauccugu

SEQ ID NO: 964500 - RNA, 22 nt, Human
aagagcuggaguuugcagcccu

SEQ ID NO: 964501 - RNA, 22 nt, Human
ggcaguggcuccucucuacucc

SEQ ID NO: 964502 - RNA, 22 nt, Human
ggcugccugcucaggugcggcg

SEQ ID NO: 964503 - RNA, 22 nt, Human
aggcugcaggucugggucaugu

SEQ ID NO: 964504 - RNA, 20 nt, Human
gcaaauggaucccacaagcc

SEQ ID NO: 964505 - RNA, 22 nt, Human
ucuucaaaugcuaguaauauca

SEQ ID NO: 964506 - RNA, 22 nt, Human
aucaggauagucuguaaauugu

SEQ ID NO: 964507 - RNA, 22 nt, Human
uccaugaggcagggaggcuggc

SEQ ID NO: 964508 - RNA, 22 nt, Human
agccuggagguaaugaggaaac

SEQ ID NO: 964509 - RNA, 22 nt, Human
gucuggagccacccuaagcauu

SEQ ID NO: 964510 - RNA, 22 nt, Human
cucugggaccauggcaagugcg

SEQ ID NO: 964511 - RNA, 20 nt, Human
ugccaugguaacagagugug

SEQ ID NO: 964512 - RNA, 22 nt, Human
cugagcugggacucaguagcaa

SEQ ID NO: 964513 - RNA, 22 nt, Human
aucaggaugacuauaaggcugc

SEQ ID NO: 964514 - RNA, 20 nt, Human
gaguuccccauuucuccugg

SEQ ID NO: 964515 - RNA, 23 nt, Human
agcuccagaacauagcacaggaa

SEQ ID NO: 964516 - RNA, 16 nt, Human
aggaggggaauuagga

SEQ ID NO: 964517 - RNA, 22 nt, Human
ggagagaaauugagguagcaag

SEQ ID NO: 964518 - RNA, 22 nt, Human
caggagggcccgagacucuucc

SEQ ID NO: 964519 - RNA, 22 nt, Human
gcaaguuauuuccauuuaaagc

SEQ ID NO: 964520 - RNA, 20 nt, Human
cucaggauugucuagccccu

SEQ ID NO: 964521 - RNA, 17 nt, Human
agcugaccagauggacu

SEQ ID NO: 964522 - RNA, 22 nt, Human
ugcuccauucucuagccagugc

SEQ ID NO: 964523 - RNA, 22 nt, Human
cucaggaggugguagaggcccu

SEQ ID NO: 964524 - RNA, 22 nt, Human
agaaaugugagccccuuaucaa

SEQ ID NO: 964525 - RNA, 22 nt, Human
gcugcugugaauuuuuuaaaug

SEQ ID NO: 964526 - RNA, 22 nt, Human
uccuucagggggccgccugcac

SEQ ID NO: 964527 - RNA, 22 nt, Human
uucuacagacuauaacugugau

SEQ ID NO: 964528 - RNA, 22 nt, Human
ugguccagaugccuuggcuuua

SEQ ID NO: 964529 - RNA, 22 nt, Human
gcagguguggaguggggugagc

SEQ ID NO: 964530 - RNA, 22 nt, Human
gucauuccuauccauuugauac

SEQ ID NO: 964531 - RNA, 22 nt, Human
agaguucugcucuucucaguga

SEQ ID NO: 964532 - RNA, 22 nt, Human
ugggcuggcguggagaguuuag

SEQ ID NO: 964533 - RNA, 22 nt, Human
agaaauuccuaagguacacaag

SEQ ID NO: 964534 - RNA, 22 nt, Human
uauguuuaguauccauuuucag

SEQ ID NO: 964535 - RNA, 22 nt, Human
gcugcucucucccuaaguuggg

SEQ ID NO: 964536 - RNA, 19 nt, Human
aggcugugagggaggacuc

SEQ ID NO: 964537 - RNA, 22 nt, Human
cagucccaccaggaucgcucuu

SEQ ID NO: 964538 - RNA, 22 nt, Human
aauccuggaauacaagagugaa

SEQ ID NO: 964539 - RNA, 22 nt, Human
augcaucauggaaaacucaguu

SEQ ID NO: 964540 - RNA, 22 nt, Human
gcagaggagaugaagauacuuu

SEQ ID NO: 964541 - RNA, 22 nt, Human
ugaaaugauguacaagaaggca

SEQ ID NO: 964542 - RNA, 22 nt, Human
cugccucucaggucccugagau

SEQ ID NO: 964543 - RNA, 22 nt, Human
acagcagcuaaccccugggcca

SEQ ID NO: 964544 - RNA, 22 nt, Human
uccauuuuagaagaaaauccac

SEQ ID NO: 964545 - RNA, 18 nt, Human
cugcccagagcacuugug

SEQ ID NO: 964546 - RNA, 22 nt, Human
ugcccaaguccuccaccgaggu

SEQ ID NO: 964547 - RNA, 22 nt, Human
ucuguaaaacuucuuuguaaau

SEQ ID NO: 964548 - RNA, 22 nt, Human
gcugggcagccccuacagagag

SEQ ID NO: 964549 - RNA, 22 nt, Human
uuauuccauucaguucaacaag

SEQ ID NO: 964550 - RNA, 22 nt, Human
aaucuucuacuugacaguucuc

SEQ ID NO: 964551 - RNA, 22 nt, Human
ggcucugcuucagaaggcucau

SEQ ID NO: 964552 - RNA, 22 nt, Human
ggugcccaccugucuuccugga

SEQ ID NO: 964553 - RNA, 22 nt, Human
ggcagcuuguccuucaggagag

SEQ ID NO: 964554 - RNA, 22 nt, Human
ucagggaaauuuccauguguuu

SEQ ID NO: 964555 - RNA, 23 nt, Human
cuugcaggaagcagauggcacac

SEQ ID NO: 964556 - RNA, 22 nt, Human
uggcugaaggaagauucuucua

SEQ ID NO: 964557 - RNA, 22 nt, Human
uguaggccuauguccagcaauu

SEQ ID NO: 964558 - RNA, 22 nt, Human
gacuuucucuccucccaggugu

SEQ ID NO: 964559 - RNA, 22 nt, Human
ucugucuccugccagugccucu

SEQ ID NO: 964560 - RNA, 22 nt, Human
ugcuggcccaguauggacugca

SEQ ID NO: 964561 - RNA, 22 nt, Human
ugcucuggguccugggccuccu

SEQ ID NO: 964562 - RNA, 22 nt, Human
ugguaaaguguacugaauauga

SEQ ID NO: 964563 - RNA, 22 nt, Human
agaggggaaguaaugaaugaua

SEQ ID NO: 964564 - RNA, 22 nt, Human
cacugaagguaggaccaaggcu

SEQ ID NO: 964565 - RNA, 20 nt, Human
ugcuccaucuaaagugauua

SEQ ID NO: 964566 - RNA, 17 nt, Human
agaggcagauacuugga

SEQ ID NO: 964567 - RNA, 22 nt, Human
uccuggagccacggagcuuuca

SEQ ID NO: 964568 - RNA, 22 nt, Human
augcaguacugauacaugccac

SEQ ID NO: 964569 - RNA, 22 nt, Human
ggucucaggagacuggagagca

SEQ ID NO: 964570 - RNA, 22 nt, Human
gcccugucggaacugcgaccuc

SEQ ID NO: 964571 - RNA, 22 nt, Human
ggcuucugccacgagagggaag

SEQ ID NO: 964572 - RNA, 22 nt, Human
acacugaauauacaaugaauau

SEQ ID NO: 964573 - RNA, 22 nt, Human
ccccagcucagugcagggacau

SEQ ID NO: 964574 - RNA, 22 nt, Human
aagugggaauagaaaugaaggu

SEQ ID NO: 964575 - RNA, 18 nt, Human
gcccugguggagcuggug

SEQ ID NO: 964576 - RNA, 22 nt, Human
cucuugaagcaggggccaguuc

SEQ ID NO: 964577 - RNA, 22 nt, Human
uaggcagcgcuuggcugugcuu

SEQ ID NO: 964578 - RNA, 22 nt, Human
ucacaggagggagagacaccca

SEQ ID NO: 964579 - RNA, 22 nt, Human
ugucccaggccucauguugcca

SEQ ID NO: 964580 - RNA, 22 nt, Human
gcugggagcaaagccaugcaua

SEQ ID NO: 964581 - RNA, 22 nt, Human
cagagcugcuucccaguuugug

SEQ ID NO: 964582 - RNA, 22 nt, Human
cagcugacccgugggaggcggg

SEQ ID NO: 964583 - RNA, 22 nt, Human
acuuaaaaagaaucuuuucacg

SEQ ID NO: 964584 - RNA, 22 nt, Human
ugaaaugagauagauaaucagg

SEQ ID NO: 964585 - RNA, 22 nt, Human
gcagagccuugcgucaugugcc

SEQ ID NO: 964586 - RNA, 22 nt, Human
caaaauguucuggcaccuuuaa

SEQ ID NO: 964587 - RNA, 22 nt, Human
gaacaguaucaguagugccagu

SEQ ID NO: 964588 - RNA, 20 nt, Human
gcugggggugugcugaguga

SEQ ID NO: 964589 - RNA, 22 nt, Human
ucuggccugggccugccggugc

SEQ ID NO: 964590 - RNA, 22 nt, Human
auuaaauuagcaaacugugaaa

SEQ ID NO: 964591 - RNA, 22 nt, Human
ccuccuggugggcgcuucuggc

SEQ ID NO: 964592 - RNA, 22 nt, Human
gaaaaaugagcugaugucaggg

SEQ ID NO: 964593 - RNA, 22 nt, Human
uggccugguuauauugcuauca

SEQ ID NO: 964594 - RNA, 22 nt, Human
ucucucagaggaagaggcagug

SEQ ID NO: 964595 - RNA, 22 nt, Human
gcaagcuggcuguuagaggaug

SEQ ID NO: 964596 - RNA, 22 nt, Human
gccagcuggagacuggcagggg

SEQ ID NO: 964597 - RNA, 22 nt, Human
cagccagcuggcacugugagua

SEQ ID NO: 964598 - RNA, 17 nt, Human
gccucugcuugugucau

SEQ ID NO: 964599 - RNA, 22 nt, Human
cccucagcuccacccucagcag

SEQ ID NO: 964600 - RNA, 22 nt, Human
uguauuagaucugagaacuucu

SEQ ID NO: 964601 - RNA, 22 nt, Human
gcucucugccuuucucaaugac

SEQ ID NO: 964602 - RNA, 22 nt, Human
gagcacugaggaaagcugguua

SEQ ID NO: 964603 - RNA, 22 nt, Human
cuggacuuuggcccaucugcca

SEQ ID NO: 964604 - RNA, 22 nt, Human
gucuucuuuucagucugcuugu

SEQ ID NO: 964605 - RNA, 22 nt, Human
aggugcugccccgagaaggaug

SEQ ID NO: 964606 - RNA, 22 nt, Human
gcucccaguucccaaagugacc

SEQ ID NO: 964607 - RNA, 22 nt, Human
ccagcagcccacaggcgucccu

SEQ ID NO: 964608 - RNA, 22 nt, Human
uauguagguaaacacagacaua

SEQ ID NO: 964609 - RNA, 22 nt, Human
gcucccaggaugaggagccagg

SEQ ID NO: 964610 - RNA, 22 nt, Human
gcagggccagggcucaggcugu

SEQ ID NO: 964611 - RNA, 22 nt, Human
gaggccuguagucauggaugua

SEQ ID NO: 964612 - RNA, 22 nt, Human
guuccuauauagccuuaaggau

SEQ ID NO: 964613 - RNA, 22 nt, Human
uccucaggaucuaggagugcuu

SEQ ID NO: 964614 - RNA, 22 nt, Human
uggcaggcagugugggagcugg

SEQ ID NO: 964615 - RNA, 22 nt, Human
guuauaaaggugauaaugguca

SEQ ID NO: 964616 - RNA, 22 nt, Human
agucucaggcagaggaaggcua

SEQ ID NO: 964617 - RNA, 22 nt, Human
cagggcaguaacgggaacaucu

SEQ ID NO: 964618 - RNA, 22 nt, Human
ugggggagauugugcaucucua

SEQ ID NO: 964619 - RNA, 22 nt, Human
ucuugggaccauuuacacauac

SEQ ID NO: 964620 - RNA, 22 nt, Human
cacagaaucugugacuccaaga

SEQ ID NO: 964621 - RNA, 22 nt, Human
ucuguucacugagcaauggcaa

SEQ ID NO: 964622 - RNA, 21 nt, Human
aaaggccauaaucacggagca

SEQ ID NO: 964623 - RNA, 22 nt, Human
gagaggagguggcuaugacagc

SEQ ID NO: 964624 - RNA, 22 nt, Human
aaugcuagugugauauguaagg

SEQ ID NO: 964625 - RNA, 22 nt, Human
agcacuuuccuggcaaaugugg

SEQ ID NO: 964626 - RNA, 22 nt, Human
aauuaggagaaaacuguugucu

SEQ ID NO: 964627 - RNA, 22 nt, Human
aggugagggugccagugcaugg

SEQ ID NO: 964628 - RNA, 22 nt, Human
cagucucagaggugggaguggg

SEQ ID NO: 964629 - RNA, 22 nt, Human
cagcuguggcugccacugcucc

SEQ ID NO: 964630 - RNA, 22 nt, Human
ccugggcagggcuggacucuca

SEQ ID NO: 964631 - RNA, 22 nt, Human
uuugauucuguaaaauaacagg

SEQ ID NO: 964632 - RNA, 22 nt, Human
gcagggugaaggucacauagaa

SEQ ID NO: 964633 - RNA, 22 nt, Human
ccuguggcugccacuuggguga

SEQ ID NO: 964634 - RNA, 22 nt, Human
gcagcugccuucagcuggaugg

SEQ ID NO: 964635 - RNA, 22 nt, Human
aaaugcacaggagaaccaauuc

SEQ ID NO: 964636 - RNA, 18 nt, Human
aguaguggguuuagcuuc

SEQ ID NO: 964637 - RNA, 17 nt, Human
ugcauuguuggaaauuu

SEQ ID NO: 964638 - RNA, 22 nt, Human
ccugccugacagagaagguuca

SEQ ID NO: 964639 - RNA, 22 nt, Human
aagcagcagaccugauuuugaa

SEQ ID NO: 964640 - RNA, 22 nt, Human
caaaguuuaaaguagauuucag

SEQ ID NO: 964641 - RNA, 23 nt, Human
ccugcagcugcuggggcuccacc

SEQ ID NO: 964642 - RNA, 22 nt, Human
acagucuacuugagcuuguaua

SEQ ID NO: 964643 - RNA, 22 nt, Human
ucaggaucaggggccuuuccuu

SEQ ID NO: 964644 - RNA, 22 nt, Human
uauguacaugauuucauuugcu

SEQ ID NO: 964645 - RNA, 18 nt, Human
guaggucaguaccaagca

SEQ ID NO: 964646 - RNA, 22 nt, Human
cuugcugucuugcauuuagagc

SEQ ID NO: 964647 - RNA, 22 nt, Human
ugccuggguccaggccaagccu

SEQ ID NO: 964648 - RNA, 22 nt, Human
acuuccugaauggggcuaauua

SEQ ID NO: 964649 - RNA, 22 nt, Human
cauuuguaucugggcugcugug

SEQ ID NO: 964650 - RNA, 19 nt, Human
ucuguucacauuguuucgc

SEQ ID NO: 964651 - RNA, 22 nt, Human
cugaggcaugaaugugggcuuu

SEQ ID NO: 964652 - RNA, 22 nt, Human
cugaaggagcauagucaguuuu

SEQ ID NO: 964653 - RNA, 22 nt, Human
ccugggagugugccaucucugu

SEQ ID NO: 964654 - RNA, 22 nt, Human
uguaguaagugcgcaauaaaua

SEQ ID NO: 964655 - RNA, 22 nt, Human
auguacauuuguaguaauauca

SEQ ID NO: 964656 - RNA, 22 nt, Human
aaggcagccagauccuuugggu

SEQ ID NO: 964657 - RNA, 22 nt, Human
gugcauuggugcgccacuucac

SEQ ID NO: 964658 - RNA, 22 nt, Human
agauguuuucuaauucuauauu

SEQ ID NO: 964659 - RNA, 22 nt, Human
caggaccccauauucacugaac

SEQ ID NO: 964660 - RNA, 21 nt, Human
agugaaaugaaguguaugcuc

SEQ ID NO: 964661 - RNA, 22 nt, Human
uagccgggugugguggaacucc

SEQ ID NO: 964662 - RNA, 22 nt, Human
ucccaagugucuuggaccaggg

SEQ ID NO: 964663 - RNA, 22 nt, Human
ccuguuuacaucaucaaggacu

SEQ ID NO: 964664 - RNA, 22 nt, Human
aggcagcuggaaaacuccaggc

SEQ ID NO: 964665 - RNA, 22 nt, Human
agcucccauuaucuucugaaac

SEQ ID NO: 964666 - RNA, 22 nt, Human
uuauucuuuaaacauauauguu

SEQ ID NO: 964667 - RNA, 22 nt, Human
caggggcugagaaggaacgucc

SEQ ID NO: 964668 - RNA, 22 nt, Human
agcagugggggaguguuaguuu

SEQ ID NO: 964669 - RNA, 22 nt, Human
gaggagcugggcugagaggguc

SEQ ID NO: 964670 - RNA, 22 nt, Human
auucuguauuucuaauaagauc

SEQ ID NO: 964671 - RNA, 19 nt, Human
uuugaaaggauuguuauuu

SEQ ID NO: 964672 - RNA, 22 nt, Human
uagaaacagcauauauuagccc

SEQ ID NO: 964673 - RNA, 22 nt, Human
ggagugaguacuggaguagcug

SEQ ID NO: 964674 - RNA, 22 nt, Human
augugaaagagguguucagugg

SEQ ID NO: 964675 - RNA, 22 nt, Human
gcuggggagcuagaccucagca

SEQ ID NO: 964676 - RNA, 22 nt, Human
gagggagugccagagggccagc

SEQ ID NO: 964677 - RNA, 22 nt, Human
cugccgagugggucaugaggca

SEQ ID NO: 964678 - RNA, 22 nt, Human
aggaggcccuagagcucuagag

SEQ ID NO: 964679 - RNA, 22 nt, Human
uuggccaagugguuaaucucca

SEQ ID NO: 964680 - RNA, 22 nt, Human
ucugccacuuuugcuuacuggg

SEQ ID NO: 964681 - RNA, 22 nt, Human
auggccuggccagagcucugcu

SEQ ID NO: 964682 - RNA, 22 nt, Human
ucaggcuggaaugcaguggggc

SEQ ID NO: 964683 - RNA, 19 nt, Human
gggcagaauggcaucucag

SEQ ID NO: 964684 - RNA, 22 nt, Human
aaaucaguuguuauauuaaaga

SEQ ID NO: 964685 - RNA, 22 nt, Human
uagaaaucauuuagaaguauug

SEQ ID NO: 964686 - RNA, 22 nt, Human
ucuaaccuuugaaacugcuuuc

SEQ ID NO: 964687 - RNA, 22 nt, Human
guguguccuugggccucugcag

SEQ ID NO: 964688 - RNA, 22 nt, Human
ucucaguguguuuucucucaga

SEQ ID NO: 964689 - RNA, 22 nt, Human
cagucccaguuugagacucugg

SEQ ID NO: 964690 - RNA, 19 nt, Human
uguguaaagucugugguca

SEQ ID NO: 964691 - RNA, 22 nt, Human
auuagguuagugugcaagagaa

SEQ ID NO: 964692 - RNA, 22 nt, Human
ucugggaguggguccaaggaau

SEQ ID NO: 964693 - RNA, 22 nt, Human
cuucuaggcuucucagggggca

SEQ ID NO: 964694 - RNA, 22 nt, Human
caggcacuagcagaaugaggcu

SEQ ID NO: 964695 - RNA, 22 nt, Human
aaguucuacuguggguaaaaug

SEQ ID NO: 964696 - RNA, 22 nt, Human
ccagcugacgaugccuggucuc

SEQ ID NO: 964697 - RNA, 22 nt, Human
uaaaugcaagugcuccugggag

SEQ ID NO: 964698 - RNA, 22 nt, Human
cauggccugccuccuccuggug

SEQ ID NO: 964699 - RNA, 22 nt, Human
gaggccuggagccgccuaggcg

SEQ ID NO: 964700 - RNA, 22 nt, Human
uucugugaaucuuuuuucccac

SEQ ID NO: 964701 - RNA, 22 nt, Human
uuuggaauuggaaagugcugug

SEQ ID NO: 964702 - RNA, 22 nt, Human
agacaacaccaaaugcuagugu

SEQ ID NO: 964703 - RNA, 19 nt, Human
uugaaagauuagcuuucua

SEQ ID NO: 964704 - RNA, 22 nt, Human
agcagggcagcugaugcgcacg

SEQ ID NO: 964705 - RNA, 22 nt, Human
uuucaucuaacacuacauaggg

SEQ ID NO: 964706 - RNA, 19 nt, Human
cugcucaggucagucuguc

SEQ ID NO: 964707 - RNA, 22 nt, Human
ggcuccuggggaggugagcuug

SEQ ID NO: 964708 - RNA, 22 nt, Human
cuggcaggcagacuucugcaag

SEQ ID NO: 964709 - RNA, 22 nt, Human
gaagcagcuagcccacuaguca

SEQ ID NO: 964710 - RNA, 22 nt, Human
ggagaccagaaggaagcuucga

SEQ ID NO: 964711 - RNA, 22 nt, Human
caucuggcuagcuaucauugug

SEQ ID NO: 964712 - RNA, 22 nt, Human
gcugggaggaauuuggggaaua

SEQ ID NO: 964713 - RNA, 22 nt, Human
ucuuuccaaggacucuguagca

SEQ ID NO: 964714 - RNA, 22 nt, Human
gcagccccaggagacgcccagg

SEQ ID NO: 964715 - RNA, 22 nt, Human
agcugcccuuuaugaugcugaa

SEQ ID NO: 964716 - RNA, 22 nt, Human
auggcucauuuaucuugcagcc

SEQ ID NO: 964717 - RNA, 22 nt, Human
agcagagaagacacaggcuuca

SEQ ID NO: 964718 - RNA, 22 nt, Human
ugaugcugagccugggacugac

SEQ ID NO: 964719 - RNA, 22 nt, Human
gggccagagcuuggcagcuggg

SEQ ID NO: 964720 - RNA, 22 nt, Human
guguguccucaguaguggcaug

SEQ ID NO: 964721 - RNA, 22 nt, Human
ugagagaugaacucugauaugu

SEQ ID NO: 964722 - RNA, 22 nt, Human
uuaagucacuuaucuaaagaca

SEQ ID NO: 964723 - RNA, 22 nt, Human
ugcugcucuguaaagugaugag

SEQ ID NO: 964724 - RNA, 22 nt, Human
auucacaacaaaaggauaugag

SEQ ID NO: 964725 - RNA, 20 nt, Human
aggaagccaaaggcugucuu

SEQ ID NO: 964726 - RNA, 22 nt, Human
ggccagcucugcacagcagcug

SEQ ID NO: 964727 - RNA, 22 nt, Human
ucccuucacagaugcgauguuu

SEQ ID NO: 964728 - RNA, 22 nt, Human
uguacaaugccgagacuaacuc

SEQ ID NO: 964729 - RNA, 22 nt, Human
agaaauguuguggguuuuguua

SEQ ID NO: 964730 - RNA, 22 nt, Human
uccaugagggacacuggaugcu

SEQ ID NO: 964731 - RNA, 22 nt, Human
aagggcugagcacagugagcca

SEQ ID NO: 964732 - RNA, 22 nt, Human
ucaggcagcuccaggaauggua

SEQ ID NO: 964733 - RNA, 22 nt, Human
gagagcuguccggcugagcagc

SEQ ID NO: 964734 - RNA, 22 nt, Human
ugcuuagacgucaaguacagcc

SEQ ID NO: 964735 - RNA, 22 nt, Human
gacagagugcagggcuagaaga

SEQ ID NO: 964736 - RNA, 22 nt, Human
ugcccuguuaucuuggaagagu

SEQ ID NO: 964737 - RNA, 22 nt, Human
gcagagcuucuguccuucagga

SEQ ID NO: 964738 - RNA, 22 nt, Human
uggccuugagagaucaaaaggu

SEQ ID NO: 964739 - RNA, 22 nt, Human
cucacaggagaaagucaugguc

SEQ ID NO: 964740 - RNA, 22 nt, Human
ucagggcaagauugguuaauaa

SEQ ID NO: 964741 - RNA, 22 nt, Human
augauucagcaauuuuauaucu

SEQ ID NO: 964742 - RNA, 22 nt, Human
ucaagugcuugugagguauuug

SEQ ID NO: 964743 - RNA, 22 nt, Human
acagaacugggaaaugcacaua

SEQ ID NO: 964744 - RNA, 21 nt, Human
gcucccuggcugugugaccug

SEQ ID NO: 964745 - RNA, 22 nt, Human
agagacaggguuuugucguguu

SEQ ID NO: 964746 - RNA, 22 nt, Human
uccuuugacuucuugcagucca

SEQ ID NO: 964747 - RNA, 22 nt, Human
cagagccagaacuagaccuugu

SEQ ID NO: 964748 - RNA, 22 nt, Human
cugaaagaauaagauguuuaca

SEQ ID NO: 964749 - RNA, 22 nt, Human
acagcuuuucaauucugcugag

SEQ ID NO: 964750 - RNA, 22 nt, Human
gaguggggucugggcaucaguc

SEQ ID NO: 964751 - RNA, 22 nt, Human
aaccaggacaauuugaauagaa

SEQ ID NO: 964752 - RNA, 22 nt, Human
cagcagcucccauccgcugagc

SEQ ID NO: 964753 - RNA, 22 nt, Human
gcagugggagcuuaggcagugc

SEQ ID NO: 964754 - RNA, 22 nt, Human
ggcucacgcaauuaucccggcc

SEQ ID NO: 964755 - RNA, 22 nt, Human
gauuucaaggaguuuucacagu

SEQ ID NO: 964756 - RNA, 22 nt, Human
cagggccuccccggcagucuuu

SEQ ID NO: 964757 - RNA, 20 nt, Human
agggcagagggauuacaggc

SEQ ID NO: 964758 - RNA, 22 nt, Human
aagagguugucugugaugaguu

SEQ ID NO: 964759 - RNA, 22 nt, Human
gcucucuuuuuccagugguggu

SEQ ID NO: 964760 - RNA, 22 nt, Human
augggggccugaacaggcaaaa

SEQ ID NO: 964761 - RNA, 22 nt, Human
gcucagccgaacuucagagcag

SEQ ID NO: 964762 - RNA, 22 nt, Human
aucuacccacugaacacaauau

SEQ ID NO: 964763 - RNA, 23 nt, Human
gccaggaguggguagacuaaugc

SEQ ID NO: 964764 - RNA, 22 nt, Human
ucacugucugaaagaaauggcc

SEQ ID NO: 964765 - RNA, 22 nt, Human
agcagaggaggauuuaguuagg

SEQ ID NO: 964766 - RNA, 22 nt, Human
acagccagaggugguccugggu

SEQ ID NO: 964767 - RNA, 22 nt, Human
caguuucuucaucaguuaagca

SEQ ID NO: 964768 - RNA, 22 nt, Human
auaugagaauuggaaaauauca

SEQ ID NO: 964769 - RNA, 22 nt, Human
gaggugaguggaucacgagguc

SEQ ID NO: 964770 - RNA, 22 nt, Human
ggcagugaaaaaguauguuucc

SEQ ID NO: 964771 - RNA, 22 nt, Human
gccuggugguauccuggcaaga

SEQ ID NO: 964772 - RNA, 22 nt, Human
uuccaugaaauguguuaugcuu

SEQ ID NO: 964773 - RNA, 22 nt, Human
uaacuccagagaauccauccau

SEQ ID NO: 964774 - RNA, 22 nt, Human
aauguacaaggguuccaguuuu

SEQ ID NO: 964775 - RNA, 22 nt, Human
cucugggcuuguugaccugcac

SEQ ID NO: 964776 - RNA, 22 nt, Human
agggaagugaaugacagauauc

SEQ ID NO: 964777 - RNA, 22 nt, Human
cauuucugauuacagaauacua

SEQ ID NO: 964778 - RNA, 22 nt, Human
ccuccagguguuacauaugacu

SEQ ID NO: 964779 - RNA, 22 nt, Human
agaaauguacgauguuaugcag

SEQ ID NO: 964780 - RNA, 22 nt, Human
cuggugucugcucccucacagc

SEQ ID NO: 964781 - RNA, 21 nt, Human
aggagcuguguuagcuggucg

SEQ ID NO: 964782 - RNA, 22 nt, Human
ugaggccacuuccccacagccc

SEQ ID NO: 964783 - RNA, 22 nt, Human
gucuuucuuaauucaagugcuu

SEQ ID NO: 964784 - RNA, 22 nt, Human
gcugugaguggaggaggcugag

SEQ ID NO: 964785 - RNA, 22 nt, Human
gcccccucuuuggagccagcca

SEQ ID NO: 964786 - RNA, 22 nt, Human
ccuggccugcucggcucuuaag

SEQ ID NO: 964787 - RNA, 22 nt, Human
uuuuucauauuccccucucugg

SEQ ID NO: 964788 - RNA, 22 nt, Human
agugaaauaugcccauugcugu

SEQ ID NO: 964789 - RNA, 19 nt, Human
auuagcaugcuugaggaug

SEQ ID NO: 964790 - RNA, 22 nt, Human
ucauaauacaaagaguucugca

SEQ ID NO: 964791 - RNA, 22 nt, Human
auuaaagugaaguucucagaug

SEQ ID NO: 964792 - RNA, 20 nt, Human
guccaggacccagcaggagg

SEQ ID NO: 964793 - RNA, 22 nt, Human
augcugagacuggagcagcugg

SEQ ID NO: 964794 - RNA, 22 nt, Human
cagaguguugaccauaagccca

SEQ ID NO: 964795 - RNA, 22 nt, Human
gccagcucccaagugagccccu

SEQ ID NO: 964796 - RNA, 22 nt, Human
gccuggugugcgccgcgcagcu

SEQ ID NO: 964797 - RNA, 22 nt, Human
gcaaggcugugcacuuugcauu

SEQ ID NO: 964798 - RNA, 22 nt, Human
cucccaggcacagggaggagcc

SEQ ID NO: 964799 - RNA, 22 nt, Human
aggcagucuaucucuggagccu

SEQ ID NO: 964800 - RNA, 22 nt, Human
uggagucugugaugcucugggu

SEQ ID NO: 964801 - RNA, 22 nt, Human
ucagggcacauucugcaguggc

SEQ ID NO: 964802 - RNA, 22 nt, Human
ucauucagguugggcaaguguc

SEQ ID NO: 964803 - RNA, 22 nt, Human
augaaacacacacgcgcauacu

SEQ ID NO: 964804 - RNA, 22 nt, Human
gcucuccacugaccacggggca

SEQ ID NO: 964805 - RNA, 22 nt, Human
caagagcuagacuuugucagga

SEQ ID NO: 964806 - RNA, 22 nt, Human
agaggccaugcuagaggccugg

SEQ ID NO: 964807 - RNA, 22 nt, Human
auaugaagucagacaaacuggg

SEQ ID NO: 964808 - RNA, 22 nt, Human
agaaguuguagguuugcauauu

SEQ ID NO: 964809 - RNA, 22 nt, Human
ucugaggcuaagagacagaggc

SEQ ID NO: 964810 - RNA, 22 nt, Human
gccaggagcccugggcaaguuc

SEQ ID NO: 964811 - RNA, 22 nt, Human
gcauuucugugcauacacauga

SEQ ID NO: 964812 - RNA, 22 nt, Human
agacaaaggauuaaugaugaug

SEQ ID NO: 964813 - RNA, 22 nt, Human
auguucuguuuuguaauucaua

SEQ ID NO: 964814 - RNA, 22 nt, Human
auaugaaaguaagcaugugugu

SEQ ID NO: 964815 - RNA, 22 nt, Human
gaggcagcagggcugguuccuu

SEQ ID NO: 964816 - RNA, 22 nt, Human
uucuggaguauuccuggcaccu

SEQ ID NO: 964817 - RNA, 22 nt, Human
ccugugugucugucacugcaca

SEQ ID NO: 964818 - RNA, 22 nt, Human
cagagccagcuguccuuggcau

SEQ ID NO: 964819 - RNA, 22 nt, Human
auuaggaaauguguugcaagca

SEQ ID NO: 964820 - RNA, 22 nt, Human
uaaagacaugguguaggugaac

SEQ ID NO: 964821 - RNA, 22 nt, Human
ccugguggccuucagcccacaa

SEQ ID NO: 964822 - RNA, 22 nt, Human
acuguucacccagcacuagcag

SEQ ID NO: 964823 - RNA, 22 nt, Human
cugguucauccccuuccaggaa

SEQ ID NO: 964824 - RNA, 22 nt, Human
gguggggcccuggcacugguau

SEQ ID NO: 964825 - RNA, 22 nt, Human
cugcugugucagaguccagggg

SEQ ID NO: 964826 - RNA, 22 nt, Human
ccuggccauuugaacuucagac

SEQ ID NO: 964827 - RNA, 22 nt, Human
augcaaaugaacauguugcuag

SEQ ID NO: 964828 - RNA, 22 nt, Human
agaagccagcuucagcugcccg

SEQ ID NO: 964829 - RNA, 19 nt, Human
uuugaauccagcugguaac

SEQ ID NO: 964830 - RNA, 20 nt, Human
cuccucaguuccaugggagg

SEQ ID NO: 964831 - RNA, 22 nt, Human
uaacuccacaccccucuuggug

SEQ ID NO: 964832 - RNA, 22 nt, Human
cacccaggcuagagugcagugg

SEQ ID NO: 964833 - RNA, 22 nt, Human
cccaggaauuggaggcugcagu

SEQ ID NO: 964834 - RNA, 22 nt, Human
aagccagggucaggggccuccu

SEQ ID NO: 964835 - RNA, 22 nt, Human
cagcugagcaucacuagucugg

SEQ ID NO: 964836 - RNA, 22 nt, Human
aggcccugcuuuccagagcuca

SEQ ID NO: 964837 - RNA, 22 nt, Human
uuuauuguuaucaugggugagu

SEQ ID NO: 964838 - RNA, 22 nt, Human
gggcaguggcucacgccuguaa

SEQ ID NO: 964839 - RNA, 22 nt, Human
gcuccuggguguggcugccccu

SEQ ID NO: 964840 - RNA, 18 nt, Human
cagggcuguggggucacu

SEQ ID NO: 964841 - RNA, 22 nt, Human
cuugaaucuggcuuugccacuu

SEQ ID NO: 964842 - RNA, 22 nt, Human
cuuucaaugugccugccuuggg

SEQ ID NO: 964843 - RNA, 22 nt, Human
auuaaauuggacgcugggggaa

SEQ ID NO: 964844 - RNA, 22 nt, Human
guggcugcagagccagcaagcu

SEQ ID NO: 964845 - RNA, 22 nt, Human
aagaagaugguuaacuuucagu

SEQ ID NO: 964846 - RNA, 22 nt, Human
cagggccuucguaaguguccgg

SEQ ID NO: 964847 - RNA, 22 nt, Human
gccugagauucccggagccgug

SEQ ID NO: 964848 - RNA, 22 nt, Human
aauuuccagaccccauccacag

SEQ ID NO: 964849 - RNA, 22 nt, Human
cccagcuccaagggacagcgaa

SEQ ID NO: 964850 - RNA, 22 nt, Human
uccuucagcuacucaguuucca

SEQ ID NO: 964851 - RNA, 22 nt, Human
gagggggagaugugcacacacu

SEQ ID NO: 964852 - RNA, 22 nt, Human
ugggggacugcacuggcgucag

SEQ ID NO: 964853 - RNA, 22 nt, Human
gcuggcagcuggaaguugggcu

SEQ ID NO: 964854 - RNA, 22 nt, Human
gggugcugacuggggccugaaa

SEQ ID NO: 964855 - RNA, 22 nt, Human
cagcagcugcgugcccaggccg

SEQ ID NO: 964856 - RNA, 17 nt, Human
ccaggugggaggugggg

SEQ ID NO: 964857 - RNA, 22 nt, Human
aaauucuuucauggcuaauaag

SEQ ID NO: 964858 - RNA, 20 nt, Human
gggcaguggcgcuaucucag

SEQ ID NO: 964859 - RNA, 22 nt, Human
uguggcucucagauccuccaau

SEQ ID NO: 964860 - RNA, 22 nt, Human
uucaggaugcucagaguagucu

SEQ ID NO: 964861 - RNA, 22 nt, Human
uaucuguuaugggcugaauugc

SEQ ID NO: 964862 - RNA, 22 nt, Human
gucucccaaccccugugcccag

SEQ ID NO: 964863 - RNA, 22 nt, Human
gaaagaggaaggagauguauua

SEQ ID NO: 964864 - RNA, 22 nt, Human
ucacugcucagucuguacuaca

SEQ ID NO: 964865 - RNA, 22 nt, Human
uggaguucucaggugagggcuu

SEQ ID NO: 964866 - RNA, 22 nt, Human
caaauauuccagguacaucccu

SEQ ID NO: 964867 - RNA, 22 nt, Human
auaugaagaauuccaauuugga

SEQ ID NO: 964868 - RNA, 22 nt, Human
uggucucugacucugaagaccc

SEQ ID NO: 964869 - RNA, 20 nt, Human
ugggccugagccugugggcu

SEQ ID NO: 964870 - RNA, 22 nt, Human
cuggcuugcagcucaucauaaa

SEQ ID NO: 964871 - RNA, 22 nt, Human
ugaugauguuuaucuugguauu

SEQ ID NO: 964872 - RNA, 18 nt, Human
acauacauucugucugca

SEQ ID NO: 964873 - RNA, 22 nt, Human
gccagcugaagcccugguggaa

SEQ ID NO: 964874 - RNA, 22 nt, Human
aauaguaaaagauacagcuaau

SEQ ID NO: 964875 - RNA, 22 nt, Human
cagagagagucaaaucuuugcu

SEQ ID NO: 964876 - RNA, 22 nt, Human
aagccagccagugccagucuua

SEQ ID NO: 964877 - RNA, 21 nt, Human
ggcagcugaccgcgcggugca

SEQ ID NO: 964878 - RNA, 22 nt, Human
agggagguaggagcuucuagcu

SEQ ID NO: 964879 - RNA, 22 nt, Human
uauccaauucaccauugauggg

SEQ ID NO: 964880 - RNA, 22 nt, Human
ggccugucucacccccgggugc

SEQ ID NO: 964881 - RNA, 22 nt, Human
aucaguuuaacugucaagagcc

SEQ ID NO: 964882 - RNA, 22 nt, Human
gagggagagugauggaccauug

SEQ ID NO: 964883 - RNA, 23 nt, Human
uugcaaauuucaguuaguucaug

SEQ ID NO: 964884 - RNA, 22 nt, Human
uccuuggcagcagggagcauga

SEQ ID NO: 964885 - RNA, 22 nt, Human
uucaggauucugugucugacaa

SEQ ID NO: 964886 - RNA, 22 nt, Human
ugcaugcauaaauguacacaca

SEQ ID NO: 964887 - RNA, 22 nt, Human
cagcugcccaggccaccuggag

SEQ ID NO: 964888 - RNA, 22 nt, Human
gcuccuggcuccaggcagccaa

SEQ ID NO: 964889 - RNA, 22 nt, Human
auaauaaaccaggaugggucug

SEQ ID NO: 964890 - RNA, 22 nt, Human
ugaugaaauguugaggcaguga

SEQ ID NO: 964891 - RNA, 22 nt, Human
auuaucuauguagaaugauuuu

SEQ ID NO: 964892 - RNA, 22 nt, Human
gggcagcagagcccugccgagu

SEQ ID NO: 964893 - RNA, 22 nt, Human
gcucaggagcucuugguggcgc

SEQ ID NO: 964894 - RNA, 20 nt, Human
agcccaggccugugugaguc

SEQ ID NO: 964895 - RNA, 22 nt, Human
auacaugucaucauauguuugu

SEQ ID NO: 964896 - RNA, 22 nt, Human
ccucuucuagguuucagccugc

SEQ ID NO: 964897 - RNA, 22 nt, Human
gggugggguucaggaaucuuca

SEQ ID NO: 964898 - RNA, 22 nt, Human
ucagaacaauugggaaccauua

SEQ ID NO: 964899 - RNA, 22 nt, Human
caggccuggcccccggcacacc

SEQ ID NO: 964900 - RNA, 20 nt, Human
cagcaggaaaagugccucag

SEQ ID NO: 964901 - RNA, 22 nt, Human
uaaagaacacagggaauagcac

SEQ ID NO: 964902 - RNA, 18 nt, Human
ucuuggcagcaucuggca

SEQ ID NO: 964903 - RNA, 22 nt, Human
agcagggcaaagucaggcuaac

SEQ ID NO: 964904 - RNA, 18 nt, Human
cagcugccagcucaugga

SEQ ID NO: 964905 - RNA, 23 nt, Human
agccagggcacugguggagauug

SEQ ID NO: 964906 - RNA, 22 nt, Human
uaaagcacauaucuuacaauaa

SEQ ID NO: 964907 - RNA, 22 nt, Human
ggcccagccggcgagucucgcg

SEQ ID NO: 964908 - RNA, 22 nt, Human
auuguuuuguuucccagugacu

SEQ ID NO: 964909 - RNA, 22 nt, Human
ccugggaagagcugacaggagg

SEQ ID NO: 964910 - RNA, 22 nt, Human
cugccugugugugccugcagaa

SEQ ID NO: 964911 - RNA, 22 nt, Human
agagaagacuuacagccacagu

SEQ ID NO: 964912 - RNA, 22 nt, Human
ugauuucauaguauauacauga

SEQ ID NO: 964913 - RNA, 19 nt, Human
agcagcuggagguggagug

SEQ ID NO: 964914 - RNA, 22 nt, Human
cuaauuuuuguucugcauugaa

SEQ ID NO: 964915 - RNA, 22 nt, Human
ggcaggguggcccuccagugag

SEQ ID NO: 964916 - RNA, 22 nt, Human
gguggccugcccugaucccugg

SEQ ID NO: 964917 - RNA, 22 nt, Human
uugaaaacuuucuagaccaaga

SEQ ID NO: 964918 - RNA, 22 nt, Human
ggccagcuuugagcugcaggaa

SEQ ID NO: 964919 - RNA, 22 nt, Human
gggcuucucuuuagugagcuga

SEQ ID NO: 964920 - RNA, 22 nt, Human
gauuaggacauggauguauguu

SEQ ID NO: 964921 - RNA, 22 nt, Human
cuacauuuugugauuaugaaau

SEQ ID NO: 964922 - RNA, 22 nt, Human
caggccugucugcacaugaggc

SEQ ID NO: 964923 - RNA, 22 nt, Human
ggauaagaaaauuguaauaacu

SEQ ID NO: 964924 - RNA, 22 nt, Human
uacacuuuuuacuacagauucu

SEQ ID NO: 964925 - RNA, 22 nt, Human
gggcucucaugaguguguggua

SEQ ID NO: 964926 - RNA, 22 nt, Human
cucucugguuucagcgaagggg

SEQ ID NO: 964927 - RNA, 19 nt, Human
gggaaauucacuugcuucc

SEQ ID NO: 964928 - RNA, 22 nt, Human
cagcccuguccagcagagggug

SEQ ID NO: 964929 - RNA, 22 nt, Human
augggaggcaggcucagaaccg

SEQ ID NO: 964930 - RNA, 22 nt, Human
aaaauucugucauuaaauugug

SEQ ID NO: 964931 - RNA, 22 nt, Human
aggaugagaagauuggaaucuu

SEQ ID NO: 964932 - RNA, 17 nt, Human
ugcauguccuuuguucc

SEQ ID NO: 964933 - RNA, 20 nt, Human
agaagcugauacugauggaa

SEQ ID NO: 964934 - RNA, 22 nt, Human
ugagcccaggaguaugaggcug

SEQ ID NO: 964935 - RNA, 22 nt, Human
uccagggaccucccugagagcu

SEQ ID NO: 964936 - RNA, 21 nt, Human
acagcaagccuucacaugagu

SEQ ID NO: 964937 - RNA, 22 nt, Human
gccugguggugugcucaagugg

SEQ ID NO: 964938 - RNA, 22 nt, Human
aucuuucagagcuccaucaggg

SEQ ID NO: 964939 - RNA, 22 nt, Human
uggccugguccuugucaaggca

SEQ ID NO: 964940 - RNA, 22 nt, Human
gugcccaggcccaaggcaccac

SEQ ID NO: 964941 - RNA, 22 nt, Human
gcugagugauugauauuuuagu

SEQ ID NO: 964942 - RNA, 22 nt, Human
gaggagguuccggguggagaag

SEQ ID NO: 964943 - RNA, 18 nt, Human
gggaagaggaucuggccc

SEQ ID NO: 964944 - RNA, 22 nt, Human
ucuccugugcacccucccugug

SEQ ID NO: 964945 - RNA, 22 nt, Human
ccuggccucuccgaguaaccug

SEQ ID NO: 964946 - RNA, 22 nt, Human
uaaguucauaagcuuauucuua

SEQ ID NO: 964947 - RNA, 22 nt, Human
agccacagcccacaggacucuu

SEQ ID NO: 964948 - RNA, 19 nt, Human
aggcugcaagguggugggc

SEQ ID NO: 964949 - RNA, 20 nt, Human
gagggcaggcacccauuuca

SEQ ID NO: 964950 - RNA, 22 nt, Human
uccugggcgguuaugugaucug

SEQ ID NO: 964951 - RNA, 22 nt, Human
aagugagugguaaggagcaugg

SEQ ID NO: 964952 - RNA, 22 nt, Human
accuggcaugaagcaugccuua

SEQ ID NO: 964953 - RNA, 22 nt, Human
uaugagcuuccaguguugcaug

SEQ ID NO: 964954 - RNA, 22 nt, Human
uggcucagauuuuuguaggcuu

SEQ ID NO: 964955 - RNA, 22 nt, Human
cugucuccagggcaggugcagg

SEQ ID NO: 964956 - RNA, 22 nt, Human
cuggagcugucuucacaggccu

SEQ ID NO: 964957 - RNA, 22 nt, Human
aggaguggugcaggaccugcca

SEQ ID NO: 964958 - RNA, 18 nt, Human
agcagagcccaugcauuc

SEQ ID NO: 964959 - RNA, 22 nt, Human
gcccaggaaaugccccguggug

SEQ ID NO: 964960 - RNA, 20 nt, Human
agggcagcuugaggagccgg

SEQ ID NO: 964961 - RNA, 22 nt, Human
uagggaggaggguuuucaaauc

SEQ ID NO: 964962 - RNA, 22 nt, Human
auccaaaccuggacaugagugg

SEQ ID NO: 964963 - RNA, 22 nt, Human
aaagaacaauguggaaucuccu

SEQ ID NO: 964964 - RNA, 22 nt, Human
guuuccauggcucuguuaaugg

SEQ ID NO: 964965 - RNA, 22 nt, Human
ccugggcauaaaucacuccaag

SEQ ID NO: 964966 - RNA, 22 nt, Human
uucaccuugaauaugucuuaaa

SEQ ID NO: 964967 - RNA, 22 nt, Human
cagaggcagacccuccagggcg

SEQ ID NO: 964968 - RNA, 22 nt, Human
aggcaguggaugucaggaaugg

SEQ ID NO: 964969 - RNA, 22 nt, Human
ucuguuuugcauaauguucuuu

SEQ ID NO: 964970 - RNA, 22 nt, Human
cugggcagugguggcccuuccc

SEQ ID NO: 964971 - RNA, 22 nt, Human
uggggagugaugccucggauaa

SEQ ID NO: 964972 - RNA, 22 nt, Human
uuccuguauuuugcgaauuuuc

SEQ ID NO: 964973 - RNA, 21 nt, Human
aucacauuggcuguuauuauu

SEQ ID NO: 964974 - RNA, 22 nt, Human
aggcucuguuauucuagagggc

SEQ ID NO: 964975 - RNA, 22 nt, Human
cuucaagauccauagauauugc

SEQ ID NO: 964976 - RNA, 22 nt, Human
gccuucccacccugcgaggcug

SEQ ID NO: 964977 - RNA, 22 nt, Human
ucaggagacuuaugucacagug

SEQ ID NO: 964978 - RNA, 22 nt, Human
gauggcagcauauugacagcau

SEQ ID NO: 964979 - RNA, 23 nt, Human
cagggccaggcagcagcugucac

SEQ ID NO: 964980 - RNA, 22 nt, Human
gcccagcacagcuggaagaguc

SEQ ID NO: 964981 - RNA, 22 nt, Human
agaggcugucccuugcuauucc

SEQ ID NO: 964982 - RNA, 22 nt, Human
cugggggcaauggucagagugu

SEQ ID NO: 964983 - RNA, 20 nt, Human
ggggcccaagcccucuugcc

SEQ ID NO: 964984 - RNA, 22 nt, Human
gcauggcagccaguacauggug

SEQ ID NO: 964985 - RNA, 22 nt, Human
uucaaaggcaggauagcagcug

SEQ ID NO: 964986 - RNA, 22 nt, Human
aggcagaggagaaugaucuucc

SEQ ID NO: 964987 - RNA, 22 nt, Human
aagggcuggaucucucugagca

SEQ ID NO: 964988 - RNA, 22 nt, Human
ggcuggaaguccaagaucaaga

SEQ ID NO: 964989 - RNA, 22 nt, Human
uauggcauuuuguaagggcuug

SEQ ID NO: 964990 - RNA, 22 nt, Human
uggccucugggaaagcagauuc

SEQ ID NO: 964991 - RNA, 22 nt, Human
cauggcagagccugcagguggg

SEQ ID NO: 964992 - RNA, 22 nt, Human
uggcacaugguaagugcuuaac

SEQ ID NO: 964993 - RNA, 22 nt, Human
cuguaugguccacgugggugcc

SEQ ID NO: 964994 - RNA, 22 nt, Human
gugagcaggauuucauggugua

SEQ ID NO: 964995 - RNA, 20 nt, Human
gcacugaagguuccagggga

SEQ ID NO: 964996 - RNA, 16 nt, Human
ggagagugucugcaaa

SEQ ID NO: 964997 - RNA, 22 nt, Human
ggacagcccauacacaugucug

SEQ ID NO: 964998 - RNA, 21 nt, Human
uauaguguggauaugcugaug

SEQ ID NO: 964999 - RNA, 22 nt, Human
ugugugccagccuacgaggagc

SEQ ID NO: 965000 - RNA, 20 nt, Human
auuccauaguuggcacuuuu

SEQ ID NO: 965001 - RNA, 22 nt, Human
ucugcaggcuguacaggaagca

SEQ ID NO: 965002 - RNA, 22 nt, Human
acacuugauaggucaaaucagu

SEQ ID NO: 965003 - RNA, 22 nt, Human
aggugcagcugacaccaugugg

SEQ ID NO: 965004 - RNA, 22 nt, Human
cagccagggagggcaaaugaga

SEQ ID NO: 965005 - RNA, 22 nt, Human
uuugaaaacuuaauuuggucgu

SEQ ID NO: 965006 - RNA, 22 nt, Human
cugggagcuggaaugggagaag

SEQ ID NO: 965007 - RNA, 22 nt, Human
agcagaugagccucaugacugg

SEQ ID NO: 965008 - RNA, 22 nt, Human
guggcagcggugugcaaggagg

SEQ ID NO: 965009 - RNA, 22 nt, Human
gcugcccacaaugauuacaugg

SEQ ID NO: 965010 - RNA, 22 nt, Human
uacugcauaacuggcauguggg

SEQ ID NO: 965011 - RNA, 22 nt, Human
aaccauuugcaguuacugagac

SEQ ID NO: 965012 - RNA, 22 nt, Human
cucugaacucuugggcagcaug

SEQ ID NO: 965013 - RNA, 22 nt, Human
ccucauggccuugagcugaggg

SEQ ID NO: 965014 - RNA, 22 nt, Human
uauuuguauuucaugcaguaaa

SEQ ID NO: 965015 - RNA, 22 nt, Human
uggcucugagacacaggcucuc

SEQ ID NO: 965016 - RNA, 22 nt, Human
ucagcagucacauguuguccca

SEQ ID NO: 965017 - RNA, 19 nt, Human
cuugcugggugguuucugc

SEQ ID NO: 965018 - RNA, 22 nt, Human
cugucuccuccacugcauggga

SEQ ID NO: 965019 - RNA, 22 nt, Human
gagagcuggccagcuucaguau

SEQ ID NO: 965020 - RNA, 22 nt, Human
aggcacugacaauucuggacug

SEQ ID NO: 965021 - RNA, 22 nt, Human
gcaggcagguggcaucuuguga

SEQ ID NO: 965022 - RNA, 20 nt, Human
auguuuuauaaaagaacggg

SEQ ID NO: 965023 - RNA, 22 nt, Human
ucagauggguuuugaaggaugu

SEQ ID NO: 965024 - RNA, 22 nt, Human
ccaggagcaggagcuggacaga

SEQ ID NO: 965025 - RNA, 22 nt, Human
ggccugcucaguccucuuucuu

SEQ ID NO: 965026 - RNA, 22 nt, Human
ggauuugggcuugcagcagagc

SEQ ID NO: 965027 - RNA, 22 nt, Human
ucucaggaauagaguggcagca

SEQ ID NO: 965028 - RNA, 22 nt, Human
uuuuggcacugcgucuacaugg

SEQ ID NO: 965029 - RNA, 22 nt, Human
gccucugcucggacuuugccuc

SEQ ID NO: 965030 - RNA, 23 nt, Human
ucugcucugaaguucggcugagc

SEQ ID NO: 965031 - RNA, 22 nt, Human
gcucaggacuggaggagcgggg

SEQ ID NO: 965032 - RNA, 22 nt, Human
acaggugggcuuaagagucggc

SEQ ID NO: 965033 - RNA, 22 nt, Human
gucaggauuuacaaacuucagu

SEQ ID NO: 965034 - RNA, 22 nt, Human
acagggcagguggcuacugguc

SEQ ID NO: 965035 - RNA, 22 nt, Human
accucugccacuuucuaacucu

SEQ ID NO: 965036 - RNA, 22 nt, Human
cucccucugucuuguccagaaa

SEQ ID NO: 965037 - RNA, 22 nt, Human
cacauguuuggcaugucaccaa

SEQ ID NO: 965038 - RNA, 22 nt, Human
aaaaaugcuuggacuuaauaaa

SEQ ID NO: 965039 - RNA, 22 nt, Human
cucugcuuuuuaaaaggagucc

SEQ ID NO: 965040 - RNA, 20 nt, Human
aggccaaacccagcgcgccc

SEQ ID NO: 965041 - RNA, 22 nt, Human
ucauuucuccgaccugcugucc

SEQ ID NO: 965042 - RNA, 22 nt, Human
cugccuggccugaucuccacgc

SEQ ID NO: 965043 - RNA, 22 nt, Human
gcucuguccagcgugcacagaa

SEQ ID NO: 965044 - RNA, 22 nt, Human
auuuccuuugcaaagacugugc

SEQ ID NO: 965045 - RNA, 20 nt, Human
uuuuccagaaaguaucauug

SEQ ID NO: 965046 - RNA, 22 nt, Human
cagggugggcacccagccucca

SEQ ID NO: 965047 - RNA, 22 nt, Human
gaagccaguacugugcucugca

SEQ ID NO: 965048 - RNA, 22 nt, Human
cucaugucuucacccauucuaa

SEQ ID NO: 965049 - RNA, 22 nt, Human
caggugaccuuuguccuaaguu

SEQ ID NO: 965050 - RNA, 22 nt, Human
acagaauuaaugaaaauuacaa

SEQ ID NO: 965051 - RNA, 22 nt, Human
acagagaugcaaguguguauuu

SEQ ID NO: 965052 - RNA, 22 nt, Human
agguaggguuaauggagauaua

SEQ ID NO: 965053 - RNA, 22 nt, Human
ucagcaaugugauacugugcaa

SEQ ID NO: 965054 - RNA, 22 nt, Human
agcagaacauuuucagggcugu

SEQ ID NO: 965055 - RNA, 22 nt, Human
ccagagucuuuauauuccugaa

SEQ ID NO: 965056 - RNA, 20 nt, Human
acugagcugcauggagagga

SEQ ID NO: 965057 - RNA, 22 nt, Human
ccugccugcuuucugcuuugca

SEQ ID NO: 965058 - RNA, 22 nt, Human
agcagcuguggaaaaguaacua

SEQ ID NO: 965059 - RNA, 22 nt, Human
uugaaucauuacaauagauaag

SEQ ID NO: 965060 - RNA, 22 nt, Human
ggcagacaccuuuaugucuaau

SEQ ID NO: 965061 - RNA, 22 nt, Human
cagcccaggccgacaguuccuc

SEQ ID NO: 965062 - RNA, 22 nt, Human
acugaaggcuuucccaagguca

SEQ ID NO: 965063 - RNA, 22 nt, Human
gagaagcaauuuccaacugugc

SEQ ID NO: 965064 - RNA, 22 nt, Human
ccaggcucaggugcgagagaca

SEQ ID NO: 965065 - RNA, 22 nt, Human
gagacugauggggcucccagaa

SEQ ID NO: 965066 - RNA, 22 nt, Human
ccuggcuguggcggugcucuca

SEQ ID NO: 965067 - RNA, 22 nt, Human
cagcugccccuccagggcuggg

SEQ ID NO: 965068 - RNA, 22 nt, Human
aucaguuuauacuuauaaaucu

SEQ ID NO: 965069 - RNA, 22 nt, Human
aauaauuagugggacagagaac

SEQ ID NO: 965070 - RNA, 22 nt, Human
aggccaaauguguauaaaacau

SEQ ID NO: 965071 - RNA, 22 nt, Human
ucucucagggggaaggcugaag

SEQ ID NO: 965072 - RNA, 22 nt, Human
gaaauauucuugucuuguuuuc

SEQ ID NO: 965073 - RNA, 22 nt, Human
uggccuggaaaaaugcagaugg

SEQ ID NO: 965074 - RNA, 22 nt, Human
aacauuucagcaccugauuccu

SEQ ID NO: 965075 - RNA, 22 nt, Human
ugggagcccaagggagcugccg

SEQ ID NO: 965076 - RNA, 22 nt, Human
gggaggugauggcaagcagcgg

SEQ ID NO: 965077 - RNA, 22 nt, Human
uggugagcucuggcagucugug

SEQ ID NO: 965078 - RNA, 22 nt, Human
agagugaagguugacacuucac

SEQ ID NO: 965079 - RNA, 22 nt, Human
ggccacaagugguccugagucc

SEQ ID NO: 965080 - RNA, 22 nt, Human
guuauauaagacaaaucagagu

SEQ ID NO: 965081 - RNA, 17 nt, Human
uuccaguuuaguauugu

SEQ ID NO: 965082 - RNA, 22 nt, Human
uuaaagggccgauuuccaggcc

SEQ ID NO: 965083 - RNA, 22 nt, Human
gaacagcuucuugggagcuggg

SEQ ID NO: 965084 - RNA, 22 nt, Human
uggcaacauggacaggucugcc

SEQ ID NO: 965085 - RNA, 22 nt, Human
gucaucuugcuguuuuagaucu

SEQ ID NO: 965086 - RNA, 21 nt, Human
aaugugugcuauuuaucuuuu

SEQ ID NO: 965087 - RNA, 22 nt, Human
gcucaggaucagccaccucuuu

SEQ ID NO: 965088 - RNA, 22 nt, Human
ugauuuccaguugcugggugcu

SEQ ID NO: 965089 - RNA, 22 nt, Human
ccagagcuccagggcuacagaa

SEQ ID NO: 965090 - RNA, 22 nt, Human
agaugauggccauguccucucc

SEQ ID NO: 965091 - RNA, 22 nt, Human
agcugaaggcuagaacagcugg

SEQ ID NO: 965092 - RNA, 16 nt, Human
gccuggaguggcaggg

SEQ ID NO: 965093 - RNA, 22 nt, Human
acuguucacagauuagucgaug

SEQ ID NO: 965094 - RNA, 22 nt, Human
gcuccacuugcagcuaggcuug

SEQ ID NO: 965095 - RNA, 22 nt, Human
ucuuugcaacucccauuuccau

SEQ ID NO: 965096 - RNA, 19 nt, Human
gaguuauugccagggcaug

SEQ ID NO: 965097 - RNA, 22 nt, Human
ucagaacagaagaaggaacacg

SEQ ID NO: 965098 - RNA, 22 nt, Human
auuaggacagagaugucaagag

SEQ ID NO: 965099 - RNA, 22 nt, Human
gccugggugucgaucacuagug

SEQ ID NO: 965100 - RNA, 21 nt, Human
uccaggagcacgggacuagga

SEQ ID NO: 965101 - RNA, 22 nt, Human
gcagcagaguuugggagauggu

SEQ ID NO: 965102 - RNA, 22 nt, Human
ugggagcaccuugagggcagaa

SEQ ID NO: 965103 - RNA, 22 nt, Human
ugcuccuuccucauccugugca

SEQ ID NO: 965104 - RNA, 22 nt, Human
gccuggcacauugcaguggauu

SEQ ID NO: 965105 - RNA, 22 nt, Human
ccuggccagggucugggcugcu

SEQ ID NO: 965106 - RNA, 20 nt, Human
acaaaugcauucugugacau

SEQ ID NO: 965107 - RNA, 22 nt, Human
ugucacauguguggcauuuuuc

SEQ ID NO: 965108 - RNA, 20 nt, Human
acugccuugguucaguaggu

SEQ ID NO: 965109 - RNA, 22 nt, Human
gagaaagcuucuuucccacagg

SEQ ID NO: 965110 - RNA, 22 nt, Human
gcucucuugguggcuguccugg

SEQ ID NO: 965111 - RNA, 22 nt, Human
auauguuuuuggaaagaacaca

SEQ ID NO: 965112 - RNA, 22 nt, Human
guuugcauguauuaagucaaua

SEQ ID NO: 965113 - RNA, 22 nt, Human
cagggcucaucugugugaccag

SEQ ID NO: 965114 - RNA, 22 nt, Human
uugacaauguccuuugaauuuc

SEQ ID NO: 965115 - RNA, 22 nt, Human
caaagccucugauuucacuugu

SEQ ID NO: 965116 - RNA, 21 nt, Human
ugagccaggcugacggcugug

SEQ ID NO: 965117 - RNA, 19 nt, Human
gcuuuggagggagguucua

SEQ ID NO: 965118 - RNA, 22 nt, Human
gcuggccuucugcagaguucug

SEQ ID NO: 965119 - RNA, 18 nt, Human
cagagcagagguggagcg

SEQ ID NO: 965120 - RNA, 22 nt, Human
gagccagguuggaggcugcagu

SEQ ID NO: 965121 - RNA, 22 nt, Human
uggcagggccugaaucuuauac

SEQ ID NO: 965122 - RNA, 22 nt, Human
ugcugcacucaccaacagauaa

SEQ ID NO: 965123 - RNA, 22 nt, Human
uggaagggggaagacagcucug

SEQ ID NO: 965124 - RNA, 22 nt, Human
ugucucagggcagcagcagggg

SEQ ID NO: 965125 - RNA, 22 nt, Human
uaguaucuauuaguaacaagag

SEQ ID NO: 965126 - RNA, 22 nt, Human
auguguguacacacgugacucu

SEQ ID NO: 965127 - RNA, 22 nt, Human
cuuguucaguugccucuccugc

SEQ ID NO: 965128 - RNA, 22 nt, Human
uucuaaacuucaauucuaaauu

SEQ ID NO: 965129 - RNA, 22 nt, Human
auugaaagagaauguagcucuu

SEQ ID NO: 965130 - RNA, 22 nt, Human
gauuucuugauaauucaaaucc

SEQ ID NO: 965131 - RNA, 22 nt, Human
uguggccaccagagcugcuauu

SEQ ID NO: 965132 - RNA, 21 nt, Human
ugggacagugauggcuccucc

SEQ ID NO: 965133 - RNA, 22 nt, Human
ucucaggagccacagcgggagu

SEQ ID NO: 965134 - RNA, 22 nt, Human
aucuggcucuuccuggaguucc

SEQ ID NO: 965135 - RNA, 22 nt, Human
agaguggggaagguguugagaa

SEQ ID NO: 965136 - RNA, 22 nt, Human
cuuggcagcuuuuggaggagcc

SEQ ID NO: 965137 - RNA, 22 nt, Human
gaagcagcugccagagaugucu

SEQ ID NO: 965138 - RNA, 22 nt, Human
gcaguggauccaaugguaucuu

SEQ ID NO: 965139 - RNA, 22 nt, Human
augggagccaucgcauuugcug

SEQ ID NO: 965140 - RNA, 22 nt, Human
uccugggcugcagggaagagca

SEQ ID NO: 965141 - RNA, 22 nt, Human
aggguggagggagucccugagc

SEQ ID NO: 965142 - RNA, 22 nt, Human
gccaccagguuagauccagccu

SEQ ID NO: 965143 - RNA, 22 nt, Human
uuuggaauauuaaaaugucuca

SEQ ID NO: 965144 - RNA, 22 nt, Human
gcagggacaacugugcaccuga

SEQ ID NO: 965145 - RNA, 23 nt, Human
aggauguaggauguauggcagag

SEQ ID NO: 965146 - RNA, 21 nt, Human
accucaagcaacaaccaaggu

SEQ ID NO: 965147 - RNA, 22 nt, Human
ugcauugcauuugucaugaaga

SEQ ID NO: 965148 - RNA, 19 nt, Human
cccaggagcaguauugaug

SEQ ID NO: 965149 - RNA, 22 nt, Human
aggccagaugucgggcuagaag

SEQ ID NO: 965150 - RNA, 22 nt, Human
ggcucugcugguaagaugccuc

SEQ ID NO: 965151 - RNA, 22 nt, Human
uguuuuaagggucaacugucac

SEQ ID NO: 965152 - RNA, 22 nt, Human
uuuccuaggagauugaucacau

SEQ ID NO: 965153 - RNA, 22 nt, Human
gucaaguuaagauaaggucaug

SEQ ID NO: 965154 - RNA, 22 nt, Human
aggccagcaagaaagagagucu

SEQ ID NO: 965155 - RNA, 22 nt, Human
aaaggaagaugccaggacucug

SEQ ID NO: 965156 - RNA, 22 nt, Human
uaaaaguauacuuucaaaggag

SEQ ID NO: 965157 - RNA, 22 nt, Human
aggaaaaagaguugcugccuuc

SEQ ID NO: 965158 - RNA, 22 nt, Human
cagggccaaguuggugccuuuu

SEQ ID NO: 965159 - RNA, 22 nt, Human
uacaacauuguguugcuucaua

SEQ ID NO: 965160 - RNA, 22 nt, Human
agaaguuaccacauacuucucu

SEQ ID NO: 965161 - RNA, 22 nt, Human
cccaugagguggagguugcagu

SEQ ID NO: 965162 - RNA, 22 nt, Human
cagcuagcuaagaaggccagag

SEQ ID NO: 965163 - RNA, 22 nt, Human
uuugucagucaugucugcuuuu

SEQ ID NO: 965164 - RNA, 22 nt, Human
ggagccaggggaccuucacaga

SEQ ID NO: 965165 - RNA, 22 nt, Human
cucuggccuggggccugcuccc

SEQ ID NO: 965166 - RNA, 22 nt, Human
uguuggcaucucugagagaguu

SEQ ID NO: 965167 - RNA, 22 nt, Human
uccucugcucagcauuccucac

SEQ ID NO: 965168 - RNA, 20 nt, Human
uugauaggcagcuugucagg

SEQ ID NO: 965169 - RNA, 21 nt, Human
cccaggagaagaaaagaugca

SEQ ID NO: 965170 - RNA, 22 nt, Human
gugccuggcacacagaaggcaa

SEQ ID NO: 965171 - RNA, 22 nt, Human
ggcucagggaaugaggaagaau

SEQ ID NO: 965172 - RNA, 22 nt, Human
uagaaaagaauuuuauuugaua

SEQ ID NO: 965173 - RNA, 22 nt, Human
agccagugcaacagcagugaag

SEQ ID NO: 965174 - RNA, 22 nt, Human
gcugucuguucgagcguguguu

SEQ ID NO: 965175 - RNA, 22 nt, Human
aacuuuguguguuuaauauggc

SEQ ID NO: 965176 - RNA, 22 nt, Human
ugcaggaaauuccaggguggcc

SEQ ID NO: 965177 - RNA, 22 nt, Human
uuuauaaguacuuugucugcuu

SEQ ID NO: 965178 - RNA, 22 nt, Human
cuucuccucugaguccugggag

SEQ ID NO: 965179 - RNA, 22 nt, Human
aaaucugggagcagcucggcca

SEQ ID NO: 965180 - RNA, 21 nt, Human
uuugaauagaaauagugcuua

SEQ ID NO: 965181 - RNA, 22 nt, Human
acagaggaaggcugagcugccc

SEQ ID NO: 965182 - RNA, 22 nt, Human
aaucuucacagagaaaauuagg

SEQ ID NO: 965183 - RNA, 22 nt, Human
ugcucugugguccaagauggcu

SEQ ID NO: 965184 - RNA, 21 nt, Human
uuagaaagcucacuacaguua

SEQ ID NO: 965185 - RNA, 22 nt, Human
ccagggcaugggaagaacugaa

SEQ ID NO: 965186 - RNA, 22 nt, Human
augcaccugaacuccaucagcu

SEQ ID NO: 965187 - RNA, 19 nt, Human
ugcucaggccaaggagccc

SEQ ID NO: 965188 - RNA, 22 nt, Human
uccaugaguuugaggaaaagag

SEQ ID NO: 965189 - RNA, 22 nt, Human
ugagaggccccagcucuuggcc

SEQ ID NO: 965190 - RNA, 22 nt, Human
auaugaaaauguuuuagcugua

SEQ ID NO: 965191 - RNA, 22 nt, Human
aggcugggaaaccugaaguugu

SEQ ID NO: 965192 - RNA, 22 nt, Human
acacuucuauucccugcacaaa

SEQ ID NO: 965193 - RNA, 22 nt, Human
ugccaggggaccuagggauguc

SEQ ID NO: 965194 - RNA, 22 nt, Human
cugagccaaggggacagugaca

SEQ ID NO: 965195 - RNA, 22 nt, Human
cagccagcugaauguaccauga

SEQ ID NO: 965196 - RNA, 22 nt, Human
augcccugaggaaugucacgcu

SEQ ID NO: 965197 - RNA, 22 nt, Human
gccuugggauucuuggaugcuc

SEQ ID NO: 965198 - RNA, 22 nt, Human
ccagggcagggaccacgugucu

SEQ ID NO: 965199 - RNA, 22 nt, Human
ucauaacagcuaagucccuuuc

SEQ ID NO: 965200 - RNA, 22 nt, Human
agccaggaaugcaugcucugcu

SEQ ID NO: 965201 - RNA, 22 nt, Human
agccuggagaggcgccauacac

SEQ ID NO: 965202 - RNA, 22 nt, Human
auucagaaauagaaaauuugau

SEQ ID NO: 965203 - RNA, 22 nt, Human
uucacagacauugcagacugaa

SEQ ID NO: 965204 - RNA, 22 nt, Human
gaaaugugaccuacuuccuugu

SEQ ID NO: 965205 - RNA, 22 nt, Human
uuuuaacuuaaaauacauagau

SEQ ID NO: 965206 - RNA, 22 nt, Human
acagcauucaauaaauaauaac

SEQ ID NO: 965207 - RNA, 22 nt, Human
cugagggucaacuugauuguau

SEQ ID NO: 965208 - RNA, 22 nt, Human
ggggaugguagaccggugacgu

SEQ ID NO: 965209 - RNA, 22 nt, Human
ugccagcacuucuggcugucug

SEQ ID NO: 965210 - RNA, 22 nt, Human
aaaugugcuucuuacucucaau

SEQ ID NO: 965211 - RNA, 22 nt, Human
uugaaaguagcagcugcauaug

SEQ ID NO: 965212 - RNA, 22 nt, Human
uccuugaagaaugauucuugga

SEQ ID NO: 965213 - RNA, 22 nt, Human
uaugcacacauuagcacagggu

SEQ ID NO: 965214 - RNA, 22 nt, Human
gagcucuguguagccugagggu

SEQ ID NO: 965215 - RNA, 22 nt, Human
ucuccucaccaccagcagcaga

SEQ ID NO: 965216 - RNA, 22 nt, Human
aaacacuucaaggacuucuguc

SEQ ID NO: 965217 - RNA, 22 nt, Human
agacaggaugcauacucuuggu

SEQ ID NO: 965218 - RNA, 22 nt, Human
gcuggccugggcagccugucgg

SEQ ID NO: 965219 - RNA, 22 nt, Human
ugaggcagcaauugauuauuca

SEQ ID NO: 965220 - RNA, 22 nt, Human
gccugagcaggcguggaccaug

SEQ ID NO: 965221 - RNA, 22 nt, Human
gcucccugaaaagaacaaaguc

SEQ ID NO: 965222 - RNA, 22 nt, Human
agagccaggcaggcaauguuga

SEQ ID NO: 965223 - RNA, 22 nt, Human
acuccugggugcauuucugauu

SEQ ID NO: 965224 - RNA, 22 nt, Human
ugaaggccagcucuuuaucagc

SEQ ID NO: 965225 - RNA, 22 nt, Human
agaggccggccgagcccauggg

SEQ ID NO: 965226 - RNA, 22 nt, Human
ugacacagaaauuaagcuguca

SEQ ID NO: 965227 - RNA, 18 nt, Human
caggucagccuggccuca

SEQ ID NO: 965228 - RNA, 22 nt, Human
ugcugggggugucucaccaggc

SEQ ID NO: 965229 - RNA, 22 nt, Human
ccagagccagagaggugccugc

SEQ ID NO: 965230 - RNA, 22 nt, Human
ucuguaucacccguucccagaa

SEQ ID NO: 965231 - RNA, 17 nt, Human
gccaggagguuugagcu

SEQ ID NO: 965232 - RNA, 22 nt, Human
uggucaaaagaaagcucagaac

SEQ ID NO: 965233 - RNA, 22 nt, Human
agacagggucuugaucagagcu

SEQ ID NO: 965234 - RNA, 22 nt, Human
ggcacgugccuaaggagcaggc

SEQ ID NO: 965235 - RNA, 22 nt, Human
acagugucaugucguguucccc

SEQ ID NO: 965236 - RNA, 22 nt, Human
cagcugagucugagguucuuug

SEQ ID NO: 965237 - RNA, 22 nt, Human
cccagcacuuugaauaugucac

SEQ ID NO: 965238 - RNA, 22 nt, Human
aggguaggaacugaguggaagg

SEQ ID NO: 965239 - RNA, 22 nt, Human
cugguccuugacgcgugggagg

SEQ ID NO: 965240 - RNA, 22 nt, Human
uacagaaaaacuggcauugaag

SEQ ID NO: 965241 - RNA, 22 nt, Human
uuaguuuucccaucuuuauggu

SEQ ID NO: 965242 - RNA, 22 nt, Human
agcugagcauuugauccaccuc

SEQ ID NO: 965243 - RNA, 22 nt, Human
agcccuccucacaucagcgucc

SEQ ID NO: 965244 - RNA, 22 nt, Human
gagcucauccccaugguccguc

SEQ ID NO: 965245 - RNA, 22 nt, Human
caucagcacuaugauuaaagua

SEQ ID NO: 965246 - RNA, 22 nt, Human
aaagccuuggucaucugguucc

SEQ ID NO: 965247 - RNA, 19 nt, Human
uaucuguuuccugcuuguc

SEQ ID NO: 965248 - RNA, 22 nt, Human
uggcucugccacuaacuuggua

SEQ ID NO: 965249 - RNA, 22 nt, Human
aggcugcuucagcugcagggag

SEQ ID NO: 965250 - RNA, 22 nt, Human
gguggccaggccagcucuggcc

SEQ ID NO: 965251 - RNA, 22 nt, Human
augcugagugagugaaacccag

SEQ ID NO: 965252 - RNA, 22 nt, Human
gcagcuggagccagccagacac

SEQ ID NO: 965253 - RNA, 22 nt, Human
caggccugagacaucugagaua

SEQ ID NO: 965254 - RNA, 22 nt, Human
aagagggcugcaaucuuauugc

SEQ ID NO: 965255 - RNA, 22 nt, Human
ugugcccauuccacuugaguac

SEQ ID NO: 965256 - RNA, 22 nt, Human
aacuccagggcauugucuccug

SEQ ID NO: 965257 - RNA, 22 nt, Human
cagagcagaagcgguccucaca

SEQ ID NO: 965258 - RNA, 22 nt, Human
ccccaggacguggcccucauag

SEQ ID NO: 965259 - RNA, 22 nt, Human
acuuucuauggcuuauuaugag

SEQ ID NO: 965260 - RNA, 22 nt, Human
gcugguaggaagugcuccugcc

SEQ ID NO: 965261 - RNA, 22 nt, Human
aggggugugcauccuggaggau

SEQ ID NO: 965262 - RNA, 22 nt, Human
uauuccagguauucuucaagag

SEQ ID NO: 965263 - RNA, 22 nt, Human
auuauuaggugcucucugacaa

SEQ ID NO: 965264 - RNA, 22 nt, Human
gaugggggccagggccugcuuu

SEQ ID NO: 965265 - RNA, 22 nt, Human
gaccaaggaagaggggagccag

SEQ ID NO: 965266 - RNA, 22 nt, Human
agcaccugucacaagcagaagg

SEQ ID NO: 965267 - RNA, 20 nt, Human
gagauggcuaagugcugaac

SEQ ID NO: 965268 - RNA, 22 nt, Human
gcuguccagagcaugggagcaa

SEQ ID NO: 965269 - RNA, 22 nt, Human
ucacaucucccuggaggacaca

SEQ ID NO: 965270 - RNA, 22 nt, Human
aagggagguaaagcuauuuaaa

SEQ ID NO: 965271 - RNA, 22 nt, Human
gagggagggccaggucccaacc

SEQ ID NO: 965272 - RNA, 22 nt, Human
agugaaaugauaguguaaauac

SEQ ID NO: 965273 - RNA, 19 nt, Human
ugaaauggcaguugcuaaa

SEQ ID NO: 965274 - RNA, 22 nt, Human
uguggaaaagaauaagggagau

SEQ ID NO: 965275 - RNA, 20 nt, Human
cuggcaggagcgagucuacc

SEQ ID NO: 965276 - RNA, 22 nt, Human
uccuggccaggaugaccuaaca

SEQ ID NO: 965277 - RNA, 22 nt, Human
aaguggacuaauacaaggacua

SEQ ID NO: 965278 - RNA, 22 nt, Human
caggcacugugccucgcucccu

SEQ ID NO: 965279 - RNA, 20 nt, Human
uggucuggagccagugagga

SEQ ID NO: 965280 - RNA, 22 nt, Human
cagcacugcuucgcagccaggg

SEQ ID NO: 965281 - RNA, 20 nt, Human
aggagaaauucgggacaccu

SEQ ID NO: 965282 - RNA, 22 nt, Human
gguggccuuucaguggaucagg

SEQ ID NO: 965283 - RNA, 21 nt, Human
aguucauacugaguaacaaaa

SEQ ID NO: 965284 - RNA, 22 nt, Human
uauccaggaggaacucauuuug

SEQ ID NO: 965285 - RNA, 17 nt, Human
ugguggcuggagucagg

SEQ ID NO: 965286 - RNA, 22 nt, Human
agccuucaaccuagcuagagca

SEQ ID NO: 965287 - RNA, 22 nt, Human
ccucuggggugagugggccacu

SEQ ID NO: 965288 - RNA, 22 nt, Human
ccuggcagacagcacugaagcu

SEQ ID NO: 965289 - RNA, 22 nt, Human
aaaacucugcaguuaguuucua

SEQ ID NO: 965290 - RNA, 22 nt, Human
cugccagucuaugcugcucggc

SEQ ID NO: 965291 - RNA, 22 nt, Human
aauaauuuugagagccuggaaa

SEQ ID NO: 965292 - RNA, 22 nt, Human
ucagaagcaaacaucacucuag

SEQ ID NO: 965293 - RNA, 22 nt, Human
ucagggaaugaugcacacaguu

SEQ ID NO: 965294 - RNA, 22 nt, Human
aaaguuugagugauuugacaca

SEQ ID NO: 965295 - RNA, 22 nt, Human
ugaggggagguuggggcacauc

SEQ ID NO: 965296 - RNA, 21 nt, Human
gggaaugagauucuuggagau

SEQ ID NO: 965297 - RNA, 21 nt, Human
ccaggcagagcugugaguucu

SEQ ID NO: 965298 - RNA, 22 nt, Human
uagggauguggugagaacugag

SEQ ID NO: 965299 - RNA, 22 nt, Human
cacugugggguuuggcuggaac

SEQ ID NO: 965300 - RNA, 23 nt, Human
ugggcaucuccucugugccaggc

SEQ ID NO: 965301 - RNA, 23 nt, Human
aagcuuccuucacgucuccuggg

SEQ ID NO: 965302 - RNA, 22 nt, Human
guccagggaaauagcgacaggg

SEQ ID NO: 965303 - RNA, 18 nt, Human
caggagcaggaguugaac

SEQ ID NO: 965304 - RNA, 22 nt, Human
gggcaugguggugcacaccugu

SEQ ID NO: 965305 - RNA, 22 nt, Human
uccacugcagcuucugauggaa

SEQ ID NO: 965306 - RNA, 22 nt, Human
gagcaguagaguacauggcucc

SEQ ID NO: 965307 - RNA, 22 nt, Human
ccugcagcuccggauuucuggg

SEQ ID NO: 965308 - RNA, 22 nt, Human
gucaggaucucccaguacauau

SEQ ID NO: 965309 - RNA, 20 nt, Human
cugcugugugugccucagcc

SEQ ID NO: 965310 - RNA, 22 nt, Human
aggucaaaccacagcucuaggc

SEQ ID NO: 965311 - RNA, 22 nt, Human
ccuggugcuuaccagagcuuuu

SEQ ID NO: 965312 - RNA, 20 nt, Human
aauaaaagaagccuucaccc

SEQ ID NO: 965313 - RNA, 22 nt, Human
acauguaaaaggaacaugcaug

SEQ ID NO: 965314 - RNA, 22 nt, Human
acaaaguuugugguauuccaag

SEQ ID NO: 965315 - RNA, 22 nt, Human
uuucauuaguaugacagcacgc

SEQ ID NO: 965316 - RNA, 22 nt, Human
aauguguauaugaacauacagg

SEQ ID NO: 965317 - RNA, 22 nt, Human
guuguuuuuguucucuauagcu

SEQ ID NO: 965318 - RNA, 22 nt, Human
ucuugggaucaccuccuggcuu

SEQ ID NO: 965319 - RNA, 23 nt, Human
uuugaaguugacugccuuccaga

SEQ ID NO: 965320 - RNA, 22 nt, Human
cucuuucugauucgcugggacc

SEQ ID NO: 965321 - RNA, 22 nt, Human
augcacuacuagaugcaaaagu

SEQ ID NO: 965322 - RNA, 22 nt, Human
agugccaggagcaaggagcucc

SEQ ID NO: 965323 - RNA, 22 nt, Human
acacaugcugauaagaauauaa

SEQ ID NO: 965324 - RNA, 21 nt, Human
ugcagagauaucugaagcaga

SEQ ID NO: 965325 - RNA, 22 nt, Human
ccuucugcuggucaucccagug

SEQ ID NO: 965326 - RNA, 21 nt, Human
ugccaggccugagcugggguc

SEQ ID NO: 965327 - RNA, 22 nt, Human
cacauggggcgcugcauuggcc

SEQ ID NO: 965328 - RNA, 22 nt, Human
uauucacaaaaugagguccuca

SEQ ID NO: 965329 - RNA, 22 nt, Human
gcuggagcugcagccugggccu

SEQ ID NO: 965330 - RNA, 22 nt, Human
ccuucauugcaucuuuaagaga

SEQ ID NO: 965331 - RNA, 22 nt, Human
uuaugcuaguauaguccuuaga

SEQ ID NO: 965332 - RNA, 23 nt, Human
uugcuucugugcaauucaguacu

SEQ ID NO: 965333 - RNA, 22 nt, Human
ucauuuguucucauucucuacu

SEQ ID NO: 965334 - RNA, 22 nt, Human
uuccuguaguugugcaauguac

SEQ ID NO: 965335 - RNA, 18 nt, Human
gggcaagcggcugucacc

SEQ ID NO: 965336 - RNA, 22 nt, Human
uuugaagucagacacugcuuug

SEQ ID NO: 965337 - RNA, 22 nt, Human
aagaauuauugcaauacuagau

SEQ ID NO: 965338 - RNA, 22 nt, Human
ccaaagucuggagcagcagagc

SEQ ID NO: 965339 - RNA, 22 nt, Human
ucauuuguaccauuuuuuaaga

SEQ ID NO: 965340 - RNA, 23 nt, Human
cuugcagggcuggaggcuuagaa

SEQ ID NO: 965341 - RNA, 22 nt, Human
uccucagaugcucuuggacgcc

SEQ ID NO: 965342 - RNA, 22 nt, Human
uuacaaaguucugaguucaaac

SEQ ID NO: 965343 - RNA, 22 nt, Human
cguguacagucuaucuuuuuuc

SEQ ID NO: 965344 - RNA, 22 nt, Human
agccuccuggaguuucugggau

SEQ ID NO: 965345 - RNA, 22 nt, Human
gagcgauguggguauguagaag

SEQ ID NO: 965346 - RNA, 22 nt, Human
acugccugcauccuuaggguag

SEQ ID NO: 965347 - RNA, 22 nt, Human
uucuucuccgaggagggcuggu

SEQ ID NO: 965348 - RNA, 22 nt, Human
gauuucuugauaaguaguguga

SEQ ID NO: 965349 - RNA, 22 nt, Human
uaaagugcuggauuugaguaaa

SEQ ID NO: 965350 - RNA, 19 nt, Human
gcucugcuacuauuaccac

SEQ ID NO: 965351 - RNA, 22 nt, Human
gccagagcagaauagaguggcc

SEQ ID NO: 965352 - RNA, 22 nt, Human
ucaccagucuuucuuaccauug

SEQ ID NO: 965353 - RNA, 22 nt, Human
ucccaggacuuccaguuggagg

SEQ ID NO: 965354 - RNA, 22 nt, Human
agcugcucuuugaaggacacuu

SEQ ID NO: 965355 - RNA, 22 nt, Human
gcucagagaugucugcugccuu

SEQ ID NO: 965356 - RNA, 19 nt, Human
ggaugagggucaggcauag

SEQ ID NO: 965357 - RNA, 22 nt, Human
ggucagggggaucugugaggua

SEQ ID NO: 965358 - RNA, 22 nt, Human
gcaggagaacaaagcaagcugc

SEQ ID NO: 965359 - RNA, 22 nt, Human
ugaagcaggaaacuucuuguuu

SEQ ID NO: 965360 - RNA, 22 nt, Human
agccuggauccauguggcuacc

SEQ ID NO: 965361 - RNA, 22 nt, Human
aguauuuccuggcuuaucugcu

SEQ ID NO: 965362 - RNA, 22 nt, Human
gccuucugauaucucuuggcau

SEQ ID NO: 965363 - RNA, 22 nt, Human
aaaggcuccuucucccaugacc

SEQ ID NO: 965364 - RNA, 22 nt, Human
augcugagcagagcugacaugc

SEQ ID NO: 965365 - RNA, 22 nt, Human
cagggccaagccccuuuggcug

SEQ ID NO: 965366 - RNA, 22 nt, Human
ucucagagugguggucccucug

SEQ ID NO: 965367 - RNA, 22 nt, Human
uuuccucuccggggccuccagg

SEQ ID NO: 965368 - RNA, 22 nt, Human
ucaaaccaccuuguuacugggg

SEQ ID NO: 965369 - RNA, 22 nt, Human
uucuucuuaauguccugggaac

SEQ ID NO: 965370 - RNA, 22 nt, Human
agaggagguccuuuucugaugu

SEQ ID NO: 965371 - RNA, 22 nt, Human
cccuggcagaaugucucugggc

SEQ ID NO: 965372 - RNA, 22 nt, Human
ccuugggacagccagcuucaga

SEQ ID NO: 965373 - RNA, 22 nt, Human
cccaggaggcagagguugcagu

SEQ ID NO: 965374 - RNA, 22 nt, Human
uggcuggcaaggcuggagucag

SEQ ID NO: 965375 - RNA, 22 nt, Human
acugaaggucucagcaaggaug

SEQ ID NO: 965376 - RNA, 21 nt, Human
uucaauacuauuucaauaguc

SEQ ID NO: 965377 - RNA, 22 nt, Human
cagcugcaguucaaugcuugcu

SEQ ID NO: 965378 - RNA, 22 nt, Human
uauguuauuuucauacaacaga

SEQ ID NO: 965379 - RNA, 22 nt, Human
ugagggaggcccuuugagcaga

SEQ ID NO: 965380 - RNA, 19 nt, Human
cuugguuaugguaugaugc

SEQ ID NO: 965381 - RNA, 21 nt, Human
auacuuugaauuacagccuug

SEQ ID NO: 965382 - RNA, 22 nt, Human
ucagguggcuucggggaguggc

SEQ ID NO: 965383 - RNA, 22 nt, Human
uguuucuaggucaauaauuuuu

SEQ ID NO: 965384 - RNA, 17 nt, Human
gauuuccugaaguucuu

SEQ ID NO: 965385 - RNA, 17 nt, Human
cccagagaugcugccuu

SEQ ID NO: 965386 - RNA, 22 nt, Human
gaggcagcgggucaggaccgug

SEQ ID NO: 965387 - RNA, 22 nt, Human
cagacuggccacaucugcacug

SEQ ID NO: 965388 - RNA, 22 nt, Human
acacugaauaauugagaguuga

SEQ ID NO: 965389 - RNA, 19 nt, Human
ugucucugaaagaugagcu

SEQ ID NO: 965390 - RNA, 22 nt, Human
cugcucugugguccaugagaca

SEQ ID NO: 965391 - RNA, 22 nt, Human
aauguacaauaagacaaagagg

SEQ ID NO: 965392 - RNA, 22 nt, Human
ccagagcugcauccagcagguu

SEQ ID NO: 965393 - RNA, 22 nt, Human
aggggugaaagagggcccucaa

SEQ ID NO: 965394 - RNA, 22 nt, Human
ggcaggcugggugucauggagu

SEQ ID NO: 965395 - RNA, 19 nt, Human
caugagcugcucacuuccc

SEQ ID NO: 965396 - RNA, 22 nt, Human
acaucucaugaaugauaaauca

SEQ ID NO: 965397 - RNA, 22 nt, Human
ugagccaggaguuugaggcugu

SEQ ID NO: 965398 - RNA, 22 nt, Human
aaaguuugaaugauauauuagu

SEQ ID NO: 965399 - RNA, 22 nt, Human
agugauggagcuuccucugcua

SEQ ID NO: 965400 - RNA, 22 nt, Human
uuucaaagucaauaucauuacc

SEQ ID NO: 965401 - RNA, 22 nt, Human
agcaccuucacaggcucucagg

SEQ ID NO: 965402 - RNA, 22 nt, Human
ucugccugagggagcugaggaa

SEQ ID NO: 965403 - RNA, 20 nt, Human
agccugccagcuggcccaga

SEQ ID NO: 965404 - RNA, 22 nt, Human
uccaagggaaugugggcaaugc

SEQ ID NO: 965405 - RNA, 22 nt, Human
gagcagggccacuucuguaccu

SEQ ID NO: 965406 - RNA, 22 nt, Human
aaccuuuugcaagugccuugac

SEQ ID NO: 965407 - RNA, 22 nt, Human
uuggcugaagguuaagugcugg

SEQ ID NO: 965408 - RNA, 22 nt, Human
uagccuucucaagacaaaguug

SEQ ID NO: 965409 - RNA, 22 nt, Human
uuaaagagucuacugcacaucc

SEQ ID NO: 965410 - RNA, 22 nt, Human
caguucucuuuccacuggaggc

SEQ ID NO: 965411 - RNA, 22 nt, Human
ucuggcuccacuuucuucauuu

SEQ ID NO: 965412 - RNA, 22 nt, Human
cagaaccaggaacugauggaga

SEQ ID NO: 965413 - RNA, 22 nt, Human
uucucuuuucaccaguugcuaa

SEQ ID NO: 965414 - RNA, 22 nt, Human
aucaguuuuguucacuacuaua

SEQ ID NO: 965415 - RNA, 22 nt, Human
ugcuuggccuacuuguccuuug

SEQ ID NO: 965416 - RNA, 22 nt, Human
gauuucuacuugaacuugcuaa

SEQ ID NO: 965417 - RNA, 22 nt, Human
acuguguggaaauuugugaggg

SEQ ID NO: 965418 - RNA, 22 nt, Human
auuauuagacuuauaugguagu

SEQ ID NO: 965419 - RNA, 22 nt, Human
gagaggccaccugacgagcagu

SEQ ID NO: 965420 - RNA, 22 nt, Human
gaaucauagaacauuaauagaa

SEQ ID NO: 965421 - RNA, 22 nt, Human
accugggagucacaccugagaa

SEQ ID NO: 965422 - RNA, 19 nt, Human
uggaggcaagacauggagg

SEQ ID NO: 965423 - RNA, 20 nt, Human
gcugcucuccacggucugca

SEQ ID NO: 965424 - RNA, 21 nt, Human
agagaagggacucuuccaguc

SEQ ID NO: 965425 - RNA, 22 nt, Human
gcuggggucugugaggagggcu

SEQ ID NO: 965426 - RNA, 22 nt, Human
agcuaggaaauugaggcugaga

SEQ ID NO: 965427 - RNA, 22 nt, Human
guaucuuuuacaccaggaaauu

SEQ ID NO: 965428 - RNA, 22 nt, Human
auccuugaacuuagacacuagg

SEQ ID NO: 965429 - RNA, 22 nt, Human
uuuugaaagggugauuuggcuu

SEQ ID NO: 965430 - RNA, 22 nt, Human
aaaauguguuuaugcauuucgu

SEQ ID NO: 965431 - RNA, 22 nt, Human
cuucucagaucucagcuuugag

SEQ ID NO: 965432 - RNA, 22 nt, Human
aggcagcguagcaaggcuagua

SEQ ID NO: 965433 - RNA, 20 nt, Human
ucccuggaggugguggcauc

SEQ ID NO: 965434 - RNA, 22 nt, Human
gugcuucucuucacacccaacu

SEQ ID NO: 965435 - RNA, 22 nt, Human
ugagcugggcugggcugagcug

SEQ ID NO: 965436 - RNA, 22 nt, Human
ugcugucugauucagggugauu

SEQ ID NO: 965437 - RNA, 17 nt, Human
uccuucagugccucugc

SEQ ID NO: 965438 - RNA, 22 nt, Human
uuucugcugugcuuucuugcgu

SEQ ID NO: 965439 - RNA, 22 nt, Human
aaaaaguauuggccaugguuga

SEQ ID NO: 965440 - RNA, 22 nt, Human
cgcugccaggauccccugccgg

SEQ ID NO: 965441 - RNA, 22 nt, Human
gcuggagauaguaggauccaua

SEQ ID NO: 965442 - RNA, 22 nt, Human
cagugccucuuaagugucaccc

SEQ ID NO: 965443 - RNA, 22 nt, Human
acuccuggguucuaaauuugaa

SEQ ID NO: 965444 - RNA, 22 nt, Human
uggcucagaacuacuucuaguu

SEQ ID NO: 965445 - RNA, 22 nt, Human
aauuuagaauucgcuagcuaau

SEQ ID NO: 965446 - RNA, 22 nt, Human
cagagccacuuggagaugagaa

SEQ ID NO: 965447 - RNA, 22 nt, Human
aggccuggcuuugguuugcuga

SEQ ID NO: 965448 - RNA, 22 nt, Human
aacucagcauccugcacagaga

SEQ ID NO: 965449 - RNA, 22 nt, Human
ccuuccuggagcccaugcagau

SEQ ID NO: 965450 - RNA, 22 nt, Human
guuugcauaucugugaaaugga

SEQ ID NO: 965451 - RNA, 22 nt, Human
uucacagggcagcagcugagcc

SEQ ID NO: 965452 - RNA, 22 nt, Human
ggccaaaucuguaaggcaagau

SEQ ID NO: 965453 - RNA, 22 nt, Human
ugcagaccucccauggcugccu

SEQ ID NO: 965454 - RNA, 18 nt, Human
ggcagggaaaagauaggg

SEQ ID NO: 965455 - RNA, 22 nt, Human
uacaguagaauuuuuaguaacu

SEQ ID NO: 965456 - RNA, 22 nt, Human
caaauacuaaacauaagauuuu

SEQ ID NO: 965457 - RNA, 22 nt, Human
aaagcaguauauugguaguugu

SEQ ID NO: 965458 - RNA, 21 nt, Human
agggagcuauuuauaguaagc

SEQ ID NO: 965459 - RNA, 22 nt, Human
aggcaucugaguuugcaagcuu

SEQ ID NO: 965460 - RNA, 22 nt, Human
caggaggaggugagguagaacu

SEQ ID NO: 965461 - RNA, 22 nt, Human
agggcagccugagugcuggccc

SEQ ID NO: 965462 - RNA, 22 nt, Human
uauguacaguccuuaacuuaaa

SEQ ID NO: 965463 - RNA, 22 nt, Human
agagauaugcugccuaaauuua

SEQ ID NO: 965464 - RNA, 22 nt, Human
aaggcagagggcuggaucagag

SEQ ID NO: 965465 - RNA, 22 nt, Human
agcucuggaauaaugaugugau

SEQ ID NO: 965466 - RNA, 22 nt, Human
aagaugcagcuuccacuuuugc

SEQ ID NO: 965467 - RNA, 22 nt, Human
gaagcacauggcuauagcuauu

SEQ ID NO: 965468 - RNA, 22 nt, Human
aggcccugagaaaaucccugca

SEQ ID NO: 965469 - RNA, 22 nt, Human
agcagcaacuuauuuuucuuau

SEQ ID NO: 965470 - RNA, 22 nt, Human
gugcuuccaucuagagggucac

SEQ ID NO: 965471 - RNA, 22 nt, Human
uguguuugggggagaugcauuu

SEQ ID NO: 965472 - RNA, 22 nt, Human
ugaagcagauggucuggucauu

SEQ ID NO: 965473 - RNA, 17 nt, Human
ccaggagagaugcuugu

SEQ ID NO: 965474 - RNA, 22 nt, Human
uggcugccuuucaccucaucuc

SEQ ID NO: 965475 - RNA, 22 nt, Human
uugcaaaagccgaggcacucca

SEQ ID NO: 965476 - RNA, 22 nt, Human
agacgagggccuggcacacagu

SEQ ID NO: 965477 - RNA, 22 nt, Human
ggugccaggcucccagcucagg

SEQ ID NO: 965478 - RNA, 22 nt, Human
ucauuucaaugauacuacuaag

SEQ ID NO: 965479 - RNA, 22 nt, Human
uucacauuagugguucuauaua

SEQ ID NO: 965480 - RNA, 22 nt, Human
ugggagagugcucaaugugcaa

SEQ ID NO: 965481 - RNA, 22 nt, Human
acauuugugcacaugugcaugg

SEQ ID NO: 965482 - RNA, 22 nt, Human
aggcccugcaggaagcaggaug

SEQ ID NO: 965483 - RNA, 22 nt, Human
cugugucuucugcuuacagucu

SEQ ID NO: 965484 - RNA, 22 nt, Human
ggcaccuggagguuuacuggau

SEQ ID NO: 965485 - RNA, 22 nt, Human
augauguuauuuucagaaacau

SEQ ID NO: 965486 - RNA, 22 nt, Human
uuugaaauuaagauauugucca

SEQ ID NO: 965487 - RNA, 22 nt, Human
ccugucugaaggcagggggaug

SEQ ID NO: 965488 - RNA, 22 nt, Human
acacucuguaaugucacacucc

SEQ ID NO: 965489 - RNA, 22 nt, Human
ucagcuggagaugagaaccgaa

SEQ ID NO: 965490 - RNA, 22 nt, Human
uucuuccucagcagggcugccu

SEQ ID NO: 965491 - RNA, 22 nt, Human
cagagccaaaugcugugguuau

SEQ ID NO: 965492 - RNA, 22 nt, Human
auuguaucuugucauuaugcau

SEQ ID NO: 965493 - RNA, 22 nt, Human
acauuucucagggaguuuugcu

SEQ ID NO: 965494 - RNA, 22 nt, Human
acuugcauuauauuuaucacaa

SEQ ID NO: 965495 - RNA, 22 nt, Human
cuggcaguguccagcucgugau

SEQ ID NO: 965496 - RNA, 21 nt, Human
uguuguuuuauggcuaugaau

SEQ ID NO: 965497 - RNA, 22 nt, Human
uacaaaguuuucuuggauugag

SEQ ID NO: 965498 - RNA, 22 nt, Human
gcagggcucaacaggacacccc

SEQ ID NO: 965499 - RNA, 22 nt, Human
aggagggugauccgggcugguc

SEQ ID NO: 965500 - RNA, 22 nt, Human
uuucaaagacagccauauuugu

SEQ ID NO: 965501 - RNA, 22 nt, Human
cugcagagaauuguggggcuuc

SEQ ID NO: 965502 - RNA, 22 nt, Human
ucuugccucuuccccuuuccau

SEQ ID NO: 965503 - RNA, 22 nt, Human
uuggcagugucacuagggagcc

SEQ ID NO: 965504 - RNA, 22 nt, Human
ucagucucaucaacucuauucc

SEQ ID NO: 965505 - RNA, 19 nt, Human
auuucaagagguuuauugg

SEQ ID NO: 965506 - RNA, 22 nt, Human
agaauaugaggaaacugugaau

SEQ ID NO: 965507 - RNA, 22 nt, Human
cuuccucugcggcgccgggcgc

SEQ ID NO: 965508 - RNA, 22 nt, Human
gccuggcugagguggggaggca

SEQ ID NO: 965509 - RNA, 22 nt, Human
auuaaggaauguaggcaagaag

SEQ ID NO: 965510 - RNA, 22 nt, Human
uaaaugaaaggguuuaauuuau

SEQ ID NO: 965511 - RNA, 22 nt, Human
gagcuucccucugcagucccug

SEQ ID NO: 965512 - RNA, 22 nt, Human
cuggccugaggccgccuucaga

SEQ ID NO: 965513 - RNA, 22 nt, Human
ggcugggcugcugggucagagc

SEQ ID NO: 965514 - RNA, 22 nt, Human
aguuuuaugcaguguucugaua

SEQ ID NO: 965515 - RNA, 22 nt, Human
cagcuggcguggagugauugca

SEQ ID NO: 965516 - RNA, 22 nt, Human
agcugcuguccuaggcacugua

SEQ ID NO: 965517 - RNA, 22 nt, Human
cagucuucuaaccuagcagccu

SEQ ID NO: 965518 - RNA, 22 nt, Human
cagacuugacggcagcugcuuu

SEQ ID NO: 965519 - RNA, 22 nt, Human
cagcuggcuccaccucugggcu

SEQ ID NO: 965520 - RNA, 22 nt, Human
ucucugcuaagauugugucuag

SEQ ID NO: 965521 - RNA, 22 nt, Human
cuuaacagagagaaguguugcu

SEQ ID NO: 965522 - RNA, 18 nt, Human
auguauguacauauuuau

SEQ ID NO: 965523 - RNA, 22 nt, Human
gaagagcugacagugucauccu

SEQ ID NO: 965524 - RNA, 22 nt, Human
ccucugagagaaggccuucagc

SEQ ID NO: 965525 - RNA, 22 nt, Human
gcucaggacccaggugugaccu

SEQ ID NO: 965526 - RNA, 22 nt, Human
auucuucauacagacaaguccu

SEQ ID NO: 965527 - RNA, 22 nt, Human
ucuccucuauuucuguauguau

SEQ ID NO: 965528 - RNA, 22 nt, Human
ugcugccagagagacagggacu

SEQ ID NO: 965529 - RNA, 20 nt, Human
uccugcaguuccuaggaggg

SEQ ID NO: 965530 - RNA, 19 nt, Human
aauccaggauaagccccuu

SEQ ID NO: 965531 - RNA, 22 nt, Human
cagagaccccuggcaugguggu

SEQ ID NO: 965532 - RNA, 22 nt, Human
gcauucaucuuccuccaugcag

SEQ ID NO: 965533 - RNA, 22 nt, Human
gcagggcuauuggaaggagaug

SEQ ID NO: 965534 - RNA, 22 nt, Human
auuaggcaauucugggcaucuc

SEQ ID NO: 965535 - RNA, 22 nt, Human
ugggacugcucuugcugggguc

SEQ ID NO: 965536 - RNA, 22 nt, Human
ccacagaggacaacugccuggc

SEQ ID NO: 965537 - RNA, 22 nt, Human
ucccaggauguuggcggcaggu

SEQ ID NO: 965538 - RNA, 22 nt, Human
uaaaucagggagucaucugcga

SEQ ID NO: 965539 - RNA, 22 nt, Human
gcucuauguugaccuucagugg

SEQ ID NO: 965540 - RNA, 22 nt, Human
ugggggagccuucacaguagcu

SEQ ID NO: 965541 - RNA, 22 nt, Human
guacauuucauuuaaaugaugu

SEQ ID NO: 965542 - RNA, 21 nt, Human
ccugggagaauuggguguggc

SEQ ID NO: 965543 - RNA, 22 nt, Human
cucacagaugcugugggucagg

SEQ ID NO: 965544 - RNA, 22 nt, Human
cauuaaguauuucaguuacugu

SEQ ID NO: 965545 - RNA, 22 nt, Human
uugugucuggauuucagcuuuc

SEQ ID NO: 965546 - RNA, 22 nt, Human
gaagucuucauucucucugaga

SEQ ID NO: 965547 - RNA, 22 nt, Human
gaugguuuaugauagaugggaa

SEQ ID NO: 965548 - RNA, 22 nt, Human
agggcacaucugcugggaaugg

SEQ ID NO: 965549 - RNA, 23 nt, Human
aaaguugauuugcaguuuaagag

SEQ ID NO: 965550 - RNA, 22 nt, Human
uggagccaggagccugggaguc

SEQ ID NO: 965551 - RNA, 22 nt, Human
ugcauggaggaagaugaaugca

SEQ ID NO: 965552 - RNA, 22 nt, Human
auucuucagaauaucuggcacu

SEQ ID NO: 965553 - RNA, 22 nt, Human
guggcaggagacuggaagaugg

SEQ ID NO: 965554 - RNA, 22 nt, Human
cccugggcagucugcacuucag

SEQ ID NO: 965555 - RNA, 22 nt, Human
ucaaugauaucagcaggaugug

SEQ ID NO: 965556 - RNA, 22 nt, Human
ugcagaaggccugacauugcac

SEQ ID NO: 965557 - RNA, 22 nt, Human
ggcagcugagcauggcuaccuu

SEQ ID NO: 965558 - RNA, 22 nt, Human
ggaggggauuuaguagaugcua

SEQ ID NO: 965559 - RNA, 20 nt, Human
ucugcccaccccggcuccca

SEQ ID NO: 965560 - RNA, 22 nt, Human
aguggggaagagcaugggcccu

SEQ ID NO: 965561 - RNA, 21 nt, Human
gcauggcaggucacuggggca

SEQ ID NO: 965562 - RNA, 22 nt, Human
agcaggaguuugaugcuuuuau

SEQ ID NO: 965563 - RNA, 22 nt, Human
uuuauuuauccuucuggauugc

SEQ ID NO: 965564 - RNA, 22 nt, Human
aacaaauggaacacaaaucuuu

SEQ ID NO: 965565 - RNA, 22 nt, Human
uaauaauuggcuaacccuggga

SEQ ID NO: 965566 - RNA, 22 nt, Human
accacaggacccaugagucagu

SEQ ID NO: 965567 - RNA, 20 nt, Human
agucucuguagugccugaga

SEQ ID NO: 965568 - RNA, 22 nt, Human
acaggagaauuaucuggaacaa

SEQ ID NO: 965569 - RNA, 22 nt, Human
uacccaggagaaacagcagggc

SEQ ID NO: 965570 - RNA, 22 nt, Human
ugggacaggaugaccagaaggu

SEQ ID NO: 965571 - RNA, 20 nt, Human
agaggcuuccuugggaggag

SEQ ID NO: 965572 - RNA, 22 nt, Human
auuuguaacacgugacagguug

SEQ ID NO: 965573 - RNA, 22 nt, Human
aggggaugauccucccgcagcg

SEQ ID NO: 965574 - RNA, 22 nt, Human
agucagugaaggcauugcucaa

SEQ ID NO: 965575 - RNA, 22 nt, Human
ccuguggcucucuuuggagguc

SEQ ID NO: 965576 - RNA, 22 nt, Human
gcuagaaaucgacuucagaauu

SEQ ID NO: 965577 - RNA, 22 nt, Human
ccugcaggggagagacuucuag

SEQ ID NO: 965578 - RNA, 22 nt, Human
uuuggaaugguaccuucaguug

SEQ ID NO: 965579 - RNA, 22 nt, Human
cucugggcaaguuucuucauga

SEQ ID NO: 965580 - RNA, 19 nt, Human
gagaggccugugcuugaag

SEQ ID NO: 965581 - RNA, 22 nt, Human
cucugugccucaguuuucuucu

SEQ ID NO: 965582 - RNA, 22 nt, Human
agauggggcucaguguggaggc

SEQ ID NO: 965583 - RNA, 22 nt, Human
ucugagcuggagcccaucaccu

SEQ ID NO: 965584 - RNA, 22 nt, Human
ggcuucccagcagagggcgcac

SEQ ID NO: 965585 - RNA, 22 nt, Human
ccacagagacagagcccagggu

SEQ ID NO: 965586 - RNA, 22 nt, Human
uaggcaggugugcacugcccac

SEQ ID NO: 965587 - RNA, 22 nt, Human
ugcauuaucuuuaauguucuca

SEQ ID NO: 965588 - RNA, 22 nt, Human
aaaugcacagaaaggaugugga

SEQ ID NO: 965589 - RNA, 22 nt, Human
ugagcuuacgugggaacagacu

SEQ ID NO: 965590 - RNA, 23 nt, Human
aggauccugguacaggagcagag

SEQ ID NO: 965591 - RNA, 22 nt, Human
ccugggcuugcaucugugcugg

SEQ ID NO: 965592 - RNA, 22 nt, Human
uguuuauuacaguucuuggaau

SEQ ID NO: 965593 - RNA, 22 nt, Human
auuuguagugaagugaaaauaa

SEQ ID NO: 965594 - RNA, 22 nt, Human
gggcagcuagcccucuagccca

SEQ ID NO: 965595 - RNA, 22 nt, Human
cgaggcagaggcugaaacggcu

SEQ ID NO: 965596 - RNA, 22 nt, Human
uugaagcaugguacuuguucaa

SEQ ID NO: 965597 - RNA, 22 nt, Human
aggcugccucgugagcucgcug

SEQ ID NO: 965598 - RNA, 22 nt, Human
aaguucaagagugacauauuag

SEQ ID NO: 965599 - RNA, 22 nt, Human
ucucaggguuuguacaagugua

SEQ ID NO: 965600 - RNA, 22 nt, Human
aacauacagugagcaguggacu

SEQ ID NO: 965601 - RNA, 22 nt, Human
guaucacuuuugagagugagaa

SEQ ID NO: 965602 - RNA, 22 nt, Human
cagggagggacaauugucaccu

SEQ ID NO: 965603 - RNA, 22 nt, Human
cugccuccuggcugauggguag

SEQ ID NO: 965604 - RNA, 22 nt, Human
ccugucugcggaggaguggaag

SEQ ID NO: 965605 - RNA, 22 nt, Human
uccagccuaauguucuucccac

SEQ ID NO: 965606 - RNA, 22 nt, Human
uuugaaguggaaaaggauuuaa

SEQ ID NO: 965607 - RNA, 22 nt, Human
ucugcagaaguggcugggccac

SEQ ID NO: 965608 - RNA, 22 nt, Human
uaagacaugguugaucuagugu

SEQ ID NO: 965609 - RNA, 22 nt, Human
cagcccuggugccaagguuccc

SEQ ID NO: 965610 - RNA, 22 nt, Human
aguuaaagucugaaauagagaa

SEQ ID NO: 965611 - RNA, 22 nt, Human
guuuuauaauugcuucauaaga

SEQ ID NO: 965612 - RNA, 17 nt, Human
acagagcacaucaagau

SEQ ID NO: 965613 - RNA, 19 nt, Human
cugaagucuuuucagcugg

SEQ ID NO: 965614 - RNA, 22 nt, Human
gaggcaggcagauugcuugagg

SEQ ID NO: 965615 - RNA, 22 nt, Human
cuugcuuuguccagaaauucag

SEQ ID NO: 965616 - RNA, 22 nt, Human
ucagagaguuagugucuuagcu

SEQ ID NO: 965617 - RNA, 22 nt, Human
aaguugagaugucauaggagac

SEQ ID NO: 965618 - RNA, 22 nt, Human
ugaacccaggagguugcaguga

SEQ ID NO: 965619 - RNA, 22 nt, Human
gacacauagaucuaucucacuc

SEQ ID NO: 965620 - RNA, 22 nt, Human
gugcauauaugcacauaugugu

SEQ ID NO: 965621 - RNA, 19 nt, Human
cgcaggagccgaggugacc

SEQ ID NO: 965622 - RNA, 22 nt, Human
auauucuucuuguucagacuau

SEQ ID NO: 965623 - RNA, 22 nt, Human
uucugggacaucuggacaguuu

SEQ ID NO: 965624 - RNA, 22 nt, Human
cuggcuccaucacugggugaug

SEQ ID NO: 965625 - RNA, 22 nt, Human
ggcugccuacuuucccagaguu

SEQ ID NO: 965626 - RNA, 22 nt, Human
uuguaaaugaccuuuucuaauu

SEQ ID NO: 965627 - RNA, 22 nt, Human
ggagcagagcugggcuuggcug

SEQ ID NO: 965628 - RNA, 22 nt, Human
aagauuuccuggauguaauucc

SEQ ID NO: 965629 - RNA, 22 nt, Human
agagagcccgggccagggcaca

SEQ ID NO: 965630 - RNA, 22 nt, Human
augcaguggcagcuccuggugu

SEQ ID NO: 965631 - RNA, 22 nt, Human
aucaggauuauuaaaucuggau

SEQ ID NO: 965632 - RNA, 22 nt, Human
cagcauggggcuuggagucagc

SEQ ID NO: 965633 - RNA, 22 nt, Human
cuccagggggcauccacacagc

SEQ ID NO: 965634 - RNA, 22 nt, Human
gccugaaguuucaugccucuau

SEQ ID NO: 965635 - RNA, 22 nt, Human
uccugggccuguacuccauccg

SEQ ID NO: 965636 - RNA, 22 nt, Human
aggugauguccacagcuugcag

SEQ ID NO: 965637 - RNA, 22 nt, Human
ucacuucacacccacuaucaug

SEQ ID NO: 965638 - RNA, 22 nt, Human
cccucccaagcacucugacaua

SEQ ID NO: 965639 - RNA, 22 nt, Human
ucuuuccauggccacacagucu

SEQ ID NO: 965640 - RNA, 22 nt, Human
gauuuggccuuucgcaugguau

SEQ ID NO: 965641 - RNA, 22 nt, Human
agucucugugagcucccaaugg

SEQ ID NO: 965642 - RNA, 22 nt, Human
cugggacagagcagcagugggg

SEQ ID NO: 965643 - RNA, 22 nt, Human
ucugucuccucugaggugccag

SEQ ID NO: 965644 - RNA, 22 nt, Human
augauugguggucagcaguaug

SEQ ID NO: 965645 - RNA, 22 nt, Human
gcuggccacacugcugauggag

SEQ ID NO: 965646 - RNA, 22 nt, Human
cagccucucuguaucucaggau

SEQ ID NO: 965647 - RNA, 22 nt, Human
agcugcagagguuugugcaaca

SEQ ID NO: 965648 - RNA, 22 nt, Human
uuggccaaccagaacggagguc

SEQ ID NO: 965649 - RNA, 22 nt, Human
augguguagcaugugauaugac

SEQ ID NO: 965650 - RNA, 22 nt, Human
gcuggccucuggagaagggcuu

SEQ ID NO: 965651 - RNA, 22 nt, Human
caagugucuauaucagugcuug

SEQ ID NO: 965652 - RNA, 22 nt, Human
agcccagcagaaaguccagccu

SEQ ID NO: 965653 - RNA, 22 nt, Human
cguguggucccggcaaggcaag

SEQ ID NO: 965654 - RNA, 22 nt, Human
acaaauauuuacugaauccacu

SEQ ID NO: 965655 - RNA, 22 nt, Human
agcuuccuacaaccaucucaga

SEQ ID NO: 965656 - RNA, 21 nt, Human
cucuggaggcaagggagagug

SEQ ID NO: 965657 - RNA, 22 nt, Human
caaaagauacuugcaucuaacu

SEQ ID NO: 965658 - RNA, 22 nt, Human
cucugcuaagcaugaacaauua

SEQ ID NO: 965659 - RNA, 22 nt, Human
agcaugcgcuugaucagcucca

SEQ ID NO: 965660 - RNA, 22 nt, Human
agcagggguaacagaaggaaag

SEQ ID NO: 965661 - RNA, 22 nt, Human
gcccucucuucugcagccucca

SEQ ID NO: 965662 - RNA, 22 nt, Human
cagaaauguacugacaugcagu

SEQ ID NO: 965663 - RNA, 22 nt, Human
aggggcucaaagugugcaggga

SEQ ID NO: 965664 - RNA, 22 nt, Human
augcuguagaucuuagccucua

SEQ ID NO: 965665 - RNA, 22 nt, Human
acauucuaacauuguacagaua

SEQ ID NO: 965666 - RNA, 19 nt, Human
gcugugugaccuugggcaa

SEQ ID NO: 965667 - RNA, 19 nt, Human
agaggcagucuccaacagg

SEQ ID NO: 965668 - RNA, 22 nt, Human
caaagggcucuagacucagcag

SEQ ID NO: 965669 - RNA, 22 nt, Human
cugggcugucccaaccccaucc

SEQ ID NO: 965670 - RNA, 23 nt, Human
cagaagcaccuguugacugcugc

SEQ ID NO: 965671 - RNA, 22 nt, Human
uauuugaaaguguacaaaaacu

SEQ ID NO: 965672 - RNA, 22 nt, Human
agagccuggggauuggcaaggg

SEQ ID NO: 965673 - RNA, 22 nt, Human
augauggugagguugagcacag

SEQ ID NO: 965674 - RNA, 20 nt, Human
cacaagagaauacacacugg

SEQ ID NO: 965675 - RNA, 22 nt, Human
acucugcuuaauuaaaaccagg

SEQ ID NO: 965676 - RNA, 22 nt, Human
aggcuuccucgugccuuagaua

SEQ ID NO: 965677 - RNA, 22 nt, Human
gcugagagaaaagugagguucu

SEQ ID NO: 965678 - RNA, 22 nt, Human
agcagcagaggucagaaaggua

SEQ ID NO: 965679 - RNA, 22 nt, Human
gaggcagagaccuucaggaccu

SEQ ID NO: 965680 - RNA, 22 nt, Human
agaucucaccucuguguauuau

SEQ ID NO: 965681 - RNA, 22 nt, Human
gugcaggggaucagguugcagc

SEQ ID NO: 965682 - RNA, 22 nt, Human
aaaaguauuuauggcuauguaa

SEQ ID NO: 965683 - RNA, 22 nt, Human
acuaaggaauaugacaaacuca

SEQ ID NO: 965684 - RNA, 22 nt, Human
gaggacagcuuagggcuuccug

SEQ ID NO: 965685 - RNA, 22 nt, Human
uucaggagcuggcugcgaagga

SEQ ID NO: 965686 - RNA, 22 nt, Human
cuggugugauugagcccaggug

SEQ ID NO: 965687 - RNA, 22 nt, Human
aggcucuggacagugaggaguu

SEQ ID NO: 965688 - RNA, 22 nt, Human
gccaggaggucagccccucaac

SEQ ID NO: 965689 - RNA, 22 nt, Human
uuaaacaguguuucaugugggg

SEQ ID NO: 965690 - RNA, 22 nt, Human
caggcagcugcgacaagagagc

SEQ ID NO: 965691 - RNA, 22 nt, Human
auggaaagccaguguuccauca

SEQ ID NO: 965692 - RNA, 17 nt, Human
agaugcuggccacaugu

SEQ ID NO: 965693 - RNA, 20 nt, Human
gaggcucugggcauggcgcc

SEQ ID NO: 965694 - RNA, 22 nt, Human
agugugucgagggaggguccag

SEQ ID NO: 965695 - RNA, 22 nt, Human
aggcacugggaauaugcugagg

SEQ ID NO: 965696 - RNA, 22 nt, Human
uccugaggaaaguucaugaaug

SEQ ID NO: 965697 - RNA, 22 nt, Human
cugagccuuauucaccagcccu

SEQ ID NO: 965698 - RNA, 22 nt, Human
gcugcagccaaauucauuguca

SEQ ID NO: 965699 - RNA, 22 nt, Human
uuugaacuucuccauucugaug

SEQ ID NO: 965700 - RNA, 22 nt, Human
ccagggcauguccaagacuuag

SEQ ID NO: 965701 - RNA, 22 nt, Human
cauggcagggcugugggcaggu

SEQ ID NO: 965702 - RNA, 22 nt, Human
cacugagcugauagaauuccag

SEQ ID NO: 965703 - RNA, 22 nt, Human
ucugccugcggcugcagguggc

SEQ ID NO: 965704 - RNA, 22 nt, Human
uggggacaggagacuuacagcu

SEQ ID NO: 965705 - RNA, 22 nt, Human
uuuguuaaaaugcagauucugu

SEQ ID NO: 965706 - RNA, 22 nt, Human
agucaauucuuuucaacucaag

SEQ ID NO: 965707 - RNA, 22 nt, Human
ggagcaggagucucuugaauuu

SEQ ID NO: 965708 - RNA, 22 nt, Human
ggcugccugaggcagugagaga

SEQ ID NO: 965709 - RNA, 22 nt, Human
ucucagggccccaaaggcuagu

SEQ ID NO: 965710 - RNA, 22 nt, Human
acuggccagguucaaaauacag

SEQ ID NO: 965711 - RNA, 22 nt, Human
cagguggcaugacugccuacaa

SEQ ID NO: 965712 - RNA, 22 nt, Human
uauugaaauucuucauguccuc

SEQ ID NO: 965713 - RNA, 23 nt, Human
agaugaaagcuucccaucacagu

SEQ ID NO: 965714 - RNA, 19 nt, Human
ggcagcuugggaagguagc

SEQ ID NO: 965715 - RNA, 23 nt, Human
aaacugcuuccaauuccugccau

SEQ ID NO: 965716 - RNA, 18 nt, Human
augugcaauuuuguauuu

SEQ ID NO: 965717 - RNA, 22 nt, Human
ccagccagcugcccuuggggcc

SEQ ID NO: 965718 - RNA, 22 nt, Human
accucugcaguagggcugugcc

SEQ ID NO: 965719 - RNA, 22 nt, Human
aauguuaaaaccuucagugcuu

SEQ ID NO: 965720 - RNA, 22 nt, Human
ccaaaguccauaguuuacauaa

SEQ ID NO: 965721 - RNA, 22 nt, Human
gccucugcugacaagauggaca

SEQ ID NO: 965722 - RNA, 22 nt, Human
gaggcucagagggagcaugguc

SEQ ID NO: 965723 - RNA, 22 nt, Human
ccugggugucaugggcagcugg

SEQ ID NO: 965724 - RNA, 22 nt, Human
cuggcaggucucgcugacgugu

SEQ ID NO: 965725 - RNA, 22 nt, Human
ugcaggggcuugucugggccug

SEQ ID NO: 965726 - RNA, 22 nt, Human
aguccaaggagagacagcauuu

SEQ ID NO: 965727 - RNA, 22 nt, Human
gcaggaguguauuugcauguaa

SEQ ID NO: 965728 - RNA, 15 nt, Human
cuccaugauuuugca

SEQ ID NO: 965729 - RNA, 23 nt, Human
gagcugggauacaggcuuacugc

SEQ ID NO: 965730 - RNA, 22 nt, Human
agccaaagagaccccauaucca

SEQ ID NO: 965731 - RNA, 22 nt, Human
gauuucaaaaguagauccauca

SEQ ID NO: 965732 - RNA, 22 nt, Human
auuugcaugcuucuauugugaa

SEQ ID NO: 965733 - RNA, 22 nt, Human
aagagcuggauggaaucuggga

SEQ ID NO: 965734 - RNA, 22 nt, Human
caguugcuggaugugcagcucu

SEQ ID NO: 965735 - RNA, 20 nt, Human
ucucuucuggggagauaaaa

SEQ ID NO: 965736 - RNA, 22 nt, Human
uggcaggguuggccaccuuacc

SEQ ID NO: 965737 - RNA, 22 nt, Human
uccauuuuucaugacuccucaa

SEQ ID NO: 965738 - RNA, 22 nt, Human
ugauuuccccagucuugcugcu

SEQ ID NO: 965739 - RNA, 22 nt, Human
ucccagcccagauuugugugac

SEQ ID NO: 965740 - RNA, 22 nt, Human
agcuauguaacagugccaugga

SEQ ID NO: 965741 - RNA, 22 nt, Human
gcugccugauguccagcaggac

SEQ ID NO: 965742 - RNA, 22 nt, Human
ucacaugcuacugagccagacc

SEQ ID NO: 965743 - RNA, 22 nt, Human
agggucccgaaggagacagcaa

SEQ ID NO: 965744 - RNA, 22 nt, Human
uggcagccaucugagggugggg

SEQ ID NO: 965745 - RNA, 22 nt, Human
cagccaggacagggaaacuagu

SEQ ID NO: 965746 - RNA, 22 nt, Human
uuucacagguacaaacacuccu

SEQ ID NO: 965747 - RNA, 17 nt, Human
aaggccauuuccaccca

SEQ ID NO: 965748 - RNA, 22 nt, Human
gggagccaaggagagaggccuu

SEQ ID NO: 965749 - RNA, 22 nt, Human
cuucagaggggacucaaaguca

SEQ ID NO: 965750 - RNA, 22 nt, Human
gggcuggcucccagguguugaa

SEQ ID NO: 965751 - RNA, 22 nt, Human
gaggggcagaaugugaucaggg

SEQ ID NO: 965752 - RNA, 22 nt, Human
cccaggaccgcgcggcugagcg

SEQ ID NO: 965753 - RNA, 22 nt, Human
gcucugcucuugacuuaccagg

SEQ ID NO: 965754 - RNA, 22 nt, Human
uuauuagguuauucucuguacu

SEQ ID NO: 965755 - RNA, 22 nt, Human
gaggucagucagaccaggguuu

SEQ ID NO: 965756 - RNA, 22 nt, Human
uuuccuaugauauucuaugugu

SEQ ID NO: 965757 - RNA, 22 nt, Human
gcaggagugacauggaugugga

SEQ ID NO: 965758 - RNA, 22 nt, Human
ugccuucaaucaggauggucuc

SEQ ID NO: 965759 - RNA, 22 nt, Human
ugucucugcuuuccuugcaggg

SEQ ID NO: 965760 - RNA, 22 nt, Human
ugggcuggagcuuguugcuucc

SEQ ID NO: 965761 - RNA, 22 nt, Human
auccaguucucagugcuuacag

SEQ ID NO: 965762 - RNA, 19 nt, Human
auagucuuuccaauuauac

SEQ ID NO: 965763 - RNA, 22 nt, Human
aaguuugugucagagcuguuac

SEQ ID NO: 965764 - RNA, 23 nt, Human
cuggcucuguagguggcauccuu

SEQ ID NO: 965765 - RNA, 20 nt, Human
cacaggcuauaugagagcca

SEQ ID NO: 965766 - RNA, 23 nt, Human
aacugagauaauguauguaaagc

SEQ ID NO: 965767 - RNA, 22 nt, Human
cccagcaggaggagguugcagu

SEQ ID NO: 965768 - RNA, 22 nt, Human
uuccaggaauucagcucucagu

SEQ ID NO: 965769 - RNA, 22 nt, Human
augggaugcauggcuguggcca

SEQ ID NO: 965770 - RNA, 22 nt, Human
acagggaacaggaauauacaaa

SEQ ID NO: 965771 - RNA, 22 nt, Human
accaaggaguuugguauuuuag

SEQ ID NO: 965772 - RNA, 22 nt, Human
gaaaucugaacucuguauccuu

SEQ ID NO: 965773 - RNA, 21 nt, Human
gcagaggcacggcaccaaggg

SEQ ID NO: 965774 - RNA, 22 nt, Human
ucuugggauugcccugcaguuc

SEQ ID NO: 965775 - RNA, 22 nt, Human
guggcucucgccagccugcggg

SEQ ID NO: 965776 - RNA, 22 nt, Human
aaauacagaguugcuuaaaagc

SEQ ID NO: 965777 - RNA, 22 nt, Human
uuggcaucaguguaggaccugu

SEQ ID NO: 965778 - RNA, 22 nt, Human
ucaggagaacuuccuucuaccc

SEQ ID NO: 965779 - RNA, 22 nt, Human
gcaggaguuaggcgucguggau

SEQ ID NO: 965780 - RNA, 20 nt, Human
agucccagaucaaauuucug

SEQ ID NO: 965781 - RNA, 22 nt, Human
gucccuggggaaucagcuggag

SEQ ID NO: 965782 - RNA, 22 nt, Human
uggcagcauuaauuauucaggu

SEQ ID NO: 965783 - RNA, 22 nt, Human
uuugcauuguuucaaaagugaa

SEQ ID NO: 965784 - RNA, 22 nt, Human
cagcuugggaguuugguuuuau

SEQ ID NO: 965785 - RNA, 22 nt, Human
auggcagccuguggacagucaa

SEQ ID NO: 965786 - RNA, 22 nt, Human
gcugcucuuuucagagaugaga

SEQ ID NO: 965787 - RNA, 22 nt, Human
agggggaggcugugcugcgucu

SEQ ID NO: 965788 - RNA, 22 nt, Human
aggcaggcucaaugcccagucu

SEQ ID NO: 965789 - RNA, 23 nt, Human
ucagcugcuuccuccugccugcc

SEQ ID NO: 965790 - RNA, 22 nt, Human
guccugggaaggaagccaggga

SEQ ID NO: 965791 - RNA, 22 nt, Human
cugucucagcaggaagucauca

SEQ ID NO: 965792 - RNA, 22 nt, Human
ugccugucuccucugcagggug

SEQ ID NO: 965793 - RNA, 22 nt, Human
caggaacacaaguucagggaug

SEQ ID NO: 965794 - RNA, 22 nt, Human
uugcuguguaacuccuggccug

SEQ ID NO: 965795 - RNA, 22 nt, Human
ucucauugguauauacaugugu

SEQ ID NO: 965796 - RNA, 22 nt, Human
ccagagccugcugagccccauu

SEQ ID NO: 965797 - RNA, 22 nt, Human
aagcaauauacugauaugauua

SEQ ID NO: 965798 - RNA, 22 nt, Human
agcacauucugccuugcuuugc

SEQ ID NO: 965799 - RNA, 22 nt, Human
ugcaauaacuacuuuaauguug

SEQ ID NO: 965800 - RNA, 22 nt, Human
uggggguguccuggugcacaca

SEQ ID NO: 965801 - RNA, 22 nt, Human
ugcucauuggcgaucugaggga

SEQ ID NO: 965802 - RNA, 22 nt, Human
agcagggcucuguggagggugg

SEQ ID NO: 965803 - RNA, 22 nt, Human
uggccggggcugauggacagug

SEQ ID NO: 965804 - RNA, 21 nt, Human
ucagacuugagcucuucuaca

SEQ ID NO: 965805 - RNA, 22 nt, Human
gcagaggccaggccaccagcaa

SEQ ID NO: 965806 - RNA, 18 nt, Human
ugucucugaauuccagug

SEQ ID NO: 965807 - RNA, 22 nt, Human
acugaaagauaaaucaguuagc

SEQ ID NO: 965808 - RNA, 22 nt, Human
uggguggaauaaaucaguucug

SEQ ID NO: 965809 - RNA, 22 nt, Human
uugcaccaaaugaguuaaaauu

SEQ ID NO: 965810 - RNA, 22 nt, Human
cagcacuggggccacuggaguu

SEQ ID NO: 965811 - RNA, 22 nt, Human
cucucugggcccaguuggcacc

SEQ ID NO: 965812 - RNA, 22 nt, Human
uuuccuaaucccaaugacauuu

SEQ ID NO: 965813 - RNA, 22 nt, Human
cuggcuggccggaggcaucccu

SEQ ID NO: 965814 - RNA, 22 nt, Human
cuccuucccuucaaguguuccu

SEQ ID NO: 965815 - RNA, 22 nt, Human
uucugagcugcaacacuaacau

SEQ ID NO: 965816 - RNA, 22 nt, Human
auauuaggaguuaaauguauua

SEQ ID NO: 965817 - RNA, 22 nt, Human
auuaaaagcuucccaagaguua

SEQ ID NO: 965818 - RNA, 22 nt, Human
uggcucagugacauuccuccca

SEQ ID NO: 965819 - RNA, 17 nt, Human
gaaagguccuagaaauc

SEQ ID NO: 965820 - RNA, 22 nt, Human
uuuauuugaaucaggggagaau

SEQ ID NO: 965821 - RNA, 22 nt, Human
gcaaaaaaugcuuguugcuuag

SEQ ID NO: 965822 - RNA, 22 nt, Human
cugcuguguuucugcuagaaaa

SEQ ID NO: 965823 - RNA, 19 nt, Human
ggucacagggguuacaagg

SEQ ID NO: 965824 - RNA, 22 nt, Human
uccucuucugcccaucagaggc

SEQ ID NO: 965825 - RNA, 20 nt, Human
aagggcagagggaacagacu

SEQ ID NO: 965826 - RNA, 22 nt, Human
ggggccuguagagcuucaggga

SEQ ID NO: 965827 - RNA, 20 nt, Human
aucagcaacugccacucagu

SEQ ID NO: 965828 - RNA, 22 nt, Human
acagcauugcuccaucucaaga

SEQ ID NO: 965829 - RNA, 22 nt, Human
gggagccaugcuggucuucuuu

SEQ ID NO: 965830 - RNA, 22 nt, Human
guccucaguaagagggccucug

SEQ ID NO: 965831 - RNA, 22 nt, Human
ggcucaggcuggagugcagugg

SEQ ID NO: 965832 - RNA, 22 nt, Human
uuacuggcugggccugagggcu

SEQ ID NO: 965833 - RNA, 22 nt, Human
uuuguaaaggccugaauuucag

SEQ ID NO: 965834 - RNA, 18 nt, Human
aaggcuucaaagaguaga

SEQ ID NO: 965835 - RNA, 22 nt, Human
cagcccuuuccuucucagcuuu

SEQ ID NO: 965836 - RNA, 22 nt, Human
ucauuugugugagugauuugac

SEQ ID NO: 965837 - RNA, 22 nt, Human
ucccagaagugaaauuucuaga

SEQ ID NO: 965838 - RNA, 22 nt, Human
agccucucuuucugguggcuaa

SEQ ID NO: 965839 - RNA, 22 nt, Human
ugcagggccgcuggaggucaug

SEQ ID NO: 965840 - RNA, 22 nt, Human
cugaaauuccauuucagccaca

SEQ ID NO: 965841 - RNA, 22 nt, Human
uuggcauaccuuagugguggag

SEQ ID NO: 965842 - RNA, 22 nt, Human
aggcugccuguuccaaucuccu

SEQ ID NO: 965843 - RNA, 22 nt, Human
aaaagcagaucuccaaagucua

SEQ ID NO: 965844 - RNA, 22 nt, Human
gucccuaguggaaagacaugau

SEQ ID NO: 965845 - RNA, 22 nt, Human
ucugagccaaaauaaacagcau

SEQ ID NO: 965846 - RNA, 22 nt, Human
auggcacugaccucccuuguaa

SEQ ID NO: 965847 - RNA, 22 nt, Human
gcccaggauggcuggaggugcu

SEQ ID NO: 965848 - RNA, 22 nt, Human
gagguggaaggcaggaacaaau

SEQ ID NO: 965849 - RNA, 22 nt, Human
ccuucucuacuccugaugcaug

SEQ ID NO: 965850 - RNA, 22 nt, Human
gagcccugauuugcagcauuug

SEQ ID NO: 965851 - RNA, 22 nt, Human
gagggcugauaacaggaauaca

SEQ ID NO: 965852 - RNA, 20 nt, Human
uccugggguaagccaugguc

SEQ ID NO: 965853 - RNA, 22 nt, Human
ucccagagcaguacuccaggag

SEQ ID NO: 965854 - RNA, 22 nt, Human
aauuuguuaaaagugagugaca

SEQ ID NO: 965855 - RNA, 22 nt, Human
agagcugggacuuggacucaau

SEQ ID NO: 965856 - RNA, 22 nt, Human
uugcauuucccauugaguaaug

SEQ ID NO: 965857 - RNA, 22 nt, Human
aggcugggaagguaaaguugua

SEQ ID NO: 965858 - RNA, 21 nt, Human
uucuccccagcgaauccucgg

SEQ ID NO: 965859 - RNA, 22 nt, Human
gcugugagggcuucugaggcau

SEQ ID NO: 965860 - RNA, 22 nt, Human
auuagcauauuaaauagucauu

SEQ ID NO: 965861 - RNA, 22 nt, Human
cuggcagcuuccuuugcaucug

SEQ ID NO: 965862 - RNA, 22 nt, Human
gcccugcugcuggcagaggcgc

SEQ ID NO: 965863 - RNA, 22 nt, Human
aggggccauuguucugcccgcu

SEQ ID NO: 965864 - RNA, 22 nt, Human
cugugucuucacauuugugugc

SEQ ID NO: 965865 - RNA, 22 nt, Human
uuuuucauugcagccucucucc

SEQ ID NO: 965866 - RNA, 22 nt, Human
uacauuuauaaggcuucucugu

SEQ ID NO: 965867 - RNA, 19 nt, Human
agaaaucucgagauuuguu

SEQ ID NO: 965868 - RNA, 22 nt, Human
cacaggcuuccaguccccagcu

SEQ ID NO: 965869 - RNA, 22 nt, Human
gugauuccuauuaguacaugca

SEQ ID NO: 965870 - RNA, 22 nt, Human
cagaagcacuaggaggaaacgu

SEQ ID NO: 965871 - RNA, 22 nt, Human
ucugucacuuuuauuuacugaa

SEQ ID NO: 965872 - RNA, 21 nt, Human
acagaacuguauagugauaaa

SEQ ID NO: 965873 - RNA, 22 nt, Human
cugcugugacagcugccguguu

SEQ ID NO: 965874 - RNA, 19 nt, Human
aggcaggugcagagguccc

SEQ ID NO: 965875 - RNA, 18 nt, Human
cugcugcaggcacucagg

SEQ ID NO: 965876 - RNA, 22 nt, Human
uacaaaugaaccaacuuugaug

SEQ ID NO: 965877 - RNA, 22 nt, Human
accaggaguaacagugaguggu

SEQ ID NO: 965878 - RNA, 22 nt, Human
acaggugguaaaauggacuguc

SEQ ID NO: 965879 - RNA, 22 nt, Human
cucagugugaaugcucaguaaa

SEQ ID NO: 965880 - RNA, 22 nt, Human
agggagcugagcugugagcagc

SEQ ID NO: 965881 - RNA, 23 nt, Human
ugacacauuuccuuuccacugca

SEQ ID NO: 965882 - RNA, 22 nt, Human
uuuuaguguagucaccgugggu

SEQ ID NO: 965883 - RNA, 22 nt, Human
ggcugggcucgcugauuggcug

SEQ ID NO: 965884 - RNA, 22 nt, Human
gaggccugaggcugccuggagc

SEQ ID NO: 965885 - RNA, 21 nt, Human
uggcucugcucagagcagucc

SEQ ID NO: 965886 - RNA, 22 nt, Human
cuucuugcaauuuucaucuuau

SEQ ID NO: 965887 - RNA, 22 nt, Human
uccuggagagugggcgagcaca

SEQ ID NO: 965888 - RNA, 22 nt, Human
aaguuuguguaguuuagcaucc

SEQ ID NO: 965889 - RNA, 22 nt, Human
gugucccaggccucuggaauua

SEQ ID NO: 965890 - RNA, 22 nt, Human
acugaaggcuuaacucuuucau

SEQ ID NO: 965891 - RNA, 22 nt, Human
caguaugucuacuggacaaagu

SEQ ID NO: 965892 - RNA, 22 nt, Human
auggacaggaacucccuuggca

SEQ ID NO: 965893 - RNA, 22 nt, Human
agggcucugagugggaaagagg

SEQ ID NO: 965894 - RNA, 22 nt, Human
acauuugagaugccuuuuaggu

SEQ ID NO: 965895 - RNA, 22 nt, Human
uuuaguaaguucacugcaaagc

SEQ ID NO: 965896 - RNA, 19 nt, Human
ucauaaggagagaggaaau

SEQ ID NO: 965897 - RNA, 22 nt, Human
cagaggcucuuccucacugccc

SEQ ID NO: 965898 - RNA, 19 nt, Human
ccuuccuccccagggccau

SEQ ID NO: 965899 - RNA, 22 nt, Human
augguacaaaauguauaaaguc

SEQ ID NO: 965900 - RNA, 22 nt, Human
acauuucuucccuuuagcagaa

SEQ ID NO: 965901 - RNA, 22 nt, Human
acuggccaggagcuggaaauac

SEQ ID NO: 965902 - RNA, 20 nt, Human
uccucagaagacauuugggg

SEQ ID NO: 965903 - RNA, 22 nt, Human
aaguauaagcuauucuucauga

SEQ ID NO: 965904 - RNA, 22 nt, Human
gugucccagccccacaggccug

SEQ ID NO: 965905 - RNA, 21 nt, Human
uugaaggaucacuucuguacc

SEQ ID NO: 965906 - RNA, 22 nt, Human
acauugaugaaaagguaucauu

SEQ ID NO: 965907 - RNA, 22 nt, Human
aaagcugcugccaaucaggcuu

SEQ ID NO: 965908 - RNA, 22 nt, Human
ucuuucucucuaaucaagcaca

SEQ ID NO: 965909 - RNA, 22 nt, Human
agaagugccauacuguggucca

SEQ ID NO: 965910 - RNA, 22 nt, Human
gcaggagcccuggcauguucuu

SEQ ID NO: 965911 - RNA, 22 nt, Human
cugugcuucgcaacuccaaggu

SEQ ID NO: 965912 - RNA, 19 nt, Human
ccugggagucagcugaagg

SEQ ID NO: 965913 - RNA, 22 nt, Human
cagaagcauugacuccuugcuc

SEQ ID NO: 965914 - RNA, 18 nt, Human
aagccagagaccacugcc

SEQ ID NO: 965915 - RNA, 22 nt, Human
ucaggcugaggucaucugcauc

SEQ ID NO: 965916 - RNA, 22 nt, Human
cauuugcagagggugacacucu

SEQ ID NO: 965917 - RNA, 22 nt, Human
cauuuccugucuggaggucaaa

SEQ ID NO: 965918 - RNA, 22 nt, Human
ugaagcagcuucuuucugucaa

SEQ ID NO: 965919 - RNA, 22 nt, Human
acagggcaugugcaagagacau

SEQ ID NO: 965920 - RNA, 22 nt, Human
cuuuggaagugaccacaauccu

SEQ ID NO: 965921 - RNA, 22 nt, Human
agagcccugaagcagagcuaaa

SEQ ID NO: 965922 - RNA, 22 nt, Human
uucaagauggcugcaaauacuu

SEQ ID NO: 965923 - RNA, 22 nt, Human
uggaccugcuggaugggcaggu

SEQ ID NO: 965924 - RNA, 22 nt, Human
ggaagugaggaaauauuuuguu

SEQ ID NO: 965925 - RNA, 22 nt, Human
aaacagucaugguugcuguuca

SEQ ID NO: 965926 - RNA, 22 nt, Human
uuccuggcaccaccacuucuag

SEQ ID NO: 965927 - RNA, 22 nt, Human
gcucugcucccucaaaugacau

SEQ ID NO: 965928 - RNA, 18 nt, Human
uggccuggagacaacucu

SEQ ID NO: 965929 - RNA, 22 nt, Human
aauuucagagguagagauucua

SEQ ID NO: 965930 - RNA, 23 nt, Human
auucuucauuaucuucuagaaaa

SEQ ID NO: 965931 - RNA, 22 nt, Human
cugccagcacugccuccugagg

SEQ ID NO: 965932 - RNA, 22 nt, Human
agcugccauccgaggugucaga

SEQ ID NO: 965933 - RNA, 22 nt, Human
gaaaugcagaaccugagaccau

SEQ ID NO: 965934 - RNA, 17 nt, Human
gagauggguggaucacc

SEQ ID NO: 965935 - RNA, 22 nt, Human
cuggcagcucuacucagagccu

SEQ ID NO: 965936 - RNA, 22 nt, Human
gacagggccgcagauggagacu

SEQ ID NO: 965937 - RNA, 22 nt, Human
cuuauuagaguuguguucuguu

SEQ ID NO: 965938 - RNA, 22 nt, Human
agcagagccugggcuaggggug

SEQ ID NO: 965939 - RNA, 22 nt, Human
ucccaggaaaacacucgaggac

SEQ ID NO: 965940 - RNA, 22 nt, Human
aggcacugauucuguuuuccau

SEQ ID NO: 965941 - RNA, 22 nt, Human
uucagcaaauggacuguucagg

SEQ ID NO: 965942 - RNA, 22 nt, Human
cugaaggagaaggccacuguuc

SEQ ID NO: 965943 - RNA, 22 nt, Human
cuggggcugcggacgggagccc

SEQ ID NO: 965944 - RNA, 22 nt, Human
cagggagaaaucuccaggaggu

SEQ ID NO: 965945 - RNA, 22 nt, Human
uauuccagaugaaaucauucag

SEQ ID NO: 965946 - RNA, 22 nt, Human
ucugcgcugccuugauccuugg

SEQ ID NO: 965947 - RNA, 22 nt, Human
ggagccuggcaaugcugcgucc

SEQ ID NO: 965948 - RNA, 22 nt, Human
cuggcagcgcagcaugaagucg

SEQ ID NO: 965949 - RNA, 22 nt, Human
ggccugcuggcuccagcgcccg

SEQ ID NO: 965950 - RNA, 22 nt, Human
gccugccugcugugugcaaguu

SEQ ID NO: 965951 - RNA, 22 nt, Human
uuuuaguuguacugucaacagu

SEQ ID NO: 965952 - RNA, 22 nt, Human
ccuggccagccagggcuggggu

SEQ ID NO: 965953 - RNA, 19 nt, Human
acucaagucuaaugaaauc

SEQ ID NO: 965954 - RNA, 22 nt, Human
auucaaguccagcuucucuaca

SEQ ID NO: 965955 - RNA, 21 nt, Human
uauuucuuugacucucucccu

SEQ ID NO: 965956 - RNA, 22 nt, Human
uuccuuccauagcaaaacaugc

SEQ ID NO: 965957 - RNA, 20 nt, Human
uuggcagcagcucagccacc

SEQ ID NO: 965958 - RNA, 22 nt, Human
ggagccuguggccgucacgacu

SEQ ID NO: 965959 - RNA, 22 nt, Human
ucuuugcaaauguuauuaucuu

SEQ ID NO: 965960 - RNA, 22 nt, Human
gaggcugcggggaggagccugc

SEQ ID NO: 965961 - RNA, 22 nt, Human
gggaaauugugugagaucuuug

SEQ ID NO: 965962 - RNA, 22 nt, Human
gugucauguagaaauugaugaa

SEQ ID NO: 965963 - RNA, 22 nt, Human
agaggcggagcuugcagugagc

SEQ ID NO: 965964 - RNA, 22 nt, Human
gccuccuggauuuuagugccau

SEQ ID NO: 965965 - RNA, 22 nt, Human
agcaggguauguuagagcugua

SEQ ID NO: 965966 - RNA, 19 nt, Human
ucauucaggaccaguggau

SEQ ID NO: 965967 - RNA, 22 nt, Human
gaggcagugcauugucuagggg

SEQ ID NO: 965968 - RNA, 22 nt, Human
cuuacauuuaaucaugugucau

SEQ ID NO: 965969 - RNA, 22 nt, Human
guguugacucuuggacuucaag

SEQ ID NO: 965970 - RNA, 22 nt, Human
uggccuuggcagugagaagagu

SEQ ID NO: 965971 - RNA, 22 nt, Human
uagcagugccaggauuuugcug

SEQ ID NO: 965972 - RNA, 22 nt, Human
aguaaugugccugaaauacuug

SEQ ID NO: 965973 - RNA, 22 nt, Human
ucccagggacaccaagcuguuu

SEQ ID NO: 965974 - RNA, 22 nt, Human
cauagaaaagaguagguaaugu

SEQ ID NO: 965975 - RNA, 22 nt, Human
uucuucaaaauccagcaugauu

SEQ ID NO: 965976 - RNA, 22 nt, Human
ggagccuugggcgcucucccau

SEQ ID NO: 965977 - RNA, 22 nt, Human
cagcaggagcagucagacuccu

SEQ ID NO: 965978 - RNA, 21 nt, Human
uggcccuggccacggcugcca

SEQ ID NO: 965979 - RNA, 20 nt, Human
ucugugugccaucaccuaac

SEQ ID NO: 965980 - RNA, 22 nt, Human
ucuguuccauguuuuguuccau

SEQ ID NO: 965981 - RNA, 23 nt, Human
uccagcagagccuuccaggaggg

SEQ ID NO: 965982 - RNA, 22 nt, Human
accuuguuaaaaugaggauucu

SEQ ID NO: 965983 - RNA, 22 nt, Human
acugggccggugcagaguaguu

SEQ ID NO: 965984 - RNA, 22 nt, Human
uugcucaggcuuagagcuacua

SEQ ID NO: 965985 - RNA, 22 nt, Human
gaaaggucaguuccacuuccau

SEQ ID NO: 965986 - RNA, 22 nt, Human
ucugccagaaguucugagagua

SEQ ID NO: 965987 - RNA, 22 nt, Human
aaaguucaugguguuauagaaa

SEQ ID NO: 965988 - RNA, 22 nt, Human
gccucugccaagggggcugcgg

SEQ ID NO: 965989 - RNA, 22 nt, Human
uugacaaugcacugugcuaagu

SEQ ID NO: 965990 - RNA, 22 nt, Human
gggcugugagaguggggcugcu

SEQ ID NO: 965991 - RNA, 20 nt, Human
uaugaagauaugugaacagc

SEQ ID NO: 965992 - RNA, 22 nt, Human
uggagcugacucacaccagcua

SEQ ID NO: 965993 - RNA, 22 nt, Human
aaugcugcaagaggugaaaaga

SEQ ID NO: 965994 - RNA, 22 nt, Human
ccagggccaagagaccucgagg

SEQ ID NO: 965995 - RNA, 22 nt, Human
ucuccuggcucaccaggcugga

SEQ ID NO: 965996 - RNA, 22 nt, Human
ccagcugcagguguuccagaug

SEQ ID NO: 965997 - RNA, 22 nt, Human
ucauuguuauguuuugcugucu

SEQ ID NO: 965998 - RNA, 20 nt, Human
gcaggcagggaaugggggug

SEQ ID NO: 965999 - RNA, 22 nt, Human
auagacauuuugcauucaagca

SEQ ID NO: 966000 - RNA, 22 nt, Human
ugcagaagcagagaguugccaa

SEQ ID NO: 966001 - RNA, 22 nt, Human
aaaugucuaucuggcauauucc

SEQ ID NO: 966002 - RNA, 22 nt, Human
ugggcuguccagcaccugggcu

SEQ ID NO: 966003 - RNA, 20 nt, Human
gugcuucagaagccauugcu

SEQ ID NO: 966004 - RNA, 20 nt, Human
ucagacuugauucuaugcua

SEQ ID NO: 966005 - RNA, 22 nt, Human
augggcugugagguccggcagg

SEQ ID NO: 966006 - RNA, 22 nt, Human
ccugagcugaacuaagcaguuu

SEQ ID NO: 966007 - RNA, 22 nt, Human
ccugggagguggagguugcagu

SEQ ID NO: 966008 - RNA, 22 nt, Human
cuguagcagugugcucuuuuuc

SEQ ID NO: 966009 - RNA, 18 nt, Human
uucaccagugugaugggu

SEQ ID NO: 966010 - RNA, 22 nt, Human
caagauggguguugugaugguu

SEQ ID NO: 966011 - RNA, 20 nt, Human
uuugucuguuaaguguuucu

SEQ ID NO: 966012 - RNA, 22 nt, Human
aggacaggauugagcugaacug

SEQ ID NO: 966013 - RNA, 21 nt, Human
uuugaaagcccuauguuuuca

SEQ ID NO: 966014 - RNA, 22 nt, Human
aaauaguuagcccugcauauau

SEQ ID NO: 966015 - RNA, 22 nt, Human
gccuuucaguuccaucaaagga

SEQ ID NO: 966016 - RNA, 22 nt, Human
ucagcagggaggcucugugccc

SEQ ID NO: 966017 - RNA, 22 nt, Human
acucugcaauguggcaagaaca

SEQ ID NO: 966018 - RNA, 22 nt, Human
gacagcaggagaucaugauaga

SEQ ID NO: 966019 - RNA, 22 nt, Human
guacaaaguggaccugauagua

SEQ ID NO: 966020 - RNA, 22 nt, Human
gcuguauuuaacaacuggcuca

SEQ ID NO: 966021 - RNA, 22 nt, Human
uaugcacaguuacaagaauauc

SEQ ID NO: 966022 - RNA, 22 nt, Human
cuuuggcaaugaaacacaagaa

SEQ ID NO: 966023 - RNA, 22 nt, Human
aggguccaucaaggacugcaca

SEQ ID NO: 966024 - RNA, 22 nt, Human
aaggguggauuucugagcucua

SEQ ID NO: 966025 - RNA, 22 nt, Human
agcucccugagaugccacagca

SEQ ID NO: 966026 - RNA, 22 nt, Human
agcagccagagaaugaugcagu

SEQ ID NO: 966027 - RNA, 22 nt, Human
augcaguagauaggcacuuuua

SEQ ID NO: 966028 - RNA, 22 nt, Human
aagagcuggagcugcuacagga

SEQ ID NO: 966029 - RNA, 22 nt, Human
cuggcccagucucagaguguca

SEQ ID NO: 966030 - RNA, 22 nt, Human
guagcccaccuggggagggcga

SEQ ID NO: 966031 - RNA, 22 nt, Human
ggucuugcuauguugcccaggc

SEQ ID NO: 966032 - RNA, 22 nt, Human
cuccucacuuuccagacugggc

SEQ ID NO: 966033 - RNA, 22 nt, Human
uuuucauuguaaaucaggaaac

SEQ ID NO: 966034 - RNA, 22 nt, Human
uuagcugcauuaucaaaguuau

SEQ ID NO: 966035 - RNA, 22 nt, Human
cuggccugggagcugcuagcgu

SEQ ID NO: 966036 - RNA, 22 nt, Human
aggcucugacccaugggaccca

SEQ ID NO: 966037 - RNA, 22 nt, Human
ucuuugcacacaucccuucccg

SEQ ID NO: 966038 - RNA, 22 nt, Human
gcugccucccccauggcuggaa

SEQ ID NO: 966039 - RNA, 22 nt, Human
agucauguguucaucuuucauu

SEQ ID NO: 966040 - RNA, 22 nt, Human
gcuggaccaggugugcacaggc

SEQ ID NO: 966041 - RNA, 22 nt, Human
uucuugcaggucacucacugag

SEQ ID NO: 966042 - RNA, 22 nt, Human
caagaacauugugaucacuuca

SEQ ID NO: 966043 - RNA, 22 nt, Human
ucugaggcccugcaggcagugu

SEQ ID NO: 966044 - RNA, 19 nt, Human
ugcucauggggacuucucc

SEQ ID NO: 966045 - RNA, 20 nt, Human
uuggcagcaguuccaaguga

SEQ ID NO: 966046 - RNA, 22 nt, Human
uuucaugagauuccuccacauc

SEQ ID NO: 966047 - RNA, 18 nt, Human
cugcuugggagacgucag

SEQ ID NO: 966048 - RNA, 22 nt, Human
aggcuggcccuacuggcugccu

SEQ ID NO: 966049 - RNA, 22 nt, Human
aacaaaugauaccaguucucaa

SEQ ID NO: 966050 - RNA, 22 nt, Human
caaaagucuuccuauucucuua

SEQ ID NO: 966051 - RNA, 22 nt, Human
caggccugcaggaaaggcuccc

SEQ ID NO: 966052 - RNA, 20 nt, Human
aaguuuucuccaaauacagu

SEQ ID NO: 966053 - RNA, 22 nt, Human
uuucaguuguccuguuaauagc

SEQ ID NO: 966054 - RNA, 22 nt, Human
ggcauggcuggguucuggugag

SEQ ID NO: 966055 - RNA, 22 nt, Human
cagggaggaugggcuguuuugc

SEQ ID NO: 966056 - RNA, 22 nt, Human
cuggccuuuaaaaugaccuuau

SEQ ID NO: 966057 - RNA, 22 nt, Human
aucauucuaguccuuauggucu

SEQ ID NO: 966058 - RNA, 22 nt, Human
uucucauguaaaugccaucauc

SEQ ID NO: 966059 - RNA, 22 nt, Human
gggacugggagauccuccuggc

SEQ ID NO: 966060 - RNA, 22 nt, Human
aggagcugaagucucugcacuc

SEQ ID NO: 966061 - RNA, 22 nt, Human
ggugauuuucgaguuucauguu

SEQ ID NO: 966062 - RNA, 22 nt, Human
ccucagggacuccaugcugcag

SEQ ID NO: 966063 - RNA, 22 nt, Human
cuacccaggcuggagugcagua

SEQ ID NO: 966064 - RNA, 23 nt, Human
ucaguuuuggcuguucaguguug

SEQ ID NO: 966065 - RNA, 22 nt, Human
uuucauugcagagucugugugc

SEQ ID NO: 966066 - RNA, 22 nt, Human
uguguuaaggugcaucuagugc

SEQ ID NO: 966067 - RNA, 22 nt, Human
gcucccugacucaguuccugag

SEQ ID NO: 966068 - RNA, 22 nt, Human
gcugagagugagcacuggauau

SEQ ID NO: 966069 - RNA, 22 nt, Human
uccuaggcaguuggugcuccau

SEQ ID NO: 966070 - RNA, 22 nt, Human
cuucucagcauuuugucagucu

SEQ ID NO: 966071 - RNA, 22 nt, Human
cugagcugggaguagagacucu

SEQ ID NO: 966072 - RNA, 22 nt, Human
caggaaugacugcagauggggc

SEQ ID NO: 966073 - RNA, 22 nt, Human
ggaccuggcaauuugcaucucu

SEQ ID NO: 966074 - RNA, 22 nt, Human
gcugccagccaacuugcugugc

SEQ ID NO: 966075 - RNA, 22 nt, Human
agagccagcauuugggcccugc

SEQ ID NO: 966076 - RNA, 22 nt, Human
ucccaggaucugagggcagaga

SEQ ID NO: 966077 - RNA, 22 nt, Human
uucauuccuucuguaccuugcc

SEQ ID NO: 966078 - RNA, 22 nt, Human
aaggaguuuggguagucauaca

SEQ ID NO: 966079 - RNA, 22 nt, Human
ccagagagaaauggauuugagu

SEQ ID NO: 966080 - RNA, 22 nt, Human
aacacauauuuauauaugcaca

SEQ ID NO: 966081 - RNA, 22 nt, Human
gcccaggaguucaagucuagug

SEQ ID NO: 966082 - RNA, 22 nt, Human
aagguacaguuuuaagaauaag

SEQ ID NO: 966083 - RNA, 21 nt, Human
uggagacucugguucuuugug

SEQ ID NO: 966084 - RNA, 22 nt, Human
agucagacacguuuuccauuag

SEQ ID NO: 966085 - RNA, 22 nt, Human
gugucacaugguuuacugcagc

SEQ ID NO: 966086 - RNA, 22 nt, Human
uggcuucagacuucugcuacgu

SEQ ID NO: 966087 - RNA, 22 nt, Human
uaccuucaccagcgaauguuug

SEQ ID NO: 966088 - RNA, 22 nt, Human
uuguaacacuuuucuauuaaua

SEQ ID NO: 966089 - RNA, 22 nt, Human
uccuucuuugacaaguggcaga

SEQ ID NO: 966090 - RNA, 19 nt, Human
gggcucuggccucaguggg

SEQ ID NO: 966091 - RNA, 22 nt, Human
ggccucucuccagucagugcag

SEQ ID NO: 966092 - RNA, 22 nt, Human
ucugcuggccuuagcaggucua

SEQ ID NO: 966093 - RNA, 20 nt, Human
cagcaggcuauggggcaccc

SEQ ID NO: 966094 - RNA, 22 nt, Human
aucauucugauggucaaugcua

SEQ ID NO: 966095 - RNA, 22 nt, Human
gcugucacauuuggagcacugg

SEQ ID NO: 966096 - RNA, 22 nt, Human
gaggcugggaaguccaagacca

SEQ ID NO: 966097 - RNA, 22 nt, Human
cagucccacuagugccaauacc

SEQ ID NO: 966098 - RNA, 22 nt, Human
uggcugccuagugucugagcag

SEQ ID NO: 966099 - RNA, 22 nt, Human
gcugccucugcgacucugggcg

SEQ ID NO: 966100 - RNA, 22 nt, Human
auuguguaauuuucagcucaua

SEQ ID NO: 966101 - RNA, 22 nt, Human
gcccaggaaguugaggcugccg

SEQ ID NO: 966102 - RNA, 22 nt, Human
aucagacucugcauugcagucu

SEQ ID NO: 966103 - RNA, 22 nt, Human
uuaaacagacaguaaaugaaac

SEQ ID NO: 966104 - RNA, 22 nt, Human
uuauccaaacuggugaaucauu

SEQ ID NO: 966105 - RNA, 22 nt, Human
gcagacagccagacugcacugg

SEQ ID NO: 966106 - RNA, 22 nt, Human
agcuguguggugucugacagcu

SEQ ID NO: 966107 - RNA, 22 nt, Human
ccugaccuccaaguggcucugg

SEQ ID NO: 966108 - RNA, 22 nt, Human
ucagcugcucuguugagcugaa

SEQ ID NO: 966109 - RNA, 21 nt, Human
uuucaauguguucuuuguagu

SEQ ID NO: 966110 - RNA, 22 nt, Human
uuucaguggguuuauuucaugu

SEQ ID NO: 966111 - RNA, 22 nt, Human
gcagugugaccgagcuugcuuc

SEQ ID NO: 966112 - RNA, 22 nt, Human
augcagcugucagggagaacau

SEQ ID NO: 966113 - RNA, 22 nt, Human
gcauaauauacaugcuugaucc

SEQ ID NO: 966114 - RNA, 22 nt, Human
gccugcagaggugcugcuagcu

SEQ ID NO: 966115 - RNA, 22 nt, Human
cagagaccccgcugcccuucug

SEQ ID NO: 966116 - RNA, 22 nt, Human
cucuuaaauaacaucauugcuu

SEQ ID NO: 966117 - RNA, 22 nt, Human
gggcaggaugcaguuucagaga

SEQ ID NO: 966118 - RNA, 22 nt, Human
uccaggcuggacaugaggcggg

SEQ ID NO: 966119 - RNA, 22 nt, Human
aguggcagagguugacugcagu

SEQ ID NO: 966120 - RNA, 21 nt, Human
ugagagccuccaaccggcuac

SEQ ID NO: 966121 - RNA, 22 nt, Human
aucuggguucaccaugcuccug

SEQ ID NO: 966122 - RNA, 22 nt, Human
cuccucccucuuugccacacau

SEQ ID NO: 966123 - RNA, 21 nt, Human
gccaggaguagauuacauuua

SEQ ID NO: 966124 - RNA, 22 nt, Human
accaggaggaaguguuaaugau

SEQ ID NO: 966125 - RNA, 22 nt, Human
agaagcugacagaugcagcagg

SEQ ID NO: 966126 - RNA, 22 nt, Human
guacauguugguuguuuccagu

SEQ ID NO: 966127 - RNA, 22 nt, Human
acuccuggugcugaugaagaga

SEQ ID NO: 966128 - RNA, 22 nt, Human
gcugucaccaaagcaggcacug

SEQ ID NO: 966129 - RNA, 23 nt, Human
uuuuccagaaucgacucuguaga

SEQ ID NO: 966130 - RNA, 22 nt, Human
gaagcccauuuguacagcacau

SEQ ID NO: 966131 - RNA, 19 nt, Human
agacagagcucaguggguu

SEQ ID NO: 966132 - RNA, 22 nt, Human
gcucugggugaacuuggagcaa

SEQ ID NO: 966133 - RNA, 22 nt, Human
gcuguggcuguacagagaccau

SEQ ID NO: 966134 - RNA, 22 nt, Human
cuucuauaaacugugaucuuuc

SEQ ID NO: 966135 - RNA, 20 nt, Human
ugucaugcauuagaugaaga

SEQ ID NO: 966136 - RNA, 22 nt, Human
ggaugcaggacggcauggaugu

SEQ ID NO: 966137 - RNA, 22 nt, Human
gcugggaagugcaagaucaagg

SEQ ID NO: 966138 - RNA, 22 nt, Human
aaagcagagguugcagugagcu

SEQ ID NO: 966139 - RNA, 22 nt, Human
agcacagauucugaagaguccu

SEQ ID NO: 966140 - RNA, 22 nt, Human
cuccaggccauggcugcggagg

SEQ ID NO: 966141 - RNA, 22 nt, Human
cagggcaguuuuacuucucucu

SEQ ID NO: 966142 - RNA, 22 nt, Human
gcaagauguuaacauagggaga

SEQ ID NO: 966143 - RNA, 22 nt, Human
auccaugauuaguaggauaaag

SEQ ID NO: 966144 - RNA, 22 nt, Human
auguuuuauguuccacucaagg

SEQ ID NO: 966145 - RNA, 22 nt, Human
agugcuuuagcauccaacuguc

SEQ ID NO: 966146 - RNA, 22 nt, Human
gugucauuaaccaccaugcaaa

SEQ ID NO: 966147 - RNA, 20 nt, Human
gagccuuccccucaccacug

SEQ ID NO: 966148 - RNA, 22 nt, Human
gguggccucucaugcaagguag

SEQ ID NO: 966149 - RNA, 22 nt, Human
aggagaggguggcauuaaguuu

SEQ ID NO: 966150 - RNA, 22 nt, Human
cuggcucaugugaugagggcaa

SEQ ID NO: 966151 - RNA, 22 nt, Human
ggcucagagaccugcgaucuga

SEQ ID NO: 966152 - RNA, 22 nt, Human
acugucugcccugagaugccag

SEQ ID NO: 966153 - RNA, 22 nt, Human
uugaagcacaaugucuuuuauc

SEQ ID NO: 966154 - RNA, 22 nt, Human
uccucaggucaaagcaggagaa

SEQ ID NO: 966155 - RNA, 22 nt, Human
agaaauguuacaguuguuauuu

SEQ ID NO: 966156 - RNA, 21 nt, Human
ugcauuccuccauccaacagg

SEQ ID NO: 966157 - RNA, 22 nt, Human
aagucauucuauuucucuaugu

SEQ ID NO: 966158 - RNA, 22 nt, Human
cucaggaucgcuugcccuaggg

SEQ ID NO: 966159 - RNA, 22 nt, Human
aauaugucugcuaauuguuucu

SEQ ID NO: 966160 - RNA, 22 nt, Human
gcacucuguuucuccugucagc

SEQ ID NO: 966161 - RNA, 22 nt, Human
guuauaaaaugcacaguuguuu

SEQ ID NO: 966162 - RNA, 22 nt, Human
uaucuuguaauagguccacuug

SEQ ID NO: 966163 - RNA, 22 nt, Human
gacucguucauaguuccaauuu

SEQ ID NO: 966164 - RNA, 22 nt, Human
cacagcuucugagugaggauuu

SEQ ID NO: 966165 - RNA, 22 nt, Human
aaucucuugggaggaaugaauu

SEQ ID NO: 966166 - RNA, 22 nt, Human
uacaaaguuugagaaugcuuuc

SEQ ID NO: 966167 - RNA, 22 nt, Human
uacuuuaaaaacugauaauuca

SEQ ID NO: 966168 - RNA, 19 nt, Human
ugccuggcaccagcuccac

SEQ ID NO: 966169 - RNA, 22 nt, Human
agcugcucuugggugacuucaa

SEQ ID NO: 966170 - RNA, 22 nt, Human
uugaaaaguuuugaaacacucu

SEQ ID NO: 966171 - RNA, 22 nt, Human
cauugcuguuaauugucucuag

SEQ ID NO: 966172 - RNA, 22 nt, Human
cggagggguuugaacagaggag

SEQ ID NO: 966173 - RNA, 22 nt, Human
uucagaaguagcuaagcaguca

SEQ ID NO: 966174 - RNA, 22 nt, Human
ucacaugcucaccuaagccaca

SEQ ID NO: 966175 - RNA, 22 nt, Human
aggagcuggaguccaggcaagu

SEQ ID NO: 966176 - RNA, 22 nt, Human
uaacagaaauauuuccagguga

SEQ ID NO: 966177 - RNA, 22 nt, Human
ugucuguacaaauuuucugugu

SEQ ID NO: 966178 - RNA, 22 nt, Human
cugucccagauguucucagcac

SEQ ID NO: 966179 - RNA, 22 nt, Human
ugcuggagaucauuaauguuca

SEQ ID NO: 966180 - RNA, 22 nt, Human
gaggaguguauuccacaccacu

SEQ ID NO: 966181 - RNA, 22 nt, Human
cccagcaggucggugcugccug

SEQ ID NO: 966182 - RNA, 22 nt, Human
guagcuuauuagggauaauagu

SEQ ID NO: 966183 - RNA, 23 nt, Human
ggacagggcccugcccuauggcc

SEQ ID NO: 966184 - RNA, 22 nt, Human
uagcccagaagagggaagcaac

SEQ ID NO: 966185 - RNA, 22 nt, Human
uccaggagucuagccucaggcc

SEQ ID NO: 966186 - RNA, 22 nt, Human
gggcagcuggcuuauagguuug

SEQ ID NO: 966187 - RNA, 22 nt, Human
ccugccugguguaagucuaagg

SEQ ID NO: 966188 - RNA, 22 nt, Human
ggcagcaggagccaucugguag

SEQ ID NO: 966189 - RNA, 19 nt, Human
aaaugugaugguacaauuc

SEQ ID NO: 966190 - RNA, 22 nt, Human
gcugccagucuaaugggaaaca

SEQ ID NO: 966191 - RNA, 22 nt, Human
cagugauggauauggagaaguc

SEQ ID NO: 966192 - RNA, 22 nt, Human
uccguauuugacuauugcaccg

SEQ ID NO: 966193 - RNA, 22 nt, Human
ugcucuguauucuauggcaguu

SEQ ID NO: 966194 - RNA, 22 nt, Human
ccaggagacaaagaugacugcu

SEQ ID NO: 966195 - RNA, 22 nt, Human
ccuggcugucguuuugugaaau

SEQ ID NO: 966196 - RNA, 22 nt, Human
gucagaggggcagcugccaggc

SEQ ID NO: 966197 - RNA, 19 nt, Human
ugcugcuguccuugcaggg

SEQ ID NO: 966198 - RNA, 22 nt, Human
ucaauuaugccauugcaauauu

SEQ ID NO: 966199 - RNA, 22 nt, Human
uuuauuagauuaucaaagaggu

SEQ ID NO: 966200 - RNA, 22 nt, Human
aagccgaggccacacagcagga

SEQ ID NO: 966201 - RNA, 22 nt, Human
cuaaauaaucccucuggucuua

SEQ ID NO: 966202 - RNA, 22 nt, Human
uaaggccaaggggccauagucu

SEQ ID NO: 966203 - RNA, 22 nt, Human
ucuuggagacucuuguauauuu

SEQ ID NO: 966204 - RNA, 22 nt, Human
agcugcaggcccaugcucaguc

SEQ ID NO: 966205 - RNA, 22 nt, Human
cucccugguguccccuccagga

SEQ ID NO: 966206 - RNA, 22 nt, Human
caggaaugaggucguaaguguc

SEQ ID NO: 966207 - RNA, 22 nt, Human
uauuaguagcuugaaauuggug

SEQ ID NO: 966208 - RNA, 22 nt, Human
aaaacuacauuugacauuuugu

SEQ ID NO: 966209 - RNA, 22 nt, Human
uguggccuugcagccuggaggu

SEQ ID NO: 966210 - RNA, 22 nt, Human
gaugcacagugacccugccagu

SEQ ID NO: 966211 - RNA, 22 nt, Human
ggccugccucacagucagcacc

SEQ ID NO: 966212 - RNA, 22 nt, Human
ugggggugacuaucucgggaau

SEQ ID NO: 966213 - RNA, 22 nt, Human
uuucagaucauuuuuuaaguac

SEQ ID NO: 966214 - RNA, 22 nt, Human
agcuuccucaccucagaggucu

SEQ ID NO: 966215 - RNA, 22 nt, Human
ggucccagcuggucacugucag

SEQ ID NO: 966216 - RNA, 22 nt, Human
uuauuuaaaauguagguuggga

SEQ ID NO: 966217 - RNA, 22 nt, Human
ugcucugucaagaaaagaugcc

SEQ ID NO: 966218 - RNA, 22 nt, Human
gaggcugcaggcaaugcugccc

SEQ ID NO: 966219 - RNA, 22 nt, Human
ugcccaagcagaggagugauuc

SEQ ID NO: 966220 - RNA, 22 nt, Human
uucagaaugugaccuuauuugg

SEQ ID NO: 966221 - RNA, 22 nt, Human
uauguuuuucaagugcacacua

SEQ ID NO: 966222 - RNA, 22 nt, Human
agaagucauuuauguuagauga

SEQ ID NO: 966223 - RNA, 22 nt, Human
uccucugccaaagggaguugcc

SEQ ID NO: 966224 - RNA, 22 nt, Human
cugagagucagcuucuccuccu

SEQ ID NO: 966225 - RNA, 22 nt, Human
aaauguguauaugaaacaugau

SEQ ID NO: 966226 - RNA, 22 nt, Human
uggugcugacaguucugagugc

SEQ ID NO: 966227 - RNA, 22 nt, Human
uguugauuaguguuuagacuua

SEQ ID NO: 966228 - RNA, 22 nt, Human
caggguuucaccauguuagcag

SEQ ID NO: 966229 - RNA, 22 nt, Human
cccaggaacagggcucagaccc

SEQ ID NO: 966230 - RNA, 22 nt, Human
ucuugaaggggggcaguguuga

SEQ ID NO: 966231 - RNA, 22 nt, Human
gagagcccugcuccuaucccag

SEQ ID NO: 966232 - RNA, 22 nt, Human
uagacacaagagaaggguauaa

SEQ ID NO: 966233 - RNA, 22 nt, Human
caguuuaaaugagugacugcag

SEQ ID NO: 966234 - RNA, 21 nt, Human
uucaaaguuugccuaaagauu

SEQ ID NO: 966235 - RNA, 22 nt, Human
caagaaauuucuuaagaacuaa

SEQ ID NO: 966236 - RNA, 22 nt, Human
uaguuuaauggucaacuaauga

SEQ ID NO: 966237 - RNA, 22 nt, Human
ccugccugcggcccgcggggag

SEQ ID NO: 966238 - RNA, 22 nt, Human
gccaggcauucuagaaguagug

SEQ ID NO: 966239 - RNA, 20 nt, Human
augugucuguaaacaacucu

SEQ ID NO: 966240 - RNA, 18 nt, Human
aggccagcccugcuacug

SEQ ID NO: 966241 - RNA, 23 nt, Human
aucaaacuggugagaaugucagu

SEQ ID NO: 966242 - RNA, 22 nt, Human
uccaagggcucauggacacuuu

SEQ ID NO: 966243 - RNA, 22 nt, Human
agaggcuccuagccacuggcuu

SEQ ID NO: 966244 - RNA, 18 nt, Human
uaggagagaauuuauuua

SEQ ID NO: 966245 - RNA, 22 nt, Human
gcucugcucuaacauuccugac

SEQ ID NO: 966246 - RNA, 22 nt, Human
gcugucucggggcuuucuccug

SEQ ID NO: 966247 - RNA, 22 nt, Human
ccaggcugggcuacaaguugag

SEQ ID NO: 966248 - RNA, 22 nt, Human
gggucugaggaguaccauuguc

SEQ ID NO: 966249 - RNA, 22 nt, Human
agcagagccaggucucucugua

SEQ ID NO: 966250 - RNA, 22 nt, Human
ucaaauguucccuguacuggcc

SEQ ID NO: 966251 - RNA, 23 nt, Human
cauuucugggagauuuauaaaau

SEQ ID NO: 966252 - RNA, 22 nt, Human
aguggccagugcugcucugggg

SEQ ID NO: 966253 - RNA, 22 nt, Human
aggcagcaugggccccagcucc

SEQ ID NO: 966254 - RNA, 22 nt, Human
gaaggucaccuccccucucugg

SEQ ID NO: 966255 - RNA, 22 nt, Human
agcagcuguacuuucaucuguu

SEQ ID NO: 966256 - RNA, 22 nt, Human
uucaaugagcccaagaacguga

SEQ ID NO: 966257 - RNA, 22 nt, Human
gagugugggcacgggggccuug

SEQ ID NO: 966258 - RNA, 20 nt, Human
gccuggcacccggggcuggc

SEQ ID NO: 966259 - RNA, 22 nt, Human
agcagggccucuggcacugguc

SEQ ID NO: 966260 - RNA, 22 nt, Human
cugggcugcaucaaagaggcau

SEQ ID NO: 966261 - RNA, 22 nt, Human
ugaacaguuucaagaaaacuuu

SEQ ID NO: 966262 - RNA, 22 nt, Human
aaauaguuguuuggaucaauaa

SEQ ID NO: 966263 - RNA, 20 nt, Human
gcagagccucacugcaaggg

SEQ ID NO: 966264 - RNA, 22 nt, Human
ucuacccagagcuaugaccuga

SEQ ID NO: 966265 - RNA, 22 nt, Human
ggcuuggaccagucacaguggu

SEQ ID NO: 966266 - RNA, 22 nt, Human
cugggguggaggagcuccccug

SEQ ID NO: 966267 - RNA, 22 nt, Human
ucagagaguuggaaagaauuaa

SEQ ID NO: 966268 - RNA, 22 nt, Human
gagagcugucagcguagcaccg

SEQ ID NO: 966269 - RNA, 22 nt, Human
cuugcugggguaagucugugcu

SEQ ID NO: 966270 - RNA, 22 nt, Human
ugcuuaauauugugauguaaua

SEQ ID NO: 966271 - RNA, 22 nt, Human
augggcaugcuucuaguugaaa

SEQ ID NO: 966272 - RNA, 22 nt, Human
ugauuuccaugaagcugaaggc

SEQ ID NO: 966273 - RNA, 22 nt, Human
uggcuguggacucagauggcuc

SEQ ID NO: 966274 - RNA, 22 nt, Human
uucuuaagaggaacauuuuugu

SEQ ID NO: 966275 - RNA, 22 nt, Human
aagaugcuuauugcuccugcag

SEQ ID NO: 966276 - RNA, 22 nt, Human
gggcagggguagcauuccaagu

SEQ ID NO: 966277 - RNA, 22 nt, Human
aaugccaguguguugauuccag

SEQ ID NO: 966278 - RNA, 22 nt, Human
ccuccugguccagcaucucuuu

SEQ ID NO: 966279 - RNA, 22 nt, Human
acugugcaaugaguaauaaacu

SEQ ID NO: 966280 - RNA, 22 nt, Human
aggagagagaacacuugggucc

SEQ ID NO: 966281 - RNA, 22 nt, Human
gucaggaugcuauuguuauuaa

SEQ ID NO: 966282 - RNA, 22 nt, Human
acacugcucacuucuucccuug

SEQ ID NO: 966283 - RNA, 22 nt, Human
acuuugcacuaaguuacucauu

SEQ ID NO: 966284 - RNA, 22 nt, Human
aaguuacuggcaagggcugcag

SEQ ID NO: 966285 - RNA, 22 nt, Human
uucaacuagauuuauacaauuc

SEQ ID NO: 966286 - RNA, 22 nt, Human
cagcacuggggggauucggagc

SEQ ID NO: 966287 - RNA, 22 nt, Human
gcaguaaaaaaggauaugugca

SEQ ID NO: 966288 - RNA, 22 nt, Human
uauuggauagcuugugcagaau

SEQ ID NO: 966289 - RNA, 22 nt, Human
aaauuagucgguuuaggaauuu

SEQ ID NO: 966290 - RNA, 22 nt, Human
ugucuucagcaaaugccuuucu

SEQ ID NO: 966291 - RNA, 22 nt, Human
gccaccaggagcccaguccaaa

SEQ ID NO: 966292 - RNA, 22 nt, Human
cccaggaaacccgaaggcgacc

SEQ ID NO: 966293 - RNA, 22 nt, Human
auggaaagggaagcaaggaaca

SEQ ID NO: 966294 - RNA, 22 nt, Human
gugcugugugauccaugcuggc

SEQ ID NO: 966295 - RNA, 22 nt, Human
uacaaacuuguuuuaaguaagu

SEQ ID NO: 966296 - RNA, 22 nt, Human
ugccugugucacagugauguuu

SEQ ID NO: 966297 - RNA, 23 nt, Human
gggggcugguugacucucugcag

SEQ ID NO: 966298 - RNA, 21 nt, Human
cagagcagcguucugcugugg

SEQ ID NO: 966299 - RNA, 20 nt, Human
uaugaguauuacuuucagga

SEQ ID NO: 966300 - RNA, 22 nt, Human
gaaggagacccugaagaugcug

SEQ ID NO: 966301 - RNA, 18 nt, Human
ccucagggagagagacgc

SEQ ID NO: 966302 - RNA, 22 nt, Human
uuuucucuacaaaauaaccagc

SEQ ID NO: 966303 - RNA, 22 nt, Human
agcagcauguugggaugugaaa

SEQ ID NO: 966304 - RNA, 22 nt, Human
cuggagccccagacagggagag

SEQ ID NO: 966305 - RNA, 22 nt, Human
ucuacugugguccuuguaacca

SEQ ID NO: 966306 - RNA, 22 nt, Human
auauauaagcugaugagccaca

SEQ ID NO: 966307 - RNA, 22 nt, Human
gacaauaaaaugaucuuacagu

SEQ ID NO: 966308 - RNA, 22 nt, Human
cgaggcagacaaaaguuggaag

SEQ ID NO: 966309 - RNA, 22 nt, Human
gcugcccagcaggccccagggg

SEQ ID NO: 966310 - RNA, 22 nt, Human
cugaaggacuuggugauaguug

SEQ ID NO: 966311 - RNA, 22 nt, Human
ccucuggguaucuguggaagua

SEQ ID NO: 966312 - RNA, 22 nt, Human
agucugcuuccuggagaacuca

SEQ ID NO: 966313 - RNA, 22 nt, Human
aggggagcuaacaccagagccc

SEQ ID NO: 966314 - RNA, 17 nt, Human
cgagggcuugcuggcuc

SEQ ID NO: 966315 - RNA, 22 nt, Human
uggcucagauaauucaaggggc

SEQ ID NO: 966316 - RNA, 22 nt, Human
ucauugcagugauguuguaugu

SEQ ID NO: 966317 - RNA, 22 nt, Human
aagcacagaaaaggagcaugga

SEQ ID NO: 966318 - RNA, 22 nt, Human
cuccugugggucaccaauaggc

SEQ ID NO: 966319 - RNA, 22 nt, Human
auggcagggcagccucucagag

SEQ ID NO: 966320 - RNA, 22 nt, Human
uggagggcaugcuguccauggg

SEQ ID NO: 966321 - RNA, 22 nt, Human
gagagcuguaauagucaugucu

SEQ ID NO: 966322 - RNA, 22 nt, Human
uggaggcaucagagugcuuggc

SEQ ID NO: 966323 - RNA, 22 nt, Human
auuuaagauugcguauucaugu

SEQ ID NO: 966324 - RNA, 22 nt, Human
aggcagcuucugauuagcagcg

SEQ ID NO: 966325 - RNA, 22 nt, Human
uaacuuugauaagaaucaggga

SEQ ID NO: 966326 - RNA, 22 nt, Human
auaguauuuaauaguuagcuca

SEQ ID NO: 966327 - RNA, 22 nt, Human
aucuucaacuugaucauuugaa

SEQ ID NO: 966328 - RNA, 22 nt, Human
agagucuuuugucaguaauguu

SEQ ID NO: 966329 - RNA, 22 nt, Human
aggcagcauccagaggagaaug

SEQ ID NO: 966330 - RNA, 22 nt, Human
gaaaggccauuucugaggguuu

SEQ ID NO: 966331 - RNA, 22 nt, Human
aggcacugaaagguggccagag

SEQ ID NO: 966332 - RNA, 22 nt, Human
gucucagggacugcuucugggg

SEQ ID NO: 966333 - RNA, 20 nt, Human
caggccagagguuugauggc

SEQ ID NO: 966334 - RNA, 22 nt, Human
cugcaucaguggauaugauggu

SEQ ID NO: 966335 - RNA, 22 nt, Human
cccacaggcuagggguagggca

SEQ ID NO: 966336 - RNA, 22 nt, Human
auguguuuguaccuuuaaauau

SEQ ID NO: 966337 - RNA, 18 nt, Human
ugagagugugugcucuug

SEQ ID NO: 966338 - RNA, 22 nt, Human
ggaggggaacuaaucccgugac

SEQ ID NO: 966339 - RNA, 22 nt, Human
ugauucuuugaccaaaaaauug

SEQ ID NO: 966340 - RNA, 22 nt, Human
aggggcugacuggaaagugcca

SEQ ID NO: 966341 - RNA, 22 nt, Human
guguuuccucuagaagccaugg

SEQ ID NO: 966342 - RNA, 22 nt, Human
augucuuuauaaauguauaaug

SEQ ID NO: 966343 - RNA, 22 nt, Human
ugcaccuucauuuuaggcagcu

SEQ ID NO: 966344 - RNA, 22 nt, Human
acucugcuguuuacucucuaua

SEQ ID NO: 966345 - RNA, 22 nt, Human
uaugaaauuuaaacacagauca

SEQ ID NO: 966346 - RNA, 22 nt, Human
gcugagcugaggcagggcuggg

SEQ ID NO: 966347 - RNA, 22 nt, Human
cugucaucacaguugagcagcc

SEQ ID NO: 966348 - RNA, 20 nt, Human
gucaggauuaguaaacucug

SEQ ID NO: 966349 - RNA, 22 nt, Human
cccuggagugccggaaucaaga

SEQ ID NO: 966350 - RNA, 22 nt, Human
cacuguguaagaagaugggcuu

SEQ ID NO: 966351 - RNA, 22 nt, Human
uaaggccagccagcaaaucugu

SEQ ID NO: 966352 - RNA, 22 nt, Human
cagcauggugccagugagucca

SEQ ID NO: 966353 - RNA, 21 nt, Human
ugauuuccaucuuaaaauaaa

SEQ ID NO: 966354 - RNA, 22 nt, Human
guuuacauauuuuaauugguga

SEQ ID NO: 966355 - RNA, 23 nt, Human
aggagccaggugcagcccuugug

SEQ ID NO: 966356 - RNA, 22 nt, Human
aaggcacuguacuaguuaguua

SEQ ID NO: 966357 - RNA, 22 nt, Human
ucagggacuaggugcugccuga

SEQ ID NO: 966358 - RNA, 22 nt, Human
cuucagaacuauaaaaaguacu

SEQ ID NO: 966359 - RNA, 22 nt, Human
gcacagaacuucucuuaguagg

SEQ ID NO: 966360 - RNA, 22 nt, Human
gcagagcccuggggguauggug

SEQ ID NO: 966361 - RNA, 17 nt, Human
uuccccugaccaagccu

SEQ ID NO: 966362 - RNA, 22 nt, Human
uugaaagaggcaaaguuugauc

SEQ ID NO: 966363 - RNA, 22 nt, Human
cucagaguccccaguggguuug

SEQ ID NO: 966364 - RNA, 22 nt, Human
ugaugggacugccagcugcuga

SEQ ID NO: 966365 - RNA, 22 nt, Human
aguuuuucugcuggucucacua

SEQ ID NO: 966366 - RNA, 22 nt, Human
aagggcaggugggcauuucugg

SEQ ID NO: 966367 - RNA, 22 nt, Human
gcccaggagguugggcugugca

SEQ ID NO: 966368 - RNA, 22 nt, Human
uuaacagauguuuauggagcau

SEQ ID NO: 966369 - RNA, 20 nt, Human
agcugguuaucuuaauucuu

SEQ ID NO: 966370 - RNA, 22 nt, Human
uuccaguugguagaauguaagg

SEQ ID NO: 966371 - RNA, 17 nt, Human
uggcucugaggcugaau

SEQ ID NO: 966372 - RNA, 22 nt, Human
gauauuuugagaaauccuauga

SEQ ID NO: 966373 - RNA, 22 nt, Human
aggcagcuuuaacugguaguag

SEQ ID NO: 966374 - RNA, 22 nt, Human
gacccagcuuaagucacauguu

SEQ ID NO: 966375 - RNA, 22 nt, Human
aagcugccaccagcccagggca

SEQ ID NO: 966376 - RNA, 22 nt, Human
agcuggcagucauccuagugag

SEQ ID NO: 966377 - RNA, 22 nt, Human
ucaguuuuguauguuguaaguc

SEQ ID NO: 966378 - RNA, 22 nt, Human
agucucagccacacagaccuau

SEQ ID NO: 966379 - RNA, 22 nt, Human
uggcccugcuguaucaucugcu

SEQ ID NO: 966380 - RNA, 21 nt, Human
ucucugggcccuccugugggg

SEQ ID NO: 966381 - RNA, 22 nt, Human
cuagccugggauuugaacuuau

SEQ ID NO: 966382 - RNA, 22 nt, Human
ugagagagccugaaucucuuac

SEQ ID NO: 966383 - RNA, 22 nt, Human
cuggcugcuggccugaggaugc

SEQ ID NO: 966384 - RNA, 22 nt, Human
uuugcauaagucauguccagug

SEQ ID NO: 966385 - RNA, 22 nt, Human
ucagaagccggaagugcuccuc

SEQ ID NO: 966386 - RNA, 22 nt, Human
aacuaaaucuggcauuuagagc

SEQ ID NO: 966387 - RNA, 22 nt, Human
uggaucucggcaaugcgggacu

SEQ ID NO: 966388 - RNA, 22 nt, Human
cucugggcacauuuuccaggac

SEQ ID NO: 966389 - RNA, 22 nt, Human
agugcagugguuaggagccagg

SEQ ID NO: 966390 - RNA, 18 nt, Human
gcagcuagccaggggggc

SEQ ID NO: 966391 - RNA, 22 nt, Human
cuguccuguagcuccaucaguc

SEQ ID NO: 966392 - RNA, 21 nt, Human
uuugaaagcuacaucuauagc

SEQ ID NO: 966393 - RNA, 22 nt, Human
ccagaggaaaaauaucucccua

SEQ ID NO: 966394 - RNA, 22 nt, Human
cccucugccucugaguaggaca

SEQ ID NO: 966395 - RNA, 22 nt, Human
aggcccugcccagagcuccucg

SEQ ID NO: 966396 - RNA, 22 nt, Human
uuauuccauuauuucacuuagg

SEQ ID NO: 966397 - RNA, 22 nt, Human
ccuggagcacagcccaguccca

SEQ ID NO: 966398 - RNA, 22 nt, Human
ggagaggcgaugagucacagcc

SEQ ID NO: 966399 - RNA, 22 nt, Human
gagccuggagcuggaacgaagc

SEQ ID NO: 966400 - RNA, 22 nt, Human
gaaggccauuuuuagguagaau

SEQ ID NO: 966401 - RNA, 22 nt, Human
cccucagcuucucccugcagcu

SEQ ID NO: 966402 - RNA, 22 nt, Human
cccugcagaaccacagacaaac

SEQ ID NO: 966403 - RNA, 22 nt, Human
ggcccuguuagagcucccacaa

SEQ ID NO: 966404 - RNA, 22 nt, Human
gcugucaggccaugugggccuu

SEQ ID NO: 966405 - RNA, 22 nt, Human
uccagccuaggggaacagcugc

SEQ ID NO: 966406 - RNA, 22 nt, Human
uugaaggacaucuuguuucuag

SEQ ID NO: 966407 - RNA, 22 nt, Human
agccacagguguuggccagugu

SEQ ID NO: 966408 - RNA, 22 nt, Human
aucuggcucauucagggaacgg

SEQ ID NO: 966409 - RNA, 19 nt, Human
cuuugucagaacaugcuuc

SEQ ID NO: 966410 - RNA, 22 nt, Human
cccaguuucaacuuuccagugg

SEQ ID NO: 966411 - RNA, 22 nt, Human
agcagccaauuggaggaugaag

SEQ ID NO: 966412 - RNA, 22 nt, Human
ccacagggccuuuccugcuggc

SEQ ID NO: 966413 - RNA, 22 nt, Human
cauuuguacagaacagcuuuau

SEQ ID NO: 966414 - RNA, 22 nt, Human
cuagaaaugcucaagagaaagu

SEQ ID NO: 966415 - RNA, 22 nt, Human
auuuucuaagccugucagacuu

SEQ ID NO: 966416 - RNA, 22 nt, Human
agaagauuuagguugacgcuau

SEQ ID NO: 966417 - RNA, 22 nt, Human
uugcuauuuugagagucauagu

SEQ ID NO: 966418 - RNA, 22 nt, Human
gggcagcuggccagguauucug

SEQ ID NO: 966419 - RNA, 22 nt, Human
guacuucccugggaggcaagca

SEQ ID NO: 966420 - RNA, 22 nt, Human
gcaccugauugauuucacugcu

SEQ ID NO: 966421 - RNA, 22 nt, Human
cagcugacagugaggugggggc

SEQ ID NO: 966422 - RNA, 22 nt, Human
uguauauucugccuaaaagcuu

SEQ ID NO: 966423 - RNA, 22 nt, Human
uccuuuuuaagucguuguggua

SEQ ID NO: 966424 - RNA, 22 nt, Human
uuugaaagcaccauuugaguag

SEQ ID NO: 966425 - RNA, 22 nt, Human
cagagcugcacauucuaugaug

SEQ ID NO: 966426 - RNA, 22 nt, Human
agaaaucauucccaaacccaua

SEQ ID NO: 966427 - RNA, 22 nt, Human
auucacaaaugcugccccauuc

SEQ ID NO: 966428 - RNA, 22 nt, Human
ucaagagagugcugcuuggggu

SEQ ID NO: 966429 - RNA, 22 nt, Human
gggagggaucugcuaggcaaug

SEQ ID NO: 966430 - RNA, 22 nt, Human
uccuguuuaucugugugacucg

SEQ ID NO: 966431 - RNA, 22 nt, Human
augugucucuaccaaugcaauu

SEQ ID NO: 966432 - RNA, 22 nt, Human
cagcaggcguugggagaaagac

SEQ ID NO: 966433 - RNA, 22 nt, Human
gaugcacuuucuuuucaacagu

SEQ ID NO: 966434 - RNA, 22 nt, Human
ucuuugcaucccuuccauaguu

SEQ ID NO: 966435 - RNA, 22 nt, Human
uuuccuuccaaaugcccgggag

SEQ ID NO: 966436 - RNA, 22 nt, Human
uuuauuuauaagccacuugcug

SEQ ID NO: 966437 - RNA, 22 nt, Human
aggcccuggucaggucuggcug

SEQ ID NO: 966438 - RNA, 22 nt, Human
aaggcagccgugugacugcaug

SEQ ID NO: 966439 - RNA, 22 nt, Human
cugagccagcgggcucacuuuu

SEQ ID NO: 966440 - RNA, 22 nt, Human
aaaguguugggauuacaggugu

SEQ ID NO: 966441 - RNA, 22 nt, Human
ccagaggcuggcagccagcuga

SEQ ID NO: 966442 - RNA, 22 nt, Human
cacacuagucuauccauuagcu

SEQ ID NO: 966443 - RNA, 22 nt, Human
cagaaauggagcccaggaaucu

SEQ ID NO: 966444 - RNA, 22 nt, Human
gccugucaauuuuguguacaau

SEQ ID NO: 966445 - RNA, 22 nt, Human
ugggugaggaugaugaggcagc

SEQ ID NO: 966446 - RNA, 22 nt, Human
gcugccugaagugucuacacug

SEQ ID NO: 966447 - RNA, 19 nt, Human
acuuccugcccgcuccuuu

SEQ ID NO: 966448 - RNA, 22 nt, Human
gagucuuugguaaagucugcug

SEQ ID NO: 966449 - RNA, 20 nt, Human
ucacagaaacaaauagagaa

SEQ ID NO: 966450 - RNA, 18 nt, Human
agcagaauucuaggguuc

SEQ ID NO: 966451 - RNA, 22 nt, Human
ggcucagguuuaaagugcuuua

SEQ ID NO: 966452 - RNA, 22 nt, Human
gccaggcauuuguuaggugcug

SEQ ID NO: 966453 - RNA, 22 nt, Human
ugcugggcuugaaagcugcuaa

SEQ ID NO: 966454 - RNA, 23 nt, Human
cugcugugaaacaugguuuuggu

SEQ ID NO: 966455 - RNA, 22 nt, Human
aguauacauauauuagccuucg

SEQ ID NO: 966456 - RNA, 22 nt, Human
cuugcaggcagggccuccugga

SEQ ID NO: 966457 - RNA, 18 nt, Human
ugaauagggguuugcaga

SEQ ID NO: 966458 - RNA, 22 nt, Human
uagggcagccuuauagcuccca

SEQ ID NO: 966459 - RNA, 22 nt, Human
cagucacacaaguggacuuggg

SEQ ID NO: 966460 - RNA, 22 nt, Human
acagaaauuagcagugaguuua

SEQ ID NO: 966461 - RNA, 23 nt, Human
ucucaagaggaagcagggcucau

SEQ ID NO: 966462 - RNA, 22 nt, Human
gcucccacaaccuucuugcucc

SEQ ID NO: 966463 - RNA, 22 nt, Human
gggcugacucugcacugagcca

SEQ ID NO: 966464 - RNA, 22 nt, Human
cugucacacugauaucaggcuu

SEQ ID NO: 966465 - RNA, 21 nt, Human
caggaaaagcggaagucuagc

SEQ ID NO: 966466 - RNA, 22 nt, Human
uagauuuuaggagauuuuacug

SEQ ID NO: 966467 - RNA, 22 nt, Human
uuuaggaucucucuuguuacau

SEQ ID NO: 966468 - RNA, 22 nt, Human
ugcuagaauaccuaccuggagg

SEQ ID NO: 966469 - RNA, 22 nt, Human
gcugggaggaucucucccuguc

SEQ ID NO: 966470 - RNA, 22 nt, Human
uagauuucucauucauagauug

SEQ ID NO: 966471 - RNA, 22 nt, Human
cacucugccugauguuacaugg

SEQ ID NO: 966472 - RNA, 22 nt, Human
aauagcucacugauuucucuuu

SEQ ID NO: 966473 - RNA, 22 nt, Human
uagcagggccaggcugggaacc

SEQ ID NO: 966474 - RNA, 22 nt, Human
uugucugaaagaucauuacauu

SEQ ID NO: 966475 - RNA, 22 nt, Human
cugaagcaaaugaaacagcucu

SEQ ID NO: 966476 - RNA, 22 nt, Human
gcucugaggcugugaggugcug

SEQ ID NO: 966477 - RNA, 22 nt, Human
cagauccacccuuguagugaca

SEQ ID NO: 966478 - RNA, 22 nt, Human
cuggccugaggucggcuguagg

SEQ ID NO: 966479 - RNA, 22 nt, Human
ugguuuugcuccaguauaaaua

SEQ ID NO: 966480 - RNA, 23 nt, Human
cugcuguguuggucucgauggga

SEQ ID NO: 966481 - RNA, 22 nt, Human
uaacacugauuuguucucaggg

SEQ ID NO: 966482 - RNA, 20 nt, Human
uuggcagcuucaggguacua

SEQ ID NO: 966483 - RNA, 22 nt, Human
auggagggugucagagagcgaa

SEQ ID NO: 966484 - RNA, 22 nt, Human
ccuggcagcagcacaugccuuc

SEQ ID NO: 966485 - RNA, 22 nt, Human
auagauacauuagguaacuugu

SEQ ID NO: 966486 - RNA, 22 nt, Human
cacaauuuccuugcuucacuuu

SEQ ID NO: 966487 - RNA, 19 nt, Human
ggaagagaggaaaggugga

SEQ ID NO: 966488 - RNA, 22 nt, Human
aaaaccaggcguuuccuauuau

SEQ ID NO: 966489 - RNA, 17 nt, Human
acagggcagaaacagcu

SEQ ID NO: 966490 - RNA, 22 nt, Human
caggggacauuaaagcuccaua

SEQ ID NO: 966491 - RNA, 22 nt, Human
agggacaguuacaucaucagac

SEQ ID NO: 966492 - RNA, 22 nt, Human
cuggcagucacggccaugugcu

SEQ ID NO: 966493 - RNA, 22 nt, Human
gccucugggcucugccccuggc

SEQ ID NO: 966494 - RNA, 22 nt, Human
ggacacagcugcagccacaccc

SEQ ID NO: 966495 - RNA, 22 nt, Human
gcaggcuccaggccggccccuu

SEQ ID NO: 966496 - RNA, 18 nt, Human
uccuggccacacuaccuu

SEQ ID NO: 966497 - RNA, 22 nt, Human
agggccagggaagcuguauuuu

SEQ ID NO: 966498 - RNA, 23 nt, Human
caggcaggaugaggacuacacuc

SEQ ID NO: 966499 - RNA, 22 nt, Human
ccuccagcugccucagucucuu

SEQ ID NO: 966500 - RNA, 22 nt, Human
gugcaugugcauccauguguac

SEQ ID NO: 966501 - RNA, 22 nt, Human
accuggcacuacaggcaccugu

SEQ ID NO: 966502 - RNA, 19 nt, Human
uuucaauggcuuagagaaa

SEQ ID NO: 966503 - RNA, 22 nt, Human
aggaggccgauuucagaggucg

SEQ ID NO: 966504 - RNA, 22 nt, Human
caacagcugaucuuugaugaag

SEQ ID NO: 966505 - RNA, 22 nt, Human
ggccuggagaaggcccagggag

SEQ ID NO: 966506 - RNA, 22 nt, Human
auguaauaggguaacauaacau

SEQ ID NO: 966507 - RNA, 22 nt, Human
uauuuccaccuauuauuuucug

SEQ ID NO: 966508 - RNA, 22 nt, Human
aaucagaaaauucaguggaauu

SEQ ID NO: 966509 - RNA, 22 nt, Human
cugggcuucucccccuggcaga

SEQ ID NO: 966510 - RNA, 22 nt, Human
gcuggccuccugcuagauggaa

SEQ ID NO: 966511 - RNA, 22 nt, Human
gagccuggauagccuuguucca

SEQ ID NO: 966512 - RNA, 22 nt, Human
ccugggagugucagacuugcuu

SEQ ID NO: 966513 - RNA, 22 nt, Human
ggcauguuucaucacaucaaga

SEQ ID NO: 966514 - RNA, 22 nt, Human
uuuaaauggcauuuucccagau

SEQ ID NO: 966515 - RNA, 22 nt, Human
aggagcugacuuguaaagcauu

SEQ ID NO: 966516 - RNA, 22 nt, Human
gaggcccaguccugcaagcacg

SEQ ID NO: 966517 - RNA, 21 nt, Human
uuucacaaaaguaugugacaa

SEQ ID NO: 966518 - RNA, 22 nt, Human
auauuucuggggguguguuucu

SEQ ID NO: 966519 - RNA, 22 nt, Human
caggcagccaggggaccugucc

SEQ ID NO: 966520 - RNA, 22 nt, Human
cagucccuaguggagcucacag

SEQ ID NO: 966521 - RNA, 22 nt, Human
cugagcugcucccgcugcagcg

SEQ ID NO: 966522 - RNA, 22 nt, Human
uuuccucacuucaugagaguuu

SEQ ID NO: 966523 - RNA, 22 nt, Human
ggacagaggguugacagaguau

SEQ ID NO: 966524 - RNA, 22 nt, Human
gccaggcuguggggaacuugaa

SEQ ID NO: 966525 - RNA, 22 nt, Human
ggguccagacacuccagaggaa

SEQ ID NO: 966526 - RNA, 22 nt, Human
ucugggaacacacgucacuuca

SEQ ID NO: 966527 - RNA, 22 nt, Human
gucaggauuauuuuauuaaaag

SEQ ID NO: 966528 - RNA, 22 nt, Human
caggagugucuccacacagcaa

SEQ ID NO: 966529 - RNA, 22 nt, Human
ucugccaccuucauccuccacu

SEQ ID NO: 966530 - RNA, 17 nt, Human
ugagcaguagaagaugc

SEQ ID NO: 966531 - RNA, 19 nt, Human
acacugaauguagaauugg

SEQ ID NO: 966532 - RNA, 20 nt, Human
uauuugaaauggccaagugu

SEQ ID NO: 966533 - RNA, 22 nt, Human
ugucauguguucuuaaauacau

SEQ ID NO: 966534 - RNA, 22 nt, Human
uuggcagcccagcuuacuagca

SEQ ID NO: 966535 - RNA, 21 nt, Human
cucaaagaccaaaaguguaga

SEQ ID NO: 966536 - RNA, 22 nt, Human
guuuucugauuagcaaaucuga

SEQ ID NO: 966537 - RNA, 20 nt, Human
ugcucaggauggagaggugu

SEQ ID NO: 966538 - RNA, 22 nt, Human
aaaucacuaaguuauagugugg

SEQ ID NO: 966539 - RNA, 22 nt, Human
gucccuggaauggacucugcgc

SEQ ID NO: 966540 - RNA, 22 nt, Human
agaccauggccauccuaggaaa

SEQ ID NO: 966541 - RNA, 23 nt, Human
acagaggcuuaaaugaguggcag

SEQ ID NO: 966542 - RNA, 22 nt, Human
agugggcagcccaggaggucuu

SEQ ID NO: 966543 - RNA, 22 nt, Human
gagugcagaugccagccccagu

SEQ ID NO: 966544 - RNA, 22 nt, Human
gggauggcucaaaggagucagg

SEQ ID NO: 966545 - RNA, 22 nt, Human
cagaggugcauacaggucauua

SEQ ID NO: 966546 - RNA, 22 nt, Human
gacagcaggaugugaggggaug

SEQ ID NO: 966547 - RNA, 22 nt, Human
cucuucuuauggccguggcuga

SEQ ID NO: 966548 - RNA, 22 nt, Human
ugcuggcuguauaugugagagu

SEQ ID NO: 966549 - RNA, 23 nt, Human
ggcagagagcauggcuggggccc

SEQ ID NO: 966550 - RNA, 22 nt, Human
ucacaaauauuuuaacaguagg

SEQ ID NO: 966551 - RNA, 22 nt, Human
agggagcugcucugcuuccgug

SEQ ID NO: 966552 - RNA, 22 nt, Human
ucuccuggucaccucagaaguc

SEQ ID NO: 966553 - RNA, 22 nt, Human
cagaguggcagucccaggccca

SEQ ID NO: 966554 - RNA, 22 nt, Human
uacaaaguaauguauaauaucg

SEQ ID NO: 966555 - RNA, 22 nt, Human
uaauuuaauuucaugccagccu

SEQ ID NO: 966556 - RNA, 22 nt, Human
uggcagcuuccugcucauagga

SEQ ID NO: 966557 - RNA, 22 nt, Human
gcagagugaggaagagcuucca

SEQ ID NO: 966558 - RNA, 22 nt, Human
agguaagggucacaguucauau

SEQ ID NO: 966559 - RNA, 22 nt, Human
ccugcagacacuuguccagcaa

SEQ ID NO: 966560 - RNA, 22 nt, Human
acagugugugcuuucccuuacg

SEQ ID NO: 966561 - RNA, 22 nt, Human
ucagagguaagggcugagagga

SEQ ID NO: 966562 - RNA, 22 nt, Human
gagagugucgggggccccagga

SEQ ID NO: 966563 - RNA, 22 nt, Human
gccagguggucuggcuccagag

SEQ ID NO: 966564 - RNA, 22 nt, Human
cacagcuuaugccacugauugg

SEQ ID NO: 966565 - RNA, 20 nt, Human
uugaggagauauugaauacu

SEQ ID NO: 966566 - RNA, 22 nt, Human
agagacaggauaucugcucaug

SEQ ID NO: 966567 - RNA, 22 nt, Human
caugaaaauaacauuguuguga

SEQ ID NO: 966568 - RNA, 22 nt, Human
gaggggcuggcacgauggcugc

SEQ ID NO: 966569 - RNA, 22 nt, Human
cugauuccugauucaugcucuu

SEQ ID NO: 966570 - RNA, 22 nt, Human
gaauguaauagucaguagaaca

SEQ ID NO: 966571 - RNA, 22 nt, Human
aucaaaguucguaacugauaac

SEQ ID NO: 966572 - RNA, 22 nt, Human
uccaggagguugagacugcagu

SEQ ID NO: 966573 - RNA, 21 nt, Human
cagaggccucaugcucugugc

SEQ ID NO: 966574 - RNA, 22 nt, Human
gaaacuguauguaguuuuuggg

SEQ ID NO: 966575 - RNA, 19 nt, Human
ugaagcaggcagagaagau

SEQ ID NO: 966576 - RNA, 22 nt, Human
gcaggccuccccugcuggagcu

SEQ ID NO: 966577 - RNA, 22 nt, Human
gagagggauacugaguuuuggu

SEQ ID NO: 966578 - RNA, 23 nt, Human
uggggcugauggagacggaccag

SEQ ID NO: 966579 - RNA, 22 nt, Human
cagcagggcccccgggugcgcc

SEQ ID NO: 966580 - RNA, 22 nt, Human
agagccagguguagucucggag

SEQ ID NO: 966581 - RNA, 22 nt, Human
aaagcagaggugauaugacuua

SEQ ID NO: 966582 - RNA, 22 nt, Human
aaagguuugcauggaauuuacc

SEQ ID NO: 966583 - RNA, 21 nt, Human
uccucugcucucauaccacaa

SEQ ID NO: 966584 - RNA, 22 nt, Human
ucacucugguccauccgagagc

SEQ ID NO: 966585 - RNA, 17 nt, Human
ggcagccucaggcguuu

SEQ ID NO: 966586 - RNA, 22 nt, Human
aaaagucugcucucauuucaga

SEQ ID NO: 966587 - RNA, 22 nt, Human
uaacagaaguuguucauugugg

SEQ ID NO: 966588 - RNA, 22 nt, Human
ugucaccucuuuggcugcagcu

SEQ ID NO: 966589 - RNA, 22 nt, Human
acauuucuuccacaugcugcug

SEQ ID NO: 966590 - RNA, 22 nt, Human
gcagggaggaagagaugcuucc

SEQ ID NO: 966591 - RNA, 22 nt, Human
uaaugcacauagaaguacuuag

SEQ ID NO: 966592 - RNA, 22 nt, Human
ugucuuaauaugugcauucugu

SEQ ID NO: 966593 - RNA, 22 nt, Human
ucacucugacuuggccuccaac

SEQ ID NO: 966594 - RNA, 22 nt, Human
aggagucauugagagggguccu

SEQ ID NO: 966595 - RNA, 22 nt, Human
gcucaggauuucauccaugugu

SEQ ID NO: 966596 - RNA, 22 nt, Human
ucucagagcuucaguuauuuuc

SEQ ID NO: 966597 - RNA, 22 nt, Human
gugugcaugcauagacaccaca

SEQ ID NO: 966598 - RNA, 22 nt, Human
ggcucaggccuguaauccuagc

SEQ ID NO: 966599 - RNA, 17 nt, Human
aggccagaugaggcaag

SEQ ID NO: 966600 - RNA, 22 nt, Human
cugacccauauaagaguggagg

SEQ ID NO: 966601 - RNA, 22 nt, Human
gguagcagggcugugagucaga

SEQ ID NO: 966602 - RNA, 22 nt, Human
uuggccaagggaucgagguugg

SEQ ID NO: 966603 - RNA, 22 nt, Human
gcagcuggaagugacacucugu

SEQ ID NO: 966604 - RNA, 22 nt, Human
aguuucaauucuuuucacaaag

SEQ ID NO: 966605 - RNA, 22 nt, Human
ggccugcuauuggugggcagac

SEQ ID NO: 966606 - RNA, 22 nt, Human
caggcagggagcuggaaaggau

SEQ ID NO: 966607 - RNA, 22 nt, Human
caagauggacauaaggagagaa

SEQ ID NO: 966608 - RNA, 22 nt, Human
cauucugugauucuaaaucccu

SEQ ID NO: 966609 - RNA, 22 nt, Human
uguacauacauagauauacaca

SEQ ID NO: 966610 - RNA, 17 nt, Human
gccuuccuuccuccaca

SEQ ID NO: 966611 - RNA, 18 nt, Human
cugcuuugccuucauucc

SEQ ID NO: 966612 - RNA, 22 nt, Human
ucugucucaaguucuugcacuc

SEQ ID NO: 966613 - RNA, 22 nt, Human
uguaccuuuuucugugcaugcu

SEQ ID NO: 966614 - RNA, 22 nt, Human
aaaaguuaccucuguaauauaa

SEQ ID NO: 966615 - RNA, 22 nt, Human
caagauggagaagcagcaaggg

SEQ ID NO: 966616 - RNA, 22 nt, Human
agaguguuuuucugucaaggac

SEQ ID NO: 966617 - RNA, 22 nt, Human
cugggagcaagaggcugcaaau

SEQ ID NO: 966618 - RNA, 22 nt, Human
cucuugaaaauuggaacacaga

SEQ ID NO: 966619 - RNA, 22 nt, Human
ucacagcaaaagugugcagagc

SEQ ID NO: 966620 - RNA, 19 nt, Human
ucaucucacagggccuggc

SEQ ID NO: 966621 - RNA, 22 nt, Human
agcucccagcuccuuugagaga

SEQ ID NO: 966622 - RNA, 22 nt, Human
uaggaugacacagcaaguauag

SEQ ID NO: 966623 - RNA, 22 nt, Human
ucuuccaagguugcacacuauc

SEQ ID NO: 966624 - RNA, 22 nt, Human
cuggcuuucucugugguguuca

SEQ ID NO: 966625 - RNA, 22 nt, Human
ccugaggggcugcaggccagcu

SEQ ID NO: 966626 - RNA, 22 nt, Human
cugggccuuggauugacacugu

SEQ ID NO: 966627 - RNA, 22 nt, Human
uuaacagagaacauagaaguag

SEQ ID NO: 966628 - RNA, 22 nt, Human
uuagcuaaacuguaacuagaau

SEQ ID NO: 966629 - RNA, 22 nt, Human
ggccucaguuucuucaacugua

SEQ ID NO: 966630 - RNA, 22 nt, Human
caagggcucacggucugcuggg

SEQ ID NO: 966631 - RNA, 22 nt, Human
cugccacuagcuuucacaucuu

SEQ ID NO: 966632 - RNA, 22 nt, Human
ugugucugaacuaguugcucuc

SEQ ID NO: 966633 - RNA, 22 nt, Human
aacuccagugucagcugcaaug

SEQ ID NO: 966634 - RNA, 22 nt, Human
cagagccaggccugcccucuuu

SEQ ID NO: 966635 - RNA, 22 nt, Human
auacaagacucagcacagacgg

SEQ ID NO: 966636 - RNA, 22 nt, Human
ccuccuggccugugcagagccc

SEQ ID NO: 966637 - RNA, 22 nt, Human
uuuaaauuuagaagaaacacug

SEQ ID NO: 966638 - RNA, 22 nt, Human
acaauucuggguauuuauauag

SEQ ID NO: 966639 - RNA, 22 nt, Human
gaggcaguguuuacugcccugu

SEQ ID NO: 966640 - RNA, 22 nt, Human
ucucugcugagaagggcuggca

SEQ ID NO: 966641 - RNA, 22 nt, Human
uggcuggcuuguucacugacug

SEQ ID NO: 966642 - RNA, 22 nt, Human
aacacugcugcuggguucugug

SEQ ID NO: 966643 - RNA, 22 nt, Human
caaaugaagaaccuucucaccu

SEQ ID NO: 966644 - RNA, 22 nt, Human
accccaagacaguagaagagaa

SEQ ID NO: 966645 - RNA, 22 nt, Human
uuugcuauaaaagggucacacg

SEQ ID NO: 966646 - RNA, 21 nt, Human
cucuuuauauaguaaagauau

SEQ ID NO: 966647 - RNA, 22 nt, Human
agagauaugaguaguugugaca

SEQ ID NO: 966648 - RNA, 22 nt, Human
uggagcuggaauuucugggccu

SEQ ID NO: 966649 - RNA, 22 nt, Human
agaaaugcauuagcacauauag

SEQ ID NO: 966650 - RNA, 20 nt, Human
aggcucugccauugucccug

SEQ ID NO: 966651 - RNA, 22 nt, Human
acauuucuggaguuucucaaca

SEQ ID NO: 966652 - RNA, 22 nt, Human
ggaggccaccugaccugcuguu

SEQ ID NO: 966653 - RNA, 22 nt, Human
uuuucuuaugugcagcuauaug

SEQ ID NO: 966654 - RNA, 22 nt, Human
cuggccaauccauuaauuuguu

SEQ ID NO: 966655 - RNA, 18 nt, Human
uugauaaacaauuucauu

SEQ ID NO: 966656 - RNA, 22 nt, Human
agucccagcucugccacuuacu

SEQ ID NO: 966657 - RNA, 22 nt, Human
gauacaaauucaugucugaauu

SEQ ID NO: 966658 - RNA, 23 nt, Human
caguggagacucaugcuuccuua

SEQ ID NO: 966659 - RNA, 22 nt, Human
gugaaggacuagcauggagggc

SEQ ID NO: 966660 - RNA, 22 nt, Human
cugcugugagcacuccagccug

SEQ ID NO: 966661 - RNA, 22 nt, Human
uuaacauacaucaugaacaaug

SEQ ID NO: 966662 - RNA, 22 nt, Human
uauuagcgcuuacugaguugcc

SEQ ID NO: 966663 - RNA, 22 nt, Human
ggcugccuucagacuccagcuu

SEQ ID NO: 966664 - RNA, 22 nt, Human
ucagggcaggacaguguaggcc

SEQ ID NO: 966665 - RNA, 22 nt, Human
uccaggccacugcagaggcucu

SEQ ID NO: 966666 - RNA, 22 nt, Human
ccugcuguucuguuuagugaac

SEQ ID NO: 966667 - RNA, 22 nt, Human
uggcagagguauauugggagga

SEQ ID NO: 966668 - RNA, 22 nt, Human
cugcucugacccuuucaccuuc

SEQ ID NO: 966669 - RNA, 22 nt, Human
ugaaggagcucaaugaugaugc

SEQ ID NO: 966670 - RNA, 22 nt, Human
ugcagcugaggccagcuaugcc

SEQ ID NO: 966671 - RNA, 22 nt, Human
ggggcagccuccaggaaagcug

SEQ ID NO: 966672 - RNA, 21 nt, Human
ucacaugcccauuacuggagc

SEQ ID NO: 966673 - RNA, 22 nt, Human
auuuucaaaacaucugcugugu

SEQ ID NO: 966674 - RNA, 22 nt, Human
ucaccgccuugcccggccgggc

SEQ ID NO: 966675 - RNA, 21 nt, Human
aaaaagcuggggcaugcaugc

SEQ ID NO: 966676 - RNA, 22 nt, Human
ucaguuuuuguuugccagauag

SEQ ID NO: 966677 - RNA, 22 nt, Human
cugggcaguuuauucaguucug

SEQ ID NO: 966678 - RNA, 22 nt, Human
aggccagaaauuuggaguaugu

SEQ ID NO: 966679 - RNA, 22 nt, Human
ccugggcaacauagugagaccu

SEQ ID NO: 966680 - RNA, 22 nt, Human
gcaggggaguggaugauggauu

SEQ ID NO: 966681 - RNA, 22 nt, Human
agcagacaacccagaugaccca

SEQ ID NO: 966682 - RNA, 22 nt, Human
uugggugcugucauggggcacg

SEQ ID NO: 966683 - RNA, 22 nt, Human
cuuucauucuuagauauuagug

SEQ ID NO: 966684 - RNA, 22 nt, Human
uuccucuccucacaugagucac

SEQ ID NO: 966685 - RNA, 22 nt, Human
agcauaaguugguacagccacu

SEQ ID NO: 966686 - RNA, 22 nt, Human
agcagcagauccaaaaaaugug

SEQ ID NO: 966687 - RNA, 22 nt, Human
cagccuuuuccauguauuguug

SEQ ID NO: 966688 - RNA, 21 nt, Human
ccaggguccagcugccauggu

SEQ ID NO: 966689 - RNA, 22 nt, Human
agagcagugcugaagaguaggg

SEQ ID NO: 966690 - RNA, 19 nt, Human
gcucugugaugcugagggg

SEQ ID NO: 966691 - RNA, 22 nt, Human
cucugggcaccaaagagcagcu

SEQ ID NO: 966692 - RNA, 22 nt, Human
uauguacauggagagcaauuga

SEQ ID NO: 966693 - RNA, 22 nt, Human
gaaauaagaguccaugccaggu

SEQ ID NO: 966694 - RNA, 20 nt, Human
agagccuggaaaaagacauc

SEQ ID NO: 966695 - RNA, 22 nt, Human
ggguggagcuuggacaccagua

SEQ ID NO: 966696 - RNA, 22 nt, Human
cugcccuguuuggacagcccgg

SEQ ID NO: 966697 - RNA, 22 nt, Human
gcccugagacugagcauggguu

SEQ ID NO: 966698 - RNA, 22 nt, Human
guguccaucagcagccacugug

SEQ ID NO: 966699 - RNA, 22 nt, Human
uugaacugguaguuggaaaucu

SEQ ID NO: 966700 - RNA, 22 nt, Human
cugcuguggccagccaggucaa

SEQ ID NO: 966701 - RNA, 22 nt, Human
uggggcuguggauucucacgaa

SEQ ID NO: 966702 - RNA, 22 nt, Human
ucagcugccuuucccaugcuag

SEQ ID NO: 966703 - RNA, 22 nt, Human
ucccagggcagcuguccagaag

SEQ ID NO: 966704 - RNA, 22 nt, Human
ccaggcagcucugauuuauguc

SEQ ID NO: 966705 - RNA, 22 nt, Human
ugggcugcggauaggccucgga

SEQ ID NO: 966706 - RNA, 22 nt, Human
agggggcccuugcaggugagcg

SEQ ID NO: 966707 - RNA, 22 nt, Human
uggcagagagacucuccuugau

SEQ ID NO: 966708 - RNA, 22 nt, Human
ugcauuucagaagaaaauucgg

SEQ ID NO: 966709 - RNA, 18 nt, Human
agaguguucucagugaaa

SEQ ID NO: 966710 - RNA, 22 nt, Human
gcagagccugugucugagcaaa

SEQ ID NO: 966711 - RNA, 22 nt, Human
ccacucugauuucaagggagau

SEQ ID NO: 966712 - RNA, 22 nt, Human
agccuccaaaugucaggucccg

SEQ ID NO: 966713 - RNA, 22 nt, Human
gagucaguaauggauaugucau

SEQ ID NO: 966714 - RNA, 22 nt, Human
uggccgggccgggcgccuccac

SEQ ID NO: 966715 - RNA, 22 nt, Human
gcauccagagguagccacugug

SEQ ID NO: 966716 - RNA, 22 nt, Human
guucuucaucauuuuagauagg

SEQ ID NO: 966717 - RNA, 22 nt, Human
uaagaacaguguuucaucucua

SEQ ID NO: 966718 - RNA, 22 nt, Human
cuuaagaauauugaaguugugg

SEQ ID NO: 966719 - RNA, 22 nt, Human
ccugacucuggccaggccagcu

SEQ ID NO: 966720 - RNA, 21 nt, Human
gccucugcugucuuauuguga

SEQ ID NO: 966721 - RNA, 22 nt, Human
agucucugagguucagaugccu

SEQ ID NO: 966722 - RNA, 22 nt, Human
aguguccaacucagcuugucaa

SEQ ID NO: 966723 - RNA, 22 nt, Human
uuuaaauaggacuccugggggu

SEQ ID NO: 966724 - RNA, 22 nt, Human
aagagagagcauucuucuguua

SEQ ID NO: 966725 - RNA, 22 nt, Human
uggccugggccggcagauauac

SEQ ID NO: 966726 - RNA, 22 nt, Human
gcuccuggugcaaaguuucuuc

SEQ ID NO: 966727 - RNA, 22 nt, Human
cccaggagaauauaauguucuu

SEQ ID NO: 966728 - RNA, 22 nt, Human
auggccaagcaugccuguggcc

SEQ ID NO: 966729 - RNA, 22 nt, Human
caugcugugcaucuugaugacc

SEQ ID NO: 966730 - RNA, 22 nt, Human
uauuuaguuaucuuucauaaaa

SEQ ID NO: 966731 - RNA, 22 nt, Human
gaucaaaagcuggguucuaaaa

SEQ ID NO: 966732 - RNA, 22 nt, Human
gcucuggguagccacugccugg

SEQ ID NO: 966733 - RNA, 22 nt, Human
cccagcaucuccaggcauggcc

SEQ ID NO: 966734 - RNA, 22 nt, Human
augagacuaccuguaauguggc

SEQ ID NO: 966735 - RNA, 18 nt, Human
gcagcugacacuggaguu

SEQ ID NO: 966736 - RNA, 22 nt, Human
aacucaguucuuuccacaaugc

SEQ ID NO: 966737 - RNA, 22 nt, Human
uggcucaguuucaguccugguu

SEQ ID NO: 966738 - RNA, 20 nt, Human
ccuccuggucaggugugcag

SEQ ID NO: 966739 - RNA, 22 nt, Human
uuggcaggaauauugcagaggu

SEQ ID NO: 966740 - RNA, 22 nt, Human
ggcaaaguuuucaucucauaac

SEQ ID NO: 966741 - RNA, 22 nt, Human
gccugccucaaaaucccaguuc

SEQ ID NO: 966742 - RNA, 22 nt, Human
gagaggccaaaaucccugcccc

SEQ ID NO: 966743 - RNA, 22 nt, Human
gugugccaacaaaagacagugc

SEQ ID NO: 966744 - RNA, 22 nt, Human
guauacauagaugaugaacaag

SEQ ID NO: 966745 - RNA, 22 nt, Human
gcaggcugauagaggauuccau

SEQ ID NO: 966746 - RNA, 22 nt, Human
cagcuggcauaccugggcccgg

SEQ ID NO: 966747 - RNA, 22 nt, Human
ugaagcagaggggucuugagcu

SEQ ID NO: 966748 - RNA, 22 nt, Human
accucaggauguggacacagaa

SEQ ID NO: 966749 - RNA, 22 nt, Human
acacacaacucauuguguaaua

SEQ ID NO: 966750 - RNA, 22 nt, Human
uuccaugaaagugaaauggagc

SEQ ID NO: 966751 - RNA, 22 nt, Human
uacauaguauucacauuguuuu

SEQ ID NO: 966752 - RNA, 22 nt, Human
cagcucccagagugaccagcag

SEQ ID NO: 966753 - RNA, 21 nt, Human
agcucagccgggcacaguggc

SEQ ID NO: 966754 - RNA, 22 nt, Human
gucuaauuccugcucuuacuca

SEQ ID NO: 966755 - RNA, 22 nt, Human
ggagccagggaagcugcuuccu

SEQ ID NO: 966756 - RNA, 20 nt, Human
guggcaggcagugaaggagc

SEQ ID NO: 966757 - RNA, 22 nt, Human
aagggcaggaaaagauggaugu

SEQ ID NO: 966758 - RNA, 22 nt, Human
uauuucagcaagaagaaugugg

SEQ ID NO: 966759 - RNA, 19 nt, Human
gggaugggcccucacccuc

SEQ ID NO: 966760 - RNA, 22 nt, Human
uucagcagucguccaggaaaag

SEQ ID NO: 966761 - RNA, 22 nt, Human
uuauauacugugguaguacugu

SEQ ID NO: 966762 - RNA, 22 nt, Human
gcagcuaccacccaggaaggac

SEQ ID NO: 966763 - RNA, 22 nt, Human
gccaccucuuugucucugccgc

SEQ ID NO: 966764 - RNA, 22 nt, Human
gcagaacauuucacaguaucuu

SEQ ID NO: 966765 - RNA, 22 nt, Human
aggagcugggcugcugcuggga

SEQ ID NO: 966766 - RNA, 22 nt, Human
acauuuaaauaccuauguuucu

SEQ ID NO: 966767 - RNA, 22 nt, Human
ucucuggaguauaaccagggau

SEQ ID NO: 966768 - RNA, 22 nt, Human
ggaggcaggaaagacagguuca

SEQ ID NO: 966769 - RNA, 22 nt, Human
ucauucuuuaccaaguugucac

SEQ ID NO: 966770 - RNA, 22 nt, Human
accuguuuguguccauuaguga

SEQ ID NO: 966771 - RNA, 22 nt, Human
gcauuccuacaggcugcuauga

SEQ ID NO: 966772 - RNA, 20 nt, Human
aggcucugcauuucugagug

SEQ ID NO: 966773 - RNA, 22 nt, Human
acucugggccccagguggagcu

SEQ ID NO: 966774 - RNA, 22 nt, Human
gagucacauuaauuuaauuuua

SEQ ID NO: 966775 - RNA, 22 nt, Human
gcauguguugguuuaugcaugu

SEQ ID NO: 966776 - RNA, 22 nt, Human
uuauguaccugaauuaguaaag

SEQ ID NO: 966777 - RNA, 22 nt, Human
aaguuugacagaaguuucuaau

SEQ ID NO: 966778 - RNA, 22 nt, Human
uuguuuguaugcugagaagaau

SEQ ID NO: 966779 - RNA, 22 nt, Human
ucagcaggcaggaggcaugcca

SEQ ID NO: 966780 - RNA, 22 nt, Human
cucagagucccuucccucgugg

SEQ ID NO: 966781 - RNA, 22 nt, Human
auucuucaaagagugucaaagu

SEQ ID NO: 966782 - RNA, 22 nt, Human
uuaguaaauaaagucuacuuuc

SEQ ID NO: 966783 - RNA, 22 nt, Human
aacagugagaagguggacagga

SEQ ID NO: 966784 - RNA, 22 nt, Human
cuuccagagauagggccucaag

SEQ ID NO: 966785 - RNA, 22 nt, Human
gcagaggcauuucugacgcugc

SEQ ID NO: 966786 - RNA, 22 nt, Human
agagacagaggcaauauagcuu

SEQ ID NO: 966787 - RNA, 23 nt, Human
acagcugcaccuggccgccuggc

SEQ ID NO: 966788 - RNA, 22 nt, Human
gccaggagcaugucauuguuga

SEQ ID NO: 966789 - RNA, 22 nt, Human
caugucuguguacacaugcaca

SEQ ID NO: 966790 - RNA, 22 nt, Human
ggcuccugauaggagaaugcgg

SEQ ID NO: 966791 - RNA, 22 nt, Human
aaccuucacuugcuucauuuga

SEQ ID NO: 966792 - RNA, 22 nt, Human
uccucagggcggccuccgucuu

SEQ ID NO: 966793 - RNA, 22 nt, Human
cuauuagguaugcagccuauuu

SEQ ID NO: 966794 - RNA, 22 nt, Human
agccugccuugggcugcuugag

SEQ ID NO: 966795 - RNA, 22 nt, Human
gcucccuccaugaggcagaccg

SEQ ID NO: 966796 - RNA, 22 nt, Human
uggccucuuacgacauagccuu

SEQ ID NO: 966797 - RNA, 22 nt, Human
uagcacauacauaauagauaga

SEQ ID NO: 966798 - RNA, 22 nt, Human
ucuguucaguugauuagacaga

SEQ ID NO: 966799 - RNA, 22 nt, Human
ucagggcaagucucagaagguu

SEQ ID NO: 966800 - RNA, 22 nt, Human
ugcugaugaguccuucuaucgc

SEQ ID NO: 966801 - RNA, 22 nt, Human
cuguaguugaugauuucugaua

SEQ ID NO: 966802 - RNA, 22 nt, Human
ugggcugcugcggugcucuugg

SEQ ID NO: 966803 - RNA, 22 nt, Human
ugagaacugaggauuugaauuc

SEQ ID NO: 966804 - RNA, 22 nt, Human
cugugugugucugcagcauacu

SEQ ID NO: 966805 - RNA, 22 nt, Human
aggaccagaggccagagucagc

SEQ ID NO: 966806 - RNA, 22 nt, Human
ugcauugcaguuaacucaguau

SEQ ID NO: 966807 - RNA, 22 nt, Human
ucagcugaaguggagaagcaga

SEQ ID NO: 966808 - RNA, 22 nt, Human
gcacagggcugccaggcggcuu

SEQ ID NO: 966809 - RNA, 22 nt, Human
agcugagcuaguaguuccagug

SEQ ID NO: 966810 - RNA, 22 nt, Human
uccaggagguuuggaggaagca

SEQ ID NO: 966811 - RNA, 22 nt, Human
gcccaggaguuugcauuuuaac

SEQ ID NO: 966812 - RNA, 22 nt, Human
gugagcaucuuggcagauauga

SEQ ID NO: 966813 - RNA, 22 nt, Human
gcugcucuacccaugcaucugu

SEQ ID NO: 966814 - RNA, 22 nt, Human
aggagucauaaaugugaacaaa

SEQ ID NO: 966815 - RNA, 23 nt, Human
uuucuguuggguauauauccaag

SEQ ID NO: 966816 - RNA, 22 nt, Human
uaaauuuacccaaggaacaugu

SEQ ID NO: 966817 - RNA, 21 nt, Human
uucugagcacucaucacuguc

SEQ ID NO: 966818 - RNA, 22 nt, Human
uuucucugcugccugugucgau

SEQ ID NO: 966819 - RNA, 22 nt, Human
auuuggaaacaauuauauucuu

SEQ ID NO: 966820 - RNA, 22 nt, Human
uucauauauaugcacuacguac

SEQ ID NO: 966821 - RNA, 22 nt, Human
ccuggccucagccuagggcuga

SEQ ID NO: 966822 - RNA, 22 nt, Human
ugugugaaggaauauauacuca

SEQ ID NO: 966823 - RNA, 22 nt, Human
aagaggaaaugauugacuauau

SEQ ID NO: 966824 - RNA, 22 nt, Human
uaaagcacgucuauuuaaugau

SEQ ID NO: 966825 - RNA, 22 nt, Human
uacuacauuaauaaaacauuca

SEQ ID NO: 966826 - RNA, 22 nt, Human
aagauuucagaguuugggggaa

SEQ ID NO: 966827 - RNA, 22 nt, Human
ggcagcugauuagcaucaagga

SEQ ID NO: 966828 - RNA, 22 nt, Human
aaagauaugucuccaaagagau

SEQ ID NO: 966829 - RNA, 22 nt, Human
acagaauugaaaguauaaucug

SEQ ID NO: 966830 - RNA, 22 nt, Human
ccaaggagaaaugcugugcuuu

SEQ ID NO: 966831 - RNA, 22 nt, Human
caguacuucuuggaaacuggau

SEQ ID NO: 966832 - RNA, 22 nt, Human
gugggcaaggucccugccagcu

SEQ ID NO: 966833 - RNA, 22 nt, Human
ggcagccuugacuagugacuua

SEQ ID NO: 966834 - RNA, 22 nt, Human
gccucucucuacccaguaugau

SEQ ID NO: 966835 - RNA, 22 nt, Human
cccugccugugggcaucaacau

SEQ ID NO: 966836 - RNA, 22 nt, Human
acuuguuuacaagcaguucuga

SEQ ID NO: 966837 - RNA, 22 nt, Human
aauguucaguagaauaggaaug

SEQ ID NO: 966838 - RNA, 22 nt, Human
uuaaauauuauguugucugcaa

SEQ ID NO: 966839 - RNA, 22 nt, Human
ucugggaauuuauuggcacuuu

SEQ ID NO: 966840 - RNA, 22 nt, Human
acugcagccuagggaccacagu

SEQ ID NO: 966841 - RNA, 22 nt, Human
uuagcucagaaaauuuaaacuu

SEQ ID NO: 966842 - RNA, 20 nt, Human
aggcacuggauuucuuauau

SEQ ID NO: 966843 - RNA, 23 nt, Human
gugcaugugucuuuacaguagca

SEQ ID NO: 966844 - RNA, 22 nt, Human
ucuggcucaggagcuguguuca

SEQ ID NO: 966845 - RNA, 19 nt, Human
guggccucggagcgcgcgg

SEQ ID NO: 966846 - RNA, 23 nt, Human
uccaagggcuacaaacacagacc

SEQ ID NO: 966847 - RNA, 22 nt, Human
auaaugugauauuucauuuaca

SEQ ID NO: 966848 - RNA, 17 nt, Human
ccugggaggaguuauga

SEQ ID NO: 966849 - RNA, 22 nt, Human
uagaacagaggguugcccagau

SEQ ID NO: 966850 - RNA, 22 nt, Human
ugccugagugauguggcagcca

SEQ ID NO: 966851 - RNA, 22 nt, Human
ggagccaggcaaucuguacuuu

SEQ ID NO: 966852 - RNA, 22 nt, Human
cuugcaggauuuugcugcugua

SEQ ID NO: 966853 - RNA, 22 nt, Human
acauacauaugacaacuuuccu

SEQ ID NO: 966854 - RNA, 22 nt, Human
ccuggagccccucuggccagcc

SEQ ID NO: 966855 - RNA, 22 nt, Human
cuucuucauaggcaguccuguu

SEQ ID NO: 966856 - RNA, 22 nt, Human
ugcccugcagugagugcgucug

SEQ ID NO: 966857 - RNA, 22 nt, Human
ggccugcucuggcuguggucag

SEQ ID NO: 966858 - RNA, 22 nt, Human
ucagggcagccuaaggcaccuc

SEQ ID NO: 966859 - RNA, 22 nt, Human
uuuauucuugagagugagaaga

SEQ ID NO: 966860 - RNA, 22 nt, Human
aaucaguuucuuggcaaguuua

SEQ ID NO: 966861 - RNA, 22 nt, Human
cagcugucuaaguugagcagga

SEQ ID NO: 966862 - RNA, 22 nt, Human
ccaggcaucacgggcauguggc

SEQ ID NO: 966863 - RNA, 19 nt, Human
auacacauacguaaacuga

SEQ ID NO: 966864 - RNA, 22 nt, Human
gccugggaacucugaucuccug

SEQ ID NO: 966865 - RNA, 21 nt, Human
ucauuugugaucugauuucca

SEQ ID NO: 966866 - RNA, 22 nt, Human
ccagcuggugacauccccaacc

SEQ ID NO: 966867 - RNA, 22 nt, Human
agcaaggcagucagcuggcugg

SEQ ID NO: 966868 - RNA, 22 nt, Human
aagaggaggacgguucccagaa

SEQ ID NO: 966869 - RNA, 22 nt, Human
augagcugugggauuccagagg

SEQ ID NO: 966870 - RNA, 22 nt, Human
ggccagagaagucagacccuug

SEQ ID NO: 966871 - RNA, 22 nt, Human
uuugcagcaaggagagagcauu

SEQ ID NO: 966872 - RNA, 22 nt, Human
agcuggguggagggcccacggu

SEQ ID NO: 966873 - RNA, 22 nt, Human
gcugggagccguaccugucacg

SEQ ID NO: 966874 - RNA, 22 nt, Human
gggagcuggagcuggaagacuc

SEQ ID NO: 966875 - RNA, 22 nt, Human
caggccuggguucaaaucccuu

SEQ ID NO: 966876 - RNA, 22 nt, Human
aucugcaggaaugugugcagag

SEQ ID NO: 966877 - RNA, 22 nt, Human
ucucuggguuuuuguccuguac

SEQ ID NO: 966878 - RNA, 22 nt, Human
ggcagcaucacuugucuccagc

SEQ ID NO: 966879 - RNA, 22 nt, Human
aaaccgcaauuacuuuugcguc

SEQ ID NO: 966880 - RNA, 18 nt, Human
agcuggcccuggcugccg

SEQ ID NO: 966881 - RNA, 22 nt, Human
ugggagcaggaagcaggaagua

SEQ ID NO: 966882 - RNA, 22 nt, Human
gcccauggacacccaagugcca

SEQ ID NO: 966883 - RNA, 22 nt, Human
guuuauuaacugucaagugauu

SEQ ID NO: 966884 - RNA, 22 nt, Human
agcaggcuuguuaugucugaga

SEQ ID NO: 966885 - RNA, 17 nt, Human
uucaaagcuuaucaagg

SEQ ID NO: 966886 - RNA, 22 nt, Human
acacaaauuguaggauaauugc

SEQ ID NO: 966887 - RNA, 20 nt, Human
uucaaaguguaugauaugca

SEQ ID NO: 966888 - RNA, 22 nt, Human
cagcagugucuccagcaucaca

SEQ ID NO: 966889 - RNA, 22 nt, Human
acuuuguauaagacaauaaaga

SEQ ID NO: 966890 - RNA, 22 nt, Human
ccuggagcacucucccuggcug

SEQ ID NO: 966891 - RNA, 17 nt, Human
guccugggaggagagag

SEQ ID NO: 966892 - RNA, 19 nt, Human
accucugcagagauguuua

SEQ ID NO: 966893 - RNA, 22 nt, Human
agcuccaggugcaagucauggu

SEQ ID NO: 966894 - RNA, 22 nt, Human
acuuuguugaugaaauaguuuu

SEQ ID NO: 966895 - RNA, 23 nt, Human
cugaggccugcugcguucagguu

SEQ ID NO: 966896 - RNA, 23 nt, Human
caugccaguuugugcaggcagau

SEQ ID NO: 966897 - RNA, 22 nt, Human
cugagaggugacagcgugcugg

SEQ ID NO: 966898 - RNA, 22 nt, Human
aaaaucugcuuccuuuuacaga

SEQ ID NO: 966899 - RNA, 22 nt, Human
ggagacaguauggcuuguagcu

SEQ ID NO: 966900 - RNA, 22 nt, Human
aggaagccugcaggugacugcu

SEQ ID NO: 966901 - RNA, 22 nt, Human
uggcuggcaguaggcuaguggc

SEQ ID NO: 966902 - RNA, 22 nt, Human
gcugcugucacggugcuaaggg

SEQ ID NO: 966903 - RNA, 22 nt, Human
ugugccagaaaauaugcugagg

SEQ ID NO: 966904 - RNA, 22 nt, Human
ccuggagcucacugggagccgg

SEQ ID NO: 966905 - RNA, 22 nt, Human
aaacaugagcaucucuucaagc

SEQ ID NO: 966906 - RNA, 23 nt, Human
gacaccuuugccagaucaagaug

SEQ ID NO: 966907 - RNA, 22 nt, Human
agaggagugggaagcagugcaa

SEQ ID NO: 966908 - RNA, 21 nt, Human
agaugaggauacugaggccua

SEQ ID NO: 966909 - RNA, 22 nt, Human
ugccucugugugcaggugagca

SEQ ID NO: 966910 - RNA, 22 nt, Human
ugucuuuggaauauuuagcuga

SEQ ID NO: 966911 - RNA, 22 nt, Human
ggccucuggucaagacaagcau

SEQ ID NO: 966912 - RNA, 22 nt, Human
ucuccugcucagaacagccuca

SEQ ID NO: 966913 - RNA, 22 nt, Human
agcugcuacugcucugccagag

SEQ ID NO: 966914 - RNA, 20 nt, Human
aggauuugagaaggcgucuu

SEQ ID NO: 966915 - RNA, 22 nt, Human
cagcaauauacacagucuaugg

SEQ ID NO: 966916 - RNA, 22 nt, Human
agugaaauaaagcugccuaugg

SEQ ID NO: 966917 - RNA, 22 nt, Human
gcuggccugcaaagcccggcug

SEQ ID NO: 966918 - RNA, 22 nt, Human
acacugcagaugaaagcauaag

SEQ ID NO: 966919 - RNA, 22 nt, Human
agaacagcaguuaugguucauu

SEQ ID NO: 966920 - RNA, 20 nt, Human
ggcucugcuugugagcagcc

SEQ ID NO: 966921 - RNA, 22 nt, Human
gucugucaucugagauggagug

SEQ ID NO: 966922 - RNA, 22 nt, Human
cacauacaaggcacacuggagg

SEQ ID NO: 966923 - RNA, 22 nt, Human
aaaguuuccugcuaagugcuau

SEQ ID NO: 966924 - RNA, 22 nt, Human
ucuuagaaguuuauggcacgga

SEQ ID NO: 966925 - RNA, 22 nt, Human
cagcugcccauccugggaaaug

SEQ ID NO: 966926 - RNA, 22 nt, Human
ccugggcaaaugccagagacaa

SEQ ID NO: 966927 - RNA, 19 nt, Human
cauaauacaguggaucuga

SEQ ID NO: 966928 - RNA, 22 nt, Human
cagcccagcagucuuagccugc

SEQ ID NO: 966929 - RNA, 20 nt, Human
ucacucugaugcuagggugg

SEQ ID NO: 966930 - RNA, 22 nt, Human
ucacaaauagcuauauuaagga

SEQ ID NO: 966931 - RNA, 22 nt, Human
acauuuuuauucaucaaagcag

SEQ ID NO: 966932 - RNA, 22 nt, Human
acaggagaaaucuggucaaaag

SEQ ID NO: 966933 - RNA, 22 nt, Human
uucuuaaguuuagcaacuugug

SEQ ID NO: 966934 - RNA, 22 nt, Human
uggagccaugccuggccuuucc

SEQ ID NO: 966935 - RNA, 22 nt, Human
cagcagcaaaucuagaagagga

SEQ ID NO: 966936 - RNA, 22 nt, Human
acuugggauuucagaugcugug

SEQ ID NO: 966937 - RNA, 22 nt, Human
gucaugccagcggagcucggga

SEQ ID NO: 966938 - RNA, 22 nt, Human
gcugggagccccgagccagcgc

SEQ ID NO: 966939 - RNA, 22 nt, Human
ucacguuuuacugagugagaua

SEQ ID NO: 966940 - RNA, 22 nt, Human
ggcacugggagaggugagacgg

SEQ ID NO: 966941 - RNA, 22 nt, Human
acaaagucucuaauaaucuucu

SEQ ID NO: 966942 - RNA, 22 nt, Human
ucaggagacuggcagugcccac

SEQ ID NO: 966943 - RNA, 22 nt, Human
uuugaaauaugugucuuuugaa

SEQ ID NO: 966944 - RNA, 22 nt, Human
gggcucuggauggagccugcag

SEQ ID NO: 966945 - RNA, 22 nt, Human
ucuguucaucaucuggacacau

SEQ ID NO: 966946 - RNA, 22 nt, Human
ucuucuuccucauuuauacaua

SEQ ID NO: 966947 - RNA, 22 nt, Human
agguggaacguucaggugcuag

SEQ ID NO: 966948 - RNA, 22 nt, Human
uccucaggugacuagguaucuu

SEQ ID NO: 966949 - RNA, 22 nt, Human
auguuuccagguucuuccuaug

SEQ ID NO: 966950 - RNA, 22 nt, Human
aggcuggaguacaguggcuauu

SEQ ID NO: 966951 - RNA, 22 nt, Human
uagagcuggaauuugcagcaag

SEQ ID NO: 966952 - RNA, 22 nt, Human
acacagggaggaggugcugugc

SEQ ID NO: 966953 - RNA, 23 nt, Human
cccuggaguaaauucuuggaagg

SEQ ID NO: 966954 - RNA, 22 nt, Human
ccagggugggguccaggaacca

SEQ ID NO: 966955 - RNA, 22 nt, Human
gcagggucgcucuaggagauca

SEQ ID NO: 966956 - RNA, 18 nt, Human
gcagcugcaguuguagcu

SEQ ID NO: 966957 - RNA, 22 nt, Human
caguggguggcuaaguggcuga

SEQ ID NO: 966958 - RNA, 22 nt, Human
auacauucagcagugcucauga

SEQ ID NO: 966959 - RNA, 22 nt, Human
uggcucagcgcggccuggucuu

SEQ ID NO: 966960 - RNA, 22 nt, Human
agcuggccuccgggugccuggg

SEQ ID NO: 966961 - RNA, 22 nt, Human
gaggggcuggguagggcaaccc

SEQ ID NO: 966962 - RNA, 22 nt, Human
gcuuggcauugaccauuaucau

SEQ ID NO: 966963 - RNA, 22 nt, Human
gacagaggcaagaccagaagcc

SEQ ID NO: 966964 - RNA, 22 nt, Human
gccuuccugcagcucugagcgu

SEQ ID NO: 966965 - RNA, 22 nt, Human
uuugaaucugauauggcagcau

SEQ ID NO: 966966 - RNA, 22 nt, Human
gcagcagagcuuuguccuggcu

SEQ ID NO: 966967 - RNA, 23 nt, Human
uagggcagcugggagggacaugc

SEQ ID NO: 966968 - RNA, 22 nt, Human
ccccuggguccaggcuucucug

SEQ ID NO: 966969 - RNA, 22 nt, Human
gaggccagcgcgcagcacuuuu

SEQ ID NO: 966970 - RNA, 22 nt, Human
uccaggaguccugggagugauu

SEQ ID NO: 966971 - RNA, 20 nt, Human
aggagggaccuggauuggcg

SEQ ID NO: 966972 - RNA, 22 nt, Human
uggcccugaggacccagugugg

SEQ ID NO: 966973 - RNA, 22 nt, Human
aaugcuuuuugcgaaaugugca

SEQ ID NO: 966974 - RNA, 22 nt, Human
gcuggcugggucccugagaggc

SEQ ID NO: 966975 - RNA, 22 nt, Human
ucuccugggaggacaaggaagg

SEQ ID NO: 966976 - RNA, 22 nt, Human
agcugccacaugcccaagggca

SEQ ID NO: 966977 - RNA, 22 nt, Human
gaggggagacagggaaaucagu

SEQ ID NO: 966978 - RNA, 22 nt, Human
caggacaguauaggcuuuagga

SEQ ID NO: 966979 - RNA, 22 nt, Human
uacaaagagguaauugcauaua

SEQ ID NO: 966980 - RNA, 22 nt, Human
gcugccaguguggcaugaugca

SEQ ID NO: 966981 - RNA, 21 nt, Human
uucaagauauuuaaaaggugg

SEQ ID NO: 966982 - RNA, 22 nt, Human
ccaggacuucgaggcuacagug

SEQ ID NO: 966983 - RNA, 22 nt, Human
agggcacagccuaaagccuaug

SEQ ID NO: 966984 - RNA, 22 nt, Human
gcagggcuaauggggcaaguag

SEQ ID NO: 966985 - RNA, 22 nt, Human
gcuggagcuugagaggacaggg

SEQ ID NO: 966986 - RNA, 22 nt, Human
agaggcaggaagagcugauuuu

SEQ ID NO: 966987 - RNA, 22 nt, Human
cacagcuuccauuagaaugaga

SEQ ID NO: 966988 - RNA, 22 nt, Human
gacaucauagggugggaggaaa

SEQ ID NO: 966989 - RNA, 22 nt, Human
uuucacaaucaaauggugaaau

SEQ ID NO: 966990 - RNA, 22 nt, Human
aggcacugugcugaugucuuau

SEQ ID NO: 966991 - RNA, 22 nt, Human
cugggaggcagucucucuagaa

SEQ ID NO: 966992 - RNA, 21 nt, Human
ugcuuuaugggaaaaauguca

SEQ ID NO: 966993 - RNA, 22 nt, Human
ggcagcagggucuagauugaug

SEQ ID NO: 966994 - RNA, 22 nt, Human
acuguacacgugucauuuacag

SEQ ID NO: 966995 - RNA, 22 nt, Human
cuuaagauuugagauaccuaau

SEQ ID NO: 966996 - RNA, 22 nt, Human
cagcaggggaacugugggccag

SEQ ID NO: 966997 - RNA, 22 nt, Human
uucuccgcuaaguucucugcag

SEQ ID NO: 966998 - RNA, 22 nt, Human
uuguguccugauuugacacaau

SEQ ID NO: 966999 - RNA, 22 nt, Human
agcugguuagcaaucuaaguga

SEQ ID NO: 967000 - RNA, 22 nt, Human
ggcaugcugcguacagaugaac

SEQ ID NO: 967001 - RNA, 22 nt, Human
ccaggccuccugugaguggacc

SEQ ID NO: 967002 - RNA, 22 nt, Human
acagaguacauucagagacuau

SEQ ID NO: 967003 - RNA, 22 nt, Human
uccucagaagaaccccuagauu

SEQ ID NO: 967004 - RNA, 22 nt, Human
agcagcugucccuuaacaucag

SEQ ID NO: 967005 - RNA, 22 nt, Human
aggaaagguagcgugccagcag

SEQ ID NO: 967006 - RNA, 22 nt, Human
acaaaugugucuaauugugccu

SEQ ID NO: 967007 - RNA, 22 nt, Human
cuuuccaagaaugcagauaccu

SEQ ID NO: 967008 - RNA, 22 nt, Human
auacacauuacuuucugucuga

SEQ ID NO: 967009 - RNA, 22 nt, Human
gggccaugagagguucaucaac

SEQ ID NO: 967010 - RNA, 22 nt, Human
cugagccaaaaagcagagcuug

SEQ ID NO: 967011 - RNA, 22 nt, Human
aaaugcagcagcuaauugaaaa

SEQ ID NO: 967012 - RNA, 22 nt, Human
gcacugugaucaaggcuaagca

SEQ ID NO: 967013 - RNA, 22 nt, Human
agcagccaagguaaccugugcu

SEQ ID NO: 967014 - RNA, 22 nt, Human
cugaaggagguagagugacaua

SEQ ID NO: 967015 - RNA, 19 nt, Human
aaaaacuuaguccagaaag

SEQ ID NO: 967016 - RNA, 22 nt, Human
aagggaaaucauauggugcagu

SEQ ID NO: 967017 - RNA, 20 nt, Human
ugagugauggaggcggguca

SEQ ID NO: 967018 - RNA, 22 nt, Human
agagcugggugaagugccauca

SEQ ID NO: 967019 - RNA, 22 nt, Human
aucugguuuggggauccuugug

SEQ ID NO: 967020 - RNA, 22 nt, Human
uugaagcauuugcuauagcauu

SEQ ID NO: 967021 - RNA, 22 nt, Human
ugucuucaucucagacacaguu

SEQ ID NO: 967022 - RNA, 22 nt, Human
guuuauuauucaacuucauguu

SEQ ID NO: 967023 - RNA, 22 nt, Human
uuacaaagagaaguuguagaau

SEQ ID NO: 967024 - RNA, 22 nt, Human
uugugaguagugccgcaauaaa

SEQ ID NO: 967025 - RNA, 22 nt, Human
gcagggaaggggcaugcuggag

SEQ ID NO: 967026 - RNA, 22 nt, Human
aguucuucauaaccuuacugug

SEQ ID NO: 967027 - RNA, 22 nt, Human
acagauguacacucauauauaa

SEQ ID NO: 967028 - RNA, 22 nt, Human
agcagcucaaagccugcaagga

SEQ ID NO: 967029 - RNA, 22 nt, Human
auuugucugcuugcugccuucc

SEQ ID NO: 967030 - RNA, 22 nt, Human
ccagucccaggcagaaauccag

SEQ ID NO: 967031 - RNA, 22 nt, Human
ugucuuauuccuucuguucagc

SEQ ID NO: 967032 - RNA, 20 nt, Human
ugaagcagccuugauucugu

SEQ ID NO: 967033 - RNA, 22 nt, Human
cugugucggacgugggcagcag

SEQ ID NO: 967034 - RNA, 22 nt, Human
ccagcccuugcugaaggguggc

SEQ ID NO: 967035 - RNA, 22 nt, Human
uggggcugaggagccucacucu

SEQ ID NO: 967036 - RNA, 22 nt, Human
uguggucucguuauguugccca

SEQ ID NO: 967037 - RNA, 22 nt, Human
caggagugaguuggggucuaca

SEQ ID NO: 967038 - RNA, 22 nt, Human
agaggcggagguugcagugagc

SEQ ID NO: 967039 - RNA, 22 nt, Human
ucucccacugcaagcccaggcu

SEQ ID NO: 967040 - RNA, 22 nt, Human
aauagaauguaaucuaauacau

SEQ ID NO: 967041 - RNA, 22 nt, Human
ccacaaguuucagcacccagag

SEQ ID NO: 967042 - RNA, 23 nt, Human
ucugucaccuauggcugcucuuc

SEQ ID NO: 967043 - RNA, 22 nt, Human
uggccugaggcucggcaugggu

SEQ ID NO: 967044 - RNA, 22 nt, Human
uugcaucuagggcaacccagag

SEQ ID NO: 967045 - RNA, 21 nt, Human
aggcuguccuuugccagcccu

SEQ ID NO: 967046 - RNA, 22 nt, Human
gcugccugauuuacauagugaa

SEQ ID NO: 967047 - RNA, 22 nt, Human
aaggcacugaacuuaaauucug

SEQ ID NO: 967048 - RNA, 22 nt, Human
gcugcucugaaaaugacuguug

SEQ ID NO: 967049 - RNA, 17 nt, Human
aggugcagaggcagagc

SEQ ID NO: 967050 - RNA, 22 nt, Human
auaucuuuuagagcaagcuugu

SEQ ID NO: 967051 - RNA, 22 nt, Human
uccuggccuccguucucugcau

SEQ ID NO: 967052 - RNA, 22 nt, Human
cccagcucaucaggagccgccc

SEQ ID NO: 967053 - RNA, 22 nt, Human
gucauugcaguggcaaaucaca

SEQ ID NO: 967054 - RNA, 22 nt, Human
auuuauuauugugguuacuucu

SEQ ID NO: 967055 - RNA, 22 nt, Human
gcucccaccuuugcuaucagua

SEQ ID NO: 967056 - RNA, 22 nt, Human
aggcacuugaauugaugauguu

SEQ ID NO: 967057 - RNA, 19 nt, Human
ccauggagagagaugcauu

SEQ ID NO: 967058 - RNA, 22 nt, Human
aggcucagcccaagguggagag

SEQ ID NO: 967059 - RNA, 22 nt, Human
ucacucugcugcccgagggcug

SEQ ID NO: 967060 - RNA, 22 nt, Human
ccuggccaaucuagggcuguua

SEQ ID NO: 967061 - RNA, 22 nt, Human
ccagugggugcugggcucugcc

SEQ ID NO: 967062 - RNA, 22 nt, Human
aucuggcuuuuaccccacggcc

SEQ ID NO: 967063 - RNA, 22 nt, Human
ccucaggcuuacgggcaaugga

SEQ ID NO: 967064 - RNA, 22 nt, Human
uaaguucagaguucucauuugu

SEQ ID NO: 967065 - RNA, 22 nt, Human
ggcuggaaguccaagaucaagg

SEQ ID NO: 967066 - RNA, 22 nt, Human
uugaaaggugacauuguuagag

SEQ ID NO: 967067 - RNA, 22 nt, Human
uucaaacaguguagaauauaug

SEQ ID NO: 967068 - RNA, 22 nt, Human
uuauuaguguugauauuaggau

SEQ ID NO: 967069 - RNA, 22 nt, Human
ugcccuuggguaacuugcugau

SEQ ID NO: 967070 - RNA, 22 nt, Human
accgaguuagccaggauggucu

SEQ ID NO: 967071 - RNA, 18 nt, Human
uccagagcuacuguggug

SEQ ID NO: 967072 - RNA, 22 nt, Human
caaaaagcuuagguaacaagcc

SEQ ID NO: 967073 - RNA, 22 nt, Human
gucaucuuugcccugugcagga

SEQ ID NO: 967074 - RNA, 22 nt, Human
aaaauacuacugucuucuuccc

SEQ ID NO: 967075 - RNA, 22 nt, Human
auguccuuccauuuugaucugu

SEQ ID NO: 967076 - RNA, 22 nt, Human
aaugaacaaaauaugcuuugca

SEQ ID NO: 967077 - RNA, 22 nt, Human
cuggcucaauaaauauuagcug

SEQ ID NO: 967078 - RNA, 22 nt, Human
uauucacaguugauuuacaguu

SEQ ID NO: 967079 - RNA, 22 nt, Human
gcagugaaucuggcaagaauuu

SEQ ID NO: 967080 - RNA, 22 nt, Human
aggcagcagucaugaggaaaga

SEQ ID NO: 967081 - RNA, 22 nt, Human
cuggcugugcagucuuccagaa

SEQ ID NO: 967082 - RNA, 22 nt, Human
cuguauuuucaugccuacguac

SEQ ID NO: 967083 - RNA, 22 nt, Human
aauagaauuuguacuguguuuu

SEQ ID NO: 967084 - RNA, 20 nt, Human
auacacuugcccagcuugug

SEQ ID NO: 967085 - RNA, 22 nt, Human
ggcagcuccaaaaggaaacacu

SEQ ID NO: 967086 - RNA, 22 nt, Human
aaauguguuuagaugguuuauu

SEQ ID NO: 967087 - RNA, 23 nt, Human
uuucacaaugagcauuacagaau

SEQ ID NO: 967088 - RNA, 22 nt, Human
cauuuagacauuugauuugggg

SEQ ID NO: 967089 - RNA, 23 nt, Human
aaauucaguccuucaacucugag

SEQ ID NO: 967090 - RNA, 22 nt, Human
ccaggcucugcgcuggacaugg

SEQ ID NO: 967091 - RNA, 22 nt, Human
cugcccuggucccauggcugau

SEQ ID NO: 967092 - RNA, 22 nt, Human
cauuacaugguccaggauauau

SEQ ID NO: 967093 - RNA, 22 nt, Human
gagagcugcauucucagacaca

SEQ ID NO: 967094 - RNA, 22 nt, Human
agugaccaaucaugguuagauu

SEQ ID NO: 967095 - RNA, 22 nt, Human
ucagggaacaauguuauggcuu

SEQ ID NO: 967096 - RNA, 22 nt, Human
uccauugucuuugguccuagcc

SEQ ID NO: 967097 - RNA, 20 nt, Human
cuucuucaguaguuuguucu

SEQ ID NO: 967098 - RNA, 21 nt, Human
ugggaugggucugggaccagc

SEQ ID NO: 967099 - RNA, 22 nt, Human
ccaggagcagauauggacauaa

SEQ ID NO: 967100 - RNA, 21 nt, Human
gcaggcuggucaaaccucagu

SEQ ID NO: 967101 - RNA, 22 nt, Human
agggcagagggugccucaccug

SEQ ID NO: 967102 - RNA, 22 nt, Human
uucacagacuuuccauagauug

SEQ ID NO: 967103 - RNA, 22 nt, Human
aggcccagggcugcucucugaa

SEQ ID NO: 967104 - RNA, 22 nt, Human
cuuuguagcugcuucugauuua

SEQ ID NO: 967105 - RNA, 22 nt, Human
cuggcugcuuguagacucgacu

SEQ ID NO: 967106 - RNA, 22 nt, Human
guggaggacaaaagaagccuuu

SEQ ID NO: 967107 - RNA, 22 nt, Human
cccaggaggguggccucugccc

SEQ ID NO: 967108 - RNA, 22 nt, Human
cccauggcuuaggagggagugu

SEQ ID NO: 967109 - RNA, 22 nt, Human
cuccucagucaggucuaggguc

SEQ ID NO: 967110 - RNA, 19 nt, Human
uagaggagaagggaagugg

SEQ ID NO: 967111 - RNA, 22 nt, Human
agaguguaauaagggcaagggc

SEQ ID NO: 967112 - RNA, 22 nt, Human
gccugggagggcagcagugugg

SEQ ID NO: 967113 - RNA, 22 nt, Human
uuucacauuuuauacuuaagcc

SEQ ID NO: 967114 - RNA, 22 nt, Human
agagcuggcugguagcccugau

SEQ ID NO: 967115 - RNA, 22 nt, Human
ucugagggugggagaaggagcu

SEQ ID NO: 967116 - RNA, 22 nt, Human
ggauggcauguugggcucuguu

SEQ ID NO: 967117 - RNA, 22 nt, Human
ccuggaccaaacacuggccugg

SEQ ID NO: 967118 - RNA, 22 nt, Human
gcuguauuccugcacuguauag

SEQ ID NO: 967119 - RNA, 22 nt, Human
gaaaugugggucaugacccauu

SEQ ID NO: 967120 - RNA, 22 nt, Human
guuuaagaggguuucauuccca

SEQ ID NO: 967121 - RNA, 22 nt, Human
uggagggaacccaggcugcucu

SEQ ID NO: 967122 - RNA, 22 nt, Human
uugaagcaaggcgaaucuugug

SEQ ID NO: 967123 - RNA, 22 nt, Human
auauuuucacagaacuugcaaa

SEQ ID NO: 967124 - RNA, 22 nt, Human
gcucccaccaggcagaccuacc

SEQ ID NO: 967125 - RNA, 22 nt, Human
ucuucagauaaagggagaguau

SEQ ID NO: 967126 - RNA, 22 nt, Human
auguuuaaucggcugccuuucc

SEQ ID NO: 967127 - RNA, 22 nt, Human
auuuccauacacccauuucuga

SEQ ID NO: 967128 - RNA, 22 nt, Human
agcccagcaaagggagguucag

SEQ ID NO: 967129 - RNA, 22 nt, Human
aagucagagcaacugagacauu

SEQ ID NO: 967130 - RNA, 22 nt, Human
ggccagcugggccaccaggugc

SEQ ID NO: 967131 - RNA, 22 nt, Human
agaaaugaagcaggaguuauua

SEQ ID NO: 967132 - RNA, 22 nt, Human
uaccauuucauucuuuccucau

SEQ ID NO: 967133 - RNA, 22 nt, Human
acucugcucuuauaguguuaua

SEQ ID NO: 967134 - RNA, 22 nt, Human
cggaggggauacauuuucugaa

SEQ ID NO: 967135 - RNA, 22 nt, Human
ucugagagucucugaggcagau

SEQ ID NO: 967136 - RNA, 22 nt, Human
cugggccaucagaggggcugga

SEQ ID NO: 967137 - RNA, 22 nt, Human
uuccucugaaauggcuuggaaa

SEQ ID NO: 967138 - RNA, 22 nt, Human
ccaggccuggccaggggaugcc

SEQ ID NO: 967139 - RNA, 22 nt, Human
gaagcagcaaaucugcaguauc

SEQ ID NO: 967140 - RNA, 22 nt, Human
cagcagagguuggaacaguucu

SEQ ID NO: 967141 - RNA, 22 nt, Human
gacauucacaguuuccgauggu

SEQ ID NO: 967142 - RNA, 22 nt, Human
auaucuuuguuuuugccaagau

SEQ ID NO: 967143 - RNA, 22 nt, Human
gcugguccacucccuggaggcu

SEQ ID NO: 967144 - RNA, 22 nt, Human
ggugccagccuagugcaguggu

SEQ ID NO: 967145 - RNA, 23 nt, Human
ugcugggcagagcuggugcugag

SEQ ID NO: 967146 - RNA, 21 nt, Human
augacagaugcugcagaucgu

SEQ ID NO: 967147 - RNA, 22 nt, Human
agugucauuuuguccaucuucu

SEQ ID NO: 967148 - RNA, 22 nt, Human
ucagagaugcagugccaccuac

SEQ ID NO: 967149 - RNA, 20 nt, Human
agugccagggcaggugagag

SEQ ID NO: 967150 - RNA, 22 nt, Human
uggagcagcuaagccucugaga

SEQ ID NO: 967151 - RNA, 18 nt, Human
aggaagcaggaggaaggc

SEQ ID NO: 967152 - RNA, 22 nt, Human
uaggcacugggcuaggacaggu

SEQ ID NO: 967153 - RNA, 22 nt, Human
ccagcaugagacgaugaugaag

SEQ ID NO: 967154 - RNA, 22 nt, Human
uuucauaaggguuucuagacuu

SEQ ID NO: 967155 - RNA, 22 nt, Human
gcuguucaagacuaggaaauuu

SEQ ID NO: 967156 - RNA, 23 nt, Human
ugugucugaggauauaugugcau

SEQ ID NO: 967157 - RNA, 22 nt, Human
ucccuuaaaacucauguguugu

SEQ ID NO: 967158 - RNA, 22 nt, Human
ugggcucugugccagguuggug

SEQ ID NO: 967159 - RNA, 22 nt, Human
ggccugaggcaauagucagaca

SEQ ID NO: 967160 - RNA, 22 nt, Human
cccaggaugaucgagaguggga

SEQ ID NO: 967161 - RNA, 22 nt, Human
cuucaguucuaaaguagaaugu

SEQ ID NO: 967162 - RNA, 22 nt, Human
uuucaggguacauggagcaaau

SEQ ID NO: 967163 - RNA, 22 nt, Human
gagcuuccugaugccgaccagu

SEQ ID NO: 967164 - RNA, 22 nt, Human
ugauuuccucuacuagcaauua

SEQ ID NO: 967165 - RNA, 22 nt, Human
ccagggcagcagaauuggggca

SEQ ID NO: 967166 - RNA, 19 nt, Human
agcagccauagacaauaug

SEQ ID NO: 967167 - RNA, 23 nt, Human
ccagcccuccaccagcucuaggc

SEQ ID NO: 967168 - RNA, 22 nt, Human
gcacccagccagcaucucagag

SEQ ID NO: 967169 - RNA, 23 nt, Human
cccauuuucauguuaacuccugg

SEQ ID NO: 967170 - RNA, 22 nt, Human
ccuguucagagcuaagcaucau

SEQ ID NO: 967171 - RNA, 19 nt, Human
cucagcuguagcucaugug

SEQ ID NO: 967172 - RNA, 22 nt, Human
agagcugaggauccagcugagc

SEQ ID NO: 967173 - RNA, 22 nt, Human
cagggugcgccacucagaugua

SEQ ID NO: 967174 - RNA, 22 nt, Human
cagggccagcgucucgggcuau

SEQ ID NO: 967175 - RNA, 22 nt, Human
gagggcugcaaugagacagaga

SEQ ID NO: 967176 - RNA, 22 nt, Human
uggcgagccccgacugaguguu

SEQ ID NO: 967177 - RNA, 22 nt, Human
cuggcuguauuaguuugauccu

SEQ ID NO: 967178 - RNA, 18 nt, Human
gggcaucauucacaaagu

SEQ ID NO: 967179 - RNA, 22 nt, Human
gccuugggccagcugcucugga

SEQ ID NO: 967180 - RNA, 22 nt, Human
acagcuguggccacuugcaucc

SEQ ID NO: 967181 - RNA, 20 nt, Human
uucuuucaucuacacguugu

SEQ ID NO: 967182 - RNA, 22 nt, Human
agcaacaggaaauagcugauua

SEQ ID NO: 967183 - RNA, 22 nt, Human
cugggcaggagggcucuaugga

SEQ ID NO: 967184 - RNA, 22 nt, Human
caggucagaggcgcagccccca

SEQ ID NO: 967185 - RNA, 22 nt, Human
gauuauauaauggaagcucuug

SEQ ID NO: 967186 - RNA, 22 nt, Human
aggggccucgcaggaccgcucc

SEQ ID NO: 967187 - RNA, 23 nt, Human
uggcucuguggaucccucaggag

SEQ ID NO: 967188 - RNA, 22 nt, Human
ccuggccagcuaauugcccauc

SEQ ID NO: 967189 - RNA, 22 nt, Human
augccaggccccacgcugggca

SEQ ID NO: 967190 - RNA, 22 nt, Human
aggauccuuuggccacuucuua

SEQ ID NO: 967191 - RNA, 22 nt, Human
aucugcuugaaugagcaacagg

SEQ ID NO: 967192 - RNA, 22 nt, Human
cagcaggcugcgauugcucauu

SEQ ID NO: 967193 - RNA, 22 nt, Human
agagccugucugccuuucuacc

SEQ ID NO: 967194 - RNA, 22 nt, Human
uagaaacacagagagacccaug

SEQ ID NO: 967195 - RNA, 22 nt, Human
gaaguacaguuuuaucuagcca

SEQ ID NO: 967196 - RNA, 20 nt, Human
ccugggguacacuggcaugu

SEQ ID NO: 967197 - RNA, 22 nt, Human
ggaggcagaauagagugugggu

SEQ ID NO: 967198 - RNA, 22 nt, Human
ggaugcuggggaccaaucucug

SEQ ID NO: 967199 - RNA, 21 nt, Human
aggcaucuaaagagaguagac

SEQ ID NO: 967200 - RNA, 22 nt, Human
gcuccuggauguucaagucggc

SEQ ID NO: 967201 - RNA, 22 nt, Human
caaagcucaugcucuuagccau

SEQ ID NO: 967202 - RNA, 22 nt, Human
gaagagcugcucagaacaugau

SEQ ID NO: 967203 - RNA, 22 nt, Human
gacuccuggcuuucccucuuag

SEQ ID NO: 967204 - RNA, 22 nt, Human
gaggcagcaucuauggugggaa

SEQ ID NO: 967205 - RNA, 22 nt, Human
ucuucuucccaucccucaaaug

SEQ ID NO: 967206 - RNA, 22 nt, Human
gcccucugcacagcucugagca

SEQ ID NO: 967207 - RNA, 22 nt, Human
gugccagggggcacugaacaga

SEQ ID NO: 967208 - RNA, 22 nt, Human
ccugcucugguuuagucagucu

SEQ ID NO: 967209 - RNA, 22 nt, Human
uucagcaagaauuuacugagcu

SEQ ID NO: 967210 - RNA, 19 nt, Human
gcuguauuaaagauacaug

SEQ ID NO: 967211 - RNA, 22 nt, Human
ggucccagcugcucaagaggcu

SEQ ID NO: 967212 - RNA, 22 nt, Human
cugcccagaaucacucacucga

SEQ ID NO: 967213 - RNA, 22 nt, Human
augcuuuuaugucacaugguca

SEQ ID NO: 967214 - RNA, 22 nt, Human
ucuuugcaggccaaauuguuaa

SEQ ID NO: 967215 - RNA, 22 nt, Human
ugcagcuucuuguccugugauu

SEQ ID NO: 967216 - RNA, 22 nt, Human
aaauguuagguuguacugaguc

SEQ ID NO: 967217 - RNA, 22 nt, Human
gccugucugcgucacgcuuauu

SEQ ID NO: 967218 - RNA, 22 nt, Human
aaagaauacccugggucauaaa

SEQ ID NO: 967219 - RNA, 20 nt, Human
aggcaccugucacaggugag

SEQ ID NO: 967220 - RNA, 22 nt, Human
cccaggagagagacuugaaucu

SEQ ID NO: 967221 - RNA, 18 nt, Human
agucuucugauccauuuu

SEQ ID NO: 967222 - RNA, 22 nt, Human
uccacagaauguaagauccaca

SEQ ID NO: 967223 - RNA, 21 nt, Human
gcugucucuggcuccugggaa

SEQ ID NO: 967224 - RNA, 19 nt, Human
uccaaaggacccaccucca

SEQ ID NO: 967225 - RNA, 22 nt, Human
cucagggccaaggaugcuguug

SEQ ID NO: 967226 - RNA, 22 nt, Human
acuuucuaggucucaguccuuu

SEQ ID NO: 967227 - RNA, 19 nt, Human
gcacccugaggucauggcc

SEQ ID NO: 967228 - RNA, 20 nt, Human
agcaggaaugaugcuuucau

SEQ ID NO: 967229 - RNA, 23 nt, Human
aguuccagaaaaaugcucaagca

SEQ ID NO: 967230 - RNA, 22 nt, Human
aguuacuugagacguuuaugaa

SEQ ID NO: 967231 - RNA, 22 nt, Human
uaugcacauugguuuccucauu

SEQ ID NO: 967232 - RNA, 22 nt, Human
uuagaaaucaccucugaagauc

SEQ ID NO: 967233 - RNA, 22 nt, Human
uugcaccauuucacuuccauua

SEQ ID NO: 967234 - RNA, 22 nt, Human
agcagcugcagagggcuccccc

SEQ ID NO: 967235 - RNA, 22 nt, Human
gaggaggcuggcgccgccugcc

SEQ ID NO: 967236 - RNA, 22 nt, Human
ggagccuguggcugcuugaagc

SEQ ID NO: 967237 - RNA, 22 nt, Human
ccaggcuggauuuugcaguuca

SEQ ID NO: 967238 - RNA, 21 nt, Human
ucccacucuaaauggacugaa

SEQ ID NO: 967239 - RNA, 22 nt, Human
cauuucauaguugucacaauaa

SEQ ID NO: 967240 - RNA, 22 nt, Human
gcagcaugagcuauacaaagua

SEQ ID NO: 967241 - RNA, 22 nt, Human
acccaggagcaggcugggcagu

SEQ ID NO: 967242 - RNA, 22 nt, Human
ugggagcagccucagcuucggg

SEQ ID NO: 967243 - RNA, 22 nt, Human
ggucugaguggugcugacucag

SEQ ID NO: 967244 - RNA, 22 nt, Human
uuggaggcaaugggaaggaggc

SEQ ID NO: 967245 - RNA, 22 nt, Human
acacauuuacauguuuacguau

SEQ ID NO: 967246 - RNA, 22 nt, Human
ucucagagaggggccgggccuu

SEQ ID NO: 967247 - RNA, 22 nt, Human
gcacccagggacuuggcuggcc

SEQ ID NO: 967248 - RNA, 22 nt, Human
gaaggccacggaauggagcugg

SEQ ID NO: 967249 - RNA, 22 nt, Human
ucagggcaucaucaugaauaua

SEQ ID NO: 967250 - RNA, 22 nt, Human
ucuuugcaaaauacaacaaugg

SEQ ID NO: 967251 - RNA, 22 nt, Human
uuuaagaaguuauguuauaaau

SEQ ID NO: 967252 - RNA, 22 nt, Human
acagccagucaucucagcaggg

SEQ ID NO: 967253 - RNA, 22 nt, Human
ugucucugaacagcuuacuaaa

SEQ ID NO: 967254 - RNA, 22 nt, Human
acucaggaauggggcugggacu

SEQ ID NO: 967255 - RNA, 22 nt, Human
ucagcagugcagggugaggcag

SEQ ID NO: 967256 - RNA, 22 nt, Human
gaaccucagugaaacuggaggu

SEQ ID NO: 967257 - RNA, 22 nt, Human
cuuguauuccccuaucucuaaa

SEQ ID NO: 967258 - RNA, 22 nt, Human
ccugggagagccaucuguggcc

SEQ ID NO: 967259 - RNA, 19 nt, Human
gcuccugggccucacucau

SEQ ID NO: 967260 - RNA, 22 nt, Human
gacuucuauuaauaccucuacu

SEQ ID NO: 967261 - RNA, 22 nt, Human
ugggagcagccaacauggccuu

SEQ ID NO: 967262 - RNA, 22 nt, Human
gcagcagaugcuuucauggaca

SEQ ID NO: 967263 - RNA, 22 nt, Human
agucuugcauuuucugaagaug

SEQ ID NO: 967264 - RNA, 22 nt, Human
gugucaugcacacucaguguug

SEQ ID NO: 967265 - RNA, 22 nt, Human
ccuugcugcgugcuagcacaga

SEQ ID NO: 967266 - RNA, 22 nt, Human
ccugggaggcuguuuccagccu

SEQ ID NO: 967267 - RNA, 22 nt, Human
cuuguacauagagaagaagccu

SEQ ID NO: 967268 - RNA, 18 nt, Human
ugcuuggagcauuuacca

SEQ ID NO: 967269 - RNA, 22 nt, Human
aauggacaggagagcauaguca

SEQ ID NO: 967270 - RNA, 22 nt, Human
caaggccaugagcagcgagugu

SEQ ID NO: 967271 - RNA, 22 nt, Human
agggcagagcugucuaaauggc

SEQ ID NO: 967272 - RNA, 22 nt, Human
ggcucccugccuguccucaguc

SEQ ID NO: 967273 - RNA, 22 nt, Human
uaguccagccuuggguguagcc

SEQ ID NO: 967274 - RNA, 22 nt, Human
agggugccugcugcagguucag

SEQ ID NO: 967275 - RNA, 19 nt, Human
agccuggagggcuggucac

SEQ ID NO: 967276 - RNA, 22 nt, Human
ucuguucagcugccucagggua

SEQ ID NO: 967277 - RNA, 22 nt, Human
uuuauauuucccaggauuggcc

SEQ ID NO: 967278 - RNA, 22 nt, Human
agcugccaucagccuuuggaug

SEQ ID NO: 967279 - RNA, 22 nt, Human
gcugcaggggggucuggacuug

SEQ ID NO: 967280 - RNA, 22 nt, Human
cuuaagauuugcgauaccuaau

SEQ ID NO: 967281 - RNA, 22 nt, Human
aguuuuuccguggcuacgauaa

SEQ ID NO: 967282 - RNA, 22 nt, Human
gcagaggcagggcccuccucca

SEQ ID NO: 967283 - RNA, 22 nt, Human
uccauggggcccaggaugagag

SEQ ID NO: 967284 - RNA, 22 nt, Human
cauugcaccacauugcaucccu

SEQ ID NO: 967285 - RNA, 22 nt, Human
augauggugggagaugacccag

SEQ ID NO: 967286 - RNA, 22 nt, Human
cugcuuuguggaaucacacugg

SEQ ID NO: 967287 - RNA, 22 nt, Human
uggaagagguggaaguggcuuc

SEQ ID NO: 967288 - RNA, 22 nt, Human
agauauuuguaucuugcuauug

SEQ ID NO: 967289 - RNA, 22 nt, Human
gcuguguuggugaagcuguagc

SEQ ID NO: 967290 - RNA, 22 nt, Human
agccuggcuguaaccucauggu

SEQ ID NO: 967291 - RNA, 22 nt, Human
gagggaggcaucaugaauccag

SEQ ID NO: 967292 - RNA, 22 nt, Human
ucuggaaguuagaggaggaaag

SEQ ID NO: 967293 - RNA, 22 nt, Human
acagggcagagugaaaugcuau

SEQ ID NO: 967294 - RNA, 22 nt, Human
aauggcucugauguuguuguga

SEQ ID NO: 967295 - RNA, 22 nt, Human
cugcuuuggcucagugacauca

SEQ ID NO: 967296 - RNA, 22 nt, Human
ccugggcaucucaugcaccugc

SEQ ID NO: 967297 - RNA, 22 nt, Human
ucuucccuaaucaccaucuuca

SEQ ID NO: 967298 - RNA, 22 nt, Human
uccaggaguuugaccugugggc

SEQ ID NO: 967299 - RNA, 22 nt, Human
augaggauuaacuguugucaua

SEQ ID NO: 967300 - RNA, 22 nt, Human
ucacaguaaaagcauggaagag

SEQ ID NO: 967301 - RNA, 22 nt, Human
cugcauucauaucagauagaag

SEQ ID NO: 967302 - RNA, 20 nt, Human
aacagggggcugcagagggc

SEQ ID NO: 967303 - RNA, 22 nt, Human
cagccaucaguaaagacagcuu

SEQ ID NO: 967304 - RNA, 22 nt, Human
auguuucaaugcacuuuagccu

SEQ ID NO: 967305 - RNA, 22 nt, Human
uccuucaguuaaagaucucaca

SEQ ID NO: 967306 - RNA, 22 nt, Human
agcuuguuaaggaugcauauua

SEQ ID NO: 967307 - RNA, 22 nt, Human
ccaggguggcguagaugcuggg

SEQ ID NO: 967308 - RNA, 22 nt, Human
uuucagaaagcaucaucaaagu

SEQ ID NO: 967309 - RNA, 22 nt, Human
ucucuucuugauuuucacugga

SEQ ID NO: 967310 - RNA, 22 nt, Human
aggagcugagucagcccgacag

SEQ ID NO: 967311 - RNA, 22 nt, Human
ucaagcaggguagcaagcuggu

SEQ ID NO: 967312 - RNA, 22 nt, Human
aaucaguuaggguguuaaugag

SEQ ID NO: 967313 - RNA, 22 nt, Human
gguuugcauucugaaaggcuca

SEQ ID NO: 967314 - RNA, 18 nt, Human
ggccugaggauuucagca

SEQ ID NO: 967315 - RNA, 22 nt, Human
ucugaggcauacccaggccccc

SEQ ID NO: 967316 - RNA, 22 nt, Human
aagaauguuaguuucugauaca

SEQ ID NO: 967317 - RNA, 22 nt, Human
ugaaaugaagggcuuguucugg

SEQ ID NO: 967318 - RNA, 21 nt, Human
uggcucugaaagagugcugca

SEQ ID NO: 967319 - RNA, 22 nt, Human
gaguuauugaguauagaaugua

SEQ ID NO: 967320 - RNA, 22 nt, Human
ggaggggagguccagcugaucu

SEQ ID NO: 967321 - RNA, 21 nt, Human
acagggcaugcagcuggcugu

SEQ ID NO: 967322 - RNA, 22 nt, Human
acugggagggucuugaagaggg

SEQ ID NO: 967323 - RNA, 22 nt, Human
ccucugcaccauagccuucagc

SEQ ID NO: 967324 - RNA, 22 nt, Human
uccauuggucucugugcccagg

SEQ ID NO: 967325 - RNA, 22 nt, Human
uucacagggccacuggcaggag

SEQ ID NO: 967326 - RNA, 22 nt, Human
auugagaauccauuugagauga

SEQ ID NO: 967327 - RNA, 22 nt, Human
aucuggcuuacgaagcacuggu

SEQ ID NO: 967328 - RNA, 22 nt, Human
uacuuuagaaggaaauaaguuc

SEQ ID NO: 967329 - RNA, 22 nt, Human
gggccaggucggugaaugguca

SEQ ID NO: 967330 - RNA, 20 nt, Human
augugagggguugaaguggg

SEQ ID NO: 967331 - RNA, 22 nt, Human
ggagagagaugccgccuugcuc

SEQ ID NO: 967332 - RNA, 22 nt, Human
gggcugugggacccggcacuuu

SEQ ID NO: 967333 - RNA, 22 nt, Human
ugccugggggacuaaggccaaa

SEQ ID NO: 967334 - RNA, 23 nt, Human
ucguugaauagcaauagcacaac

SEQ ID NO: 967335 - RNA, 22 nt, Human
gagggaaagguuaauacaugau

SEQ ID NO: 967336 - RNA, 22 nt, Human
aguggcagagcugugucuugaa

SEQ ID NO: 967337 - RNA, 20 nt, Human
ucaccuuuguugguauucau

SEQ ID NO: 967338 - RNA, 22 nt, Human
uguucuugagccuuuagaccua

SEQ ID NO: 967339 - RNA, 22 nt, Human
cagagggcacaugguuuccuca

SEQ ID NO: 967340 - RNA, 21 nt, Human
uccugccuuaguccagagcag

SEQ ID NO: 967341 - RNA, 22 nt, Human
ucacugcagagaccucuaguca

SEQ ID NO: 967342 - RNA, 22 nt, Human
uuucuaguccucaugcaucauu

SEQ ID NO: 967343 - RNA, 22 nt, Human
aaaacagacagccaguguagag

SEQ ID NO: 967344 - RNA, 22 nt, Human
agggacagucuacuguucacug

SEQ ID NO: 967345 - RNA, 22 nt, Human
gugccugguuuggggaauguuc

SEQ ID NO: 967346 - RNA, 20 nt, Human
ugaaggccauuuguuccaga

SEQ ID NO: 967347 - RNA, 22 nt, Human
caugaagcuugaagcaguccac

SEQ ID NO: 967348 - RNA, 22 nt, Human
cugggagcggcugucacugguu

SEQ ID NO: 967349 - RNA, 22 nt, Human
caaaaguaauggcgguuuuuac

SEQ ID NO: 967350 - RNA, 22 nt, Human
ucauaaaacacaccagguaguu

SEQ ID NO: 967351 - RNA, 22 nt, Human
gcauacagagaggauguggcau

SEQ ID NO: 967352 - RNA, 22 nt, Human
auugcuguaaauuaucuuauua

SEQ ID NO: 967353 - RNA, 22 nt, Human
ucagaagucccuugcaucuuag

SEQ ID NO: 967354 - RNA, 22 nt, Human
caguugcuacaguucaagugug

SEQ ID NO: 967355 - RNA, 22 nt, Human
gaggaaggucccaucagaauuu

SEQ ID NO: 967356 - RNA, 22 nt, Human
cugccuguuagucuagcaguua

SEQ ID NO: 967357 - RNA, 20 nt, Human
gacauucauaguuauuacca

SEQ ID NO: 967358 - RNA, 22 nt, Human
ccagcaccuugaucuuggaguu

SEQ ID NO: 967359 - RNA, 17 nt, Human
ggcagcugccacuuuuu

SEQ ID NO: 967360 - RNA, 23 nt, Human
aguacauucgaaaaauucuguga

SEQ ID NO: 967361 - RNA, 22 nt, Human
aaggccaggacaccaggggacu

SEQ ID NO: 967362 - RNA, 22 nt, Human
ucuucaaacugaaaauuuagaa

SEQ ID NO: 967363 - RNA, 22 nt, Human
gccaggcuggucuugaacuccu

SEQ ID NO: 967364 - RNA, 22 nt, Human
aauguucauugauuaaaugaau

SEQ ID NO: 967365 - RNA, 22 nt, Human
uggcagggccugcucaucaucc

SEQ ID NO: 967366 - RNA, 19 nt, Human
ucccaggaaccuuuuauuu

SEQ ID NO: 967367 - RNA, 22 nt, Human
ugcagaaggaggaggaaaucca

SEQ ID NO: 967368 - RNA, 22 nt, Human
gagggcugaagauuguggcccc

SEQ ID NO: 967369 - RNA, 19 nt, Human
aagggcugggcaccucacu

SEQ ID NO: 967370 - RNA, 22 nt, Human
aucacugucgucaucugagauu

SEQ ID NO: 967371 - RNA, 22 nt, Human
uacagucuuuggaaagagauag

SEQ ID NO: 967372 - RNA, 22 nt, Human
cagggccagccauccugcuggg

SEQ ID NO: 967373 - RNA, 22 nt, Human
cccaggcugauguucagcgggu

SEQ ID NO: 967374 - RNA, 22 nt, Human
uggcuuccugcacagugucugc

SEQ ID NO: 967375 - RNA, 22 nt, Human
uguuggcauuagaggguuauug

SEQ ID NO: 967376 - RNA, 22 nt, Human
uaaagguacgaagugagggauu

SEQ ID NO: 967377 - RNA, 22 nt, Human
cuggcagcugcccgagaugccc

SEQ ID NO: 967378 - RNA, 22 nt, Human
acuuugcagagccagaagagaa

SEQ ID NO: 967379 - RNA, 22 nt, Human
aaggcucuuggagugaaugcag

SEQ ID NO: 967380 - RNA, 22 nt, Human
ucuagaaacaugacauugaucu

SEQ ID NO: 967381 - RNA, 20 nt, Human
ggcugugcccuuccguggcc

SEQ ID NO: 967382 - RNA, 22 nt, Human
ggugaaggaggaagcugaugga

SEQ ID NO: 967383 - RNA, 22 nt, Human
aaggcucucugauggcagcagu

SEQ ID NO: 967384 - RNA, 23 nt, Human
uggcucugagcuuccugguggcc

SEQ ID NO: 967385 - RNA, 22 nt, Human
accaggcugugaagugagacua

SEQ ID NO: 967386 - RNA, 21 nt, Human
ugccagggauuuacagagccu

SEQ ID NO: 967387 - RNA, 22 nt, Human
caggugggaccaugauagggca

SEQ ID NO: 967388 - RNA, 22 nt, Human
cuggcacacaaguauuuccuuu

SEQ ID NO: 967389 - RNA, 22 nt, Human
gggagggguugcauguuugagu

SEQ ID NO: 967390 - RNA, 22 nt, Human
ucaguagcagaaagcaaugagu

SEQ ID NO: 967391 - RNA, 22 nt, Human
aggcaguguauugcuagcggcu

SEQ ID NO: 967392 - RNA, 20 nt, Human
ggccugagcauggcuggcag

SEQ ID NO: 967393 - RNA, 22 nt, Human
cccugagaugccucacccuagu

SEQ ID NO: 967394 - RNA, 18 nt, Human
uccagagguguuggagcc

SEQ ID NO: 967395 - RNA, 22 nt, Human
aaauuucaguuaccuuuacguu

SEQ ID NO: 967396 - RNA, 22 nt, Human
ggccuugggaggagggucagaa

SEQ ID NO: 967397 - RNA, 22 nt, Human
ccugagaggcccucucacuguc

SEQ ID NO: 967398 - RNA, 22 nt, Human
cccaggaugucgaggcugcagu

SEQ ID NO: 967399 - RNA, 21 nt, Human
agagaauugccuuagauguuc

SEQ ID NO: 967400 - RNA, 21 nt, Human
augaagucuaugcuucugugu

SEQ ID NO: 967401 - RNA, 22 nt, Human
ugcucagacaagcugaacagua

SEQ ID NO: 967402 - RNA, 22 nt, Human
aguuacaaccaugacacaagca

SEQ ID NO: 967403 - RNA, 22 nt, Human
acaggggauugauuggaagucu

SEQ ID NO: 967404 - RNA, 22 nt, Human
uuccagaaaucuuucagcucaa

SEQ ID NO: 967405 - RNA, 22 nt, Human
uuuccagagcaugucugcucag

SEQ ID NO: 967406 - RNA, 18 nt, Human
gagaggagccagaauuuu

SEQ ID NO: 967407 - RNA, 22 nt, Human
uucuuacagaguuuacagagcc

SEQ ID NO: 967408 - RNA, 22 nt, Human
caauaugcaagcuauuaaguau

SEQ ID NO: 967409 - RNA, 22 nt, Human
ucucuucuagcuucuugugguu

SEQ ID NO: 967410 - RNA, 22 nt, Human
gaccuggaggauccucuucuug

SEQ ID NO: 967411 - RNA, 22 nt, Human
ccucuggggguccucagagucu

SEQ ID NO: 967412 - RNA, 22 nt, Human
ugaaggaagaauaggcaguguu

SEQ ID NO: 967413 - RNA, 22 nt, Human
cugaggccagcugcagagcucu

SEQ ID NO: 967414 - RNA, 22 nt, Human
uaagaacauaaauucauacggg

SEQ ID NO: 967415 - RNA, 22 nt, Human
uuuauugcauacacaaauguca

SEQ ID NO: 967416 - RNA, 22 nt, Human
gaggccaggaagcccaagauca

SEQ ID NO: 967417 - RNA, 22 nt, Human
gagguagcgaguggacagugca

SEQ ID NO: 967418 - RNA, 18 nt, Human
acugugugaauuagcucc

SEQ ID NO: 967419 - RNA, 22 nt, Human
aggaagccaugguggacgucua

SEQ ID NO: 967420 - RNA, 20 nt, Human
uggcuccucuuggcuguggc

SEQ ID NO: 967421 - RNA, 22 nt, Human
aguaccaugcuuccugacuggu

SEQ ID NO: 967422 - RNA, 22 nt, Human
uccagcagggaauuaguagucu

SEQ ID NO: 967423 - RNA, 22 nt, Human
cuccuggcuucugaaaucgugg

SEQ ID NO: 967424 - RNA, 22 nt, Human
cugcccagaagccagaugggca

SEQ ID NO: 967425 - RNA, 22 nt, Human
acuguguguuugucuagcacag

SEQ ID NO: 967426 - RNA, 22 nt, Human
ucagggaacuacuucucccuau

SEQ ID NO: 967427 - RNA, 22 nt, Human
ucucucagucagaugcuaaaga

SEQ ID NO: 967428 - RNA, 22 nt, Human
aggcacaggaaugucauccagu

SEQ ID NO: 967429 - RNA, 22 nt, Human
ucaggggacagccagcuggagg

SEQ ID NO: 967430 - RNA, 22 nt, Human
ugggcucauggcccagcacugg

SEQ ID NO: 967431 - RNA, 22 nt, Human
uuguaacagcuguuuauauagu

SEQ ID NO: 967432 - RNA, 22 nt, Human
uggaaagaaaguaaaggcguau

SEQ ID NO: 967433 - RNA, 22 nt, Human
uggcucaggguccccaaauggu

SEQ ID NO: 967434 - RNA, 22 nt, Human
ggccugagcucuggggaggcaa

SEQ ID NO: 967435 - RNA, 22 nt, Human
caaauucacaugauugcuucug

SEQ ID NO: 967436 - RNA, 22 nt, Human
gggguggauuccuacaggucca

SEQ ID NO: 967437 - RNA, 22 nt, Human
cuccucuggaaauuccucugcc

SEQ ID NO: 967438 - RNA, 21 nt, Human
uccuggccagggcacuaggca

SEQ ID NO: 967439 - RNA, 22 nt, Human
gggagacacgcugcaggcauaa

SEQ ID NO: 967440 - RNA, 22 nt, Human
uuucuguaaguggcaaauaaug

SEQ ID NO: 967441 - RNA, 22 nt, Human
gcucugcugggugggcaguuau

SEQ ID NO: 967442 - RNA, 22 nt, Human
cugcagagcaaguaacauccuc

SEQ ID NO: 967443 - RNA, 22 nt, Human
cucccaggggaacuaucaagua

SEQ ID NO: 967444 - RNA, 21 nt, Human
acagacagggccagugucccc

SEQ ID NO: 967445 - RNA, 22 nt, Human
ugcugguggagaaaguggaggu

SEQ ID NO: 967446 - RNA, 22 nt, Human
uuccagagcaguuuucagauca

SEQ ID NO: 967447 - RNA, 22 nt, Human
ugaggugaagaguggagcucag

SEQ ID NO: 967448 - RNA, 22 nt, Human
ggcagugaaugaaacagaggcu

SEQ ID NO: 967449 - RNA, 22 nt, Human
aagcagccaccucaucuccacu

SEQ ID NO: 967450 - RNA, 22 nt, Human
uuccuggccccaccccuggaga

SEQ ID NO: 967451 - RNA, 22 nt, Human
agcugucugucuccugaggaga

SEQ ID NO: 967452 - RNA, 22 nt, Human
ugcaaacuauugguagagaugg

SEQ ID NO: 967453 - RNA, 22 nt, Human
uacaaagcuguauagccugguc

SEQ ID NO: 967454 - RNA, 22 nt, Human
uuucaacauauaccauaaugcc

SEQ ID NO: 967455 - RNA, 22 nt, Human
uggcuucaucugcagcacugcc

SEQ ID NO: 967456 - RNA, 22 nt, Human
ggcuuccuuucacuacccucag

SEQ ID NO: 967457 - RNA, 22 nt, Human
ccacaggggcccacgagccgcu

SEQ ID NO: 967458 - RNA, 22 nt, Human
uccugccuucauacugcuguau

SEQ ID NO: 967459 - RNA, 22 nt, Human
cuuauuauaaaauccuguuuga

SEQ ID NO: 967460 - RNA, 22 nt, Human
cccauuuaucccaagguuacuc

SEQ ID NO: 967461 - RNA, 22 nt, Human
cugggcacaggggagcagaguc

SEQ ID NO: 967462 - RNA, 22 nt, Human
ucaugaauauugaaugcuucau

SEQ ID NO: 967463 - RNA, 22 nt, Human
uuaagacauucagauauuucua

SEQ ID NO: 967464 - RNA, 22 nt, Human
uuucacaucagagguagauuag

SEQ ID NO: 967465 - RNA, 21 nt, Human
cagcagaguaaugcauucgua

SEQ ID NO: 967466 - RNA, 22 nt, Human
gagauuucuuuugaugccuguc

SEQ ID NO: 967467 - RNA, 22 nt, Human
ugaggggagcccgcccuggacg

SEQ ID NO: 967468 - RNA, 22 nt, Human
gauuuuauauggcauacugugg

SEQ ID NO: 967469 - RNA, 22 nt, Human
uaccuuggguugaguucauucu

SEQ ID NO: 967470 - RNA, 22 nt, Human
ucuuuguaacugucuauugaga

SEQ ID NO: 967471 - RNA, 20 nt, Human
uccuugaaagugggguauau

SEQ ID NO: 967472 - RNA, 22 nt, Human
ucucuggaauuggcugaggcaa

SEQ ID NO: 967473 - RNA, 22 nt, Human
ccugugaggucaucugugguaa

SEQ ID NO: 967474 - RNA, 22 nt, Human
ccuaagaauuaaugaauacacc

SEQ ID NO: 967475 - RNA, 22 nt, Human
gggcuacagacaugcucuaagc

SEQ ID NO: 967476 - RNA, 22 nt, Human
acacagggucuagaguuaggcc

SEQ ID NO: 967477 - RNA, 22 nt, Human
uaaggcauucucaugcugugaa

SEQ ID NO: 967478 - RNA, 22 nt, Human
cacagggcuucucauggggugc

SEQ ID NO: 967479 - RNA, 22 nt, Human
auuugcuucugugaaaucaagu

SEQ ID NO: 967480 - RNA, 22 nt, Human
ccagcugcugugcagggaggcu

SEQ ID NO: 967481 - RNA, 22 nt, Human
ugggagagcacugcagccccgg

SEQ ID NO: 967482 - RNA, 22 nt, Human
uuuugugagcccauaaaugcca

SEQ ID NO: 967483 - RNA, 22 nt, Human
ggcuguagguuggugcuggaca

SEQ ID NO: 967484 - RNA, 22 nt, Human
cccagcccagcguucgaggggu

SEQ ID NO: 967485 - RNA, 18 nt, Human
cggcagagugcuucuagc

SEQ ID NO: 967486 - RNA, 22 nt, Human
uagggcagaguccaggaugggc

SEQ ID NO: 967487 - RNA, 22 nt, Human
auccauggaggacaagagcaau

SEQ ID NO: 967488 - RNA, 17 nt, Human
uccuucagggccucaca

SEQ ID NO: 967489 - RNA, 22 nt, Human
cagagccaacgccaccugccca

SEQ ID NO: 967490 - RNA, 22 nt, Human
uggcugugugccaggcugucug

SEQ ID NO: 967491 - RNA, 22 nt, Human
ucuccugggugcuuuaucagaa

SEQ ID NO: 967492 - RNA, 22 nt, Human
cccacucccugcacgccugccg

SEQ ID NO: 967493 - RNA, 22 nt, Human
uuccaggauggcaauaaugaau

SEQ ID NO: 967494 - RNA, 22 nt, Human
cugccugcuuaccaugcaucag

SEQ ID NO: 967495 - RNA, 22 nt, Human
uggccugcagcucucagggaag

SEQ ID NO: 967496 - RNA, 22 nt, Human
uucaggauucucucccauuuac

SEQ ID NO: 967497 - RNA, 20 nt, Human
guggccucucacauucugag

SEQ ID NO: 967498 - RNA, 22 nt, Human
ggagcagagcauuucacagccu

SEQ ID NO: 967499 - RNA, 23 nt, Human
ucugagagaacaaugccuccuau

SEQ ID NO: 967500 - RNA, 22 nt, Human
uuugaaagggaaauaaacuccu

SEQ ID NO: 967501 - RNA, 22 nt, Human
cugggccaguuaugucucaucu

SEQ ID NO: 967502 - RNA, 22 nt, Human
uaagaauuguguugaauagagu

SEQ ID NO: 967503 - RNA, 22 nt, Human
auguuuuucauaccaguguugg

SEQ ID NO: 967504 - RNA, 22 nt, Human
gggcugcugccaccagguggau

SEQ ID NO: 967505 - RNA, 22 nt, Human
cauuuauucauuugcuagggcu

SEQ ID NO: 967506 - RNA, 22 nt, Human
aucaggaucacagaaacuuuua

SEQ ID NO: 967507 - RNA, 22 nt, Human
augcaguaaauguucuaguuug

SEQ ID NO: 967508 - RNA, 22 nt, Human
uggcagcugccauguccacgug

SEQ ID NO: 967509 - RNA, 22 nt, Human
guggguggaggcgucgagggca

SEQ ID NO: 967510 - RNA, 22 nt, Human
cagcuggccugaucccuguggc

SEQ ID NO: 967511 - RNA, 22 nt, Human
caguauguacucuuaucaugua

SEQ ID NO: 967512 - RNA, 22 nt, Human
cagaagaggacuggguagcuca

SEQ ID NO: 967513 - RNA, 22 nt, Human
cuggagggugagccucaucucu

SEQ ID NO: 967514 - RNA, 22 nt, Human
ugcagccaccaccucugcugaa

SEQ ID NO: 967515 - RNA, 22 nt, Human
uuuccaagagcuuauuucugaa

SEQ ID NO: 967516 - RNA, 23 nt, Human
ugggccuggaaagccuuagagag

SEQ ID NO: 967517 - RNA, 22 nt, Human
gcugagguggcugccuuaguaa

SEQ ID NO: 967518 - RNA, 22 nt, Human
uaaaugcagcaguuucuguucu

SEQ ID NO: 967519 - RNA, 22 nt, Human
cugcugugcuuguggccacccg

SEQ ID NO: 967520 - RNA, 23 nt, Human
gccucagagaaacagcugcacac

SEQ ID NO: 967521 - RNA, 18 nt, Human
aaaugcuaggcuacauga

SEQ ID NO: 967522 - RNA, 22 nt, Human
uacuguauuugauaagugaagu

SEQ ID NO: 967523 - RNA, 22 nt, Human
agcagcaggagccgugggguga

SEQ ID NO: 967524 - RNA, 22 nt, Human
gaucuucuagcagaaguaauuu

SEQ ID NO: 967525 - RNA, 22 nt, Human
cuuccuguugucacagucugcg

SEQ ID NO: 967526 - RNA, 22 nt, Human
ugaauauguuccucacaaguuc

SEQ ID NO: 967527 - RNA, 22 nt, Human
ccucuccaguuuuaacgugacc

SEQ ID NO: 967528 - RNA, 22 nt, Human
uugugucuaaauaaggagaccu

SEQ ID NO: 967529 - RNA, 22 nt, Human
acaccagggccuagccagggcg

SEQ ID NO: 967530 - RNA, 22 nt, Human
aucagcugaaaaacaggcagca

SEQ ID NO: 967531 - RNA, 23 nt, Human
acucagcuuugggagaugacuca

SEQ ID NO: 967532 - RNA, 22 nt, Human
auucacaaauaacaggugcaga

SEQ ID NO: 967533 - RNA, 18 nt, Human
uggugaaggguggaggag

SEQ ID NO: 967534 - RNA, 22 nt, Human
aaaggaagauugagcuuuucca

SEQ ID NO: 967535 - RNA, 22 nt, Human
gcagagccaggagagacccuug

SEQ ID NO: 967536 - RNA, 22 nt, Human
gaaggggacuggcagcugcaga

SEQ ID NO: 967537 - RNA, 22 nt, Human
uguggccuccccacuucugggg

SEQ ID NO: 967538 - RNA, 22 nt, Human
ugcugaaacaauaacauacugg

SEQ ID NO: 967539 - RNA, 22 nt, Human
ccucagggaaugggaggcuggg

SEQ ID NO: 967540 - RNA, 22 nt, Human
aagauaaacucuugauuucuga

SEQ ID NO: 967541 - RNA, 22 nt, Human
cucaggauagauuguccucuca

SEQ ID NO: 967542 - RNA, 22 nt, Human
uaacaguguggacuugagaucu

SEQ ID NO: 967543 - RNA, 22 nt, Human
gaggcugccccuuccucagcug

SEQ ID NO: 967544 - RNA, 22 nt, Human
gagcaccgccuccacgaugccc

SEQ ID NO: 967545 - RNA, 22 nt, Human
ggccugcuucucagugagcuug

SEQ ID NO: 967546 - RNA, 20 nt, Human
ccagacagcaccugccuggu

SEQ ID NO: 967547 - RNA, 22 nt, Human
uuaauaaacaggugcagcugaa

SEQ ID NO: 967548 - RNA, 22 nt, Human
acugugcuuucucuggaggcau

SEQ ID NO: 967549 - RNA, 22 nt, Human
cccagggagguagcaggagaaa

SEQ ID NO: 967550 - RNA, 22 nt, Human
gguacaaggagugaagguuugg

SEQ ID NO: 967551 - RNA, 22 nt, Human
gcugagcugggacaguccuggg

SEQ ID NO: 967552 - RNA, 22 nt, Human
aaggcugagagucacaguccua

SEQ ID NO: 967553 - RNA, 22 nt, Human
gggcucugggauucagagcaag

SEQ ID NO: 967554 - RNA, 22 nt, Human
gggcagcugccaagugcaucgc

SEQ ID NO: 967555 - RNA, 22 nt, Human
uggcucuguuuguuaacuagac

SEQ ID NO: 967556 - RNA, 22 nt, Human
ugcucagggacaauggagaggg

SEQ ID NO: 967557 - RNA, 22 nt, Human
cagcaucuaaucuucaugccgg

SEQ ID NO: 967558 - RNA, 22 nt, Human
gcaaagcugggugugaaugcac

SEQ ID NO: 967559 - RNA, 22 nt, Human
ucagacuugccuuuuuauaaaa

SEQ ID NO: 967560 - RNA, 22 nt, Human
ucugacauuuugagaaugacau

SEQ ID NO: 967561 - RNA, 23 nt, Human
cuucuggcucuauaucagaauuc

SEQ ID NO: 967562 - RNA, 22 nt, Human
auaaugaggauuugcauauuag

SEQ ID NO: 967563 - RNA, 22 nt, Human
aaugcauauguaggcaagcagu

SEQ ID NO: 967564 - RNA, 22 nt, Human
ucagagugugacuuggucauga

SEQ ID NO: 967565 - RNA, 21 nt, Human
uuucugucucugccacuaguu

SEQ ID NO: 967566 - RNA, 22 nt, Human
uaggacaggugaggggcugugg

SEQ ID NO: 967567 - RNA, 22 nt, Human
gcacagccagcaucugagggau

SEQ ID NO: 967568 - RNA, 22 nt, Human
uggaggccagagguacugggac

SEQ ID NO: 967569 - RNA, 22 nt, Human
caaagugcuaggauuacaggcc

SEQ ID NO: 967570 - RNA, 22 nt, Human
aguugacauccauaacaggaag

SEQ ID NO: 967571 - RNA, 22 nt, Human
gcaaagguagccaaggagcuca

SEQ ID NO: 967572 - RNA, 22 nt, Human
cacagguguaugaauaugucca

SEQ ID NO: 967573 - RNA, 22 nt, Human
ugcauuguugaugaguugaaua

SEQ ID NO: 967574 - RNA, 20 nt, Human
cagccuccacucacucagcu

SEQ ID NO: 967575 - RNA, 23 nt, Human
ccuggcuggauucucugcauuca

SEQ ID NO: 967576 - RNA, 22 nt, Human
ccucugcucccuggugucugag

SEQ ID NO: 967577 - RNA, 20 nt, Human
cugcuguguuauuguagaac

SEQ ID NO: 967578 - RNA, 22 nt, Human
cccagagcugagucugauauau

SEQ ID NO: 967579 - RNA, 22 nt, Human
gugugccagacaugaugcuaug

SEQ ID NO: 967580 - RNA, 22 nt, Human
uggcugucagcugccuggugcg

SEQ ID NO: 967581 - RNA, 22 nt, Human
aggggccugguuggccucuguu

SEQ ID NO: 967582 - RNA, 22 nt, Human
ucacagacacagggagaagcau

SEQ ID NO: 967583 - RNA, 17 nt, Human
cuggagccuccaacucc

SEQ ID NO: 967584 - RNA, 22 nt, Human
ugggcagaguugugaugaacug

SEQ ID NO: 967585 - RNA, 22 nt, Human
ugucaucuuuuuaaagaagaga

SEQ ID NO: 967586 - RNA, 22 nt, Human
uggcucaggcuugaaaauagau

SEQ ID NO: 967587 - RNA, 22 nt, Human
agccucugcuggcccuggcacu

SEQ ID NO: 967588 - RNA, 22 nt, Human
accucugcucaagaccccuccg

SEQ ID NO: 967589 - RNA, 22 nt, Human
uagcagggaagaugaucagaau

SEQ ID NO: 967590 - RNA, 22 nt, Human
cacugcagcaccaugcagggcu

SEQ ID NO: 967591 - RNA, 22 nt, Human
cccagggucccugcucucugug

SEQ ID NO: 967592 - RNA, 20 nt, Human
agaauucuuacccuuugaug

SEQ ID NO: 967593 - RNA, 22 nt, Human
gagcuguccuaccaggaguccu

SEQ ID NO: 967594 - RNA, 22 nt, Human
acugggccuggauuggcguguc

SEQ ID NO: 967595 - RNA, 21 nt, Human
gggucugaauaucuggugcug

SEQ ID NO: 967596 - RNA, 22 nt, Human
gugugcccuggcuccagcacca

SEQ ID NO: 967597 - RNA, 22 nt, Human
agagccugaggaugucccagcu

SEQ ID NO: 967598 - RNA, 22 nt, Human
gcucaggaaaacagucuaguaa

SEQ ID NO: 967599 - RNA, 22 nt, Human
uugcauuugagaaaguucuccu

SEQ ID NO: 967600 - RNA, 22 nt, Human
ugaaccaggaggcagccagcac

SEQ ID NO: 967601 - RNA, 22 nt, Human
uaccugagcccagugcagcaua

SEQ ID NO: 967602 - RNA, 22 nt, Human
gccaggaggcugcuguguaggc

SEQ ID NO: 967603 - RNA, 22 nt, Human
acaagcaugggcuuugacauca

SEQ ID NO: 967604 - RNA, 22 nt, Human
acaggcugcccgcuccccaccu

SEQ ID NO: 967605 - RNA, 22 nt, Human
cucaaauauguggucagaaagc

SEQ ID NO: 967606 - RNA, 22 nt, Human
gucacacuagggccaaguggag

SEQ ID NO: 967607 - RNA, 22 nt, Human
cuuauuagaaagaaaagacaug

SEQ ID NO: 967608 - RNA, 22 nt, Human
uuacauaacgguaugaaaaaug

SEQ ID NO: 967609 - RNA, 22 nt, Human
caugugucaaaugauguagcug

SEQ ID NO: 967610 - RNA, 22 nt, Human
gagagcugugguuugaccaggc

SEQ ID NO: 967611 - RNA, 22 nt, Human
cuggcuucugggccagggcaga

SEQ ID NO: 967612 - RNA, 22 nt, Human
uucuucaaccaucuacauaaac

SEQ ID NO: 967613 - RNA, 22 nt, Human
uuucaguuuccagcuuugucau

SEQ ID NO: 967614 - RNA, 22 nt, Human
ucuugggaucucuucaccaccu

SEQ ID NO: 967615 - RNA, 22 nt, Human
gggcucuggaaggugcaccaug

SEQ ID NO: 967616 - RNA, 22 nt, Human
gaggacugcagaugggugcauc

SEQ ID NO: 967617 - RNA, 22 nt, Human
gggcugagggguaucucauggg

SEQ ID NO: 967618 - RNA, 20 nt, Human
uaacauaguccagagaacga

SEQ ID NO: 967619 - RNA, 19 nt, Human
cagcugcaccgugaccauc

SEQ ID NO: 967620 - RNA, 22 nt, Human
cccaggaaugagcaggcagggg

SEQ ID NO: 967621 - RNA, 22 nt, Human
ugggagcaagcuacuuagggaa

SEQ ID NO: 967622 - RNA, 22 nt, Human
uuuccucuucuucccaugucau

SEQ ID NO: 967623 - RNA, 22 nt, Human
ucuucagacuccaaauguuuua

SEQ ID NO: 967624 - RNA, 22 nt, Human
acacaguaugaaaagucuaguu

SEQ ID NO: 967625 - RNA, 22 nt, Human
gugcagagaaaugagaagucga

SEQ ID NO: 967626 - RNA, 22 nt, Human
gagcucauucauucauugccug

SEQ ID NO: 967627 - RNA, 22 nt, Human
ccauuugucaccucugcacucc

SEQ ID NO: 967628 - RNA, 22 nt, Human
aacagaaugcaggggaugcugc

SEQ ID NO: 967629 - RNA, 22 nt, Human
aaaugauggaaaugaggcugaa

SEQ ID NO: 967630 - RNA, 22 nt, Human
gcuggcuguaucaccuggccag

SEQ ID NO: 967631 - RNA, 22 nt, Human
uccuggccuugcgucuugggag

SEQ ID NO: 967632 - RNA, 22 nt, Human
caagacaagaucuaagcaugcu

SEQ ID NO: 967633 - RNA, 22 nt, Human
cugcccugagucaugccagaug

SEQ ID NO: 967634 - RNA, 22 nt, Human
aggcccuguuaugagccacugu

SEQ ID NO: 967635 - RNA, 22 nt, Human
aggcccuguaagguguggagau

SEQ ID NO: 967636 - RNA, 21 nt, Human
ggcagccugacccccagagag

SEQ ID NO: 967637 - RNA, 22 nt, Human
uggagaggagcaccauggccau

SEQ ID NO: 967638 - RNA, 22 nt, Human
cacucugacuggcccugcagga

SEQ ID NO: 967639 - RNA, 22 nt, Human
ucuguucauaguaguguauaug

SEQ ID NO: 967640 - RNA, 22 nt, Human
cccagcuccagagccagaaaca

SEQ ID NO: 967641 - RNA, 22 nt, Human
ucuggagauaagacagacagau

SEQ ID NO: 967642 - RNA, 22 nt, Human
uucaagaucuuccaaaggauac

SEQ ID NO: 967643 - RNA, 22 nt, Human
ugucaucugauauuacuuauag

SEQ ID NO: 967644 - RNA, 22 nt, Human
ucacugcaaggaggcuucucaa

SEQ ID NO: 967645 - RNA, 22 nt, Human
ucaucacuguaucauugauaga

SEQ ID NO: 967646 - RNA, 22 nt, Human
gcuuugaagacuuuuccagggu

SEQ ID NO: 967647 - RNA, 22 nt, Human
uggcuagcccuuguggggagag

SEQ ID NO: 967648 - RNA, 22 nt, Human
uggaagagggagcuggguggcc

SEQ ID NO: 967649 - RNA, 22 nt, Human
uauaguaaaauuuucauuuaug

SEQ ID NO: 967650 - RNA, 22 nt, Human
aagauuuccuucaguagagcua

SEQ ID NO: 967651 - RNA, 22 nt, Human
cauggaaggcaaaagacacaga

SEQ ID NO: 967652 - RNA, 22 nt, Human
uuccugaugcacacagucauuu

SEQ ID NO: 967653 - RNA, 22 nt, Human
uuguacaaauaggaaccucuga

SEQ ID NO: 967654 - RNA, 22 nt, Human
cagucucucuuguagugcagcu

SEQ ID NO: 967655 - RNA, 19 nt, Human
cagucccaaauucuuguca

SEQ ID NO: 967656 - RNA, 22 nt, Human
gcagcccaaaaaagagguagau

SEQ ID NO: 967657 - RNA, 22 nt, Human
aacucugcagugacuuauaaag

SEQ ID NO: 967658 - RNA, 17 nt, Human
aggcagcucagaacauc

SEQ ID NO: 967659 - RNA, 22 nt, Human
agagaaaacucauugagguguc

SEQ ID NO: 967660 - RNA, 22 nt, Human
cagggcagagggaaacuccuuu

SEQ ID NO: 967661 - RNA, 22 nt, Human
ugagauuuggaaaauuugauau

SEQ ID NO: 967662 - RNA, 23 nt, Human
aggcacugaaugugucagugagu

SEQ ID NO: 967663 - RNA, 22 nt, Human
gcagagcuguuaauggagcuga

SEQ ID NO: 967664 - RNA, 22 nt, Human
gagggagggacuagcauucucu

SEQ ID NO: 967665 - RNA, 22 nt, Human
gaugauggacaaagcauuggug

SEQ ID NO: 967666 - RNA, 22 nt, Human
ccucaggguggcaucagaucuu

SEQ ID NO: 967667 - RNA, 17 nt, Human
gaggacagggaaguagg

SEQ ID NO: 967668 - RNA, 22 nt, Human
uagggcagcugcaucaggcacu

SEQ ID NO: 967669 - RNA, 22 nt, Human
gucccaggcagagucaggaggg

SEQ ID NO: 967670 - RNA, 22 nt, Human
gggcugggauggcuugaagauu

SEQ ID NO: 967671 - RNA, 22 nt, Human
uggugcaagucucugaggaggg

SEQ ID NO: 967672 - RNA, 16 nt, Human
gagggcagaggcggaa

SEQ ID NO: 967673 - RNA, 21 nt, Human
ucuccuggguccaacccaugc

SEQ ID NO: 967674 - RNA, 22 nt, Human
uguguacaggccuugcuagacu

SEQ ID NO: 967675 - RNA, 22 nt, Human
guucacaagaguuacagacaga

SEQ ID NO: 967676 - RNA, 22 nt, Human
caaggccacugcucagguuucc

SEQ ID NO: 967677 - RNA, 22 nt, Human
agcccuucaaccugccuacucc

SEQ ID NO: 967678 - RNA, 22 nt, Human
uguuuucagucauauagcaggu

SEQ ID NO: 967679 - RNA, 22 nt, Human
guucuucagauuccauuucagu

SEQ ID NO: 967680 - RNA, 22 nt, Human
aggagcugcagauucugccuug

SEQ ID NO: 967681 - RNA, 17 nt, Human
aagagaggcugagcugg

SEQ ID NO: 967682 - RNA, 22 nt, Human
uugacacagaucaauauucaac

SEQ ID NO: 967683 - RNA, 22 nt, Human
ugaaagcagcaccaauaccauu

SEQ ID NO: 967684 - RNA, 22 nt, Human
ucaggaguccugccugcagccu

SEQ ID NO: 967685 - RNA, 22 nt, Human
aucaaaguaggcauauguuuuu

SEQ ID NO: 967686 - RNA, 22 nt, Human
ccaggaaauggcuugcuucuuu

SEQ ID NO: 967687 - RNA, 22 nt, Human
ugccugggccucugaggaaggc

SEQ ID NO: 967688 - RNA, 23 nt, Human
cauggcagcaagagcucauggcc

SEQ ID NO: 967689 - RNA, 22 nt, Human
uugcauuuccuguacuguuuga

SEQ ID NO: 967690 - RNA, 22 nt, Human
auaaaugauucagcaggaaaua

SEQ ID NO: 967691 - RNA, 22 nt, Human
ucagagucauugcaaguagaag

SEQ ID NO: 967692 - RNA, 22 nt, Human
augcagagacagauguggcaug

SEQ ID NO: 967693 - RNA, 22 nt, Human
uuaauuaaauucaugagcauug

SEQ ID NO: 967694 - RNA, 22 nt, Human
gccugaugagcuuccagcugag

SEQ ID NO: 967695 - RNA, 18 nt, Human
uagaauauaggucauucu

SEQ ID NO: 967696 - RNA, 22 nt, Human
gaggcauggccugaggcuagga

SEQ ID NO: 967697 - RNA, 22 nt, Human
uaagauaauaaguaugucuaug

SEQ ID NO: 967698 - RNA, 22 nt, Human
ucuuccaguguagacaucugcc

SEQ ID NO: 967699 - RNA, 22 nt, Human
auaaggcaagcugucaguuugu

SEQ ID NO: 967700 - RNA, 22 nt, Human
accaggagagauuuuauugaga

SEQ ID NO: 967701 - RNA, 22 nt, Human
guggaaugaauagauuugcauu

SEQ ID NO: 967702 - RNA, 22 nt, Human
gucaucuuccuaguguuaacua

SEQ ID NO: 967703 - RNA, 22 nt, Human
ugggagcaguugugaagcucag

SEQ ID NO: 967704 - RNA, 22 nt, Human
ucuucacaccgggcagcaggaa

SEQ ID NO: 967705 - RNA, 22 nt, Human
cuggccaguugccuuccugggu

SEQ ID NO: 967706 - RNA, 22 nt, Human
uuugacauggaauaacucauuu

SEQ ID NO: 967707 - RNA, 22 nt, Human
ccuggccucgugcucacggcuc

SEQ ID NO: 967708 - RNA, 22 nt, Human
cagucauuggcuaaagcucccu

SEQ ID NO: 967709 - RNA, 22 nt, Human
cagagguagaaggcaugcagug

SEQ ID NO: 967710 - RNA, 22 nt, Human
gauuucuuuagguguaauagug

SEQ ID NO: 967711 - RNA, 22 nt, Human
cagggccucauccucagagauu

SEQ ID NO: 967712 - RNA, 22 nt, Human
uggccucugugggagcugagca

SEQ ID NO: 967713 - RNA, 22 nt, Human
ugcugaugcuguucuguuagga

SEQ ID NO: 967714 - RNA, 22 nt, Human
augggaggcagacacuaaguuc

SEQ ID NO: 967715 - RNA, 22 nt, Human
uucuucucucauagauuaaggu

SEQ ID NO: 967716 - RNA, 22 nt, Human
gugcuaggauuacaggcauggg

SEQ ID NO: 967717 - RNA, 22 nt, Human
ccugccaggacauugcuugaag

SEQ ID NO: 967718 - RNA, 22 nt, Human
ugccaggauauaagagugcgau

SEQ ID NO: 967719 - RNA, 22 nt, Human
uauuugaaggcauacauuuuga

SEQ ID NO: 967720 - RNA, 20 nt, Human
uccuggccucccuggggcuc

SEQ ID NO: 967721 - RNA, 22 nt, Human
ucuggcucuuugggugauugua

SEQ ID NO: 967722 - RNA, 22 nt, Human
augaggcauuccacucaaacuc

SEQ ID NO: 967723 - RNA, 22 nt, Human
uuucacaauuuuaaggagcaaa

SEQ ID NO: 967724 - RNA, 22 nt, Human
aaaugcauuuuuaauuagaccc

SEQ ID NO: 967725 - RNA, 22 nt, Human
uaaaauagcaugugcagugaaa

SEQ ID NO: 967726 - RNA, 22 nt, Human
ugcuaucucuauauccauuuau

SEQ ID NO: 967727 - RNA, 23 nt, Human
agaagcagcuucuggaguaucgg

SEQ ID NO: 967728 - RNA, 22 nt, Human
aaggcacucauucaaggagaua

SEQ ID NO: 967729 - RNA, 22 nt, Human
cacaggagagcugggaggugcc

SEQ ID NO: 967730 - RNA, 22 nt, Human
aggaagcuuagugaaaggacca

SEQ ID NO: 967731 - RNA, 22 nt, Human
uugcugugaaaccaugggaagu

SEQ ID NO: 967732 - RNA, 22 nt, Human
gcagggaagacccggagcagcg

SEQ ID NO: 967733 - RNA, 22 nt, Human
ccagacaggaacacacaucucc

SEQ ID NO: 967734 - RNA, 22 nt, Human
ucugagcauugaauuuucuucc

SEQ ID NO: 967735 - RNA, 22 nt, Human
auacuguuuugugacuuaucuu

SEQ ID NO: 967736 - RNA, 22 nt, Human
guggugcaggccagcaggggcg

SEQ ID NO: 967737 - RNA, 22 nt, Human
agccacaggaaacagagacagc

SEQ ID NO: 967738 - RNA, 22 nt, Human
cagcuuugcccuuugcccaauc

SEQ ID NO: 967739 - RNA, 22 nt, Human
ugucccagcagcuggguucucu

SEQ ID NO: 967740 - RNA, 23 nt, Human
auagucauguaaaauauuugaag

SEQ ID NO: 967741 - RNA, 22 nt, Human
uucauucaucucuaaaaugccu

SEQ ID NO: 967742 - RNA, 22 nt, Human
gcugcucucagagcucaugcug

SEQ ID NO: 967743 - RNA, 22 nt, Human
uccaggagaaaacugacggugg

SEQ ID NO: 967744 - RNA, 22 nt, Human
gagacagaguuucacucuuguu

SEQ ID NO: 967745 - RNA, 22 nt, Human
aaggcagcaacuaauggaucuc

SEQ ID NO: 967746 - RNA, 21 nt, Human
accagcaggagaucagaagga

SEQ ID NO: 967747 - RNA, 22 nt, Human
aaugggagguaguaugggaggu

SEQ ID NO: 967748 - RNA, 22 nt, Human
cauucauuagaauagauaugua

SEQ ID NO: 967749 - RNA, 22 nt, Human
agaggacaaaaugagaagugcu

SEQ ID NO: 967750 - RNA, 22 nt, Human
gagaggugaauguggaugccac

SEQ ID NO: 967751 - RNA, 22 nt, Human
aggcagcuagagagugaaacug

SEQ ID NO: 967752 - RNA, 22 nt, Human
accuggccauccagcuggcauc

SEQ ID NO: 967753 - RNA, 22 nt, Human
gcccaggauggagaauaguggu

SEQ ID NO: 967754 - RNA, 22 nt, Human
cucaggauuaaggaaucuaaau

SEQ ID NO: 967755 - RNA, 22 nt, Human
ugguuucccauuaucugcagga

SEQ ID NO: 967756 - RNA, 22 nt, Human
acaaagguggaccauguggcuu

SEQ ID NO: 967757 - RNA, 22 nt, Human
ccaaggagcaaguuuacaccug

SEQ ID NO: 967758 - RNA, 23 nt, Human
agaggcaggaguggcuugcccgg

SEQ ID NO: 967759 - RNA, 22 nt, Human
gugaagauaaggaugcugcagu

SEQ ID NO: 967760 - RNA, 22 nt, Human
ucucaagagggaggcaaucaug

SEQ ID NO: 967761 - RNA, 22 nt, Human
gaucauuuugaugcccuuuuag

SEQ ID NO: 967762 - RNA, 19 nt, Human
ugcaagcuuuuucuuguua

SEQ ID NO: 967763 - RNA, 22 nt, Human
agaaugcaguuugaaauaaggu

SEQ ID NO: 967764 - RNA, 22 nt, Human
uagcagcuuccagagagggcag

SEQ ID NO: 967765 - RNA, 21 nt, Human
uagaaaucagcuggugccucu

SEQ ID NO: 967766 - RNA, 22 nt, Human
cuguuacacggaccuucaaauc

SEQ ID NO: 967767 - RNA, 22 nt, Human
agagaacaaauuaaaggugguu

SEQ ID NO: 967768 - RNA, 19 nt, Human
uuuggcacucugaaguguu

SEQ ID NO: 967769 - RNA, 22 nt, Human
uccagggacagcgcuggagcua

SEQ ID NO: 967770 - RNA, 22 nt, Human
agagggcagucucagauuggga

SEQ ID NO: 967771 - RNA, 22 nt, Human
agcagccacacgccuccuucuc

SEQ ID NO: 967772 - RNA, 22 nt, Human
guccaggaaucaaaagauggaa

SEQ ID NO: 967773 - RNA, 22 nt, Human
uuucauaaugucacagucaaaa

SEQ ID NO: 967774 - RNA, 22 nt, Human
acaaagucuuuuacaacaguca

SEQ ID NO: 967775 - RNA, 22 nt, Human
aaggcuaugaucuuuuucauga

SEQ ID NO: 967776 - RNA, 22 nt, Human
uacccaggggcugagcagaggu

SEQ ID NO: 967777 - RNA, 22 nt, Human
uguuucuagagaaaauauuuac

SEQ ID NO: 967778 - RNA, 22 nt, Human
ucucaggaagauuagggcuaag

SEQ ID NO: 967779 - RNA, 22 nt, Human
ggagcugcuccuucagccaagu

SEQ ID NO: 967780 - RNA, 22 nt, Human
uaugcuuuacuuuucauuguga

SEQ ID NO: 967781 - RNA, 22 nt, Human
gagccuguguuuccuguagcca

SEQ ID NO: 967782 - RNA, 22 nt, Human
cagagcugacccaaggauugaa

SEQ ID NO: 967783 - RNA, 22 nt, Human
aagcagcacaguaauauuggug

SEQ ID NO: 967784 - RNA, 22 nt, Human
gagggcagagucuaaugaugca

SEQ ID NO: 967785 - RNA, 22 nt, Human
cagagggagcccuccaggagca

SEQ ID NO: 967786 - RNA, 22 nt, Human
cugaaggauuagagagcacuua

SEQ ID NO: 967787 - RNA, 22 nt, Human
ugucuuaauuuggaugauguuu

SEQ ID NO: 967788 - RNA, 22 nt, Human
cugaugcuauaagccacagugg

SEQ ID NO: 967789 - RNA, 22 nt, Human
uggcagcagacaucugaggucu

SEQ ID NO: 967790 - RNA, 17 nt, Human
aagacagaagccaugag

SEQ ID NO: 967791 - RNA, 22 nt, Human
ucuggcuccacucugugcaugc

SEQ ID NO: 967792 - RNA, 22 nt, Human
ucuccuggagcaggaagguggg

SEQ ID NO: 967793 - RNA, 22 nt, Human
aggucauuuuugccuucuauuu

SEQ ID NO: 967794 - RNA, 22 nt, Human
aggcugggaaauguauuccagc

SEQ ID NO: 967795 - RNA, 22 nt, Human
ugaagccagcuuuggaagacac

SEQ ID NO: 967796 - RNA, 22 nt, Human
gugucaugggguuuguuauaca

SEQ ID NO: 967797 - RNA, 22 nt, Human
ucuuuuuauauugacaaaaggu

SEQ ID NO: 967798 - RNA, 22 nt, Human
ugcugugagguugagaaggaag

SEQ ID NO: 967799 - RNA, 22 nt, Human
uucacaggaauguaggggucuu

SEQ ID NO: 967800 - RNA, 22 nt, Human
uuaugcuaaaugaaucaaguca

SEQ ID NO: 967801 - RNA, 22 nt, Human
cuguugcucugaacaggucuug

SEQ ID NO: 967802 - RNA, 18 nt, Human
ugaacagaugaguugaag

SEQ ID NO: 967803 - RNA, 22 nt, Human
gagcagugaagacagaaguaca

SEQ ID NO: 967804 - RNA, 23 nt, Human
agaaaagcuuggacacauggccu

SEQ ID NO: 967805 - RNA, 23 nt, Human
ucucuuucaagagcuuaaugugc

SEQ ID NO: 967806 - RNA, 22 nt, Human
aaauuggauuuuaaacuguugg

SEQ ID NO: 967807 - RNA, 22 nt, Human
uugaagcagcucaggaggcuua

SEQ ID NO: 967808 - RNA, 22 nt, Human
ucccagacaaucauuggccacc

SEQ ID NO: 967809 - RNA, 22 nt, Human
cuaaaugcccuacaaugacugg

SEQ ID NO: 967810 - RNA, 22 nt, Human
acagacauucagcuaagucuau

SEQ ID NO: 967811 - RNA, 22 nt, Human
cuugaaagucacaugcagcccu

SEQ ID NO: 967812 - RNA, 23 nt, Human
aggaggccugaaacugaggcuga

SEQ ID NO: 967813 - RNA, 22 nt, Human
caggggccggcuguccgugccc

SEQ ID NO: 967814 - RNA, 22 nt, Human
caggagaggcuguacguuucuc

SEQ ID NO: 967815 - RNA, 22 nt, Human
agcuuccuguugagagagggag

SEQ ID NO: 967816 - RNA, 22 nt, Human
caggcagauuugcugcccucca

SEQ ID NO: 967817 - RNA, 22 nt, Human
cucacuggcaagacuacaggug

SEQ ID NO: 967818 - RNA, 22 nt, Human
ccaggaagccucagaugcugag

SEQ ID NO: 967819 - RNA, 20 nt, Human
aagagaagaagucuuugaaa

SEQ ID NO: 967820 - RNA, 22 nt, Human
gagacagugguugcagaagcuc

SEQ ID NO: 967821 - RNA, 23 nt, Human
aggcccaacucugugagggcugc

SEQ ID NO: 967822 - RNA, 22 nt, Human
gccaccagggggcuccagugag

SEQ ID NO: 967823 - RNA, 22 nt, Human
cagacuuucaaggagugaaggc

SEQ ID NO: 967824 - RNA, 19 nt, Human
ugcagccacgugagagacu

SEQ ID NO: 967825 - RNA, 22 nt, Human
agaauguagucuuggagauuua

SEQ ID NO: 967826 - RNA, 22 nt, Human
aggucagcaggccaggggcgaa

SEQ ID NO: 967827 - RNA, 22 nt, Human
cagagccugcucacgucucugu

SEQ ID NO: 967828 - RNA, 22 nt, Human
auuggcaggaaccgaggagggg

SEQ ID NO: 967829 - RNA, 22 nt, Human
gcuggccugggcagaggcuaug

SEQ ID NO: 967830 - RNA, 22 nt, Human
ugucaccagcugcuccucagga

SEQ ID NO: 967831 - RNA, 22 nt, Human
gauuuccucacuaacauccauc

SEQ ID NO: 967832 - RNA, 22 nt, Human
cacaggguuguucugaggauuc

SEQ ID NO: 967833 - RNA, 23 nt, Human
ugcagagggacugaagccagcuu

SEQ ID NO: 967834 - RNA, 22 nt, Human
aggagccccucuucaguccugg

SEQ ID NO: 967835 - RNA, 22 nt, Human
agaaaauauucauugagaggcu

SEQ ID NO: 967836 - RNA, 22 nt, Human
ucagcuuggacagcuugguuga

SEQ ID NO: 967837 - RNA, 22 nt, Human
gcacugugcuagaagccagggg

SEQ ID NO: 967838 - RNA, 22 nt, Human
cauuaagauuuuuuucuacugg

SEQ ID NO: 967839 - RNA, 22 nt, Human
auuugcuuuaagguauaaaagg

SEQ ID NO: 967840 - RNA, 23 nt, Human
auuucuaggggauuuucuggugc

SEQ ID NO: 967841 - RNA, 22 nt, Human
uugaaaggugcugugugcugau

SEQ ID NO: 967842 - RNA, 19 nt, Human
gcucagagggcccugugcu

SEQ ID NO: 967843 - RNA, 19 nt, Human
ucucuggggacacuuucac

SEQ ID NO: 967844 - RNA, 23 nt, Human
cucugcaggagagugggcagggc

SEQ ID NO: 967845 - RNA, 22 nt, Human
ggcuucugaaaucucugugcgu

SEQ ID NO: 967846 - RNA, 22 nt, Human
uugugaaauguuucaaaauagu

SEQ ID NO: 967847 - RNA, 22 nt, Human
agucucugccagcuuguccucu

SEQ ID NO: 967848 - RNA, 19 nt, Human
acagagcucucugcuucug

SEQ ID NO: 967849 - RNA, 22 nt, Human
acugugcaugaaccgaaacaaa

SEQ ID NO: 967850 - RNA, 17 nt, Human
aauagcugcucagagag

SEQ ID NO: 967851 - RNA, 22 nt, Human
agaggaaguaaucaggaccugc

SEQ ID NO: 967852 - RNA, 22 nt, Human
ugccuuggugcuucuucaugug

SEQ ID NO: 967853 - RNA, 22 nt, Human
ugaagacagaccaaggagaaug

SEQ ID NO: 967854 - RNA, 22 nt, Human
auaguacacauccuacaauguu

SEQ ID NO: 967855 - RNA, 22 nt, Human
agcugucuaccugcagaguccu

SEQ ID NO: 967856 - RNA, 22 nt, Human
uauuucugucagccagauaugg

SEQ ID NO: 967857 - RNA, 22 nt, Human
uaucuguuccaggcacucagcu

SEQ ID NO: 967858 - RNA, 22 nt, Human
ucugagaggcaucugcacuucu

SEQ ID NO: 967859 - RNA, 22 nt, Human
ucccagagucagagguggggcc

SEQ ID NO: 967860 - RNA, 22 nt, Human
gucaggggccaugggccaagga

SEQ ID NO: 967861 - RNA, 19 nt, Human
ucuuucauuucuagcucug

SEQ ID NO: 967862 - RNA, 22 nt, Human
caggaucccuggccuccgccca

SEQ ID NO: 967863 - RNA, 22 nt, Human
gugcuuccccaagccacagccu

SEQ ID NO: 967864 - RNA, 22 nt, Human
cacugaguucccugacauuuca

SEQ ID NO: 967865 - RNA, 22 nt, Human
cucuuccucucaugcggucaua

SEQ ID NO: 967866 - RNA, 22 nt, Human
gcaguggcaccgcuggcucugg

SEQ ID NO: 967867 - RNA, 22 nt, Human
ugagccagcaggccuccagugg

SEQ ID NO: 967868 - RNA, 22 nt, Human
ugcagccaauucauucauucuu

SEQ ID NO: 967869 - RNA, 23 nt, Human
ucacaggggccagcgcucugugg

SEQ ID NO: 967870 - RNA, 22 nt, Human
uuaaguaagaccuuaugucuug

SEQ ID NO: 967871 - RNA, 21 nt, Human
ugggggagaauugguugcuuu

SEQ ID NO: 967872 - RNA, 22 nt, Human
cuccuuccccuacucagcaucc

SEQ ID NO: 967873 - RNA, 22 nt, Human
acauaugugcuuauauccauga

SEQ ID NO: 967874 - RNA, 19 nt, Human
ucaaggcucccugagggau

SEQ ID NO: 967875 - RNA, 22 nt, Human
ccagaggcauguucaaagcaau

SEQ ID NO: 967876 - RNA, 22 nt, Human
cucuucuuggcccccaugaggg

SEQ ID NO: 967877 - RNA, 22 nt, Human
gcacagccacugagugagaacc

SEQ ID NO: 967878 - RNA, 22 nt, Human
cuugugcaauugacauugaauc

SEQ ID NO: 967879 - RNA, 22 nt, Human
agcagcaugaugacagagucuc

SEQ ID NO: 967880 - RNA, 22 nt, Human
uccugagcuucaaaacacuuug

SEQ ID NO: 967881 - RNA, 22 nt, Human
caggguacagaguuuucuaaac

SEQ ID NO: 967882 - RNA, 22 nt, Human
cgugucaucugagccuugggcg

SEQ ID NO: 967883 - RNA, 23 nt, Human
acuuuauugaccccaggucaguu

SEQ ID NO: 967884 - RNA, 22 nt, Human
uucaaaacagcuagauauugga

SEQ ID NO: 967885 - RNA, 22 nt, Human
uuguuucuucauuuagaagcuu

SEQ ID NO: 967886 - RNA, 22 nt, Human
agcaggaaguagucuguaagca

SEQ ID NO: 967887 - RNA, 22 nt, Human
ugccacccagccaggaguggga

SEQ ID NO: 967888 - RNA, 22 nt, Human
gcucccaggaagagaagggcca

SEQ ID NO: 967889 - RNA, 22 nt, Human
gccuggaguucagccaaguccc

SEQ ID NO: 967890 - RNA, 22 nt, Human
guguaucaaagcacagacuuca

SEQ ID NO: 967891 - RNA, 22 nt, Human
gcagcuggugcaaaugucacuc

SEQ ID NO: 967892 - RNA, 22 nt, Human
cuggagcagguuuaggaguccc

SEQ ID NO: 967893 - RNA, 22 nt, Human
uuugacaguaauaaagcacaag

SEQ ID NO: 967894 - RNA, 22 nt, Human
gcagcugaaagggaucucuaca

SEQ ID NO: 967895 - RNA, 22 nt, Human
gcugccugccuugccuggagga

SEQ ID NO: 967896 - RNA, 22 nt, Human
agaugcugcuccacaggccagg

SEQ ID NO: 967897 - RNA, 22 nt, Human
agagaagagcaaugauaaauuu

SEQ ID NO: 967898 - RNA, 22 nt, Human
ggucccagguugacagggagac

SEQ ID NO: 967899 - RNA, 22 nt, Human
aaggcaguagguguuucaaacu

SEQ ID NO: 967900 - RNA, 22 nt, Human
cugccagcaaugugaccaugcu

SEQ ID NO: 967901 - RNA, 22 nt, Human
aaauaacuuaugaucgucuggc

SEQ ID NO: 967902 - RNA, 22 nt, Human
aaguguagauuauggagugucu

SEQ ID NO: 967903 - RNA, 22 nt, Human
cauuuuaagaugaccugguuuc

SEQ ID NO: 967904 - RNA, 22 nt, Human
augcccgauaccuaguuaacuc

SEQ ID NO: 967905 - RNA, 23 nt, Human
uguagcaucucuuauuucucagc

SEQ ID NO: 967906 - RNA, 22 nt, Human
ggcugcugguggaaugguaggc

SEQ ID NO: 967907 - RNA, 22 nt, Human
aggggacacggcuucuccaggg

SEQ ID NO: 967908 - RNA, 22 nt, Human
agggcagagaucugagugggca

SEQ ID NO: 967909 - RNA, 22 nt, Human
ucccagaguucaaugggaaggu

SEQ ID NO: 967910 - RNA, 22 nt, Human
auacuaaaguauagaacuuagu

SEQ ID NO: 967911 - RNA, 22 nt, Human
aacuagucagugauucucagaa

SEQ ID NO: 967912 - RNA, 22 nt, Human
acugaguguaggacuuugaguu

SEQ ID NO: 967913 - RNA, 22 nt, Human
uaaauuauggcuggcagagcag

SEQ ID NO: 967914 - RNA, 18 nt, Human
gcugccugcauuccucac

SEQ ID NO: 967915 - RNA, 22 nt, Human
aaugauggucauggcaacuuuu

SEQ ID NO: 967916 - RNA, 22 nt, Human
ccucuucugagugagacucccu

SEQ ID NO: 967917 - RNA, 22 nt, Human
guguguuuagcauuagcagggg

SEQ ID NO: 967918 - RNA, 23 nt, Human
gggagaauaugaggaugauggug

SEQ ID NO: 967919 - RNA, 20 nt, Human
aggcugccaggucucacauc

SEQ ID NO: 967920 - RNA, 22 nt, Human
cauuaaauuccuuguucucaaa

SEQ ID NO: 967921 - RNA, 18 nt, Human
gcccagaggucugggccc

SEQ ID NO: 967922 - RNA, 22 nt, Human
ccaggcugcagucaaggggcau

SEQ ID NO: 967923 - RNA, 22 nt, Human
cagagagggcggcccuggcuuc

SEQ ID NO: 967924 - RNA, 22 nt, Human
uggugugggcguggcaggcaag

SEQ ID NO: 967925 - RNA, 22 nt, Human
agcucccagggcugggcaaguu

SEQ ID NO: 967926 - RNA, 21 nt, Human
aaaaugugagcgugaugcuua

SEQ ID NO: 967927 - RNA, 22 nt, Human
agauaugacuagaagcucauuu

SEQ ID NO: 967928 - RNA, 22 nt, Human
aaaggcuaugagauagaagaua

SEQ ID NO: 967929 - RNA, 22 nt, Human
gugugucuugaccaggaucgga

SEQ ID NO: 967930 - RNA, 22 nt, Human
uaggagaggugaauggcacacu

SEQ ID NO: 967931 - RNA, 22 nt, Human
cccaaggaagacgcuugugaua

SEQ ID NO: 967932 - RNA, 20 nt, Human
aagaaacuugaaaguacaag

SEQ ID NO: 967933 - RNA, 22 nt, Human
cccaggaagagugaguggcauu

SEQ ID NO: 967934 - RNA, 22 nt, Human
uggagcaggugggaugucguga

SEQ ID NO: 967935 - RNA, 18 nt, Human
uggcagccagcugcuccu

SEQ ID NO: 967936 - RNA, 23 nt, Human
acugucugauauguuuuccauca

SEQ ID NO: 967937 - RNA, 20 nt, Human
caggaggcaaggucaagguc

SEQ ID NO: 967938 - RNA, 22 nt, Human
cugucuguucagauucauuacu

SEQ ID NO: 967939 - RNA, 22 nt, Human
cccugaggggaguggugaggug

SEQ ID NO: 967940 - RNA, 22 nt, Human
aguguguguuugggcgguuuau

SEQ ID NO: 967941 - RNA, 22 nt, Human
uuugcauuucucguaaggaaac

SEQ ID NO: 967942 - RNA, 22 nt, Human
ccucacagggccaggccccuca

SEQ ID NO: 967943 - RNA, 22 nt, Human
uucugagacaauugagagucua

SEQ ID NO: 967944 - RNA, 22 nt, Human
ggaaggaggaugcucuggccuu

SEQ ID NO: 967945 - RNA, 22 nt, Human
guguauaacuaucuaucuagua

SEQ ID NO: 967946 - RNA, 22 nt, Human
ugggaggagcccucugggaagg

SEQ ID NO: 967947 - RNA, 22 nt, Human
ugccugaugcaggaguaucaga

SEQ ID NO: 967948 - RNA, 22 nt, Human
agccacagagagggagcugcaa

SEQ ID NO: 967949 - RNA, 22 nt, Human
cugcugagcccuggcacaggug

SEQ ID NO: 967950 - RNA, 22 nt, Human
guauuaggagguggagccuuug

SEQ ID NO: 967951 - RNA, 22 nt, Human
acaaaaaccguggauucagcau

SEQ ID NO: 967952 - RNA, 22 nt, Human
uggcagcacuagguacugagcu

SEQ ID NO: 967953 - RNA, 22 nt, Human
cagaggcagugggguugcuccu

SEQ ID NO: 967954 - RNA, 22 nt, Human
acuuggcaaguaucuauaaagu

SEQ ID NO: 967955 - RNA, 22 nt, Human
uuucuuaaauauuugcaggaca

SEQ ID NO: 967956 - RNA, 22 nt, Human
agaccaagaaaggaugaggauc

SEQ ID NO: 967957 - RNA, 22 nt, Human
acuuagaacaggcagaauucca

SEQ ID NO: 967958 - RNA, 22 nt, Human
agggggcaucagguccuggcuc

SEQ ID NO: 967959 - RNA, 20 nt, Human
cccagugaagcauggaagag

SEQ ID NO: 967960 - RNA, 22 nt, Human
aagcagccucauuugugguaag

SEQ ID NO: 967961 - RNA, 22 nt, Human
aaaugcacucugcuucugugac

SEQ ID NO: 967962 - RNA, 22 nt, Human
cagaggaggccaccgcauaggc

SEQ ID NO: 967963 - RNA, 22 nt, Human
gggcccuggauuuaagcaugga

SEQ ID NO: 967964 - RNA, 22 nt, Human
gccauuuagggaggcaagguga

SEQ ID NO: 967965 - RNA, 22 nt, Human
ugucaguguauacauacaguau

SEQ ID NO: 967966 - RNA, 22 nt, Human
auuuauuaccucggaguuucug

SEQ ID NO: 967967 - RNA, 22 nt, Human
uggcucuguugugcugagccag

SEQ ID NO: 967968 - RNA, 22 nt, Human
cucucugcaaguuuugaaauag

SEQ ID NO: 967969 - RNA, 22 nt, Human
ccugggugacccgugagcgucc

SEQ ID NO: 967970 - RNA, 21 nt, Human
ggugggcacaggagagcagag

SEQ ID NO: 967971 - RNA, 22 nt, Human
cagcuugcaguacuuguuuuug

SEQ ID NO: 967972 - RNA, 22 nt, Human
uucaggauggcggauguugggg

SEQ ID NO: 967973 - RNA, 22 nt, Human
cucucuggcuuggcacggagau

SEQ ID NO: 967974 - RNA, 22 nt, Human
agcagcaggcuguguggacuga

SEQ ID NO: 967975 - RNA, 22 nt, Human
cuucucaaaguugugaaucagg

SEQ ID NO: 967976 - RNA, 22 nt, Human
agccuggccugggcaggcacau

SEQ ID NO: 967977 - RNA, 22 nt, Human
gcagccuguuguaccagccugu

SEQ ID NO: 967978 - RNA, 22 nt, Human
gaggaccacagaugagccugca

SEQ ID NO: 967979 - RNA, 23 nt, Human
cagaaaguuugagaagauacauc

SEQ ID NO: 967980 - RNA, 22 nt, Human
agagagccugaguggcagcuau

SEQ ID NO: 967981 - RNA, 22 nt, Human
auccccagaaaauaggugccua

SEQ ID NO: 967982 - RNA, 22 nt, Human
cuacauuucccagcugccuucc

SEQ ID NO: 967983 - RNA, 22 nt, Human
ggagcuguuggcagcuaucuug

SEQ ID NO: 967984 - RNA, 22 nt, Human
cccaggagguuggggcuacagu

SEQ ID NO: 967985 - RNA, 22 nt, Human
augggcagcagcugccauucau

SEQ ID NO: 967986 - RNA, 22 nt, Human
cagcugaauucuucagacucca

SEQ ID NO: 967987 - RNA, 22 nt, Human
uggccugacugucaggcuguau

SEQ ID NO: 967988 - RNA, 20 nt, Human
uccagcugucuuucagagac

SEQ ID NO: 967989 - RNA, 22 nt, Human
gagcuuccacucuagaaggagu

SEQ ID NO: 967990 - RNA, 22 nt, Human
gcuggagguagggagguccugu

SEQ ID NO: 967991 - RNA, 22 nt, Human
ggcccugggaugcucagcagug

SEQ ID NO: 967992 - RNA, 22 nt, Human
ggaggcucccacgcagcucaca

SEQ ID NO: 967993 - RNA, 22 nt, Human
cuugaaagauuuggccucugug

SEQ ID NO: 967994 - RNA, 22 nt, Human
agugggcagugcgcucggaugc

SEQ ID NO: 967995 - RNA, 22 nt, Human
aggcaggcaaccaccugggaag

SEQ ID NO: 967996 - RNA, 22 nt, Human
acagcuugcaauggcuuucaac

SEQ ID NO: 967997 - RNA, 22 nt, Human
caggcuggagugcaguugugca

SEQ ID NO: 967998 - RNA, 22 nt, Human
cugaggccccucuugugagcau

SEQ ID NO: 967999 - RNA, 22 nt, Human
ugccaggcccugugcuggaugc

SEQ ID NO: 968000 - RNA, 22 nt, Human
ccagccaggcauugcaaacuga

SEQ ID NO: 968001 - RNA, 22 nt, Human
uucucugaaggccaugcucacu

SEQ ID NO: 968002 - RNA, 22 nt, Human
ggcuguggucugggugcucccc

SEQ ID NO: 968003 - RNA, 22 nt, Human
ucccucagggugcaguugcuuu

SEQ ID NO: 968004 - RNA, 22 nt, Human
cucccaagggguaagggagcug

SEQ ID NO: 968005 - RNA, 22 nt, Human
cagcaucuuucucuucuggagu

SEQ ID NO: 968006 - RNA, 22 nt, Human
ucauuuguggaagugauugugg

SEQ ID NO: 968007 - RNA, 22 nt, Human
aucaaaguggaaguuuacuagg

SEQ ID NO: 968008 - RNA, 22 nt, Human
uaacagaaacagauaaguguaa

SEQ ID NO: 968009 - RNA, 22 nt, Human
ggucugaguagagggcuggcga

SEQ ID NO: 968010 - RNA, 22 nt, Human
uggcucuggauuaaucuaggaa

SEQ ID NO: 968011 - RNA, 22 nt, Human
cugggcugugguguggcccaaa

SEQ ID NO: 968012 - RNA, 22 nt, Human
acugcccucccaucuauugcaa

SEQ ID NO: 968013 - RNA, 22 nt, Human
uuaaguccuugguaauuuucuu

SEQ ID NO: 968014 - RNA, 22 nt, Human
aguaaaaauugaggugcaaaau

SEQ ID NO: 968015 - RNA, 22 nt, Human
uggcuucuugggaugggucauu

SEQ ID NO: 968016 - RNA, 22 nt, Human
ucugccugcaguguggcagggc

SEQ ID NO: 968017 - RNA, 22 nt, Human
uuuuagauaguuuaacugcacu

SEQ ID NO: 968018 - RNA, 22 nt, Human
uggccugggucacaccaggguc

SEQ ID NO: 968019 - RNA, 22 nt, Human
acucccagguugccuggcaggc

SEQ ID NO: 968020 - RNA, 22 nt, Human
ggccugcugggccccacagucc

SEQ ID NO: 968021 - RNA, 22 nt, Human
uggcucuggcgugaagcccaga

SEQ ID NO: 968022 - RNA, 22 nt, Human
cccagcugcaccucuauggccu

SEQ ID NO: 968023 - RNA, 22 nt, Human
cagcaggcccaggugcugguga

SEQ ID NO: 968024 - RNA, 22 nt, Human
cacugccaccugcaugcccuga

SEQ ID NO: 968025 - RNA, 22 nt, Human
aagaauucacugguagagucaa

SEQ ID NO: 968026 - RNA, 22 nt, Human
gccaggcugaggcucuggaaga

SEQ ID NO: 968027 - RNA, 22 nt, Human
gaaaucugaacaacagcuguca

SEQ ID NO: 968028 - RNA, 22 nt, Human
uguggaaaauuggaacguuccu

SEQ ID NO: 968029 - RNA, 20 nt, Human
uccugagauuuaagggguuc

SEQ ID NO: 968030 - RNA, 22 nt, Human
aggaggggcaaugauagucugg

SEQ ID NO: 968031 - RNA, 22 nt, Human
accaucagagcacaguccgugc

SEQ ID NO: 968032 - RNA, 22 nt, Human
ucacuggggccuuuggucagga

SEQ ID NO: 968033 - RNA, 22 nt, Human
aaugugguuaacccauuuaaga

SEQ ID NO: 968034 - RNA, 22 nt, Human
cccacagguccccaugaacucg

SEQ ID NO: 968035 - RNA, 22 nt, Human
accugccucagugcagcuggau

SEQ ID NO: 968036 - RNA, 22 nt, Human
guguggcuaccucagaggagca

SEQ ID NO: 968037 - RNA, 22 nt, Human
gcagagccugggggucugcgga

SEQ ID NO: 968038 - RNA, 21 nt, Human
gcaggaugcaucuuggugucu

SEQ ID NO: 968039 - RNA, 22 nt, Human
ucuggcuccguguccgcuccca

SEQ ID NO: 968040 - RNA, 22 nt, Human
ccacaggcugcugcaggucccg

SEQ ID NO: 968041 - RNA, 22 nt, Human
caucacugacgcugagauucca

SEQ ID NO: 968042 - RNA, 22 nt, Human
ccuggagcacauggcaggaggc

SEQ ID NO: 968043 - RNA, 21 nt, Human
cccacggaaugaugaggcacu

SEQ ID NO: 968044 - RNA, 22 nt, Human
uugcuucauuuuaaauaaagac

SEQ ID NO: 968045 - RNA, 22 nt, Human
agccaggauuggcugagccuua

SEQ ID NO: 968046 - RNA, 22 nt, Human
uuucacauacaguguauaguag

SEQ ID NO: 968047 - RNA, 22 nt, Human
uguuuuaugagccauauaaccu

SEQ ID NO: 968048 - RNA, 22 nt, Human
ccccagcugcauacuugccaag

SEQ ID NO: 968049 - RNA, 22 nt, Human
guucuucaguaaaauuaaaugu

SEQ ID NO: 968050 - RNA, 22 nt, Human
guucacauccuugugaggauuu

SEQ ID NO: 968051 - RNA, 22 nt, Human
ucugacauuagauuaauuggaa

SEQ ID NO: 968052 - RNA, 22 nt, Human
cauauuuauagaucuggcauuu

SEQ ID NO: 968053 - RNA, 22 nt, Human
uaauguguccugaaagcuucug

SEQ ID NO: 968054 - RNA, 22 nt, Human
agaaaugugaauuucauuuccu

SEQ ID NO: 968055 - RNA, 22 nt, Human
gccuggagacaaggacaaaggg

SEQ ID NO: 968056 - RNA, 22 nt, Human
ugaaggaaugagggaguggguc

SEQ ID NO: 968057 - RNA, 22 nt, Human
ggcucaggggccaggccugucc

SEQ ID NO: 968058 - RNA, 22 nt, Human
gccuugggaaagugggaggaga

SEQ ID NO: 968059 - RNA, 22 nt, Human
ugcucuagagcuauuggcuucc

SEQ ID NO: 968060 - RNA, 22 nt, Human
ucccagaggacuguuggugcua

SEQ ID NO: 968061 - RNA, 22 nt, Human
uaaauguguguagccaucugug

SEQ ID NO: 968062 - RNA, 23 nt, Human
uagagcagggaaaucugucagag

SEQ ID NO: 968063 - RNA, 22 nt, Human
gggcauguagugugcauagaga

SEQ ID NO: 968064 - RNA, 22 nt, Human
aaaucuaggcucauccuggucc

SEQ ID NO: 968065 - RNA, 22 nt, Human
cagggccaguucucgcagcagu

SEQ ID NO: 968066 - RNA, 22 nt, Human
ugagccuggguggucgaggcug

SEQ ID NO: 968067 - RNA, 22 nt, Human
agaugggcgcccuggacugagg

SEQ ID NO: 968068 - RNA, 22 nt, Human
ugcauauugugaaaauguagau

SEQ ID NO: 968069 - RNA, 21 nt, Human
agcuggugucagagcucuggg

SEQ ID NO: 968070 - RNA, 22 nt, Human
gcacacagccagcugagggcua

SEQ ID NO: 968071 - RNA, 22 nt, Human
aaacagcuaauggccaggaaua

SEQ ID NO: 968072 - RNA, 22 nt, Human
ugccugaguuuaacccucagag

SEQ ID NO: 968073 - RNA, 22 nt, Human
uauuucugggaguucagaaauu

SEQ ID NO: 968074 - RNA, 22 nt, Human
cagcaggcucugaguggcugcc

SEQ ID NO: 968075 - RNA, 22 nt, Human
gaggugagaagggggucagaug

SEQ ID NO: 968076 - RNA, 22 nt, Human
uuugggaacucuaucauggaaa

SEQ ID NO: 968077 - RNA, 22 nt, Human
ccaaaaagcucagagauauguu

SEQ ID NO: 968078 - RNA, 22 nt, Human
cugggugguuuugaugugaauu

SEQ ID NO: 968079 - RNA, 22 nt, Human
gaggccugucgcuaggccucug

SEQ ID NO: 968080 - RNA, 22 nt, Human
ucuuggccagguguggugccuc

SEQ ID NO: 968081 - RNA, 22 nt, Human
ugagguaggugguaagagauac

SEQ ID NO: 968082 - RNA, 22 nt, Human
uaacauuagguagacauaagcc

SEQ ID NO: 968083 - RNA, 22 nt, Human
agguacagaugaaagucuaguu

SEQ ID NO: 968084 - RNA, 22 nt, Human
cuggagaggccccaagauauuu

SEQ ID NO: 968085 - RNA, 22 nt, Human
agugaccauuuucagcuagagg

SEQ ID NO: 968086 - RNA, 22 nt, Human
agguggcuccucccauggcugg

SEQ ID NO: 968087 - RNA, 22 nt, Human
ucucuggccgagagucccuggg

SEQ ID NO: 968088 - RNA, 22 nt, Human
cuggagagauccuccugaaaaa

SEQ ID NO: 968089 - RNA, 22 nt, Human
ugggccuguggcuuggcucuag

SEQ ID NO: 968090 - RNA, 20 nt, Human
uccagcugggaacagcugau

SEQ ID NO: 968091 - RNA, 22 nt, Human
cauuucugcagaauugcucuuc

SEQ ID NO: 968092 - RNA, 22 nt, Human
aguccagaccccggcagcuggu

SEQ ID NO: 968093 - RNA, 22 nt, Human
gucaggauuggggucaugaguc

SEQ ID NO: 968094 - RNA, 22 nt, Human
uugauacaggcucuauuucauc

SEQ ID NO: 968095 - RNA, 22 nt, Human
uacaaagugugcccaugcugag

SEQ ID NO: 968096 - RNA, 22 nt, Human
ucugugaacaucacauugacag

SEQ ID NO: 968097 - RNA, 22 nt, Human
auaaaaacugacccauccuuug

SEQ ID NO: 968098 - RNA, 22 nt, Human
agggucuguggaugcaucuggg

SEQ ID NO: 968099 - RNA, 22 nt, Human
cauuuguuaauuacuauuaucu

SEQ ID NO: 968100 - RNA, 22 nt, Human
aaaauugucgaacaguaguaac

SEQ ID NO: 968101 - RNA, 22 nt, Human
gcugucagcgcccaaggagcuc

SEQ ID NO: 968102 - RNA, 22 nt, Human
auauauaaccuggauaaggcuu

SEQ ID NO: 968103 - RNA, 22 nt, Human
ugggugggagcgcccugucugg

SEQ ID NO: 968104 - RNA, 22 nt, Human
cacagacccagaagggaugaag

SEQ ID NO: 968105 - RNA, 22 nt, Human
gcacugggugugaggcagcguc

SEQ ID NO: 968106 - RNA, 22 nt, Human
ucucuguaguugggcagcugcu

SEQ ID NO: 968107 - RNA, 22 nt, Human
ccagcccuugagauggaaggga

SEQ ID NO: 968108 - RNA, 22 nt, Human
uaggcacugaguacauauuggu

SEQ ID NO: 968109 - RNA, 22 nt, Human
uugauuucuauucagauguaga

SEQ ID NO: 968110 - RNA, 19 nt, Human
gugaggauacugcucagag

SEQ ID NO: 968111 - RNA, 22 nt, Human
ugaacaaacugcauucuucacu

SEQ ID NO: 968112 - RNA, 18 nt, Human
caaagcucacguuccauc

SEQ ID NO: 968113 - RNA, 22 nt, Human
ggggcugguggugguuucucca

SEQ ID NO: 968114 - RNA, 23 nt, Human
uggcuaaaggcucuaguccugcu

SEQ ID NO: 968115 - RNA, 22 nt, Human
cugggguggugcaggccucaug

SEQ ID NO: 968116 - RNA, 22 nt, Human
ugaaaaggaguccuuguuuuca

SEQ ID NO: 968117 - RNA, 22 nt, Human
uggcucagaguucaucuuuuag

SEQ ID NO: 968118 - RNA, 22 nt, Human
acaacauucuuaaauacacuga

SEQ ID NO: 968119 - RNA, 22 nt, Human
gcagcugagagaagaacagggc

SEQ ID NO: 968120 - RNA, 21 nt, Human
ugguggagugugcugagcaug

SEQ ID NO: 968121 - RNA, 22 nt, Human
uuuauguaguuacggacuauca

SEQ ID NO: 968122 - RNA, 22 nt, Human
aggaggugacagccugcaucug

SEQ ID NO: 968123 - RNA, 22 nt, Human
uucucugagauagacuaagugg

SEQ ID NO: 968124 - RNA, 22 nt, Human
cuugucugugucggauaaaacu

SEQ ID NO: 968125 - RNA, 22 nt, Human
gaaggaaaacagaucugccuga

SEQ ID NO: 968126 - RNA, 22 nt, Human
gcagggaagggaaacagagacc

SEQ ID NO: 968127 - RNA, 22 nt, Human
ucagcugagcuccagcucauag

SEQ ID NO: 968128 - RNA, 22 nt, Human
uacauuaucuuguuaucuuuca

SEQ ID NO: 968129 - RNA, 22 nt, Human
uucggcuuggguauuucucagg

SEQ ID NO: 968130 - RNA, 18 nt, Human
aaaaugcaggcgacaugg

SEQ ID NO: 968131 - RNA, 22 nt, Human
aaggccaugcacauccuaggca

SEQ ID NO: 968132 - RNA, 22 nt, Human
agggagcaugggugaagcaggc

SEQ ID NO: 968133 - RNA, 22 nt, Human
agggacugagcuaggaucuagu

SEQ ID NO: 968134 - RNA, 22 nt, Human
gaguggggcguggauccagcgu

SEQ ID NO: 968135 - RNA, 22 nt, Human
gccagggggucagcaggcacuu

SEQ ID NO: 968136 - RNA, 22 nt, Human
ccugugugcugaugacgacaga

SEQ ID NO: 968137 - RNA, 22 nt, Human
uugugucuggaaugcguggagc

SEQ ID NO: 968138 - RNA, 22 nt, Human
gggacaggccccucgcuagcuu

SEQ ID NO: 968139 - RNA, 22 nt, Human
ccugccagcauggcuuaucucc

SEQ ID NO: 968140 - RNA, 22 nt, Human
guggccaggacauugccaggca

SEQ ID NO: 968141 - RNA, 22 nt, Human
ccugcagaccacacucaguccu

SEQ ID NO: 968142 - RNA, 22 nt, Human
agucccagccuaggcugugcug

SEQ ID NO: 968143 - RNA, 22 nt, Human
agcugcugagagucugccgggc

SEQ ID NO: 968144 - RNA, 22 nt, Human
uaguccauuuucacacugcuga

SEQ ID NO: 968145 - RNA, 22 nt, Human
agagaugaaaaguggagacugg

SEQ ID NO: 968146 - RNA, 22 nt, Human
gagcagcugagcuggaaugaga

SEQ ID NO: 968147 - RNA, 22 nt, Human
gggacuggcacagggcugggag

SEQ ID NO: 968148 - RNA, 18 nt, Human
gguggccuugacuucucu

SEQ ID NO: 968149 - RNA, 22 nt, Human
aaguaaaagcuuuaccaugcgc

SEQ ID NO: 968150 - RNA, 22 nt, Human
ggcuccugggaugggacugagc

SEQ ID NO: 968151 - RNA, 22 nt, Human
uuacuuuguucucaagauaugu

SEQ ID NO: 968152 - RNA, 21 nt, Human
agcagcugcaguuucuaucug

SEQ ID NO: 968153 - RNA, 22 nt, Human
aaucaguuguucacucugaaaa

SEQ ID NO: 968154 - RNA, 22 nt, Human
cagccaucccagccugugguuc

SEQ ID NO: 968155 - RNA, 22 nt, Human
gccucccuguucuuccacaaua

SEQ ID NO: 968156 - RNA, 22 nt, Human
aggucaaggccaaaagaguggu

SEQ ID NO: 968157 - RNA, 17 nt, Human
gcagccagugcagcagg

SEQ ID NO: 968158 - RNA, 22 nt, Human
aaggaaagacauauaaaugacu

SEQ ID NO: 968159 - RNA, 20 nt, Human
gccuggaggcagagauaaag

SEQ ID NO: 968160 - RNA, 22 nt, Human
caggaugugaggaggccauuug

SEQ ID NO: 968161 - RNA, 22 nt, Human
uuugaaagaauuuauguacuuu

SEQ ID NO: 968162 - RNA, 22 nt, Human
gccuucaguaguauccucauga

SEQ ID NO: 968163 - RNA, 22 nt, Human
cuggcccuucucuugcuuccug

SEQ ID NO: 968164 - RNA, 22 nt, Human
uccaggagggguaggcaguaug

SEQ ID NO: 968165 - RNA, 22 nt, Human
cuaauuuucccaaggccuucua

SEQ ID NO: 968166 - RNA, 19 nt, Human
gcuuuuuguugucaaaggu

SEQ ID NO: 968167 - RNA, 22 nt, Human
uacaguauggaaaauguauagu

SEQ ID NO: 968168 - RNA, 22 nt, Human
caaucuauaaauaucaguuucc

SEQ ID NO: 968169 - RNA, 22 nt, Human
ucugguaaccuuuaucccuccu

SEQ ID NO: 968170 - RNA, 22 nt, Human
uggccacacccaccuagaggag

SEQ ID NO: 968171 - RNA, 22 nt, Human
gggcauggugaugugcaccugu

SEQ ID NO: 968172 - RNA, 22 nt, Human
cagucuuuguucccauuacuga

SEQ ID NO: 968173 - RNA, 22 nt, Human
ugugccuucucaguccugcuca

SEQ ID NO: 968174 - RNA, 22 nt, Human
aaggccagcuuguagggcuggu

SEQ ID NO: 968175 - RNA, 22 nt, Human
ggccugcucugcagccucuaca

SEQ ID NO: 968176 - RNA, 22 nt, Human
uagggaugacgaaaggacagag

SEQ ID NO: 968177 - RNA, 17 nt, Human
ucugggcuucagugguc

SEQ ID NO: 968178 - RNA, 22 nt, Human
acauagcuuaaaugagaagaua

SEQ ID NO: 968179 - RNA, 22 nt, Human
ggacagcauaucagcagggcag

SEQ ID NO: 968180 - RNA, 22 nt, Human
ucagcugccucucccuggaaga

SEQ ID NO: 968181 - RNA, 22 nt, Human
aaauauuagggagaacagggac

SEQ ID NO: 968182 - RNA, 22 nt, Human
cuguagcaaguuauucaauaaa

SEQ ID NO: 968183 - RNA, 23 nt, Human
cuggcucauccugguugcagugg

SEQ ID NO: 968184 - RNA, 22 nt, Human
uggaugcuguaggacacgcucu

SEQ ID NO: 968185 - RNA, 22 nt, Human
cagaacauuccaugugcccugc

SEQ ID NO: 968186 - RNA, 22 nt, Human
ccagcauggcaccugagaugag

SEQ ID NO: 968187 - RNA, 22 nt, Human
uuucacagcuggguggcagagu

SEQ ID NO: 968188 - RNA, 22 nt, Human
agaggggaaggaugugauguga

SEQ ID NO: 968189 - RNA, 22 nt, Human
gcaggaaagguugagacuuugc

SEQ ID NO: 968190 - RNA, 22 nt, Human
gagcucuggcagggcaggucug

SEQ ID NO: 968191 - RNA, 22 nt, Human
aggcacaguuucauccccgggc

SEQ ID NO: 968192 - RNA, 22 nt, Human
ccacagggaacaugacagccuu

SEQ ID NO: 968193 - RNA, 22 nt, Human
caggaugagaagggcucuuacg

SEQ ID NO: 968194 - RNA, 22 nt, Human
uaugugcaaauuaauugcuaga

SEQ ID NO: 968195 - RNA, 22 nt, Human
caaguaugagaaagcuauuacc

SEQ ID NO: 968196 - RNA, 22 nt, Human
aauauucaaguuauucuuucuu

SEQ ID NO: 968197 - RNA, 22 nt, Human
ucagcuggcaguucagaggcug

SEQ ID NO: 968198 - RNA, 22 nt, Human
uccaggacuagcauuucugaua

SEQ ID NO: 968199 - RNA, 22 nt, Human
acaaugcaccagcaucuucacc

SEQ ID NO: 968200 - RNA, 22 nt, Human
cgccugggaguccacaccugcu

SEQ ID NO: 968201 - RNA, 22 nt, Human
acagaccucuagauuacauuug

SEQ ID NO: 968202 - RNA, 22 nt, Human
gccugcaguucugugcuaggca

SEQ ID NO: 968203 - RNA, 19 nt, Human
uuucacaaagagagcguga

SEQ ID NO: 968204 - RNA, 22 nt, Human
aaaaauaggucaaccguguaug

SEQ ID NO: 968205 - RNA, 20 nt, Human
cagauggcacgucagggcau

SEQ ID NO: 968206 - RNA, 22 nt, Human
ugcuagugcaggguuuucaguu

SEQ ID NO: 968207 - RNA, 22 nt, Human
ugucauaaaacacaagcuguug

SEQ ID NO: 968208 - RNA, 22 nt, Human
ucauugaacgaagagcuccauu

SEQ ID NO: 968209 - RNA, 22 nt, Human
uugcaggaaacugagugugagc

SEQ ID NO: 968210 - RNA, 22 nt, Human
uaaggccaggcuguggucggca

SEQ ID NO: 968211 - RNA, 23 nt, Human
gcauugucuccccacuucugggc

SEQ ID NO: 968212 - RNA, 22 nt, Human
acauuugaggauguuaagaaug

SEQ ID NO: 968213 - RNA, 22 nt, Human
cagguaaaaauaaauuugugag

SEQ ID NO: 968214 - RNA, 22 nt, Human
aggagccaugagugacaucaca

SEQ ID NO: 968215 - RNA, 22 nt, Human
ucccagagccucugccacucug

SEQ ID NO: 968216 - RNA, 20 nt, Human
agacccuguguccuguggcc

SEQ ID NO: 968217 - RNA, 22 nt, Human
gaugccugcauuucaggagagu

SEQ ID NO: 968218 - RNA, 23 nt, Human
uuauugaggguguagauuggugu

SEQ ID NO: 968219 - RNA, 19 nt, Human
caguggagauuggaggagg

SEQ ID NO: 968220 - RNA, 22 nt, Human
gcugaaugaauguauuuuaaaa

SEQ ID NO: 968221 - RNA, 22 nt, Human
aagaguuuucuauaaucuuggc

SEQ ID NO: 968222 - RNA, 22 nt, Human
gcccagaaguugaggcugcagu

SEQ ID NO: 968223 - RNA, 22 nt, Human
ggugaagggccuuaggagacag

SEQ ID NO: 968224 - RNA, 22 nt, Human
uagaauaugauuaauuuucuua

SEQ ID NO: 968225 - RNA, 22 nt, Human
gugucaugggagucagaaguga

SEQ ID NO: 968226 - RNA, 22 nt, Human
ggagggaaugucuagcauucuu

SEQ ID NO: 968227 - RNA, 22 nt, Human
ucacgagaggcacagaauagag

SEQ ID NO: 968228 - RNA, 22 nt, Human
uaagaacaagauguuccuguuu

SEQ ID NO: 968229 - RNA, 22 nt, Human
ggaagaagggucauuggcagcc

SEQ ID NO: 968230 - RNA, 22 nt, Human
ucuggccaacccucaaguugua

SEQ ID NO: 968231 - RNA, 21 nt, Human
ucauuuuuauugcuaccuugc

SEQ ID NO: 968232 - RNA, 22 nt, Human
aagauuucugcuuuuggaggca

SEQ ID NO: 968233 - RNA, 22 nt, Human
gauguguuuccaggauuuguuu

SEQ ID NO: 968234 - RNA, 22 nt, Human
ggagguggcagggaacauaauu

SEQ ID NO: 968235 - RNA, 22 nt, Human
uuuuaucuaccuaugcucauuu

SEQ ID NO: 968236 - RNA, 22 nt, Human
cccagcuaccucugcuaggaga

SEQ ID NO: 968237 - RNA, 20 nt, Human
ccuggcugcauucaggacgg

SEQ ID NO: 968238 - RNA, 22 nt, Human
ucuggcuccugaguccaugcuc

SEQ ID NO: 968239 - RNA, 22 nt, Human
ugcucuccggcuuccguggccu

SEQ ID NO: 968240 - RNA, 22 nt, Human
acagagccacuuuggugccuac

SEQ ID NO: 968241 - RNA, 22 nt, Human
cagcagcuucuguugaucagaa

SEQ ID NO: 968242 - RNA, 22 nt, Human
caaggagauaaaauguugagcu

SEQ ID NO: 968243 - RNA, 22 nt, Human
caaauguaaauucuuuugaagc

SEQ ID NO: 968244 - RNA, 22 nt, Human
accaaggaagaaucuauuugag

SEQ ID NO: 968245 - RNA, 22 nt, Human
gcccaggagccuggagaugugu

SEQ ID NO: 968246 - RNA, 22 nt, Human
gguggcagucuuaagagaucuu

SEQ ID NO: 968247 - RNA, 21 nt, Human
guguuuccuguuuauggcuug

SEQ ID NO: 968248 - RNA, 22 nt, Human
gucccuggucuaccguggcuuc

SEQ ID NO: 968249 - RNA, 22 nt, Human
agugugggugagggaggcccuc

SEQ ID NO: 968250 - RNA, 22 nt, Human
aagucuuacauaaacaggaaau

SEQ ID NO: 968251 - RNA, 22 nt, Human
cagcagggggcagcgcagauca

SEQ ID NO: 968252 - RNA, 22 nt, Human
uuagccaugcccuagaagagga

SEQ ID NO: 968253 - RNA, 21 nt, Human
acagucuccccagaucucucc

SEQ ID NO: 968254 - RNA, 22 nt, Human
aagauuuagggccaguuuacau

SEQ ID NO: 968255 - RNA, 22 nt, Human
uggccacagccucugccaguuc

SEQ ID NO: 968256 - RNA, 20 nt, Human
accuugaacccgccagccau

SEQ ID NO: 968257 - RNA, 22 nt, Human
gucuucuuguuuugaaggaaau

SEQ ID NO: 968258 - RNA, 22 nt, Human
gaggucaggcuugcagcagggu

SEQ ID NO: 968259 - RNA, 20 nt, Human
auuugcaucugaauaacuua

SEQ ID NO: 968260 - RNA, 22 nt, Human
cauugcugugggcauuugcugc

SEQ ID NO: 968261 - RNA, 23 nt, Human
gcugucaguuguuuuugucucua

SEQ ID NO: 968262 - RNA, 22 nt, Human
cccuccagcucaaagcaaccgg

SEQ ID NO: 968263 - RNA, 22 nt, Human
cccagacuccucuggcuggugg

SEQ ID NO: 968264 - RNA, 22 nt, Human
uauuucuucgggauucaagcua

SEQ ID NO: 968265 - RNA, 22 nt, Human
uugcauugaaugcacauuuuua

SEQ ID NO: 968266 - RNA, 22 nt, Human
aagggccuccuggggagccugg

SEQ ID NO: 968267 - RNA, 21 nt, Human
uagggcaggcauuggaagaga

SEQ ID NO: 968268 - RNA, 22 nt, Human
ugggcccaagagagucuccaac

SEQ ID NO: 968269 - RNA, 22 nt, Human
ugggcucuccuggaggacaaca

SEQ ID NO: 968270 - RNA, 22 nt, Human
ggucaugcugugaaucagugcu

SEQ ID NO: 968271 - RNA, 22 nt, Human
uauugaguuacagaaaauacuu

SEQ ID NO: 968272 - RNA, 22 nt, Human
acuggcagccacaacuggcagg

SEQ ID NO: 968273 - RNA, 22 nt, Human
auucuucauuuacuguuacuug

SEQ ID NO: 968274 - RNA, 22 nt, Human
aacucaguuacauauuagaaua

SEQ ID NO: 968275 - RNA, 22 nt, Human
cagggcagggauguugcggcag

SEQ ID NO: 968276 - RNA, 22 nt, Human
ucuucaauuagauuuaccaauu

SEQ ID NO: 968277 - RNA, 22 nt, Human
cccaggcuggauuucgguggca

SEQ ID NO: 968278 - RNA, 19 nt, Human
cugagagaugcuucacaca

SEQ ID NO: 968279 - RNA, 19 nt, Human
ccugcagggaugagagguu

SEQ ID NO: 968280 - RNA, 22 nt, Human
agacccugucaguguuaggaaa

SEQ ID NO: 968281 - RNA, 22 nt, Human
uucucagaauugacugggagca

SEQ ID NO: 968282 - RNA, 22 nt, Human
uuccauauguauauagcuguua

SEQ ID NO: 968283 - RNA, 22 nt, Human
cuguuucaagugaagucagaca

SEQ ID NO: 968284 - RNA, 22 nt, Human
gugccaggugcuaagcugugcu

SEQ ID NO: 968285 - RNA, 22 nt, Human
gggcagugguccaggcuacagc

SEQ ID NO: 968286 - RNA, 22 nt, Human
agggccuggcuucacuuucuca

SEQ ID NO: 968287 - RNA, 22 nt, Human
ucccagccugacagugcaucaa

SEQ ID NO: 968288 - RNA, 22 nt, Human
agauggcagggguaccuggaag

SEQ ID NO: 968289 - RNA, 23 nt, Human
ggccacaaauagucuccccuggc

SEQ ID NO: 968290 - RNA, 22 nt, Human
ggcagggagagcaugcugauaa

SEQ ID NO: 968291 - RNA, 22 nt, Human
guguccagggccguguugucuu

SEQ ID NO: 968292 - RNA, 22 nt, Human
gucuucaacaauaacuaccacu

SEQ ID NO: 968293 - RNA, 22 nt, Human
uauuagugaaagaauuaguuug

SEQ ID NO: 968294 - RNA, 22 nt, Human
gacagccucaugaggagcaaaa

SEQ ID NO: 968295 - RNA, 22 nt, Human
auuacaguaacagcuacaaugc

SEQ ID NO: 968296 - RNA, 22 nt, Human
uuuuugaaggcugaugugauua

SEQ ID NO: 968297 - RNA, 22 nt, Human
cuucacaaucaccuuuucggaa

SEQ ID NO: 968298 - RNA, 22 nt, Human
aaauugugagcuauagaucuag

SEQ ID NO: 968299 - RNA, 22 nt, Human
ugaagucuauuaacugauuucu

SEQ ID NO: 968300 - RNA, 22 nt, Human
gccugcuggauguggccaggcc

SEQ ID NO: 968301 - RNA, 22 nt, Human
gcucugcuguguuuguucagca

SEQ ID NO: 968302 - RNA, 22 nt, Human
gcugugcagucuuuggugugcc

SEQ ID NO: 968303 - RNA, 22 nt, Human
ccagugcuuccaggaauacggu

SEQ ID NO: 968304 - RNA, 22 nt, Human
aggcacugauucucagaguuac

SEQ ID NO: 968305 - RNA, 22 nt, Human
uagcagcucacagccucccauu

SEQ ID NO: 968306 - RNA, 22 nt, Human
ccugucuggccaccagggcgau

SEQ ID NO: 968307 - RNA, 22 nt, Human
gcagaagggaauaaggagcuuu

SEQ ID NO: 968308 - RNA, 22 nt, Human
uagggcaguuucauguuaucuu

SEQ ID NO: 968309 - RNA, 22 nt, Human
aagcaagacagaaguuacugcc

SEQ ID NO: 968310 - RNA, 22 nt, Human
agaggcagcagucauacuacag

SEQ ID NO: 968311 - RNA, 22 nt, Human
uuaaauuccagccucauaauag

SEQ ID NO: 968312 - RNA, 22 nt, Human
auggccugggcccgcuucagau

SEQ ID NO: 968313 - RNA, 22 nt, Human
augauugaccaucugcugggcu

SEQ ID NO: 968314 - RNA, 22 nt, Human
gcagagaacccagcagauuggc

SEQ ID NO: 968315 - RNA, 20 nt, Human
caucaucacaugagccaauu

SEQ ID NO: 968316 - RNA, 22 nt, Human
cugaggucucuuuccauaguga

SEQ ID NO: 968317 - RNA, 20 nt, Human
ugcugcaguuucaugggacu

SEQ ID NO: 968318 - RNA, 22 nt, Human
gugcauuuggugacucucaccc

SEQ ID NO: 968319 - RNA, 22 nt, Human
caguagcaggcaggugcuuuug

SEQ ID NO: 968320 - RNA, 22 nt, Human
cuuguagaauugaaauggucuc

SEQ ID NO: 968321 - RNA, 22 nt, Human
auccagagacccaaggacagaa

SEQ ID NO: 968322 - RNA, 22 nt, Human
ccuccuggauggauuuggugga

SEQ ID NO: 968323 - RNA, 22 nt, Human
ugccuugcuggaugucaguuuu

SEQ ID NO: 968324 - RNA, 22 nt, Human
ccuuuucaacuaagauucugca

SEQ ID NO: 968325 - RNA, 22 nt, Human
auggcacuaagagggagcugga

SEQ ID NO: 968326 - RNA, 22 nt, Human
agaaaacuugucacagcucuca

SEQ ID NO: 968327 - RNA, 22 nt, Human
ugccugggaaccaauccuggcu

SEQ ID NO: 968328 - RNA, 22 nt, Human
gaggccaggacaugaaagcuga

SEQ ID NO: 968329 - RNA, 22 nt, Human
aguaaugucccuuaaauguggu

SEQ ID NO: 968330 - RNA, 22 nt, Human
gaaugcacacgugugugcaugc

SEQ ID NO: 968331 - RNA, 22 nt, Human
cuccaggagggggauggcugua

SEQ ID NO: 968332 - RNA, 22 nt, Human
ggagccagagucugcaguguaa

SEQ ID NO: 968333 - RNA, 21 nt, Human
ucuuuccugcccaguugcccu

SEQ ID NO: 968334 - RNA, 22 nt, Human
ggccaggagaggagggcacuga

SEQ ID NO: 968335 - RNA, 22 nt, Human
uuguuuucacagcuuugcccgg

SEQ ID NO: 968336 - RNA, 22 nt, Human
agaccuggauuccaauccuacc

SEQ ID NO: 968337 - RNA, 22 nt, Human
agaaggggagaagcuaccagga

SEQ ID NO: 968338 - RNA, 22 nt, Human
gccuggcaggaaucucagugcu

SEQ ID NO: 968339 - RNA, 19 nt, Human
gccugagccagccaugcaa

SEQ ID NO: 968340 - RNA, 18 nt, Human
acagaacucaggggcacc

SEQ ID NO: 968341 - RNA, 22 nt, Human
ucaguucugcuagaaaaacagu

SEQ ID NO: 968342 - RNA, 22 nt, Human
aaaucagugcucauuugaaagg

SEQ ID NO: 968343 - RNA, 21 nt, Human
ucacuuauaauguauuugcug

SEQ ID NO: 968344 - RNA, 22 nt, Human
uuaugcuaagugcaacaagcca

SEQ ID NO: 968345 - RNA, 22 nt, Human
aggggcucaguuacuuuggcag

SEQ ID NO: 968346 - RNA, 22 nt, Human
cacaggcuccggccuugcagcc

SEQ ID NO: 968347 - RNA, 21 nt, Human
ggccucugucauccugggaag

SEQ ID NO: 968348 - RNA, 22 nt, Human
ucuggcucuauaacuccuagcu

SEQ ID NO: 968349 - RNA, 22 nt, Human
gccugugcuuaacugacgugag

SEQ ID NO: 968350 - RNA, 22 nt, Human
gggcuggagccagcuguggcug

SEQ ID NO: 968351 - RNA, 22 nt, Human
guggcccugucccaggccuccu

SEQ ID NO: 968352 - RNA, 22 nt, Human
ucuggccacuaauaggucucac

SEQ ID NO: 968353 - RNA, 22 nt, Human
auacaucuuccuuuuaaaaugc

SEQ ID NO: 968354 - RNA, 22 nt, Human
ucuuguuaaagugaagauacug

SEQ ID NO: 968355 - RNA, 22 nt, Human
agcuuuauucaugauuucaggg

SEQ ID NO: 968356 - RNA, 21 nt, Human
cugcucugacagugaggccag

SEQ ID NO: 968357 - RNA, 22 nt, Human
guagggagcccagagcccagug

SEQ ID NO: 968358 - RNA, 21 nt, Human
uuuauuaacaacuguggacgu

SEQ ID NO: 968359 - RNA, 19 nt, Human
cucugccucuggcuguggc

SEQ ID NO: 968360 - RNA, 22 nt, Human
cagauggcaacagcucugugac

SEQ ID NO: 968361 - RNA, 22 nt, Human
ccagcugagaaguguaaaguga

SEQ ID NO: 968362 - RNA, 22 nt, Human
cugccugcacugccuggcucca

SEQ ID NO: 968363 - RNA, 22 nt, Human
ccaggagcaacuugaaggcaag

SEQ ID NO: 968364 - RNA, 22 nt, Human
ccagggucuuggagaggagugc

SEQ ID NO: 968365 - RNA, 22 nt, Human
ggagaggaaaugccagcacuuc

SEQ ID NO: 968366 - RNA, 22 nt, Human
uguauuagagcaguagaauuau

SEQ ID NO: 968367 - RNA, 22 nt, Human
aggcagcucuguggccucccag

SEQ ID NO: 968368 - RNA, 22 nt, Human
uggcccugcugggucagagcug

SEQ ID NO: 968369 - RNA, 22 nt, Human
gucugcugcagagcauggcuuu

SEQ ID NO: 968370 - RNA, 22 nt, Human
ccugccugcagaaaguaucucc

SEQ ID NO: 968371 - RNA, 22 nt, Human
gcucugcuggagggaaagagaa

SEQ ID NO: 968372 - RNA, 22 nt, Human
ucucagggugaggaaagaauuu

SEQ ID NO: 968373 - RNA, 22 nt, Human
agacagaacagaauaauuguug

SEQ ID NO: 968374 - RNA, 22 nt, Human
ucacucuguggcccaggcagug

SEQ ID NO: 968375 - RNA, 22 nt, Human
ugguuugcccacucgagugauu

SEQ ID NO: 968376 - RNA, 22 nt, Human
ccugcugugaagccaggccugu

SEQ ID NO: 968377 - RNA, 22 nt, Human
ucugccuggaugauggcagggc

SEQ ID NO: 968378 - RNA, 22 nt, Human
cagaaauucccauuucagauuc

SEQ ID NO: 968379 - RNA, 22 nt, Human
ugcuucagaggaaaggcaaaag

SEQ ID NO: 968380 - RNA, 22 nt, Human
ccugccugauuccaggauggcu

SEQ ID NO: 968381 - RNA, 22 nt, Human
uggaggaaguugcuggaaguca

SEQ ID NO: 968382 - RNA, 22 nt, Human
uguuuuaaagccauugccuuuc

SEQ ID NO: 968383 - RNA, 22 nt, Human
cacauauuguaguucaccagga

SEQ ID NO: 968384 - RNA, 22 nt, Human
uuuauguaaguggaaugaugcc

SEQ ID NO: 968385 - RNA, 22 nt, Human
agcccagggacagggcggaugu

SEQ ID NO: 968386 - RNA, 22 nt, Human
ugcagggcuaagucagagccug

SEQ ID NO: 968387 - RNA, 22 nt, Human
gcuggccugaccagccacaggc

SEQ ID NO: 968388 - RNA, 22 nt, Human
auuugcuugugcuaugaaaguu

SEQ ID NO: 968389 - RNA, 22 nt, Human
gacagcauggugucuguucagg

SEQ ID NO: 968390 - RNA, 22 nt, Human
ucacagaauagcacuguaagcg

SEQ ID NO: 968391 - RNA, 22 nt, Human
uccuggauucugcccugaaggc

SEQ ID NO: 968392 - RNA, 22 nt, Human
aaauaauguuaggccuuugcuc

SEQ ID NO: 968393 - RNA, 22 nt, Human
uggcagcaaaaccagaaucaga

SEQ ID NO: 968394 - RNA, 22 nt, Human
agugcuuugaacgaaaggcuga

SEQ ID NO: 968395 - RNA, 19 nt, Human
uggcagggagugauauuag

SEQ ID NO: 968396 - RNA, 22 nt, Human
uuggccaaggaccuuuuuggag

SEQ ID NO: 968397 - RNA, 22 nt, Human
cacaaauggccguguucaaaga

SEQ ID NO: 968398 - RNA, 22 nt, Human
gccaggcagcaggaagccagug

SEQ ID NO: 968399 - RNA, 22 nt, Human
gugggagccauuuccaguaugc

SEQ ID NO: 968400 - RNA, 22 nt, Human
uggcuuccacugugugcccccu

SEQ ID NO: 968401 - RNA, 22 nt, Human
acuacuuugggccauuuguuua

SEQ ID NO: 968402 - RNA, 22 nt, Human
cagccaggcccccgagucguug

SEQ ID NO: 968403 - RNA, 22 nt, Human
agcagccacccagcugcucauu

SEQ ID NO: 968404 - RNA, 22 nt, Human
guacacauugucuguuuacuuc

SEQ ID NO: 968405 - RNA, 22 nt, Human
uggccuggugucugcgaggccu

SEQ ID NO: 968406 - RNA, 19 nt, Human
aggcucugagcuccuggag

SEQ ID NO: 968407 - RNA, 21 nt, Human
gagccuucccucugcccuuuc

SEQ ID NO: 968408 - RNA, 22 nt, Human
ucaguuuucauuucaugagcag

SEQ ID NO: 968409 - RNA, 22 nt, Human
aaagaacaaauuagcuguuuua

SEQ ID NO: 968410 - RNA, 22 nt, Human
agucugcacucagguggagguc

SEQ ID NO: 968411 - RNA, 22 nt, Human
ucucuucuaacacuagaaauuc

SEQ ID NO: 968412 - RNA, 22 nt, Human
ggcucuggcguccaauggagcg

SEQ ID NO: 968413 - RNA, 22 nt, Human
uaacagaaaggggacagaaaua

SEQ ID NO: 968414 - RNA, 22 nt, Human
acagcagccuuguugguuucga

SEQ ID NO: 968415 - RNA, 22 nt, Human
ucagccugcuccaagugcugcc

SEQ ID NO: 968416 - RNA, 22 nt, Human
ugcacacaguucucaggaaaga

SEQ ID NO: 968417 - RNA, 23 nt, Human
agcacagacuagaaaggucuuuc

SEQ ID NO: 968418 - RNA, 22 nt, Human
uuucuaggucuuccauacugcc

SEQ ID NO: 968419 - RNA, 22 nt, Human
uucugaaagccaauucauugaa

SEQ ID NO: 968420 - RNA, 22 nt, Human
agaggaggaagagcuuuaaaau

SEQ ID NO: 968421 - RNA, 19 nt, Human
gccugggaugggcagaacu

SEQ ID NO: 968422 - RNA, 21 nt, Human
agucccaggggugagugaugu

SEQ ID NO: 968423 - RNA, 22 nt, Human
acaugcaugucuaugggcaggu

SEQ ID NO: 968424 - RNA, 22 nt, Human
ugucucaggcccaagccaguaa

SEQ ID NO: 968425 - RNA, 22 nt, Human
guuugcauuccaauuuagggga

SEQ ID NO: 968426 - RNA, 18 nt, Human
gcaggagauggguggggu

SEQ ID NO: 968427 - RNA, 22 nt, Human
acauuucuccuacuuguuauuu

SEQ ID NO: 968428 - RNA, 22 nt, Human
uuguuaguuuauauaauguagu

SEQ ID NO: 968429 - RNA, 22 nt, Human
ggcugcucugccuuccagcugg

SEQ ID NO: 968430 - RNA, 22 nt, Human
gucuccugagacugcagucacc

SEQ ID NO: 968431 - RNA, 21 nt, Human
ucagcagcaucugccuagagu

SEQ ID NO: 968432 - RNA, 23 nt, Human
cagaaaacccagagcucaguccc

SEQ ID NO: 968433 - RNA, 22 nt, Human
uaguuuuacuugcgaugauaau

SEQ ID NO: 968434 - RNA, 22 nt, Human
agcaggaggguuuuguagaguc

SEQ ID NO: 968435 - RNA, 22 nt, Human
aggaaaaauaaggcagcagggc

SEQ ID NO: 968436 - RNA, 22 nt, Human
ucuuuccuacuuuauugugaac

SEQ ID NO: 968437 - RNA, 22 nt, Human
aagaaauuaaugugccauuacu

SEQ ID NO: 968438 - RNA, 22 nt, Human
ugacagcugagccccaggcaag

SEQ ID NO: 968439 - RNA, 22 nt, Human
aggccugggcaagaaggggcgu

SEQ ID NO: 968440 - RNA, 22 nt, Human
ugccagggugucaggagagcua

SEQ ID NO: 968441 - RNA, 22 nt, Human
cucagaauuacaucccauuuua

SEQ ID NO: 968442 - RNA, 22 nt, Human
uacagaaaucacaucgcuuuga

SEQ ID NO: 968443 - RNA, 22 nt, Human
auuccaguucuccucucuaaag

SEQ ID NO: 968444 - RNA, 23 nt, Human
auguuauuauuagcagucuugcc

SEQ ID NO: 968445 - RNA, 22 nt, Human
gauuucuugaccccugucucag

SEQ ID NO: 968446 - RNA, 22 nt, Human
uacauggugguggcacuugacu

SEQ ID NO: 968447 - RNA, 22 nt, Human
cugccaggcacgugcagcauca

SEQ ID NO: 968448 - RNA, 22 nt, Human
ggcuggcucagggcuugagaga

SEQ ID NO: 968449 - RNA, 21 nt, Human
gcaggggauagaaauggucug

SEQ ID NO: 968450 - RNA, 22 nt, Human
aguuucauauuaccaugucacc

SEQ ID NO: 968451 - RNA, 22 nt, Human
aggcacugguccauuuucugca

SEQ ID NO: 968452 - RNA, 22 nt, Human
aauaugaauuauuguuacaagu

SEQ ID NO: 968453 - RNA, 22 nt, Human
agucucuuccuucaaggcuggu

SEQ ID NO: 968454 - RNA, 18 nt, Human
ucagggaaucuuggccuu

SEQ ID NO: 968455 - RNA, 22 nt, Human
uuccaaauuaaaauguacaaug

SEQ ID NO: 968456 - RNA, 22 nt, Human
augcuuuuccuaaaaugaugcc

SEQ ID NO: 968457 - RNA, 22 nt, Human
ccucagggccaucucugucccu

SEQ ID NO: 968458 - RNA, 22 nt, Human
aaauguguuucgaaaacuggug

SEQ ID NO: 968459 - RNA, 22 nt, Human
uugagucaguaauuccauuucu

SEQ ID NO: 968460 - RNA, 22 nt, Human
aggccaaauugaucaucuuuag

SEQ ID NO: 968461 - RNA, 22 nt, Human
ucuggauggucagcucuuccug

SEQ ID NO: 968462 - RNA, 22 nt, Human
ugcccaaaccucuccuagcucu

SEQ ID NO: 968463 - RNA, 22 nt, Human
uuuaccaagcuuuaauuacaua

SEQ ID NO: 968464 - RNA, 22 nt, Human
cccaggaagaggggucaggugu

SEQ ID NO: 968465 - RNA, 22 nt, Human
aggcacuguggaagacaugguu

SEQ ID NO: 968466 - RNA, 22 nt, Human
uaggcacuuggcguguuggaga

SEQ ID NO: 968467 - RNA, 22 nt, Human
aacaucuuguccuuagauuaaa

SEQ ID NO: 968468 - RNA, 22 nt, Human
gaagcagcuuucuggugaggag

SEQ ID NO: 968469 - RNA, 22 nt, Human
agggcuggcaucucuaaugcug

SEQ ID NO: 968470 - RNA, 22 nt, Human
gcugcagcuguaggacacaauu

SEQ ID NO: 968471 - RNA, 22 nt, Human
ccugccagcccgcguucaugcc

SEQ ID NO: 968472 - RNA, 18 nt, Human
guucaaggucaagagaga

SEQ ID NO: 968473 - RNA, 22 nt, Human
ucuggcaggucaaucauucuuu

SEQ ID NO: 968474 - RNA, 22 nt, Human
cuagggaguggcagagcuggga

SEQ ID NO: 968475 - RNA, 22 nt, Human
auaaacaguagagaaagguggu

SEQ ID NO: 968476 - RNA, 22 nt, Human
uuaggcauauggcacaugauag

SEQ ID NO: 968477 - RNA, 22 nt, Human
ugcaggagcugugcggugaggg

SEQ ID NO: 968478 - RNA, 22 nt, Human
aggugcagcaugaguccaacgg

SEQ ID NO: 968479 - RNA, 22 nt, Human
ucugggaaugaauaagaccugu

SEQ ID NO: 968480 - RNA, 22 nt, Human
cccuggccagcucaugucugag

SEQ ID NO: 968481 - RNA, 22 nt, Human
agguggggccaaaugcuacagu

SEQ ID NO: 968482 - RNA, 22 nt, Human
ccuuucucuggcagcaggacag

SEQ ID NO: 968483 - RNA, 20 nt, Human
ugcguguguauuuauuuucu

SEQ ID NO: 968484 - RNA, 22 nt, Human
ccuuccaggagucucugcaggu

SEQ ID NO: 968485 - RNA, 22 nt, Human
auguucuuguucaaaugucagu

SEQ ID NO: 968486 - RNA, 22 nt, Human
aucuuucaguuucauaccaauu

SEQ ID NO: 968487 - RNA, 22 nt, Human
gccaggaggcuuaacuggacag

SEQ ID NO: 968488 - RNA, 22 nt, Human
cugcucuggucucuucauguuu

SEQ ID NO: 968489 - RNA, 17 nt, Human
uccagagcacagagcuc

SEQ ID NO: 968490 - RNA, 22 nt, Human
ccuggcugugcauugccggccc

SEQ ID NO: 968491 - RNA, 22 nt, Human
uuuaguagaaauauuugggccu

SEQ ID NO: 968492 - RNA, 22 nt, Human
cagugucuuauuuguagcucag

SEQ ID NO: 968493 - RNA, 20 nt, Human
cugagcugagcuccaugggu

SEQ ID NO: 968494 - RNA, 22 nt, Human
uuuccucugaugcugacuugga

SEQ ID NO: 968495 - RNA, 22 nt, Human
caggaaagagcugccaggcagg

SEQ ID NO: 968496 - RNA, 22 nt, Human
caggguccggcugccuggcugu

SEQ ID NO: 968497 - RNA, 22 nt, Human
ggcccagcacagugcuuggggg

SEQ ID NO: 968498 - RNA, 22 nt, Human
ccuccuuuccuguuuuccugag

SEQ ID NO: 968499 - RNA, 18 nt, Human
uacaucuauauaguguuu

SEQ ID NO: 968500 - RNA, 22 nt, Human
aauucacauguugaaguccuaa

SEQ ID NO: 968501 - RNA, 22 nt, Human
ccagccaguccagcauuggugu

SEQ ID NO: 968502 - RNA, 22 nt, Human
ucucagaggugcccuggcaucu

SEQ ID NO: 968503 - RNA, 22 nt, Human
acaaaugccauauauaaauucu

SEQ ID NO: 968504 - RNA, 22 nt, Human
ucagggcagguuaacuugggug

SEQ ID NO: 968505 - RNA, 22 nt, Human
augaagauaagaccaggcugga

SEQ ID NO: 968506 - RNA, 22 nt, Human
acuguucauuuguccuguaucu

SEQ ID NO: 968507 - RNA, 22 nt, Human
acccagaggugucuagcaagcu

SEQ ID NO: 968508 - RNA, 22 nt, Human
uggcucagaagaaaagguaaac

SEQ ID NO: 968509 - RNA, 22 nt, Human
gcugccuguggcccuucugggu

SEQ ID NO: 968510 - RNA, 22 nt, Human
uuauguaauuuguuugcucuuc

SEQ ID NO: 968511 - RNA, 17 nt, Human
gguggccugcaguggcu

SEQ ID NO: 968512 - RNA, 22 nt, Human
ccacugucugcaggccucagca

SEQ ID NO: 968513 - RNA, 22 nt, Human
cagugucuccagaugcuccaau

SEQ ID NO: 968514 - RNA, 22 nt, Human
ucuguccucuuugaagcugcuc

SEQ ID NO: 968515 - RNA, 22 nt, Human
gugcuuucugcaugguuccuac

SEQ ID NO: 968516 - RNA, 20 nt, Human
gaggaaaagcugccaggccu

SEQ ID NO: 968517 - RNA, 20 nt, Human
cucuggcuccgcgugaccgc

SEQ ID NO: 968518 - RNA, 21 nt, Human
ugcucacagaugugcucagug

SEQ ID NO: 968519 - RNA, 23 nt, Human
aggaggaaaaguuaucugcugag

SEQ ID NO: 968520 - RNA, 22 nt, Human
gcucagagcacucagacucagc

SEQ ID NO: 968521 - RNA, 22 nt, Human
cccuggagucagguuggccugg

SEQ ID NO: 968522 - RNA, 22 nt, Human
aaagucauacauggugcuuacu

SEQ ID NO: 968523 - RNA, 22 nt, Human
accuuggggugaugcugaaaga

SEQ ID NO: 968524 - RNA, 22 nt, Human
gggcuaggcuuggccagcacug

SEQ ID NO: 968525 - RNA, 22 nt, Human
aaggcagauauaaagacuagag

SEQ ID NO: 968526 - RNA, 23 nt, Human
uuccuggcagguacaacuuuuac

SEQ ID NO: 968527 - RNA, 22 nt, Human
agcugcuccuuuccugcaggcg

SEQ ID NO: 968528 - RNA, 22 nt, Human
gccugguggacacugggcauca

SEQ ID NO: 968529 - RNA, 22 nt, Human
cccagccagccucuucccauau

SEQ ID NO: 968530 - RNA, 22 nt, Human
aagaggaacugggggcugaguc

SEQ ID NO: 968531 - RNA, 22 nt, Human
aggcaacuuuuggggaugaugg

SEQ ID NO: 968532 - RNA, 22 nt, Human
aaccaggugacucauggugagc

SEQ ID NO: 968533 - RNA, 22 nt, Human
aaacuccugcauacucagaagc

SEQ ID NO: 968534 - RNA, 22 nt, Human
ccaugagacagcaacugaaagu

SEQ ID NO: 968535 - RNA, 22 nt, Human
uuguacacaauucuuaacauac

SEQ ID NO: 968536 - RNA, 22 nt, Human
cugcucacgccaccguucauca

SEQ ID NO: 968537 - RNA, 22 nt, Human
ggagccagaggcugcugcugug

SEQ ID NO: 968538 - RNA, 22 nt, Human
ugcauuuccagauuucuggagu

SEQ ID NO: 968539 - RNA, 22 nt, Human
auuugucuucaguagguucuuc

SEQ ID NO: 968540 - RNA, 23 nt, Human
uccucccaaauuucagccucauu

SEQ ID NO: 968541 - RNA, 22 nt, Human
ucagguguuagaagaaauuuca

SEQ ID NO: 968542 - RNA, 22 nt, Human
ucugcugugauuugcuaccugu

SEQ ID NO: 968543 - RNA, 22 nt, Human
aucuucucauguguaaugaggu

SEQ ID NO: 968544 - RNA, 22 nt, Human
ccuggaugauccaugucaugga

SEQ ID NO: 968545 - RNA, 22 nt, Human
aagagcugcccaaggugaacag

SEQ ID NO: 968546 - RNA, 21 nt, Human
gcucagaguauugcacuguuu

SEQ ID NO: 968547 - RNA, 22 nt, Human
cugagcuuggccaggaaugaau

SEQ ID NO: 968548 - RNA, 22 nt, Human
uuuucaguaaugucuacauaau

SEQ ID NO: 968549 - RNA, 22 nt, Human
uuuuuuauaucaacugaagucu

SEQ ID NO: 968550 - RNA, 22 nt, Human
ucccacugcuuugcucugcuca

SEQ ID NO: 968551 - RNA, 22 nt, Human
gagagggagccagccaggaacc

SEQ ID NO: 968552 - RNA, 20 nt, Human
gcccuggagccuuguccugg

SEQ ID NO: 968553 - RNA, 22 nt, Human
ggagggcaucaaucaggccugg

SEQ ID NO: 968554 - RNA, 22 nt, Human
acagcagcacuauugacauuuu

SEQ ID NO: 968555 - RNA, 22 nt, Human
uauuuccagcaguaagaagaca

SEQ ID NO: 968556 - RNA, 17 nt, Human
uuucuccuuccaucuca

SEQ ID NO: 968557 - RNA, 22 nt, Human
guugaguggguuaggaugcuga

SEQ ID NO: 968558 - RNA, 22 nt, Human
agucucugcaugccugcugugc

SEQ ID NO: 968559 - RNA, 22 nt, Human
agugcagccgagaucaggugcu

SEQ ID NO: 968560 - RNA, 21 nt, Human
gcagagccugagguucuugag

SEQ ID NO: 968561 - RNA, 22 nt, Human
ggaggccaugaggcucuaggug

SEQ ID NO: 968562 - RNA, 22 nt, Human
gcaggagcucguuuccaggcug

SEQ ID NO: 968563 - RNA, 22 nt, Human
uggcucuguuuuaugaguacca

SEQ ID NO: 968564 - RNA, 22 nt, Human
ucagagaggcaauacuguuuaa

SEQ ID NO: 968565 - RNA, 22 nt, Human
ugauuuccugugcgcccuuagg

SEQ ID NO: 968566 - RNA, 22 nt, Human
gcugcuucucugauggagucca

SEQ ID NO: 968567 - RNA, 22 nt, Human
uuccaggagacuuccagaaaua

SEQ ID NO: 968568 - RNA, 22 nt, Human
ucaugcccagagcaguaaauua

SEQ ID NO: 968569 - RNA, 22 nt, Human
gcugaguguaaugauggcagag

SEQ ID NO: 968570 - RNA, 22 nt, Human
ugcauuguuuagaacucuuugg

SEQ ID NO: 968571 - RNA, 22 nt, Human
agccucuggcccuagacugcuu

SEQ ID NO: 968572 - RNA, 22 nt, Human
ggaggggagucucccaaagccg

SEQ ID NO: 968573 - RNA, 22 nt, Human
aggccuagaggaauggccaggg

SEQ ID NO: 968574 - RNA, 22 nt, Human
aggcugggcuccgcccaacucc

SEQ ID NO: 968575 - RNA, 22 nt, Human
aggaagcucaaagccaugaugu

SEQ ID NO: 968576 - RNA, 22 nt, Human
ccugcugugaccggggagcagg

SEQ ID NO: 968577 - RNA, 22 nt, Human
cugcugggcagaggcugcauga

SEQ ID NO: 968578 - RNA, 21 nt, Human
aaguuuguucuuguauagucu

SEQ ID NO: 968579 - RNA, 22 nt, Human
guugcacaguuccucaagcagg

SEQ ID NO: 968580 - RNA, 22 nt, Human
caggaacagcaccaggagcuag

SEQ ID NO: 968581 - RNA, 22 nt, Human
gcucagaggaugcuccuuuaug

SEQ ID NO: 968582 - RNA, 22 nt, Human
cuuuccuagauggccaucuuuc

SEQ ID NO: 968583 - RNA, 17 nt, Human
caagagagaugacugga

SEQ ID NO: 968584 - RNA, 22 nt, Human
aagagcuggcucuugcagcagc

SEQ ID NO: 968585 - RNA, 22 nt, Human
gggcacugcuggaggcucccug

SEQ ID NO: 968586 - RNA, 17 nt, Human
augugucuagugcaacc

SEQ ID NO: 968587 - RNA, 21 nt, Human
ugaggcuguuguaccagggag

SEQ ID NO: 968588 - RNA, 22 nt, Human
agugcauuauauguuucaaugg

SEQ ID NO: 968589 - RNA, 22 nt, Human
caggggcuagcacuuaauguuu

SEQ ID NO: 968590 - RNA, 22 nt, Human
cauggcagcaauuuuccugacu

SEQ ID NO: 968591 - RNA, 22 nt, Human
cuuccaaacccaggguaugggc

SEQ ID NO: 968592 - RNA, 22 nt, Human
aggcugcugaggccaccacgcu

SEQ ID NO: 968593 - RNA, 22 nt, Human
uggagcugaacuuugaggccag

SEQ ID NO: 968594 - RNA, 19 nt, Human
ggcaggcuggauagagagg

SEQ ID NO: 968595 - RNA, 22 nt, Human
uccagucuucuugcagcuacau

SEQ ID NO: 968596 - RNA, 22 nt, Human
uugauagguuuuauguauaguu

SEQ ID NO: 968597 - RNA, 22 nt, Human
auccugggaagcugacauugaa

SEQ ID NO: 968598 - RNA, 22 nt, Human
uuucaugugcaauuagcaauau

SEQ ID NO: 968599 - RNA, 22 nt, Human
cugggagacaagagagggcuga

SEQ ID NO: 968600 - RNA, 19 nt, Human
cagcucaguuugauucucu

SEQ ID NO: 968601 - RNA, 22 nt, Human
aauguguguauuucuaggcgag

SEQ ID NO: 968602 - RNA, 22 nt, Human
gagaagccgagucagcugagcc

SEQ ID NO: 968603 - RNA, 22 nt, Human
aguuuucacacucaccaaaagg

SEQ ID NO: 968604 - RNA, 21 nt, Human
gggccuggcugcgcaggacgg

SEQ ID NO: 968605 - RNA, 23 nt, Human
cccuguagcccaggacaggcuuu

SEQ ID NO: 968606 - RNA, 22 nt, Human
ccuugcaggggaacaggcagug

SEQ ID NO: 968607 - RNA, 22 nt, Human
agccacaccuguccugccagcu

SEQ ID NO: 968608 - RNA, 22 nt, Human
ccuccaaguuugacucaggaca

SEQ ID NO: 968609 - RNA, 22 nt, Human
cuggagccggaccagggacggu

SEQ ID NO: 968610 - RNA, 22 nt, Human
ccacagcaugcaggccugacac

SEQ ID NO: 968611 - RNA, 20 nt, Human
uugagcuuuuaguacagaca

SEQ ID NO: 968612 - RNA, 22 nt, Human
aacugcauuuaacaaauacucu

SEQ ID NO: 968613 - RNA, 21 nt, Human
cccaggaggcugagaagagca

SEQ ID NO: 968614 - RNA, 22 nt, Human
caguggcaugguugacugcagu

SEQ ID NO: 968615 - RNA, 22 nt, Human
ccugucacgaugacugcacucu

SEQ ID NO: 968616 - RNA, 22 nt, Human
cccuugcaucccauguguggcc

SEQ ID NO: 968617 - RNA, 22 nt, Human
acugucuccucaucaugccugg

SEQ ID NO: 968618 - RNA, 22 nt, Human
gaggccugguuugcaugagaau

SEQ ID NO: 968619 - RNA, 22 nt, Human
gcaggcaggcuuccuugaacug

SEQ ID NO: 968620 - RNA, 22 nt, Human
ccuccuggaggcucuaagggag

SEQ ID NO: 968621 - RNA, 22 nt, Human
ugaagggggagauauaugugug

SEQ ID NO: 968622 - RNA, 22 nt, Human
guuuucuuugaaugcuucuaga

SEQ ID NO: 968623 - RNA, 22 nt, Human
aguguguccagaaaucuguauu

SEQ ID NO: 968624 - RNA, 22 nt, Human
uggcagcucauuuggaaaugga

SEQ ID NO: 968625 - RNA, 22 nt, Human
cagggcacaguuauggaggugg

SEQ ID NO: 968626 - RNA, 22 nt, Human
cagaagcaaaugccuugcugag

SEQ ID NO: 968627 - RNA, 22 nt, Human
aggcugcuucaauggauaagau

SEQ ID NO: 968628 - RNA, 22 nt, Human
acacagggauauuucagguggu

SEQ ID NO: 968629 - RNA, 22 nt, Human
uuuagaaauucaucuauggccu

SEQ ID NO: 968630 - RNA, 22 nt, Human
ggcuccuggcaucuggugggua

SEQ ID NO: 968631 - RNA, 22 nt, Human
acaggcugacuuccugccaugu

SEQ ID NO: 968632 - RNA, 20 nt, Human
accaauguuagcuuaguacu

SEQ ID NO: 968633 - RNA, 22 nt, Human
cucaggaaaggccaugcaaggg

SEQ ID NO: 968634 - RNA, 22 nt, Human
ggagcuguugcgcaugcgcucg

SEQ ID NO: 968635 - RNA, 20 nt, Human
gaugggaaucggagcuggua

SEQ ID NO: 968636 - RNA, 22 nt, Human
aguuuauguaaaauuaguaaug

SEQ ID NO: 968637 - RNA, 22 nt, Human
ucuuuacaaucuaagcauaguu

SEQ ID NO: 968638 - RNA, 22 nt, Human
uuaacaauagaguuucuucagg

SEQ ID NO: 968639 - RNA, 22 nt, Human
uucuggagcuaaaguccacucu

SEQ ID NO: 968640 - RNA, 23 nt, Human
uccuccuuuugcuugugcuuccc

SEQ ID NO: 968641 - RNA, 22 nt, Human
ucuccuuuaagauuuccucagg

SEQ ID NO: 968642 - RNA, 22 nt, Human
ccagcugggauuaagggaaaau

SEQ ID NO: 968643 - RNA, 22 nt, Human
ucagucucuggggcuucuguuu

SEQ ID NO: 968644 - RNA, 22 nt, Human
cugcuuugauuagaagaguaca

SEQ ID NO: 968645 - RNA, 22 nt, Human
aggagcagcuucugaaccaugu

SEQ ID NO: 968646 - RNA, 22 nt, Human
aggagccaggaaaccugcucug

SEQ ID NO: 968647 - RNA, 22 nt, Human
cagcaauaagccagguuagaca

SEQ ID NO: 968648 - RNA, 22 nt, Human
cacuccuguuccacuaaaugag

SEQ ID NO: 968649 - RNA, 22 nt, Human
uccucaggaugugggguagaau

SEQ ID NO: 968650 - RNA, 22 nt, Human
agcuguccuggcucaggcugug

SEQ ID NO: 968651 - RNA, 22 nt, Human
acacaugagaaacaucaguugu

SEQ ID NO: 968652 - RNA, 22 nt, Human
ggccaaauuuggccaugagcau

SEQ ID NO: 968653 - RNA, 22 nt, Human
gagcuggcuccgccaugcugcu

SEQ ID NO: 968654 - RNA, 22 nt, Human
acuuucucccacccacccgucu

SEQ ID NO: 968655 - RNA, 22 nt, Human
agaccaagacuauaaugagagg

SEQ ID NO: 968656 - RNA, 22 nt, Human
gaaaugcagauucugauucugu

SEQ ID NO: 968657 - RNA, 22 nt, Human
aggcugggcaccguuuugaucc

SEQ ID NO: 968658 - RNA, 22 nt, Human
cuccagggagcuuggaaagacc

SEQ ID NO: 968659 - RNA, 22 nt, Human
ucaucucaaaacccaaggggca

SEQ ID NO: 968660 - RNA, 22 nt, Human
gagggaggggagcuccacccuc

SEQ ID NO: 968661 - RNA, 22 nt, Human
aauguuguuuuucugcaugucu

SEQ ID NO: 968662 - RNA, 22 nt, Human
acuggcagaggauagcacuaau

SEQ ID NO: 968663 - RNA, 22 nt, Human
uccugagcugccgcaucagcag

SEQ ID NO: 968664 - RNA, 22 nt, Human
ccagguggugaaagugggcccu

SEQ ID NO: 968665 - RNA, 22 nt, Human
aggugagugugacugcaagaga

SEQ ID NO: 968666 - RNA, 22 nt, Human
aaacauugcuaaauaaugcugc

SEQ ID NO: 968667 - RNA, 22 nt, Human
ugaugguugauuauaaaucagu

SEQ ID NO: 968668 - RNA, 22 nt, Human
ccuuuccuuuuuagugugggag

SEQ ID NO: 968669 - RNA, 22 nt, Human
aaggcccuggccccagcuucuu

SEQ ID NO: 968670 - RNA, 22 nt, Human
gaggaaccaaaucagcuugcac

SEQ ID NO: 968671 - RNA, 22 nt, Human
aagcagaauuucccacuaguug

SEQ ID NO: 968672 - RNA, 22 nt, Human
uggugcugauaauggcaggauu

SEQ ID NO: 968673 - RNA, 22 nt, Human
agccacagucaaccuguccaua

SEQ ID NO: 968674 - RNA, 22 nt, Human
agggcacaagacucugagcccc

SEQ ID NO: 968675 - RNA, 22 nt, Human
aaaugcaucagcucauaagaga

SEQ ID NO: 968676 - RNA, 22 nt, Human
ucagccucucugaguccagacc

SEQ ID NO: 968677 - RNA, 20 nt, Human
cccucugcacauggcugugg

SEQ ID NO: 968678 - RNA, 22 nt, Human
ucugagggcuugaggggaagua

SEQ ID NO: 968679 - RNA, 23 nt, Human
ccagcucccaggucugaggacug

SEQ ID NO: 968680 - RNA, 22 nt, Human
acaugcauacaagcacauguag

SEQ ID NO: 968681 - RNA, 22 nt, Human
ugccagcaguagcaguaggcca

SEQ ID NO: 968682 - RNA, 22 nt, Human
uaaugaugugugcaaacugaau

SEQ ID NO: 968683 - RNA, 22 nt, Human
ccucuccuugcacccgucccgc

SEQ ID NO: 968684 - RNA, 20 nt, Human
ucauccaggacaggaguggc

SEQ ID NO: 968685 - RNA, 22 nt, Human
ggugagggaguggaacgaggug

SEQ ID NO: 968686 - RNA, 20 nt, Human
gggcuggcgcauggggaaag

SEQ ID NO: 968687 - RNA, 19 nt, Human
ugcauccaaagccccacca

SEQ ID NO: 968688 - RNA, 22 nt, Human
gacaggaggcagagcucaggug

SEQ ID NO: 968689 - RNA, 22 nt, Human
gcugucaggaacaugccuuggu

SEQ ID NO: 968690 - RNA, 21 nt, Human
cugugcuucuuccuaagccag

SEQ ID NO: 968691 - RNA, 22 nt, Human
ucugcucuaguugcuuccugcc

SEQ ID NO: 968692 - RNA, 22 nt, Human
cagggugacugcccuggccacu

SEQ ID NO: 968693 - RNA, 23 nt, Human
ucagagaaguuguaggcugggga

SEQ ID NO: 968694 - RNA, 22 nt, Human
agguggguccuggcucugccau

SEQ ID NO: 968695 - RNA, 22 nt, Human
aucauaaagugcuaucugauug

SEQ ID NO: 968696 - RNA, 22 nt, Human
cccagcuugcccaggacugagg

SEQ ID NO: 968697 - RNA, 22 nt, Human
uggccaggggaguuccccucca

SEQ ID NO: 968698 - RNA, 22 nt, Human
acaggcuuuuuuagaaugacau

SEQ ID NO: 968699 - RNA, 19 nt, Human
acaaaugauguugcacuga

SEQ ID NO: 968700 - RNA, 22 nt, Human
uucauugugauucuuggcuagc

SEQ ID NO: 968701 - RNA, 22 nt, Human
cucucugcuguauccuuaggcu

SEQ ID NO: 968702 - RNA, 22 nt, Human
auguuuaaaggagucagagacu

SEQ ID NO: 968703 - RNA, 22 nt, Human
ugcagcagacugaguaugagaa

SEQ ID NO: 968704 - RNA, 22 nt, Human
caggcagccuucucgucucaca

SEQ ID NO: 968705 - RNA, 22 nt, Human
uccucagaaaccccugugaggu

SEQ ID NO: 968706 - RNA, 22 nt, Human
cauucuaucuuggacuggaucu

SEQ ID NO: 968707 - RNA, 22 nt, Human
cagcaucaccgccauuucugau

SEQ ID NO: 968708 - RNA, 22 nt, Human
caggccuccacuccacgcagac

SEQ ID NO: 968709 - RNA, 22 nt, Human
aacuaacagucauuaaaagaac

SEQ ID NO: 968710 - RNA, 22 nt, Human
ucugaaaugcaaauuugacuga

SEQ ID NO: 968711 - RNA, 22 nt, Human
auacauacguacauacguaugu

SEQ ID NO: 968712 - RNA, 22 nt, Human
acauuucucagguaagucauuu

SEQ ID NO: 968713 - RNA, 22 nt, Human
agccagccaguucacuaggaaa

SEQ ID NO: 968714 - RNA, 22 nt, Human
gagcuggugaucagcuggagga

SEQ ID NO: 968715 - RNA, 22 nt, Human
auccugggcagugugucacucu

SEQ ID NO: 968716 - RNA, 22 nt, Human
auugucuguacuuuaaaaaugu

SEQ ID NO: 968717 - RNA, 22 nt, Human
gcucacugcaaccucugcuucc

SEQ ID NO: 968718 - RNA, 22 nt, Human
gcuggcuuugcacugggugcau

SEQ ID NO: 968719 - RNA, 22 nt, Human
cugggagcuagcucugagcuga

SEQ ID NO: 968720 - RNA, 22 nt, Human
ugcauuccauguguuuccugag

SEQ ID NO: 968721 - RNA, 22 nt, Human
ccaggcauccauugcuuccucu

SEQ ID NO: 968722 - RNA, 22 nt, Human
guucagggagggacagaugaag

SEQ ID NO: 968723 - RNA, 17 nt, Human
gcuggcugacccaugcc

SEQ ID NO: 968724 - RNA, 22 nt, Human
uggcagagcuggcugcggauga

SEQ ID NO: 968725 - RNA, 22 nt, Human
uauaucauggagauuaacauuc

SEQ ID NO: 968726 - RNA, 22 nt, Human
ggccugcugacccaaguccugu

SEQ ID NO: 968727 - RNA, 19 nt, Human
accaggaguaucagagcug

SEQ ID NO: 968728 - RNA, 22 nt, Human
caucugcugcugaagccagcau

SEQ ID NO: 968729 - RNA, 20 nt, Human
uguugauuggugucaucuca

SEQ ID NO: 968730 - RNA, 22 nt, Human
aucugccuggcuccaggugagc

SEQ ID NO: 968731 - RNA, 22 nt, Human
cuuuauguccuugaagaguugu

SEQ ID NO: 968732 - RNA, 22 nt, Human
agagggcccauguugggcugcu

SEQ ID NO: 968733 - RNA, 22 nt, Human
gagcugccuacauugccaagag

SEQ ID NO: 968734 - RNA, 22 nt, Human
ccagcuccgggaguugcugcug

SEQ ID NO: 968735 - RNA, 17 nt, Human
cccacggaggugugaaa

SEQ ID NO: 968736 - RNA, 22 nt, Human
aggcaguggagcuggaauaggc

SEQ ID NO: 968737 - RNA, 22 nt, Human
ccugccugcaccuucucugggg

SEQ ID NO: 968738 - RNA, 22 nt, Human
caggccugugacaccgugucug

SEQ ID NO: 968739 - RNA, 22 nt, Human
aaggugucacugggacaggaaa

SEQ ID NO: 968740 - RNA, 22 nt, Human
uuucccagagguaugaauaagu

SEQ ID NO: 968741 - RNA, 22 nt, Human
ccaggacaaguguggccauggc

SEQ ID NO: 968742 - RNA, 21 nt, Human
uugaagcaaggguggcucuga

SEQ ID NO: 968743 - RNA, 22 nt, Human
cagggugccuguccucagcaaa

SEQ ID NO: 968744 - RNA, 22 nt, Human
uccaagggcaacaauggaacac

SEQ ID NO: 968745 - RNA, 22 nt, Human
ggaaccaggaguuacacgaguu

SEQ ID NO: 968746 - RNA, 22 nt, Human
cuggggcugcagcgaucuucau

SEQ ID NO: 968747 - RNA, 22 nt, Human
acagagccuccaggagugcugg

SEQ ID NO: 968748 - RNA, 18 nt, Human
ccuggcuuccaucuuggu

SEQ ID NO: 968749 - RNA, 19 nt, Human
acagaaauuaguuauuuuc

SEQ ID NO: 968750 - RNA, 22 nt, Human
ugccaggauggccagggggcca

SEQ ID NO: 968751 - RNA, 22 nt, Human
uccaggagacacccuugugugu

SEQ ID NO: 968752 - RNA, 22 nt, Human
aauuucaaacuaauaggaacca

SEQ ID NO: 968753 - RNA, 22 nt, Human
aagccgggccugagaaaugaca

SEQ ID NO: 968754 - RNA, 22 nt, Human
uuucaaauaccauaaaccuaau

SEQ ID NO: 968755 - RNA, 22 nt, Human
ugaggugaccgcagaugggaag

SEQ ID NO: 968756 - RNA, 22 nt, Human
cugaaggacacgugaggagcca

SEQ ID NO: 968757 - RNA, 22 nt, Human
gccuguccacuaaacagccaag

SEQ ID NO: 968758 - RNA, 22 nt, Human
uaaggccaaacuauuauaguuc

SEQ ID NO: 968759 - RNA, 22 nt, Human
ugcaggugugguuccucagcca

SEQ ID NO: 968760 - RNA, 22 nt, Human
ucuuugcacugugcaagcagaa

SEQ ID NO: 968761 - RNA, 22 nt, Human
cuuggcagauccaaaaaugaca

SEQ ID NO: 968762 - RNA, 21 nt, Human
gccauuguuuucuaccuggag

SEQ ID NO: 968763 - RNA, 22 nt, Human
acuuugcagggcuugauaucca

SEQ ID NO: 968764 - RNA, 22 nt, Human
caggugggagcggagacugauu

SEQ ID NO: 968765 - RNA, 22 nt, Human
auggccaagcauauacagauug

SEQ ID NO: 968766 - RNA, 22 nt, Human
aagaaauuaaggaaugcaacga

SEQ ID NO: 968767 - RNA, 22 nt, Human
agagcuggauggucaagauggc

SEQ ID NO: 968768 - RNA, 22 nt, Human
agucucagggccacccggggaa

SEQ ID NO: 968769 - RNA, 22 nt, Human
ggcagcuggguuggccagaaac

SEQ ID NO: 968770 - RNA, 22 nt, Human
caaaugcauagaaagaugaaac

SEQ ID NO: 968771 - RNA, 22 nt, Human
acuuuuuacaggguguauacca

SEQ ID NO: 968772 - RNA, 22 nt, Human
aagaacagguucuagaaccauu

SEQ ID NO: 968773 - RNA, 22 nt, Human
gcucugggaacugacugccuuc

SEQ ID NO: 968774 - RNA, 22 nt, Human
gugccugccccacuccucagca

SEQ ID NO: 968775 - RNA, 22 nt, Human
uuucucugaggcuggccucccu

SEQ ID NO: 968776 - RNA, 22 nt, Human
cucagggcuugaguguccagga

SEQ ID NO: 968777 - RNA, 21 nt, Human
agguggggcugcaccucugcu

SEQ ID NO: 968778 - RNA, 22 nt, Human
gagcagagacaguacaacuggc

SEQ ID NO: 968779 - RNA, 22 nt, Human
uugcugugucugauggcugaga

SEQ ID NO: 968780 - RNA, 21 nt, Human
auucugaguugucagucuuca

SEQ ID NO: 968781 - RNA, 22 nt, Human
gcagcugaauguccauugcugc

SEQ ID NO: 968782 - RNA, 22 nt, Human
uucaggauccccaccgcguuua

SEQ ID NO: 968783 - RNA, 22 nt, Human
uauauuaacacccacuugccuc

SEQ ID NO: 968784 - RNA, 22 nt, Human
gcauccagucuuggcuccugga

SEQ ID NO: 968785 - RNA, 22 nt, Human
aggcagacaaggucccuggucu

SEQ ID NO: 968786 - RNA, 22 nt, Human
ccuguucaauauucuuccuugu

SEQ ID NO: 968787 - RNA, 22 nt, Human
cauuugaaugagauugcuguaa

SEQ ID NO: 968788 - RNA, 22 nt, Human
aaguuacaggagaaagagauca

SEQ ID NO: 968789 - RNA, 22 nt, Human
ggaggugguggcagugacaauu

SEQ ID NO: 968790 - RNA, 22 nt, Human
aaauacaguguguguucuuuga

SEQ ID NO: 968791 - RNA, 22 nt, Human
ggcagcugcaaaucugcucugu

SEQ ID NO: 968792 - RNA, 22 nt, Human
gcccagcugucuggcagggaug

SEQ ID NO: 968793 - RNA, 22 nt, Human
uggcagcucuguucaacaugag

SEQ ID NO: 968794 - RNA, 20 nt, Human
ugggagcuggugaggucuca

SEQ ID NO: 968795 - RNA, 22 nt, Human
gaggcagcaaaauauaucauaa

SEQ ID NO: 968796 - RNA, 22 nt, Human
acagugacguuuauuugagacg

SEQ ID NO: 968797 - RNA, 22 nt, Human
ccagccagccuugaucugagua

SEQ ID NO: 968798 - RNA, 22 nt, Human
cacaggagguuaggaagugguc

SEQ ID NO: 968799 - RNA, 22 nt, Human
aggcaguuuauccccagagccu

SEQ ID NO: 968800 - RNA, 22 nt, Human
ugggcuacucugggagccuaac

SEQ ID NO: 968801 - RNA, 22 nt, Human
caguuuaaccuauccauuaugu

SEQ ID NO: 968802 - RNA, 22 nt, Human
uugacagcuauuuugcuuugau

SEQ ID NO: 968803 - RNA, 22 nt, Human
uuggccuuguuaaggaggcccu

SEQ ID NO: 968804 - RNA, 22 nt, Human
cauuugaaauucuuagaacaaa

SEQ ID NO: 968805 - RNA, 22 nt, Human
augugucucuaaaauuuaguaa

SEQ ID NO: 968806 - RNA, 22 nt, Human
cuguagccaguuuggccucacc

SEQ ID NO: 968807 - RNA, 22 nt, Human
uggcccugcacccagagcaguu

SEQ ID NO: 968808 - RNA, 22 nt, Human
gugauuuucuccuccuagaagu

SEQ ID NO: 968809 - RNA, 22 nt, Human
guggccaauuuccaucuguaag

SEQ ID NO: 968810 - RNA, 22 nt, Human
cagggagcacugcgagcggcag

SEQ ID NO: 968811 - RNA, 22 nt, Human
ugaggcaggacugagcgggaug

SEQ ID NO: 968812 - RNA, 22 nt, Human
ggaggggagauguuugggcuca

SEQ ID NO: 968813 - RNA, 22 nt, Human
uucaugaaaguguaucuugugg

SEQ ID NO: 968814 - RNA, 22 nt, Human
cccagcagaccgcugugauggc

SEQ ID NO: 968815 - RNA, 22 nt, Human
ucugggagagcacguggcugac

SEQ ID NO: 968816 - RNA, 22 nt, Human
caaugauggcuaggcagcugcu

SEQ ID NO: 968817 - RNA, 22 nt, Human
caaugugucaggaaaagggcca

SEQ ID NO: 968818 - RNA, 20 nt, Human
uccaagggcagcagaaucag

SEQ ID NO: 968819 - RNA, 22 nt, Human
cgaggcaggcaggcggaggaua

SEQ ID NO: 968820 - RNA, 22 nt, Human
gccugggagagggauagugcag

SEQ ID NO: 968821 - RNA, 22 nt, Human
ccucaggggucacugugaggag

SEQ ID NO: 968822 - RNA, 22 nt, Human
uggccugggugcugcugacauc

SEQ ID NO: 968823 - RNA, 22 nt, Human
gaaauauuacaguggaggggau

SEQ ID NO: 968824 - RNA, 22 nt, Human
gcagcuggucuggccuagagua

SEQ ID NO: 968825 - RNA, 22 nt, Human
agcucccagucuccucuccaug

SEQ ID NO: 968826 - RNA, 16 nt, Human
ccccaggacuuggcac

SEQ ID NO: 968827 - RNA, 22 nt, Human
uugaagcaaauucugugcagua

SEQ ID NO: 968828 - RNA, 22 nt, Human
uacucugccccagccaauaaug

SEQ ID NO: 968829 - RNA, 22 nt, Human
cugucugcuagaacaucuauac

SEQ ID NO: 968830 - RNA, 22 nt, Human
gcuugggagaggguccccagga

SEQ ID NO: 968831 - RNA, 22 nt, Human
ugccugcucuuaccacucuccc

SEQ ID NO: 968832 - RNA, 22 nt, Human
ggcucagaccucccagcuccag

SEQ ID NO: 968833 - RNA, 22 nt, Human
uuguaacaggcacucugugcca

SEQ ID NO: 968834 - RNA, 22 nt, Human
guggcagcaaaugccuggacua

SEQ ID NO: 968835 - RNA, 22 nt, Human
uggacucaaguccaaguucacg

SEQ ID NO: 968836 - RNA, 22 nt, Human
cacauuucucuaccucacacaa

SEQ ID NO: 968837 - RNA, 22 nt, Human
acucagaaccauuuacucugag

SEQ ID NO: 968838 - RNA, 17 nt, Human
cugucugcgcaugaggu

SEQ ID NO: 968839 - RNA, 19 nt, Human
ccagcagacacagcugccc

SEQ ID NO: 968840 - RNA, 22 nt, Human
gcagggugauagugaggcucag

SEQ ID NO: 968841 - RNA, 22 nt, Human
accugccuaguugguucugccc

SEQ ID NO: 968842 - RNA, 22 nt, Human
aggcagagaaaaaccagauaug

SEQ ID NO: 968843 - RNA, 22 nt, Human
aggcccugcauuguacugaggg

SEQ ID NO: 968844 - RNA, 22 nt, Human
ucccuguccugggcaaucccag

SEQ ID NO: 968845 - RNA, 22 nt, Human
aucagcaaguccuguuaauucu

SEQ ID NO: 968846 - RNA, 22 nt, Human
cuuguucaguccugacuuccug

SEQ ID NO: 968847 - RNA, 22 nt, Human
aucuggcuuggguguggguagc

SEQ ID NO: 968848 - RNA, 22 nt, Human
caggcaccccaggugagcacug

SEQ ID NO: 968849 - RNA, 22 nt, Human
aggggaggagcuuuucuugccu

SEQ ID NO: 968850 - RNA, 22 nt, Human
ggcugccuugacccuggcuccg

SEQ ID NO: 968851 - RNA, 22 nt, Human
ucacaacucuuuccauuuaaua

SEQ ID NO: 968852 - RNA, 22 nt, Human
gccugccuuuuggaggcacauu

SEQ ID NO: 968853 - RNA, 22 nt, Human
aggcuccuuguucaucauccau

SEQ ID NO: 968854 - RNA, 21 nt, Human
cugcaucucauagaacauguc

SEQ ID NO: 968855 - RNA, 21 nt, Human
cucaggcauuugaggagaguc

SEQ ID NO: 968856 - RNA, 22 nt, Human
cggcagagcuuccugcucagcg

SEQ ID NO: 968857 - RNA, 22 nt, Human
agccccugggaguagcugcugc

SEQ ID NO: 968858 - RNA, 22 nt, Human
acagaauucucucugcagaggc

SEQ ID NO: 968859 - RNA, 22 nt, Human
cagguggaucucuaaggacuga

SEQ ID NO: 968860 - RNA, 22 nt, Human
uagaaauguugguauuaacauu

SEQ ID NO: 968861 - RNA, 22 nt, Human
ucaguuuuucuauacuuuguag

SEQ ID NO: 968862 - RNA, 18 nt, Human
cuuguucuucucuuggcg

SEQ ID NO: 968863 - RNA, 22 nt, Human
cuggcacaaugucacuuuugcu

SEQ ID NO: 968864 - RNA, 22 nt, Human
auggccaacugaaaugaaagau

SEQ ID NO: 968865 - RNA, 22 nt, Human
cuuggccucuucucaggguggg

SEQ ID NO: 968866 - RNA, 22 nt, Human
aguucuuuugugaacauaugcu

SEQ ID NO: 968867 - RNA, 22 nt, Human
ugaaaucuuagccauucugccu

SEQ ID NO: 968868 - RNA, 21 nt, Human
aggcagcaggauccagggaca

SEQ ID NO: 968869 - RNA, 22 nt, Human
aaguauuucguucugaaaaagu

SEQ ID NO: 968870 - RNA, 20 nt, Human
aagcacauuucuacaauaau

SEQ ID NO: 968871 - RNA, 22 nt, Human
accaggagaggcacuugcaaug

SEQ ID NO: 968872 - RNA, 22 nt, Human
gucucagauucagacaucuaca

SEQ ID NO: 968873 - RNA, 18 nt, Human
uccuccuuuggccuuuuc

SEQ ID NO: 968874 - RNA, 22 nt, Human
ccuggccauagggcccaggaaa

SEQ ID NO: 968875 - RNA, 22 nt, Human
gggagggaaagcuugaucuguc

SEQ ID NO: 968876 - RNA, 22 nt, Human
uacacauguuuggcaaguaugu

SEQ ID NO: 968877 - RNA, 17 nt, Human
ggaaaaggaugauacag

SEQ ID NO: 968878 - RNA, 22 nt, Human
aaaauaucagcaaagggugaca

SEQ ID NO: 968879 - RNA, 18 nt, Human
cccagcuccacuucccuc

SEQ ID NO: 968880 - RNA, 22 nt, Human
uggcucaguuuagcagcucagu

SEQ ID NO: 968881 - RNA, 22 nt, Human
uaagcauucaaugcuuagcacu

SEQ ID NO: 968882 - RNA, 20 nt, Human
uauauaggaaauauuguguu

SEQ ID NO: 968883 - RNA, 22 nt, Human
uccaggagggggagccgugccg

SEQ ID NO: 968884 - RNA, 22 nt, Human
uaaaaguaggaaugaaacgcau

SEQ ID NO: 968885 - RNA, 22 nt, Human
aggguagggcccggagacagac

SEQ ID NO: 968886 - RNA, 22 nt, Human
accucccagcucugagcuuggg

SEQ ID NO: 968887 - RNA, 22 nt, Human
acagaaugcguagugcauguug

SEQ ID NO: 968888 - RNA, 17 nt, Human
gcugccaccuuuggagc

SEQ ID NO: 968889 - RNA, 22 nt, Human
aggcauguauaugugcacaugu

SEQ ID NO: 968890 - RNA, 22 nt, Human
aggcugaggcagguggaucauu

SEQ ID NO: 968891 - RNA, 21 nt, Human
gcagggacaaagcuucaggag

SEQ ID NO: 968892 - RNA, 20 nt, Human
acagaaagagagaaugucag

SEQ ID NO: 968893 - RNA, 21 nt, Human
aaacugaccuugccugagaca

SEQ ID NO: 968894 - RNA, 22 nt, Human
ggaaccaguggaaugauaugcu

SEQ ID NO: 968895 - RNA, 21 nt, Human
gcagccagacgggauucaguu

SEQ ID NO: 968896 - RNA, 22 nt, Human
uauuuaauaaaacuauggcaug

SEQ ID NO: 968897 - RNA, 22 nt, Human
gggacaggcugagacuugagcu

SEQ ID NO: 968898 - RNA, 22 nt, Human
ucauacauaacuuguacaguga

SEQ ID NO: 968899 - RNA, 22 nt, Human
gugcgccagcucaaggggaggc

SEQ ID NO: 968900 - RNA, 22 nt, Human
ucugcagcuucuugccagagag

SEQ ID NO: 968901 - RNA, 17 nt, Human
agcagcugaagcagcca

SEQ ID NO: 968902 - RNA, 18 nt, Human
gagaggcccggcugugcc

SEQ ID NO: 968903 - RNA, 22 nt, Human
caucagcagucacaugaugcug

SEQ ID NO: 968904 - RNA, 22 nt, Human
ugcaguggcgccaucucagcuc

SEQ ID NO: 968905 - RNA, 22 nt, Human
cucugugccagucugcacucgg

SEQ ID NO: 968906 - RNA, 22 nt, Human
aaggcugaggagggccugcagg

SEQ ID NO: 968907 - RNA, 22 nt, Human
aaguucaaucagaugaaaaagc

SEQ ID NO: 968908 - RNA, 22 nt, Human
agggcuggcaagggauugaaau

SEQ ID NO: 968909 - RNA, 22 nt, Human
acccaggagcucugggguccuc

SEQ ID NO: 968910 - RNA, 22 nt, Human
ugaggaggucagagucuggcug

SEQ ID NO: 968911 - RNA, 22 nt, Human
ccaggccucuggcugcuuaguc

SEQ ID NO: 968912 - RNA, 22 nt, Human
caaaugugguuucucagcauuc

SEQ ID NO: 968913 - RNA, 22 nt, Human
cuugaacucaaugugaggaaga

SEQ ID NO: 968914 - RNA, 22 nt, Human
uuggcaguagugguaguacauu

SEQ ID NO: 968915 - RNA, 22 nt, Human
uuuuauauugagugagaguucc

SEQ ID NO: 968916 - RNA, 22 nt, Human
uauuucaacguaugaaaagcug

SEQ ID NO: 968917 - RNA, 18 nt, Human
uguuccaaggaaggaauc

SEQ ID NO: 968918 - RNA, 22 nt, Human
cugcaggcugagcgccugccgg

SEQ ID NO: 968919 - RNA, 17 nt, Human
gucugggcuuuagagac

SEQ ID NO: 968920 - RNA, 22 nt, Human
ugcagcugcuggcccaggugcu

SEQ ID NO: 968921 - RNA, 22 nt, Human
gcugugggugcuggcuccaccc

SEQ ID NO: 968922 - RNA, 22 nt, Human
ucacaugaguauuauuuuccaa

SEQ ID NO: 968923 - RNA, 22 nt, Human
cacugaagccacuggaagagga

SEQ ID NO: 968924 - RNA, 22 nt, Human
auugaaaguccuaucuaaggga

SEQ ID NO: 968925 - RNA, 23 nt, Human
cagguggcuccacgagggguggg

SEQ ID NO: 968926 - RNA, 22 nt, Human
gaggccagggaugcaaugagag

SEQ ID NO: 968927 - RNA, 18 nt, Human
uccauuguucuacuguga

SEQ ID NO: 968928 - RNA, 22 nt, Human
uaaauguauaggcacuaaaccu

SEQ ID NO: 968929 - RNA, 22 nt, Human
gcuucucuggccugcagggcau

SEQ ID NO: 968930 - RNA, 22 nt, Human
aaaucagucccucuuggaauuu

SEQ ID NO: 968931 - RNA, 22 nt, Human
gcccagugguaaaagcaggccu

SEQ ID NO: 968932 - RNA, 22 nt, Human
cagcaugguuggguucugggga

SEQ ID NO: 968933 - RNA, 22 nt, Human
uuccagggcuaauuccugugga

SEQ ID NO: 968934 - RNA, 22 nt, Human
cugcagccucaaccuccugagc

SEQ ID NO: 968935 - RNA, 22 nt, Human
ugcucacagcccagaacauaau

SEQ ID NO: 968936 - RNA, 22 nt, Human
auuguuuuauuaaaugagcccu

SEQ ID NO: 968937 - RNA, 22 nt, Human
aacacauaggcagagcaugaca

SEQ ID NO: 968938 - RNA, 18 nt, Human
cccggcuaauuuuuggua

SEQ ID NO: 968939 - RNA, 17 nt, Human
uuugaaaggaugucagu

SEQ ID NO: 968940 - RNA, 22 nt, Human
ugccucuguggaaauggugguc

SEQ ID NO: 968941 - RNA, 22 nt, Human
ugcucugguccucccucggcgc

SEQ ID NO: 968942 - RNA, 19 nt, Human
ucaaagucugagucacuuu

SEQ ID NO: 968943 - RNA, 22 nt, Human
gccagagcugagugagguucuu

SEQ ID NO: 968944 - RNA, 22 nt, Human
aaguuuaagguggaaguggugg

SEQ ID NO: 968945 - RNA, 22 nt, Human
caguguccucagccagcagcua

SEQ ID NO: 968946 - RNA, 22 nt, Human
gcuguccucugaucucuggagg

SEQ ID NO: 968947 - RNA, 22 nt, Human
ucuaaaaaagucuguucacuug

SEQ ID NO: 968948 - RNA, 22 nt, Human
guggccaaacaccaguuuagga

SEQ ID NO: 968949 - RNA, 22 nt, Human
ccagaggcuggguucaccucag

SEQ ID NO: 968950 - RNA, 22 nt, Human
uccaggaggccucauuuccugu

SEQ ID NO: 968951 - RNA, 22 nt, Human
cagccagggagcaaagaguuga

SEQ ID NO: 968952 - RNA, 22 nt, Human
gccuggagcccaguguggggcu

SEQ ID NO: 968953 - RNA, 22 nt, Human
uuucauuauucaugcuaguuau

SEQ ID NO: 968954 - RNA, 18 nt, Human
ugcuggguaacuguaugg

SEQ ID NO: 968955 - RNA, 22 nt, Human
gcagcugcaggcaggcuugcug

SEQ ID NO: 968956 - RNA, 22 nt, Human
uuuuuccuuagggguuacucac

SEQ ID NO: 968957 - RNA, 22 nt, Human
agcauuuaauuacaguuuaauu

SEQ ID NO: 968958 - RNA, 22 nt, Human
ggcauggcucggagucagaaca

SEQ ID NO: 968959 - RNA, 22 nt, Human
auacauuagaaucugguacuca

SEQ ID NO: 968960 - RNA, 22 nt, Human
ugugaaagauacuaggcagagg

SEQ ID NO: 968961 - RNA, 22 nt, Human
cagcuggaucccugcagaacuu

SEQ ID NO: 968962 - RNA, 22 nt, Human
uucuuuccacagaggggaugau

SEQ ID NO: 968963 - RNA, 22 nt, Human
auuucuguaguccacauucuuu

SEQ ID NO: 968964 - RNA, 22 nt, Human
cugcugcugagaaugccucagg

SEQ ID NO: 968965 - RNA, 22 nt, Human
uucuuauucuugaaauguggga

SEQ ID NO: 968966 - RNA, 22 nt, Human
caguacuuugcaucauuccacu

SEQ ID NO: 968967 - RNA, 22 nt, Human
ugcuggaggccugacuguguuu

SEQ ID NO: 968968 - RNA, 22 nt, Human
cugagcugggcucucuugaggg

SEQ ID NO: 968969 - RNA, 18 nt, Human
gcacucugacugcagagc

SEQ ID NO: 968970 - RNA, 22 nt, Human
gcugucacucaccaggccugca

SEQ ID NO: 968971 - RNA, 22 nt, Human
uggaggaaaaaaccaggcagag

SEQ ID NO: 968972 - RNA, 22 nt, Human
cacauggccuguguggccagac

SEQ ID NO: 968973 - RNA, 19 nt, Human
cugaggcccauguaccaug

SEQ ID NO: 968974 - RNA, 22 nt, Human
cagugauguuucugcaucagag

SEQ ID NO: 968975 - RNA, 22 nt, Human
ggcucagguuaccagucccucc

SEQ ID NO: 968976 - RNA, 22 nt, Human
ucaggcugagaaaaucuggacc

SEQ ID NO: 968977 - RNA, 22 nt, Human
ugggccugugaugcugggcuau

SEQ ID NO: 968978 - RNA, 22 nt, Human
cccuggaguccuggcaguugau

SEQ ID NO: 968979 - RNA, 22 nt, Human
uuuaaauuauaguuaaugucug

SEQ ID NO: 968980 - RNA, 22 nt, Human
aaagauuuaagaauaauuugug

SEQ ID NO: 968981 - RNA, 22 nt, Human
ugagccugggagauggaggcug

SEQ ID NO: 968982 - RNA, 22 nt, Human
gaaaucugaaucuucuguuggu

SEQ ID NO: 968983 - RNA, 22 nt, Human
cugccuugguuucuagcagggc

SEQ ID NO: 968984 - RNA, 22 nt, Human
cccagacucaucccugggagcu

SEQ ID NO: 968985 - RNA, 22 nt, Human
gaggggcucuugggcaugaagg

SEQ ID NO: 968986 - RNA, 22 nt, Human
uccugucuaaagaccugcaggc

SEQ ID NO: 968987 - RNA, 22 nt, Human
agugcugaagacuggcuaggga

SEQ ID NO: 968988 - RNA, 22 nt, Human
auacacauguguaugugcaugc

SEQ ID NO: 968989 - RNA, 22 nt, Human
uguguuaacacugcaugauaau

SEQ ID NO: 968990 - RNA, 22 nt, Human
aagagagaacucccuucgccag

SEQ ID NO: 968991 - RNA, 22 nt, Human
ucugaacuccagcccugcucuc

SEQ ID NO: 968992 - RNA, 22 nt, Human
uggcagaggagaauuaagauua

SEQ ID NO: 968993 - RNA, 22 nt, Human
ucccaaggcacagggcagggac

SEQ ID NO: 968994 - RNA, 22 nt, Human
cagcaugguggagcugcucuuu

SEQ ID NO: 968995 - RNA, 22 nt, Human
uagucccauuuugagguauuug

SEQ ID NO: 968996 - RNA, 22 nt, Human
caguaaagcauguaugucuuca

SEQ ID NO: 968997 - RNA, 22 nt, Human
aggagaggucucccuuccccag

SEQ ID NO: 968998 - RNA, 19 nt, Human
ugucccagacuccgugucu

SEQ ID NO: 968999 - RNA, 21 nt, Human
gugguuauuuucauuagcauc

SEQ ID NO: 969000 - RNA, 22 nt, Human
aaucuuucccuauuaaaugugg

SEQ ID NO: 969001 - RNA, 19 nt, Human
gaggucagcaagaaguauu

SEQ ID NO: 969002 - RNA, 22 nt, Human
gcucugagagugggugauucug

SEQ ID NO: 969003 - RNA, 22 nt, Human
uagaaagcuugggguguuuaaa

SEQ ID NO: 969004 - RNA, 22 nt, Human
aaaauguaaagcuugaguguag

SEQ ID NO: 969005 - RNA, 22 nt, Human
cugcuuugaggggcucuguaua

SEQ ID NO: 969006 - RNA, 22 nt, Human
ucagguggcuuggagggggacg

SEQ ID NO: 969007 - RNA, 22 nt, Human
uagcacaucuucuuggccugca

SEQ ID NO: 969008 - RNA, 22 nt, Human
uuuuuggguccaggcuguaucu

SEQ ID NO: 969009 - RNA, 22 nt, Human
ccagcucccugaagccuggucu

SEQ ID NO: 969010 - RNA, 19 nt, Human
gagcagcugcacccauuga

SEQ ID NO: 969011 - RNA, 22 nt, Human
caaauucucuuacuguuugaca

SEQ ID NO: 969012 - RNA, 22 nt, Human
ccagcucugcagggccuggggu

SEQ ID NO: 969013 - RNA, 22 nt, Human
uacauuugggacaauaagagaa

SEQ ID NO: 969014 - RNA, 22 nt, Human
cagaggcucaccagccuuucac

SEQ ID NO: 969015 - RNA, 22 nt, Human
guaaaauagaauaacguggcua

SEQ ID NO: 969016 - RNA, 22 nt, Human
ucuucagacccuuagcugugau

SEQ ID NO: 969017 - RNA, 22 nt, Human
cugagcauggccgguccauggu

SEQ ID NO: 969018 - RNA, 22 nt, Human
gucaaguuuauccgcucauuca

SEQ ID NO: 969019 - RNA, 22 nt, Human
ucaacacucuuuggcacaguua

SEQ ID NO: 969020 - RNA, 22 nt, Human
ugaaaggugacauuucuuggau

SEQ ID NO: 969021 - RNA, 22 nt, Human
gaggagagggcugcgggcccac

SEQ ID NO: 969022 - RNA, 22 nt, Human
aucaguuucugugaagaacaca

SEQ ID NO: 969023 - RNA, 22 nt, Human
aggagagucuugagucacuggu

SEQ ID NO: 969024 - RNA, 22 nt, Human
uggucuaaauauggcucuaaau

SEQ ID NO: 969025 - RNA, 22 nt, Human
acagguggcuuauuggcugauu

SEQ ID NO: 969026 - RNA, 22 nt, Human
agagccuggucugagauaggac

SEQ ID NO: 969027 - RNA, 22 nt, Human
augggagugacagggccacugg

SEQ ID NO: 969028 - RNA, 22 nt, Human
gucauuccuuauguugauucag

SEQ ID NO: 969029 - RNA, 22 nt, Human
ucuuugcaggagcccuuugaac

SEQ ID NO: 969030 - RNA, 22 nt, Human
acagaguauuggaaaggcagug

SEQ ID NO: 969031 - RNA, 18 nt, Human
uggagcaggaagccuggc

SEQ ID NO: 969032 - RNA, 22 nt, Human
ggcuccuguggcaagacagcuu

SEQ ID NO: 969033 - RNA, 22 nt, Human
caugccaguuuugagaugcacc

SEQ ID NO: 969034 - RNA, 22 nt, Human
ugcugcucuucaccauggccuc

SEQ ID NO: 969035 - RNA, 22 nt, Human
aaagcuaugaggcaugcauuuc

SEQ ID NO: 969036 - RNA, 22 nt, Human
cacugcauggaugauggcugua

SEQ ID NO: 969037 - RNA, 22 nt, Human
aggguggcuggaggaaucagaa

SEQ ID NO: 969038 - RNA, 22 nt, Human
ggcagcuuccuaggagagggca

SEQ ID NO: 969039 - RNA, 22 nt, Human
aggcacuguacuagguacaggg

SEQ ID NO: 969040 - RNA, 18 nt, Human
gaaaugugauucuagggc

SEQ ID NO: 969041 - RNA, 22 nt, Human
ggcugcuucucacucauuugca

SEQ ID NO: 969042 - RNA, 22 nt, Human
uccucagggggccaacccagcc

SEQ ID NO: 969043 - RNA, 22 nt, Human
guuccacaaaauguacccaguu

SEQ ID NO: 969044 - RNA, 22 nt, Human
uuggccaauuccagaggaucau

SEQ ID NO: 969045 - RNA, 22 nt, Human
auucaaauuaaguuaauucagc

SEQ ID NO: 969046 - RNA, 22 nt, Human
agcagaaccacagcacuguuga

SEQ ID NO: 969047 - RNA, 22 nt, Human
cacagggcaccaguuggccauc

SEQ ID NO: 969048 - RNA, 21 nt, Human
gauuucacuuaccuucauuua

SEQ ID NO: 969049 - RNA, 22 nt, Human
ccugggcuggaguacagcagug

SEQ ID NO: 969050 - RNA, 21 nt, Human
uccucagggccccagagcacu

SEQ ID NO: 969051 - RNA, 22 nt, Human
gccaccagccccaugcgcugug

SEQ ID NO: 969052 - RNA, 20 nt, Human
uccagccacuuccgcugguc

SEQ ID NO: 969053 - RNA, 22 nt, Human
ugagaaccaugaaaagcuguca

SEQ ID NO: 969054 - RNA, 22 nt, Human
uuagaaacccagacucuuaggu

SEQ ID NO: 969055 - RNA, 22 nt, Human
cuguucacacacuuguacucuc

SEQ ID NO: 969056 - RNA, 22 nt, Human
cagauggcugccaagaugggcu

SEQ ID NO: 969057 - RNA, 22 nt, Human
gcccaggagaggccagggcuga

SEQ ID NO: 969058 - RNA, 22 nt, Human
agggccucugacgcccccagcc

SEQ ID NO: 969059 - RNA, 22 nt, Human
cugcugugauugggagaaaccg

SEQ ID NO: 969060 - RNA, 22 nt, Human
cucaggaugcaauuccaucaag

SEQ ID NO: 969061 - RNA, 22 nt, Human
cacaggaggaggccagagcgua

SEQ ID NO: 969062 - RNA, 22 nt, Human
uuuccuguugccaucaagaaug

SEQ ID NO: 969063 - RNA, 18 nt, Human
ggcugccuguuccugaag

SEQ ID NO: 969064 - RNA, 22 nt, Human
uaccuugggguuuuguugcucu

SEQ ID NO: 969065 - RNA, 22 nt, Human
agcagcauagaagcugggagga

SEQ ID NO: 969066 - RNA, 21 nt, Human
uagagaaaagaagcuguuccu

SEQ ID NO: 969067 - RNA, 22 nt, Human
uaugccagggacuguuucacca

SEQ ID NO: 969068 - RNA, 22 nt, Human
gcuuccuggagggagagagcug

SEQ ID NO: 969069 - RNA, 22 nt, Human
cuggagcaggcuugucccagcu

SEQ ID NO: 969070 - RNA, 22 nt, Human
ucuuccucuagaucugaggccc

SEQ ID NO: 969071 - RNA, 20 nt, Human
ccagcauguacacaugugga

SEQ ID NO: 969072 - RNA, 22 nt, Human
uucucuucaucucaguaaaugu

SEQ ID NO: 969073 - RNA, 22 nt, Human
ggcuucucucuucacauggcuu

SEQ ID NO: 969074 - RNA, 22 nt, Human
auaugucgcuacaucauuagau

SEQ ID NO: 969075 - RNA, 22 nt, Human
ccagcacugcucucagacugag

SEQ ID NO: 969076 - RNA, 20 nt, Human
agauggugaaggccagggag

SEQ ID NO: 969077 - RNA, 22 nt, Human
agucuccuuggccucaaugccu

SEQ ID NO: 969078 - RNA, 22 nt, Human
cagcuucccuuggcugagcaga

SEQ ID NO: 969079 - RNA, 22 nt, Human
uucaacacaggaacaugauaua

SEQ ID NO: 969080 - RNA, 22 nt, Human
aggcagauauuggggugaugug

SEQ ID NO: 969081 - RNA, 22 nt, Human
uauuuucuggacagucuugcuu

SEQ ID NO: 969082 - RNA, 22 nt, Human
cacauuuaaagguugaagcuga

SEQ ID NO: 969083 - RNA, 22 nt, Human
gcagaggcugggugucccaguc

SEQ ID NO: 969084 - RNA, 22 nt, Human
aaagagcuaacauugccgagau

SEQ ID NO: 969085 - RNA, 22 nt, Human
agaggauguucuaggcacucau

SEQ ID NO: 969086 - RNA, 22 nt, Human
gcaggggcugcugggaacucgg

SEQ ID NO: 969087 - RNA, 22 nt, Human
ucuguggauuuuaguguucaug

SEQ ID NO: 969088 - RNA, 22 nt, Human
guuugcauuuauuagucuucug

SEQ ID NO: 969089 - RNA, 21 nt, Human
uauacaugugugcauacgugu

SEQ ID NO: 969090 - RNA, 22 nt, Human
ggccuggcauggggacuaaggg

SEQ ID NO: 969091 - RNA, 22 nt, Human
acuuguuuuaucugucaauaga

SEQ ID NO: 969092 - RNA, 22 nt, Human
accugagggcccaaacuuggua

SEQ ID NO: 969093 - RNA, 22 nt, Human
uaggauaugguagaaaucauuc

SEQ ID NO: 969094 - RNA, 22 nt, Human
ccagcuggaagagugcagaacu

SEQ ID NO: 969095 - RNA, 22 nt, Human
uuacauuuggcuauguccucua

SEQ ID NO: 969096 - RNA, 21 nt, Human
aguugcauaggccagccaucc

SEQ ID NO: 969097 - RNA, 22 nt, Human
ggaaggucgagcugcaucuggc

SEQ ID NO: 969098 - RNA, 22 nt, Human
ggcugcaguuugucuuuugcuu

SEQ ID NO: 969099 - RNA, 23 nt, Human
uauggcaugguacuuccagcaga

SEQ ID NO: 969100 - RNA, 21 nt, Human
aacaaagggaugcucaucuuu

SEQ ID NO: 969101 - RNA, 22 nt, Human
aaagguuaagguguucaagaaa

SEQ ID NO: 969102 - RNA, 22 nt, Human
gaguggggcccacugcugggug

SEQ ID NO: 969103 - RNA, 22 nt, Human
gcugggcaccggagagacccca

SEQ ID NO: 969104 - RNA, 22 nt, Human
ugcagcauucuuggccacuacu

SEQ ID NO: 969105 - RNA, 22 nt, Human
agcaggagcccuuaucaccagg

SEQ ID NO: 969106 - RNA, 22 nt, Human
cccugcagaccaaugccauaga

SEQ ID NO: 969107 - RNA, 22 nt, Human
ccaggguggggcaggcccacug

SEQ ID NO: 969108 - RNA, 22 nt, Human
ucaugcaaggcugaaacauggu

SEQ ID NO: 969109 - RNA, 19 nt, Human
gcugucugaugcugagguc

SEQ ID NO: 969110 - RNA, 22 nt, Human
uguggccuggaaggggcugcuc

SEQ ID NO: 969111 - RNA, 22 nt, Human
ugaggcagugauguuuaagcac

SEQ ID NO: 969112 - RNA, 22 nt, Human
ggcagucuuaucagcauuggac

SEQ ID NO: 969113 - RNA, 22 nt, Human
cagcauggacccaucgcugagu

SEQ ID NO: 969114 - RNA, 22 nt, Human
cacugcuuaguugguaaaugug

SEQ ID NO: 969115 - RNA, 22 nt, Human
cagggagggaggaaaauuugcu

SEQ ID NO: 969116 - RNA, 22 nt, Human
ggagaggggcaaguuuaucuag

SEQ ID NO: 969117 - RNA, 22 nt, Human
uuuagaguugaguauucauugg

SEQ ID NO: 969118 - RNA, 18 nt, Human
aggcaggugcuggaaguc

SEQ ID NO: 969119 - RNA, 22 nt, Human
aggcaguuuaggcagcgauuua

SEQ ID NO: 969120 - RNA, 22 nt, Human
agggucugcauuccaacuuggg

SEQ ID NO: 969121 - RNA, 21 nt, Human
ggauggauagggaagagauuu

SEQ ID NO: 969122 - RNA, 22 nt, Human
gcuguuaggugcccugaccuug

SEQ ID NO: 969123 - RNA, 22 nt, Human
ggcagagcuuguuccuucuguu

SEQ ID NO: 969124 - RNA, 21 nt, Human
ggcugcugggagagcugcgug

SEQ ID NO: 969125 - RNA, 22 nt, Human
caacagaaggaagcagggucag

SEQ ID NO: 969126 - RNA, 19 nt, Human
caagugaagccugggaugg

SEQ ID NO: 969127 - RNA, 22 nt, Human
ucuuuccuuagaauaauucuuu

SEQ ID NO: 969128 - RNA, 22 nt, Human
uccucaggauguggaguagaau

SEQ ID NO: 969129 - RNA, 22 nt, Human
uagagugguuaacaguuuagaa

SEQ ID NO: 969130 - RNA, 22 nt, Human
gggcacagaagucuaagacauc

SEQ ID NO: 969131 - RNA, 22 nt, Human
aaaugucuguuagucauaucau

SEQ ID NO: 969132 - RNA, 22 nt, Human
guguacauagaauugugcuuug

SEQ ID NO: 969133 - RNA, 22 nt, Human
cagagcugcaaaugccccuccg

SEQ ID NO: 969134 - RNA, 22 nt, Human
auuuagaaguuggagggcaaga

SEQ ID NO: 969135 - RNA, 22 nt, Human
gguggccuccagggcauaggug

SEQ ID NO: 969136 - RNA, 19 nt, Human
acuggcaguuucugcaugg

SEQ ID NO: 969137 - RNA, 22 nt, Human
gggugggccacugagcagcgug

SEQ ID NO: 969138 - RNA, 22 nt, Human
aaucauaauuguauacauucau

SEQ ID NO: 969139 - RNA, 22 nt, Human
ggcugcagggcagcuggugugg

SEQ ID NO: 969140 - RNA, 22 nt, Human
gcaaggaccuuugagcgugcca

SEQ ID NO: 969141 - RNA, 22 nt, Human
agcuggccuguuagagcugagu

SEQ ID NO: 969142 - RNA, 22 nt, Human
ugggcucugcugcguaccaguu

SEQ ID NO: 969143 - RNA, 22 nt, Human
guccucugggcagcugccccac

SEQ ID NO: 969144 - RNA, 22 nt, Human
cugggagcucagcccuggggug

SEQ ID NO: 969145 - RNA, 22 nt, Human
acccaggaggugacacagggcu

SEQ ID NO: 969146 - RNA, 22 nt, Human
uggcacugccuggcagggcccc

SEQ ID NO: 969147 - RNA, 22 nt, Human
aguuuuuccugauuuuacagaa

SEQ ID NO: 969148 - RNA, 22 nt, Human
gcuaugcaggagccuaaugaca

SEQ ID NO: 969149 - RNA, 22 nt, Human
uuuaguagaugcagcauuauuu

SEQ ID NO: 969150 - RNA, 22 nt, Human
uuugaaauuggcucauugguuu

SEQ ID NO: 969151 - RNA, 22 nt, Human
uagaaaugauugguugagcucu

SEQ ID NO: 969152 - RNA, 22 nt, Human
cuuauguaaacuacagauaaua

SEQ ID NO: 969153 - RNA, 22 nt, Human
auaugugugaugcauggacuaa

SEQ ID NO: 969154 - RNA, 22 nt, Human
cauguacaaaaggcaaaugccu

SEQ ID NO: 969155 - RNA, 19 nt, Human
ggcagcuggacgcuguuca

SEQ ID NO: 969156 - RNA, 22 nt, Human
guucauuuaugauguaacaugu

SEQ ID NO: 969157 - RNA, 22 nt, Human
uauuagguaaaggacuugcagg

SEQ ID NO: 969158 - RNA, 22 nt, Human
cugucaccuguucacugcagca

SEQ ID NO: 969159 - RNA, 20 nt, Human
cuggguggcaagcaaggggg

SEQ ID NO: 969160 - RNA, 22 nt, Human
caggcagcaggagcccugcucg

SEQ ID NO: 969161 - RNA, 22 nt, Human
uccagggcuggguuggcucagc

SEQ ID NO: 969162 - RNA, 22 nt, Human
caguccagcucaucaguggcac

SEQ ID NO: 969163 - RNA, 19 nt, Human
acacagggaucagaggguu

SEQ ID NO: 969164 - RNA, 22 nt, Human
acaaagcuagagaagagaauug

SEQ ID NO: 969165 - RNA, 22 nt, Human
agauuuccaucuuuuucaugug

SEQ ID NO: 969166 - RNA, 22 nt, Human
cccaggaucaccuggucaaggg

SEQ ID NO: 969167 - RNA, 22 nt, Human
ucuggcucaaaauacguacucu

SEQ ID NO: 969168 - RNA, 22 nt, Human
ugaggcagccugcauuaaagag

SEQ ID NO: 969169 - RNA, 22 nt, Human
cucagagcccaggguacacccg

SEQ ID NO: 969170 - RNA, 22 nt, Human
aaauuauuaugccccucuauaa

SEQ ID NO: 969171 - RNA, 23 nt, Human
uggccucuccccaccuggcagaa

SEQ ID NO: 969172 - RNA, 22 nt, Human
gcugcccuaauaucacauguua

SEQ ID NO: 969173 - RNA, 22 nt, Human
guggguggaucaccugagguca

SEQ ID NO: 969174 - RNA, 22 nt, Human
cagagcucagagcagggcacuc

SEQ ID NO: 969175 - RNA, 22 nt, Human
gcuguucaaaagccacaguuac

SEQ ID NO: 969176 - RNA, 22 nt, Human
ucagaggauugccucagcgagc

SEQ ID NO: 969177 - RNA, 22 nt, Human
ugccagaagugcuuuauaagug

SEQ ID NO: 969178 - RNA, 22 nt, Human
agcugggagcagagccacagcc

SEQ ID NO: 969179 - RNA, 22 nt, Human
gagccuggccuccugccucagc

SEQ ID NO: 969180 - RNA, 22 nt, Human
caggcucccacccuccugcagc

SEQ ID NO: 969181 - RNA, 22 nt, Human
caaagcaaggcucaguuugaac

SEQ ID NO: 969182 - RNA, 22 nt, Human
aguuuaauauccuucaacuuuc

SEQ ID NO: 969183 - RNA, 17 nt, Human
auguuaauuucacauuu

SEQ ID NO: 969184 - RNA, 22 nt, Human
guccaugacugugacucacaug

SEQ ID NO: 969185 - RNA, 22 nt, Human
cauugaaaaacguugacugagu

SEQ ID NO: 969186 - RNA, 22 nt, Human
auggggagagaagggcugagcu

SEQ ID NO: 969187 - RNA, 20 nt, Human
cccagguaggugccaugagu

SEQ ID NO: 969188 - RNA, 22 nt, Human
aauaugcauguauacaugugua

SEQ ID NO: 969189 - RNA, 22 nt, Human
ugcaugcagcuggugauaagaa

SEQ ID NO: 969190 - RNA, 18 nt, Human
cuccagggaacucaguca

SEQ ID NO: 969191 - RNA, 22 nt, Human
cgcuggccauagccuccugugu

SEQ ID NO: 969192 - RNA, 22 nt, Human
uuucucuaaauagggaggcuua

SEQ ID NO: 969193 - RNA, 22 nt, Human
ggcugcagcagagggacucacg

SEQ ID NO: 969194 - RNA, 22 nt, Human
guauuagggccaaaggcaggaa

SEQ ID NO: 969195 - RNA, 22 nt, Human
uaacagaauagcagaaacagaa

SEQ ID NO: 969196 - RNA, 22 nt, Human
agagccugugggagaugcagcu

SEQ ID NO: 969197 - RNA, 22 nt, Human
agugucugaaccaccggggcau

SEQ ID NO: 969198 - RNA, 22 nt, Human
gagaggccauggcugugcagug

SEQ ID NO: 969199 - RNA, 22 nt, Human
gggcuggcaggaccugggcuga

SEQ ID NO: 969200 - RNA, 22 nt, Human
cuggccuuggugcuugcagaca

SEQ ID NO: 969201 - RNA, 22 nt, Human
ccugucaguugcugucagggau

SEQ ID NO: 969202 - RNA, 22 nt, Human
auggccaaaucuaaacuguugg

SEQ ID NO: 969203 - RNA, 22 nt, Human
gccagucuucauauucauggug

SEQ ID NO: 969204 - RNA, 22 nt, Human
agccugguguggggcugcagag

SEQ ID NO: 969205 - RNA, 22 nt, Human
uagaggugucacuuugggaagu

SEQ ID NO: 969206 - RNA, 22 nt, Human
acucugugugaguagagccugu

SEQ ID NO: 969207 - RNA, 22 nt, Human
ugagauguaagguaugcuuacu

SEQ ID NO: 969208 - RNA, 22 nt, Human
auguuauuuuggaaaauacaaa

SEQ ID NO: 969209 - RNA, 22 nt, Human
gcagggcugggugggagacaga

SEQ ID NO: 969210 - RNA, 21 nt, Human
cagagcuguccaaacccugac

SEQ ID NO: 969211 - RNA, 22 nt, Human
aaacauucucagcccugcuugc

SEQ ID NO: 969212 - RNA, 22 nt, Human
uugcauuccaguccccacugug

SEQ ID NO: 969213 - RNA, 22 nt, Human
ggcugagcaauuuugaugacau

SEQ ID NO: 969214 - RNA, 22 nt, Human
ugcuggcugggcugcuggagac

SEQ ID NO: 969215 - RNA, 22 nt, Human
gggcugucaugugucagugacc

SEQ ID NO: 969216 - RNA, 22 nt, Human
ccaggccauucccagaguugcu

SEQ ID NO: 969217 - RNA, 22 nt, Human
uuccucucgcucuccggggccc

SEQ ID NO: 969218 - RNA, 22 nt, Human
acuuucauuugugaagacugua

SEQ ID NO: 969219 - RNA, 22 nt, Human
gcuuccaaaucuguucaaaaug

SEQ ID NO: 969220 - RNA, 22 nt, Human
ccccagcacuuggaguggggag

SEQ ID NO: 969221 - RNA, 22 nt, Human
ggcucaggccagaccacgacuc

SEQ ID NO: 969222 - RNA, 22 nt, Human
ggaccugccagaacucaggcua

SEQ ID NO: 969223 - RNA, 17 nt, Human
uuccucucacauuuuuu

SEQ ID NO: 969224 - RNA, 22 nt, Human
ugggcacaaacaucugccuguu

SEQ ID NO: 969225 - RNA, 22 nt, Human
cagcuucucagaaagcugaggu

SEQ ID NO: 969226 - RNA, 22 nt, Human
uaggcaauauuagacuuugucu

SEQ ID NO: 969227 - RNA, 22 nt, Human
cuucuucaucuguaaaacuugg

SEQ ID NO: 969228 - RNA, 22 nt, Human
ucacuguauuugcugaugcaua

SEQ ID NO: 969229 - RNA, 22 nt, Human
cuggagcuaauaauccaucuga

SEQ ID NO: 969230 - RNA, 21 nt, Human
aaugcauuaacauaaagcuga

SEQ ID NO: 969231 - RNA, 22 nt, Human
gguuauauaauucagugcuuuc

SEQ ID NO: 969232 - RNA, 22 nt, Human
cuggagccaugucuugacugcu

SEQ ID NO: 969233 - RNA, 22 nt, Human
agaggcaguauacaauccgagc

SEQ ID NO: 969234 - RNA, 22 nt, Human
agaauucuuggugguuagaaua

SEQ ID NO: 969235 - RNA, 22 nt, Human
ccugagggaggguauaggcugu

SEQ ID NO: 969236 - RNA, 22 nt, Human
ucugucacccaggcuggagugc

SEQ ID NO: 969237 - RNA, 22 nt, Human
ugccugucuuggaguccuggcc

SEQ ID NO: 969238 - RNA, 22 nt, Human
gcugugagccgcugcugagcau

SEQ ID NO: 969239 - RNA, 22 nt, Human
cagaggauucccuagugaccug

SEQ ID NO: 969240 - RNA, 23 nt, Human
ucaggauauugugugccaaggug

SEQ ID NO: 969241 - RNA, 17 nt, Human
ccucccacaccgcccug

SEQ ID NO: 969242 - RNA, 22 nt, Human
ucuggagaacuugcaagaggau

SEQ ID NO: 969243 - RNA, 22 nt, Human
agaaaucugacugcugugcaca

SEQ ID NO: 969244 - RNA, 22 nt, Human
uagggagcucuggcagaaggaa

SEQ ID NO: 969245 - RNA, 22 nt, Human
auggaguucuuuaaauucacag

SEQ ID NO: 969246 - RNA, 21 nt, Human
aaguaaaucagagaaauaacc

SEQ ID NO: 969247 - RNA, 22 nt, Human
ccuggagcgcgggucaagcugg

SEQ ID NO: 969248 - RNA, 22 nt, Human
ucacuuuugaucccuaugcagu

SEQ ID NO: 969249 - RNA, 22 nt, Human
cuguauuuaguuaaaaugcuaa

SEQ ID NO: 969250 - RNA, 22 nt, Human
cuugcaggccuuucuagcucua

SEQ ID NO: 969251 - RNA, 22 nt, Human
gucuuugcugucuuugcucuca

SEQ ID NO: 969252 - RNA, 22 nt, Human
aguguuguaugggaugacugcu

SEQ ID NO: 969253 - RNA, 22 nt, Human
uagaaaucagcaggcauaugua

SEQ ID NO: 969254 - RNA, 22 nt, Human
ugccugucuuuccucccucgua

SEQ ID NO: 969255 - RNA, 22 nt, Human
uggcagagaauaaaucuugacu

SEQ ID NO: 969256 - RNA, 19 nt, Human
gggcuuggggcugaagccu

SEQ ID NO: 969257 - RNA, 22 nt, Human
uggagggaacaaaggaguccca

SEQ ID NO: 969258 - RNA, 22 nt, Human
cagguggagcugacugagggca

SEQ ID NO: 969259 - RNA, 22 nt, Human
ugcaggcuguaaucugaggcua

SEQ ID NO: 969260 - RNA, 22 nt, Human
gaggcagaaguugcagugagca

SEQ ID NO: 969261 - RNA, 22 nt, Human
guuauguaugagggaaugauua

SEQ ID NO: 969262 - RNA, 22 nt, Human
aguggggcggacaggaccagga

SEQ ID NO: 969263 - RNA, 22 nt, Human
cugggaggcaccgcgucgugcu

SEQ ID NO: 969264 - RNA, 22 nt, Human
cuuuggcaacacaugugggaca

SEQ ID NO: 969265 - RNA, 22 nt, Human
gccugccuguuggcugaggugc

SEQ ID NO: 969266 - RNA, 22 nt, Human
cagggcagggccacacccccug

SEQ ID NO: 969267 - RNA, 22 nt, Human
gcagcccagguguagcucuuug

SEQ ID NO: 969268 - RNA, 22 nt, Human
agcuucuugggcuuuacacaaa

SEQ ID NO: 969269 - RNA, 22 nt, Human
ucuuggcaauuugaucucaguu

SEQ ID NO: 969270 - RNA, 22 nt, Human
gcagggacagggcagggccuuu

SEQ ID NO: 969271 - RNA, 22 nt, Human
uaugucacauuguaacagugug

SEQ ID NO: 969272 - RNA, 22 nt, Human
ucaggagacaaagggugcggag

SEQ ID NO: 969273 - RNA, 22 nt, Human
ggcugagcucaggggcagcagg

SEQ ID NO: 969274 - RNA, 22 nt, Human
uuucacaacugcuuauuugaga

SEQ ID NO: 969275 - RNA, 22 nt, Human
cuuccugcaggacagccaucug

SEQ ID NO: 969276 - RNA, 19 nt, Human
uagaaugcccacuuaaaaa

SEQ ID NO: 969277 - RNA, 22 nt, Human
augcuguguauuuuacucuuuc

SEQ ID NO: 969278 - RNA, 22 nt, Human
cugggccagauccagccucaca

SEQ ID NO: 969279 - RNA, 22 nt, Human
ggcuggguuauuuauggccaag

SEQ ID NO: 969280 - RNA, 22 nt, Human
uuuuccuacugauaaacaguua

SEQ ID NO: 969281 - RNA, 22 nt, Human
cugggcugcagcgggagcgacg

SEQ ID NO: 969282 - RNA, 22 nt, Human
uggaggaugccuggggaggccu

SEQ ID NO: 969283 - RNA, 22 nt, Human
uggcuuccuccagagcaggagg

SEQ ID NO: 969284 - RNA, 22 nt, Human
gcugcccagacauugaaucagg

SEQ ID NO: 969285 - RNA, 20 nt, Human
cagaggcauuuucagacucu

SEQ ID NO: 969286 - RNA, 22 nt, Human
uguaucaaaccaaauuaauucu

SEQ ID NO: 969287 - RNA, 22 nt, Human
agaauuguugggguaauaaaag

SEQ ID NO: 969288 - RNA, 22 nt, Human
uuugaaaauuuaagugcuacac

SEQ ID NO: 969289 - RNA, 22 nt, Human
uaaguaaauuuauaaugugauu

SEQ ID NO: 969290 - RNA, 22 nt, Human
cucuuccuacagucugcuaugc

SEQ ID NO: 969291 - RNA, 22 nt, Human
uagagcugggcagugcucugag

SEQ ID NO: 969292 - RNA, 22 nt, Human
cugugggcugaaagugcucccg

SEQ ID NO: 969293 - RNA, 22 nt, Human
gaggcagcaauaaaaagaauuu

SEQ ID NO: 969294 - RNA, 22 nt, Human
aaaugcauguagaauaauagag

SEQ ID NO: 969295 - RNA, 22 nt, Human
aggcuuauuaauaugauucugc

SEQ ID NO: 969296 - RNA, 22 nt, Human
gugggccuugcagggugcaggg

SEQ ID NO: 969297 - RNA, 22 nt, Human
uuggccaagucacugguuaaug

SEQ ID NO: 969298 - RNA, 22 nt, Human
ucaaucacguguuccauguucu

SEQ ID NO: 969299 - RNA, 22 nt, Human
uggcagagugcagaagaggcau

SEQ ID NO: 969300 - RNA, 22 nt, Human
ccacagcugaccgcaggugagc

SEQ ID NO: 969301 - RNA, 22 nt, Human
ucaggagagaguuggguaggcu

SEQ ID NO: 969302 - RNA, 22 nt, Human
ugcuggcuggccuggccuggac

SEQ ID NO: 969303 - RNA, 22 nt, Human
aucuacagcugucugcacagua

SEQ ID NO: 969304 - RNA, 22 nt, Human
uuucuguaaggacuuaaugcaa

SEQ ID NO: 969305 - RNA, 22 nt, Human
aggagcugcauggauaccuggu

SEQ ID NO: 969306 - RNA, 22 nt, Human
acugcagggcauccuggccaag

SEQ ID NO: 969307 - RNA, 22 nt, Human
ccaggaguuugaggcugcagug

SEQ ID NO: 969308 - RNA, 22 nt, Human
cccagcauuucugggcugcacu

SEQ ID NO: 969309 - RNA, 22 nt, Human
uuuaaauucugucugccgcuua

SEQ ID NO: 969310 - RNA, 18 nt, Human
cucucugggugaggacaa

SEQ ID NO: 969311 - RNA, 22 nt, Human
ccagcuccucuucccaguguca

SEQ ID NO: 969312 - RNA, 22 nt, Human
uccuggccuugcuccugaugcc

SEQ ID NO: 969313 - RNA, 22 nt, Human
ggcugccauaacagaguaccac

SEQ ID NO: 969314 - RNA, 22 nt, Human
gcucccucugcucaggcacuug

SEQ ID NO: 969315 - RNA, 22 nt, Human
gagcagaacaggccggguggga

SEQ ID NO: 969316 - RNA, 22 nt, Human
acacugaauguuuaagaacuug

SEQ ID NO: 969317 - RNA, 22 nt, Human
acagugucuccugguacccagu

SEQ ID NO: 969318 - RNA, 22 nt, Human
caaaggagguaaugggugugag

SEQ ID NO: 969319 - RNA, 22 nt, Human
uccaggcugggcugaagggugc

SEQ ID NO: 969320 - RNA, 22 nt, Human
cuuaacagauacaucugugguu

SEQ ID NO: 969321 - RNA, 22 nt, Human
gauguuucaugcuagcaugugu

SEQ ID NO: 969322 - RNA, 22 nt, Human
cccaggagagaggggauaaagc

SEQ ID NO: 969323 - RNA, 22 nt, Human
caggauccuggcugcauggacg

SEQ ID NO: 969324 - RNA, 22 nt, Human
caggaacacaaugagucucaaa

SEQ ID NO: 969325 - RNA, 22 nt, Human
uuguguuucuggccaagaugga

SEQ ID NO: 969326 - RNA, 19 nt, Human
agguggucuaggcuggaga

SEQ ID NO: 969327 - RNA, 22 nt, Human
aaucuucuuucuuaacaguaca

SEQ ID NO: 969328 - RNA, 22 nt, Human
cagagcugcagauugaaggcau

SEQ ID NO: 969329 - RNA, 22 nt, Human
augugucuuggaguuuuaaugu

SEQ ID NO: 969330 - RNA, 22 nt, Human
gccugagauucugcauuucuaa

SEQ ID NO: 969331 - RNA, 22 nt, Human
ggagaggagcuauugggggcuc

SEQ ID NO: 969332 - RNA, 22 nt, Human
agucugucuacuuaaagucugu

SEQ ID NO: 969333 - RNA, 22 nt, Human
guuauguaaucuaacacucagu

SEQ ID NO: 969334 - RNA, 22 nt, Human
ggagaggugaauggcugcucua

SEQ ID NO: 969335 - RNA, 22 nt, Human
auuguauuuguacaagacaugu

SEQ ID NO: 969336 - RNA, 22 nt, Human
uacuuugucauucuaaccuucc

SEQ ID NO: 969337 - RNA, 22 nt, Human
uuugaaugcaggacauacagaa

SEQ ID NO: 969338 - RNA, 21 nt, Human
ugcucaugcaaugcaugucca

SEQ ID NO: 969339 - RNA, 22 nt, Human
uuccuggcgccacggagccggu

SEQ ID NO: 969340 - RNA, 22 nt, Human
ugcagccaggaaauauuugcug

SEQ ID NO: 969341 - RNA, 22 nt, Human
uugaaaggccuguuuauccagc

SEQ ID NO: 969342 - RNA, 22 nt, Human
uuucacaaugcaauccuacuuc

SEQ ID NO: 969343 - RNA, 17 nt, Human
ucaggauguagcaguag

SEQ ID NO: 969344 - RNA, 22 nt, Human
uugggcugaacccugcagcuga

SEQ ID NO: 969345 - RNA, 22 nt, Human
aguggcagaagucacuggguag

SEQ ID NO: 969346 - RNA, 22 nt, Human
ucccacugugaauccaaggccu

SEQ ID NO: 969347 - RNA, 22 nt, Human
ccaggaguuggagguugcagug

SEQ ID NO: 969348 - RNA, 22 nt, Human
aggaaucccgcaccagcugcug

SEQ ID NO: 969349 - RNA, 17 nt, Human
ggucuggggccauuggc

SEQ ID NO: 969350 - RNA, 18 nt, Human
gggcccuggcguccgccc

SEQ ID NO: 969351 - RNA, 22 nt, Human
cuguggaguuuguggcgcugac

SEQ ID NO: 969352 - RNA, 22 nt, Human
cuguccugcaguugggggcagg

SEQ ID NO: 969353 - RNA, 22 nt, Human
acuggcaguggcagcagaaaga

SEQ ID NO: 969354 - RNA, 22 nt, Human
agagauucauguuuacuguagg

SEQ ID NO: 969355 - RNA, 22 nt, Human
aaggcaguuugggccaccaucu

SEQ ID NO: 969356 - RNA, 23 nt, Human
aaacuugcuauggcugaaaucau

SEQ ID NO: 969357 - RNA, 22 nt, Human
ccugggaggcugugggucugcu

SEQ ID NO: 969358 - RNA, 22 nt, Human
aaaugaugcucacagauuagug

SEQ ID NO: 969359 - RNA, 22 nt, Human
aacucaguguguuucuuaguau

SEQ ID NO: 969360 - RNA, 22 nt, Human
agcuugaguuuuggaugaagug

SEQ ID NO: 969361 - RNA, 22 nt, Human
ugcugagguuucgucugcuugc

SEQ ID NO: 969362 - RNA, 22 nt, Human
acacaggggcucggcugggugc

SEQ ID NO: 969363 - RNA, 19 nt, Human
cuuauuagagugagagcuu

SEQ ID NO: 969364 - RNA, 22 nt, Human
acagaaagaagguguauuugag

SEQ ID NO: 969365 - RNA, 22 nt, Human
cuuguacaggaauccaugguau

SEQ ID NO: 969366 - RNA, 22 nt, Human
ggcagcugucucugaguuagca

SEQ ID NO: 969367 - RNA, 22 nt, Human
ugccuggcaacuguggugggcu

SEQ ID NO: 969368 - RNA, 22 nt, Human
aggacagggauucaaacuccca

SEQ ID NO: 969369 - RNA, 22 nt, Human
agcugguguccuccuggagcug

SEQ ID NO: 969370 - RNA, 22 nt, Human
gugggagcccucagggaggugc

SEQ ID NO: 969371 - RNA, 21 nt, Human
uggccucccacacuuccaugg

SEQ ID NO: 969372 - RNA, 22 nt, Human
auaaacaucuguuucucuucug

SEQ ID NO: 969373 - RNA, 22 nt, Human
auaucacaaacaagucuguacu

SEQ ID NO: 969374 - RNA, 22 nt, Human
gcacccagaggucagcagugcu

SEQ ID NO: 969375 - RNA, 22 nt, Human
ucugcaggcucuagaugagguu

SEQ ID NO: 969376 - RNA, 22 nt, Human
aguguauugauuggaacagccu

SEQ ID NO: 969377 - RNA, 22 nt, Human
cauuuacagugagaguuuuuac

SEQ ID NO: 969378 - RNA, 22 nt, Human
uaggcacuguguuuguaggagu

SEQ ID NO: 969379 - RNA, 22 nt, Human
ugggcuggcugaggcauucacu

SEQ ID NO: 969380 - RNA, 22 nt, Human
ggguccagcgacagcaggcuca

SEQ ID NO: 969381 - RNA, 22 nt, Human
agugugcuauugcaccaucaua

SEQ ID NO: 969382 - RNA, 22 nt, Human
ugaggggauacgguacacauug

SEQ ID NO: 969383 - RNA, 22 nt, Human
ugcaguggaaucuggagagcag

SEQ ID NO: 969384 - RNA, 22 nt, Human
auuucacucuuaauugcuuccu

SEQ ID NO: 969385 - RNA, 22 nt, Human
agcccaggucucaaaguacagg

SEQ ID NO: 969386 - RNA, 22 nt, Human
cacagccugcugcacucaagaa

SEQ ID NO: 969387 - RNA, 22 nt, Human
cucaggauauugggcuggagca

SEQ ID NO: 969388 - RNA, 22 nt, Human
augcugugaaaaagaaggcuga

SEQ ID NO: 969389 - RNA, 21 nt, Human
ucuuugcaucaguuguuuucu

SEQ ID NO: 969390 - RNA, 19 nt, Human
ggccaggcugacugugguc

SEQ ID NO: 969391 - RNA, 22 nt, Human
augguacaauguguuuguuagg

SEQ ID NO: 969392 - RNA, 22 nt, Human
caggaaggcccaccuguccugu

SEQ ID NO: 969393 - RNA, 22 nt, Human
gucccagaugucuggaacuccc

SEQ ID NO: 969394 - RNA, 21 nt, Human
agggaaagaaaaugagcuaau

SEQ ID NO: 969395 - RNA, 22 nt, Human
uugauuccuugaaauauccuug

SEQ ID NO: 969396 - RNA, 22 nt, Human
ucucagagaacaguuggugcuu

SEQ ID NO: 969397 - RNA, 22 nt, Human
agcagcuggguccggcggagca

SEQ ID NO: 969398 - RNA, 22 nt, Human
ccaaggcuggagugcaguggcg

SEQ ID NO: 969399 - RNA, 22 nt, Human
ccagggcaauaggaacacuuuu

SEQ ID NO: 969400 - RNA, 22 nt, Human
cagggcccaagacacaaugagg

SEQ ID NO: 969401 - RNA, 22 nt, Human
gcccaggagguggaggugcagu

SEQ ID NO: 969402 - RNA, 22 nt, Human
uagauuucaggcuggcuugcgg

SEQ ID NO: 969403 - RNA, 22 nt, Human
gagccuucaucgcagccuuguu

SEQ ID NO: 969404 - RNA, 22 nt, Human
uauuccuauuucuaaacauaug

SEQ ID NO: 969405 - RNA, 22 nt, Human
cuucaagauauuucuagaauca

SEQ ID NO: 969406 - RNA, 22 nt, Human
ucaaaguccuugcuuuuucugu

SEQ ID NO: 969407 - RNA, 22 nt, Human
aguugaauaauuagacauaucu

SEQ ID NO: 969408 - RNA, 22 nt, Human
acccaggccugagagacaggag

SEQ ID NO: 969409 - RNA, 17 nt, Human
uuaagguggaucagcac

SEQ ID NO: 969410 - RNA, 22 nt, Human
aaaggccacacugcucuuucuc

SEQ ID NO: 969411 - RNA, 21 nt, Human
ugcagccauucagcccuaugc

SEQ ID NO: 969412 - RNA, 22 nt, Human
agauggguaacuggagucugcu

SEQ ID NO: 969413 - RNA, 22 nt, Human
gaaaagagaacaucugaggauc

SEQ ID NO: 969414 - RNA, 22 nt, Human
uggucuuuaagguagcugucau

SEQ ID NO: 969415 - RNA, 22 nt, Human
uuagaaagaacuuuagauauca

SEQ ID NO: 969416 - RNA, 22 nt, Human
ccucuugccaaucagcuacaga

SEQ ID NO: 969417 - RNA, 22 nt, Human
ccaggccucccuuuuccagcca

SEQ ID NO: 969418 - RNA, 21 nt, Human
gauugaaaccauggcagugag

SEQ ID NO: 969419 - RNA, 22 nt, Human
ugaugaauaaacuugagaguca

SEQ ID NO: 969420 - RNA, 22 nt, Human
gcacagggagacagccguggcc

SEQ ID NO: 969421 - RNA, 20 nt, Human
cucuccuugccgacuuggca

SEQ ID NO: 969422 - RNA, 22 nt, Human
aggcucagcugguggugaucgc

SEQ ID NO: 969423 - RNA, 22 nt, Human
aucacgucaugguuugaucugg

SEQ ID NO: 969424 - RNA, 22 nt, Human
ucccagccggugccuggguccc

SEQ ID NO: 969425 - RNA, 22 nt, Human
gcagacaggcccaguggaggga

SEQ ID NO: 969426 - RNA, 18 nt, Human
agcuucccucugagaggg

SEQ ID NO: 969427 - RNA, 22 nt, Human
gcuggccagggcugcucgcgga

SEQ ID NO: 969428 - RNA, 21 nt, Human
ccuccaggugauuccgugcuc

SEQ ID NO: 969429 - RNA, 22 nt, Human
gguagcacauugcauuaggaga

SEQ ID NO: 969430 - RNA, 22 nt, Human
cuggcuccauccuugagcucug

SEQ ID NO: 969431 - RNA, 22 nt, Human
uucagcagugcagacacccagu

SEQ ID NO: 969432 - RNA, 22 nt, Human
auugucgcuuauuuaggugcuu

SEQ ID NO: 969433 - RNA, 19 nt, Human
ccagcagcuuugauucucu

SEQ ID NO: 969434 - RNA, 22 nt, Human
cuugaaagaagggucuuuuaau

SEQ ID NO: 969435 - RNA, 22 nt, Human
aagccagguuccauggaggagc

SEQ ID NO: 969436 - RNA, 22 nt, Human
auaaggaaugauguaucaguuu

SEQ ID NO: 969437 - RNA, 22 nt, Human
uccuggaguauuucuguggugu

SEQ ID NO: 969438 - RNA, 22 nt, Human
agucauaauuauaaacaucagu

SEQ ID NO: 969439 - RNA, 22 nt, Human
ucuggagcuuccucauuuacag

SEQ ID NO: 969440 - RNA, 22 nt, Human
gcaggggcugagcaccagcggg

SEQ ID NO: 969441 - RNA, 22 nt, Human
uggcuggggccugaauccugca

SEQ ID NO: 969442 - RNA, 22 nt, Human
cuggcccagagcucuggccuuu

SEQ ID NO: 969443 - RNA, 22 nt, Human
aggcagcaaagaaaugaugcug

SEQ ID NO: 969444 - RNA, 22 nt, Human
uuugcauuucuaaugagcuccg

SEQ ID NO: 969445 - RNA, 22 nt, Human
acugugugacuguuauuacugu

SEQ ID NO: 969446 - RNA, 22 nt, Human
gagugcaucguggccauuuuaa

SEQ ID NO: 969447 - RNA, 22 nt, Human
acuuccugcuaugagcuucugu

SEQ ID NO: 969448 - RNA, 20 nt, Human
agugucuggugcagggccuc

SEQ ID NO: 969449 - RNA, 22 nt, Human
acagggcagaaauguugcaucu

SEQ ID NO: 969450 - RNA, 22 nt, Human
gauggcagcagcagccagggau

SEQ ID NO: 969451 - RNA, 22 nt, Human
ccugucucuuucaaucugagag

SEQ ID NO: 969452 - RNA, 22 nt, Human
ggcacugaaguggguguugggu

SEQ ID NO: 969453 - RNA, 22 nt, Human
cugcugggucuaugcaagugga

SEQ ID NO: 969454 - RNA, 22 nt, Human
uaaggccaccguuauagaacca

SEQ ID NO: 969455 - RNA, 22 nt, Human
gugucccacucuggaggugaag

SEQ ID NO: 969456 - RNA, 22 nt, Human
agcugguaugaacaggauagga

SEQ ID NO: 969457 - RNA, 22 nt, Human
caaaugcagucccuuuguugcu

SEQ ID NO: 969458 - RNA, 22 nt, Human
augauuuccaguuguugcuaag

SEQ ID NO: 969459 - RNA, 22 nt, Human
ggcuggcacucuguccaguguc

SEQ ID NO: 969460 - RNA, 22 nt, Human
cauggcaggugugggguuuuau

SEQ ID NO: 969461 - RNA, 22 nt, Human
aggagucagauaugggaaaguu

SEQ ID NO: 969462 - RNA, 22 nt, Human
ccuccugggacucauuagcacc

SEQ ID NO: 969463 - RNA, 22 nt, Human
acaaagucaaauugcagccgcc

SEQ ID NO: 969464 - RNA, 22 nt, Human
ugaggcagugugagauaauaaa

SEQ ID NO: 969465 - RNA, 22 nt, Human
auucuuaauugccaugcuguau

SEQ ID NO: 969466 - RNA, 22 nt, Human
caggaggcaucauggagcggac

SEQ ID NO: 969467 - RNA, 22 nt, Human
ucccaggcuaggccucugcguu

SEQ ID NO: 969468 - RNA, 22 nt, Human
aggcaguggcugagaccagggg

SEQ ID NO: 969469 - RNA, 22 nt, Human
cccugcaggggaccugcagccu

SEQ ID NO: 969470 - RNA, 22 nt, Human
uuggcagcagggaguuggccgc

SEQ ID NO: 969471 - RNA, 22 nt, Human
gucuuucuaugaugaacuguug

SEQ ID NO: 969472 - RNA, 22 nt, Human
cccagcccccgagugucuggaa

SEQ ID NO: 969473 - RNA, 22 nt, Human
agauacauuguucuaagcauug

SEQ ID NO: 969474 - RNA, 22 nt, Human
uaucuaaauggaauauuccaga

SEQ ID NO: 969475 - RNA, 22 nt, Human
gaaggaggcguuagcccuagga

SEQ ID NO: 969476 - RNA, 22 nt, Human
auggacaggcugagcuuccuca

SEQ ID NO: 969477 - RNA, 22 nt, Human
uuguuucugaguuuucauguau

SEQ ID NO: 969478 - RNA, 22 nt, Human
uucuuugaguuaguacagucca

SEQ ID NO: 969479 - RNA, 22 nt, Human
agagggauggccccguaacuca

SEQ ID NO: 969480 - RNA, 22 nt, Human
gcuggccugucuagagccuuac

SEQ ID NO: 969481 - RNA, 22 nt, Human
aaggcagcucagcucauggcag

SEQ ID NO: 969482 - RNA, 22 nt, Human
ugagagugaaaugucacauguc

SEQ ID NO: 969483 - RNA, 22 nt, Human
uuugucuuauccaaucucucag

SEQ ID NO: 969484 - RNA, 22 nt, Human
cuccucaguugucccauggaga

SEQ ID NO: 969485 - RNA, 22 nt, Human
uucuccuuuguaauucucaucc

SEQ ID NO: 969486 - RNA, 22 nt, Human
cuccagggcagcauggcagugg

SEQ ID NO: 969487 - RNA, 22 nt, Human
ugaagcaggguggccagauugu

SEQ ID NO: 969488 - RNA, 20 nt, Human
uuucuguaaggcauuaaucu

SEQ ID NO: 969489 - RNA, 22 nt, Human
uuucauuuugguuaugccauaa

SEQ ID NO: 969490 - RNA, 22 nt, Human
gccaggagaaaaggcgaaugau

SEQ ID NO: 969491 - RNA, 22 nt, Human
cugucuguuucugauucaaccu

SEQ ID NO: 969492 - RNA, 22 nt, Human
caacccaagguuaguuggucuu

SEQ ID NO: 969493 - RNA, 19 nt, Human
ugcuagaaauucugugacu

SEQ ID NO: 969494 - RNA, 23 nt, Human
cccagcagagaugaggagggguc

SEQ ID NO: 969495 - RNA, 22 nt, Human
gcuggcagggacagcugcgugu

SEQ ID NO: 969496 - RNA, 22 nt, Human
uauauagaaaagcagauguugg

SEQ ID NO: 969497 - RNA, 22 nt, Human
ggcagggaggaggugaaaguga

SEQ ID NO: 969498 - RNA, 22 nt, Human
cagcucugcugggaggaugcag

SEQ ID NO: 969499 - RNA, 22 nt, Human
gauggcacacagacauccccgc

SEQ ID NO: 969500 - RNA, 22 nt, Human
aacaaaugaccugauuucuucc

SEQ ID NO: 969501 - RNA, 22 nt, Human
aaauacauaaagguuguaccag

SEQ ID NO: 969502 - RNA, 22 nt, Human
cugaggaugguguggucuucuc

SEQ ID NO: 969503 - RNA, 23 nt, Human
ucuccuccuagauacagucaugg

SEQ ID NO: 969504 - RNA, 22 nt, Human
ccaugagcuuccuauauagggu

SEQ ID NO: 969505 - RNA, 22 nt, Human
uucuuuucuuuaggcauugugu

SEQ ID NO: 969506 - RNA, 22 nt, Human
cucuucuugaaagaggaauuca

SEQ ID NO: 969507 - RNA, 20 nt, Human
agcuggccuguccuaggccu

SEQ ID NO: 969508 - RNA, 22 nt, Human
caaugguggugucagaagagau

SEQ ID NO: 969509 - RNA, 22 nt, Human
gagagugauucccucccauaga

SEQ ID NO: 969510 - RNA, 22 nt, Human
cugccugggccggccacccucu

SEQ ID NO: 969511 - RNA, 22 nt, Human
agcaggugacccaagcaggcug

SEQ ID NO: 969512 - RNA, 22 nt, Human
uuucaugaggggcaaaaucuca

SEQ ID NO: 969513 - RNA, 22 nt, Human
ugccagaagauucucuaucaga

SEQ ID NO: 969514 - RNA, 22 nt, Human
uaagauaaguggguugagaugg

SEQ ID NO: 969515 - RNA, 22 nt, Human
cugcagugaaaucaggaagcaa

SEQ ID NO: 969516 - RNA, 22 nt, Human
aagcugccacacggugaguacu

SEQ ID NO: 969517 - RNA, 22 nt, Human
uucuuucccuuccagcagcucc

SEQ ID NO: 969518 - RNA, 22 nt, Human
cauguacauucuguagauggag

SEQ ID NO: 969519 - RNA, 22 nt, Human
aagucauuaucucuucuaaucu

SEQ ID NO: 969520 - RNA, 22 nt, Human
cuggcagcccaaccuagagucu

SEQ ID NO: 969521 - RNA, 22 nt, Human
agguacagggugaaaguuuaug

SEQ ID NO: 969522 - RNA, 22 nt, Human
cauuguauugaggauacuuaag

SEQ ID NO: 969523 - RNA, 22 nt, Human
uuguuucaugaguguaaaggga

SEQ ID NO: 969524 - RNA, 21 nt, Human
gagcucucaggcaagaagcag

SEQ ID NO: 969525 - RNA, 22 nt, Human
cauuuguaguaucuguuuauau

SEQ ID NO: 969526 - RNA, 22 nt, Human
cccaggaaaugaacuucugauu

SEQ ID NO: 969527 - RNA, 22 nt, Human
uuaguaggagagcuuguucauu

SEQ ID NO: 969528 - RNA, 22 nt, Human
agccagcugugggcucaggcgg

SEQ ID NO: 969529 - RNA, 22 nt, Human
uggaaagaugaagauguuuaag

SEQ ID NO: 969530 - RNA, 22 nt, Human
ugcugcacaauuggaaaguauc

SEQ ID NO: 969531 - RNA, 22 nt, Human
ggaggccaucagggagggcauu

SEQ ID NO: 969532 - RNA, 22 nt, Human
uacauucaacaugucacuaugu

SEQ ID NO: 969533 - RNA, 22 nt, Human
caaaugcauaguuuauaagaag

SEQ ID NO: 969534 - RNA, 22 nt, Human
gggugggaucuguggagccuca

SEQ ID NO: 969535 - RNA, 22 nt, Human
gguggagcuggaccaggagagg

SEQ ID NO: 969536 - RNA, 22 nt, Human
uuuauauagagauuugugcaug

SEQ ID NO: 969537 - RNA, 22 nt, Human
uugucuguccaggcaccccaag

SEQ ID NO: 969538 - RNA, 22 nt, Human
uugauacauuuuuaggauaaac

SEQ ID NO: 969539 - RNA, 22 nt, Human
uggcuguguuaccacuucaugu

SEQ ID NO: 969540 - RNA, 22 nt, Human
cuagcaucagaugagaagcugu

SEQ ID NO: 969541 - RNA, 22 nt, Human
augcuuuuccaggagaaauaua

SEQ ID NO: 969542 - RNA, 22 nt, Human
uucaagaugucuucacaauagu

SEQ ID NO: 969543 - RNA, 23 nt, Human
auauuagggagauuagcccucua

SEQ ID NO: 969544 - RNA, 22 nt, Human
aauugcuaaagauuauguuuuc

SEQ ID NO: 969545 - RNA, 23 nt, Human
ugcugggguaguuuguggcacag

SEQ ID NO: 969546 - RNA, 22 nt, Human
aaagcagcagcaccugcauuuc

SEQ ID NO: 969547 - RNA, 22 nt, Human
cagcuccccaugguuccugaag

SEQ ID NO: 969548 - RNA, 22 nt, Human
cagaagccugccucagaugcac

SEQ ID NO: 969549 - RNA, 22 nt, Human
cucacagguaccagcacccucc

SEQ ID NO: 969550 - RNA, 22 nt, Human
uggcugcuuguuuuagugaggc

SEQ ID NO: 969551 - RNA, 22 nt, Human
ugucccaguuuaucugggacug

SEQ ID NO: 969552 - RNA, 17 nt, Human
agguggguggaucaccu

SEQ ID NO: 969553 - RNA, 22 nt, Human
cacagcuaggaggaaagcagag

SEQ ID NO: 969554 - RNA, 22 nt, Human
aaguucaaguguaaucuuuauu

SEQ ID NO: 969555 - RNA, 22 nt, Human
aagggaggccagagguuuugca

SEQ ID NO: 969556 - RNA, 22 nt, Human
aaauuguugaucuacaguaagg

SEQ ID NO: 969557 - RNA, 22 nt, Human
ggcaugcucuuuguccacagua

SEQ ID NO: 969558 - RNA, 23 nt, Human
acagcaagaggaccagaugugag

SEQ ID NO: 969559 - RNA, 22 nt, Human
auuauucuuaugucaucauggc

SEQ ID NO: 969560 - RNA, 22 nt, Human
guauuugauagauuucaaagga

SEQ ID NO: 969561 - RNA, 22 nt, Human
gccuuugccugcgacguggcug

SEQ ID NO: 969562 - RNA, 22 nt, Human
acagcaugucuaguuaaauacu

SEQ ID NO: 969563 - RNA, 22 nt, Human
cacucugcagcugaagggcugg

SEQ ID NO: 969564 - RNA, 22 nt, Human
ugggugcuucgucagcucugag

SEQ ID NO: 969565 - RNA, 22 nt, Human
uuucauaugggcauuggcaaua

SEQ ID NO: 969566 - RNA, 22 nt, Human
ggaggccaaggagggcggauca

SEQ ID NO: 969567 - RNA, 22 nt, Human
aaagauuucacaucccaagccu

SEQ ID NO: 969568 - RNA, 22 nt, Human
ucuggcugcugcgugagugcuu

SEQ ID NO: 969569 - RNA, 22 nt, Human
uuauguacucugcaauguuuga

SEQ ID NO: 969570 - RNA, 22 nt, Human
gcuggccagcccucuuccucca

SEQ ID NO: 969571 - RNA, 22 nt, Human
aaggcaguacuuuauguccaua

SEQ ID NO: 969572 - RNA, 22 nt, Human
gcugagagcaaagcaugucuag

SEQ ID NO: 969573 - RNA, 23 nt, Human
cacaccaggagccgucugggcca

SEQ ID NO: 969574 - RNA, 22 nt, Human
uaaauacuuuuacuccacugau

SEQ ID NO: 969575 - RNA, 22 nt, Human
gucagaggaauggaugagugau

SEQ ID NO: 969576 - RNA, 17 nt, Human
agauggcaggaggcaga

SEQ ID NO: 969577 - RNA, 22 nt, Human
ggacacaagcuccggggcugca

SEQ ID NO: 969578 - RNA, 22 nt, Human
uggcugcucaagggaggaggcu

SEQ ID NO: 969579 - RNA, 19 nt, Human
ucauaaaaaugguaaccca

SEQ ID NO: 969580 - RNA, 17 nt, Human
auuagguuuugucauga

SEQ ID NO: 969581 - RNA, 19 nt, Human
aauacaguguuauagaauu

SEQ ID NO: 969582 - RNA, 22 nt, Human
aagcagcauaauugcuauuuua

SEQ ID NO: 969583 - RNA, 22 nt, Human
uucuguaagggauuuauucuga

SEQ ID NO: 969584 - RNA, 22 nt, Human
cagacaggcuagccagacucac

SEQ ID NO: 969585 - RNA, 22 nt, Human
uacagaguggugagaucuuuug

SEQ ID NO: 969586 - RNA, 22 nt, Human
uacaaaguauauuucuagcugu

SEQ ID NO: 969587 - RNA, 22 nt, Human
gccuggagacagcagaggcggc

SEQ ID NO: 969588 - RNA, 22 nt, Human
cucagcuggcaauucuggcucc

SEQ ID NO: 969589 - RNA, 21 nt, Human
gagacagcccagugccagggc

SEQ ID NO: 969590 - RNA, 22 nt, Human
aggccuggguguucaccagaag

SEQ ID NO: 969591 - RNA, 22 nt, Human
agcagacauaucucaugucaca

SEQ ID NO: 969592 - RNA, 22 nt, Human
aaguuaugaaauuuggacagcu

SEQ ID NO: 969593 - RNA, 22 nt, Human
acauucuagaagucuuugcaau

SEQ ID NO: 969594 - RNA, 22 nt, Human
aaguaugacauuuaagacaauu

SEQ ID NO: 969595 - RNA, 21 nt, Human
agaaauguaucauucuuuucc

SEQ ID NO: 969596 - RNA, 21 nt, Human
ucccagggccaggugccauca

SEQ ID NO: 969597 - RNA, 22 nt, Human
aacuagaaccacuuguauuucc

SEQ ID NO: 969598 - RNA, 22 nt, Human
cugucagguuggucucagagcu

SEQ ID NO: 969599 - RNA, 22 nt, Human
gaugaagccugacuucucggug

SEQ ID NO: 969600 - RNA, 22 nt, Human
gagcagaacuacucacauaucg

SEQ ID NO: 969601 - RNA, 22 nt, Human
aaggcacucagccuugggacag

SEQ ID NO: 969602 - RNA, 22 nt, Human
uggcucagucauggaugaguaa

SEQ ID NO: 969603 - RNA, 22 nt, Human
ggagcagcuugcaugcucaggg

SEQ ID NO: 969604 - RNA, 22 nt, Human
aagagcuggauugugcugcaga

SEQ ID NO: 969605 - RNA, 22 nt, Human
agggcagcagcccauggcucug

SEQ ID NO: 969606 - RNA, 22 nt, Human
uucuuuaaaauagugagaaaga

SEQ ID NO: 969607 - RNA, 22 nt, Human
cuggcucacuagcccugcccug

SEQ ID NO: 969608 - RNA, 18 nt, Human
gaggauggaaggagaugc

SEQ ID NO: 969609 - RNA, 19 nt, Human
uccaggaggcugccauuga

SEQ ID NO: 969610 - RNA, 23 nt, Human
acugcuuuauucaugaggcucuc

SEQ ID NO: 969611 - RNA, 22 nt, Human
cagaggccuauccaguguccau

SEQ ID NO: 969612 - RNA, 22 nt, Human
uaauguauaacaaauacucauc

SEQ ID NO: 969613 - RNA, 22 nt, Human
gaaaauguuuccuguuauuugc

SEQ ID NO: 969614 - RNA, 22 nt, Human
cucugaagggagggccaagccc

SEQ ID NO: 969615 - RNA, 22 nt, Human
gcuggcaccugcaccaagcagg

SEQ ID NO: 969616 - RNA, 22 nt, Human
gccuggcucugagggagcuccu

SEQ ID NO: 969617 - RNA, 22 nt, Human
acugaaggguaaugugggagcc

SEQ ID NO: 969618 - RNA, 22 nt, Human
caggcaggucagugaagaagga

SEQ ID NO: 969619 - RNA, 22 nt, Human
agaaaucaauaucuauauguug

SEQ ID NO: 969620 - RNA, 19 nt, Human
ucaaagcaagcauguucug

SEQ ID NO: 969621 - RNA, 22 nt, Human
agaagccaauucugugugaguc

SEQ ID NO: 969622 - RNA, 23 nt, Human
ugucacauuuaguuggcauuguu

SEQ ID NO: 969623 - RNA, 22 nt, Human
auaaauaucacuguugucccuc

SEQ ID NO: 969624 - RNA, 22 nt, Human
uggcagaaguucacuaguagcu

SEQ ID NO: 969625 - RNA, 22 nt, Human
ugagccaggcacugcuccugga

SEQ ID NO: 969626 - RNA, 20 nt, Human
gcuuccuucccagcccccac

SEQ ID NO: 969627 - RNA, 22 nt, Human
caguacuuauuucuauuuaggg

SEQ ID NO: 969628 - RNA, 22 nt, Human
aauuaggaaaugagaguauuug

SEQ ID NO: 969629 - RNA, 22 nt, Human
uuugcauaggauggacauuuua

SEQ ID NO: 969630 - RNA, 22 nt, Human
gagcaggcuugcagagaagggg

SEQ ID NO: 969631 - RNA, 22 nt, Human
aucauaaaccacuuuguaaucu

SEQ ID NO: 969632 - RNA, 22 nt, Human
cagagccagcccacuguucccg

SEQ ID NO: 969633 - RNA, 22 nt, Human
aaugcacauauauguguauaca

SEQ ID NO: 969634 - RNA, 22 nt, Human
ggccucugguucacagggagga

SEQ ID NO: 969635 - RNA, 22 nt, Human
ucagagccccuccgcuguccca

SEQ ID NO: 969636 - RNA, 22 nt, Human
ggucccugaagaggccuggggu

SEQ ID NO: 969637 - RNA, 22 nt, Human
gagcagaugugugccaggaugc

SEQ ID NO: 969638 - RNA, 23 nt, Human
ccagugauugccuggaaggaggu

SEQ ID NO: 969639 - RNA, 22 nt, Human
ugucccaguuggguauugaauu

SEQ ID NO: 969640 - RNA, 22 nt, Human
gguggcagcgucuaucugacau

SEQ ID NO: 969641 - RNA, 22 nt, Human
ccuggcagguggagguugcagu

SEQ ID NO: 969642 - RNA, 22 nt, Human
gaaggaggugucaguuggacug

SEQ ID NO: 969643 - RNA, 22 nt, Human
aggcuccuugcucacaggcuca

SEQ ID NO: 969644 - RNA, 22 nt, Human
guuccaaacaagucauaaagua

SEQ ID NO: 969645 - RNA, 22 nt, Human
agcuacccgaggacaggcuaag

SEQ ID NO: 969646 - RNA, 22 nt, Human
uguuuauugagugccuacuaua

SEQ ID NO: 969647 - RNA, 22 nt, Human
aaggagcucccggcagaccagg

SEQ ID NO: 969648 - RNA, 22 nt, Human
aggacagaccuaggacuggagc

SEQ ID NO: 969649 - RNA, 22 nt, Human
ggugcuucugggcauagcagga

SEQ ID NO: 969650 - RNA, 22 nt, Human
aggccuguuccuuccugggcac

SEQ ID NO: 969651 - RNA, 22 nt, Human
gcgaaaaauguguaaauauguu

SEQ ID NO: 969652 - RNA, 22 nt, Human
ccugccagucacuaugucaccu

SEQ ID NO: 969653 - RNA, 22 nt, Human
gaggccuggaauuccagccugg

SEQ ID NO: 969654 - RNA, 22 nt, Human
caguaugagaguugaaucaagg

SEQ ID NO: 969655 - RNA, 22 nt, Human
ggcacugagcgggcucugagcg

SEQ ID NO: 969656 - RNA, 22 nt, Human
gcucugcuggaaguucucugga

SEQ ID NO: 969657 - RNA, 22 nt, Human
gcugucuucacuuccugguuuc

SEQ ID NO: 969658 - RNA, 22 nt, Human
gagggaaggacccauuuuaagu

SEQ ID NO: 969659 - RNA, 22 nt, Human
gaaaugugugacaaguuucaau

SEQ ID NO: 969660 - RNA, 22 nt, Human
gcaaggcagcgcggaguagcua

SEQ ID NO: 969661 - RNA, 22 nt, Human
gaggccaaucaauagggcaaua

SEQ ID NO: 969662 - RNA, 22 nt, Human
uuaugggagcaauuggggaggu

SEQ ID NO: 969663 - RNA, 22 nt, Human
caggcccugggcaggaucagcc

SEQ ID NO: 969664 - RNA, 22 nt, Human
cagcuggcugcaugaugccaaa

SEQ ID NO: 969665 - RNA, 19 nt, Human
ucuaagccucaauguuuuc

SEQ ID NO: 969666 - RNA, 22 nt, Human
uucagcaaacacgaugcuuguu

SEQ ID NO: 969667 - RNA, 22 nt, Human
ccugcagagccacgugccagcg

SEQ ID NO: 969668 - RNA, 22 nt, Human
uucagaaagugaaucuuguuau

SEQ ID NO: 969669 - RNA, 22 nt, Human
gccagggaacccaagggccuca

SEQ ID NO: 969670 - RNA, 22 nt, Human
cuccuuccugccccagugauaa

SEQ ID NO: 969671 - RNA, 22 nt, Human
uucaaugaggauagaacuggau

SEQ ID NO: 969672 - RNA, 22 nt, Human
acccaggauaaucuguguaucu

SEQ ID NO: 969673 - RNA, 22 nt, Human
acucagaagauauaaugacuca

SEQ ID NO: 969674 - RNA, 22 nt, Human
aagauuauuuaagacaggaacc

SEQ ID NO: 969675 - RNA, 22 nt, Human
agagcuguucagcagccagguu

SEQ ID NO: 969676 - RNA, 19 nt, Human
gagcccucuccauggccac

SEQ ID NO: 969677 - RNA, 21 nt, Human
uaacuuuugugccuaucuugu

SEQ ID NO: 969678 - RNA, 22 nt, Human
uucauucauuacgugccaggca

SEQ ID NO: 969679 - RNA, 22 nt, Human
gauuucuaguucauuaucuauu

SEQ ID NO: 969680 - RNA, 22 nt, Human
cccagggaaugacucuggccuu

SEQ ID NO: 969681 - RNA, 22 nt, Human
uccucuggcccagcugccucug

SEQ ID NO: 969682 - RNA, 22 nt, Human
gcuucucucucagacugcaagc

SEQ ID NO: 969683 - RNA, 22 nt, Human
uggcacugcacuuuaagauuua

SEQ ID NO: 969684 - RNA, 19 nt, Human
uuagaaacuguugacacug

SEQ ID NO: 969685 - RNA, 22 nt, Human
aggagccaguuccaccccagga

SEQ ID NO: 969686 - RNA, 22 nt, Human
ugcagugccucggcagugcagc

SEQ ID NO: 969687 - RNA, 22 nt, Human
gggaugucacugugccuggcac

SEQ ID NO: 969688 - RNA, 22 nt, Human
agagccagagaccuggguucac

SEQ ID NO: 969689 - RNA, 22 nt, Human
cugcagagcuaggcugagugaa

SEQ ID NO: 969690 - RNA, 20 nt, Human
ugcuguaagauuagagagcu

SEQ ID NO: 969691 - RNA, 21 nt, Human
aagcaggacauaugaugcccu

SEQ ID NO: 969692 - RNA, 22 nt, Human
acuguucauuuggauuucucug

SEQ ID NO: 969693 - RNA, 22 nt, Human
ucuuuguaaaugccuagcauaa

SEQ ID NO: 969694 - RNA, 20 nt, Human
uggagcuccagcguccaugu

SEQ ID NO: 969695 - RNA, 22 nt, Human
auuccaggcagaccagagagau

SEQ ID NO: 969696 - RNA, 22 nt, Human
gcaucuaaauaaacgugggagu

SEQ ID NO: 969697 - RNA, 22 nt, Human
aaagauuauggcauugaaauac

SEQ ID NO: 969698 - RNA, 22 nt, Human
aaggacagaaacagauugcugg

SEQ ID NO: 969699 - RNA, 22 nt, Human
gugcauugcgaugcagacgacc

SEQ ID NO: 969700 - RNA, 22 nt, Human
uccuuucccuuuccauccuggc

SEQ ID NO: 969701 - RNA, 23 nt, Human
cccuggccuuggggcacaggcug

SEQ ID NO: 969702 - RNA, 23 nt, Human
uuucuucagaagccuugcgaggc

SEQ ID NO: 969703 - RNA, 20 nt, Human
agagaauucccuuuggagau

SEQ ID NO: 969704 - RNA, 22 nt, Human
acacauuuaaaaaggaacauau

SEQ ID NO: 969705 - RNA, 23 nt, Human
cccagcgcugagcccugcaggca

SEQ ID NO: 969706 - RNA, 22 nt, Human
aagaauguucauuaaacuguug

SEQ ID NO: 969707 - RNA, 22 nt, Human
gacuguguccaugugcuggauu

SEQ ID NO: 969708 - RNA, 23 nt, Human
ggcuggcccggggcugcuccuga

SEQ ID NO: 969709 - RNA, 22 nt, Human
uugaaucuauguauucagugua

SEQ ID NO: 969710 - RNA, 22 nt, Human
cagggacauugguggccagguu

SEQ ID NO: 969711 - RNA, 22 nt, Human
aauaaaaugaacugguagaguu

SEQ ID NO: 969712 - RNA, 22 nt, Human
ccugucugagccagggugggca

SEQ ID NO: 969713 - RNA, 22 nt, Human
ccugggcaggaugggcccggug

SEQ ID NO: 969714 - RNA, 22 nt, Human
gcccugucccuuggcuucuagg

SEQ ID NO: 969715 - RNA, 22 nt, Human
ucugccucgcuaacagcagcca

SEQ ID NO: 969716 - RNA, 22 nt, Human
cugagcuuccaguuccuccagg

SEQ ID NO: 969717 - RNA, 22 nt, Human
cucagccugugaagagcagagg

SEQ ID NO: 969718 - RNA, 22 nt, Human
gcaggcaggagcccaacugccu

SEQ ID NO: 969719 - RNA, 22 nt, Human
ggcagauggagaagcagcaggu

SEQ ID NO: 969720 - RNA, 22 nt, Human
ucccagaggucucugcugguuc

SEQ ID NO: 969721 - RNA, 22 nt, Human
ugcucccaggcauucucuguug

SEQ ID NO: 969722 - RNA, 22 nt, Human
ugcugccuugaccuccugggcu

SEQ ID NO: 969723 - RNA, 22 nt, Human
ugccugccaugcagaaagcuga

SEQ ID NO: 969724 - RNA, 22 nt, Human
agacuuugagcucuuagagaag

SEQ ID NO: 969725 - RNA, 22 nt, Human
ggaaggaggggcaaagcaguuc

SEQ ID NO: 969726 - RNA, 22 nt, Human
ugccugucuucaggagugucac

SEQ ID NO: 969727 - RNA, 22 nt, Human
auucucuuuguauaacaucuug

SEQ ID NO: 969728 - RNA, 22 nt, Human
aucaggaucagggcuagcagag

SEQ ID NO: 969729 - RNA, 22 nt, Human
aaaugcuucaccucauuaaacu

SEQ ID NO: 969730 - RNA, 22 nt, Human
cuuuagugguauuuuagcaagu

SEQ ID NO: 969731 - RNA, 20 nt, Human
cucugcugcccgccggcugc

SEQ ID NO: 969732 - RNA, 22 nt, Human
aagcaugugcuggggcuuuuug

SEQ ID NO: 969733 - RNA, 22 nt, Human
ugagcuucaaaauaugugaauc

SEQ ID NO: 969734 - RNA, 22 nt, Human
agugucauaugccacugcaucc

SEQ ID NO: 969735 - RNA, 22 nt, Human
gcacagggcccugugcguaggu

SEQ ID NO: 969736 - RNA, 22 nt, Human
uuauuauugugaccugagaaug

SEQ ID NO: 969737 - RNA, 22 nt, Human
agagccuggacuuuucugagcc

SEQ ID NO: 969738 - RNA, 22 nt, Human
uugcauugugauuacagaggug

SEQ ID NO: 969739 - RNA, 22 nt, Human
agccauugaguuuuaugugcua

SEQ ID NO: 969740 - RNA, 22 nt, Human
gcagcuguggguuccaagucua

SEQ ID NO: 969741 - RNA, 22 nt, Human
aaguaaauguuggagcucaaau

SEQ ID NO: 969742 - RNA, 23 nt, Human
aaaguguagccagguuaagaacc

SEQ ID NO: 969743 - RNA, 22 nt, Human
gcaggagcugcucuccugacga

SEQ ID NO: 969744 - RNA, 22 nt, Human
ugcagaaguauuccaggcccca

SEQ ID NO: 969745 - RNA, 22 nt, Human
agguaaaauagauaguauuucu

SEQ ID NO: 969746 - RNA, 22 nt, Human
acaaacagcuaacauauguuaa

SEQ ID NO: 969747 - RNA, 22 nt, Human
aggcuggguaccugucauaugc

SEQ ID NO: 969748 - RNA, 22 nt, Human
acuggccaggcgaaccacacug

SEQ ID NO: 969749 - RNA, 22 nt, Human
aaggcagcuucaccacagcauu

SEQ ID NO: 969750 - RNA, 22 nt, Human
uugaacauuggcaauuucauau

SEQ ID NO: 969751 - RNA, 22 nt, Human
aacaugaagguaggaugguuuu

SEQ ID NO: 969752 - RNA, 22 nt, Human
cugggacuuuacccuguggccc

SEQ ID NO: 969753 - RNA, 22 nt, Human
ugagccagucugucugggugaa

SEQ ID NO: 969754 - RNA, 22 nt, Human
gcaggcagucaucuuucauauu

SEQ ID NO: 969755 - RNA, 21 nt, Human
guauucuuuaugaagugaaaa

SEQ ID NO: 969756 - RNA, 22 nt, Human
agcaugcugguguucauggcag

SEQ ID NO: 969757 - RNA, 22 nt, Human
cugcucugagaggcucuuccua

SEQ ID NO: 969758 - RNA, 22 nt, Human
ggcagcuuccugagccagcagc

SEQ ID NO: 969759 - RNA, 22 nt, Human
uggcucaguaaucgagucuccu

SEQ ID NO: 969760 - RNA, 22 nt, Human
agccauggcgccacuagaggga

SEQ ID NO: 969761 - RNA, 22 nt, Human
agaagcuuccuacauuguucuu

SEQ ID NO: 969762 - RNA, 22 nt, Human
agugugcugcuuaaacaguugu

SEQ ID NO: 969763 - RNA, 22 nt, Human
gcagccacuaguuuuccuguuu

SEQ ID NO: 969764 - RNA, 22 nt, Human
caggcacugugcuagauccuug

SEQ ID NO: 969765 - RNA, 22 nt, Human
aaugcacaugucuuggccucac

SEQ ID NO: 969766 - RNA, 22 nt, Human
agggugccuggaagccacucac

SEQ ID NO: 969767 - RNA, 22 nt, Human
caugcaggcccgccugaauggg

SEQ ID NO: 969768 - RNA, 22 nt, Human
uagugcuuggcccuaccagaua

SEQ ID NO: 969769 - RNA, 22 nt, Human
uacaaaugaccauagccacuua

SEQ ID NO: 969770 - RNA, 22 nt, Human
ucagccuggcaggauggccugg

SEQ ID NO: 969771 - RNA, 22 nt, Human
uccagggacacagaguccuucu

SEQ ID NO: 969772 - RNA, 22 nt, Human
acagggccauuaucuguucuag

SEQ ID NO: 969773 - RNA, 23 nt, Human
ccacuagcaccuguucaacuucu

SEQ ID NO: 969774 - RNA, 22 nt, Human
uuucuagaggcuccaggggagu

SEQ ID NO: 969775 - RNA, 22 nt, Human
uuucaguucaguuuauuauauc

SEQ ID NO: 969776 - RNA, 22 nt, Human
gcugucugucucugugacuuaa

SEQ ID NO: 969777 - RNA, 22 nt, Human
uguguuuugaacucaucuacug

SEQ ID NO: 969778 - RNA, 22 nt, Human
agccaagcacucaacuccugga

SEQ ID NO: 969779 - RNA, 22 nt, Human
ccugugccagcugggcccugcc

SEQ ID NO: 969780 - RNA, 22 nt, Human
aaggccuggauuuagguuguga

SEQ ID NO: 969781 - RNA, 22 nt, Human
acagagguguuccagaccuagg

SEQ ID NO: 969782 - RNA, 22 nt, Human
uucuucuuuaucucaguauccu

SEQ ID NO: 969783 - RNA, 22 nt, Human
gcuguauuuauuuucuaggguu

SEQ ID NO: 969784 - RNA, 22 nt, Human
cagggccaccguguuugcugcu

SEQ ID NO: 969785 - RNA, 21 nt, Human
acagaugggaugagcacacug

SEQ ID NO: 969786 - RNA, 19 nt, Human
uucacaauuaugaaauuag

SEQ ID NO: 969787 - RNA, 22 nt, Human
uaugaagauauaucugaucucu

SEQ ID NO: 969788 - RNA, 22 nt, Human
uuucaucuuccuuggcauaggu

SEQ ID NO: 969789 - RNA, 22 nt, Human
cuucucucugcauaggcauggg

SEQ ID NO: 969790 - RNA, 22 nt, Human
gaaguucaggugggaauugagc

SEQ ID NO: 969791 - RNA, 22 nt, Human
guaucuuucccaccaaucacaa

SEQ ID NO: 969792 - RNA, 22 nt, Human
aggucauuacaauuaucauuuu

SEQ ID NO: 969793 - RNA, 17 nt, Human
uagcugccccgaaugcu

SEQ ID NO: 969794 - RNA, 22 nt, Human
gucaggauuuuaaaaucccagu

SEQ ID NO: 969795 - RNA, 22 nt, Human
cucuuucaguucugauagucuc

SEQ ID NO: 969796 - RNA, 21 nt, Human
ggccuuggcgggggccgaauu

SEQ ID NO: 969797 - RNA, 22 nt, Human
cauugcacucuggcuggaacgg

SEQ ID NO: 969798 - RNA, 20 nt, Human
gauuucaaagcagaguggcc

SEQ ID NO: 969799 - RNA, 22 nt, Human
ucacugcagacaaccucaguca

SEQ ID NO: 969800 - RNA, 22 nt, Human
guuauugcaguauagaggucua

SEQ ID NO: 969801 - RNA, 22 nt, Human
cauacuuugggauaagagugga

SEQ ID NO: 969802 - RNA, 22 nt, Human
agggaaggaaaagcugucgcuu

SEQ ID NO: 969803 - RNA, 22 nt, Human
uaugaaaagguggccaauguag

SEQ ID NO: 969804 - RNA, 22 nt, Human
ugcugccucagcuuccugggcu

SEQ ID NO: 969805 - RNA, 22 nt, Human
aacucagucauaaagcgaaugc

SEQ ID NO: 969806 - RNA, 18 nt, Human
ccuggagcuccacagcaa

SEQ ID NO: 969807 - RNA, 22 nt, Human
aggcccugggagcagagaugca

SEQ ID NO: 969808 - RNA, 22 nt, Human
cugcucaguaauaguccuaucu

SEQ ID NO: 969809 - RNA, 22 nt, Human
gcagcuggacccacacggcuua

SEQ ID NO: 969810 - RNA, 22 nt, Human
cuucccugauaagagccucaga

SEQ ID NO: 969811 - RNA, 22 nt, Human
cuggccugagcacagcggcugc

SEQ ID NO: 969812 - RNA, 22 nt, Human
ugggaaauguguuucuggacca

SEQ ID NO: 969813 - RNA, 22 nt, Human
gccuggagaggaagccggugga

SEQ ID NO: 969814 - RNA, 22 nt, Human
gccagagccggcuucacaggau

SEQ ID NO: 969815 - RNA, 22 nt, Human
cugcagcuccccugagaucaag

SEQ ID NO: 969816 - RNA, 22 nt, Human
ccaaggaguagagcaggaagcu

SEQ ID NO: 969817 - RNA, 22 nt, Human
cacugagaggucucauuuccaa

SEQ ID NO: 969818 - RNA, 22 nt, Human
aauaugugagguauguucagug

SEQ ID NO: 969819 - RNA, 22 nt, Human
caggagaucuuaggaauucuua

SEQ ID NO: 969820 - RNA, 21 nt, Human
uacagaaugcgcuucagucug

SEQ ID NO: 969821 - RNA, 22 nt, Human
ggucccagaauugguuagcaca

SEQ ID NO: 969822 - RNA, 21 nt, Human
acagcagggcuggcaugacag

SEQ ID NO: 969823 - RNA, 22 nt, Human
ucucagucuuugcaaggaugcu

SEQ ID NO: 969824 - RNA, 22 nt, Human
acuuggagagcauugcugggga

SEQ ID NO: 969825 - RNA, 22 nt, Human
caacugcugacaccaucacucc

SEQ ID NO: 969826 - RNA, 22 nt, Human
aauucuuguuguuaguauauuu

SEQ ID NO: 969827 - RNA, 22 nt, Human
agggaagcccuggcugagaccc

SEQ ID NO: 969828 - RNA, 22 nt, Human
augaaacaguguguauagcaaa

SEQ ID NO: 969829 - RNA, 22 nt, Human
auaaaaguuuccaaucaugccu

SEQ ID NO: 969830 - RNA, 22 nt, Human
acagauugaucuugagaauuau

SEQ ID NO: 969831 - RNA, 19 nt, Human
agcauuuggaauucuacac

SEQ ID NO: 969832 - RNA, 22 nt, Human
caaaguccuagaacagugcuug

SEQ ID NO: 969833 - RNA, 21 nt, Human
ugaaaugagaaugcugagcac

SEQ ID NO: 969834 - RNA, 23 nt, Human
ugggccuggccucccaguccagc

SEQ ID NO: 969835 - RNA, 22 nt, Human
accaguccgcggagcuccgggg

SEQ ID NO: 969836 - RNA, 22 nt, Human
ugccuaggaaaccucaugcuuc

SEQ ID NO: 969837 - RNA, 22 nt, Human
cccaugccuucugacucacagg

SEQ ID NO: 969838 - RNA, 22 nt, Human
uucacagaauggcaaguuaugg

SEQ ID NO: 969839 - RNA, 22 nt, Human
aaggagagagcuuugcuggaac

SEQ ID NO: 969840 - RNA, 19 nt, Human
acugccugaggcucacagg

SEQ ID NO: 969841 - RNA, 15 nt, Human
caggagaggaagguu

SEQ ID NO: 969842 - RNA, 19 nt, Human
uccuccuuacuuccucuug

SEQ ID NO: 969843 - RNA, 22 nt, Human
ugagggcugcuuccagagcuag

SEQ ID NO: 969844 - RNA, 22 nt, Human
gggagggaagguaccuguguga

SEQ ID NO: 969845 - RNA, 22 nt, Human
gcucaggaaauaguuuaguguu

SEQ ID NO: 969846 - RNA, 22 nt, Human
uuauagaaggagcauucacuua

SEQ ID NO: 969847 - RNA, 22 nt, Human
augaaggcuguguagauggaug

SEQ ID NO: 969848 - RNA, 22 nt, Human
aaauuaguacauugcaaagucc

SEQ ID NO: 969849 - RNA, 22 nt, Human
gccuggcaggccuguuggggcu

SEQ ID NO: 969850 - RNA, 22 nt, Human
agaaugcaagauaaacuuuauu

SEQ ID NO: 969851 - RNA, 22 nt, Human
agagccaggaugucuucugggg

SEQ ID NO: 969852 - RNA, 22 nt, Human
aacugcauucagaaagcucacu

SEQ ID NO: 969853 - RNA, 22 nt, Human
gccucugcccauccaccaucag

SEQ ID NO: 969854 - RNA, 22 nt, Human
aaugagacacgugaagcagaug

SEQ ID NO: 969855 - RNA, 22 nt, Human
uuuuaguuguaguuggugagga

SEQ ID NO: 969856 - RNA, 22 nt, Human
uuuacagaaugucaauuucuau

SEQ ID NO: 969857 - RNA, 20 nt, Human
cuaucuccuggcgugccuuc

SEQ ID NO: 969858 - RNA, 22 nt, Human
agcagggcuuugcagacuuggg

SEQ ID NO: 969859 - RNA, 22 nt, Human
agucccagagaggucggggcca

SEQ ID NO: 969860 - RNA, 22 nt, Human
agcucccagaaggcccugcgcc

SEQ ID NO: 969861 - RNA, 22 nt, Human
uagagcugcuggacuguaacag

SEQ ID NO: 969862 - RNA, 22 nt, Human
cauagaaacugagacaaggauu

SEQ ID NO: 969863 - RNA, 22 nt, Human
caguuuuugccauuaagaguaa

SEQ ID NO: 969864 - RNA, 22 nt, Human
gcugggagcaaguacucaucuu

SEQ ID NO: 969865 - RNA, 22 nt, Human
uacuuuuagccuauuugauucu

SEQ ID NO: 969866 - RNA, 20 nt, Human
ugucauuguuucuaggaccu

SEQ ID NO: 969867 - RNA, 22 nt, Human
gcucccugcagcugagaguucc

SEQ ID NO: 969868 - RNA, 22 nt, Human
gaaggcugaugacagauucugc

SEQ ID NO: 969869 - RNA, 22 nt, Human
ugggccacggggguggagagcu

SEQ ID NO: 969870 - RNA, 22 nt, Human
cugccucugcgucccacagagu

SEQ ID NO: 969871 - RNA, 22 nt, Human
gcagcuuggugaaaggugaugg

SEQ ID NO: 969872 - RNA, 23 nt, Human
cauguacagaguuugauaaagug

SEQ ID NO: 969873 - RNA, 22 nt, Human
uuguccuuggaugaagcuggga

SEQ ID NO: 969874 - RNA, 22 nt, Human
uuuauaagaagcaaugucugag

SEQ ID NO: 969875 - RNA, 22 nt, Human
cauuucugggagacaugcuaga

SEQ ID NO: 969876 - RNA, 22 nt, Human
gcugaagagagaugcguccagc

SEQ ID NO: 969877 - RNA, 22 nt, Human
ccugagccugaguggugcaggg

SEQ ID NO: 969878 - RNA, 21 nt, Human
uuuuuucuugcgugaggccug

SEQ ID NO: 969879 - RNA, 22 nt, Human
uugcagcuucgagucuaucugu

SEQ ID NO: 969880 - RNA, 22 nt, Human
ugcugaggucaccuugcugcua

SEQ ID NO: 969881 - RNA, 22 nt, Human
gacugucauucuagugcccaug

SEQ ID NO: 969882 - RNA, 18 nt, Human
ccagagcuggcuccucgc

SEQ ID NO: 969883 - RNA, 23 nt, Human
ucuuuacauacugaugaguucuc

SEQ ID NO: 969884 - RNA, 18 nt, Human
cagucccaaaccuuagga

SEQ ID NO: 969885 - RNA, 22 nt, Human
cagagagaggccacugcuauua

SEQ ID NO: 969886 - RNA, 22 nt, Human
ggcaguggaggacccugugucu

SEQ ID NO: 969887 - RNA, 22 nt, Human
uggagcucaaaggccuguggga

SEQ ID NO: 969888 - RNA, 22 nt, Human
ucuucagugcauguuaccuaua

SEQ ID NO: 969889 - RNA, 18 nt, Human
cauuguacaaugcuuuau

SEQ ID NO: 969890 - RNA, 22 nt, Human
uuuucagaggccuaagagguuu

SEQ ID NO: 969891 - RNA, 22 nt, Human
caggucccgccccgggcugacc

SEQ ID NO: 969892 - RNA, 22 nt, Human
ggugaggggagagugaaagaaa

SEQ ID NO: 969893 - RNA, 22 nt, Human
guugaaagcuuuucauuuaguu

SEQ ID NO: 969894 - RNA, 22 nt, Human
acuggccaugggauuuauauuu

SEQ ID NO: 969895 - RNA, 22 nt, Human
uaaaguauauuuuuucucaaua

SEQ ID NO: 969896 - RNA, 22 nt, Human
uuugaaauaugaggcauuauga

SEQ ID NO: 969897 - RNA, 22 nt, Human
augcuguggaugccuugcccca

SEQ ID NO: 969898 - RNA, 22 nt, Human
uuucaacagcucucaaaugauc

SEQ ID NO: 969899 - RNA, 21 nt, Human
aaugaaguggcuauuuugagg

SEQ ID NO: 969900 - RNA, 22 nt, Human
aaguaugcaaaucgucuuagaa

SEQ ID NO: 969901 - RNA, 22 nt, Human
gccuggcuccuaaggacuggcu

SEQ ID NO: 969902 - RNA, 22 nt, Human
uuaaauuauuucuagugaggug

SEQ ID NO: 969903 - RNA, 22 nt, Human
uggcagagaacacacaugauuc

SEQ ID NO: 969904 - RNA, 20 nt, Human
aguaccuuuuguauguuacc

SEQ ID NO: 969905 - RNA, 22 nt, Human
acaccuuucagguccagacagu

SEQ ID NO: 969906 - RNA, 22 nt, Human
ucaaguguaguggugucagguc

SEQ ID NO: 969907 - RNA, 18 nt, Human
ggcagcuugacuagcaac

SEQ ID NO: 969908 - RNA, 22 nt, Human
ggagggacccacucuagaggug

SEQ ID NO: 969909 - RNA, 22 nt, Human
aaauuuaagaagugugugcgug

SEQ ID NO: 969910 - RNA, 22 nt, Human
cccagacauaacagcagagagg

SEQ ID NO: 969911 - RNA, 22 nt, Human
cagugcagaacacauggaaaau

SEQ ID NO: 969912 - RNA, 22 nt, Human
ggcuagaauaauugacuucauu

SEQ ID NO: 969913 - RNA, 22 nt, Human
aacagaauaguugauguacagu

SEQ ID NO: 969914 - RNA, 22 nt, Human
aggaggcugguucaggccauau

SEQ ID NO: 969915 - RNA, 19 nt, Human
agaggcugucaccuguagc

SEQ ID NO: 969916 - RNA, 18 nt, Human
uggacaggguggagaaaa

SEQ ID NO: 969917 - RNA, 22 nt, Human
guuuauaaggcccaauauuucu

SEQ ID NO: 969918 - RNA, 22 nt, Human
ggguuggggcccagcagucugc

SEQ ID NO: 969919 - RNA, 22 nt, Human
aguuggagugaacaugagauug

SEQ ID NO: 969920 - RNA, 22 nt, Human
aaucaguauugguauagaauga

SEQ ID NO: 969921 - RNA, 22 nt, Human
aggugccaauuuucagugaaca

SEQ ID NO: 969922 - RNA, 22 nt, Human
uggcucaguuaggucagaaaca

SEQ ID NO: 969923 - RNA, 22 nt, Human
aggaaaaucgagucuggaggca

SEQ ID NO: 969924 - RNA, 22 nt, Human
aucugcuuccuccuuagggaaa

SEQ ID NO: 969925 - RNA, 22 nt, Human
uaaauuauguuccauguccuuu

SEQ ID NO: 969926 - RNA, 22 nt, Human
cauugcacuuuggguccaggac

SEQ ID NO: 969927 - RNA, 20 nt, Human
cuuuggcaaugagaacaggg

SEQ ID NO: 969928 - RNA, 22 nt, Human
cagagccaggucuaggagucuc

SEQ ID NO: 969929 - RNA, 22 nt, Human
agaccaagugcaggugccacua

SEQ ID NO: 969930 - RNA, 22 nt, Human
aauucacaaaaccagauugcuu

SEQ ID NO: 969931 - RNA, 22 nt, Human
uccaggaggcaccuuuggacca

SEQ ID NO: 969932 - RNA, 21 nt, Human
agaggccuuacaggauagacc

SEQ ID NO: 969933 - RNA, 22 nt, Human
gcagugcuuuagucuguccuuu

SEQ ID NO: 969934 - RNA, 22 nt, Human
ccuucagaccuagacaggaauc

SEQ ID NO: 969935 - RNA, 22 nt, Human
gaggagcuggcagcgucuccgc

SEQ ID NO: 969936 - RNA, 22 nt, Human
ugugugcaauucuuaacauaca

SEQ ID NO: 969937 - RNA, 22 nt, Human
accaggaguugggggugggacc

SEQ ID NO: 969938 - RNA, 22 nt, Human
gagacaaaaguuggagugcaag

SEQ ID NO: 969939 - RNA, 22 nt, Human
cagaugaggcaaccucauugcu

SEQ ID NO: 969940 - RNA, 20 nt, Human
gccagcacagggagcaguuc

SEQ ID NO: 969941 - RNA, 19 nt, Human
ggcagucucaagcagcaca

SEQ ID NO: 969942 - RNA, 22 nt, Human
gggccugggaacuugcauuuag

SEQ ID NO: 969943 - RNA, 22 nt, Human
ugcaguggaggccgugagacag

SEQ ID NO: 969944 - RNA, 22 nt, Human
aggccaggcaacauucugaagu

SEQ ID NO: 969945 - RNA, 22 nt, Human
uucuucucggcugucagauagu

SEQ ID NO: 969946 - RNA, 22 nt, Human
agcagagcugcaguggccugcu

SEQ ID NO: 969947 - RNA, 21 nt, Human
uucucagagucuauuacaguu

SEQ ID NO: 969948 - RNA, 22 nt, Human
ggcuggcacugaggagagcucu

SEQ ID NO: 969949 - RNA, 20 nt, Human
uaacagaaguagaagugggu

SEQ ID NO: 969950 - RNA, 22 nt, Human
uccaaggcauagacacagugcc

SEQ ID NO: 969951 - RNA, 22 nt, Human
augaccccuaaaauuuacuguc

SEQ ID NO: 969952 - RNA, 22 nt, Human
cugccucuauaggaguccacca

SEQ ID NO: 969953 - RNA, 22 nt, Human
agagcuggaaucagaccucagg

SEQ ID NO: 969954 - RNA, 22 nt, Human
ugccugcuaggcccugcugggu

SEQ ID NO: 969955 - RNA, 22 nt, Human
agggcucugggguggcagagau

SEQ ID NO: 969956 - RNA, 22 nt, Human
aucuggcugacuuugugggaca

SEQ ID NO: 969957 - RNA, 22 nt, Human
gcuugcuggugccugcaggcuc

SEQ ID NO: 969958 - RNA, 22 nt, Human
uguguauuaccauuuuacagcu

SEQ ID NO: 969959 - RNA, 22 nt, Human
gagguggucgaggagggguacc

SEQ ID NO: 969960 - RNA, 21 nt, Human
aagcuucccugcucuccaggg

SEQ ID NO: 969961 - RNA, 22 nt, Human
agagcagaggcauggccguggg

SEQ ID NO: 969962 - RNA, 22 nt, Human
cugugccuaagaugcaugucuc

SEQ ID NO: 969963 - RNA, 22 nt, Human
ccaggccagagugcaguggcac

SEQ ID NO: 969964 - RNA, 22 nt, Human
ugcaggugaaaauuaugaggau

SEQ ID NO: 969965 - RNA, 22 nt, Human
aggcucugugacaaucaagcug

SEQ ID NO: 969966 - RNA, 22 nt, Human
cugaagccaugugcucacuggu

SEQ ID NO: 969967 - RNA, 22 nt, Human
cugcccugucugcagccuggcu

SEQ ID NO: 969968 - RNA, 22 nt, Human
uggcucagaggggaagugguuu

SEQ ID NO: 969969 - RNA, 22 nt, Human
agggacacacuccaguguuauu

SEQ ID NO: 969970 - RNA, 22 nt, Human
ggaagagggaaccacgacugua

SEQ ID NO: 969971 - RNA, 22 nt, Human
aaacagaaauuuccucaugcuc

SEQ ID NO: 969972 - RNA, 22 nt, Human
uccuuagagacaagaccaguuu

SEQ ID NO: 969973 - RNA, 22 nt, Human
acaugucaauuuaguacucuua

SEQ ID NO: 969974 - RNA, 22 nt, Human
ugcaucuguucagagcugucga

SEQ ID NO: 969975 - RNA, 22 nt, Human
gggcaagcucuucagaagcucu

SEQ ID NO: 969976 - RNA, 22 nt, Human
ccagcuggugggucuuucucug

SEQ ID NO: 969977 - RNA, 19 nt, Human
gccacuccugaugcugccc

SEQ ID NO: 969978 - RNA, 22 nt, Human
cagcuggcaaguggagcagggu

SEQ ID NO: 969979 - RNA, 22 nt, Human
caagggaccugagauggucucu

SEQ ID NO: 969980 - RNA, 22 nt, Human
cugaaggaagcagaagcgaggu

SEQ ID NO: 969981 - RNA, 22 nt, Human
uccaggagugcugguuagagua

SEQ ID NO: 969982 - RNA, 22 nt, Human
cccagcucucgcacuuacuagc

SEQ ID NO: 969983 - RNA, 22 nt, Human
ggcuccuguccuccuggagcuc

SEQ ID NO: 969984 - RNA, 19 nt, Human
auuccucaaggacagaaau

SEQ ID NO: 969985 - RNA, 21 nt, Human
ucuuccuccacagcgugccac

SEQ ID NO: 969986 - RNA, 22 nt, Human
cucaucugauaaaucacucuua

SEQ ID NO: 969987 - RNA, 22 nt, Human
uucagcaaugacagccuauaua

SEQ ID NO: 969988 - RNA, 22 nt, Human
ucauugaaugcucugcagguug

SEQ ID NO: 969989 - RNA, 22 nt, Human
ggccuugggauguggcugcagc

SEQ ID NO: 969990 - RNA, 22 nt, Human
aauacaguaauuuugaugaguu

SEQ ID NO: 969991 - RNA, 22 nt, Human
aagacaagcaucaaaucaggca

SEQ ID NO: 969992 - RNA, 17 nt, Human
gaggagcuccaguaggu

SEQ ID NO: 969993 - RNA, 22 nt, Human
auaauuuacaacugcuuuuaau

SEQ ID NO: 969994 - RNA, 22 nt, Human
uaacacacugaaggugagaugg

SEQ ID NO: 969995 - RNA, 22 nt, Human
uggucucuucuuccaagauggc

SEQ ID NO: 969996 - RNA, 22 nt, Human
uccuucaggccucauucucaua

SEQ ID NO: 969997 - RNA, 22 nt, Human
uggcacugagcagccgcggcag

SEQ ID NO: 969998 - RNA, 22 nt, Human
aaggcacuugcccagagcugca

SEQ ID NO: 969999 - RNA, 21 nt, Human
ugauuuccagaaaauuggccc

SEQ ID NO: 970000 - RNA, 22 nt, Human
uucucuuagcuguaaagucaau

SEQ ID NO: 970001 - RNA, 22 nt, Human
aacaucagaauauccauguugg

SEQ ID NO: 970002 - RNA, 22 nt, Human
ucacccuugauaauguucuucu

SEQ ID NO: 970003 - RNA, 22 nt, Human
cucagagaaaaggagcaagggu

SEQ ID NO: 970004 - RNA, 22 nt, Human
augcugugauuguagaaauauu

SEQ ID NO: 970005 - RNA, 22 nt, Human
guuguauagagggcaugaaucu

SEQ ID NO: 970006 - RNA, 22 nt, Human
ucugugcucuucucaguaucac

SEQ ID NO: 970007 - RNA, 22 nt, Human
gggcuggaggagauccagaggc

SEQ ID NO: 970008 - RNA, 22 nt, Human
uagggaugagccaguggguagu

SEQ ID NO: 970009 - RNA, 21 nt, Human
ggcagaaguagcauggacggg

SEQ ID NO: 970010 - RNA, 22 nt, Human
ugcagaagcagagccgguggcc

SEQ ID NO: 970011 - RNA, 22 nt, Human
gugcauuucucauacacuaaau

SEQ ID NO: 970012 - RNA, 22 nt, Human
gaggcaggguguugauuacaga

SEQ ID NO: 970013 - RNA, 22 nt, Human
agcucauggugcuaucucaggg

SEQ ID NO: 970014 - RNA, 22 nt, Human
caaggugcagcguugucaagcu

SEQ ID NO: 970015 - RNA, 20 nt, Human
uauuuagauucaaguaugga

SEQ ID NO: 970016 - RNA, 22 nt, Human
ccacagggauaggaauggggcu

SEQ ID NO: 970017 - RNA, 22 nt, Human
ggagcuguucaggacugcuuca

SEQ ID NO: 970018 - RNA, 22 nt, Human
gcaggagcuggaaagugauguu

SEQ ID NO: 970019 - RNA, 22 nt, Human
cagugcauagauccugaggccu

SEQ ID NO: 970020 - RNA, 22 nt, Human
ccuuuucuaaucuuaagaaugu

SEQ ID NO: 970021 - RNA, 21 nt, Human
uucucagaucgaguagugaga

SEQ ID NO: 970022 - RNA, 22 nt, Human
ggagccugggcauuaguaauuu

SEQ ID NO: 970023 - RNA, 22 nt, Human
auucacaaugauacauaagcga

SEQ ID NO: 970024 - RNA, 22 nt, Human
gaggccuggcugggaggaggug

SEQ ID NO: 970025 - RNA, 22 nt, Human
aagcaucucuauguggagagug

SEQ ID NO: 970026 - RNA, 22 nt, Human
ugcauugccucuauucauuaua

SEQ ID NO: 970027 - RNA, 22 nt, Human
gccagagacacuuggagguaga

SEQ ID NO: 970028 - RNA, 22 nt, Human
cccuggagcugcuugcauguug

SEQ ID NO: 970029 - RNA, 23 nt, Human
aacaauagguuuuggcagaauag

SEQ ID NO: 970030 - RNA, 22 nt, Human
uagcagcucugauucugggccc

SEQ ID NO: 970031 - RNA, 22 nt, Human
gcuggucacucugggagcugcu

SEQ ID NO: 970032 - RNA, 22 nt, Human
aucuaggauuugaaugcacagu

SEQ ID NO: 970033 - RNA, 22 nt, Human
acuaacauguuaaucaaaagaa

SEQ ID NO: 970034 - RNA, 22 nt, Human
cuauuagguuggugcaaaagua

SEQ ID NO: 970035 - RNA, 22 nt, Human
acaagagacaagagguucuucu

SEQ ID NO: 970036 - RNA, 22 nt, Human
cccaccaguacagaugguagau

SEQ ID NO: 970037 - RNA, 22 nt, Human
uugaaaugcagauuccaaucca

SEQ ID NO: 970038 - RNA, 22 nt, Human
ugugccuuaugaauucuuucug

SEQ ID NO: 970039 - RNA, 22 nt, Human
cagcagugaugugugaggguuc

SEQ ID NO: 970040 - RNA, 22 nt, Human
uguacauagaucuugaaaauua

SEQ ID NO: 970041 - RNA, 22 nt, Human
aacucugccagguuucaggagc

SEQ ID NO: 970042 - RNA, 22 nt, Human
cucuggagggaggcugagcugg

SEQ ID NO: 970043 - RNA, 22 nt, Human
cugagcugcggcaggcaccugg

SEQ ID NO: 970044 - RNA, 22 nt, Human
gggcucagccccauugaaccag

SEQ ID NO: 970045 - RNA, 22 nt, Human
ggacacaguggaagacagcuug

SEQ ID NO: 970046 - RNA, 19 nt, Human
uggcugggcgugccuccgu

SEQ ID NO: 970047 - RNA, 22 nt, Human
ggcuccugaaagacuaugggaa

SEQ ID NO: 970048 - RNA, 22 nt, Human
uggggcuccuccuggcaggagg

SEQ ID NO: 970049 - RNA, 22 nt, Human
acagucuugagcaucagccaga

SEQ ID NO: 970050 - RNA, 22 nt, Human
cacagaaaaaggcuugaaaauc

SEQ ID NO: 970051 - RNA, 22 nt, Human
caucacagauguuguguggagu

SEQ ID NO: 970052 - RNA, 22 nt, Human
ucugagccaauuucugugucca

SEQ ID NO: 970053 - RNA, 22 nt, Human
uuccaaagaaauugaccaagac

SEQ ID NO: 970054 - RNA, 20 nt, Human
uuucaguuaucuugaccuuc

SEQ ID NO: 970055 - RNA, 18 nt, Human
ccucaggggaccuggcag

SEQ ID NO: 970056 - RNA, 22 nt, Human
aaggucauggcaaauuacuuuu

SEQ ID NO: 970057 - RNA, 22 nt, Human
uguuccuguguggaaaagggcc

SEQ ID NO: 970058 - RNA, 22 nt, Human
gggcugugcugaguaggaggug

SEQ ID NO: 970059 - RNA, 22 nt, Human
uccaggaccucccaggcuagag

SEQ ID NO: 970060 - RNA, 22 nt, Human
ccugccagauccccugagcuga

SEQ ID NO: 970061 - RNA, 22 nt, Human
ggccugagucccaccuggcugu

SEQ ID NO: 970062 - RNA, 22 nt, Human
cagcccuggaacagcugacuca

SEQ ID NO: 970063 - RNA, 22 nt, Human
ucuggcucccagccugcucuca

SEQ ID NO: 970064 - RNA, 20 nt, Human
cccagggaccugagcuccau

SEQ ID NO: 970065 - RNA, 22 nt, Human
gagacugcauuguccaaggguu

SEQ ID NO: 970066 - RNA, 20 nt, Human
uguccuaauagacaagcaga

SEQ ID NO: 970067 - RNA, 22 nt, Human
uuuccauauuuggucuuuggga

SEQ ID NO: 970068 - RNA, 22 nt, Human
gggccuguguguucaggagccu

SEQ ID NO: 970069 - RNA, 23 nt, Human
gcccaugcuguugggcccgagca

SEQ ID NO: 970070 - RNA, 22 nt, Human
aggaugaauaacugaaauggug

SEQ ID NO: 970071 - RNA, 22 nt, Human
uaggcagcugcaaacuucgguc

SEQ ID NO: 970072 - RNA, 22 nt, Human
auggccuccgacccaugacgug

SEQ ID NO: 970073 - RNA, 22 nt, Human
ugaguuuugucuugcuagaagu

SEQ ID NO: 970074 - RNA, 22 nt, Human
auuucaguguuuuaagaguuca

SEQ ID NO: 970075 - RNA, 22 nt, Human
ggcuucugagugcucugcuguu

SEQ ID NO: 970076 - RNA, 22 nt, Human
agcagcauucucugguaugggg

SEQ ID NO: 970077 - RNA, 22 nt, Human
aaaguauucuugacuguuuuuc

SEQ ID NO: 970078 - RNA, 22 nt, Human
uugaaaggugaacaugaugcac

SEQ ID NO: 970079 - RNA, 22 nt, Human
agcuuuauauuuaaugaauucu

SEQ ID NO: 970080 - RNA, 22 nt, Human
agcaguggaccucagugcuauu

SEQ ID NO: 970081 - RNA, 22 nt, Human
cuuggggcugucacucuggcau

SEQ ID NO: 970082 - RNA, 22 nt, Human
uauuuguauguguguacauaua

SEQ ID NO: 970083 - RNA, 23 nt, Human
ggcucugugcugggccugcagga

SEQ ID NO: 970084 - RNA, 22 nt, Human
aacaaauguguuuuguaauuaa

SEQ ID NO: 970085 - RNA, 22 nt, Human
agagaaaagaguucaggcuuug

SEQ ID NO: 970086 - RNA, 22 nt, Human
cuguuuaucccuuuggucagca

SEQ ID NO: 970087 - RNA, 22 nt, Human
uaucuuuagaggaagagaaucu

SEQ ID NO: 970088 - RNA, 22 nt, Human
agccuggauucgugcauccaca

SEQ ID NO: 970089 - RNA, 21 nt, Human
ggucuuccaaauaaggagaaa

SEQ ID NO: 970090 - RNA, 22 nt, Human
ggagaggacauggcucccacag

SEQ ID NO: 970091 - RNA, 22 nt, Human
caugcugugugguuagaacugu

SEQ ID NO: 970092 - RNA, 22 nt, Human
aggccagagaggggaccagccu

SEQ ID NO: 970093 - RNA, 22 nt, Human
cuucagaaugggacuguguuug

SEQ ID NO: 970094 - RNA, 17 nt, Human
cagacaggcugucaccc

SEQ ID NO: 970095 - RNA, 22 nt, Human
ucucacugcaaauauuauguau

SEQ ID NO: 970096 - RNA, 22 nt, Human
cugugcccuggccaggccucuc

SEQ ID NO: 970097 - RNA, 22 nt, Human
agcugccaaguuucucaguuua

SEQ ID NO: 970098 - RNA, 22 nt, Human
aucugucuggaggccuggcaug

SEQ ID NO: 970099 - RNA, 21 nt, Human
ugcuucucuagaucaacuacu

SEQ ID NO: 970100 - RNA, 22 nt, Human
ggacagcucugccaggagcuca

SEQ ID NO: 970101 - RNA, 22 nt, Human
caggcacuggggaugcugggau

SEQ ID NO: 970102 - RNA, 22 nt, Human
ucugaagccaccucugcuuguc

SEQ ID NO: 970103 - RNA, 22 nt, Human
auucaguaggucuagaauaaga

SEQ ID NO: 970104 - RNA, 22 nt, Human
acagccuguguaccagcuggga

SEQ ID NO: 970105 - RNA, 20 nt, Human
acaaaauagguacuggguag

SEQ ID NO: 970106 - RNA, 22 nt, Human
ggguccagcuacaucagggugg

SEQ ID NO: 970107 - RNA, 23 nt, Human
ugaugggaaggaacgacuaccac

SEQ ID NO: 970108 - RNA, 22 nt, Human
gcaaagcauucuguggagucua

SEQ ID NO: 970109 - RNA, 22 nt, Human
aaaugugcuugugaucagcugu

SEQ ID NO: 970110 - RNA, 22 nt, Human
gucacuggggccacaugcagaa

SEQ ID NO: 970111 - RNA, 21 nt, Human
ucuuggccuaaguucacugaa

SEQ ID NO: 970112 - RNA, 22 nt, Human
caggcugccgugaagcaggccu

SEQ ID NO: 970113 - RNA, 22 nt, Human
ggaguaggaguagaacucauca

SEQ ID NO: 970114 - RNA, 22 nt, Human
ccagguggaggugugagguccu

SEQ ID NO: 970115 - RNA, 22 nt, Human
gccuggcaggccucaugagggg

SEQ ID NO: 970116 - RNA, 22 nt, Human
ucagaagagcuggugcugccug

SEQ ID NO: 970117 - RNA, 22 nt, Human
augcagcaguuuacaaagcaau

SEQ ID NO: 970118 - RNA, 19 nt, Human
uagcugccuguuaccucca

SEQ ID NO: 970119 - RNA, 22 nt, Human
gcuuuuaauuaguugcuuccau

SEQ ID NO: 970120 - RNA, 22 nt, Human
ugcauggacucaucagacaaga

SEQ ID NO: 970121 - RNA, 22 nt, Human
auucuucaccauggauaauuug

SEQ ID NO: 970122 - RNA, 22 nt, Human
ggcugugccucaaggcuacuca

SEQ ID NO: 970123 - RNA, 23 nt, Human
agggcacugaagcuggaauuggg

SEQ ID NO: 970124 - RNA, 22 nt, Human
acauucuuaacaguuaaaaacu

SEQ ID NO: 970125 - RNA, 22 nt, Human
cagucccacaagaucuccacaa

SEQ ID NO: 970126 - RNA, 22 nt, Human
cuccucuggcuuccuggaggca

SEQ ID NO: 970127 - RNA, 22 nt, Human
uucaagauggccccagugagcc

SEQ ID NO: 970128 - RNA, 22 nt, Human
ggggcagcuaccggaaguaggg

SEQ ID NO: 970129 - RNA, 22 nt, Human
gcugccaguaguuggagcucca

SEQ ID NO: 970130 - RNA, 22 nt, Human
aggagcagaacugauucugacu

SEQ ID NO: 970131 - RNA, 22 nt, Human
auccuuggaugugucuuuuugu

SEQ ID NO: 970132 - RNA, 22 nt, Human
cugcugugcagacagacucucu

SEQ ID NO: 970133 - RNA, 22 nt, Human
gagcucuggguggcaggugucu

SEQ ID NO: 970134 - RNA, 22 nt, Human
aagagggcagcacagguggguc

SEQ ID NO: 970135 - RNA, 22 nt, Human
uggggacauagccagucuggcu

SEQ ID NO: 970136 - RNA, 22 nt, Human
cuccaggagcugugucuuucuu

SEQ ID NO: 970137 - RNA, 22 nt, Human
ucuggccagugaaaugcagaau

SEQ ID NO: 970138 - RNA, 22 nt, Human
gccucugcugcaagccugguug

SEQ ID NO: 970139 - RNA, 22 nt, Human
gaggccuggguuggaggugcau

SEQ ID NO: 970140 - RNA, 22 nt, Human
uauuccagugugaucuuuguag

SEQ ID NO: 970141 - RNA, 22 nt, Human
aaucacaauuacuuuugcacca

SEQ ID NO: 970142 - RNA, 22 nt, Human
gauuuauuggucuuucauuggu

SEQ ID NO: 970143 - RNA, 22 nt, Human
ccuguucaaugcccuggcuuca

SEQ ID NO: 970144 - RNA, 22 nt, Human
uucuuauagaagcaaccauugu

SEQ ID NO: 970145 - RNA, 22 nt, Human
ugagccagaguggagugugccu

SEQ ID NO: 970146 - RNA, 22 nt, Human
uucaggauucuuucagacuggg

SEQ ID NO: 970147 - RNA, 22 nt, Human
uuccucucucuugccagaaugu

SEQ ID NO: 970148 - RNA, 22 nt, Human
cugggcacuuuggggagccuac

SEQ ID NO: 970149 - RNA, 22 nt, Human
uggaagcacuuggguuuuguug

SEQ ID NO: 970150 - RNA, 22 nt, Human
cugcccaggcugaaggaacauc

SEQ ID NO: 970151 - RNA, 18 nt, Human
ccgggcuuuggugacaca

SEQ ID NO: 970152 - RNA, 22 nt, Human
gggcacugaaugccaagcuagg

SEQ ID NO: 970153 - RNA, 22 nt, Human
gcccaggaucugcucagaucau

SEQ ID NO: 970154 - RNA, 22 nt, Human
ucgcugugguuucuguacaugg

SEQ ID NO: 970155 - RNA, 22 nt, Human
ggccucugguucguggugaccu

SEQ ID NO: 970156 - RNA, 18 nt, Human
agaaggagcuaugggcag

SEQ ID NO: 970157 - RNA, 22 nt, Human
agaggcaggagguugacuugag

SEQ ID NO: 970158 - RNA, 22 nt, Human
accuuuuuucagaacucuaaag

SEQ ID NO: 970159 - RNA, 22 nt, Human
acucuugucucaacuuuuguau

SEQ ID NO: 970160 - RNA, 22 nt, Human
aggggcuggcuuaucugagagu

SEQ ID NO: 970161 - RNA, 22 nt, Human
ucagauggcacacagagccugc

SEQ ID NO: 970162 - RNA, 23 nt, Human
agggaaaguaguaauggccuuug

SEQ ID NO: 970163 - RNA, 22 nt, Human
uuucauuauacagcuucauaaa

SEQ ID NO: 970164 - RNA, 22 nt, Human
agugcuuucccugaaaccuucc

SEQ ID NO: 970165 - RNA, 22 nt, Human
caugggaggucugcaaggugcu

SEQ ID NO: 970166 - RNA, 22 nt, Human
cccugccucugaagcugcucag

SEQ ID NO: 970167 - RNA, 22 nt, Human
cauuuguuggucagauuguagu

SEQ ID NO: 970168 - RNA, 23 nt, Human
cccagagcacagccuccagaugc

SEQ ID NO: 970169 - RNA, 21 nt, Human
agggcagauuagcuguaagag

SEQ ID NO: 970170 - RNA, 20 nt, Human
agguauaagaaaugugauuu

SEQ ID NO: 970171 - RNA, 22 nt, Human
guguguuucagaagccaggugu

SEQ ID NO: 970172 - RNA, 19 nt, Human
uggcugggugccaauggcc

SEQ ID NO: 970173 - RNA, 22 nt, Human
cugcugcucagugucaucaugu

SEQ ID NO: 970174 - RNA, 22 nt, Human
ccugagagcagcuuccugcuua

SEQ ID NO: 970175 - RNA, 22 nt, Human
cucuggaguucucaugaggaac

SEQ ID NO: 970176 - RNA, 22 nt, Human
gccugccuuuguaugacccuga

SEQ ID NO: 970177 - RNA, 22 nt, Human
uagcccagagucccaauuccag

SEQ ID NO: 970178 - RNA, 21 nt, Human
gcucccugcucagcuccuggg

SEQ ID NO: 970179 - RNA, 22 nt, Human
uccaguggcacuggagacuaga

SEQ ID NO: 970180 - RNA, 22 nt, Human
uguauacauuuaacuagauaga

SEQ ID NO: 970181 - RNA, 22 nt, Human
ucuaggagcaugaagggaaggc

SEQ ID NO: 970182 - RNA, 22 nt, Human
ggcagcagaacuggcccuguau

SEQ ID NO: 970183 - RNA, 22 nt, Human
ugaggaugacgauggcaauggc

SEQ ID NO: 970184 - RNA, 22 nt, Human
cuggaggcacccuuagagaggc

SEQ ID NO: 970185 - RNA, 17 nt, Human
uugggagagaaagguau

SEQ ID NO: 970186 - RNA, 22 nt, Human
aacagaacccgagugugaaucu

SEQ ID NO: 970187 - RNA, 20 nt, Human
uggggccuguuucugugguu

SEQ ID NO: 970188 - RNA, 22 nt, Human
uuaagucauuucugauuauaga

SEQ ID NO: 970189 - RNA, 22 nt, Human
uagugaaacaguuaucaaucug

SEQ ID NO: 970190 - RNA, 22 nt, Human
aauccagguggcggagguugug

SEQ ID NO: 970191 - RNA, 22 nt, Human
aguauguagugcaaucagucag

SEQ ID NO: 970192 - RNA, 22 nt, Human
ggcugcaggcaggguauccacu

SEQ ID NO: 970193 - RNA, 22 nt, Human
acagagccaaaaggacauagua

SEQ ID NO: 970194 - RNA, 22 nt, Human
uuccuguaugucagugaagagc

SEQ ID NO: 970195 - RNA, 19 nt, Human
acccucucagugccugagg

SEQ ID NO: 970196 - RNA, 22 nt, Human
auggggcucugcggcugcuccc

SEQ ID NO: 970197 - RNA, 22 nt, Human
uugcauaaagauuuuauugcau

SEQ ID NO: 970198 - RNA, 22 nt, Human
gagagcugcaagguagggcggg

SEQ ID NO: 970199 - RNA, 22 nt, Human
aggauguuaucugugcaggugg

SEQ ID NO: 970200 - RNA, 22 nt, Human
uaaagcaggccacauaugugau

SEQ ID NO: 970201 - RNA, 19 nt, Human
ccugugugggguagagauc

SEQ ID NO: 970202 - RNA, 22 nt, Human
aaguuugagaagcuuauagaua

SEQ ID NO: 970203 - RNA, 22 nt, Human
agugaaauacugucguuuuuag

SEQ ID NO: 970204 - RNA, 22 nt, Human
ccucagggaggccucuguggcu

SEQ ID NO: 970205 - RNA, 22 nt, Human
uacuuucuguccuucuguuaaa

SEQ ID NO: 970206 - RNA, 22 nt, Human
gggagggaaggaccuuaugaau

SEQ ID NO: 970207 - RNA, 22 nt, Human
uacagggguaacaguggggaau

SEQ ID NO: 970208 - RNA, 22 nt, Human
guuuauuagaguuuucugucug

SEQ ID NO: 970209 - RNA, 22 nt, Human
ccagguggcuucugcccgaugu

SEQ ID NO: 970210 - RNA, 22 nt, Human
uagauuucgcugcaucucaauc

SEQ ID NO: 970211 - RNA, 22 nt, Human
cuauugaauuaacuauuaaagu

SEQ ID NO: 970212 - RNA, 22 nt, Human
gccagagguucaacaacugucu

SEQ ID NO: 970213 - RNA, 22 nt, Human
aauaagaauuuacuugucaaga

SEQ ID NO: 970214 - RNA, 22 nt, Human
cuggccuuuagccccagugucu

SEQ ID NO: 970215 - RNA, 22 nt, Human
ugaugggaaaaugaggccuggg

SEQ ID NO: 970216 - RNA, 22 nt, Human
augugucuggcauggaaagugu

SEQ ID NO: 970217 - RNA, 22 nt, Human
ugaggccaaugacccugggcag

SEQ ID NO: 970218 - RNA, 22 nt, Human
gcuuagucaauuauaaauaggc

SEQ ID NO: 970219 - RNA, 22 nt, Human
augccagccucuaagcacuuua

SEQ ID NO: 970220 - RNA, 22 nt, Human
aaggcaguuaauuuggcuagaa

SEQ ID NO: 970221 - RNA, 22 nt, Human
guuuuguugcugcagagcucaa

SEQ ID NO: 970222 - RNA, 22 nt, Human
guuuuucuuugugugaagacaa

SEQ ID NO: 970223 - RNA, 22 nt, Human
gaggccuuagagcuuuucuaga

SEQ ID NO: 970224 - RNA, 19 nt, Human
gcucagcagacccagugcu

SEQ ID NO: 970225 - RNA, 22 nt, Human
ccaggaugacccccacuuuccu

SEQ ID NO: 970226 - RNA, 22 nt, Human
uuaauaggcuucuaacauagcu

SEQ ID NO: 970227 - RNA, 22 nt, Human
cuggccagcauuuuugcuuuag

SEQ ID NO: 970228 - RNA, 22 nt, Human
acuguagcugccacuggaugca

SEQ ID NO: 970229 - RNA, 23 nt, Human
ucuugaaaagccuacagcaguuc

SEQ ID NO: 970230 - RNA, 22 nt, Human
gcugcucugcuguguaagcagg

SEQ ID NO: 970231 - RNA, 22 nt, Human
gagguauguaugcuacauucuu

SEQ ID NO: 970232 - RNA, 22 nt, Human
agagccugcuguguaagucaca

SEQ ID NO: 970233 - RNA, 22 nt, Human
caaguaaacaauaugugauuca

SEQ ID NO: 970234 - RNA, 22 nt, Human
ugcauuccuccaccuccugcac

SEQ ID NO: 970235 - RNA, 22 nt, Human
ggagcuggcuacagagaacucc

SEQ ID NO: 970236 - RNA, 22 nt, Human
uuuaaaaaacuagucugagucu

SEQ ID NO: 970237 - RNA, 22 nt, Human
aacucuggagcacgcccuggcc

SEQ ID NO: 970238 - RNA, 22 nt, Human
uagcuuuacaaagugcugcacc

SEQ ID NO: 970239 - RNA, 22 nt, Human
auuguggcuagacagucacaau

SEQ ID NO: 970240 - RNA, 19 nt, Human
gccugcagaaaaggcaggg

SEQ ID NO: 970241 - RNA, 22 nt, Human
ucugagcuacgaugccugucac

SEQ ID NO: 970242 - RNA, 22 nt, Human
cuggagccgcauggagcaggga

SEQ ID NO: 970243 - RNA, 22 nt, Human
agccagcuguucuggggcagca

SEQ ID NO: 970244 - RNA, 22 nt, Human
acagagcucccagccaucuccu

SEQ ID NO: 970245 - RNA, 22 nt, Human
aauuaggaauaaaugaguacuu

SEQ ID NO: 970246 - RNA, 22 nt, Human
ucaggaugguguggaggaaaua

SEQ ID NO: 970247 - RNA, 22 nt, Human
ugaaggccuaacuuccagugcu

SEQ ID NO: 970248 - RNA, 22 nt, Human
agggagaaugaccaagguauau

SEQ ID NO: 970249 - RNA, 22 nt, Human
gacagggcgagacucagucuca

SEQ ID NO: 970250 - RNA, 22 nt, Human
aaagguaguacuucuagaaggg

SEQ ID NO: 970251 - RNA, 22 nt, Human
gcucugugggugaguagaaucu

SEQ ID NO: 970252 - RNA, 22 nt, Human
gggcagagagcuggaacuccuu

SEQ ID NO: 970253 - RNA, 19 nt, Human
cccaggagucuggcugguu

SEQ ID NO: 970254 - RNA, 22 nt, Human
cacucuccagcacaccccauuu

SEQ ID NO: 970255 - RNA, 22 nt, Human
gagagaagggggauaugagccu

SEQ ID NO: 970256 - RNA, 22 nt, Human
cugcucugcaaggcacagugau

SEQ ID NO: 970257 - RNA, 22 nt, Human
acuuugcaauacuuaauacaaa

SEQ ID NO: 970258 - RNA, 22 nt, Human
ugugccuggcauucugggcuuc

SEQ ID NO: 970259 - RNA, 22 nt, Human
aggcaccuugagagcaggagcu

SEQ ID NO: 970260 - RNA, 22 nt, Human
cccaggaaccuaccagcucgag

SEQ ID NO: 970261 - RNA, 22 nt, Human
ucacauacacuaggauauuuuu

SEQ ID NO: 970262 - RNA, 22 nt, Human
uucaagauaauaggaaugaaaa

SEQ ID NO: 970263 - RNA, 22 nt, Human
uugauacaggccuucuagauga

SEQ ID NO: 970264 - RNA, 22 nt, Human
aucuucaaagcacaucguuugu

SEQ ID NO: 970265 - RNA, 22 nt, Human
agagugggccucugagucccag

SEQ ID NO: 970266 - RNA, 23 nt, Human
uuuauccaacucuguaaucucuc

SEQ ID NO: 970267 - RNA, 17 nt, Human
cuccuggccaccccucu

SEQ ID NO: 970268 - RNA, 22 nt, Human
aagugacauaccuuacauaugu

SEQ ID NO: 970269 - RNA, 21 nt, Human
uggaaagauucaaagaccagg

SEQ ID NO: 970270 - RNA, 22 nt, Human
acaaauaugguacucggagaaa

SEQ ID NO: 970271 - RNA, 22 nt, Human
acuguucacuagugaggguuga

SEQ ID NO: 970272 - RNA, 20 nt, Human
aaacauucauguacaaguga

SEQ ID NO: 970273 - RNA, 22 nt, Human
uuuacuuuugguaaggucauuu

SEQ ID NO: 970274 - RNA, 19 nt, Human
ucccaggaagcaaauguca

SEQ ID NO: 970275 - RNA, 22 nt, Human
uggcacauagaaaaggaucaau

SEQ ID NO: 970276 - RNA, 22 nt, Human
uaacuccaucucugugucugcu

SEQ ID NO: 970277 - RNA, 22 nt, Human
ucccagaggaaauggcagcuga

SEQ ID NO: 970278 - RNA, 22 nt, Human
ucuucuccagugcuucugcaca

SEQ ID NO: 970279 - RNA, 22 nt, Human
uucacagaugccugaugugugg

SEQ ID NO: 970280 - RNA, 20 nt, Human
ucucugcuguccacauuugc

SEQ ID NO: 970281 - RNA, 22 nt, Human
gaugagcauuguuucauguguu

SEQ ID NO: 970282 - RNA, 22 nt, Human
agccacagagcaggagaccuuu

SEQ ID NO: 970283 - RNA, 22 nt, Human
uccagccaugcaugacaaucac

SEQ ID NO: 970284 - RNA, 22 nt, Human
uaggaugaaaauccagcuuaua

SEQ ID NO: 970285 - RNA, 22 nt, Human
gugggaugcaguggugaguggc

SEQ ID NO: 970286 - RNA, 22 nt, Human
cccagccucagcuuuacuucca

SEQ ID NO: 970287 - RNA, 22 nt, Human
ucucccacagucucccauggcu

SEQ ID NO: 970288 - RNA, 22 nt, Human
gaucuguuucauucacagucug

SEQ ID NO: 970289 - RNA, 22 nt, Human
gucagagagggcacgugcacac

SEQ ID NO: 970290 - RNA, 22 nt, Human
ggacagagcccugguggccuaa

SEQ ID NO: 970291 - RNA, 21 nt, Human
uccucugcagugagguggccu

SEQ ID NO: 970292 - RNA, 20 nt, Human
cucugcagcaaggccugggu

SEQ ID NO: 970293 - RNA, 22 nt, Human
ugauuuccaauaaggagaaugu

SEQ ID NO: 970294 - RNA, 22 nt, Human
gcacugggaagaaugagccugu

SEQ ID NO: 970295 - RNA, 22 nt, Human
cagacaggcaggugcugcuuug

SEQ ID NO: 970296 - RNA, 22 nt, Human
aggcagacucaauggcuagaua

SEQ ID NO: 970297 - RNA, 22 nt, Human
uuuacagagaauguacauaaag

SEQ ID NO: 970298 - RNA, 22 nt, Human
agggucaggagacacuggcaac

SEQ ID NO: 970299 - RNA, 20 nt, Human
ucaggaugugcugagugaag

SEQ ID NO: 970300 - RNA, 22 nt, Human
aggcacugacucaagggagcca

SEQ ID NO: 970301 - RNA, 23 nt, Human
gcagauggccccagagugcugcc

SEQ ID NO: 970302 - RNA, 22 nt, Human
ccacagagagugucagccuuug

SEQ ID NO: 970303 - RNA, 22 nt, Human
gaauagcuuccuuuuuuccaaa

SEQ ID NO: 970304 - RNA, 22 nt, Human
gugugcaagggcauguacauug

SEQ ID NO: 970305 - RNA, 22 nt, Human
aaguguauauaugacuuauaaa

SEQ ID NO: 970306 - RNA, 22 nt, Human
uaggccaguggcagguugugug

SEQ ID NO: 970307 - RNA, 22 nt, Human
agaaguaggcagggcuguauca

SEQ ID NO: 970308 - RNA, 22 nt, Human
uauuggugggggcagagagaga

SEQ ID NO: 970309 - RNA, 23 nt, Human
cccuggagcuagucugagcagag

SEQ ID NO: 970310 - RNA, 22 nt, Human
uuaaacagucccagaggcugac

SEQ ID NO: 970311 - RNA, 22 nt, Human
gcuggccugaccugaggcuggg

SEQ ID NO: 970312 - RNA, 22 nt, Human
aaguucaaggcagguccugagg

SEQ ID NO: 970313 - RNA, 22 nt, Human
aaaugcauugguuucuacuugu

SEQ ID NO: 970314 - RNA, 22 nt, Human
ccuccaggaacuugagagacac

SEQ ID NO: 970315 - RNA, 22 nt, Human
uggccaaauuugguguaacuug

SEQ ID NO: 970316 - RNA, 19 nt, Human
agggcugcucuggccuggg

SEQ ID NO: 970317 - RNA, 22 nt, Human
acucaggaagaaagcagcuggu

SEQ ID NO: 970318 - RNA, 22 nt, Human
uauuuuaaagacugccagccua

SEQ ID NO: 970319 - RNA, 22 nt, Human
agcccaagcuaugaggugaccu

SEQ ID NO: 970320 - RNA, 22 nt, Human
augcuuugauuugguuucucua

SEQ ID NO: 970321 - RNA, 22 nt, Human
cauuuagagucuugcaauuuua

SEQ ID NO: 970322 - RNA, 19 nt, Human
auaaauaaaaagugggaga

SEQ ID NO: 970323 - RNA, 20 nt, Human
ccugucugcaauggagguca

SEQ ID NO: 970324 - RNA, 22 nt, Human
aggagagagcugagcuuugcug

SEQ ID NO: 970325 - RNA, 22 nt, Human
uccaagggaauuuaaaguugcu

SEQ ID NO: 970326 - RNA, 22 nt, Human
gcaaaugcuaaaguguagagac

SEQ ID NO: 970327 - RNA, 22 nt, Human
gcccagcuggcuuccagcacau

SEQ ID NO: 970328 - RNA, 22 nt, Human
cucacugugaccucagcagaca

SEQ ID NO: 970329 - RNA, 22 nt, Human
agcucccagcagagcuggccac

SEQ ID NO: 970330 - RNA, 22 nt, Human
gcugccuccugaaagcgcucug

SEQ ID NO: 970331 - RNA, 22 nt, Human
ugaggcagcaauuguauuguau

SEQ ID NO: 970332 - RNA, 22 nt, Human
aggaccaguaugagagcaucug

SEQ ID NO: 970333 - RNA, 19 nt, Human
caguggccuggaggucucu

SEQ ID NO: 970334 - RNA, 22 nt, Human
cauguuuacuaccaggagaaug

SEQ ID NO: 970335 - RNA, 22 nt, Human
acagggaaguucugcaacagga

SEQ ID NO: 970336 - RNA, 22 nt, Human
ggcugaaacagauuucaagaca

SEQ ID NO: 970337 - RNA, 22 nt, Human
aagaaaagaaaccugaggcuuu

SEQ ID NO: 970338 - RNA, 19 nt, Human
uccccagcaccucugaguc

SEQ ID NO: 970339 - RNA, 22 nt, Human
gagcagugacuggagcaugaga

SEQ ID NO: 970340 - RNA, 22 nt, Human
uauauuaaccauaggguucuag

SEQ ID NO: 970341 - RNA, 22 nt, Human
ucucagagggaggauuacugcc

SEQ ID NO: 970342 - RNA, 22 nt, Human
acaauauuguacccagaaguuu

SEQ ID NO: 970343 - RNA, 22 nt, Human
caagaaauguuuacugagcauc

SEQ ID NO: 970344 - RNA, 22 nt, Human
ucugggcccuaaaccagcucua

SEQ ID NO: 970345 - RNA, 23 nt, Human
cugcccugaucuugaucuauugu

SEQ ID NO: 970346 - RNA, 21 nt, Human
ugcagcagaguaagcagggga

SEQ ID NO: 970347 - RNA, 22 nt, Human
cucuccuugcagauggcugccu

SEQ ID NO: 970348 - RNA, 22 nt, Human
gagggauggugugagaggcuca

SEQ ID NO: 970349 - RNA, 23 nt, Human
cagggaggagauacuguguaucu

SEQ ID NO: 970350 - RNA, 22 nt, Human
cagccuguagaauacaguaaau

SEQ ID NO: 970351 - RNA, 22 nt, Human
uugaaggaggcuccuuuuuaaa

SEQ ID NO: 970352 - RNA, 22 nt, Human
caggaugaagggcaaaggcaag

SEQ ID NO: 970353 - RNA, 22 nt, Human
ggcagcagcaagguuggagcug

SEQ ID NO: 970354 - RNA, 22 nt, Human
gagaagguggaccugaaggagc

SEQ ID NO: 970355 - RNA, 22 nt, Human
uggcucuguucgccaucaggag

SEQ ID NO: 970356 - RNA, 22 nt, Human
aacauuucagcaaauaagaaca

SEQ ID NO: 970357 - RNA, 22 nt, Human
cagcuuuuuagaaucuagggca

SEQ ID NO: 970358 - RNA, 22 nt, Human
gugugucccuccucuccugagu

SEQ ID NO: 970359 - RNA, 22 nt, Human
agaggccuccgaaaggugggcu

SEQ ID NO: 970360 - RNA, 22 nt, Human
uccagaaacuuuuccagucuca

SEQ ID NO: 970361 - RNA, 22 nt, Human
gaagcagccacggggagacaga

SEQ ID NO: 970362 - RNA, 22 nt, Human
ucucugguuauuaacuaacucc

SEQ ID NO: 970363 - RNA, 22 nt, Human
ucacaacuugaagcugauuuaa

SEQ ID NO: 970364 - RNA, 22 nt, Human
cacaugugugcugaggacugug

SEQ ID NO: 970365 - RNA, 21 nt, Human
auccuugaucagaagagugcu

SEQ ID NO: 970366 - RNA, 22 nt, Human
ggagcggagggagggccacugu

SEQ ID NO: 970367 - RNA, 22 nt, Human
ugaaugugaugcuaaacauaug

SEQ ID NO: 970368 - RNA, 22 nt, Human
auucuucacauggauaggaucu

SEQ ID NO: 970369 - RNA, 20 nt, Human
ccugaggguuuguguucuuu

SEQ ID NO: 970370 - RNA, 23 nt, Human
uggcucugugucacauacaggau

SEQ ID NO: 970371 - RNA, 22 nt, Human
uaugcauauagaugcacacaca

SEQ ID NO: 970372 - RNA, 22 nt, Human
ggccugagcagacagcaugaug

SEQ ID NO: 970373 - RNA, 20 nt, Human
uaaggcuguuuuguauuccu

SEQ ID NO: 970374 - RNA, 22 nt, Human
gcucuggacccuggaguggcug

SEQ ID NO: 970375 - RNA, 22 nt, Human
uaauacuuuugccuuguauuca

SEQ ID NO: 970376 - RNA, 22 nt, Human
gcagcugaagcugcaguuccag

SEQ ID NO: 970377 - RNA, 22 nt, Human
ucugggagaagcugaugugaag

SEQ ID NO: 970378 - RNA, 22 nt, Human
cauguguaugcauucauacaua

SEQ ID NO: 970379 - RNA, 22 nt, Human
gcugguuuccuuaucuauaaag

SEQ ID NO: 970380 - RNA, 22 nt, Human
acagaaauauucguggugcuug

SEQ ID NO: 970381 - RNA, 22 nt, Human
aaauguaguauguugcauguau

SEQ ID NO: 970382 - RNA, 22 nt, Human
ucacaggauaagguggcaucac

SEQ ID NO: 970383 - RNA, 22 nt, Human
uuugaaagcaggugugggaggg

SEQ ID NO: 970384 - RNA, 23 nt, Human
aagaauaaaugacauuaaaggug

SEQ ID NO: 970385 - RNA, 22 nt, Human
gcaggagccaggccgagcuggu

SEQ ID NO: 970386 - RNA, 22 nt, Human
guucacaauuuuuacugauugg

SEQ ID NO: 970387 - RNA, 22 nt, Human
ucauugcagacuaacaaucuca

SEQ ID NO: 970388 - RNA, 22 nt, Human
uagcuuuccuuguugccugugc

SEQ ID NO: 970389 - RNA, 22 nt, Human
ugcaguggugguaaagaugcuc

SEQ ID NO: 970390 - RNA, 22 nt, Human
ucaccugggagggcugugguag

SEQ ID NO: 970391 - RNA, 22 nt, Human
agcuaccuggcuuaucacuguc

SEQ ID NO: 970392 - RNA, 22 nt, Human
uuuaucuuuggaucuucagaaa

SEQ ID NO: 970393 - RNA, 22 nt, Human
ugagaaagugggugccuagcaa

SEQ ID NO: 970394 - RNA, 22 nt, Human
cuuucucugugugguaaagggc

SEQ ID NO: 970395 - RNA, 22 nt, Human
ggcuggcuggcugguagacaag

SEQ ID NO: 970396 - RNA, 22 nt, Human
agaauucuguucuucgggugug

SEQ ID NO: 970397 - RNA, 22 nt, Human
ugcuauacauguacauauuagu

SEQ ID NO: 970398 - RNA, 22 nt, Human
cugcugggcuccucaugugacu

SEQ ID NO: 970399 - RNA, 22 nt, Human
cugugcaguaggucagggcugg

SEQ ID NO: 970400 - RNA, 22 nt, Human
uauugacaauaggcaacugagg

SEQ ID NO: 970401 - RNA, 22 nt, Human
aguugaaauuagaguccuggcu

SEQ ID NO: 970402 - RNA, 22 nt, Human
ggcgaggccgggacaggcugga

SEQ ID NO: 970403 - RNA, 22 nt, Human
agagugcagauaagagaauguu

SEQ ID NO: 970404 - RNA, 22 nt, Human
aauucacaggagguauuugucc

SEQ ID NO: 970405 - RNA, 22 nt, Human
cugaccaucauggugaaacccc

SEQ ID NO: 970406 - RNA, 22 nt, Human
auauacuuggagacuaucauug

SEQ ID NO: 970407 - RNA, 22 nt, Human
acagaguaggugcugucgacug

SEQ ID NO: 970408 - RNA, 22 nt, Human
ugucucaggggcauugaaauaa

SEQ ID NO: 970409 - RNA, 22 nt, Human
ugcuguagcccugcacagugca

SEQ ID NO: 970410 - RNA, 17 nt, Human
ucauuuguugugacuag

SEQ ID NO: 970411 - RNA, 19 nt, Human
ugcccaggccagguugggc

SEQ ID NO: 970412 - RNA, 22 nt, Human
aggguccugggugcaguugcuu

SEQ ID NO: 970413 - RNA, 22 nt, Human
aggucauuggggacuaucuccg

SEQ ID NO: 970414 - RNA, 20 nt, Human
cagagcuguuauggaugaug

SEQ ID NO: 970415 - RNA, 22 nt, Human
auacaacuuuaucuguaaugag

SEQ ID NO: 970416 - RNA, 23 nt, Human
ggccuggcccagggcccugauga

SEQ ID NO: 970417 - RNA, 22 nt, Human
gacagggcaagacucugucuaa

SEQ ID NO: 970418 - RNA, 22 nt, Human
caaggcugcugcgggucgcacc

SEQ ID NO: 970419 - RNA, 22 nt, Human
uccuccagugucuggggccuug

SEQ ID NO: 970420 - RNA, 22 nt, Human
ucccagagugagccaggggcag

SEQ ID NO: 970421 - RNA, 22 nt, Human
ugcuuccuugagcucuccaauc

SEQ ID NO: 970422 - RNA, 22 nt, Human
gacccugccaugagugacaggg

SEQ ID NO: 970423 - RNA, 22 nt, Human
cagcugugaauugucuuaucua

SEQ ID NO: 970424 - RNA, 22 nt, Human
ucuugauuacaaauaacaucau

SEQ ID NO: 970425 - RNA, 22 nt, Human
gaagccuugaacugcaaacccc

SEQ ID NO: 970426 - RNA, 22 nt, Human
cauaacuagagugaaauguuga

SEQ ID NO: 970427 - RNA, 22 nt, Human
aggauuugaaccugcauccagu

SEQ ID NO: 970428 - RNA, 22 nt, Human
ugucugagugugccugggcauu

SEQ ID NO: 970429 - RNA, 20 nt, Human
cugccuggaggccucuaccu

SEQ ID NO: 970430 - RNA, 22 nt, Human
ugcagcuguuacggacccuguc

SEQ ID NO: 970431 - RNA, 22 nt, Human
auuugcuuaucuccacaguugu

SEQ ID NO: 970432 - RNA, 22 nt, Human
ggugcagaggagccagcugggg

SEQ ID NO: 970433 - RNA, 22 nt, Human
gccagcccagcuccaggggaaa

SEQ ID NO: 970434 - RNA, 22 nt, Human
gugcaugugucuuuauaguaga

SEQ ID NO: 970435 - RNA, 21 nt, Human
gccagccuguuuaccuguggu

SEQ ID NO: 970436 - RNA, 22 nt, Human
ugcuguggcaguuuauguauag

SEQ ID NO: 970437 - RNA, 21 nt, Human
aagagcugucaggaaggcugc

SEQ ID NO: 970438 - RNA, 22 nt, Human
uugcugugucauuuguuuaauc

SEQ ID NO: 970439 - RNA, 20 nt, Human
ccaagagcaugcaugaggaa

SEQ ID NO: 970440 - RNA, 22 nt, Human
ugcugagaaucacagguuauaa

SEQ ID NO: 970441 - RNA, 22 nt, Human
gcccaucaucacuguggaggcu

SEQ ID NO: 970442 - RNA, 22 nt, Human
aaacacauuuuaggaaaaucua

SEQ ID NO: 970443 - RNA, 22 nt, Human
accagcagaguugaggaggaca

SEQ ID NO: 970444 - RNA, 22 nt, Human
gugcagugacccuggagagcug

SEQ ID NO: 970445 - RNA, 20 nt, Human
aggacagcagcugccacuug

SEQ ID NO: 970446 - RNA, 22 nt, Human
aucaggaucacugggagucuug

SEQ ID NO: 970447 - RNA, 18 nt, Human
cccucuccugcuaguggg

SEQ ID NO: 970448 - RNA, 22 nt, Human
cauaaguuggguaauauaauga

SEQ ID NO: 970449 - RNA, 22 nt, Human
ggcuucauggaggaggugaguc

SEQ ID NO: 970450 - RNA, 22 nt, Human
ucauuuguugaacuuuagugcg

SEQ ID NO: 970451 - RNA, 22 nt, Human
uuccucagagggcgcuggggaa

SEQ ID NO: 970452 - RNA, 22 nt, Human
agccagcaugaagacagaggcc

SEQ ID NO: 970453 - RNA, 22 nt, Human
aucccugcccucauggagcuua

SEQ ID NO: 970454 - RNA, 22 nt, Human
gaaaaaugcuccaaaucugugg

SEQ ID NO: 970455 - RNA, 22 nt, Human
uggcacauaguaggugcucaau

SEQ ID NO: 970456 - RNA, 22 nt, Human
gacccaggguauccagagcugc

SEQ ID NO: 970457 - RNA, 22 nt, Human
caaauguauaaauguacuuucu

SEQ ID NO: 970458 - RNA, 22 nt, Human
cuccuguauguugggcuucaca

SEQ ID NO: 970459 - RNA, 22 nt, Human
uuucuucuugauuuaaacaggg

SEQ ID NO: 970460 - RNA, 22 nt, Human
cccuguccuuggcugugaggcu

SEQ ID NO: 970461 - RNA, 22 nt, Human
guucucucugcuuccaagaugg

SEQ ID NO: 970462 - RNA, 22 nt, Human
aagccagguguuuaggccagcg

SEQ ID NO: 970463 - RNA, 22 nt, Human
gcuguucugcgucccaggcugg

SEQ ID NO: 970464 - RNA, 22 nt, Human
cccagagcuccgguccugccca

SEQ ID NO: 970465 - RNA, 22 nt, Human
aaaguuagaaugauaucaacga

SEQ ID NO: 970466 - RNA, 22 nt, Human
gccucugcaucuucgccgcacu

SEQ ID NO: 970467 - RNA, 20 nt, Human
aggaaaaauggaaacuggag

SEQ ID NO: 970468 - RNA, 23 nt, Human
agucuucauuguauuuccagacc

SEQ ID NO: 970469 - RNA, 22 nt, Human
cugggggcaagcagacagcugu

SEQ ID NO: 970470 - RNA, 22 nt, Human
accuauuuaugcaauuaugaaa

SEQ ID NO: 970471 - RNA, 22 nt, Human
ggagaggagauuguggcauuuu

SEQ ID NO: 970472 - RNA, 22 nt, Human
ugaggcagucacccccuccugc

SEQ ID NO: 970473 - RNA, 22 nt, Human
augugucuugcggcaguuggua

SEQ ID NO: 970474 - RNA, 22 nt, Human
ugcuuugggucucucuaguuuc

SEQ ID NO: 970475 - RNA, 22 nt, Human
cauccagggcagccauggccug

SEQ ID NO: 970476 - RNA, 22 nt, Human
gcuggccacauugugccguccu

SEQ ID NO: 970477 - RNA, 22 nt, Human
caggcugcggucggcucugguc

SEQ ID NO: 970478 - RNA, 20 nt, Human
ggagagcagggaagacagua

SEQ ID NO: 970479 - RNA, 20 nt, Human
ucccucaggucauugggcug

SEQ ID NO: 970480 - RNA, 22 nt, Human
agacaucagcuugugugcaggg

SEQ ID NO: 970481 - RNA, 22 nt, Human
cuggccugcugggugagguccu

SEQ ID NO: 970482 - RNA, 21 nt, Human
gagacagacuuucguccccug

SEQ ID NO: 970483 - RNA, 22 nt, Human
cacacuuuuggcauguuugguu

SEQ ID NO: 970484 - RNA, 22 nt, Human
cugaagagcucuccuguccccu

SEQ ID NO: 970485 - RNA, 22 nt, Human
ugucccucugaggcuucccugg

SEQ ID NO: 970486 - RNA, 22 nt, Human
gcugucuugcucacucuugcag

SEQ ID NO: 970487 - RNA, 22 nt, Human
ccagcccugucaccaacuggag

SEQ ID NO: 970488 - RNA, 22 nt, Human
uuucuguauuuaaaagaucugg

SEQ ID NO: 970489 - RNA, 22 nt, Human
gagccaagaucgcaccacugca

SEQ ID NO: 970490 - RNA, 22 nt, Human
aggaaaugcugaugcuccugga

SEQ ID NO: 970491 - RNA, 22 nt, Human
gugauuuugagaccuauauagu

SEQ ID NO: 970492 - RNA, 22 nt, Human
acacauuucuaaauuuuuaccg

SEQ ID NO: 970493 - RNA, 22 nt, Human
agcuggcuccagaaggagucgu

SEQ ID NO: 970494 - RNA, 22 nt, Human
caucucaugggcaugccaagcu

SEQ ID NO: 970495 - RNA, 21 nt, Human
agcuuguguguaucacagugu

SEQ ID NO: 970496 - RNA, 22 nt, Human
aggcucugaaggagaaccuguu

SEQ ID NO: 970497 - RNA, 22 nt, Human
gugggagcugcggaggccuggg

SEQ ID NO: 970498 - RNA, 22 nt, Human
agguaacacuacuuaguauacu

SEQ ID NO: 970499 - RNA, 22 nt, Human
uggaggaaucagggcuuaggcu

SEQ ID NO: 970500 - RNA, 22 nt, Human
agggaaugcuccguauaaaucu

SEQ ID NO: 970501 - RNA, 17 nt, Human
gcuuccugugcugggga

SEQ ID NO: 970502 - RNA, 22 nt, Human
uugaacaguuuugucagguuca

SEQ ID NO: 970503 - RNA, 22 nt, Human
aagcagcugauuucacagcuca

SEQ ID NO: 970504 - RNA, 22 nt, Human
ucagugugaguaccaugcucag

SEQ ID NO: 970505 - RNA, 22 nt, Human
gaagaacacuucaugauucauu

SEQ ID NO: 970506 - RNA, 22 nt, Human
ucacuuaaaaauucuaguuaug

SEQ ID NO: 970507 - RNA, 22 nt, Human
ggccucucauguccugggcuuc

SEQ ID NO: 970508 - RNA, 22 nt, Human
gcugccaccguggagaugagug

SEQ ID NO: 970509 - RNA, 22 nt, Human
agaggccuaauugcuacccuuu

SEQ ID NO: 970510 - RNA, 22 nt, Human
gaggaaugucagcacaggccuc

SEQ ID NO: 970511 - RNA, 22 nt, Human
gcagauggaaagugcuugaggg

SEQ ID NO: 970512 - RNA, 22 nt, Human
gugagggguggcugagcaguuu

SEQ ID NO: 970513 - RNA, 22 nt, Human
augagcuguaagguggcuuccu

SEQ ID NO: 970514 - RNA, 22 nt, Human
agaaugcauuuuguguagcuau

SEQ ID NO: 970515 - RNA, 22 nt, Human
acccaggaugauaauguucaca

SEQ ID NO: 970516 - RNA, 22 nt, Human
gcugcccaggagagguggggcu

SEQ ID NO: 970517 - RNA, 22 nt, Human
acauucaaggccuucugacaca

SEQ ID NO: 970518 - RNA, 22 nt, Human
ugggcaggaugcguugauucuu

SEQ ID NO: 970519 - RNA, 22 nt, Human
cuccaggaaagccugaggcccg

SEQ ID NO: 970520 - RNA, 22 nt, Human
cugccuggagcauucugaaggu

SEQ ID NO: 970521 - RNA, 22 nt, Human
ggcaggagauaaaauauuaguu

SEQ ID NO: 970522 - RNA, 22 nt, Human
cccagccaaggugcugguguug

SEQ ID NO: 970523 - RNA, 22 nt, Human
gcccacagcucguuccucuccu

SEQ ID NO: 970524 - RNA, 22 nt, Human
cagcuugggucaggugccugcu

SEQ ID NO: 970525 - RNA, 22 nt, Human
uaggagggcccugaaaauggca

SEQ ID NO: 970526 - RNA, 21 nt, Human
ggacagcugcgcgcagggcuc

SEQ ID NO: 970527 - RNA, 22 nt, Human
aaaugguauuuacucuguauua

SEQ ID NO: 970528 - RNA, 22 nt, Human
uggaggaaaauuacuggggucu

SEQ ID NO: 970529 - RNA, 22 nt, Human
gaaauguguuguucauuucuaa

SEQ ID NO: 970530 - RNA, 22 nt, Human
auucacaaaaugauauagauac

SEQ ID NO: 970531 - RNA, 22 nt, Human
ucuacuuuucccuauacaguuu

SEQ ID NO: 970532 - RNA, 22 nt, Human
uuuuuccuagcgauuugucagc

SEQ ID NO: 970533 - RNA, 22 nt, Human
auucugagaaaugcauugucag

SEQ ID NO: 970534 - RNA, 22 nt, Human
cuguuuaucuaggaguugcagg

SEQ ID NO: 970535 - RNA, 22 nt, Human
acuccugguuuguguccuggcu

SEQ ID NO: 970536 - RNA, 22 nt, Human
cagcaaaauuugaggauugccu

SEQ ID NO: 970537 - RNA, 22 nt, Human
auguggaggaaaugaguguaca

SEQ ID NO: 970538 - RNA, 22 nt, Human
cacugucuuuugugaagacaau

SEQ ID NO: 970539 - RNA, 22 nt, Human
gugcaugugucuuuauaguagc

SEQ ID NO: 970540 - RNA, 22 nt, Human
gcaaaacagucgaugccuccca

SEQ ID NO: 970541 - RNA, 22 nt, Human
uccuucaguucaauuaguccgu

SEQ ID NO: 970542 - RNA, 22 nt, Human
gucuucuuuaaccuacuaaagc

SEQ ID NO: 970543 - RNA, 22 nt, Human
auuuauguaucuguguagauca

SEQ ID NO: 970544 - RNA, 22 nt, Human
cuucuuaaugacagauuaaaau

SEQ ID NO: 970545 - RNA, 22 nt, Human
uucuucaauuuuccauauacug

SEQ ID NO: 970546 - RNA, 22 nt, Human
ccugccugucaucgccugcgcc

SEQ ID NO: 970547 - RNA, 22 nt, Human
uuuggccacagauccuuggggg

SEQ ID NO: 970548 - RNA, 22 nt, Human
uggcagcugucuguggggucuc

SEQ ID NO: 970549 - RNA, 22 nt, Human
acauuucugagcagggagcugu

SEQ ID NO: 970550 - RNA, 22 nt, Human
gcuguucagggcacucaugggc

SEQ ID NO: 970551 - RNA, 21 nt, Human
ggcccugguuacgccuccucu

SEQ ID NO: 970552 - RNA, 22 nt, Human
acagaaauauagaagguaggaa

SEQ ID NO: 970553 - RNA, 22 nt, Human
auacauguaacugcauuguaau

SEQ ID NO: 970554 - RNA, 22 nt, Human
agugcuuucuugcuccaucagu

SEQ ID NO: 970555 - RNA, 22 nt, Human
gggacagcuguagugcuuggcu

SEQ ID NO: 970556 - RNA, 22 nt, Human
ucauugucuugauaugauuguc

SEQ ID NO: 970557 - RNA, 22 nt, Human
acagaauuaaaguguuugugga

SEQ ID NO: 970558 - RNA, 22 nt, Human
aaguucaagucugcaucuuuuu

SEQ ID NO: 970559 - RNA, 22 nt, Human
cagcugagcucccaggccauca

SEQ ID NO: 970560 - RNA, 22 nt, Human
agcugcccagauaggaggaggc

SEQ ID NO: 970561 - RNA, 18 nt, Human
acccaggcucaugguccu

SEQ ID NO: 970562 - RNA, 22 nt, Human
aucacauuguuagcauagacug

SEQ ID NO: 970563 - RNA, 22 nt, Human
aaggcugcuuuuaacaugcaua

SEQ ID NO: 970564 - RNA, 22 nt, Human
acacagggcaaugcuuugaccu

SEQ ID NO: 970565 - RNA, 22 nt, Human
cucacaggcaucucaucaggcu

SEQ ID NO: 970566 - RNA, 22 nt, Human
cagggcugaaaucaagguguag

SEQ ID NO: 970567 - RNA, 22 nt, Human
agcagaaccugcagaccugucu

SEQ ID NO: 970568 - RNA, 22 nt, Human
ucaaagucucugcuucuguaac

SEQ ID NO: 970569 - RNA, 22 nt, Human
uaguuucagcuccuucauccug

SEQ ID NO: 970570 - RNA, 22 nt, Human
uugggcuggcagagguggucuu

SEQ ID NO: 970571 - RNA, 22 nt, Human
auguacauuuuccuaauguuuu

SEQ ID NO: 970572 - RNA, 22 nt, Human
uugaggagcaggaugggaggcu

SEQ ID NO: 970573 - RNA, 22 nt, Human
agcaugaaagcauaggacaguc

SEQ ID NO: 970574 - RNA, 22 nt, Human
aauuucaaugcacucaugguug

SEQ ID NO: 970575 - RNA, 22 nt, Human
acuuaguauuuuucagcuuuga

SEQ ID NO: 970576 - RNA, 22 nt, Human
gaggaggcacuugagcagaugu

SEQ ID NO: 970577 - RNA, 22 nt, Human
uguuaaucaaucaacaguauua

SEQ ID NO: 970578 - RNA, 22 nt, Human
ugcccugucuaagcugucagua

SEQ ID NO: 970579 - RNA, 22 nt, Human
gaggacagugugaucugccagc

SEQ ID NO: 970580 - RNA, 19 nt, Human
aucagcaagguaggaugug

SEQ ID NO: 970581 - RNA, 22 nt, Human
cuugaaagcuuugcgucuucua

SEQ ID NO: 970582 - RNA, 22 nt, Human
uggcucugaccagguagaggag

SEQ ID NO: 970583 - RNA, 22 nt, Human
cugcuguguuucacaccucugg

SEQ ID NO: 970584 - RNA, 22 nt, Human
agguaaagacagugaaagaggg

SEQ ID NO: 970585 - RNA, 22 nt, Human
augcugcacaagccacauguag

SEQ ID NO: 970586 - RNA, 22 nt, Human
guucuucagcauuagaagucau

SEQ ID NO: 970587 - RNA, 22 nt, Human
uucuagaugauaaaccagcagc

SEQ ID NO: 970588 - RNA, 22 nt, Human
cugggagcugucaggagcgugu

SEQ ID NO: 970589 - RNA, 22 nt, Human
uuugaaaucuaaucaaggaaca

SEQ ID NO: 970590 - RNA, 20 nt, Human
uuccagagaucugcauuuua

SEQ ID NO: 970591 - RNA, 22 nt, Human
ugccugugguuccaguuuuuuc

SEQ ID NO: 970592 - RNA, 20 nt, Human
accccagccccucuaucuga

SEQ ID NO: 970593 - RNA, 22 nt, Human
gaucauuuacuuguucuggacu

SEQ ID NO: 970594 - RNA, 22 nt, Human
aggaaagcucccaguagggcuc

SEQ ID NO: 970595 - RNA, 22 nt, Human
cuucuucacacuggucugaagc

SEQ ID NO: 970596 - RNA, 22 nt, Human
ugugccuggaucucugugacaa

SEQ ID NO: 970597 - RNA, 22 nt, Human
ucuguucaagacugaggugaca

SEQ ID NO: 970598 - RNA, 22 nt, Human
ggcucuggcaaggggaggcuac

SEQ ID NO: 970599 - RNA, 22 nt, Human
aaugaacaggugaaugucagau

SEQ ID NO: 970600 - RNA, 22 nt, Human
ugucuagggagcugcucaggcu

SEQ ID NO: 970601 - RNA, 22 nt, Human
uccagcagaaaagagguaggga

SEQ ID NO: 970602 - RNA, 22 nt, Human
uagauuuccucuuccucauucc

SEQ ID NO: 970603 - RNA, 22 nt, Human
aauggcugggaguguauuuugg

SEQ ID NO: 970604 - RNA, 22 nt, Human
gcugucagugaggugagacaug

SEQ ID NO: 970605 - RNA, 20 nt, Human
caccaggcgcucugagaaca

SEQ ID NO: 970606 - RNA, 22 nt, Human
agcagcugaucaaagcacuuau

SEQ ID NO: 970607 - RNA, 22 nt, Human
gccugcuguuaacugcaggaau

SEQ ID NO: 970608 - RNA, 22 nt, Human
cauuaaaauaucucaugguguu

SEQ ID NO: 970609 - RNA, 22 nt, Human
ucaaagucauggcuaguaauga

SEQ ID NO: 970610 - RNA, 22 nt, Human
agcuccugaaaagcgcuugcuu

SEQ ID NO: 970611 - RNA, 22 nt, Human
gugccucagcaccgccugcagc

SEQ ID NO: 970612 - RNA, 22 nt, Human
agaagccacuggagguugagau

SEQ ID NO: 970613 - RNA, 18 nt, Human
uuccaugauuccuuucac

SEQ ID NO: 970614 - RNA, 22 nt, Human
aaaaguguccagauuaugaaga

SEQ ID NO: 970615 - RNA, 22 nt, Human
cucugagcagaggccguggcua

SEQ ID NO: 970616 - RNA, 22 nt, Human
gguggguauugaauacaggugu

SEQ ID NO: 970617 - RNA, 22 nt, Human
uggagacugugcuaagggaguu

SEQ ID NO: 970618 - RNA, 22 nt, Human
acccaggcuggagugcaguagc

SEQ ID NO: 970619 - RNA, 22 nt, Human
ggcagaagaaaggcuaagucuc

SEQ ID NO: 970620 - RNA, 22 nt, Human
aaaucagagucugauuuuaagg

SEQ ID NO: 970621 - RNA, 22 nt, Human
ugucuuauggcauguccacugg

SEQ ID NO: 970622 - RNA, 19 nt, Human
cagaacagaggucauggcc

SEQ ID NO: 970623 - RNA, 22 nt, Human
cccagcuccuuggaugggcagg

SEQ ID NO: 970624 - RNA, 22 nt, Human
uggacaggugagugacucaggg

SEQ ID NO: 970625 - RNA, 21 nt, Human
uacauuugagagcuauaagcu

SEQ ID NO: 970626 - RNA, 22 nt, Human
ccugccugcaaaaugggacaag

SEQ ID NO: 970627 - RNA, 22 nt, Human
cagcuggcagcccuggcccugc

SEQ ID NO: 970628 - RNA, 22 nt, Human
ugggccugggagggcagacgcu

SEQ ID NO: 970629 - RNA, 22 nt, Human
aggagugcaaauaguccagaga

SEQ ID NO: 970630 - RNA, 23 nt, Human
acuauaaaguuguucugauuuac

SEQ ID NO: 970631 - RNA, 22 nt, Human
ugggcagagucauacaggagac

SEQ ID NO: 970632 - RNA, 17 nt, Human
ugccagccugucccagg

SEQ ID NO: 970633 - RNA, 22 nt, Human
aaugauguauuaguacaacaca

SEQ ID NO: 970634 - RNA, 22 nt, Human
agaaaugcucuuccugaccaga

SEQ ID NO: 970635 - RNA, 22 nt, Human
gccucugcucucagguagccuc

SEQ ID NO: 970636 - RNA, 22 nt, Human
agccaucauuucugucacuggc

SEQ ID NO: 970637 - RNA, 22 nt, Human
uuugaaaggaauuaggaugaca

SEQ ID NO: 970638 - RNA, 22 nt, Human
uacauguaggugacauuuuaau

SEQ ID NO: 970639 - RNA, 22 nt, Human
uggccagguugggcuuugcagc

SEQ ID NO: 970640 - RNA, 22 nt, Human
uuccauuuauucuuguccagau

SEQ ID NO: 970641 - RNA, 22 nt, Human
ucacucugggccagcgcaggua

SEQ ID NO: 970642 - RNA, 22 nt, Human
acauguuagaaaugcagaaucu

SEQ ID NO: 970643 - RNA, 22 nt, Human
uguuucagucccuguguucaau

SEQ ID NO: 970644 - RNA, 22 nt, Human
cugaaaugacgguuuggggcaa

SEQ ID NO: 970645 - RNA, 22 nt, Human
ccaguucuaaacauaaagcuaa

SEQ ID NO: 970646 - RNA, 22 nt, Human
gcugucucauacaaggcccugc

SEQ ID NO: 970647 - RNA, 22 nt, Human
ucuggagcaacagagcaggaca

SEQ ID NO: 970648 - RNA, 22 nt, Human
ugcccaaguguuuggcugaguc

SEQ ID NO: 970649 - RNA, 22 nt, Human
cagccugcagggcugccuguug

SEQ ID NO: 970650 - RNA, 22 nt, Human
ucugggcagcagcagcuaguag

SEQ ID NO: 970651 - RNA, 22 nt, Human
uucaguaaaacacugcaauguc

SEQ ID NO: 970652 - RNA, 22 nt, Human
aggcagggucuugcuauguugc

SEQ ID NO: 970653 - RNA, 22 nt, Human
ucucagagcuucagaaagcacc

SEQ ID NO: 970654 - RNA, 22 nt, Human
uggcaacaccuggaagacaugg

SEQ ID NO: 970655 - RNA, 22 nt, Human
aaauguagaccuauagggaccu

SEQ ID NO: 970656 - RNA, 22 nt, Human
aagugaagaaauacaugagaau

SEQ ID NO: 970657 - RNA, 22 nt, Human
aaugcacaugccacauguggua

SEQ ID NO: 970658 - RNA, 22 nt, Human
aagacuguacauuuuccagucu

SEQ ID NO: 970659 - RNA, 22 nt, Human
cuuaagaugaggucaugcuaua

SEQ ID NO: 970660 - RNA, 22 nt, Human
ucagcugccccaguggccccag

SEQ ID NO: 970661 - RNA, 22 nt, Human
gcuggccaggaagagucucaga

SEQ ID NO: 970662 - RNA, 22 nt, Human
uggcagagaugaagaguuguuu

SEQ ID NO: 970663 - RNA, 22 nt, Human
cacauguaguaagcaggcaaug

SEQ ID NO: 970664 - RNA, 22 nt, Human
uucuuucagaacacaagugauu

SEQ ID NO: 970665 - RNA, 22 nt, Human
gggcuuggcacaugggcucagc

SEQ ID NO: 970666 - RNA, 22 nt, Human
ccagaccacccuggccaugcac

SEQ ID NO: 970667 - RNA, 22 nt, Human
gcagugccuugcuucucugucu

SEQ ID NO: 970668 - RNA, 22 nt, Human
uguccucuuccagugcuccuuc

SEQ ID NO: 970669 - RNA, 22 nt, Human
agagccagcaagugaauaguga

SEQ ID NO: 970670 - RNA, 22 nt, Human
aagugaguggccuggagaggug

SEQ ID NO: 970671 - RNA, 22 nt, Human
guggccagaagacugcaaugcu

SEQ ID NO: 970672 - RNA, 22 nt, Human
aggaggcuguggagcacuccau

SEQ ID NO: 970673 - RNA, 22 nt, Human
gcugccuggcuuuaguccacuu

SEQ ID NO: 970674 - RNA, 22 nt, Human
cagacagacagccguggccacc

SEQ ID NO: 970675 - RNA, 21 nt, Human
ugauccuuucccccauguugc

SEQ ID NO: 970676 - RNA, 22 nt, Human
aaaguguggagauugaacuaaa

SEQ ID NO: 970677 - RNA, 21 nt, Human
ucacagacuggucagugaggc

SEQ ID NO: 970678 - RNA, 22 nt, Human
aggacagcccuugagagcacau

SEQ ID NO: 970679 - RNA, 20 nt, Human
uccuggccuucucgggcagu

SEQ ID NO: 970680 - RNA, 22 nt, Human
ugcccaggauugugaggucagg

SEQ ID NO: 970681 - RNA, 22 nt, Human
uucaaauacauucuuugccacu

SEQ ID NO: 970682 - RNA, 22 nt, Human
aauacaaucaaauucacuagca

SEQ ID NO: 970683 - RNA, 22 nt, Human
gggaaccagccgcuuccgccuc

SEQ ID NO: 970684 - RNA, 19 nt, Human
acuuugcaugugugucuaa

SEQ ID NO: 970685 - RNA, 22 nt, Human
ucagcagggcugugguguggcu

SEQ ID NO: 970686 - RNA, 22 nt, Human
auuguuaugaaaauaagauguu

SEQ ID NO: 970687 - RNA, 22 nt, Human
uuuuauugucaaugaagacaga

SEQ ID NO: 970688 - RNA, 22 nt, Human
cuuaaaaucuggcaguuagcua

SEQ ID NO: 970689 - RNA, 22 nt, Human
gccuucugugcuccuggccuuu

SEQ ID NO: 970690 - RNA, 22 nt, Human
cccuggaggcggauguugcagu

SEQ ID NO: 970691 - RNA, 22 nt, Human
gcagacagacugcagugauuuu

SEQ ID NO: 970692 - RNA, 22 nt, Human
ggagccuggucagguuggcucc

SEQ ID NO: 970693 - RNA, 22 nt, Human
agccauuggcugccuggugcgu

SEQ ID NO: 970694 - RNA, 22 nt, Human
gcuguucacggaggaggauggg

SEQ ID NO: 970695 - RNA, 23 nt, Human
agggguggucaguacccgcagug

SEQ ID NO: 970696 - RNA, 22 nt, Human
gcagagguggcaucugggcucu

SEQ ID NO: 970697 - RNA, 22 nt, Human
gccugccugaaggcuguaccag

SEQ ID NO: 970698 - RNA, 22 nt, Human
uucuucuugaaacuuuagguug

SEQ ID NO: 970699 - RNA, 20 nt, Human
gcccacucuaauccacuguc

SEQ ID NO: 970700 - RNA, 22 nt, Human
ggcagcuuuuaucccugacaga

SEQ ID NO: 970701 - RNA, 22 nt, Human
agacagcugggaaauggagugu

SEQ ID NO: 970702 - RNA, 22 nt, Human
uggguggcacuucuggggucca

SEQ ID NO: 970703 - RNA, 22 nt, Human
guauuagguuggugcaaaauug

SEQ ID NO: 970704 - RNA, 22 nt, Human
ggccuguguccuccuugcccug

SEQ ID NO: 970705 - RNA, 22 nt, Human
acagcacaaucugagucccaga

SEQ ID NO: 970706 - RNA, 22 nt, Human
uuaaaugaacgagauaugcaac

SEQ ID NO: 970707 - RNA, 22 nt, Human
gagagcugauagaugagcuacu

SEQ ID NO: 970708 - RNA, 17 nt, Human
agaaagaggauccacag

SEQ ID NO: 970709 - RNA, 22 nt, Human
uguuggcagauugucuaggguu

SEQ ID NO: 970710 - RNA, 22 nt, Human
ccuggccagcagccccuuccuc

SEQ ID NO: 970711 - RNA, 22 nt, Human
ccaggagaauaauggcagauua

SEQ ID NO: 970712 - RNA, 22 nt, Human
agcaccaucagaugcaauaucu

SEQ ID NO: 970713 - RNA, 22 nt, Human
ccuguucaagguauuaauuauc

SEQ ID NO: 970714 - RNA, 22 nt, Human
augguuuguguggcccagauga

SEQ ID NO: 970715 - RNA, 22 nt, Human
accuacccuuagaucacaaggg

SEQ ID NO: 970716 - RNA, 16 nt, Human
gcucugcugaggccca

SEQ ID NO: 970717 - RNA, 22 nt, Human
gaaucucaaggcuugugaggau

SEQ ID NO: 970718 - RNA, 19 nt, Human
uccauaagcuuguguucau

SEQ ID NO: 970719 - RNA, 22 nt, Human
cgcaccacugaauuccagccug

SEQ ID NO: 970720 - RNA, 22 nt, Human
cauccugguuaccccauaguca

SEQ ID NO: 970721 - RNA, 22 nt, Human
gacaguuuuuaauccuuucaug

SEQ ID NO: 970722 - RNA, 22 nt, Human
accuuuuauguaaauauauguu

SEQ ID NO: 970723 - RNA, 22 nt, Human
ucuucauuccguagauauuuau

SEQ ID NO: 970724 - RNA, 22 nt, Human
ggagcugggaauuggaucaucu

SEQ ID NO: 970725 - RNA, 22 nt, Human
auagucacucuguuagguguuu

SEQ ID NO: 970726 - RNA, 22 nt, Human
ggagacagugacuuagagacug

SEQ ID NO: 970727 - RNA, 22 nt, Human
ucacauuuucuacuacuguacg

SEQ ID NO: 970728 - RNA, 22 nt, Human
agaggggcucauauccugucau

SEQ ID NO: 970729 - RNA, 22 nt, Human
gagcagugguugaacagaggca

SEQ ID NO: 970730 - RNA, 22 nt, Human
agggaaaggcugaugcuguggg

SEQ ID NO: 970731 - RNA, 22 nt, Human
acacauuaugagcaguugucuu

SEQ ID NO: 970732 - RNA, 22 nt, Human
gagagaaaugugcaguuugggc

SEQ ID NO: 970733 - RNA, 22 nt, Human
ugucaugccaggaaauaguccc

SEQ ID NO: 970734 - RNA, 22 nt, Human
agagccugggaauuugcauguu

SEQ ID NO: 970735 - RNA, 22 nt, Human
ccuggagagagaggccaacugc

SEQ ID NO: 970736 - RNA, 23 nt, Human
ugaaggccuggaggacgcguugu

SEQ ID NO: 970737 - RNA, 22 nt, Human
gaucuucuauguaaugaagugu

SEQ ID NO: 970738 - RNA, 22 nt, Human
auauaauaguuucauaaaggcu

SEQ ID NO: 970739 - RNA, 23 nt, Human
uccuucagagccucccuccaagc

SEQ ID NO: 970740 - RNA, 22 nt, Human
uggcuggcgccgggcuagccac

SEQ ID NO: 970741 - RNA, 22 nt, Human
aaugcuguaaagaugcuaucug

SEQ ID NO: 970742 - RNA, 22 nt, Human
aaacuuuaagacaguccucaag

SEQ ID NO: 970743 - RNA, 22 nt, Human
ucuuaaagcagcuuguaaaaug

SEQ ID NO: 970744 - RNA, 22 nt, Human
gcugcccugugguccagcaggu

SEQ ID NO: 970745 - RNA, 22 nt, Human
uuggcucaggaccccugugacu

SEQ ID NO: 970746 - RNA, 22 nt, Human
aauucuauguucuugaguaaga

SEQ ID NO: 970747 - RNA, 22 nt, Human
ucacugcaaccucugccuuccg

SEQ ID NO: 970748 - RNA, 22 nt, Human
ggcuggccucaggguccucgcu

SEQ ID NO: 970749 - RNA, 22 nt, Human
ugcucugcaagcaggagcaaga

SEQ ID NO: 970750 - RNA, 22 nt, Human
uugugguuaaccgcacauuuuu

SEQ ID NO: 970751 - RNA, 22 nt, Human
ggaggcugagaaguccaagauc

SEQ ID NO: 970752 - RNA, 22 nt, Human
cugggagcccgcguccuggugg

SEQ ID NO: 970753 - RNA, 22 nt, Human
uuacugaaaauucuucaggauu

SEQ ID NO: 970754 - RNA, 22 nt, Human
auacauacauguacacauaaau

SEQ ID NO: 970755 - RNA, 22 nt, Human
cucuucuugucucugguuagaa

SEQ ID NO: 970756 - RNA, 22 nt, Human
cuggugggaggcaagguggaag

SEQ ID NO: 970757 - RNA, 22 nt, Human
gcauggcagugaggauggugcu

SEQ ID NO: 970758 - RNA, 22 nt, Human
ugcucuguugugcaugugggau

SEQ ID NO: 970759 - RNA, 22 nt, Human
agcaacuguuacaagaacaaca

SEQ ID NO: 970760 - RNA, 23 nt, Human
gccaggcuccggucuguggccac

SEQ ID NO: 970761 - RNA, 22 nt, Human
cagaguguuagcgcugguuggg

SEQ ID NO: 970762 - RNA, 22 nt, Human
ccaggccugcaucugcugcgca

SEQ ID NO: 970763 - RNA, 22 nt, Human
ucugggagguggcagggugcau

SEQ ID NO: 970764 - RNA, 22 nt, Human
uaaacaugugagugugcauaua

SEQ ID NO: 970765 - RNA, 22 nt, Human
ucuuugcaugcauuuucccuua

SEQ ID NO: 970766 - RNA, 22 nt, Human
aggcagcuuucuggugcaccau

SEQ ID NO: 970767 - RNA, 20 nt, Human
ucagugauuuugaagaggaa

SEQ ID NO: 970768 - RNA, 22 nt, Human
caaagguaaagaucugcugugg

SEQ ID NO: 970769 - RNA, 22 nt, Human
uuuucuaacaucuaguaauuug

SEQ ID NO: 970770 - RNA, 22 nt, Human
aucaggauucaccccagagcug

SEQ ID NO: 970771 - RNA, 22 nt, Human
auugacaaucuacuauguucug

SEQ ID NO: 970772 - RNA, 22 nt, Human
guuccauaucacagcagacgaa

SEQ ID NO: 970773 - RNA, 19 nt, Human
uuucuuaggccuuuggccu

SEQ ID NO: 970774 - RNA, 22 nt, Human
ugcugccacauuuaaagagggg

SEQ ID NO: 970775 - RNA, 22 nt, Human
uggagccugagucagcggaggc

SEQ ID NO: 970776 - RNA, 22 nt, Human
ccucuguccuggggaguggagc

SEQ ID NO: 970777 - RNA, 22 nt, Human
agggcugcugaggaagccuugc

SEQ ID NO: 970778 - RNA, 22 nt, Human
ccagccuggguguuagaagaca

SEQ ID NO: 970779 - RNA, 22 nt, Human
gcagagccgugaauggauuuca

SEQ ID NO: 970780 - RNA, 22 nt, Human
ugcauuauacuuuuagaaauuu

SEQ ID NO: 970781 - RNA, 22 nt, Human
caacccaaaagcguuuccauuu

SEQ ID NO: 970782 - RNA, 22 nt, Human
ucuuugaauucaaacuguucaa

SEQ ID NO: 970783 - RNA, 22 nt, Human
aucacuguguauguauaugcag

SEQ ID NO: 970784 - RNA, 22 nt, Human
auguuuuugagauacaaacaga

SEQ ID NO: 970785 - RNA, 22 nt, Human
uccucugcuguucugguucuuu

SEQ ID NO: 970786 - RNA, 22 nt, Human
ggccaaaugaaaucugagcaau

SEQ ID NO: 970787 - RNA, 22 nt, Human
cagaacauucacucauaugugg

SEQ ID NO: 970788 - RNA, 22 nt, Human
uagagaaauaagcuuugccuug

SEQ ID NO: 970789 - RNA, 22 nt, Human
uggcucaguuugggggauugaa

SEQ ID NO: 970790 - RNA, 22 nt, Human
acauuucucuugaugucucuau

SEQ ID NO: 970791 - RNA, 22 nt, Human
gagaggauccacaaaccaggaa

SEQ ID NO: 970792 - RNA, 18 nt, Human
acaaaggucugcaagacc

SEQ ID NO: 970793 - RNA, 22 nt, Human
uguuacuuaucucacgugaugc

SEQ ID NO: 970794 - RNA, 22 nt, Human
uaguuaggguucugcagagaca

SEQ ID NO: 970795 - RNA, 22 nt, Human
auguacacaugcaugcaugugc

SEQ ID NO: 970796 - RNA, 22 nt, Human
aaggcacugaaaaauugugugu

SEQ ID NO: 970797 - RNA, 21 nt, Human
uucaaugaaaacaaagugagg

SEQ ID NO: 970798 - RNA, 22 nt, Human
agagcucaagacgcucacagua

SEQ ID NO: 970799 - RNA, 22 nt, Human
aggcugcagugcagguaggauu

SEQ ID NO: 970800 - RNA, 22 nt, Human
cuaugaaaggauuuggaguugu

SEQ ID NO: 970801 - RNA, 22 nt, Human
ccagcccuguaaggaugaggca

SEQ ID NO: 970802 - RNA, 23 nt, Human
aggcgagcucuucuccagcacgu

SEQ ID NO: 970803 - RNA, 22 nt, Human
augcagcuucaggauuaugaug

SEQ ID NO: 970804 - RNA, 22 nt, Human
uaaaucccuacaucuguguuuu

SEQ ID NO: 970805 - RNA, 22 nt, Human
uuauuauaaugagggauaaaaa

SEQ ID NO: 970806 - RNA, 22 nt, Human
gcccagccuccaagcuccaagg

SEQ ID NO: 970807 - RNA, 20 nt, Human
uacagaaacaggacuuuugg

SEQ ID NO: 970808 - RNA, 19 nt, Human
augauggucccauucaccu

SEQ ID NO: 970809 - RNA, 22 nt, Human
ugcuuggcuuucugagcuucug

SEQ ID NO: 970810 - RNA, 22 nt, Human
cugggucuggugucaggcgacg

SEQ ID NO: 970811 - RNA, 22 nt, Human
uuauuucuugucuauguagcca

SEQ ID NO: 970812 - RNA, 22 nt, Human
caagagcuuuagaaaugcucau

SEQ ID NO: 970813 - RNA, 22 nt, Human
agggagccagaguugggagcuc

SEQ ID NO: 970814 - RNA, 22 nt, Human
uggagccuguguuucugcccag

SEQ ID NO: 970815 - RNA, 20 nt, Human
ugugugcacacaugacauuc

SEQ ID NO: 970816 - RNA, 22 nt, Human
gcagcaaucuucacagugucau

SEQ ID NO: 970817 - RNA, 22 nt, Human
uauugaugcuuggauugggcca

SEQ ID NO: 970818 - RNA, 22 nt, Human
augacacaauuuuagagcugaa

SEQ ID NO: 970819 - RNA, 22 nt, Human
uagaaacagagagauaugcccc

SEQ ID NO: 970820 - RNA, 22 nt, Human
gcugcugcgcuugucuacuguu

SEQ ID NO: 970821 - RNA, 22 nt, Human
uccucacaagcaagcacaggua

SEQ ID NO: 970822 - RNA, 22 nt, Human
aggucaccauggcaugcuccac

SEQ ID NO: 970823 - RNA, 23 nt, Human
cuccucguaacucuguggugggu

SEQ ID NO: 970824 - RNA, 22 nt, Human
ugaagccaucaggaagccagca

SEQ ID NO: 970825 - RNA, 22 nt, Human
cuucagggugacgcaggcugca

SEQ ID NO: 970826 - RNA, 22 nt, Human
ugcaagcacucaaugcaaacag

SEQ ID NO: 970827 - RNA, 22 nt, Human
uuucuuaggcucuaaaaugacu

SEQ ID NO: 970828 - RNA, 22 nt, Human
cuuaauaaaugguagcuguuau

SEQ ID NO: 970829 - RNA, 20 nt, Human
ugucagugccugaggcacag

SEQ ID NO: 970830 - RNA, 17 nt, Human
cauguguaugugggagu

SEQ ID NO: 970831 - RNA, 22 nt, Human
gcugagagcaguguggccuuaa

SEQ ID NO: 970832 - RNA, 23 nt, Human
ccucccaccuauuucacuuucuu

SEQ ID NO: 970833 - RNA, 22 nt, Human
gcaaagucugcaucuggaucag

SEQ ID NO: 970834 - RNA, 22 nt, Human
aaaauaguuaacguucagagua

SEQ ID NO: 970835 - RNA, 22 nt, Human
ucucucugccaacucacagcca

SEQ ID NO: 970836 - RNA, 22 nt, Human
agcccaagcauaggagggaggc

SEQ ID NO: 970837 - RNA, 22 nt, Human
ucucagaggucuucagccucug

SEQ ID NO: 970838 - RNA, 20 nt, Human
uuggccaaaucuuagucaug

SEQ ID NO: 970839 - RNA, 22 nt, Human
ucauuuguucaucugcucuucu

SEQ ID NO: 970840 - RNA, 22 nt, Human
ugaucagucccaugaucuucca

SEQ ID NO: 970841 - RNA, 22 nt, Human
uagcagggaaggugugcugagc

SEQ ID NO: 970842 - RNA, 22 nt, Human
uucaagaucgaguuuaaaguga

SEQ ID NO: 970843 - RNA, 22 nt, Human
gaggcugcugagagcccuguuu

SEQ ID NO: 970844 - RNA, 22 nt, Human
gagcugcuucugugugccgggu

SEQ ID NO: 970845 - RNA, 22 nt, Human
ucacaauuuggauacagcuaug

SEQ ID NO: 970846 - RNA, 22 nt, Human
caggccucuauggucagcugag

SEQ ID NO: 970847 - RNA, 22 nt, Human
ucacucuguguuucccugggac

SEQ ID NO: 970848 - RNA, 22 nt, Human
guccucugcuucaugcccugau

SEQ ID NO: 970849 - RNA, 22 nt, Human
uugcucagcacuggagccagcu

SEQ ID NO: 970850 - RNA, 22 nt, Human
gagaaguuucugguuugcauag

SEQ ID NO: 970851 - RNA, 22 nt, Human
cccucuggcucuucucaggccg

SEQ ID NO: 970852 - RNA, 23 nt, Human
aucauucuccaaucuggagcagg

SEQ ID NO: 970853 - RNA, 22 nt, Human
agaaaguucugugaguuguuca

SEQ ID NO: 970854 - RNA, 22 nt, Human
aagaugauagaucugucaaugu

SEQ ID NO: 970855 - RNA, 22 nt, Human
ugcacauucacuuagguauugu

SEQ ID NO: 970856 - RNA, 22 nt, Human
uaaguucaaugaacucaguucu

SEQ ID NO: 970857 - RNA, 22 nt, Human
gagaggcugaaaucacaggagc

SEQ ID NO: 970858 - RNA, 22 nt, Human
uucuucaaaacaacacuggccu

SEQ ID NO: 970859 - RNA, 22 nt, Human
uuugaaaggagcuuuauccaga

SEQ ID NO: 970860 - RNA, 23 nt, Human
ugcugguguuuuugggaccaggg

SEQ ID NO: 970861 - RNA, 22 nt, Human
uauuuaaaaagaggccagcugg

SEQ ID NO: 970862 - RNA, 22 nt, Human
caaggaaaacagaugaucaaca

SEQ ID NO: 970863 - RNA, 22 nt, Human
acacccagagcgccagugccga

SEQ ID NO: 970864 - RNA, 22 nt, Human
ucaaaaaguugaagaguugggg

SEQ ID NO: 970865 - RNA, 22 nt, Human
uaggcagcauggauucugaaua

SEQ ID NO: 970866 - RNA, 22 nt, Human
ugccacagaggugaagcccacu

SEQ ID NO: 970867 - RNA, 22 nt, Human
aaacuacuggauuaguaacuua

SEQ ID NO: 970868 - RNA, 19 nt, Human
cccagagcauccugaacuu

SEQ ID NO: 970869 - RNA, 18 nt, Human
uggagcagguaggcauga

SEQ ID NO: 970870 - RNA, 22 nt, Human
ucucugcuugguguaugugagu

SEQ ID NO: 970871 - RNA, 22 nt, Human
ggucuaaaaugagucuuccuag

SEQ ID NO: 970872 - RNA, 22 nt, Human
ggcuuccuggagaaggucugag

SEQ ID NO: 970873 - RNA, 22 nt, Human
gccugagacagugugguccaau

SEQ ID NO: 970874 - RNA, 22 nt, Human
ugugaaagcaagucuaguucuc

SEQ ID NO: 970875 - RNA, 22 nt, Human
cuggcucuucagugcuugguuc

SEQ ID NO: 970876 - RNA, 22 nt, Human
uggcagucauuaucgcugaguc

SEQ ID NO: 970877 - RNA, 22 nt, Human
agcccagguugaggcugcagug

SEQ ID NO: 970878 - RNA, 22 nt, Human
uucuucaauuauuggaaagaaa

SEQ ID NO: 970879 - RNA, 22 nt, Human
uuaacagacauauauauuugua

SEQ ID NO: 970880 - RNA, 22 nt, Human
gaagccaacauuccaaguagaa

SEQ ID NO: 970881 - RNA, 22 nt, Human
uaacccaaaggcaaugucucga

SEQ ID NO: 970882 - RNA, 22 nt, Human
ucugucccugagagcucaggag

SEQ ID NO: 970883 - RNA, 22 nt, Human
aucaguuucacuugcuugcaaa

SEQ ID NO: 970884 - RNA, 19 nt, Human
uucuccagccugaccugag

SEQ ID NO: 970885 - RNA, 22 nt, Human
uugacaaaaauaacacagcaua

SEQ ID NO: 970886 - RNA, 22 nt, Human
ucagaagacuacuaggacacau

SEQ ID NO: 970887 - RNA, 22 nt, Human
agcugcugcgccucacccuggc

SEQ ID NO: 970888 - RNA, 20 nt, Human
uucauucauuccacaacuuc

SEQ ID NO: 970889 - RNA, 22 nt, Human
acaggcugggcgcuuccugcgg

SEQ ID NO: 970890 - RNA, 22 nt, Human
cccuuagcucaauuucuugccc

SEQ ID NO: 970891 - RNA, 22 nt, Human
cugcccugcuugaugacagcga

SEQ ID NO: 970892 - RNA, 22 nt, Human
gcugccuuugugagccaagggg

SEQ ID NO: 970893 - RNA, 22 nt, Human
guucuucaucauuaacacucug

SEQ ID NO: 970894 - RNA, 21 nt, Human
ugugucacuaacuagaggcua

SEQ ID NO: 970895 - RNA, 17 nt, Human
cugcuuugugcaacgcu

SEQ ID NO: 970896 - RNA, 22 nt, Human
cccccaggcucugacacaggag

SEQ ID NO: 970897 - RNA, 22 nt, Human
aaauugcaaaaguacuuuuagg

SEQ ID NO: 970898 - RNA, 22 nt, Human
cuggccugagaaugcuacccuu

SEQ ID NO: 970899 - RNA, 22 nt, Human
gcugggcaagugccuuggguuu

SEQ ID NO: 970900 - RNA, 22 nt, Human
uggcaaccagguggucuagggu

SEQ ID NO: 970901 - RNA, 22 nt, Human
ccuggccuuaagggcagggagc

SEQ ID NO: 970902 - RNA, 23 nt, Human
cccaggagccugaguccucucug

SEQ ID NO: 970903 - RNA, 22 nt, Human
guaaaguucuacuagaaucaac

SEQ ID NO: 970904 - RNA, 22 nt, Human
uaauuuacuugcaaauaacaau

SEQ ID NO: 970905 - RNA, 22 nt, Human
acagaguagcucaagaagauug

SEQ ID NO: 970906 - RNA, 22 nt, Human
agcuggguguguaucagauaaa

SEQ ID NO: 970907 - RNA, 22 nt, Human
cuccaggaaaauagggaaugag

SEQ ID NO: 970908 - RNA, 22 nt, Human
uagggcuauucugaguaauaau

SEQ ID NO: 970909 - RNA, 22 nt, Human
guggcugcagcccagcggcacg

SEQ ID NO: 970910 - RNA, 22 nt, Human
ugggcagaguagcucagaagaa

SEQ ID NO: 970911 - RNA, 21 nt, Human
agaaaaguagaguuuucagag

SEQ ID NO: 970912 - RNA, 22 nt, Human
caggcugcagcagcaguggccc

SEQ ID NO: 970913 - RNA, 22 nt, Human
cucaggauucucgacacucaca

SEQ ID NO: 970914 - RNA, 22 nt, Human
gaaacccaaacuaagacaguag

SEQ ID NO: 970915 - RNA, 22 nt, Human
uuaauguggaaagcucuugagu

SEQ ID NO: 970916 - RNA, 22 nt, Human
gauuucaaggauguuagaggug

SEQ ID NO: 970917 - RNA, 22 nt, Human
uugaauaguguuuucaguauac

SEQ ID NO: 970918 - RNA, 21 nt, Human
acaggcuuuagaaaaugacuc

SEQ ID NO: 970919 - RNA, 22 nt, Human
uguaggauuuucaccagaccuu

SEQ ID NO: 970920 - RNA, 22 nt, Human
agauggagaccuuggaugaacu

SEQ ID NO: 970921 - RNA, 22 nt, Human
aggcccuggguuagggcccacu

SEQ ID NO: 970922 - RNA, 22 nt, Human
caguuucuuaucuucaaaauug

SEQ ID NO: 970923 - RNA, 22 nt, Human
agaccacagucaggcuccuggu

SEQ ID NO: 970924 - RNA, 20 nt, Human
acaggggcagcacaauaaug

SEQ ID NO: 970925 - RNA, 23 nt, Human
agacagaggcugaggcuggccgc

SEQ ID NO: 970926 - RNA, 22 nt, Human
cccaggcuggagugcaauggca

SEQ ID NO: 970927 - RNA, 22 nt, Human
agguaaagacugcaaggagaau

SEQ ID NO: 970928 - RNA, 22 nt, Human
acugugugggccgcucacuggg

SEQ ID NO: 970929 - RNA, 19 nt, Human
ugucacugucauggcccag

SEQ ID NO: 970930 - RNA, 22 nt, Human
uguggcugcucaggugcagacc

SEQ ID NO: 970931 - RNA, 20 nt, Human
acagaauaugcugguugugg

SEQ ID NO: 970932 - RNA, 20 nt, Human
ucucaggccccaguuuucuu

SEQ ID NO: 970933 - RNA, 22 nt, Human
aaaucaguaaauguucauuaac

SEQ ID NO: 970934 - RNA, 19 nt, Human
agcaccugugagagccugg

SEQ ID NO: 970935 - RNA, 22 nt, Human
ucuuagaaauuccccaguggcu

SEQ ID NO: 970936 - RNA, 22 nt, Human
uauugaaauccauuacguucuu

SEQ ID NO: 970937 - RNA, 23 nt, Human
uuucaacaaugcuuagagaaaac

SEQ ID NO: 970938 - RNA, 22 nt, Human
gagcacagaaucuucccaugca

SEQ ID NO: 970939 - RNA, 22 nt, Human
cagaggcauauaauugcugggg

SEQ ID NO: 970940 - RNA, 22 nt, Human
ucagcugcucaaauuuauguca

SEQ ID NO: 970941 - RNA, 22 nt, Human
cccaagagguggagguugcagu

SEQ ID NO: 970942 - RNA, 22 nt, Human
ugcuggggauccguaccaaccc

SEQ ID NO: 970943 - RNA, 22 nt, Human
ucuucauuuuacaggcagaccu

SEQ ID NO: 970944 - RNA, 22 nt, Human
cagagccauccaggugccuguu

SEQ ID NO: 970945 - RNA, 22 nt, Human
acacacagguaaaggagccugg

SEQ ID NO: 970946 - RNA, 22 nt, Human
cugugucccuugucccagagcc

SEQ ID NO: 970947 - RNA, 19 nt, Human
ccuggcccugcugcgcggg

SEQ ID NO: 970948 - RNA, 22 nt, Human
gaggcagcugggcuggugguuu

SEQ ID NO: 970949 - RNA, 22 nt, Human
agccugagagccaagcugugca

SEQ ID NO: 970950 - RNA, 22 nt, Human
gcaaauucuuaacuggacugug

SEQ ID NO: 970951 - RNA, 22 nt, Human
agggagcucacaguccaguaga

SEQ ID NO: 970952 - RNA, 21 nt, Human
ggagauggguaucgccugggc

SEQ ID NO: 970953 - RNA, 23 nt, Human
acagaaaucauuuguaagguacc

SEQ ID NO: 970954 - RNA, 21 nt, Human
gcugccaccgcgugcuccagg

SEQ ID NO: 970955 - RNA, 22 nt, Human
gcugggcuugguuucccugcuu

SEQ ID NO: 970956 - RNA, 21 nt, Human
cuggacugaggagacagucgc

SEQ ID NO: 970957 - RNA, 22 nt, Human
uggcagcugauuagauggugcc

SEQ ID NO: 970958 - RNA, 22 nt, Human
gcaggcucuucuuucugcccag

SEQ ID NO: 970959 - RNA, 22 nt, Human
uaaaauugcggugaauauuucc

SEQ ID NO: 970960 - RNA, 22 nt, Human
uccuuagagauacugucuugaa

SEQ ID NO: 970961 - RNA, 19 nt, Human
aggcagcaggccagggaug

SEQ ID NO: 970962 - RNA, 22 nt, Human
gagcugccaagauuacaaucag

SEQ ID NO: 970963 - RNA, 22 nt, Human
auucuucauuguugauucaugu

SEQ ID NO: 970964 - RNA, 22 nt, Human
cuguuaaucugcuugcaugaug

SEQ ID NO: 970965 - RNA, 19 nt, Human
ggcucagggcgcugccgcc

SEQ ID NO: 970966 - RNA, 22 nt, Human
ugcugggggcuuucuggauacc

SEQ ID NO: 970967 - RNA, 22 nt, Human
gacagcagacagaacuaccugc

SEQ ID NO: 970968 - RNA, 22 nt, Human
uuugcagugucagcuucugugu

SEQ ID NO: 970969 - RNA, 22 nt, Human
uuguauuagcuguaaauuuucu

SEQ ID NO: 970970 - RNA, 22 nt, Human
cugagccaugagccugcgccca

SEQ ID NO: 970971 - RNA, 22 nt, Human
ucaaaguuuguggcaauuuauu

SEQ ID NO: 970972 - RNA, 22 nt, Human
uccaggagauacacugcaccag

SEQ ID NO: 970973 - RNA, 22 nt, Human
ggcgugggaaguggggcuucug

SEQ ID NO: 970974 - RNA, 22 nt, Human
ggcucuggugcccuggcuccca

SEQ ID NO: 970975 - RNA, 22 nt, Human
uuucaaaguugggaauuguaau

SEQ ID NO: 970976 - RNA, 23 nt, Human
acugagccagggccugggucagc

SEQ ID NO: 970977 - RNA, 22 nt, Human
aaguuucauguggagguagacu

SEQ ID NO: 970978 - RNA, 22 nt, Human
agauuucaaugugagcauuagu

SEQ ID NO: 970979 - RNA, 22 nt, Human
gaaaaguaaacacuagggguca

SEQ ID NO: 970980 - RNA, 22 nt, Human
agucucugcugguugugccuau

SEQ ID NO: 970981 - RNA, 22 nt, Human
cacuguaucuuuuccaaagucu

SEQ ID NO: 970982 - RNA, 22 nt, Human
cagcagagcugugugggaaggg

SEQ ID NO: 970983 - RNA, 22 nt, Human
ggagagcaggguccugagauac

SEQ ID NO: 970984 - RNA, 22 nt, Human
uugaccauaccuccaggcaguu

SEQ ID NO: 970985 - RNA, 22 nt, Human
auucaucaacugauagccauag

SEQ ID NO: 970986 - RNA, 22 nt, Human
aggcugagauagguggaucauu

SEQ ID NO: 970987 - RNA, 22 nt, Human
gcacagagggcagugagccucu

SEQ ID NO: 970988 - RNA, 22 nt, Human
augugucuuauuugauuccaca

SEQ ID NO: 970989 - RNA, 22 nt, Human
aaaggucaaaaucgugacauug

SEQ ID NO: 970990 - RNA, 17 nt, Human
agcugaaauugcugaag

SEQ ID NO: 970991 - RNA, 22 nt, Human
ggagccugugggaugagaugug

SEQ ID NO: 970992 - RNA, 22 nt, Human
uugaaucucuugaaucucuguu

SEQ ID NO: 970993 - RNA, 18 nt, Human
gucaccuggaucagauua

SEQ ID NO: 970994 - RNA, 22 nt, Human
accagagauggggcuucucugu

SEQ ID NO: 970995 - RNA, 22 nt, Human
aagaacuuccuaauauauuuuc

SEQ ID NO: 970996 - RNA, 22 nt, Human
gcagggucuugagaggcagcca

SEQ ID NO: 970997 - RNA, 22 nt, Human
ugaauaagaauuauuauaauga

SEQ ID NO: 970998 - RNA, 22 nt, Human
ugggcagcuuccacuuaguuag

SEQ ID NO: 970999 - RNA, 23 nt, Human
acagacaacacugaugagagaaa

SEQ ID NO: 971000 - RNA, 22 nt, Human
ggcaggugcaccugagccaucu

SEQ ID NO: 971001 - RNA, 22 nt, Human
cugggagauugcuagagaugca

SEQ ID NO: 971002 - RNA, 22 nt, Human
ccugccugcguccucugagggc

SEQ ID NO: 971003 - RNA, 22 nt, Human
cugaaugucgaucagcuugggu

SEQ ID NO: 971004 - RNA, 22 nt, Human
gaggcucugugaugugccaggc

SEQ ID NO: 971005 - RNA, 22 nt, Human
ugugugccugagccgugccugg

SEQ ID NO: 971006 - RNA, 22 nt, Human
ucgugucagaucagagguuccu

SEQ ID NO: 971007 - RNA, 22 nt, Human
augugucugguuauugacaugc

SEQ ID NO: 971008 - RNA, 22 nt, Human
gaguuauucuagguccuuugua

SEQ ID NO: 971009 - RNA, 23 nt, Human
gugagucuugccuuugcugugga

SEQ ID NO: 971010 - RNA, 22 nt, Human
agccugcaggaugggcagcacc

SEQ ID NO: 971011 - RNA, 22 nt, Human
uaacaauaguguuugcuaguca

SEQ ID NO: 971012 - RNA, 22 nt, Human
ugcugccaugcagagcaacaga

SEQ ID NO: 971013 - RNA, 22 nt, Human
ugugcaggugcaggaagggggc

SEQ ID NO: 971014 - RNA, 22 nt, Human
uguguauagcaguuuccagucu

SEQ ID NO: 971015 - RNA, 22 nt, Human
uuccaugacaccgagggaaguc

SEQ ID NO: 971016 - RNA, 22 nt, Human
cccaggagauaacguucccaag

SEQ ID NO: 971017 - RNA, 22 nt, Human
gaccaggagauuugagcuaggc

SEQ ID NO: 971018 - RNA, 22 nt, Human
ugagagucucagaccuccuggu

SEQ ID NO: 971019 - RNA, 22 nt, Human
uuuuguuguaauauaccuaucc

SEQ ID NO: 971020 - RNA, 22 nt, Human
ccuuuuucccuggagggacagc

SEQ ID NO: 971021 - RNA, 22 nt, Human
ucccagagcagaugugcuaaag

SEQ ID NO: 971022 - RNA, 22 nt, Human
uacaccuuaaucauaugugucu

SEQ ID NO: 971023 - RNA, 22 nt, Human
ugggaauggaugcuaagugcua

SEQ ID NO: 971024 - RNA, 22 nt, Human
ggcuagaacuuuacacuuugca

SEQ ID NO: 971025 - RNA, 22 nt, Human
caauacuuccuuguuagaggca

SEQ ID NO: 971026 - RNA, 22 nt, Human
gaggagagagggacugucugca

SEQ ID NO: 971027 - RNA, 22 nt, Human
ucucaagcuuguugguauguuu

SEQ ID NO: 971028 - RNA, 22 nt, Human
aguguuccuugcuuucccagag

SEQ ID NO: 971029 - RNA, 22 nt, Human
ucacaguuauagucuguagaau

SEQ ID NO: 971030 - RNA, 22 nt, Human
ucacuaagugccgaguuuaguu

SEQ ID NO: 971031 - RNA, 21 nt, Human
uggagcugaauuuuuggcauc

SEQ ID NO: 971032 - RNA, 22 nt, Human
cuggcagcguguuuaugaacau

SEQ ID NO: 971033 - RNA, 15 nt, Human
uucaggauaugacuc

SEQ ID NO: 971034 - RNA, 22 nt, Human
ugccucagaguugucccuacca

SEQ ID NO: 971035 - RNA, 22 nt, Human
gcucugcuuucuggggggaucc

SEQ ID NO: 971036 - RNA, 22 nt, Human
cacagcuucuccuugauaucgc

SEQ ID NO: 971037 - RNA, 22 nt, Human
cacagcagaaaguguaggagga

SEQ ID NO: 971038 - RNA, 22 nt, Human
acauuucucaucuaguagagua

SEQ ID NO: 971039 - RNA, 22 nt, Human
agucaauuaucucuaggucauc

SEQ ID NO: 971040 - RNA, 22 nt, Human
aggccugagcagaggaguggac

SEQ ID NO: 971041 - RNA, 22 nt, Human
agcauggggcuccgcaaugaac

SEQ ID NO: 971042 - RNA, 22 nt, Human
ucugagaggauuccugucccga

SEQ ID NO: 971043 - RNA, 22 nt, Human
aggcaguggaaggagaaagcaa

SEQ ID NO: 971044 - RNA, 22 nt, Human
guggccaagggacucuaaggca

SEQ ID NO: 971045 - RNA, 23 nt, Human
cccagggacacgaugacaccucc

SEQ ID NO: 971046 - RNA, 22 nt, Human
gccucccuggcccacagcagcg

SEQ ID NO: 971047 - RNA, 22 nt, Human
aucaaaguuucccagaaguugu

SEQ ID NO: 971048 - RNA, 22 nt, Human
uauuagagaaaagauggaugug

SEQ ID NO: 971049 - RNA, 22 nt, Human
cugggugguucuaacuguugau

SEQ ID NO: 971050 - RNA, 18 nt, Human
gugacagcugcuagcuca

SEQ ID NO: 971051 - RNA, 22 nt, Human
agacaaagaaaccguagaagca

SEQ ID NO: 971052 - RNA, 22 nt, Human
gaggagagccugcacuuugacc

SEQ ID NO: 971053 - RNA, 22 nt, Human
cucaaggacuuauucaugccug

SEQ ID NO: 971054 - RNA, 22 nt, Human
uggccacccagcugacgccuuc

SEQ ID NO: 971055 - RNA, 22 nt, Human
uaacaucuuuagcagcucgaac

SEQ ID NO: 971056 - RNA, 22 nt, Human
aagugacaaaaggguauccaaa

SEQ ID NO: 971057 - RNA, 22 nt, Human
uugacaagaaucguugccuugg

SEQ ID NO: 971058 - RNA, 22 nt, Human
cuucaucaacucuaacaaaugu

SEQ ID NO: 971059 - RNA, 22 nt, Human
gagagcaggaggcagcgggacg

SEQ ID NO: 971060 - RNA, 22 nt, Human
uggcaauuucagaaaauagaau

SEQ ID NO: 971061 - RNA, 20 nt, Human
acuccugguaacuuuuguga

SEQ ID NO: 971062 - RNA, 22 nt, Human
agcugccacagagccuggccag

SEQ ID NO: 971063 - RNA, 22 nt, Human
guucacaucacuucacugaacc

SEQ ID NO: 971064 - RNA, 22 nt, Human
ucuccuggauggaccuucucuu

SEQ ID NO: 971065 - RNA, 22 nt, Human
agggccagcccauaaugccaaa

SEQ ID NO: 971066 - RNA, 22 nt, Human
agucuucagagaaauuaacucu

SEQ ID NO: 971067 - RNA, 22 nt, Human
ugcugggcuagaagcugaggcc

SEQ ID NO: 971068 - RNA, 22 nt, Human
gggccacauugaagggugggua

SEQ ID NO: 971069 - RNA, 22 nt, Human
agggacacugaugagaaauucu

SEQ ID NO: 971070 - RNA, 22 nt, Human
gugccuggcaugcgccggugcu

SEQ ID NO: 971071 - RNA, 22 nt, Human
auugucuuuccacugagaaguu

SEQ ID NO: 971072 - RNA, 22 nt, Human
cuggcagggugggcuuugcuuu

SEQ ID NO: 971073 - RNA, 22 nt, Human
aggcaagcauuuaaccacucau

SEQ ID NO: 971074 - RNA, 20 nt, Human
uuaggcauuuggauuggcuu

SEQ ID NO: 971075 - RNA, 21 nt, Human
cauuucaugauuauagaaaug

SEQ ID NO: 971076 - RNA, 22 nt, Human
ugcugccaggucuugcugucca

SEQ ID NO: 971077 - RNA, 22 nt, Human
ugcugcuguuuccuacaucuca

SEQ ID NO: 971078 - RNA, 22 nt, Human
ugaggcucaaggucugguggag

SEQ ID NO: 971079 - RNA, 22 nt, Human
aucuagaaaguguugaagauca

SEQ ID NO: 971080 - RNA, 22 nt, Human
cagagguauugcaaaagccuag

SEQ ID NO: 971081 - RNA, 22 nt, Human
uguuaaauguuccuuuacugga

SEQ ID NO: 971082 - RNA, 22 nt, Human
gagcuuccauggacgccaucug

SEQ ID NO: 971083 - RNA, 22 nt, Human
gcacugugacccagagcaggug

SEQ ID NO: 971084 - RNA, 22 nt, Human
acaggugugagaacaugccuug

SEQ ID NO: 971085 - RNA, 22 nt, Human
uacauucuggaaaggcacagac

SEQ ID NO: 971086 - RNA, 22 nt, Human
uauuaugagguauuuggacuuu

SEQ ID NO: 971087 - RNA, 22 nt, Human
cugugccaucugcacucucguc

SEQ ID NO: 971088 - RNA, 22 nt, Human
aaucaguuaaauauugaguaca

SEQ ID NO: 971089 - RNA, 22 nt, Human
uuaggcauuggaaggucagcuu

SEQ ID NO: 971090 - RNA, 23 nt, Human
ugggggugcacgggccacaucuu

SEQ ID NO: 971091 - RNA, 22 nt, Human
uuauuaggaaaaggucagaugu

SEQ ID NO: 971092 - RNA, 22 nt, Human
uauucacaggcuggagugaugu

SEQ ID NO: 971093 - RNA, 22 nt, Human
uuuccucugagugagcugggag

SEQ ID NO: 971094 - RNA, 22 nt, Human
uuugcauuugcaaauaaugaaa

SEQ ID NO: 971095 - RNA, 22 nt, Human
agccacagcuccuugguggaga

SEQ ID NO: 971096 - RNA, 22 nt, Human
aguuuauguagaauuggcaaua

SEQ ID NO: 971097 - RNA, 22 nt, Human
aaggagucucagcugggccuga

SEQ ID NO: 971098 - RNA, 22 nt, Human
aaaucuguaagcaauugcucag

SEQ ID NO: 971099 - RNA, 22 nt, Human
ugugcuucuugcagcuccugua

SEQ ID NO: 971100 - RNA, 21 nt, Human
ucuguacaucauugagucccc

SEQ ID NO: 971101 - RNA, 22 nt, Human
gcacccaggccggcgacugcag

SEQ ID NO: 971102 - RNA, 22 nt, Human
aggacugggugcagagggcauc

SEQ ID NO: 971103 - RNA, 22 nt, Human
ggcugccugcuccuccugcacg

SEQ ID NO: 971104 - RNA, 22 nt, Human
cuuguaauuauaauguacuguu

SEQ ID NO: 971105 - RNA, 22 nt, Human
agccuucagcaguucaggugcc

SEQ ID NO: 971106 - RNA, 22 nt, Human
ucagggugaaccaggcaggaau

SEQ ID NO: 971107 - RNA, 18 nt, Human
gucauugcaacauacugu

SEQ ID NO: 971108 - RNA, 22 nt, Human
uaaaaguggauaagcuguagga

SEQ ID NO: 971109 - RNA, 22 nt, Human
cuuccucccggcccaugcucug

SEQ ID NO: 971110 - RNA, 22 nt, Human
ucggagcuguagaugaaacccu

SEQ ID NO: 971111 - RNA, 22 nt, Human
cagggcuggauccuccagacuc

SEQ ID NO: 971112 - RNA, 22 nt, Human
aaagucauguaaugauaugauu

SEQ ID NO: 971113 - RNA, 22 nt, Human
auugaauagaugcauuauacua

SEQ ID NO: 971114 - RNA, 22 nt, Human
uugaaagugccaaguccuagug

SEQ ID NO: 971115 - RNA, 22 nt, Human
uuagccauuuuauacaagugua

SEQ ID NO: 971116 - RNA, 22 nt, Human
agcuucuggaaggcaaggcuug

SEQ ID NO: 971117 - RNA, 23 nt, Human
cuuuuaacuugaucugagaccag

SEQ ID NO: 971118 - RNA, 22 nt, Human
ugacagaaagaauaugucaauc

SEQ ID NO: 971119 - RNA, 22 nt, Human
uggcucaagugauccuccugcc

SEQ ID NO: 971120 - RNA, 20 nt, Human
gagagcuggggaugaggcug

SEQ ID NO: 971121 - RNA, 22 nt, Human
aaagccauugaacuguacuuua

SEQ ID NO: 971122 - RNA, 22 nt, Human
ugagguguguccccagggaggu

SEQ ID NO: 971123 - RNA, 22 nt, Human
uauaguacauggaaucuucaua

SEQ ID NO: 971124 - RNA, 22 nt, Human
ggcagcaguccauggcccaagg

SEQ ID NO: 971125 - RNA, 22 nt, Human
ugcacagcgggugucugucagg

SEQ ID NO: 971126 - RNA, 22 nt, Human
uggcagggucuugcuguguugc

SEQ ID NO: 971127 - RNA, 19 nt, Human
uggcuucuguuuucauguu

SEQ ID NO: 971128 - RNA, 22 nt, Human
agccucucuguuagucacuggg

SEQ ID NO: 971129 - RNA, 22 nt, Human
cccagcuccuuacagggccgaa

SEQ ID NO: 971130 - RNA, 22 nt, Human
uugggagcauuuagaaaagacg

SEQ ID NO: 971131 - RNA, 22 nt, Human
acagagagaaacaaucagcagc

SEQ ID NO: 971132 - RNA, 22 nt, Human
ggaguuggugagcaccaggcuu

SEQ ID NO: 971133 - RNA, 22 nt, Human
ucuucucucauguaggagggaa

SEQ ID NO: 971134 - RNA, 22 nt, Human
caguacuuuucuggcuuucuac

SEQ ID NO: 971135 - RNA, 22 nt, Human
auguagcaucuauccugauaaa

SEQ ID NO: 971136 - RNA, 22 nt, Human
uguuugaaagcaccuacauuuu

SEQ ID NO: 971137 - RNA, 22 nt, Human
cccaggaaugaggggcggaggc

SEQ ID NO: 971138 - RNA, 22 nt, Human
uugcauguagaauacucaacuu

SEQ ID NO: 971139 - RNA, 22 nt, Human
cacccagcagcacuuaagacua

SEQ ID NO: 971140 - RNA, 22 nt, Human
ugcacacaaguuggagaaugaa

SEQ ID NO: 971141 - RNA, 22 nt, Human
ugaggcagaguaagauacauga

SEQ ID NO: 971142 - RNA, 22 nt, Human
ccuggagauuucuucaagcuuu

SEQ ID NO: 971143 - RNA, 22 nt, Human
uuuagaaauugcagagugggug

SEQ ID NO: 971144 - RNA, 22 nt, Human
cucuggagcgcugcuucccgcg

SEQ ID NO: 971145 - RNA, 22 nt, Human
aguacuucagaggcugcccagg

SEQ ID NO: 971146 - RNA, 22 nt, Human
auacagaauacuaauuccugag

SEQ ID NO: 971147 - RNA, 22 nt, Human
cugaggcuuggaggggucuggu

SEQ ID NO: 971148 - RNA, 19 nt, Human
cucucacucgccacauccu

SEQ ID NO: 971149 - RNA, 22 nt, Human
caaggccugccucuggcagaaa

SEQ ID NO: 971150 - RNA, 22 nt, Human
agcaggugggaucaagcuggca

SEQ ID NO: 971151 - RNA, 22 nt, Human
gaggccacgguuuuccuugggg

SEQ ID NO: 971152 - RNA, 22 nt, Human
uggcagcaauuugugauguuga

SEQ ID NO: 971153 - RNA, 22 nt, Human
caugcuguguguuuuagcucca

SEQ ID NO: 971154 - RNA, 22 nt, Human
auuugucuuugagugcccugcu

SEQ ID NO: 971155 - RNA, 23 nt, Human
gaagcagaugucugaguaggcag

SEQ ID NO: 971156 - RNA, 22 nt, Human
cagcuuccgaccgggggcugca

SEQ ID NO: 971157 - RNA, 22 nt, Human
gagccucguggcggccacugcg

SEQ ID NO: 971158 - RNA, 23 nt, Human
ucucaggacacacaugucuauca

SEQ ID NO: 971159 - RNA, 20 nt, Human
agugugcauuuagagucugc

SEQ ID NO: 971160 - RNA, 22 nt, Human
aagcugccagauucagucugcu

SEQ ID NO: 971161 - RNA, 22 nt, Human
aaggccaacuaggaugagcuag

SEQ ID NO: 971162 - RNA, 22 nt, Human
uggcucagcugucacagccugg

SEQ ID NO: 971163 - RNA, 21 nt, Human
ugacauaauccauaguacaaa

SEQ ID NO: 971164 - RNA, 21 nt, Human
cugguguagcacucaggugcu

SEQ ID NO: 971165 - RNA, 22 nt, Human
ugagccaguggaagauggcagu

SEQ ID NO: 971166 - RNA, 20 nt, Human
aaagucuuaugguuaauuuu

SEQ ID NO: 971167 - RNA, 22 nt, Human
ugucacaaacauacauuauaga

SEQ ID NO: 971168 - RNA, 22 nt, Human
gagguggugguggaggcauagc

SEQ ID NO: 971169 - RNA, 22 nt, Human
cucagagucugcauuucuguca

SEQ ID NO: 971170 - RNA, 22 nt, Human
ggggauggauuccgggucccug

SEQ ID NO: 971171 - RNA, 22 nt, Human
uacauacacaaauauacuguuu

SEQ ID NO: 971172 - RNA, 22 nt, Human
uuagugauuacuacauagauga

SEQ ID NO: 971173 - RNA, 22 nt, Human
acuguucaagcaaaugacauug

SEQ ID NO: 971174 - RNA, 22 nt, Human
ggaggccagggacccagucagc

SEQ ID NO: 971175 - RNA, 16 nt, Human
auucacaaggcaucgg

SEQ ID NO: 971176 - RNA, 22 nt, Human
guauucauauuaaacauaucaa

SEQ ID NO: 971177 - RNA, 22 nt, Human
aggccagacagcuagaaacagg

SEQ ID NO: 971178 - RNA, 23 nt, Human
uccaggagaauuccagggcccgg

SEQ ID NO: 971179 - RNA, 22 nt, Human
acugucaccaucagagcgggaa

SEQ ID NO: 971180 - RNA, 23 nt, Human
gccucugcucugcguuggggacu

SEQ ID NO: 971181 - RNA, 22 nt, Human
gcugucugggaugucacugcug

SEQ ID NO: 971182 - RNA, 22 nt, Human
gcagcugguuaaugggagaauu

SEQ ID NO: 971183 - RNA, 22 nt, Human
uguuuaaucuauaaaauggaga

SEQ ID NO: 971184 - RNA, 22 nt, Human
aaaguuuuagaacuaggaagca

SEQ ID NO: 971185 - RNA, 22 nt, Human
uccucucagugugguuguggga

SEQ ID NO: 971186 - RNA, 22 nt, Human
aacauucuauuuugcuaaaaca

SEQ ID NO: 971187 - RNA, 22 nt, Human
gccuuggcugaugugcgaauga

SEQ ID NO: 971188 - RNA, 22 nt, Human
uggagcugggaguccugggcug

SEQ ID NO: 971189 - RNA, 22 nt, Human
uguaucaaggguuuauguaagc

SEQ ID NO: 971190 - RNA, 22 nt, Human
gugucccaggagaggagacaau

SEQ ID NO: 971191 - RNA, 22 nt, Human
ugggcucucuggcaggaaggcu

SEQ ID NO: 971192 - RNA, 22 nt, Human
agugauggugagugagaagcuc

SEQ ID NO: 971193 - RNA, 22 nt, Human
ucacuuauugcucaucucaugc

SEQ ID NO: 971194 - RNA, 22 nt, Human
agggacuggcucucugagcagg

SEQ ID NO: 971195 - RNA, 22 nt, Human
uaaaagacauauaacuguagga

SEQ ID NO: 971196 - RNA, 22 nt, Human
cagggccagagagggcuggcug

SEQ ID NO: 971197 - RNA, 22 nt, Human
uaugcacgucuauuuaugaaga

SEQ ID NO: 971198 - RNA, 22 nt, Human
agaagaaacugucggggauauu

SEQ ID NO: 971199 - RNA, 22 nt, Human
ucagugugaggucuuccacccg

SEQ ID NO: 971200 - RNA, 22 nt, Human
cugccagcucucuggaggcucu

SEQ ID NO: 971201 - RNA, 22 nt, Human
auccaaagauggaaagaacuuu

SEQ ID NO: 971202 - RNA, 22 nt, Human
ucuggagcuuguuucagauggu

SEQ ID NO: 971203 - RNA, 22 nt, Human
uugcaguugucuuuccuaauuu

SEQ ID NO: 971204 - RNA, 22 nt, Human
gcaggaagaugagcucagguaa

SEQ ID NO: 971205 - RNA, 22 nt, Human
uggccuggaaccuggcagggac

SEQ ID NO: 971206 - RNA, 22 nt, Human
aguaaaaucaccaucucuuugu

SEQ ID NO: 971207 - RNA, 22 nt, Human
ggcaguggguuccccaaggcac

SEQ ID NO: 971208 - RNA, 22 nt, Human
aggcuucccaagcagcugcaaa

SEQ ID NO: 971209 - RNA, 22 nt, Human
ccucaggaaaugaauaaauggc

SEQ ID NO: 971210 - RNA, 22 nt, Human
caagaugggcaccccagcaccu

SEQ ID NO: 971211 - RNA, 22 nt, Human
gucccagaggcuuuggccacag

SEQ ID NO: 971212 - RNA, 22 nt, Human
cuggcagcauggagccugugcu

SEQ ID NO: 971213 - RNA, 22 nt, Human
aaaguuuggauuagcaguuaga

SEQ ID NO: 971214 - RNA, 22 nt, Human
gcagcuguguaaugagcccaca

SEQ ID NO: 971215 - RNA, 19 nt, Human
augagcuggcauuucaggu

SEQ ID NO: 971216 - RNA, 19 nt, Human
caggagagcaugcacuuug

SEQ ID NO: 971217 - RNA, 22 nt, Human
agcagggcuucugugccugugc

SEQ ID NO: 971218 - RNA, 22 nt, Human
aggcugcucugcgaagucagcu

SEQ ID NO: 971219 - RNA, 22 nt, Human
gaggcagcaggcugaggaggau

SEQ ID NO: 971220 - RNA, 22 nt, Human
uauuucuugaguggucaguuuc

SEQ ID NO: 971221 - RNA, 22 nt, Human
cacucugcaggccaaaccaaag

SEQ ID NO: 971222 - RNA, 22 nt, Human
uucaggaugcagagguuguagu

SEQ ID NO: 971223 - RNA, 22 nt, Human
ucccuggguccugcuugcucuc

SEQ ID NO: 971224 - RNA, 22 nt, Human
gggcagagguucaacuucaaca

SEQ ID NO: 971225 - RNA, 23 nt, Human
cauccaggagcugagucugacug

SEQ ID NO: 971226 - RNA, 22 nt, Human
ucccaggaugaagacaguguug

SEQ ID NO: 971227 - RNA, 22 nt, Human
ucauugaauuucacagcuuuau

SEQ ID NO: 971228 - RNA, 22 nt, Human
guuauuuucauuggcucagacu

SEQ ID NO: 971229 - RNA, 22 nt, Human
aagacugugucuauggcuacuc

SEQ ID NO: 971230 - RNA, 22 nt, Human
uggagcaagcuggagagaacau

SEQ ID NO: 971231 - RNA, 19 nt, Human
ggcauccagaacuaccagu

SEQ ID NO: 971232 - RNA, 22 nt, Human
uggcagaguuauggguauuuau

SEQ ID NO: 971233 - RNA, 22 nt, Human
cuggccaggcuugggacagaca

SEQ ID NO: 971234 - RNA, 22 nt, Human
uaaauucuacaacuucaaagau

SEQ ID NO: 971235 - RNA, 22 nt, Human
agcugccagggacugggcaugg

SEQ ID NO: 971236 - RNA, 22 nt, Human
cccucugccugggaccaagucc

SEQ ID NO: 971237 - RNA, 22 nt, Human
uuauacuaaaacgcauugaauu

SEQ ID NO: 971238 - RNA, 22 nt, Human
gcugccucuguagcuuuggacc

SEQ ID NO: 971239 - RNA, 22 nt, Human
ugagagugguucagcucagaag

SEQ ID NO: 971240 - RNA, 22 nt, Human
aaguaaauaucuguuuauagca

SEQ ID NO: 971241 - RNA, 22 nt, Human
acagcagagugugagauagcca

SEQ ID NO: 971242 - RNA, 22 nt, Human
acaguuauucuuuaugcaacca

SEQ ID NO: 971243 - RNA, 22 nt, Human
aggccaaagugcuccuuuuaga

SEQ ID NO: 971244 - RNA, 22 nt, Human
ucagaggucacacagcaaguuu

SEQ ID NO: 971245 - RNA, 22 nt, Human
guuaucaugcuucaucaucacu

SEQ ID NO: 971246 - RNA, 22 nt, Human
aauaauguacauacauauuucg

SEQ ID NO: 971247 - RNA, 18 nt, Human
ccuggcagccaugcgcgc

SEQ ID NO: 971248 - RNA, 22 nt, Human
uucucauucugacucaguguag

SEQ ID NO: 971249 - RNA, 18 nt, Human
uuaaggauaagcagacua

SEQ ID NO: 971250 - RNA, 22 nt, Human
gcuguccucuuggacucagggc

SEQ ID NO: 971251 - RNA, 22 nt, Human
uuauuccaauuucuccuacaaa

SEQ ID NO: 971252 - RNA, 22 nt, Human
ccuggcuggauggagccccugg

SEQ ID NO: 971253 - RNA, 22 nt, Human
cagacaggaauucuggcguggu

SEQ ID NO: 971254 - RNA, 22 nt, Human
ucccagcagcauagcucagaau

SEQ ID NO: 971255 - RNA, 22 nt, Human
uugauacauagcacaguuuagg

SEQ ID NO: 971256 - RNA, 22 nt, Human
ccgggcgggggcucucgucacc

SEQ ID NO: 971257 - RNA, 22 nt, Human
gagaaacuuggaguuauucugg

SEQ ID NO: 971258 - RNA, 22 nt, Human
aaggagaaaugguagaugugca

SEQ ID NO: 971259 - RNA, 22 nt, Human
uagcucuucauuucaucugauu

SEQ ID NO: 971260 - RNA, 23 nt, Human
aagcugccuucgcaguuggucug

SEQ ID NO: 971261 - RNA, 22 nt, Human
augaggcaguacacacaaagcc

SEQ ID NO: 971262 - RNA, 22 nt, Human
gcugagguggagauugcaguga

SEQ ID NO: 971263 - RNA, 22 nt, Human
caggugcucccagagaagugcu

SEQ ID NO: 971264 - RNA, 22 nt, Human
gcccaggcuagcguagagugca

SEQ ID NO: 971265 - RNA, 22 nt, Human
ucagagucucccccaguuuggg

SEQ ID NO: 971266 - RNA, 21 nt, Human
uucugggaaaugagcuggggc

SEQ ID NO: 971267 - RNA, 22 nt, Human
cuguccugauggugccacuggu

SEQ ID NO: 971268 - RNA, 22 nt, Human
uacaugcucaguaacuuucagu

SEQ ID NO: 971269 - RNA, 22 nt, Human
uuauguacaauguuaauguaaa

SEQ ID NO: 971270 - RNA, 21 nt, Human
agggagcuggccacacagccu

SEQ ID NO: 971271 - RNA, 22 nt, Human
uccaagggcuuuggcgugaagu

SEQ ID NO: 971272 - RNA, 22 nt, Human
uugggagcuuggacuuagugug

SEQ ID NO: 971273 - RNA, 22 nt, Human
gcccagcagaucucagugucuc

SEQ ID NO: 971274 - RNA, 23 nt, Human
uuugcaaauuggacacaaccaca

SEQ ID NO: 971275 - RNA, 21 nt, Human
ggagcugcaggagccgaaggc

SEQ ID NO: 971276 - RNA, 23 nt, Human
uagcuguggcguaaggcucagcu

SEQ ID NO: 971277 - RNA, 22 nt, Human
cagcaggguauacagggaauuu

SEQ ID NO: 971278 - RNA, 22 nt, Human
uauuuuaaagugaagggucuug

SEQ ID NO: 971279 - RNA, 21 nt, Human
cuacuuaaguaggggauuagg

SEQ ID NO: 971280 - RNA, 20 nt, Human
cccugagaccagagagcagc

SEQ ID NO: 971281 - RNA, 22 nt, Human
aaggccagacaggaccacaucu

SEQ ID NO: 971282 - RNA, 21 nt, Human
auuuggauauugcuggcaaau

SEQ ID NO: 971283 - RNA, 22 nt, Human
uaaaucuuguggcaaugcuucu

SEQ ID NO: 971284 - RNA, 22 nt, Human
ugcucuggggagcuccucugcg

SEQ ID NO: 971285 - RNA, 22 nt, Human
gccauaaauugcuggucaaaau

SEQ ID NO: 971286 - RNA, 22 nt, Human
ggagaggauguuuuaguaacuu

SEQ ID NO: 971287 - RNA, 22 nt, Human
cuuucacaguccugacugagcg

SEQ ID NO: 971288 - RNA, 22 nt, Human
caaugauguuuagauaaaaucc

SEQ ID NO: 971289 - RNA, 22 nt, Human
ugucccucauugacgcugugcc

SEQ ID NO: 971290 - RNA, 22 nt, Human
cacugggcguguccugggugag

SEQ ID NO: 971291 - RNA, 23 nt, Human
cagcugaagcagccugggcugga

SEQ ID NO: 971292 - RNA, 22 nt, Human
gagagcugggaaagccguggag

SEQ ID NO: 971293 - RNA, 22 nt, Human
gcugucugucuucacaucucgc

SEQ ID NO: 971294 - RNA, 22 nt, Human
cuggggcccaucgagggcugag

SEQ ID NO: 971295 - RNA, 22 nt, Human
acuuccugcaaucguccacucc

SEQ ID NO: 971296 - RNA, 22 nt, Human
ggcugugggccagcuagacccu

SEQ ID NO: 971297 - RNA, 22 nt, Human
ucacaugcagucacugagcagg

SEQ ID NO: 971298 - RNA, 22 nt, Human
cggccaaauugcagagagaagc

SEQ ID NO: 971299 - RNA, 22 nt, Human
uuuccucuaaacgcauuugcuu

SEQ ID NO: 971300 - RNA, 22 nt, Human
ugguaauuuacgcauuucugua

SEQ ID NO: 971301 - RNA, 22 nt, Human
ccagcugguguuccuuaggacc

SEQ ID NO: 971302 - RNA, 19 nt, Human
uuucccagcccuugcugug

SEQ ID NO: 971303 - RNA, 22 nt, Human
cugggagucaccaggagcaagg

SEQ ID NO: 971304 - RNA, 22 nt, Human
cuggggccacaacggcgcacgc

SEQ ID NO: 971305 - RNA, 22 nt, Human
cagggcaggaugcugugauuau

SEQ ID NO: 971306 - RNA, 20 nt, Human
ucucccaggcucagggaaga

SEQ ID NO: 971307 - RNA, 22 nt, Human
gcugcagcucgccuuccggccu

SEQ ID NO: 971308 - RNA, 22 nt, Human
gccagcucagaugcaggaagga

SEQ ID NO: 971309 - RNA, 22 nt, Human
gcaggcaguugcaguuuucuag

SEQ ID NO: 971310 - RNA, 22 nt, Human
caagggccuccaccuugcucgu

SEQ ID NO: 971311 - RNA, 22 nt, Human
auggauaagaacaaauaucuga

SEQ ID NO: 971312 - RNA, 22 nt, Human
agugagaguauuaaugugaacu

SEQ ID NO: 971313 - RNA, 22 nt, Human
uuuaauguucaucucaaaggau

SEQ ID NO: 971314 - RNA, 22 nt, Human
uuggaauucaaguuguagcuua

SEQ ID NO: 971315 - RNA, 22 nt, Human
uaggauuuggcuuuagucaggu

SEQ ID NO: 971316 - RNA, 22 nt, Human
gcagagacuccacugucuugug

SEQ ID NO: 971317 - RNA, 22 nt, Human
acagagcaguucuggagcuggc

SEQ ID NO: 971318 - RNA, 19 nt, Human
ccucugccagcccgccucu

SEQ ID NO: 971319 - RNA, 22 nt, Human
cucucaggcuugggucguggca

SEQ ID NO: 971320 - RNA, 23 nt, Human
ggagaggggugugggcaucuuua

SEQ ID NO: 971321 - RNA, 22 nt, Human
cagaggcaaaagagguggaggu

SEQ ID NO: 971322 - RNA, 22 nt, Human
ugcauauuuguaugauguuuag

SEQ ID NO: 971323 - RNA, 22 nt, Human
ugaacgcagguccacauggcuc

SEQ ID NO: 971324 - RNA, 22 nt, Human
aucugcagaggacaggcgagga

SEQ ID NO: 971325 - RNA, 22 nt, Human
cugggcuacguguugacagcau

SEQ ID NO: 971326 - RNA, 22 nt, Human
cagcaggaggugagaugugacc

SEQ ID NO: 971327 - RNA, 21 nt, Human
cagaaguaaggguaacuucuc

SEQ ID NO: 971328 - RNA, 22 nt, Human
ugggccugggucuuugcugcca

SEQ ID NO: 971329 - RNA, 22 nt, Human
gagggugguggcuuaaggugcu

SEQ ID NO: 971330 - RNA, 22 nt, Human
gcagagaaaguuuuguccucag

SEQ ID NO: 971331 - RNA, 20 nt, Human
ugaugguucuuuccggguug

SEQ ID NO: 971332 - RNA, 22 nt, Human
gcuuuggagccuguguucugcc

SEQ ID NO: 971333 - RNA, 18 nt, Human
ccagcaugccagaggcug

SEQ ID NO: 971334 - RNA, 22 nt, Human
ccagcugcugugaggaccacag

SEQ ID NO: 971335 - RNA, 22 nt, Human
guucuucacauuucauugagga

SEQ ID NO: 971336 - RNA, 22 nt, Human
cauugaaaccuaacauaggcug

SEQ ID NO: 971337 - RNA, 22 nt, Human
agccagagcugaugucauucuc

SEQ ID NO: 971338 - RNA, 22 nt, Human
uugcugaaaacaguggguauug

SEQ ID NO: 971339 - RNA, 22 nt, Human
aagagcugauuaagucaugagg

SEQ ID NO: 971340 - RNA, 22 nt, Human
uguacuuccccaaugacagcac

SEQ ID NO: 971341 - RNA, 22 nt, Human
ugauuuccaaaaggcuucuaag

SEQ ID NO: 971342 - RNA, 22 nt, Human
aaauauagugacacuuauaguc

SEQ ID NO: 971343 - RNA, 22 nt, Human
ucugccuuggcaaccacagcuu

SEQ ID NO: 971344 - RNA, 22 nt, Human
gcccucugcuggccucaccucg

SEQ ID NO: 971345 - RNA, 22 nt, Human
ugugccugucacccucagagag

SEQ ID NO: 971346 - RNA, 22 nt, Human
agccuggacagcuacggagaac

SEQ ID NO: 971347 - RNA, 22 nt, Human
ucugggagguaaccaugcugau

SEQ ID NO: 971348 - RNA, 22 nt, Human
cuggcuggcaaguagaacacaa

SEQ ID NO: 971349 - RNA, 23 nt, Human
agcagggccagaauacuugcugu

SEQ ID NO: 971350 - RNA, 22 nt, Human
aguuauauuccauagauucaga

SEQ ID NO: 971351 - RNA, 22 nt, Human
cccucccaggaguggccagaga

SEQ ID NO: 971352 - RNA, 20 nt, Human
cugcugugauucccuccucc

SEQ ID NO: 971353 - RNA, 22 nt, Human
cuuuguaucuaaauaucuugaa

SEQ ID NO: 971354 - RNA, 22 nt, Human
cugcaagauuggaagaugcaau

SEQ ID NO: 971355 - RNA, 22 nt, Human
cccuggcauaaaacuucuccag

SEQ ID NO: 971356 - RNA, 22 nt, Human
uacauuccauguguguguauuc

SEQ ID NO: 971357 - RNA, 22 nt, Human
aucuuucagggccauuuguauu

SEQ ID NO: 971358 - RNA, 22 nt, Human
ucucugcucaggcaccagcccu

SEQ ID NO: 971359 - RNA, 22 nt, Human
augcuguguuugagaaccuagg

SEQ ID NO: 971360 - RNA, 22 nt, Human
cuggcagcauuaacagagagca

SEQ ID NO: 971361 - RNA, 22 nt, Human
uuuuauagcugaauaguauucc

SEQ ID NO: 971362 - RNA, 22 nt, Human
uccugccucuccaugcuaacua

SEQ ID NO: 971363 - RNA, 22 nt, Human
auuaggauuuuguccaaguagc

SEQ ID NO: 971364 - RNA, 20 nt, Human
aaaaacaguaaugcugaaga

SEQ ID NO: 971365 - RNA, 17 nt, Human
uggacccuugggccucc

SEQ ID NO: 971366 - RNA, 22 nt, Human
gcagagcugggucuguauccaa

SEQ ID NO: 971367 - RNA, 22 nt, Human
ucugggugcccuuugcucuguu

SEQ ID NO: 971368 - RNA, 22 nt, Human
uuuggaauuggcauucuauucu

SEQ ID NO: 971369 - RNA, 22 nt, Human
auuuuucucuccacuccauuaa

SEQ ID NO: 971370 - RNA, 21 nt, Human
gccacugcacuccagccuggg

SEQ ID NO: 971371 - RNA, 22 nt, Human
cuguccuugcuggccagguaug

SEQ ID NO: 971372 - RNA, 22 nt, Human
ugggcuggcugaacuucaaccu

SEQ ID NO: 971373 - RNA, 22 nt, Human
agggucugacaaugugacuuag

SEQ ID NO: 971374 - RNA, 22 nt, Human
cccaggauggggcugcaguuau

SEQ ID NO: 971375 - RNA, 22 nt, Human
ugguaaauauguccauucucuu

SEQ ID NO: 971376 - RNA, 22 nt, Human
gucucccaucguuugugaggaa

SEQ ID NO: 971377 - RNA, 20 nt, Human
gccugagcuccgccuccugu

SEQ ID NO: 971378 - RNA, 22 nt, Human
uuccauaaucaccuuauucuuu

SEQ ID NO: 971379 - RNA, 22 nt, Human
ucaccaggcuggaaugcagugg

SEQ ID NO: 971380 - RNA, 22 nt, Human
aggcucugaucagguggcugug

SEQ ID NO: 971381 - RNA, 22 nt, Human
cugagucucccggcaguggagg

SEQ ID NO: 971382 - RNA, 22 nt, Human
aggcugggaaauguagucuucc

SEQ ID NO: 971383 - RNA, 22 nt, Human
ugccucugcugcuguggcauca

SEQ ID NO: 971384 - RNA, 22 nt, Human
uucccucucacuuaaagcuugg

SEQ ID NO: 971385 - RNA, 22 nt, Human
agguggguaucaugagagauua

SEQ ID NO: 971386 - RNA, 22 nt, Human
guuugcauauuugcacaggaau

SEQ ID NO: 971387 - RNA, 22 nt, Human
uauaacaguuuaggugguguca

SEQ ID NO: 971388 - RNA, 22 nt, Human
auuagggaaggauuuggccuga

SEQ ID NO: 971389 - RNA, 22 nt, Human
uggcucagcaagacauugaccu

SEQ ID NO: 971390 - RNA, 22 nt, Human
ugcagaagugagucaugaggaa

SEQ ID NO: 971391 - RNA, 22 nt, Human
aaauaauugaguuggucaauau

SEQ ID NO: 971392 - RNA, 22 nt, Human
ccaggccuggaccaugccaggg

SEQ ID NO: 971393 - RNA, 22 nt, Human
uuccagaagccuccauauuacu

SEQ ID NO: 971394 - RNA, 22 nt, Human
uugguuuagagagugugguuac

SEQ ID NO: 971395 - RNA, 22 nt, Human
uguuuguucccucucuuuccug

SEQ ID NO: 971396 - RNA, 22 nt, Human
ugcagauucaaaugaaaugcaa

SEQ ID NO: 971397 - RNA, 19 nt, Human
ugacaggcuguugccuuga

SEQ ID NO: 971398 - RNA, 22 nt, Human
aaagccuugagauccuauaguu

SEQ ID NO: 971399 - RNA, 22 nt, Human
uggaggagggcuggugucugua

SEQ ID NO: 971400 - RNA, 22 nt, Human
uuucacuagaacguucuuguuu

SEQ ID NO: 971401 - RNA, 22 nt, Human
cccaggaggcagagcuugcagu

SEQ ID NO: 971402 - RNA, 22 nt, Human
uguuuuaagagcgcacuuuaua

SEQ ID NO: 971403 - RNA, 19 nt, Human
ccagcccugucacuucuug

SEQ ID NO: 971404 - RNA, 22 nt, Human
accagguggccccagcgugguu

SEQ ID NO: 971405 - RNA, 22 nt, Human
gggccuggggugacguaccccu

SEQ ID NO: 971406 - RNA, 22 nt, Human
cuuauguaugcuacuuuguggu

SEQ ID NO: 971407 - RNA, 22 nt, Human
ccaggaggcagaaguugcagug

SEQ ID NO: 971408 - RNA, 22 nt, Human
gaacuguaguuaauacuacaca

SEQ ID NO: 971409 - RNA, 22 nt, Human
ucagccagugccuugaucuugc

SEQ ID NO: 971410 - RNA, 22 nt, Human
uggacaaaugauuucuaccuuu

SEQ ID NO: 971411 - RNA, 22 nt, Human
gacauacagcauggucuaugaa

SEQ ID NO: 971412 - RNA, 22 nt, Human
augaugugugcugaucaagcuu

SEQ ID NO: 971413 - RNA, 22 nt, Human
augccuggacugacaugcacug

SEQ ID NO: 971414 - RNA, 22 nt, Human
aaugucugagucucuguauccc

SEQ ID NO: 971415 - RNA, 22 nt, Human
aacagaaaagguagguggcuuu

SEQ ID NO: 971416 - RNA, 22 nt, Human
gaggaggccaguggaaggaagc

SEQ ID NO: 971417 - RNA, 22 nt, Human
cuccaggcuucaagggccggcc

SEQ ID NO: 971418 - RNA, 22 nt, Human
cagagacaguuucacagggucu

SEQ ID NO: 971419 - RNA, 21 nt, Human
aacauuucugggagaacucac

SEQ ID NO: 971420 - RNA, 22 nt, Human
acauuucugcuagaauagguga

SEQ ID NO: 971421 - RNA, 19 nt, Human
uauggcaggccgaggcacu

SEQ ID NO: 971422 - RNA, 22 nt, Human
agguaggggguuugggaacugc

SEQ ID NO: 971423 - RNA, 23 nt, Human
ugcucugggaggcccuggagagc

SEQ ID NO: 971424 - RNA, 22 nt, Human
cuucacauguuggaguccuuug

SEQ ID NO: 971425 - RNA, 22 nt, Human
gaggugggagggcagucccuaa

SEQ ID NO: 971426 - RNA, 21 nt, Human
uccuggcccacucuaucccca

SEQ ID NO: 971427 - RNA, 16 nt, Human
ccagaggccuggccuc

SEQ ID NO: 971428 - RNA, 22 nt, Human
ucugauuagagcauucuugagu

SEQ ID NO: 971429 - RNA, 22 nt, Human
uggcaggguggcaacuuuuggu

SEQ ID NO: 971430 - RNA, 22 nt, Human
uuauguuuuaaguguguaucuu

SEQ ID NO: 971431 - RNA, 22 nt, Human
ggcugccugugcccaggcacac

SEQ ID NO: 971432 - RNA, 22 nt, Human
ccuugcauauauuauaucuuug

SEQ ID NO: 971433 - RNA, 22 nt, Human
aaaggccuugagcugggugcca

SEQ ID NO: 971434 - RNA, 22 nt, Human
gucuggaggaggaagaaggcac

SEQ ID NO: 971435 - RNA, 22 nt, Human
acagcagcauaaacugacuaag

SEQ ID NO: 971436 - RNA, 22 nt, Human
aucaggaugacaacugcugggu

SEQ ID NO: 971437 - RNA, 22 nt, Human
uauagagguggaaacugagguu

SEQ ID NO: 971438 - RNA, 22 nt, Human
aacaaauguguggcaguguggg

SEQ ID NO: 971439 - RNA, 22 nt, Human
ccauuuguucgcccagcuccaa

SEQ ID NO: 971440 - RNA, 22 nt, Human
agggaggaucugcuccuugucu

SEQ ID NO: 971441 - RNA, 22 nt, Human
ucaggggcugugcauuucccag

SEQ ID NO: 971442 - RNA, 22 nt, Human
ugaaaugagauaauuuaagugc

SEQ ID NO: 971443 - RNA, 22 nt, Human
acuucuugggacccuggcaccg

SEQ ID NO: 971444 - RNA, 22 nt, Human
cagcccagcagggucuggcccu

SEQ ID NO: 971445 - RNA, 23 nt, Human
aaugggugcaacuauccaugaca

SEQ ID NO: 971446 - RNA, 23 nt, Human
uacuuaggaauggggacggcaag

SEQ ID NO: 971447 - RNA, 22 nt, Human
aagcccaguuucacacugagac

SEQ ID NO: 971448 - RNA, 21 nt, Human
uaagaacauuaucuucuuccu

SEQ ID NO: 971449 - RNA, 22 nt, Human
aaaaacuguaauuacuuuugca

SEQ ID NO: 971450 - RNA, 22 nt, Human
ccugagguggcugcagcacugc

SEQ ID NO: 971451 - RNA, 22 nt, Human
gugccugcagcaauccauggca

SEQ ID NO: 971452 - RNA, 22 nt, Human
ucugggaagcugguccuguucu

SEQ ID NO: 971453 - RNA, 22 nt, Human
cuucucagaggccagaagcuau

SEQ ID NO: 971454 - RNA, 22 nt, Human
cagacagaccugcaagggcaca

SEQ ID NO: 971455 - RNA, 22 nt, Human
aggaucuugcuguagaggauag

SEQ ID NO: 971456 - RNA, 22 nt, Human
aauuagagaucaguucuuugac

SEQ ID NO: 971457 - RNA, 22 nt, Human
ggcagggucuggacugaaagcu

SEQ ID NO: 971458 - RNA, 22 nt, Human
cagaggccaccuguggccacug

SEQ ID NO: 971459 - RNA, 22 nt, Human
ccuggccaggcucucagcacug

SEQ ID NO: 971460 - RNA, 22 nt, Human
ugauugaagaggugaggaaguu

SEQ ID NO: 971461 - RNA, 23 nt, Human
uggccacagggugcuccauugua

SEQ ID NO: 971462 - RNA, 18 nt, Human
ucugcugcugcguccugc

SEQ ID NO: 971463 - RNA, 22 nt, Human
gcaguggggcgcugggaguugg

SEQ ID NO: 971464 - RNA, 22 nt, Human
cccuggagcaucucugcugucu

SEQ ID NO: 971465 - RNA, 22 nt, Human
uuucaucuucccagagaccuug

SEQ ID NO: 971466 - RNA, 22 nt, Human
cagggcuguaaauuagugcuga

SEQ ID NO: 971467 - RNA, 22 nt, Human
ggcuugcuucuuguccaggaau

SEQ ID NO: 971468 - RNA, 22 nt, Human
ugggccuggguuccuccugggc

SEQ ID NO: 971469 - RNA, 22 nt, Human
acagcagcuaaaggugucuccu

SEQ ID NO: 971470 - RNA, 22 nt, Human
cagcagugugcaggugugcugg

SEQ ID NO: 971471 - RNA, 22 nt, Human
cucagagaagucuuugcuaaac

SEQ ID NO: 971472 - RNA, 22 nt, Human
cugaggcucccucgggucugcu

SEQ ID NO: 971473 - RNA, 22 nt, Human
agggcuggcuccguuaccuuga

SEQ ID NO: 971474 - RNA, 22 nt, Human
ccccagccagcaggaccucuga

SEQ ID NO: 971475 - RNA, 22 nt, Human
gcuggcugcgucaucacagggc

SEQ ID NO: 971476 - RNA, 22 nt, Human
cugcacugagcucucccagccc

SEQ ID NO: 971477 - RNA, 22 nt, Human
aggcuagcaaugggagaugagu

SEQ ID NO: 971478 - RNA, 22 nt, Human
cacccacauggaaauucacagu

SEQ ID NO: 971479 - RNA, 22 nt, Human
auuaaauuuucacuaggcuccc

SEQ ID NO: 971480 - RNA, 22 nt, Human
cugucuuuuacuaucauuuacu

SEQ ID NO: 971481 - RNA, 22 nt, Human
gggcuggugaggcugcccugca

SEQ ID NO: 971482 - RNA, 22 nt, Human
uaaaacugaauacauacugagg

SEQ ID NO: 971483 - RNA, 22 nt, Human
ugagcccaggaguuggagaccg

SEQ ID NO: 971484 - RNA, 22 nt, Human
gcagagccaggagcccaggauc

SEQ ID NO: 971485 - RNA, 22 nt, Human
ccagggcacuuaggcccagccc

SEQ ID NO: 971486 - RNA, 22 nt, Human
ccuagagcucugcuuuaucuaa

SEQ ID NO: 971487 - RNA, 22 nt, Human
aaaucuggccccuugccuauuu

SEQ ID NO: 971488 - RNA, 22 nt, Human
cauauuaaggucuguaaggggu

SEQ ID NO: 971489 - RNA, 22 nt, Human
ucaaauaaugccauucaucauc

SEQ ID NO: 971490 - RNA, 21 nt, Human
ccagaggccucucuuggccac

SEQ ID NO: 971491 - RNA, 22 nt, Human
ucaaaguagggguaagccaggc

SEQ ID NO: 971492 - RNA, 22 nt, Human
ggcagccuugagggaggccugg

SEQ ID NO: 971493 - RNA, 23 nt, Human
ugucccagagggagggauaggcu

SEQ ID NO: 971494 - RNA, 22 nt, Human
auuuauuaugggauuuggcuca

SEQ ID NO: 971495 - RNA, 22 nt, Human
auaguggugagcugcauuuaug

SEQ ID NO: 971496 - RNA, 22 nt, Human
ggcccagcugugcuuccagccc

SEQ ID NO: 971497 - RNA, 22 nt, Human
ucuggcucucauacucgccagu

SEQ ID NO: 971498 - RNA, 18 nt, Human
ugggauggagaguaacug

SEQ ID NO: 971499 - RNA, 22 nt, Human
gcaggguaggugacagguaguc

SEQ ID NO: 971500 - RNA, 22 nt, Human
auuugcagagcucugaauuuug

SEQ ID NO: 971501 - RNA, 22 nt, Human
gagccagcgccuugccucuggg

SEQ ID NO: 971502 - RNA, 22 nt, Human
cuagucacucagcacugacaaa

SEQ ID NO: 971503 - RNA, 19 nt, Human
cagagccucagagcuagaa

SEQ ID NO: 971504 - RNA, 22 nt, Human
ucaaugaugcugaagguagcgu

SEQ ID NO: 971505 - RNA, 22 nt, Human
uauugacagagggucagaagag

SEQ ID NO: 971506 - RNA, 22 nt, Human
ccuggcagcauugguagagauu

SEQ ID NO: 971507 - RNA, 22 nt, Human
aggaccuguaccucagcaucua

SEQ ID NO: 971508 - RNA, 22 nt, Human
cccugggacccgcugcagaggc

SEQ ID NO: 971509 - RNA, 22 nt, Human
auaauuaauuucaguaaucucc

SEQ ID NO: 971510 - RNA, 22 nt, Human
ggcccacuugaaauggagcuca

SEQ ID NO: 971511 - RNA, 22 nt, Human
ugucaugcccaggagcaaggua

SEQ ID NO: 971512 - RNA, 22 nt, Human
ccagcugcgggcaucgagaguu

SEQ ID NO: 971513 - RNA, 22 nt, Human
ggucagagggugggcugccugu

SEQ ID NO: 971514 - RNA, 20 nt, Human
acagccagaggaggcagaca

SEQ ID NO: 971515 - RNA, 22 nt, Human
guauuaggaaauaugaagaaag

SEQ ID NO: 971516 - RNA, 22 nt, Human
caagcccaggauuccccaguua

SEQ ID NO: 971517 - RNA, 22 nt, Human
cagagcugagaauguugaugcu

SEQ ID NO: 971518 - RNA, 22 nt, Human
uggcagagcccagacuccaguc

SEQ ID NO: 971519 - RNA, 22 nt, Human
aucuucucaagcagcauccugu

SEQ ID NO: 971520 - RNA, 22 nt, Human
auuuaaauuuucugauggagag

SEQ ID NO: 971521 - RNA, 22 nt, Human
cagaacugggcagggagcagag

SEQ ID NO: 971522 - RNA, 22 nt, Human
uuagaaaggagcuuauuucuuu

SEQ ID NO: 971523 - RNA, 22 nt, Human
acauuucuccuugcaggaguca

SEQ ID NO: 971524 - RNA, 17 nt, Human
augugucugaguguccu

SEQ ID NO: 971525 - RNA, 22 nt, Human
ugucaugccaccguuucccaga

SEQ ID NO: 971526 - RNA, 22 nt, Human
ucucaggacuuugggaagcuca

SEQ ID NO: 971527 - RNA, 22 nt, Human
ccccaggagaaaucuuaaacua

SEQ ID NO: 971528 - RNA, 22 nt, Human
gagggucccugcucagggccag

SEQ ID NO: 971529 - RNA, 22 nt, Human
uugcuucaguagcucuuuaaag

SEQ ID NO: 971530 - RNA, 22 nt, Human
gcagcguggggacaggagcuca

SEQ ID NO: 971531 - RNA, 22 nt, Human
ugcauuguuugauaggugaauu

SEQ ID NO: 971532 - RNA, 17 nt, Human
cagcugugagagccuua

SEQ ID NO: 971533 - RNA, 22 nt, Human
gagccagccgcaagagcuguga

SEQ ID NO: 971534 - RNA, 22 nt, Human
uucauucugggcucuaaggaac

SEQ ID NO: 971535 - RNA, 22 nt, Human
ugcugaaaacucaaccauugug

SEQ ID NO: 971536 - RNA, 22 nt, Human
uggcagcagccauggaaggccc

SEQ ID NO: 971537 - RNA, 22 nt, Human
agagugaaguucaucgugcagc

SEQ ID NO: 971538 - RNA, 22 nt, Human
uuuccucugucaugacagcuga

SEQ ID NO: 971539 - RNA, 22 nt, Human
aagggcuggccacauucugggu

SEQ ID NO: 971540 - RNA, 22 nt, Human
uuugaaagccuggcuuuucucu

SEQ ID NO: 971541 - RNA, 22 nt, Human
cuggugcaggaaggagcuggca

SEQ ID NO: 971542 - RNA, 22 nt, Human
ugcugaaauuagaacauugagg

SEQ ID NO: 971543 - RNA, 22 nt, Human
cacauuucugugagucaauauu

SEQ ID NO: 971544 - RNA, 22 nt, Human
ucuugggaagcccauuuccacc

SEQ ID NO: 971545 - RNA, 22 nt, Human
uggcagcucccagagcuuccaa

SEQ ID NO: 971546 - RNA, 22 nt, Human
ucugggggcgaccagggacugc

SEQ ID NO: 971547 - RNA, 22 nt, Human
cagcagggaagcugugcuguuu

SEQ ID NO: 971548 - RNA, 22 nt, Human
aucuacaggcugaggugggagg

SEQ ID NO: 971549 - RNA, 22 nt, Human
cgccucagccguggucaucuuc

SEQ ID NO: 971550 - RNA, 22 nt, Human
cagcauuggguuaccuuuguuu

SEQ ID NO: 971551 - RNA, 22 nt, Human
agugugagcccuggaguggugc

SEQ ID NO: 971552 - RNA, 22 nt, Human
acugugugcccugacgccaggg

SEQ ID NO: 971553 - RNA, 22 nt, Human
ugagugaggaagcgguggagga

SEQ ID NO: 971554 - RNA, 22 nt, Human
gagugcaggccugagcaccauc

SEQ ID NO: 971555 - RNA, 22 nt, Human
cucuccucagaacaggcccucu

SEQ ID NO: 971556 - RNA, 22 nt, Human
gcugcagcagaaguucucagag

SEQ ID NO: 971557 - RNA, 22 nt, Human
cucugagcccgcugcagcccca

SEQ ID NO: 971558 - RNA, 22 nt, Human
cugugucugaauaacucugugu

SEQ ID NO: 971559 - RNA, 22 nt, Human
gacaggggucccucugggcugu

SEQ ID NO: 971560 - RNA, 20 nt, Human
ucacaucuggcagcugauga

SEQ ID NO: 971561 - RNA, 22 nt, Human
uacuuuuuagcacagugugugc

SEQ ID NO: 971562 - RNA, 22 nt, Human
ugggcagaaugugggauccaga

SEQ ID NO: 971563 - RNA, 22 nt, Human
cuuugcauacaauuuuuagaaa

SEQ ID NO: 971564 - RNA, 22 nt, Human
aaaaucuaaguagcgaguaagg

SEQ ID NO: 971565 - RNA, 22 nt, Human
gcucacuggccugaagaggacg

SEQ ID NO: 971566 - RNA, 22 nt, Human
ggcuggagugggcuccagaguu

SEQ ID NO: 971567 - RNA, 22 nt, Human
acuuucauguuggugaaggguu

SEQ ID NO: 971568 - RNA, 22 nt, Human
accauguguuuuacacauggua

SEQ ID NO: 971569 - RNA, 18 nt, Human
acauuucuaugcuucugg

SEQ ID NO: 971570 - RNA, 22 nt, Human
caggagcccguugcuccggcgg

SEQ ID NO: 971571 - RNA, 19 nt, Human
acagaagcauagaaaagga

SEQ ID NO: 971572 - RNA, 22 nt, Human
uggagaugaauauguguaccug

SEQ ID NO: 971573 - RNA, 22 nt, Human
gggagcugagcuggaagagaau

SEQ ID NO: 971574 - RNA, 22 nt, Human
ugucacauaauuuaucuguagg

SEQ ID NO: 971575 - RNA, 22 nt, Human
gccaggcucucagugacugccc

SEQ ID NO: 971576 - RNA, 18 nt, Human
cugcccagagcauuucau

SEQ ID NO: 971577 - RNA, 17 nt, Human
cucuccuuccucugagg

SEQ ID NO: 971578 - RNA, 22 nt, Human
gcaggggaguggcaggcccgga

SEQ ID NO: 971579 - RNA, 21 nt, Human
aggaggggucuuucccacuga

SEQ ID NO: 971580 - RNA, 22 nt, Human
aauguuauuacacuugugaaau

SEQ ID NO: 971581 - RNA, 22 nt, Human
auuuuucucucacacuuaccag

SEQ ID NO: 971582 - RNA, 22 nt, Human
gaggccugguuuccagcauccu

SEQ ID NO: 971583 - RNA, 21 nt, Human
cugcucuggggaccggcugug

SEQ ID NO: 971584 - RNA, 22 nt, Human
gguuugcacgauauuuccaugg

SEQ ID NO: 971585 - RNA, 22 nt, Human
uacaaaguagaaauucaguaaa

SEQ ID NO: 971586 - RNA, 22 nt, Human
agcugggaggugggcagugaga

SEQ ID NO: 971587 - RNA, 22 nt, Human
uguggccuccuguuccugggua

SEQ ID NO: 971588 - RNA, 22 nt, Human
cuauuaggcuuccauuucaugc

SEQ ID NO: 971589 - RNA, 22 nt, Human
uggacucagugcugccauuccc

SEQ ID NO: 971590 - RNA, 22 nt, Human
ugaacauauucaccucuaaaua

SEQ ID NO: 971591 - RNA, 22 nt, Human
gauuucaagcccccagagauuc

SEQ ID NO: 971592 - RNA, 22 nt, Human
agaaaugaagagagucaagguu

SEQ ID NO: 971593 - RNA, 22 nt, Human
ucugggagcagaugaugguaua

SEQ ID NO: 971594 - RNA, 22 nt, Human
gggcaugguggcaggcaccugu

SEQ ID NO: 971595 - RNA, 22 nt, Human
uaacagaagaugaaacuucuuu

SEQ ID NO: 971596 - RNA, 22 nt, Human
ucucagggcgcagugaggcagu

SEQ ID NO: 971597 - RNA, 22 nt, Human
ucaggcagaccaccgugggcag

SEQ ID NO: 971598 - RNA, 22 nt, Human
ggagauggcucugcaaggucua

SEQ ID NO: 971599 - RNA, 22 nt, Human
ucuugggauagugucucauggc

SEQ ID NO: 971600 - RNA, 22 nt, Human
uuugaaagucaaccuuccaguu

SEQ ID NO: 971601 - RNA, 22 nt, Human
caggcugggcagccuccccggc

SEQ ID NO: 971602 - RNA, 21 nt, Human
acuguucaucuguucagaagc

SEQ ID NO: 971603 - RNA, 22 nt, Human
ugggcagagucguggggaauag

SEQ ID NO: 971604 - RNA, 22 nt, Human
uagugaaauuuaugcacagcua

SEQ ID NO: 971605 - RNA, 22 nt, Human
cucuccuccaacagcccugccg

SEQ ID NO: 971606 - RNA, 22 nt, Human
gauuucuguaacacuucagaua

SEQ ID NO: 971607 - RNA, 22 nt, Human
ucugagagagggucagaugcua

SEQ ID NO: 971608 - RNA, 18 nt, Human
ucugucucuguccuugcu

SEQ ID NO: 971609 - RNA, 22 nt, Human
agagagggcauagaaaaaggga

SEQ ID NO: 971610 - RNA, 22 nt, Human
uuaaaugaggcugauguagauu

SEQ ID NO: 971611 - RNA, 22 nt, Human
uuugcauuuuagauuuaggccu

SEQ ID NO: 971612 - RNA, 22 nt, Human
ggcucuggugugaagcagccuc

SEQ ID NO: 971613 - RNA, 22 nt, Human
uggccuggcucacagugagauu

SEQ ID NO: 971614 - RNA, 22 nt, Human
uaggauaggauggagacagaau

SEQ ID NO: 971615 - RNA, 22 nt, Human
auuuuuccaauuaggauaaaga

SEQ ID NO: 971616 - RNA, 22 nt, Human
cugcuaaaccucucugagagcu

SEQ ID NO: 971617 - RNA, 17 nt, Human
ugcauuguaggcuagcc

SEQ ID NO: 971618 - RNA, 22 nt, Human
uuacaguauuguuaaacucuuu

SEQ ID NO: 971619 - RNA, 22 nt, Human
auggcuggcauccaggugggcu

SEQ ID NO: 971620 - RNA, 22 nt, Human
acuggacagaggaaauauggag

SEQ ID NO: 971621 - RNA, 22 nt, Human
ggggcuggcucacuaagagacu

SEQ ID NO: 971622 - RNA, 22 nt, Human
ggcugggccagggccuguggac

SEQ ID NO: 971623 - RNA, 22 nt, Human
acagagauggcacagagaaggu

SEQ ID NO: 971624 - RNA, 22 nt, Human
cagggccaagcugcagcaucug

SEQ ID NO: 971625 - RNA, 22 nt, Human
gagagaagaaagccaugguccu

SEQ ID NO: 971626 - RNA, 22 nt, Human
cuggguggcuguccagccagcc

SEQ ID NO: 971627 - RNA, 22 nt, Human
uuucuaaggccagagacugcug

SEQ ID NO: 971628 - RNA, 21 nt, Human
ugcccacagcaaaugcagagg

SEQ ID NO: 971629 - RNA, 22 nt, Human
uacaugcuccacuuucuccugu

SEQ ID NO: 971630 - RNA, 22 nt, Human
ugguggccaauucacagggcuc

SEQ ID NO: 971631 - RNA, 22 nt, Human
agcuggaggauaacucacuucu

SEQ ID NO: 971632 - RNA, 22 nt, Human
aggcagugcucaagacagcagc

SEQ ID NO: 971633 - RNA, 22 nt, Human
gcuggcccagggucaccuagga

SEQ ID NO: 971634 - RNA, 22 nt, Human
cauuucugucacguucuuuuau

SEQ ID NO: 971635 - RNA, 22 nt, Human
caggagugaaaugaggcccagg

SEQ ID NO: 971636 - RNA, 22 nt, Human
uggagccagagcgcagccuggg

SEQ ID NO: 971637 - RNA, 22 nt, Human
cagcuggaugggagaccauguu

SEQ ID NO: 971638 - RNA, 22 nt, Human
gccugccugcugucaucugccu

SEQ ID NO: 971639 - RNA, 22 nt, Human
uccuugaaaaucuugguuuaga

SEQ ID NO: 971640 - RNA, 22 nt, Human
ggccucugggguccugagccca

SEQ ID NO: 971641 - RNA, 22 nt, Human
gcaggaugggagcuucacucug

SEQ ID NO: 971642 - RNA, 22 nt, Human
uuccaggaagauucaacaaaag

SEQ ID NO: 971643 - RNA, 22 nt, Human
agagugaucagauaucaggugu

SEQ ID NO: 971644 - RNA, 22 nt, Human
ucuggccagcaugagaccuggu

SEQ ID NO: 971645 - RNA, 22 nt, Human
uguauagaguuggaagaugacu

SEQ ID NO: 971646 - RNA, 22 nt, Human
ccaaagucugcauuuuaacaug

SEQ ID NO: 971647 - RNA, 22 nt, Human
ugaaggcauugaugaaggaauc

SEQ ID NO: 971648 - RNA, 22 nt, Human
ucuucagauggccaguuguccc

SEQ ID NO: 971649 - RNA, 22 nt, Human
gugcugcagagucucgugccgc

SEQ ID NO: 971650 - RNA, 22 nt, Human
cuuaagaaauugcauucuaauc

SEQ ID NO: 971651 - RNA, 22 nt, Human
uccuucagucuucugagccaua

SEQ ID NO: 971652 - RNA, 22 nt, Human
uuuggccacuugggaguccagg

SEQ ID NO: 971653 - RNA, 22 nt, Human
cugggagaugacucagagcagg

SEQ ID NO: 971654 - RNA, 22 nt, Human
agcugcccugggcuggagaugg

SEQ ID NO: 971655 - RNA, 22 nt, Human
ugauuuccacagucaggggugc

SEQ ID NO: 971656 - RNA, 22 nt, Human
agauuucagaugcucggcaguu

SEQ ID NO: 971657 - RNA, 22 nt, Human
cugucccucaucaccucugggu

SEQ ID NO: 971658 - RNA, 22 nt, Human
auuucuguauccugcugucaga

SEQ ID NO: 971659 - RNA, 22 nt, Human
ggcuccucucuggccgcucccg

SEQ ID NO: 971660 - RNA, 22 nt, Human
ucuggccugaaaguccaugcuu

SEQ ID NO: 971661 - RNA, 22 nt, Human
auuguuuuccaaagaugcugcu

SEQ ID NO: 971662 - RNA, 22 nt, Human
ucucagaggcccgacguucucc

SEQ ID NO: 971663 - RNA, 19 nt, Human
uaaaaugucuguggucagu

SEQ ID NO: 971664 - RNA, 22 nt, Human
aaaccuauuggcaagaauaaua

SEQ ID NO: 971665 - RNA, 22 nt, Human
uuauguauggauggcugaaagu

SEQ ID NO: 971666 - RNA, 22 nt, Human
cacugaagccugggaguaagac

SEQ ID NO: 971667 - RNA, 22 nt, Human
augcaagauguauagaagacuu

SEQ ID NO: 971668 - RNA, 22 nt, Human
uccugagggcgauucagcaggu

SEQ ID NO: 971669 - RNA, 22 nt, Human
cucugagagagcuggugagcac

SEQ ID NO: 971670 - RNA, 22 nt, Human
gagaagcaaucaguggccaccc

SEQ ID NO: 971671 - RNA, 22 nt, Human
ucacagacauggugagguaaca

SEQ ID NO: 971672 - RNA, 22 nt, Human
ucccagaguuuccuguguccca

SEQ ID NO: 971673 - RNA, 19 nt, Human
gccucugcuggggacaggc

SEQ ID NO: 971674 - RNA, 22 nt, Human
ucucccacgguacaggauaaac

SEQ ID NO: 971675 - RNA, 22 nt, Human
ugaagcaggcauugacugauga

SEQ ID NO: 971676 - RNA, 22 nt, Human
cucagggcaguauggcugagag

SEQ ID NO: 971677 - RNA, 22 nt, Human
ugaaggugucuuugugaacauc

SEQ ID NO: 971678 - RNA, 22 nt, Human
ucucagaguuugaaucuggagu

SEQ ID NO: 971679 - RNA, 22 nt, Human
ggagcagcacugauuagcgguu

SEQ ID NO: 971680 - RNA, 22 nt, Human
aaagaauuuguacacccuacua

SEQ ID NO: 971681 - RNA, 22 nt, Human
agaauaaacugcuuuagggcag

SEQ ID NO: 971682 - RNA, 22 nt, Human
acauacauauguuuaaaugcau

SEQ ID NO: 971683 - RNA, 22 nt, Human
acccaggagacggaggugcagu

SEQ ID NO: 971684 - RNA, 22 nt, Human
uuagugauaggaagccagauug

SEQ ID NO: 971685 - RNA, 22 nt, Human
cccuggaggaccccaauguggc

SEQ ID NO: 971686 - RNA, 22 nt, Human
uguucuugggaaucuuacaguu

SEQ ID NO: 971687 - RNA, 23 nt, Human
uguugaaguaacuguuacauaga

SEQ ID NO: 971688 - RNA, 22 nt, Human
cugggcugcgggcgccccucca

SEQ ID NO: 971689 - RNA, 23 nt, Human
ggccuccuggucuaggcuagacu

SEQ ID NO: 971690 - RNA, 17 nt, Human
gcgcagcuccuggcgcg

SEQ ID NO: 971691 - RNA, 22 nt, Human
gagcugcccugagcuuugcaug

SEQ ID NO: 971692 - RNA, 22 nt, Human
aagcagaggguauggccagguu

SEQ ID NO: 971693 - RNA, 22 nt, Human
auucuuauuuaaauagagucug

SEQ ID NO: 971694 - RNA, 22 nt, Human
uccuuuccaugcuucuagaggc

SEQ ID NO: 971695 - RNA, 22 nt, Human
uagcagcuuaaguaauuagaau

SEQ ID NO: 971696 - RNA, 22 nt, Human
ggcuggcauccagggaaaucca

SEQ ID NO: 971697 - RNA, 22 nt, Human
agcugguucauucauucauggu

SEQ ID NO: 971698 - RNA, 22 nt, Human
uugaauucauuucucauugagu

SEQ ID NO: 971699 - RNA, 22 nt, Human
augcacuugcguguuugcaaau

SEQ ID NO: 971700 - RNA, 22 nt, Human
agccugagugcuuaggacuguu

SEQ ID NO: 971701 - RNA, 22 nt, Human
aaaggugacugcagcagcuauu

SEQ ID NO: 971702 - RNA, 22 nt, Human
uucaggauaugugauaucugaa

SEQ ID NO: 971703 - RNA, 22 nt, Human
cuugccuucuguuccuauagaa

SEQ ID NO: 971704 - RNA, 22 nt, Human
agaggccuuucuguugagugaa

SEQ ID NO: 971705 - RNA, 22 nt, Human
uccugagaugagacagugcugc

SEQ ID NO: 971706 - RNA, 17 nt, Human
ugaagaugcauggcagc

SEQ ID NO: 971707 - RNA, 23 nt, Human
aagcugccagucugaagccuggg

SEQ ID NO: 971708 - RNA, 22 nt, Human
ccugagccuggcucaugcacuc

SEQ ID NO: 971709 - RNA, 22 nt, Human
cccuugggccccagcucagggc

SEQ ID NO: 971710 - RNA, 22 nt, Human
ugaggcacuccaggaugcuguu

SEQ ID NO: 971711 - RNA, 22 nt, Human
ucagggcauggcugcacuuggc

SEQ ID NO: 971712 - RNA, 22 nt, Human
cagcagaggaaagcaaaucuaa

SEQ ID NO: 971713 - RNA, 22 nt, Human
aagggcagcugacagaugcuua

SEQ ID NO: 971714 - RNA, 22 nt, Human
cccaggccagaacuugguugcu

SEQ ID NO: 971715 - RNA, 22 nt, Human
cuucuucaguugcauguauugg

SEQ ID NO: 971716 - RNA, 22 nt, Human
uuguguuucugugauauguaaa

SEQ ID NO: 971717 - RNA, 22 nt, Human
ucuuggccccaccugugccagc

SEQ ID NO: 971718 - RNA, 20 nt, Human
acuggagccaucucagccua

SEQ ID NO: 971719 - RNA, 22 nt, Human
ucuggcucuccagugcucuuag

SEQ ID NO: 971720 - RNA, 22 nt, Human
acccaggaaaacauggugcaga

SEQ ID NO: 971721 - RNA, 22 nt, Human
gccugguguccagaggcgagug

SEQ ID NO: 971722 - RNA, 22 nt, Human
ucccagagaagagcuggaugga

SEQ ID NO: 971723 - RNA, 22 nt, Human
gguggccucugcaggccucgac

SEQ ID NO: 971724 - RNA, 22 nt, Human
ccuugcugaccaucaccuuuga

SEQ ID NO: 971725 - RNA, 22 nt, Human
aaguaacaaugcuguugaauug

SEQ ID NO: 971726 - RNA, 19 nt, Human
caaggccaccauuucuccg

SEQ ID NO: 971727 - RNA, 22 nt, Human
aggcaggggagcuggaagggua

SEQ ID NO: 971728 - RNA, 22 nt, Human
agggcagaaaucgauuacaccu

SEQ ID NO: 971729 - RNA, 22 nt, Human
uacuuagagcgauaauuuauac

SEQ ID NO: 971730 - RNA, 22 nt, Human
agucacuguucugucaugucaa

SEQ ID NO: 971731 - RNA, 22 nt, Human
ggcacugacugugcagcgcacc

SEQ ID NO: 971732 - RNA, 22 nt, Human
ucagagugcagcgggaggcugg

SEQ ID NO: 971733 - RNA, 22 nt, Human
aagaaugucguugguauuuuaa

SEQ ID NO: 971734 - RNA, 22 nt, Human
uucucagguagugcugaugcug

SEQ ID NO: 971735 - RNA, 22 nt, Human
agagcugagaauguggcuuccu

SEQ ID NO: 971736 - RNA, 22 nt, Human
gccuggaggggccaggguggua

SEQ ID NO: 971737 - RNA, 22 nt, Human
ucaggauaaaauguaauggcaa

SEQ ID NO: 971738 - RNA, 22 nt, Human
agugcuuugagcguuugaaaag

SEQ ID NO: 971739 - RNA, 22 nt, Human
gggauggggggaagcguccaug

SEQ ID NO: 971740 - RNA, 22 nt, Human
gagggcaggggucuugcacggu

SEQ ID NO: 971741 - RNA, 22 nt, Human
uggcucagcgguggcagcagac

SEQ ID NO: 971742 - RNA, 22 nt, Human
ggcagcucacugauuagcaauu

SEQ ID NO: 971743 - RNA, 22 nt, Human
uacacacagaggccaugggauu

SEQ ID NO: 971744 - RNA, 22 nt, Human
gcuggcagguccaagauagagc

SEQ ID NO: 971745 - RNA, 22 nt, Human
uaguuauuauuguuacuaucag

SEQ ID NO: 971746 - RNA, 22 nt, Human
acugaaauacugcucuuggauu

SEQ ID NO: 971747 - RNA, 22 nt, Human
acaguaccugcucucaagcaaa

SEQ ID NO: 971748 - RNA, 22 nt, Human
caacagaagguguacuacugaa

SEQ ID NO: 971749 - RNA, 22 nt, Human
aaucuucauuuugacaagauuc

SEQ ID NO: 971750 - RNA, 22 nt, Human
uccugggaagagaccugagcau

SEQ ID NO: 971751 - RNA, 22 nt, Human
gaggcagcagaacauggaagag

SEQ ID NO: 971752 - RNA, 22 nt, Human
cacaugcauaaggauaauuacu

SEQ ID NO: 971753 - RNA, 22 nt, Human
gagcagcuguccccaaagcuuc

SEQ ID NO: 971754 - RNA, 22 nt, Human
ucuggccuauuucugucagauc

SEQ ID NO: 971755 - RNA, 22 nt, Human
ggggggugcugaucaguggagc

SEQ ID NO: 971756 - RNA, 19 nt, Human
accuugggcaagugccuuc

SEQ ID NO: 971757 - RNA, 22 nt, Human
aacacuuucuuccuugcucagg

SEQ ID NO: 971758 - RNA, 17 nt, Human
agccccucagcgucacc

SEQ ID NO: 971759 - RNA, 21 nt, Human
gugcuuuuccuuaauguucuu

SEQ ID NO: 971760 - RNA, 22 nt, Human
agguggggugagcugcagacua

SEQ ID NO: 971761 - RNA, 22 nt, Human
agucucuuuguggacucugccu

SEQ ID NO: 971762 - RNA, 22 nt, Human
cugccagugaaauugugucagu

SEQ ID NO: 971763 - RNA, 22 nt, Human
ucuggcccagccccugagguca

SEQ ID NO: 971764 - RNA, 22 nt, Human
cuguuuauuacacuggauagca

SEQ ID NO: 971765 - RNA, 22 nt, Human
acccuuucuuacucacacgcuc

SEQ ID NO: 971766 - RNA, 22 nt, Human
uucuuuccucccagccuuugga

SEQ ID NO: 971767 - RNA, 20 nt, Human
uuucuugucggcuguugcug

SEQ ID NO: 971768 - RNA, 22 nt, Human
cagagcugguaagugguagagg

SEQ ID NO: 971769 - RNA, 22 nt, Human
uggcccugccacucacugcuga

SEQ ID NO: 971770 - RNA, 22 nt, Human
acuggccaggcacagcuguggg

SEQ ID NO: 971771 - RNA, 22 nt, Human
gaggcagugucgguggcaggau

SEQ ID NO: 971772 - RNA, 22 nt, Human
cugggacaugauagaaacagau

SEQ ID NO: 971773 - RNA, 22 nt, Human
caggcagcugaggacuuugcua

SEQ ID NO: 971774 - RNA, 23 nt, Human
cugcagccgcguggggacgugga

SEQ ID NO: 971775 - RNA, 21 nt, Human
gcaaccagaccacagggcagu

SEQ ID NO: 971776 - RNA, 22 nt, Human
uccagugguuugaaaggggugu

SEQ ID NO: 971777 - RNA, 22 nt, Human
ccccaccugugcgucugccgca

SEQ ID NO: 971778 - RNA, 22 nt, Human
gaggcagagugcaccccaggag

SEQ ID NO: 971779 - RNA, 22 nt, Human
uacaugcaugucacagaaugaa

SEQ ID NO: 971780 - RNA, 22 nt, Human
ccaggcugggcggggaaccugg

SEQ ID NO: 971781 - RNA, 22 nt, Human
acagcagcgucaacuuaaaauu

SEQ ID NO: 971782 - RNA, 22 nt, Human
uuugcauugccucugacuuaug

SEQ ID NO: 971783 - RNA, 20 nt, Human
uggcuccugcgguggaacca

SEQ ID NO: 971784 - RNA, 22 nt, Human
ggagugaaucacuagaugcaga

SEQ ID NO: 971785 - RNA, 22 nt, Human
aucuucaaagggauguccaugg

SEQ ID NO: 971786 - RNA, 19 nt, Human
caggaugaucccaugacac

SEQ ID NO: 971787 - RNA, 22 nt, Human
cuuuauguucaguacaaugcuu

SEQ ID NO: 971788 - RNA, 22 nt, Human
cagccagagaaagggcacugcc

SEQ ID NO: 971789 - RNA, 22 nt, Human
cugcagccuccugggguacaug

SEQ ID NO: 971790 - RNA, 22 nt, Human
ucauccaguaccauggaaggca

SEQ ID NO: 971791 - RNA, 22 nt, Human
acaacaggguaaggcaggccau

SEQ ID NO: 971792 - RNA, 22 nt, Human
gauuuccuugcauauugguaau

SEQ ID NO: 971793 - RNA, 22 nt, Human
ugggggagauuagagcuucuua

SEQ ID NO: 971794 - RNA, 22 nt, Human
cuggcagugacauugcaggugc

SEQ ID NO: 971795 - RNA, 22 nt, Human
accaaggagaaggugcaagcuu

SEQ ID NO: 971796 - RNA, 22 nt, Human
gccagguggcugagugacugag

SEQ ID NO: 971797 - RNA, 22 nt, Human
gaguccaguuguucacagaggc

SEQ ID NO: 971798 - RNA, 22 nt, Human
agaccagcugccucccagggcc

SEQ ID NO: 971799 - RNA, 22 nt, Human
ugggagcagcuuugcgagggag

SEQ ID NO: 971800 - RNA, 22 nt, Human
ccaaaugcuccacugacuuugg

SEQ ID NO: 971801 - RNA, 22 nt, Human
ggucagccuuggauuugguagc

SEQ ID NO: 971802 - RNA, 22 nt, Human
uggcccugaaucaaggccagca

SEQ ID NO: 971803 - RNA, 22 nt, Human
cagugcagccaaggacaggcac

SEQ ID NO: 971804 - RNA, 22 nt, Human
ucuaaagaagaggguucugcgg

SEQ ID NO: 971805 - RNA, 22 nt, Human
gacauaaaauucaauaauuugu

SEQ ID NO: 971806 - RNA, 22 nt, Human
ggucccaggauugguugcgcag

SEQ ID NO: 971807 - RNA, 22 nt, Human
ccuccuggagcauuggugagga

SEQ ID NO: 971808 - RNA, 22 nt, Human
guuaggauuauauaucccauga

SEQ ID NO: 971809 - RNA, 21 nt, Human
uccuucaguucugcacuuucu

SEQ ID NO: 971810 - RNA, 22 nt, Human
gagaggaguaggcugauggugc

SEQ ID NO: 971811 - RNA, 21 nt, Human
cgggcuggccgggcccucacc

SEQ ID NO: 971812 - RNA, 22 nt, Human
ccuggauucaagucuuucuuuc

SEQ ID NO: 971813 - RNA, 22 nt, Human
aggucagaagugccagggaauu

SEQ ID NO: 971814 - RNA, 19 nt, Human
cugccuguuauggagagaa

SEQ ID NO: 971815 - RNA, 22 nt, Human
ucuauuuacagaaagcagaauu

SEQ ID NO: 971816 - RNA, 21 nt, Human
aggcucagcagguguauaaag

SEQ ID NO: 971817 - RNA, 22 nt, Human
acgagagguccuuagaaucugu

SEQ ID NO: 971818 - RNA, 22 nt, Human
gggugggccugucuggccaugu

SEQ ID NO: 971819 - RNA, 22 nt, Human
acauuguuugagaauacagaug

SEQ ID NO: 971820 - RNA, 22 nt, Human
cagccuucugaaugaacguacu

SEQ ID NO: 971821 - RNA, 22 nt, Human
cauguacaguuuuucuguccug

SEQ ID NO: 971822 - RNA, 22 nt, Human
augauugaaaaugacauugcca

SEQ ID NO: 971823 - RNA, 22 nt, Human
ugaggccaggaucccaggcucu

SEQ ID NO: 971824 - RNA, 22 nt, Human
ugacucuguaccugucugccuu

SEQ ID NO: 971825 - RNA, 22 nt, Human
ucagggcaccaaaaaagaugcc

SEQ ID NO: 971826 - RNA, 22 nt, Human
aauaacuucaguucuuacauua

SEQ ID NO: 971827 - RNA, 22 nt, Human
auuugucuuuggaccugugaga

SEQ ID NO: 971828 - RNA, 22 nt, Human
gcucagaggagcaucauaagga

SEQ ID NO: 971829 - RNA, 22 nt, Human
auuagcugaccucuaaggagcc

SEQ ID NO: 971830 - RNA, 22 nt, Human
auguguaggugaaucgaggcug

SEQ ID NO: 971831 - RNA, 22 nt, Human
uagauuuuacuucugucauuac

SEQ ID NO: 971832 - RNA, 22 nt, Human
gcugucuggaggcucugaggga

SEQ ID NO: 971833 - RNA, 22 nt, Human
uuagaaauacaagugagguuga

SEQ ID NO: 971834 - RNA, 22 nt, Human
ccagcuccugggucuuagucag

SEQ ID NO: 971835 - RNA, 22 nt, Human
agacaggagagggaacugccgg

SEQ ID NO: 971836 - RNA, 22 nt, Human
uggcacaaaucuagucccuggu

SEQ ID NO: 971837 - RNA, 22 nt, Human
cagcugcaggaacaaaaaugug

SEQ ID NO: 971838 - RNA, 22 nt, Human
ggcugucugugguggagcguug

SEQ ID NO: 971839 - RNA, 22 nt, Human
cuggccaauauagggaaaucuu

SEQ ID NO: 971840 - RNA, 22 nt, Human
uauacuuuccugcaacuuugau

SEQ ID NO: 971841 - RNA, 22 nt, Human
cauucucaauaguagaugagua

SEQ ID NO: 971842 - RNA, 22 nt, Human
acccucccauuuccauguagca

SEQ ID NO: 971843 - RNA, 22 nt, Human
guccugggccugcugaggcuga

SEQ ID NO: 971844 - RNA, 22 nt, Human
gaagcagcgaaguggaagggac

SEQ ID NO: 971845 - RNA, 20 nt, Human
aggaggcauagucuggaaag

SEQ ID NO: 971846 - RNA, 22 nt, Human
cauugacaucaggcuuggccaa

SEQ ID NO: 971847 - RNA, 22 nt, Human
ccaggugggaggaaagcagaga

SEQ ID NO: 971848 - RNA, 22 nt, Human
cauaagaaauaaugaugaugac

SEQ ID NO: 971849 - RNA, 21 nt, Human
aaauguguuccauaaugcuuu

SEQ ID NO: 971850 - RNA, 22 nt, Human
ccucacuuuccuuucuccuggg

SEQ ID NO: 971851 - RNA, 22 nt, Human
uaccugggcccaccagugccug

SEQ ID NO: 971852 - RNA, 17 nt, Human
gcugacccuggagaagu

SEQ ID NO: 971853 - RNA, 22 nt, Human
acagaggucauggagaguucuc

SEQ ID NO: 971854 - RNA, 22 nt, Human
gaaggaaaucugugauuuaugc

SEQ ID NO: 971855 - RNA, 22 nt, Human
guugggaaggcaagaaguagaa

SEQ ID NO: 971856 - RNA, 22 nt, Human
auaagcauguuagaauauuuga

SEQ ID NO: 971857 - RNA, 22 nt, Human
guuaauaaagguauagaaucag

SEQ ID NO: 971858 - RNA, 22 nt, Human
agagcugcccacacagcagauu

SEQ ID NO: 971859 - RNA, 22 nt, Human
auucacaaagucacccuuacac

SEQ ID NO: 971860 - RNA, 22 nt, Human
acaguguccuuguggucccugu

SEQ ID NO: 971861 - RNA, 21 nt, Human
ccaggcuccugaggcugguca

SEQ ID NO: 971862 - RNA, 22 nt, Human
ucagugcagaauagugaugcau

SEQ ID NO: 971863 - RNA, 22 nt, Human
ggcagagcuugcagugagccga

SEQ ID NO: 971864 - RNA, 22 nt, Human
uaaaaaguagugagaauggcgc

SEQ ID NO: 971865 - RNA, 20 nt, Human
ugcagaagaacguucugguu

SEQ ID NO: 971866 - RNA, 22 nt, Human
augcuguggccagaguucaacu

SEQ ID NO: 971867 - RNA, 22 nt, Human
caggagcugggucuggaagcag

SEQ ID NO: 971868 - RNA, 22 nt, Human
caagggcuucaaguggccaaga

SEQ ID NO: 971869 - RNA, 22 nt, Human
gcccugggauuggguggaggcu

SEQ ID NO: 971870 - RNA, 22 nt, Human
auuuguugcuagcagcacugau

SEQ ID NO: 971871 - RNA, 19 nt, Human
ucugaggguccagaugcau

SEQ ID NO: 971872 - RNA, 22 nt, Human
uggcaucucaaacaggcagauu

SEQ ID NO: 971873 - RNA, 22 nt, Human
agcccaggucuggcccagccug

SEQ ID NO: 971874 - RNA, 22 nt, Human
aaggucauuguugcauguucuc

SEQ ID NO: 971875 - RNA, 22 nt, Human
acaggcagggaccuuggcuaag

SEQ ID NO: 971876 - RNA, 22 nt, Human
ugcuggggucauggggcgcccg

SEQ ID NO: 971877 - RNA, 22 nt, Human
auauuaauuauuuacacaugag

SEQ ID NO: 971878 - RNA, 22 nt, Human
uguguucuggaaagcucacuga

SEQ ID NO: 971879 - RNA, 22 nt, Human
agaccaugggcucugaagagca

SEQ ID NO: 971880 - RNA, 22 nt, Human
uccucagacacccugcuggcuu

SEQ ID NO: 971881 - RNA, 22 nt, Human
cccaggcagggacgugcucugg

SEQ ID NO: 971882 - RNA, 22 nt, Human
ucauuuaauaauuuuugaguag

SEQ ID NO: 971883 - RNA, 22 nt, Human
agggcagcuagcuguagaaaga

SEQ ID NO: 971884 - RNA, 22 nt, Human
aaagauguuuuauaaguuaugg

SEQ ID NO: 971885 - RNA, 22 nt, Human
uuuccuuccagguuccuaaggc

SEQ ID NO: 971886 - RNA, 22 nt, Human
ccaggagaaugggauuacccua

SEQ ID NO: 971887 - RNA, 22 nt, Human
cugugcaagcccaagauaaaac

SEQ ID NO: 971888 - RNA, 22 nt, Human
caaaaguaaucguggcuuuugc

SEQ ID NO: 971889 - RNA, 22 nt, Human
uggcugcuagccagagcuucag

SEQ ID NO: 971890 - RNA, 22 nt, Human
ucuuaaagccaagcauaaacca

SEQ ID NO: 971891 - RNA, 22 nt, Human
gagcugugagggacacauugcu

SEQ ID NO: 971892 - RNA, 22 nt, Human
acuuugugcccaacagaaagaa

SEQ ID NO: 971893 - RNA, 19 nt, Human
agcauccagucaugggauc

SEQ ID NO: 971894 - RNA, 22 nt, Human
uucuugauuucaugcaguuaag

SEQ ID NO: 971895 - RNA, 22 nt, Human
cauggcagagaaggggaacugg

SEQ ID NO: 971896 - RNA, 22 nt, Human
acuccuggaaaagaacgcaggg

SEQ ID NO: 971897 - RNA, 22 nt, Human
gggcacagcugcuacccagugc

SEQ ID NO: 971898 - RNA, 22 nt, Human
uaggccaggacagagcuuccag

SEQ ID NO: 971899 - RNA, 22 nt, Human
uucagcaacauuuguugagugc

SEQ ID NO: 971900 - RNA, 22 nt, Human
agacccagaaagcagcugcauu

SEQ ID NO: 971901 - RNA, 22 nt, Human
acaguaauuaaaauggaucugc

SEQ ID NO: 971902 - RNA, 22 nt, Human
ucuggcucggauuugucuagca

SEQ ID NO: 971903 - RNA, 19 nt, Human
ggucucagugcagcugcag

SEQ ID NO: 971904 - RNA, 17 nt, Human
aggccucccuccaggcc

SEQ ID NO: 971905 - RNA, 22 nt, Human
caggccucagagaguggcgggg

SEQ ID NO: 971906 - RNA, 20 nt, Human
cauuggacuuggcuucaugg

SEQ ID NO: 971907 - RNA, 22 nt, Human
ggccccaggaccuccacggucc

SEQ ID NO: 971908 - RNA, 22 nt, Human
augcugugccuggaaagcggcu

SEQ ID NO: 971909 - RNA, 22 nt, Human
cuggcucaguucuugguuuuca

SEQ ID NO: 971910 - RNA, 22 nt, Human
aagcuuccugaaugcucauuua

SEQ ID NO: 971911 - RNA, 22 nt, Human
gcugccuguugaagggucugug

SEQ ID NO: 971912 - RNA, 22 nt, Human
aagaagagaacuggcauccuaa

SEQ ID NO: 971913 - RNA, 22 nt, Human
cagcaggacauggaggaguaaa

SEQ ID NO: 971914 - RNA, 22 nt, Human
ggaggaccccagcagcucccca

SEQ ID NO: 971915 - RNA, 22 nt, Human
uugcauaaaagaguauaucuua

SEQ ID NO: 971916 - RNA, 22 nt, Human
ucagggcauacucuucaagguc

SEQ ID NO: 971917 - RNA, 22 nt, Human
gcugucugacuccaaguuggag

SEQ ID NO: 971918 - RNA, 22 nt, Human
gggauggggagcuggaaagggg

SEQ ID NO: 971919 - RNA, 22 nt, Human
cucugguguccuuuagaauuua

SEQ ID NO: 971920 - RNA, 22 nt, Human
agggcugcccagugugagagcu

SEQ ID NO: 971921 - RNA, 22 nt, Human
aaauguuucuacuugugagcau

SEQ ID NO: 971922 - RNA, 23 nt, Human
gugcucugcggucugcuagucug

SEQ ID NO: 971923 - RNA, 22 nt, Human
uauugucuguccgggucaaagc

SEQ ID NO: 971924 - RNA, 20 nt, Human
aggcagacaaggagucuguu

SEQ ID NO: 971925 - RNA, 22 nt, Human
gcacuugggcagagacgcacag

SEQ ID NO: 971926 - RNA, 22 nt, Human
ucucugcucugugccucaguuu

SEQ ID NO: 971927 - RNA, 22 nt, Human
agcagagguuuguuggaaaccu

SEQ ID NO: 971928 - RNA, 22 nt, Human
gggacuguaaauucauauggcc

SEQ ID NO: 971929 - RNA, 21 nt, Human
agcagcugggcaacauggagg

SEQ ID NO: 971930 - RNA, 22 nt, Human
uguaggauguaaggcaggcauc

SEQ ID NO: 971931 - RNA, 22 nt, Human
uuauuuucuccucagaaagugg

SEQ ID NO: 971932 - RNA, 22 nt, Human
ucacaugcuugaggaaagaaaa

SEQ ID NO: 971933 - RNA, 20 nt, Human
cuuccacacaagaagcacag

SEQ ID NO: 971934 - RNA, 18 nt, Human
agcuggggccucuggucc

SEQ ID NO: 971935 - RNA, 21 nt, Human
ggccucugccuugccccacuc

SEQ ID NO: 971936 - RNA, 22 nt, Human
uuagauaauguuauuguaauuu

SEQ ID NO: 971937 - RNA, 20 nt, Human
agauuauuccuaagauuucu

SEQ ID NO: 971938 - RNA, 22 nt, Human
acugucuucaaaugaauauauu

SEQ ID NO: 971939 - RNA, 22 nt, Human
gcccagagagaugcuguagacc

SEQ ID NO: 971940 - RNA, 22 nt, Human
aagauucagccaaauuguucau

SEQ ID NO: 971941 - RNA, 22 nt, Human
agcugcccuuaauaggcauuca

SEQ ID NO: 971942 - RNA, 22 nt, Human
ucucagagagaugaaacuucca

SEQ ID NO: 971943 - RNA, 22 nt, Human
uucagcaagugucucuacuguc

SEQ ID NO: 971944 - RNA, 22 nt, Human
auacaucuugucagauucaugu

SEQ ID NO: 971945 - RNA, 20 nt, Human
uaggcagcuugacccuuggu

SEQ ID NO: 971946 - RNA, 22 nt, Human
auucuccaucaccacuggcacu

SEQ ID NO: 971947 - RNA, 22 nt, Human
ucuguucuauuggucuaugugu

SEQ ID NO: 971948 - RNA, 23 nt, Human
aguuuguaaagaaauauuugcac

SEQ ID NO: 971949 - RNA, 22 nt, Human
aggguggggugcuacaucuuua

SEQ ID NO: 971950 - RNA, 22 nt, Human
ugucaccaugccagcuucugcc

SEQ ID NO: 971951 - RNA, 22 nt, Human
cccuggagguggagguugcagg

SEQ ID NO: 971952 - RNA, 22 nt, Human
ccaggccaaauucagucagcag

SEQ ID NO: 971953 - RNA, 22 nt, Human
ugcugugcuggcggcagaggcc

SEQ ID NO: 971954 - RNA, 22 nt, Human
aaaggccacuugaaggauuuuu

SEQ ID NO: 971955 - RNA, 22 nt, Human
ccugggcagguguggcuucccc

SEQ ID NO: 971956 - RNA, 22 nt, Human
ucccuggccauuccucuaggcc

SEQ ID NO: 971957 - RNA, 21 nt, Human
auuucagagcacacaaguaaa

SEQ ID NO: 971958 - RNA, 19 nt, Human
cacagggcaggucucaugu

SEQ ID NO: 971959 - RNA, 22 nt, Human
gcagagcucuguucuuaucucc

SEQ ID NO: 971960 - RNA, 22 nt, Human
ucagaaauagucuuuaaaauga

SEQ ID NO: 971961 - RNA, 22 nt, Human
ugaggcaggagaaucaccggaa

SEQ ID NO: 971962 - RNA, 22 nt, Human
auggcaguuguaugggcuguau

SEQ ID NO: 971963 - RNA, 22 nt, Human
aucugccugagucuagguuuuc

SEQ ID NO: 971964 - RNA, 22 nt, Human
acuuauuucauggaucauaaug

SEQ ID NO: 971965 - RNA, 22 nt, Human
uugauguacagaauuguucaca

SEQ ID NO: 971966 - RNA, 22 nt, Human
ccucaggauacaggagccacag

SEQ ID NO: 971967 - RNA, 22 nt, Human
uuggccaaaaaagucauuagaa

SEQ ID NO: 971968 - RNA, 22 nt, Human
aucauuccacauguaccacuag

SEQ ID NO: 971969 - RNA, 21 nt, Human
ggagucagggucuggcugggg

SEQ ID NO: 971970 - RNA, 22 nt, Human
acuuucugcaguguuggaaaug

SEQ ID NO: 971971 - RNA, 22 nt, Human
auaauguagguauguguauuua

SEQ ID NO: 971972 - RNA, 23 nt, Human
augcucugggcugugggaccugc

SEQ ID NO: 971973 - RNA, 22 nt, Human
cagcgucucguugugggccucg

SEQ ID NO: 971974 - RNA, 22 nt, Human
caauguguguguuuuucucaac

SEQ ID NO: 971975 - RNA, 22 nt, Human
uggccugauuuugcuaagagaa

SEQ ID NO: 971976 - RNA, 22 nt, Human
ucccagagaaagucaaggucuu

SEQ ID NO: 971977 - RNA, 22 nt, Human
caggaccuggaaugcuugugaa

SEQ ID NO: 971978 - RNA, 22 nt, Human
ugccaggagagugcaugcaggg

SEQ ID NO: 971979 - RNA, 22 nt, Human
gagaaccucuccacaagucugg

SEQ ID NO: 971980 - RNA, 22 nt, Human
gagccaggcccguacuugcugu

SEQ ID NO: 971981 - RNA, 21 nt, Human
aggggacagaguagcuccagg

SEQ ID NO: 971982 - RNA, 22 nt, Human
ucugucaccauucagcuugaau

SEQ ID NO: 971983 - RNA, 22 nt, Human
gggggcuggacuuucccacaca

SEQ ID NO: 971984 - RNA, 22 nt, Human
agagcaggcauaaagcuuugaa

SEQ ID NO: 971985 - RNA, 22 nt, Human
ugagagauugcuguauguuuug

SEQ ID NO: 971986 - RNA, 22 nt, Human
agguacaguagacagacaguua

SEQ ID NO: 971987 - RNA, 22 nt, Human
cagaauuuagcacaauguaugg

SEQ ID NO: 971988 - RNA, 22 nt, Human
uccuuggcuuucuggagcuucu

SEQ ID NO: 971989 - RNA, 19 nt, Human
uuacaucugcaacacuggu

SEQ ID NO: 971990 - RNA, 22 nt, Human
cagucccagacauaguaaggga

SEQ ID NO: 971991 - RNA, 22 nt, Human
cuggccuagcucucugcuugaa

SEQ ID NO: 971992 - RNA, 22 nt, Human
aguggggucuccuccagccccc

SEQ ID NO: 971993 - RNA, 23 nt, Human
aaguaacagggauaauagcaguu

SEQ ID NO: 971994 - RNA, 22 nt, Human
uggcccugucccuggagccugg

SEQ ID NO: 971995 - RNA, 22 nt, Human
cucagaguucuccugggaggug

SEQ ID NO: 971996 - RNA, 22 nt, Human
gcucugagcacugugcggcugg

SEQ ID NO: 971997 - RNA, 22 nt, Human
ucugagagccucuagccuaagu

SEQ ID NO: 971998 - RNA, 22 nt, Human
auaauuuaauuuucacaguggu

SEQ ID NO: 971999 - RNA, 22 nt, Human
agugcauaaaggaaaaacugaa

SEQ ID NO: 972000 - RNA, 22 nt, Human
ugggcagaaggaagagccaccu

SEQ ID NO: 972001 - RNA, 22 nt, Human
agcaggaaagaaaaaucugugu

SEQ ID NO: 972002 - RNA, 22 nt, Human
gucagcucucuuauccaugagg

SEQ ID NO: 972003 - RNA, 22 nt, Human
uucugaggcacuggcucuccca

SEQ ID NO: 972004 - RNA, 23 nt, Human
aggcagagccaaggucaaaaccc

SEQ ID NO: 972005 - RNA, 22 nt, Human
gaggcagcucuucugaaugggg

SEQ ID NO: 972006 - RNA, 21 nt, Human
uucaaaaugguguguuugucu

SEQ ID NO: 972007 - RNA, 22 nt, Human
auauguuucaguauucaaguca

SEQ ID NO: 972008 - RNA, 22 nt, Human
ggaagugaggaauuagguuuau

SEQ ID NO: 972009 - RNA, 22 nt, Human
cugccaggacugacgucuucag

SEQ ID NO: 972010 - RNA, 16 nt, Human
gagccaggugccuuga

SEQ ID NO: 972011 - RNA, 22 nt, Human
aggcagcuggcagcacccaggg

SEQ ID NO: 972012 - RNA, 22 nt, Human
uccagggaaggugugaggcugg

SEQ ID NO: 972013 - RNA, 22 nt, Human
cuggagaggcugggaacagguu

SEQ ID NO: 972014 - RNA, 22 nt, Human
aauauaaugcuguuuuaugcca

SEQ ID NO: 972015 - RNA, 22 nt, Human
aaccaggacaauuuugaaagua

SEQ ID NO: 972016 - RNA, 22 nt, Human
cuccuuccugguuagcaccuua

SEQ ID NO: 972017 - RNA, 22 nt, Human
uggaggcauuuuagguugucac

SEQ ID NO: 972018 - RNA, 22 nt, Human
uuugggaaacuuaggggucaga

SEQ ID NO: 972019 - RNA, 22 nt, Human
uggcacugccaaccugcuaggu

SEQ ID NO: 972020 - RNA, 17 nt, Human
aggugcuggagcaucag

SEQ ID NO: 972021 - RNA, 22 nt, Human
cucuggcuuugcucaugcaucc

SEQ ID NO: 972022 - RNA, 22 nt, Human
gagccaggucgggccgcggcga

SEQ ID NO: 972023 - RNA, 22 nt, Human
uauagaagagacaugugcauag

SEQ ID NO: 972024 - RNA, 22 nt, Human
agcugcugagccaggcugaugu

SEQ ID NO: 972025 - RNA, 22 nt, Human
auggccaagcuuacucuguugu

SEQ ID NO: 972026 - RNA, 22 nt, Human
augugcauuaaaugucaauguu

SEQ ID NO: 972027 - RNA, 22 nt, Human
cuucacaaaauauuucauuaua

SEQ ID NO: 972028 - RNA, 22 nt, Human
ggguggcacaggugcagagggu

SEQ ID NO: 972029 - RNA, 22 nt, Human
cugucagcacucuacuacagau

SEQ ID NO: 972030 - RNA, 22 nt, Human
guuuuauuggaacacagccaug

SEQ ID NO: 972031 - RNA, 22 nt, Human
acuuucauuuguaauaaacuuc

SEQ ID NO: 972032 - RNA, 22 nt, Human
agugcuuuauguuguugugcaa

SEQ ID NO: 972033 - RNA, 22 nt, Human
uccuuuuugguccaaggugacc

SEQ ID NO: 972034 - RNA, 22 nt, Human
agcuggcacagaccaggagauc

SEQ ID NO: 972035 - RNA, 19 nt, Human
ccaggaaccccuagcuacc

SEQ ID NO: 972036 - RNA, 22 nt, Human
agcugccccaugagaggcaggu

SEQ ID NO: 972037 - RNA, 22 nt, Human
ccuccugguaauuagcgaaagg

SEQ ID NO: 972038 - RNA, 22 nt, Human
gaacagaauuaccgaagaucug

SEQ ID NO: 972039 - RNA, 22 nt, Human
gcccaggaaagauagggccuca

SEQ ID NO: 972040 - RNA, 22 nt, Human
uggcagggaauacagauguuua

SEQ ID NO: 972041 - RNA, 22 nt, Human
guggccaacucaauguuuuuca

SEQ ID NO: 972042 - RNA, 22 nt, Human
gggccuggugcuucugacuccu

SEQ ID NO: 972043 - RNA, 22 nt, Human
cccaaacaguuccugugguacu

SEQ ID NO: 972044 - RNA, 22 nt, Human
uguccucagauaugucuacucu

SEQ ID NO: 972045 - RNA, 20 nt, Human
ugccagggccagcagaggcu

SEQ ID NO: 972046 - RNA, 22 nt, Human
cauauuugguauaacuuaagca

SEQ ID NO: 972047 - RNA, 22 nt, Human
ucauuuauaaggaugcaauuaa

SEQ ID NO: 972048 - RNA, 20 nt, Human
auggccaaccugcuuaugac

SEQ ID NO: 972049 - RNA, 22 nt, Human
gaggaggaaacccuguuccucu

SEQ ID NO: 972050 - RNA, 22 nt, Human
caguggggaggccaggauagaa

SEQ ID NO: 972051 - RNA, 22 nt, Human
uccuggccucacaguccugggu

SEQ ID NO: 972052 - RNA, 22 nt, Human
uuuacaaccucauauucugaug

SEQ ID NO: 972053 - RNA, 22 nt, Human
aggcucauucuugccucugagc

SEQ ID NO: 972054 - RNA, 21 nt, Human
guuugcaugaacaagucagcc

SEQ ID NO: 972055 - RNA, 22 nt, Human
acagaagagcacauuuaguaug

SEQ ID NO: 972056 - RNA, 22 nt, Human
gccugccuuugugaggaagcgg

SEQ ID NO: 972057 - RNA, 21 nt, Human
ggacuuacauagguaaggggu

SEQ ID NO: 972058 - RNA, 22 nt, Human
ccauggccgccgcugcucagga

SEQ ID NO: 972059 - RNA, 23 nt, Human
ccaaagucgaagucuaguccaga

SEQ ID NO: 972060 - RNA, 22 nt, Human
gugugucuuuauaagaagaggg

SEQ ID NO: 972061 - RNA, 22 nt, Human
guguuuccaguucagaaagcaa

SEQ ID NO: 972062 - RNA, 22 nt, Human
gcaggagaaaugaagauugggu

SEQ ID NO: 972063 - RNA, 22 nt, Human
cuguccucuguccucagcagga

SEQ ID NO: 972064 - RNA, 20 nt, Human
ucagaugggagugagccauc

SEQ ID NO: 972065 - RNA, 22 nt, Human
uuaauuuugaugagguucaguu

SEQ ID NO: 972066 - RNA, 22 nt, Human
gaugcacaugugaguauagaag

SEQ ID NO: 972067 - RNA, 22 nt, Human
ucagcaauccucccacaggugg

SEQ ID NO: 972068 - RNA, 22 nt, Human
uuuguaaggcuaaauaauauuc

SEQ ID NO: 972069 - RNA, 22 nt, Human
uauuucagacacugaucuugca

SEQ ID NO: 972070 - RNA, 21 nt, Human
auucagaguaauucaucuuua

SEQ ID NO: 972071 - RNA, 22 nt, Human
auguguccacaggugugagaga

SEQ ID NO: 972072 - RNA, 22 nt, Human
aggugaguuacaggaggagguc

SEQ ID NO: 972073 - RNA, 22 nt, Human
uuccuugaaugagucauggaaa

SEQ ID NO: 972074 - RNA, 22 nt, Human
cucuuaaagaauguuccagcug

SEQ ID NO: 972075 - RNA, 22 nt, Human
uaaaacuagugguugggacuaa

SEQ ID NO: 972076 - RNA, 22 nt, Human
agcugccuguccuaggccauca

SEQ ID NO: 972077 - RNA, 22 nt, Human
aaagaaggaccuggaggaggau

SEQ ID NO: 972078 - RNA, 22 nt, Human
acagagguguguguaggacagu

SEQ ID NO: 972079 - RNA, 22 nt, Human
uggcucaggaucuaagcagaau

SEQ ID NO: 972080 - RNA, 22 nt, Human
cagggcaggacagauacauuac

SEQ ID NO: 972081 - RNA, 22 nt, Human
caucuucagguucauggucaua

SEQ ID NO: 972082 - RNA, 22 nt, Human
ccuccuggaaaaauucccuggc

SEQ ID NO: 972083 - RNA, 22 nt, Human
gguggagcuguggacaggaagg

SEQ ID NO: 972084 - RNA, 22 nt, Human
gaaggccauugcguccugggau

SEQ ID NO: 972085 - RNA, 22 nt, Human
ucauuuguacuugugugcuugu

SEQ ID NO: 972086 - RNA, 22 nt, Human
ggagccugacagugcccagcau

SEQ ID NO: 972087 - RNA, 22 nt, Human
cugcucagcggaaggaagagcg

SEQ ID NO: 972088 - RNA, 22 nt, Human
aaucuggcucagaagaagauga

SEQ ID NO: 972089 - RNA, 20 nt, Human
agcaagaguaaggacagcga

SEQ ID NO: 972090 - RNA, 22 nt, Human
gaagagcuauguccagggagca

SEQ ID NO: 972091 - RNA, 22 nt, Human
gcugccaauccagcugugggag

SEQ ID NO: 972092 - RNA, 21 nt, Human
aggcagcuggaaggccuggcu

SEQ ID NO: 972093 - RNA, 22 nt, Human
uccaggaguggggcagaggucu

SEQ ID NO: 972094 - RNA, 21 nt, Human
ugggcacugagggugcugcuc

SEQ ID NO: 972095 - RNA, 22 nt, Human
aguuuccaaagcauguucacac

SEQ ID NO: 972096 - RNA, 22 nt, Human
aguaaaauuaauggaucagaag

SEQ ID NO: 972097 - RNA, 22 nt, Human
aagucauugguagcuugauagg

SEQ ID NO: 972098 - RNA, 22 nt, Human
agacagguaaauagagaugcug

SEQ ID NO: 972099 - RNA, 22 nt, Human
gccagcaguccugcugugugcc

SEQ ID NO: 972100 - RNA, 22 nt, Human
auacuuucugaccaauuaauug

SEQ ID NO: 972101 - RNA, 22 nt, Human
ucuggagcuggcagggcccugg

SEQ ID NO: 972102 - RNA, 22 nt, Human
cuacauaaauuuaucacagacu

SEQ ID NO: 972103 - RNA, 22 nt, Human
uggaagagaaaggaguggaucu

SEQ ID NO: 972104 - RNA, 22 nt, Human
ucaggaaagaagaugcucagug

SEQ ID NO: 972105 - RNA, 22 nt, Human
ugucaucuucaucauaaguaaa

SEQ ID NO: 972106 - RNA, 16 nt, Human
agcagccagcacugga

SEQ ID NO: 972107 - RNA, 22 nt, Human
guggccugaugccagcccugug

SEQ ID NO: 972108 - RNA, 21 nt, Human
ucucugggaggacuugugaga

SEQ ID NO: 972109 - RNA, 22 nt, Human
agauggagaaugacaauuaagg

SEQ ID NO: 972110 - RNA, 22 nt, Human
accaggaguagaauaucuguga

SEQ ID NO: 972111 - RNA, 22 nt, Human
ggauuuggaagaccgggucaca

SEQ ID NO: 972112 - RNA, 22 nt, Human
aggcacugcagauuacaggcgc

SEQ ID NO: 972113 - RNA, 22 nt, Human
ucacugcucucuaagcaucgcc

SEQ ID NO: 972114 - RNA, 22 nt, Human
ccagagccucuuaugaagaucg

SEQ ID NO: 972115 - RNA, 22 nt, Human
ucaguuuucaauuucaucagag

SEQ ID NO: 972116 - RNA, 22 nt, Human
gagcagcucugugccuggagac

SEQ ID NO: 972117 - RNA, 22 nt, Human
uggcucuguugagguauggauu

SEQ ID NO: 972118 - RNA, 22 nt, Human
aggagccaagcagaacuaagga

SEQ ID NO: 972119 - RNA, 22 nt, Human
cagguaggauggaagggcucaa

SEQ ID NO: 972120 - RNA, 22 nt, Human
ugugaaaggggucacagggaaa

SEQ ID NO: 972121 - RNA, 22 nt, Human
ucuggagcuggagggcaaggca

SEQ ID NO: 972122 - RNA, 22 nt, Human
ucaggaugguccuuuaugagaa

SEQ ID NO: 972123 - RNA, 22 nt, Human
ucagcagauggguuguguuggc

SEQ ID NO: 972124 - RNA, 17 nt, Human
uuucaucugggaccacc

SEQ ID NO: 972125 - RNA, 22 nt, Human
ggcacugauuccauucaugaag

SEQ ID NO: 972126 - RNA, 22 nt, Human
ucuuugaacuuggcugaucucu

SEQ ID NO: 972127 - RNA, 22 nt, Human
uuuugucuaagaacuuugcaaa

SEQ ID NO: 972128 - RNA, 22 nt, Human
cccaugagauucugaauuuggc

SEQ ID NO: 972129 - RNA, 22 nt, Human
cuccuggcuuucccagaccagg

SEQ ID NO: 972130 - RNA, 22 nt, Human
aucagcaaggcaaucacugcag

SEQ ID NO: 972131 - RNA, 20 nt, Human
gccugagcuauugccaggau

SEQ ID NO: 972132 - RNA, 22 nt, Human
cagaggccccauuggcugugcg

SEQ ID NO: 972133 - RNA, 22 nt, Human
ugaaaucuuauacuuugguagu

SEQ ID NO: 972134 - RNA, 19 nt, Human
augucuggguaacagcugc

SEQ ID NO: 972135 - RNA, 22 nt, Human
aaacauuguuaugauaaauuac

SEQ ID NO: 972136 - RNA, 22 nt, Human
uaacauuccucaaaguuuucag

SEQ ID NO: 972137 - RNA, 22 nt, Human
agaggaggcagcuuaacucagu

SEQ ID NO: 972138 - RNA, 22 nt, Human
agccucugugacucacagguca

SEQ ID NO: 972139 - RNA, 22 nt, Human
caggcacuggccagucagcaca

SEQ ID NO: 972140 - RNA, 18 nt, Human
ucugucuguacaaguauc

SEQ ID NO: 972141 - RNA, 22 nt, Human
uccaaagaagucacaaacgaag

SEQ ID NO: 972142 - RNA, 22 nt, Human
acagaggcugcgcuugggaacg

SEQ ID NO: 972143 - RNA, 18 nt, Human
cacaggcucccagugagg

SEQ ID NO: 972144 - RNA, 22 nt, Human
ggguggagaggcuaaguccagu

SEQ ID NO: 972145 - RNA, 22 nt, Human
ucagcagaggggaaggcaucug

SEQ ID NO: 972146 - RNA, 22 nt, Human
gcugucacucuccggccuuccc

SEQ ID NO: 972147 - RNA, 22 nt, Human
aaaaguauuggccaccauuucu

SEQ ID NO: 972148 - RNA, 22 nt, Human
gggcagcucucacagcagccaa

SEQ ID NO: 972149 - RNA, 23 nt, Human
ucaaacauauugugagacacagg

SEQ ID NO: 972150 - RNA, 22 nt, Human
agggcagccauugagggauucu

SEQ ID NO: 972151 - RNA, 22 nt, Human
ggccuucacgugaccuggcgug

SEQ ID NO: 972152 - RNA, 22 nt, Human
acuucuggauagagucagcuuu

SEQ ID NO: 972153 - RNA, 22 nt, Human
ccacugggggcugcaggcacuc

SEQ ID NO: 972154 - RNA, 22 nt, Human
ccugaggacacacgcugcagga

SEQ ID NO: 972155 - RNA, 22 nt, Human
uagcugcccaucuuuccuuuag

SEQ ID NO: 972156 - RNA, 21 nt, Human
cagagguggccugaccucuga

SEQ ID NO: 972157 - RNA, 22 nt, Human
ggcugccuucccugagccccgg

SEQ ID NO: 972158 - RNA, 22 nt, Human
uucccaggcugugcuaccagag

SEQ ID NO: 972159 - RNA, 17 nt, Human
ugauaguucauuuuaag

SEQ ID NO: 972160 - RNA, 22 nt, Human
cugaggcuggggaagggaagug

SEQ ID NO: 972161 - RNA, 22 nt, Human
uucuucuuucccccugugguac

SEQ ID NO: 972162 - RNA, 22 nt, Human
aaagauuuaugaaguucaauua

SEQ ID NO: 972163 - RNA, 22 nt, Human
guggccaagaggggacuggaua

SEQ ID NO: 972164 - RNA, 19 nt, Human
acaggcagaauugggugug

SEQ ID NO: 972165 - RNA, 22 nt, Human
aaagccagagcaagcugucaca

SEQ ID NO: 972166 - RNA, 22 nt, Human
ugggcucugcaucagugcccau

SEQ ID NO: 972167 - RNA, 22 nt, Human
cuccuugguguaguacugagca

SEQ ID NO: 972168 - RNA, 22 nt, Human
aaaguguugauaugugacaucc

SEQ ID NO: 972169 - RNA, 22 nt, Human
ggaggggaggauuaaugacaaa

SEQ ID NO: 972170 - RNA, 22 nt, Human
uuuuuccaccguacuuccugag

SEQ ID NO: 972171 - RNA, 22 nt, Human
gccuggcacucacugaagaggc

SEQ ID NO: 972172 - RNA, 22 nt, Human
auuauauaggacuugcccuucc

SEQ ID NO: 972173 - RNA, 22 nt, Human
ggaagggcaaaagagaugaacu

SEQ ID NO: 972174 - RNA, 22 nt, Human
uaugugcaguuugcucuuaaca

SEQ ID NO: 972175 - RNA, 22 nt, Human
ucucagagauuuuguuucccuu

SEQ ID NO: 972176 - RNA, 22 nt, Human
gcagggcugcugaaacuuguuu

SEQ ID NO: 972177 - RNA, 22 nt, Human
ucucuucuuguguuuuccugcc

SEQ ID NO: 972178 - RNA, 18 nt, Human
ucuuggaguaaugaucaa

SEQ ID NO: 972179 - RNA, 22 nt, Human
cugucauuuaagacauucugga

SEQ ID NO: 972180 - RNA, 22 nt, Human
ggcuggcuuucucuccgcaccu

SEQ ID NO: 972181 - RNA, 22 nt, Human
acaaagucugaaaccugaggca

SEQ ID NO: 972182 - RNA, 17 nt, Human
ggcagcugugugcaugc

SEQ ID NO: 972183 - RNA, 22 nt, Human
ucaaggaggugcuuggcuucac

SEQ ID NO: 972184 - RNA, 22 nt, Human
ccugccuggaucagccauccug

SEQ ID NO: 972185 - RNA, 19 nt, Human
uacuuuuucaggacagagu

SEQ ID NO: 972186 - RNA, 22 nt, Human
acuugauuuugaaccuuucuac

SEQ ID NO: 972187 - RNA, 20 nt, Human
ccaggcacugucccaugcag

SEQ ID NO: 972188 - RNA, 22 nt, Human
gaucuguuauaaucucuuuuau

SEQ ID NO: 972189 - RNA, 22 nt, Human
ggcucugcgcgguaaagugacu

SEQ ID NO: 972190 - RNA, 22 nt, Human
cugcccugacugaccuuuugaa

SEQ ID NO: 972191 - RNA, 22 nt, Human
gccagcugguaggcaccuagcc

SEQ ID NO: 972192 - RNA, 22 nt, Human
gagaggggcccaagccacauag

SEQ ID NO: 972193 - RNA, 22 nt, Human
agaaaugaauauguagugguua

SEQ ID NO: 972194 - RNA, 22 nt, Human
ccucccaccguaucucaguggc

SEQ ID NO: 972195 - RNA, 22 nt, Human
agucccaggcagccgagccggu

SEQ ID NO: 972196 - RNA, 22 nt, Human
gcugugcuugggaagaaucucu

SEQ ID NO: 972197 - RNA, 22 nt, Human
gugggugauguacuggaggcca

SEQ ID NO: 972198 - RNA, 22 nt, Human
ggggcagaguagcuggggugug

SEQ ID NO: 972199 - RNA, 22 nt, Human
cccagacugcagagcgggcaga

SEQ ID NO: 972200 - RNA, 17 nt, Human
uuuucucucuuggauuc

SEQ ID NO: 972201 - RNA, 18 nt, Human
agccuggaggguugaagu

SEQ ID NO: 972202 - RNA, 22 nt, Human
cagcaggaccauugaggcauca

SEQ ID NO: 972203 - RNA, 22 nt, Human
auauguguacgugcaguauaua

SEQ ID NO: 972204 - RNA, 23 nt, Human
ggggccugcaccggucugcgcgg

SEQ ID NO: 972205 - RNA, 22 nt, Human
ccuggcagcgccgaagcuggcc

SEQ ID NO: 972206 - RNA, 22 nt, Human
acauguguacauauauaugugc

SEQ ID NO: 972207 - RNA, 22 nt, Human
agggcuggagccacagcuggga

SEQ ID NO: 972208 - RNA, 22 nt, Human
uagaauguaaauuccaagggca

SEQ ID NO: 972209 - RNA, 22 nt, Human
ggccucugccucaucugggcac

SEQ ID NO: 972210 - RNA, 22 nt, Human
ccagggcagcgccccuccacgc

SEQ ID NO: 972211 - RNA, 22 nt, Human
agagcccucucauuggcuuauu

SEQ ID NO: 972212 - RNA, 22 nt, Human
aaugaugguuucaucacuugaa

SEQ ID NO: 972213 - RNA, 22 nt, Human
uagaauaaguugaugauauaug

SEQ ID NO: 972214 - RNA, 22 nt, Human
gcagggagguuugcugaccugg

SEQ ID NO: 972215 - RNA, 22 nt, Human
ucucuuucuauugcaccaugcu

SEQ ID NO: 972216 - RNA, 22 nt, Human
ccucacucugcacccugcagca

SEQ ID NO: 972217 - RNA, 22 nt, Human
auaauuuaaauuaguaugugau

SEQ ID NO: 972218 - RNA, 22 nt, Human
augcagaaggagccaugcuugc

SEQ ID NO: 972219 - RNA, 22 nt, Human
gccuucaggaaaucaguccuug

SEQ ID NO: 972220 - RNA, 22 nt, Human
ccaggcugugguuuagauagag

SEQ ID NO: 972221 - RNA, 22 nt, Human
auugcacaaacacagucagacu

SEQ ID NO: 972222 - RNA, 22 nt, Human
auaaaaccaaagcagcaguguu

SEQ ID NO: 972223 - RNA, 22 nt, Human
uacuaucucuucuaacuucaga

SEQ ID NO: 972224 - RNA, 22 nt, Human
uaaaugugucuuuuuaaggccu

SEQ ID NO: 972225 - RNA, 22 nt, Human
aguucucagcuuaguaugcugu

SEQ ID NO: 972226 - RNA, 22 nt, Human
guaauaaugguccccaaacacu

SEQ ID NO: 972227 - RNA, 22 nt, Human
uuuauuacaccagguuaacuca

SEQ ID NO: 972228 - RNA, 22 nt, Human
acuucaugcagaagagagcugu

SEQ ID NO: 972229 - RNA, 22 nt, Human
uaaugcaguacugauauaaaca

SEQ ID NO: 972230 - RNA, 22 nt, Human
gaggcaccucgcgggaggaggc

SEQ ID NO: 972231 - RNA, 22 nt, Human
uuucacaacacaaucucguuaa

SEQ ID NO: 972232 - RNA, 22 nt, Human
guccucagucaguuuggugggg

SEQ ID NO: 972233 - RNA, 22 nt, Human
acaccuuugugaagugaugaug

SEQ ID NO: 972234 - RNA, 22 nt, Human
cagugcaguuucccagaugcug

SEQ ID NO: 972235 - RNA, 22 nt, Human
agcugccaaguuggaguagcaa

SEQ ID NO: 972236 - RNA, 22 nt, Human
aggcucagauccuuguguccug

SEQ ID NO: 972237 - RNA, 22 nt, Human
agcagagguguuuauuauggga

SEQ ID NO: 972238 - RNA, 22 nt, Human
accugagcaugccaggagagug

SEQ ID NO: 972239 - RNA, 22 nt, Human
ggggccuuuucugaauguggaa

SEQ ID NO: 972240 - RNA, 22 nt, Human
guguaaggccccagguucuuua

SEQ ID NO: 972241 - RNA, 22 nt, Human
aggacagcaguuggugagguuc

SEQ ID NO: 972242 - RNA, 18 nt, Human
uugcuuuguaagcuugca

SEQ ID NO: 972243 - RNA, 22 nt, Human
gcaugggcaagaggacuggggg

SEQ ID NO: 972244 - RNA, 22 nt, Human
cagaagcagugagagaugugca

SEQ ID NO: 972245 - RNA, 22 nt, Human
cacaagagagugcgcguugcaa

SEQ ID NO: 972246 - RNA, 22 nt, Human
gcuuagaaguuccuauaaaaug

SEQ ID NO: 972247 - RNA, 23 nt, Human
auacauacagucuuacugacuuu

SEQ ID NO: 972248 - RNA, 18 nt, Human
aggagccuuugcacugga

SEQ ID NO: 972249 - RNA, 22 nt, Human
gcaggagcagucaggggcagcu

SEQ ID NO: 972250 - RNA, 22 nt, Human
ggggccuuggaucugugccccg

SEQ ID NO: 972251 - RNA, 22 nt, Human
ccuggaagauucaccacuacca

SEQ ID NO: 972252 - RNA, 22 nt, Human
ucucaggaguagugggauccau

SEQ ID NO: 972253 - RNA, 22 nt, Human
auauaauacaaccugcuaagug

SEQ ID NO: 972254 - RNA, 22 nt, Human
cacacaugucucuccaugcucu

SEQ ID NO: 972255 - RNA, 22 nt, Human
uucauucugcaguucucagcuc

SEQ ID NO: 972256 - RNA, 22 nt, Human
guggccaaaucaugucaaaggc

SEQ ID NO: 972257 - RNA, 22 nt, Human
acccugagucagacagccugac

SEQ ID NO: 972258 - RNA, 23 nt, Human
uggcuucugccccauucucucca

SEQ ID NO: 972259 - RNA, 22 nt, Human
uggcugggugcuauccaguacu

SEQ ID NO: 972260 - RNA, 22 nt, Human
caguauuuauggcuugaguauu

SEQ ID NO: 972261 - RNA, 22 nt, Human
auugcuguacacuucuagaucu

SEQ ID NO: 972262 - RNA, 22 nt, Human
agggcagauggaacuuccccga

SEQ ID NO: 972263 - RNA, 22 nt, Human
ggcagcuucucccaggcuguuu

SEQ ID NO: 972264 - RNA, 22 nt, Human
caugaguuuuuuaguucaugca

SEQ ID NO: 972265 - RNA, 22 nt, Human
uaacuaacuaguguucaaaaua

SEQ ID NO: 972266 - RNA, 22 nt, Human
guucacaauggcuuuaccuaag

SEQ ID NO: 972267 - RNA, 22 nt, Human
acuuucuaggugcuauugugau

SEQ ID NO: 972268 - RNA, 22 nt, Human
gcaggguccauggaggcagccc

SEQ ID NO: 972269 - RNA, 20 nt, Human
ucacuaguaaccaucugcuu

SEQ ID NO: 972270 - RNA, 22 nt, Human
gcugugugcucacguaguggaa

SEQ ID NO: 972271 - RNA, 22 nt, Human
ggcagccagagggcagcuggau

SEQ ID NO: 972272 - RNA, 22 nt, Human
ugagugccugaacauagaguag

SEQ ID NO: 972273 - RNA, 22 nt, Human
cauuuucaugaguuucuguuca

SEQ ID NO: 972274 - RNA, 22 nt, Human
cuugggaaugcuaacagaugac

SEQ ID NO: 972275 - RNA, 22 nt, Human
gccuggaguacuccuugaagug

SEQ ID NO: 972276 - RNA, 22 nt, Human
gcagaggccuagguggaaggcc

SEQ ID NO: 972277 - RNA, 22 nt, Human
uaaccuuucaggcauguagguu

SEQ ID NO: 972278 - RNA, 22 nt, Human
ccaaaauguuugaaugcaugug

SEQ ID NO: 972279 - RNA, 22 nt, Human
aagaugauaggacuugcuuaag

SEQ ID NO: 972280 - RNA, 22 nt, Human
gagaggggcgcgcagcucgcga

SEQ ID NO: 972281 - RNA, 22 nt, Human
aggcuucuuagauuggcuggag

SEQ ID NO: 972282 - RNA, 22 nt, Human
acaggcucuggggcaggauggc

SEQ ID NO: 972283 - RNA, 22 nt, Human
aggagggacaccaauauauguu

SEQ ID NO: 972284 - RNA, 18 nt, Human
aaugcacacauuuacucc

SEQ ID NO: 972285 - RNA, 22 nt, Human
ucccuggagauaacuucuggga

SEQ ID NO: 972286 - RNA, 22 nt, Human
agaguguuauuugcucuguauu

SEQ ID NO: 972287 - RNA, 22 nt, Human
uuucuucagccuucacaaccug

SEQ ID NO: 972288 - RNA, 20 nt, Human
guucucacugaucugcaggg

SEQ ID NO: 972289 - RNA, 22 nt, Human
aggaugggccugggauaugcuu

SEQ ID NO: 972290 - RNA, 22 nt, Human
aaauaguucagcuuguaaaccc

SEQ ID NO: 972291 - RNA, 22 nt, Human
agcucucaagauaagaaagaac

SEQ ID NO: 972292 - RNA, 22 nt, Human
cucucccccacagcagccuucu

SEQ ID NO: 972293 - RNA, 22 nt, Human
gucugucucccugugacugaga

SEQ ID NO: 972294 - RNA, 22 nt, Human
gaagagcugugauucaggcuua

SEQ ID NO: 972295 - RNA, 22 nt, Human
uggcccugacacgugguacugg

SEQ ID NO: 972296 - RNA, 22 nt, Human
gcagagcaguacucucuugacu

SEQ ID NO: 972297 - RNA, 22 nt, Human
gccuggaggaauguagcugagg

SEQ ID NO: 972298 - RNA, 22 nt, Human
auuucauagauuguaaaucccu

SEQ ID NO: 972299 - RNA, 22 nt, Human
acccugggucauauacagugug

SEQ ID NO: 972300 - RNA, 22 nt, Human
aagcagaguccccuucccaugg

SEQ ID NO: 972301 - RNA, 23 nt, Human
agucuuaauacagcucuuuucua

SEQ ID NO: 972302 - RNA, 22 nt, Human
ccagggcauccucacaucgcag

SEQ ID NO: 972303 - RNA, 22 nt, Human
caucacuguccucagcauucca

SEQ ID NO: 972304 - RNA, 22 nt, Human
accuggagucauuugaggagua

SEQ ID NO: 972305 - RNA, 22 nt, Human
ucugcagcuugcacaggcaggc

SEQ ID NO: 972306 - RNA, 22 nt, Human
aacuccugaggaaauggucuca

SEQ ID NO: 972307 - RNA, 22 nt, Human
gccccagguugccugucccagg

SEQ ID NO: 972308 - RNA, 22 nt, Human
ccagggcagaaaaagagggaau

SEQ ID NO: 972309 - RNA, 21 nt, Human
acauccaggguccucacugcc

SEQ ID NO: 972310 - RNA, 22 nt, Human
uuucaaagaccauuaacuauca

SEQ ID NO: 972311 - RNA, 22 nt, Human
cuacauuuggagaguauaggaa

SEQ ID NO: 972312 - RNA, 19 nt, Human
ggaggccuggguauuugcc

SEQ ID NO: 972313 - RNA, 22 nt, Human
gcaccugggacccagaggcacc

SEQ ID NO: 972314 - RNA, 22 nt, Human
gcugucacaucaaggcacuaaa

SEQ ID NO: 972315 - RNA, 22 nt, Human
cuuauguacacacauauauugu

SEQ ID NO: 972316 - RNA, 22 nt, Human
ucaggcacugcuuucugauaug

SEQ ID NO: 972317 - RNA, 21 nt, Human
ugcagaggcacaaacaagccc

SEQ ID NO: 972318 - RNA, 22 nt, Human
cccugcagccggccagcucauu

SEQ ID NO: 972319 - RNA, 17 nt, Human
gguguauggggagggaa

SEQ ID NO: 972320 - RNA, 22 nt, Human
aauguguacuuuuucaugcuca

SEQ ID NO: 972321 - RNA, 22 nt, Human
gcucugucauuuugcagacacu

SEQ ID NO: 972322 - RNA, 22 nt, Human
auucuccacacauccagaccuu

SEQ ID NO: 972323 - RNA, 22 nt, Human
ugagccuguccugugcauguga

SEQ ID NO: 972324 - RNA, 20 nt, Human
aggcacuggggauagguaag

SEQ ID NO: 972325 - RNA, 22 nt, Human
agccuggauccuaggcucagcu

SEQ ID NO: 972326 - RNA, 22 nt, Human
gcuggagccaagcugcucuugg

SEQ ID NO: 972327 - RNA, 22 nt, Human
ucaguguccggagccugagugc

SEQ ID NO: 972328 - RNA, 22 nt, Human
aguuuuucugggaggcacugcu

SEQ ID NO: 972329 - RNA, 22 nt, Human
cacacaggaugaagcagcagaa

SEQ ID NO: 972330 - RNA, 22 nt, Human
uccuugaagcaacgugcagaca

SEQ ID NO: 972331 - RNA, 22 nt, Human
ugaggcaggaggauugcaggau

SEQ ID NO: 972332 - RNA, 22 nt, Human
agaagccauucccuguaggcuc

SEQ ID NO: 972333 - RNA, 22 nt, Human
gccuggaguagcauggcaagcc

SEQ ID NO: 972334 - RNA, 22 nt, Human
uguacauuuagagcucaauaga

SEQ ID NO: 972335 - RNA, 20 nt, Human
gagauggacagaugaagggg

SEQ ID NO: 972336 - RNA, 22 nt, Human
aaauaaguaguuuaguguugug

SEQ ID NO: 972337 - RNA, 22 nt, Human
aaaagcuagucaaugauguauu

SEQ ID NO: 972338 - RNA, 22 nt, Human
gcacuuggauauacaaaugaag

SEQ ID NO: 972339 - RNA, 22 nt, Human
aaaagggacuacucucagcucc

SEQ ID NO: 972340 - RNA, 22 nt, Human
uggcuaggcuccaagagcugga

SEQ ID NO: 972341 - RNA, 22 nt, Human
uggcucucagcucccagcagcc

SEQ ID NO: 972342 - RNA, 22 nt, Human
aacuuucaggcaaugaauauuu

SEQ ID NO: 972343 - RNA, 22 nt, Human
cuugcugugugguguucucaga

SEQ ID NO: 972344 - RNA, 22 nt, Human
gcacacaguauaugcucauuaa

SEQ ID NO: 972345 - RNA, 22 nt, Human
cagaccuggaaaacaggcuugc

SEQ ID NO: 972346 - RNA, 22 nt, Human
guuugcauguguacuuaauugg

SEQ ID NO: 972347 - RNA, 22 nt, Human
auuguacuuuuauuacauguag

SEQ ID NO: 972348 - RNA, 22 nt, Human
guccucaggaaagcagauaaca

SEQ ID NO: 972349 - RNA, 22 nt, Human
ggcaccugcucaucuggacuca

SEQ ID NO: 972350 - RNA, 22 nt, Human
aacuuucagaauccuaugcauu

SEQ ID NO: 972351 - RNA, 22 nt, Human
ccacacagucaguuuccaagaa

SEQ ID NO: 972352 - RNA, 22 nt, Human
ugaaaugaucaguuugguuacu

SEQ ID NO: 972353 - RNA, 22 nt, Human
cugcucuguuucuuagcugggu

SEQ ID NO: 972354 - RNA, 22 nt, Human
cucccugggcagauguggcucu

SEQ ID NO: 972355 - RNA, 19 nt, Human
aauaauguucaugagauug

SEQ ID NO: 972356 - RNA, 22 nt, Human
ucaggugguccuaagugccauc

SEQ ID NO: 972357 - RNA, 22 nt, Human
cccaucaggaacccaggagccc

SEQ ID NO: 972358 - RNA, 22 nt, Human
uuuccucuucgauuaaguuugg

SEQ ID NO: 972359 - RNA, 18 nt, Human
caguuuuuauaucuggca

SEQ ID NO: 972360 - RNA, 22 nt, Human
aaacucaaauuaaacuagcuua

SEQ ID NO: 972361 - RNA, 22 nt, Human
cagcccuggccccagguggucu

SEQ ID NO: 972362 - RNA, 22 nt, Human
ggcucuggguucugcaaugcgu

SEQ ID NO: 972363 - RNA, 22 nt, Human
cuggagcugcuguccuugggug

SEQ ID NO: 972364 - RNA, 22 nt, Human
cucuugggauuugcaggcucag

SEQ ID NO: 972365 - RNA, 22 nt, Human
cugaaaauguuacacaggaaga

SEQ ID NO: 972366 - RNA, 22 nt, Human
caagaacaguuugccaaauugg

SEQ ID NO: 972367 - RNA, 22 nt, Human
cagggccacccucugcugggug

SEQ ID NO: 972368 - RNA, 22 nt, Human
agccaagcugaucuccugcuga

SEQ ID NO: 972369 - RNA, 22 nt, Human
uagauaaauuagaaaguuuacu

SEQ ID NO: 972370 - RNA, 22 nt, Human
cucugugggggagaggcagcug

SEQ ID NO: 972371 - RNA, 22 nt, Human
ccuggcuggcaagaucgugaag

SEQ ID NO: 972372 - RNA, 22 nt, Human
acagggcagagggcaguuggua

SEQ ID NO: 972373 - RNA, 22 nt, Human
agccuauuccaggaugagcuca

SEQ ID NO: 972374 - RNA, 22 nt, Human
agccaagcaccacuggcacucg

SEQ ID NO: 972375 - RNA, 22 nt, Human
auuucagcccaguaugagcccc

SEQ ID NO: 972376 - RNA, 22 nt, Human
aacaaauguaaaaugcagaugc

SEQ ID NO: 972377 - RNA, 22 nt, Human
ggagcacuauaauagagauuuu

SEQ ID NO: 972378 - RNA, 22 nt, Human
uaggccagcccuuaguccuguc

SEQ ID NO: 972379 - RNA, 22 nt, Human
uuuauuccaugugucuaugacc

SEQ ID NO: 972380 - RNA, 22 nt, Human
ucagagcuaaggggagagcaaa

SEQ ID NO: 972381 - RNA, 22 nt, Human
cauucacucagcgaugccagua

SEQ ID NO: 972382 - RNA, 22 nt, Human
ccuggagauuauuugguccaau

SEQ ID NO: 972383 - RNA, 22 nt, Human
uucaugugaucacagauuguaa

SEQ ID NO: 972384 - RNA, 22 nt, Human
aggcugugggaauggcugcuug

SEQ ID NO: 972385 - RNA, 21 nt, Human
gaacauuuggguuguuucuac

SEQ ID NO: 972386 - RNA, 19 nt, Human
caucuggaugauucuccug

SEQ ID NO: 972387 - RNA, 22 nt, Human
cuaucuuucgauucuagcuuaa

SEQ ID NO: 972388 - RNA, 22 nt, Human
caguacuuaacuuauaggagag

SEQ ID NO: 972389 - RNA, 22 nt, Human
uuuauuauguacaggcacuaua

SEQ ID NO: 972390 - RNA, 22 nt, Human
ugccucagucuaaagucucuca

SEQ ID NO: 972391 - RNA, 22 nt, Human
gaagcccaggcuuccuuggcuu

SEQ ID NO: 972392 - RNA, 22 nt, Human
ucugcuguaaagaauuucugcc

SEQ ID NO: 972393 - RNA, 22 nt, Human
ggccucuguuuggagccaggau

SEQ ID NO: 972394 - RNA, 22 nt, Human
uccuuccugcaggccaaguccu

SEQ ID NO: 972395 - RNA, 22 nt, Human
gccugccuggagcuugagguga

SEQ ID NO: 972396 - RNA, 22 nt, Human
aggccugagguuccugugcuca

SEQ ID NO: 972397 - RNA, 22 nt, Human
gacuccugggccucugagaggc

SEQ ID NO: 972398 - RNA, 22 nt, Human
augaagcugguuuuggcuuggg

SEQ ID NO: 972399 - RNA, 22 nt, Human
guuuuauaggcuguugcuauau

SEQ ID NO: 972400 - RNA, 22 nt, Human
gucaaauauacuaagagguaaa

SEQ ID NO: 972401 - RNA, 22 nt, Human
agccacagggggugagggacaa

SEQ ID NO: 972402 - RNA, 21 nt, Human
uaucuacuggugucuuucaga

SEQ ID NO: 972403 - RNA, 22 nt, Human
ggcagcaugagccuggugaauu

SEQ ID NO: 972404 - RNA, 22 nt, Human
auguguuuugguaauuucugcu

SEQ ID NO: 972405 - RNA, 23 nt, Human
ugcuguccaacagacuggccaug

SEQ ID NO: 972406 - RNA, 22 nt, Human
gggcucugcgcucagcuccagc

SEQ ID NO: 972407 - RNA, 22 nt, Human
aucauguugcucaaaauuaaac

SEQ ID NO: 972408 - RNA, 22 nt, Human
ucacucuguuuuacucacuguu

SEQ ID NO: 972409 - RNA, 22 nt, Human
aucagcaagauguaauuucuau

SEQ ID NO: 972410 - RNA, 22 nt, Human
aaugauggauuuagacaagcug

SEQ ID NO: 972411 - RNA, 22 nt, Human
ccagggaguuuccaaucugaga

SEQ ID NO: 972412 - RNA, 22 nt, Human
ggggacccucaggacugcgucu

SEQ ID NO: 972413 - RNA, 22 nt, Human
aucuuguuaaaaugcagaaacu

SEQ ID NO: 972414 - RNA, 22 nt, Human
gaguuguucaacgugugugaaa

SEQ ID NO: 972415 - RNA, 20 nt, Human
gcaaggcacagugaggaggg

SEQ ID NO: 972416 - RNA, 22 nt, Human
ugaaggaauggaggaucagagc

SEQ ID NO: 972417 - RNA, 22 nt, Human
cagagcaggcccacugcccucc

SEQ ID NO: 972418 - RNA, 22 nt, Human
ugcaccauacccauuccccucu

SEQ ID NO: 972419 - RNA, 22 nt, Human
agcuguguagggaaucagagaa

SEQ ID NO: 972420 - RNA, 22 nt, Human
cccaaggcugcagugagcauga

SEQ ID NO: 972421 - RNA, 22 nt, Human
ggugaggcuaagugacacaggg

SEQ ID NO: 972422 - RNA, 22 nt, Human
cugggaggcacuauucaggagg

SEQ ID NO: 972423 - RNA, 22 nt, Human
cugagaggaacaucuuaugcuu

SEQ ID NO: 972424 - RNA, 22 nt, Human
ugucuuuucuacuguaagcaua

SEQ ID NO: 972425 - RNA, 19 nt, Human
ucaaaacacaaaugguuga

SEQ ID NO: 972426 - RNA, 22 nt, Human
ucuuuuauccuacauuuagcuc

SEQ ID NO: 972427 - RNA, 22 nt, Human
caggaacauuuaaccacagggu

SEQ ID NO: 972428 - RNA, 22 nt, Human
uaugcacauauaaccugcacug

SEQ ID NO: 972429 - RNA, 22 nt, Human
ucuggagagucacagugccaga

SEQ ID NO: 972430 - RNA, 22 nt, Human
cagcugccugucuggaggcaau

SEQ ID NO: 972431 - RNA, 22 nt, Human
augcuguguggccaccuccaug

SEQ ID NO: 972432 - RNA, 22 nt, Human
aaaaacugcaauuacuuuuguc

SEQ ID NO: 972433 - RNA, 22 nt, Human
cugagagugcucuuugauguca

SEQ ID NO: 972434 - RNA, 18 nt, Human
guccugagcucugcugua

SEQ ID NO: 972435 - RNA, 22 nt, Human
cuggagcccugaaugggcagga

SEQ ID NO: 972436 - RNA, 22 nt, Human
ccagcuccaggacugggagcug

SEQ ID NO: 972437 - RNA, 22 nt, Human
uaaagucaucuuuacaucuuug

SEQ ID NO: 972438 - RNA, 22 nt, Human
uuugggcaguagauguaucacu

SEQ ID NO: 972439 - RNA, 23 nt, Human
aaagacugcugagaauuuuagga

SEQ ID NO: 972440 - RNA, 22 nt, Human
uagccucuggaauccuuucucu

SEQ ID NO: 972441 - RNA, 22 nt, Human
cugugcuuaccugcccagguga

SEQ ID NO: 972442 - RNA, 22 nt, Human
cucaggggaccuggcuccgagu

SEQ ID NO: 972443 - RNA, 22 nt, Human
uggggcugucccgguuuggcga

SEQ ID NO: 972444 - RNA, 22 nt, Human
uggagcaggccggaaguggcuu

SEQ ID NO: 972445 - RNA, 22 nt, Human
aagggcuggcccugggaagagu

SEQ ID NO: 972446 - RNA, 22 nt, Human
aaauuagucauguuguauuacu

SEQ ID NO: 972447 - RNA, 22 nt, Human
cugcugcauuacucuucucaag

SEQ ID NO: 972448 - RNA, 22 nt, Human
ccccuuccacagugcuuccuaa

SEQ ID NO: 972449 - RNA, 21 nt, Human
uuuauuuauauaggacacaug

SEQ ID NO: 972450 - RNA, 22 nt, Human
ccuggaggagcgcugaccagcu

SEQ ID NO: 972451 - RNA, 22 nt, Human
ucccaguguggcaggccaugga

SEQ ID NO: 972452 - RNA, 22 nt, Human
gcugcccugucugcagcaggac

SEQ ID NO: 972453 - RNA, 22 nt, Human
uggcucugcugaaccuagugca

SEQ ID NO: 972454 - RNA, 22 nt, Human
uuauucaggcucucuuuggcua

SEQ ID NO: 972455 - RNA, 22 nt, Human
aggcaaaauuacaaaguuauua

SEQ ID NO: 972456 - RNA, 22 nt, Human
ugcauugauagaaaaacaugga

SEQ ID NO: 972457 - RNA, 22 nt, Human
acgcuuuuacuauuuugagcuc

SEQ ID NO: 972458 - RNA, 19 nt, Human
gacagugcaguuguaguac

SEQ ID NO: 972459 - RNA, 22 nt, Human
ucuuuacacaagacaagaauaa

SEQ ID NO: 972460 - RNA, 22 nt, Human
gcccagcaggacagagugguuu

SEQ ID NO: 972461 - RNA, 22 nt, Human
ugggcagacgcuguuggaaggc

SEQ ID NO: 972462 - RNA, 22 nt, Human
ccacuguuuuucaguuaacuuu

SEQ ID NO: 972463 - RNA, 22 nt, Human
uccuucaguuaucacaguacug

SEQ ID NO: 972464 - RNA, 22 nt, Human
aaggagugcaugacucagagua

SEQ ID NO: 972465 - RNA, 18 nt, Human
aggcaggcuggagugacu

SEQ ID NO: 972466 - RNA, 22 nt, Human
aggcugcagaacagucaggugc

SEQ ID NO: 972467 - RNA, 22 nt, Human
ucugcuguucauucuuuuagcu

SEQ ID NO: 972468 - RNA, 22 nt, Human
uccuucagugucccgcucaggu

SEQ ID NO: 972469 - RNA, 22 nt, Human
ccugcagguaaggcuaacugcc

SEQ ID NO: 972470 - RNA, 22 nt, Human
ggcagugguuagaaacaugagc

SEQ ID NO: 972471 - RNA, 22 nt, Human
cugccuuugcccuugacacugu

SEQ ID NO: 972472 - RNA, 22 nt, Human
gcucugcugauccgcagccauc

SEQ ID NO: 972473 - RNA, 22 nt, Human
auauuguugacuauaagaguaa

SEQ ID NO: 972474 - RNA, 22 nt, Human
uuuguaaaaggaggaagcaugg

SEQ ID NO: 972475 - RNA, 22 nt, Human
uuugacaucaauacccuagaau

SEQ ID NO: 972476 - RNA, 22 nt, Human
cucaggauguacuacagaaggc

SEQ ID NO: 972477 - RNA, 22 nt, Human
gccagggaggcuguaggguccu

SEQ ID NO: 972478 - RNA, 22 nt, Human
gcuggugcauuagcugcaguuc

SEQ ID NO: 972479 - RNA, 20 nt, Human
ugaaaaggucaggagacaug

SEQ ID NO: 972480 - RNA, 22 nt, Human
ggcugcuguacugaugucaguu

SEQ ID NO: 972481 - RNA, 22 nt, Human
ucuccuggaagugauuccccug

SEQ ID NO: 972482 - RNA, 22 nt, Human
gggucagcugcugggggcugac

SEQ ID NO: 972483 - RNA, 22 nt, Human
ggccuuggugcucuguguugca

SEQ ID NO: 972484 - RNA, 22 nt, Human
auguaguguagagauuagucuc

SEQ ID NO: 972485 - RNA, 22 nt, Human
ccuggcaggccccuccuggauu

SEQ ID NO: 972486 - RNA, 22 nt, Human
acucugcuugggccauaucugg

SEQ ID NO: 972487 - RNA, 22 nt, Human
ccuuuggguucaaucucggucu

SEQ ID NO: 972488 - RNA, 19 nt, Human
agccacagaacuugcagga

SEQ ID NO: 972489 - RNA, 22 nt, Human
uaguuuaaaaguuagggaugau

SEQ ID NO: 972490 - RNA, 22 nt, Human
aguggcagaucucuggucugga

SEQ ID NO: 972491 - RNA, 22 nt, Human
guuuucuuccugcaauuggcau

SEQ ID NO: 972492 - RNA, 22 nt, Human
agccuggagcuugaguuaugag

SEQ ID NO: 972493 - RNA, 22 nt, Human
agucugucugucacuucugcag

SEQ ID NO: 972494 - RNA, 22 nt, Human
cucuucucugcagccuuugaag

SEQ ID NO: 972495 - RNA, 22 nt, Human
aggcacuggucuaccccuuagu

SEQ ID NO: 972496 - RNA, 22 nt, Human
auuugucuagugguauucacgu

SEQ ID NO: 972497 - RNA, 22 nt, Human
ucagaagcauguggggagccug

SEQ ID NO: 972498 - RNA, 22 nt, Human
cauacauaugcauguguguaua

SEQ ID NO: 972499 - RNA, 22 nt, Human
aauguguauacuggcaauuaag

SEQ ID NO: 972500 - RNA, 22 nt, Human
uggccuggcagagcaaggccug

SEQ ID NO: 972501 - RNA, 22 nt, Human
uuuuaucugcuucauuaguuga

SEQ ID NO: 972502 - RNA, 22 nt, Human
gcagagccccauugcuggcggg

SEQ ID NO: 972503 - RNA, 22 nt, Human
auggagacgcaagggaccuagg

SEQ ID NO: 972504 - RNA, 22 nt, Human
ugugcuucaucacuucucaguu

SEQ ID NO: 972505 - RNA, 22 nt, Human
agagugucugguagcugcucug

SEQ ID NO: 972506 - RNA, 22 nt, Human
ugucucugccagcuagcagaau

SEQ ID NO: 972507 - RNA, 22 nt, Human
gaggagaggggcucccaagagc

SEQ ID NO: 972508 - RNA, 22 nt, Human
gaacaauagugguaacaaagcc

SEQ ID NO: 972509 - RNA, 22 nt, Human
acagggcuuagaaaucuguugc

SEQ ID NO: 972510 - RNA, 22 nt, Human
aaauguauugcauaggauauuu

SEQ ID NO: 972511 - RNA, 22 nt, Human
aggaaaacacaguauugaugga

SEQ ID NO: 972512 - RNA, 21 nt, Human
cagggcacacagaggauggua

SEQ ID NO: 972513 - RNA, 20 nt, Human
ggcucuggaaucuggugggc

SEQ ID NO: 972514 - RNA, 22 nt, Human
aguccuuugggaaaaaugacua

SEQ ID NO: 972515 - RNA, 22 nt, Human
uuagaaaucugcugccaugcaa

SEQ ID NO: 972516 - RNA, 22 nt, Human
cccagccugucuuucccaauga

SEQ ID NO: 972517 - RNA, 22 nt, Human
ggauggagaugaccauggugac

SEQ ID NO: 972518 - RNA, 22 nt, Human
guaaaguucuauuugaauuuag

SEQ ID NO: 972519 - RNA, 21 nt, Human
aggaaguggccagauugggaa

SEQ ID NO: 972520 - RNA, 21 nt, Human
agcugcuccagggagcucagg

SEQ ID NO: 972521 - RNA, 21 nt, Human
cauuaaguaccagggcacugu

SEQ ID NO: 972522 - RNA, 22 nt, Human
ugcugccacaaauucagcugcc

SEQ ID NO: 972523 - RNA, 22 nt, Human
agaccgagaaguucuccaggcc

SEQ ID NO: 972524 - RNA, 22 nt, Human
gcuggcauuacaggagagaacc

SEQ ID NO: 972525 - RNA, 22 nt, Human
uugcauugaaaauauauuuuaa

SEQ ID NO: 972526 - RNA, 22 nt, Human
acagguggccccgagggagugg

SEQ ID NO: 972527 - RNA, 22 nt, Human
gucccuggaucugggacagcug

SEQ ID NO: 972528 - RNA, 22 nt, Human
cugggaguguucuaggucacau

SEQ ID NO: 972529 - RNA, 22 nt, Human
agggcagagauuaauuaagaca

SEQ ID NO: 972530 - RNA, 22 nt, Human
cagagccaggugguguuggggc

SEQ ID NO: 972531 - RNA, 22 nt, Human
ugaggggagacagaguggacuc

SEQ ID NO: 972532 - RNA, 22 nt, Human
agggcuggccacaugauuuggu

SEQ ID NO: 972533 - RNA, 22 nt, Human
auuguguccucauugaccuuca

SEQ ID NO: 972534 - RNA, 22 nt, Human
cccuuggggcucuuugccaggc

SEQ ID NO: 972535 - RNA, 22 nt, Human
uugagaagaggcuuuguaggaa

SEQ ID NO: 972536 - RNA, 22 nt, Human
ucuguucagacacuuuacaugu

SEQ ID NO: 972537 - RNA, 22 nt, Human
uggggaagggcacccuggagac

SEQ ID NO: 972538 - RNA, 22 nt, Human
ucaaagucuaucuguaauuacu

SEQ ID NO: 972539 - RNA, 21 nt, Human
ugaggcaggggugcuuuuguc

SEQ ID NO: 972540 - RNA, 22 nt, Human
agguggagacccagagaaggcg

SEQ ID NO: 972541 - RNA, 22 nt, Human
uaugucuugcauuuuucaaacu

SEQ ID NO: 972542 - RNA, 22 nt, Human
ggcaagcauaaccuguacagcc

SEQ ID NO: 972543 - RNA, 22 nt, Human
caggguggggcuggcuaucaaa

SEQ ID NO: 972544 - RNA, 22 nt, Human
gugugcagugagcaaaagaucu

SEQ ID NO: 972545 - RNA, 22 nt, Human
caugcuuugggucagaaaugcc

SEQ ID NO: 972546 - RNA, 22 nt, Human
gggagggaggugcugguucacg

SEQ ID NO: 972547 - RNA, 22 nt, Human
caugcuccaaaaacaagagaau

SEQ ID NO: 972548 - RNA, 22 nt, Human
ugaagcagcaaaugaugggaga

SEQ ID NO: 972549 - RNA, 22 nt, Human
agggugcagaaggagccuagga

SEQ ID NO: 972550 - RNA, 22 nt, Human
ucucagaguuuuuuuccaggac

SEQ ID NO: 972551 - RNA, 22 nt, Human
agcagcucugagaggccagcac

SEQ ID NO: 972552 - RNA, 22 nt, Human
ucucuggagggcuccaggcggg

SEQ ID NO: 972553 - RNA, 22 nt, Human
ugccucuguugagccuuggcug

SEQ ID NO: 972554 - RNA, 22 nt, Human
gcugggagacagacuuggaacc

SEQ ID NO: 972555 - RNA, 22 nt, Human
cagcaugcaaguccagaugugg

SEQ ID NO: 972556 - RNA, 22 nt, Human
agggcccaggacagcaucaggg

SEQ ID NO: 972557 - RNA, 22 nt, Human
acaaaauuguguuaaacuuuau

SEQ ID NO: 972558 - RNA, 22 nt, Human
ggcugccucugaugugcagacg

SEQ ID NO: 972559 - RNA, 22 nt, Human
cucagagcaaugaacaugcaaa

SEQ ID NO: 972560 - RNA, 22 nt, Human
gacccaggguuucugcacaggg

SEQ ID NO: 972561 - RNA, 22 nt, Human
aggauccuuuuucugcuguuug

SEQ ID NO: 972562 - RNA, 20 nt, Human
caaugcacacagcugcuucu

SEQ ID NO: 972563 - RNA, 22 nt, Human
uggcuuccugcauggauccucu

SEQ ID NO: 972564 - RNA, 22 nt, Human
ugaaaaggguagaucccuaagu

SEQ ID NO: 972565 - RNA, 22 nt, Human
agucuuuccugcuugacuguuc

SEQ ID NO: 972566 - RNA, 19 nt, Human
uggagaggaaaugcugcuc

SEQ ID NO: 972567 - RNA, 22 nt, Human
gaguggagcaaaagagguagau

SEQ ID NO: 972568 - RNA, 22 nt, Human
augucaaaucaguuuuaucaga

SEQ ID NO: 972569 - RNA, 22 nt, Human
ugugccaggcacuugcccaggc

SEQ ID NO: 972570 - RNA, 22 nt, Human
gccucuggggcagcugagucau

SEQ ID NO: 972571 - RNA, 22 nt, Human
ggcuucuguccucuggaucugu

SEQ ID NO: 972572 - RNA, 22 nt, Human
agcagcuauuucuuccagagag

SEQ ID NO: 972573 - RNA, 23 nt, Human
uuacaguaggaguuggaaaacca

SEQ ID NO: 972574 - RNA, 22 nt, Human
ggcagcuguaagaugagugaau

SEQ ID NO: 972575 - RNA, 22 nt, Human
caguugccuacuacauggcagg

SEQ ID NO: 972576 - RNA, 22 nt, Human
ccagucccagcucugccaugcu

SEQ ID NO: 972577 - RNA, 22 nt, Human
ccuggagcuuuuccauccugga

SEQ ID NO: 972578 - RNA, 22 nt, Human
agacagcaugauacaugaugcu

SEQ ID NO: 972579 - RNA, 22 nt, Human
aggagaggcaucaagaaaaucg

SEQ ID NO: 972580 - RNA, 22 nt, Human
aaaguuugcaauuuauguuaau

SEQ ID NO: 972581 - RNA, 20 nt, Human
uccagggcaacuagagugug

SEQ ID NO: 972582 - RNA, 22 nt, Human
agucuuaugugauuuaucuuuc

SEQ ID NO: 972583 - RNA, 22 nt, Human
cagcccugagaaggaggaucuc

SEQ ID NO: 972584 - RNA, 22 nt, Human
augagcuucccagacaggaugg

SEQ ID NO: 972585 - RNA, 22 nt, Human
cauggcagaaaccugagcugcu

SEQ ID NO: 972586 - RNA, 22 nt, Human
caggcuggaguuaccuuuaggg

SEQ ID NO: 972587 - RNA, 22 nt, Human
aguaauaauuuauauuagggag

SEQ ID NO: 972588 - RNA, 22 nt, Human
agccucucuuuauucccagcua

SEQ ID NO: 972589 - RNA, 20 nt, Human
ccuccaggcacacccaugug

SEQ ID NO: 972590 - RNA, 22 nt, Human
gcuaggagauugagcucugaag

SEQ ID NO: 972591 - RNA, 22 nt, Human
uuucuucauucaccuucacccc

SEQ ID NO: 972592 - RNA, 22 nt, Human
gccuggagugcaguggcgugau

SEQ ID NO: 972593 - RNA, 22 nt, Human
gcccaggaugguguguaguggu

SEQ ID NO: 972594 - RNA, 22 nt, Human
ucuggcucauacaagccugcaa

SEQ ID NO: 972595 - RNA, 22 nt, Human
accacaggaauugcucuguggu

SEQ ID NO: 972596 - RNA, 22 nt, Human
uccaggagucagacagauggug

SEQ ID NO: 972597 - RNA, 22 nt, Human
cuuagaaaugcagauucucagg

SEQ ID NO: 972598 - RNA, 22 nt, Human
ugcaauaaguuguguuaucacu

SEQ ID NO: 972599 - RNA, 22 nt, Human
uucacaggugacuggggauaac

SEQ ID NO: 972600 - RNA, 22 nt, Human
ggucucagaucuuuauuaaggc

SEQ ID NO: 972601 - RNA, 20 nt, Human
uuguuucugcuauuuucuaa

SEQ ID NO: 972602 - RNA, 22 nt, Human
auauucuuccaaaacaucauuu

SEQ ID NO: 972603 - RNA, 22 nt, Human
cagaaggcuuuguggaguagac

SEQ ID NO: 972604 - RNA, 22 nt, Human
ucauccaguaugacuggugucu

SEQ ID NO: 972605 - RNA, 22 nt, Human
cuugcacacauguacaugugua

SEQ ID NO: 972606 - RNA, 22 nt, Human
cccaggagguggagguugcagc

SEQ ID NO: 972607 - RNA, 21 nt, Human
ugcaugcuauguuuuuauuuc

SEQ ID NO: 972608 - RNA, 17 nt, Human
guccuacccauggucua

SEQ ID NO: 972609 - RNA, 22 nt, Human
auuaggaagaggaugucagcau

SEQ ID NO: 972610 - RNA, 22 nt, Human
uaaaucaguagauaugguauag

SEQ ID NO: 972611 - RNA, 22 nt, Human
gccaggcugcuccagggaggcc

SEQ ID NO: 972612 - RNA, 22 nt, Human
ggcucagguugggucacaugac

SEQ ID NO: 972613 - RNA, 22 nt, Human
ugagaggcagaauggugccugc

SEQ ID NO: 972614 - RNA, 22 nt, Human
ugaaccagagucuccagugguu

SEQ ID NO: 972615 - RNA, 22 nt, Human
gcuggccauggccugcgccauc

SEQ ID NO: 972616 - RNA, 22 nt, Human
uccuggguccauggcagccgaa

SEQ ID NO: 972617 - RNA, 22 nt, Human
uugagaagaauguguugaguuu

SEQ ID NO: 972618 - RNA, 22 nt, Human
uucaugugaauauauuugucuu

SEQ ID NO: 972619 - RNA, 22 nt, Human
uggcccgaccucugcucaugca

SEQ ID NO: 972620 - RNA, 22 nt, Human
ugggcugcacccucagccucug

SEQ ID NO: 972621 - RNA, 22 nt, Human
uccucagggaagaugagccuca

SEQ ID NO: 972622 - RNA, 22 nt, Human
gacaugcaacaauuuggcauuu

SEQ ID NO: 972623 - RNA, 22 nt, Human
ccaggagcagggcuggcugcac

SEQ ID NO: 972624 - RNA, 22 nt, Human
ugaggcaggacauggacaacug

SEQ ID NO: 972625 - RNA, 22 nt, Human
uugcauuuaaguagauguuaca

SEQ ID NO: 972626 - RNA, 22 nt, Human
agaggccaguggcugugcuguc

SEQ ID NO: 972627 - RNA, 22 nt, Human
gaggagcuugaggcuaggagcc

SEQ ID NO: 972628 - RNA, 22 nt, Human
uuaauucuuccggacugugaaa

SEQ ID NO: 972629 - RNA, 22 nt, Human
guggcugggcuccgagcggcuu

SEQ ID NO: 972630 - RNA, 22 nt, Human
ucucccaggugggugccuggag

SEQ ID NO: 972631 - RNA, 21 nt, Human
gugucaugguugacuuuggca

SEQ ID NO: 972632 - RNA, 22 nt, Human
cugugcuggagaugggccagag

SEQ ID NO: 972633 - RNA, 22 nt, Human
agagaggcgaguuaccugugcu

SEQ ID NO: 972634 - RNA, 22 nt, Human
cucucuggaccucaacuauuuu

SEQ ID NO: 972635 - RNA, 21 nt, Human
gugugucuaauguaguggaaa

SEQ ID NO: 972636 - RNA, 22 nt, Human
gcacaugagcugcugggauggg

SEQ ID NO: 972637 - RNA, 22 nt, Human
agauacauuaguaguuacuugu

SEQ ID NO: 972638 - RNA, 22 nt, Human
uuugacaggacuaacauauggc

SEQ ID NO: 972639 - RNA, 22 nt, Human
ggggcagaaguagugccccuga

SEQ ID NO: 972640 - RNA, 22 nt, Human
cagggcuggcucaugaaaaguu

SEQ ID NO: 972641 - RNA, 22 nt, Human
cugaaggauguguggugggagu

SEQ ID NO: 972642 - RNA, 22 nt, Human
gucugaggaagaugcaggggga

SEQ ID NO: 972643 - RNA, 22 nt, Human
aauguguguucggggcccagag

SEQ ID NO: 972644 - RNA, 22 nt, Human
cuggggcuucaaugcuucggug

SEQ ID NO: 972645 - RNA, 22 nt, Human
ugggauggcauccugggccuug

SEQ ID NO: 972646 - RNA, 22 nt, Human
cugugcaagacuuacuuuaaua

SEQ ID NO: 972647 - RNA, 22 nt, Human
aggcugcuggcaggcguggacg

SEQ ID NO: 972648 - RNA, 22 nt, Human
auacuuugcuaguaucagugug

SEQ ID NO: 972649 - RNA, 22 nt, Human
uccuuggggacgcugacaucgu

SEQ ID NO: 972650 - RNA, 22 nt, Human
agggugggcuagacucuucccc

SEQ ID NO: 972651 - RNA, 22 nt, Human
agagugaaguuuuugaaaguga

SEQ ID NO: 972652 - RNA, 22 nt, Human
ugggcaagucacuucugucuuu

SEQ ID NO: 972653 - RNA, 22 nt, Human
aaugcuguucugagucugcagg

SEQ ID NO: 972654 - RNA, 22 nt, Human
gagccugggacugggggucaug

SEQ ID NO: 972655 - RNA, 22 nt, Human
uaggcagggauuaggguugauu

SEQ ID NO: 972656 - RNA, 22 nt, Human
cacuggcccauuccugucuggc

SEQ ID NO: 972657 - RNA, 22 nt, Human
ccuggccaggcauggagucaca

SEQ ID NO: 972658 - RNA, 22 nt, Human
uuccaggacuggguguuugaag

SEQ ID NO: 972659 - RNA, 22 nt, Human
uuauuccauagaagucaaggaa

SEQ ID NO: 972660 - RNA, 22 nt, Human
gcugcugucagugguggcaguu

SEQ ID NO: 972661 - RNA, 22 nt, Human
cucagggucugguccuuagauu

SEQ ID NO: 972662 - RNA, 22 nt, Human
ugcuccagugagcuggccaucc

SEQ ID NO: 972663 - RNA, 22 nt, Human
gccccugggagcagagccacca

SEQ ID NO: 972664 - RNA, 16 nt, Human
auuuccagauuaugca

SEQ ID NO: 972665 - RNA, 22 nt, Human
ucucagagcaucauuuucuuag

SEQ ID NO: 972666 - RNA, 22 nt, Human
ccagggcaucacauccaguguu

SEQ ID NO: 972667 - RNA, 22 nt, Human
gggcagcugccacuccgcuugc

SEQ ID NO: 972668 - RNA, 22 nt, Human
aaaccauggaguaaguucacau

SEQ ID NO: 972669 - RNA, 22 nt, Human
auuucaaggcuauuaauauaaa

SEQ ID NO: 972670 - RNA, 22 nt, Human
cccaggagguggagcuugcagu

SEQ ID NO: 972671 - RNA, 22 nt, Human
uggagcaggacugcugcccuca

SEQ ID NO: 972672 - RNA, 22 nt, Human
acauuucagcgugcaugacaug

SEQ ID NO: 972673 - RNA, 22 nt, Human
uugaaguuguaguucagugaag

SEQ ID NO: 972674 - RNA, 22 nt, Human
agauuucacaugcugcucuauu

SEQ ID NO: 972675 - RNA, 22 nt, Human
uugcacuuuauagaaacuuuug

SEQ ID NO: 972676 - RNA, 22 nt, Human
gugugccaccagucaaggugaa

SEQ ID NO: 972677 - RNA, 22 nt, Human
caggagagauaugaguccccac

SEQ ID NO: 972678 - RNA, 22 nt, Human
acugucugcaaaacucauacuc

SEQ ID NO: 972679 - RNA, 22 nt, Human
uaacagaaauagaaaugagagu

SEQ ID NO: 972680 - RNA, 22 nt, Human
cagcuucugcuaucgaacaucu

SEQ ID NO: 972681 - RNA, 19 nt, Human
uggagggguuugaaugugg

SEQ ID NO: 972682 - RNA, 21 nt, Human
cugccuugaaugguacuggga

SEQ ID NO: 972683 - RNA, 22 nt, Human
gccuggugaaaggcagagagcg

SEQ ID NO: 972684 - RNA, 22 nt, Human
uggaagggagugacagucagag

SEQ ID NO: 972685 - RNA, 22 nt, Human
uucucugaguacguuucagugu

SEQ ID NO: 972686 - RNA, 22 nt, Human
ccugggaguggcacucacagca

SEQ ID NO: 972687 - RNA, 22 nt, Human
agucccagugagaugagccacg

SEQ ID NO: 972688 - RNA, 22 nt, Human
agcaggugaugugagucuggaa

SEQ ID NO: 972689 - RNA, 22 nt, Human
cagcucugaggaacacuccuuu

SEQ ID NO: 972690 - RNA, 22 nt, Human
caaggccaguccauuuuggaag

SEQ ID NO: 972691 - RNA, 22 nt, Human
ucucuuucuauaugugagucuu

SEQ ID NO: 972692 - RNA, 22 nt, Human
cucuggaauuaaggaagccugu

SEQ ID NO: 972693 - RNA, 22 nt, Human
uaaaguguccuagcuaggaggc

SEQ ID NO: 972694 - RNA, 22 nt, Human
uauuuuguauuuaugcaagaaa

SEQ ID NO: 972695 - RNA, 22 nt, Human
ccuccuggggugaaggauggga

SEQ ID NO: 972696 - RNA, 17 nt, Human
ugcugccaagucccaac

SEQ ID NO: 972697 - RNA, 23 nt, Human
uuucaacuccugccauuauuucu

SEQ ID NO: 972698 - RNA, 22 nt, Human
auggcagcaaaugucuggcugg

SEQ ID NO: 972699 - RNA, 22 nt, Human
aggcaccuugcgguccagugaa

SEQ ID NO: 972700 - RNA, 22 nt, Human
guuugcauuucuugaacuauau

SEQ ID NO: 972701 - RNA, 22 nt, Human
caaagucccagcugcuuagaga

SEQ ID NO: 972702 - RNA, 20 nt, Human
cagagccaagagcagcaucu

SEQ ID NO: 972703 - RNA, 22 nt, Human
agccccaguaagggagggccug

SEQ ID NO: 972704 - RNA, 22 nt, Human
gagcagcuggacaggccucccu

SEQ ID NO: 972705 - RNA, 22 nt, Human
uaucaauacauguuaucagugu

SEQ ID NO: 972706 - RNA, 22 nt, Human
uuaaaaugcagauuaugacuca

SEQ ID NO: 972707 - RNA, 22 nt, Human
acaaggcugaacagugaagccg

SEQ ID NO: 972708 - RNA, 22 nt, Human
cuucucaguugcaagugucaga

SEQ ID NO: 972709 - RNA, 23 nt, Human
uauuagggccaggacuggcaaau

SEQ ID NO: 972710 - RNA, 22 nt, Human
gcuggcaucacuggcuucggug

SEQ ID NO: 972711 - RNA, 18 nt, Human
acugugguuuauguguag

SEQ ID NO: 972712 - RNA, 20 nt, Human
aggaagcugagauguagagg

SEQ ID NO: 972713 - RNA, 22 nt, Human
aaauguguguauguacauauau

SEQ ID NO: 972714 - RNA, 22 nt, Human
gugccugggguugagcuaugaa

SEQ ID NO: 972715 - RNA, 22 nt, Human
agcccaggaaucugcaucuuga

SEQ ID NO: 972716 - RNA, 22 nt, Human
acagaaggcggggacaaggcgg

SEQ ID NO: 972717 - RNA, 19 nt, Human
ucucugcuucucuuggcau

SEQ ID NO: 972718 - RNA, 22 nt, Human
gccaggcuccccggaucccugg

SEQ ID NO: 972719 - RNA, 22 nt, Human
uuuguucugaaaacucaagucc

SEQ ID NO: 972720 - RNA, 22 nt, Human
uucuucaaagaugucuguugga

SEQ ID NO: 972721 - RNA, 23 nt, Human
cuucacaaucaaaaucaguucug

SEQ ID NO: 972722 - RNA, 22 nt, Human
caggaaccuaaugaaggcucac

SEQ ID NO: 972723 - RNA, 22 nt, Human
gggucccaggaaggagcagugu

SEQ ID NO: 972724 - RNA, 22 nt, Human
agagaaggucacuaaggaccca

SEQ ID NO: 972725 - RNA, 22 nt, Human
ccagccucacuggcaucaccua

SEQ ID NO: 972726 - RNA, 18 nt, Human
agggaguuuuagggaagg

SEQ ID NO: 972727 - RNA, 22 nt, Human
ucugcuguauuagguugaacug

SEQ ID NO: 972728 - RNA, 22 nt, Human
uuccaggaagcaguuagcagcc

SEQ ID NO: 972729 - RNA, 22 nt, Human
aguuuaaaucauguuuuguaac

SEQ ID NO: 972730 - RNA, 22 nt, Human
ccagcuugaagaugugcugguu

SEQ ID NO: 972731 - RNA, 19 nt, Human
ugcaggaggacugagcaga

SEQ ID NO: 972732 - RNA, 22 nt, Human
ucuucacauggaacaugaagcu

SEQ ID NO: 972733 - RNA, 22 nt, Human
gccaggaguguguggcuauguu

SEQ ID NO: 972734 - RNA, 21 nt, Human
cacaggugggucagugaggcc

SEQ ID NO: 972735 - RNA, 22 nt, Human
cccucugcugccuggcuggguc

SEQ ID NO: 972736 - RNA, 22 nt, Human
gagggugggccagauaugaggg

SEQ ID NO: 972737 - RNA, 22 nt, Human
gaggcagagucacaaagagucu

SEQ ID NO: 972738 - RNA, 22 nt, Human
uggucaaaaacucucaguggac

SEQ ID NO: 972739 - RNA, 19 nt, Human
ucaaaugccaaugucacag

SEQ ID NO: 972740 - RNA, 22 nt, Human
ugagagggcccagagcacacca

SEQ ID NO: 972741 - RNA, 22 nt, Human
caggcagcugcuggguucagcc

SEQ ID NO: 972742 - RNA, 22 nt, Human
acauuucucauucuccccuaac

SEQ ID NO: 972743 - RNA, 22 nt, Human
uugaaugaccaugaugcaaggg

SEQ ID NO: 972744 - RNA, 22 nt, Human
ucuguucagaaauggaagugcc

SEQ ID NO: 972745 - RNA, 22 nt, Human
aggcaggcacuccggaaguguc

SEQ ID NO: 972746 - RNA, 22 nt, Human
gguggcaggcccugagcauccc

SEQ ID NO: 972747 - RNA, 22 nt, Human
uggcacccugaaguuggucacu

SEQ ID NO: 972748 - RNA, 19 nt, Human
uauucaggaugauggcaca

SEQ ID NO: 972749 - RNA, 22 nt, Human
ucugcugucacucauuugcuuc

SEQ ID NO: 972750 - RNA, 22 nt, Human
ucagagcugcccaugcaagggg

SEQ ID NO: 972751 - RNA, 22 nt, Human
gcuggccucgcaggcaggaugu

SEQ ID NO: 972752 - RNA, 22 nt, Human
ugggccugccccaggcuucagc

SEQ ID NO: 972753 - RNA, 22 nt, Human
ucugccuuuucacugccacuaa

SEQ ID NO: 972754 - RNA, 22 nt, Human
agaggacagguuuuccaugggc

SEQ ID NO: 972755 - RNA, 22 nt, Human
cuggcugaggucaccaguagcu

SEQ ID NO: 972756 - RNA, 22 nt, Human
ucagagcuuuggagaccaggaa

SEQ ID NO: 972757 - RNA, 22 nt, Human
uuuccucuuuguaccuugacua

SEQ ID NO: 972758 - RNA, 22 nt, Human
ccaggaaauagugcugugaucu

SEQ ID NO: 972759 - RNA, 17 nt, Human
ccucacagggaccagac

SEQ ID NO: 972760 - RNA, 22 nt, Human
ggcaguggugggaggcucgcuc

SEQ ID NO: 972761 - RNA, 22 nt, Human
auguccuuugcuucucuggucc

SEQ ID NO: 972762 - RNA, 22 nt, Human
aaagugacaaccauuuauuaag

SEQ ID NO: 972763 - RNA, 22 nt, Human
ugcuuuauguuaucagaagggu

SEQ ID NO: 972764 - RNA, 22 nt, Human
caguacuuugaagauauuuuag

SEQ ID NO: 972765 - RNA, 22 nt, Human
aaaaugcucaucagcgauggcu

SEQ ID NO: 972766 - RNA, 22 nt, Human
ugcagcugcuugauucaucuug

SEQ ID NO: 972767 - RNA, 22 nt, Human
cuucugcaauaaguuuuggucc

SEQ ID NO: 972768 - RNA, 22 nt, Human
aguuuguaucaauuugcuuuau

SEQ ID NO: 972769 - RNA, 22 nt, Human
aggcacaguggcucacaccugu

SEQ ID NO: 972770 - RNA, 22 nt, Human
gugcuuccugccuggugccuuu

SEQ ID NO: 972771 - RNA, 19 nt, Human
uucauucucuuauuguugu

SEQ ID NO: 972772 - RNA, 22 nt, Human
uggaggaugccauccaggauac

SEQ ID NO: 972773 - RNA, 21 nt, Human
ucauccagguccugcuucuuc

SEQ ID NO: 972774 - RNA, 22 nt, Human
aauaauuuccagccaacuggaa

SEQ ID NO: 972775 - RNA, 22 nt, Human
ccugaggcccuggcugugcuga

SEQ ID NO: 972776 - RNA, 22 nt, Human
uuacuuugcuuucucauuacag

SEQ ID NO: 972777 - RNA, 22 nt, Human
ccagggcacguugggacaguac

SEQ ID NO: 972778 - RNA, 22 nt, Human
uuagaaaugauuucaccucuuu

SEQ ID NO: 972779 - RNA, 22 nt, Human
gcuguuccugcuuagaggucgg

SEQ ID NO: 972780 - RNA, 22 nt, Human
guaggcagugguuggaagagaa

SEQ ID NO: 972781 - RNA, 22 nt, Human
ucaguaacuuacuuauucaccu

SEQ ID NO: 972782 - RNA, 22 nt, Human
agccaggaauuggacaacacau

SEQ ID NO: 972783 - RNA, 22 nt, Human
ccauuguaguaucuguuuuagu

SEQ ID NO: 972784 - RNA, 22 nt, Human
ucuguucaguuguaccuucccc

SEQ ID NO: 972785 - RNA, 22 nt, Human
guuugaaaaaagcaguauguaa

SEQ ID NO: 972786 - RNA, 21 nt, Human
aagaaguuuggauuuuguccu

SEQ ID NO: 972787 - RNA, 20 nt, Human
auacacauauucuugcaacu

SEQ ID NO: 972788 - RNA, 22 nt, Human
ccacucugauuuuggcuccacu

SEQ ID NO: 972789 - RNA, 22 nt, Human
uccuucagccaugggcucucca

SEQ ID NO: 972790 - RNA, 22 nt, Human
guggaauguccuugaucauaag

SEQ ID NO: 972791 - RNA, 22 nt, Human
uaaaaguuuuaguuguacauaa

SEQ ID NO: 972792 - RNA, 22 nt, Human
gugugccaggaacuggcugcug

SEQ ID NO: 972793 - RNA, 22 nt, Human
ugguggcaauguccuggagaag

SEQ ID NO: 972794 - RNA, 22 nt, Human
aacugccuggccaggcugcaac

SEQ ID NO: 972795 - RNA, 22 nt, Human
auccuugagccaaugacugauu

SEQ ID NO: 972796 - RNA, 22 nt, Human
guuuuuaucuaauagcaguuau

SEQ ID NO: 972797 - RNA, 22 nt, Human
auggaaagcuaagccauuuacc

SEQ ID NO: 972798 - RNA, 22 nt, Human
gcagaggcuguagggaagguug

SEQ ID NO: 972799 - RNA, 22 nt, Human
ugcagaggagucagccugggca

SEQ ID NO: 972800 - RNA, 22 nt, Human
gcugcaggagcuggagcugugg

SEQ ID NO: 972801 - RNA, 22 nt, Human
gcuccuggcaggcagugugugu

SEQ ID NO: 972802 - RNA, 22 nt, Human
uggugagcgaugcugcauguuc

SEQ ID NO: 972803 - RNA, 22 nt, Human
uguccugggaaugggaugcagu

SEQ ID NO: 972804 - RNA, 22 nt, Human
gcugcagcuuuaggauccagug

SEQ ID NO: 972805 - RNA, 22 nt, Human
uuuagaaguucacacauuuaaa

SEQ ID NO: 972806 - RNA, 22 nt, Human
aguguuucuggcaaaugaaagu

SEQ ID NO: 972807 - RNA, 22 nt, Human
cagagagcuuagugugcugcau

SEQ ID NO: 972808 - RNA, 22 nt, Human
uuccauuguuucugucuucacu

SEQ ID NO: 972809 - RNA, 22 nt, Human
uguggccucaaggcugcccuca

SEQ ID NO: 972810 - RNA, 17 nt, Human
aaucuguuuacagucag

SEQ ID NO: 972811 - RNA, 22 nt, Human
caaagaugcugauguuggauca

SEQ ID NO: 972812 - RNA, 22 nt, Human
ccaggaggcggaagguacagug

SEQ ID NO: 972813 - RNA, 18 nt, Human
aguggucuguuauaucau

SEQ ID NO: 972814 - RNA, 22 nt, Human
gcaggcugugaggcucagaugg

SEQ ID NO: 972815 - RNA, 22 nt, Human
ugcuggcucaguuugcagacuc

SEQ ID NO: 972816 - RNA, 20 nt, Human
agagcagcaguuggugaggu

SEQ ID NO: 972817 - RNA, 22 nt, Human
aaagauuugaaauuaggcauca

SEQ ID NO: 972818 - RNA, 22 nt, Human
cagguggggcagcugugggagc

SEQ ID NO: 972819 - RNA, 22 nt, Human
cugcugugagugguucuugccu

SEQ ID NO: 972820 - RNA, 22 nt, Human
acaaaaauuagcugggcauggu

SEQ ID NO: 972821 - RNA, 22 nt, Human
uacagucaacauugaugaugau

SEQ ID NO: 972822 - RNA, 22 nt, Human
gguugccggggcaggacuggaa

SEQ ID NO: 972823 - RNA, 22 nt, Human
ggcugcuguuucagagacuguu

SEQ ID NO: 972824 - RNA, 22 nt, Human
aggcucugugcagccugcaucu

SEQ ID NO: 972825 - RNA, 22 nt, Human
cucugggcaggaccaguggacc

SEQ ID NO: 972826 - RNA, 22 nt, Human
gcauugaguccacucugucuuu

SEQ ID NO: 972827 - RNA, 22 nt, Human
uggcagcagggccccuggagga

SEQ ID NO: 972828 - RNA, 22 nt, Human
aggggcugccuggcuuggcacu

SEQ ID NO: 972829 - RNA, 22 nt, Human
ggcuggaaaagacaaagcuauu

SEQ ID NO: 972830 - RNA, 22 nt, Human
caagaugccccugguagggauc

SEQ ID NO: 972831 - RNA, 22 nt, Human
uaaccaaagggccuaaggaaug

SEQ ID NO: 972832 - RNA, 22 nt, Human
agcuucccaagguuggaagguu

SEQ ID NO: 972833 - RNA, 23 nt, Human
ggaguuggauuguacuugcugcu

SEQ ID NO: 972834 - RNA, 22 nt, Human
guccucuggccuuucccaggac

SEQ ID NO: 972835 - RNA, 22 nt, Human
acugagcugcaagucagggagg

SEQ ID NO: 972836 - RNA, 19 nt, Human
cugugcaggccgggcugag

SEQ ID NO: 972837 - RNA, 22 nt, Human
ugcagggccuucuagaccaugg

SEQ ID NO: 972838 - RNA, 22 nt, Human
acugggagucaugaggaaggag

SEQ ID NO: 972839 - RNA, 22 nt, Human
aaacaccagcacuguuuacaaa

SEQ ID NO: 972840 - RNA, 22 nt, Human
agaggucagaacaggaaagugu

SEQ ID NO: 972841 - RNA, 22 nt, Human
auacaguauuaccuguucagga

SEQ ID NO: 972842 - RNA, 22 nt, Human
uucacauuggugauauguuucu

SEQ ID NO: 972843 - RNA, 22 nt, Human
gacagcuggcaguggaaaggug

SEQ ID NO: 972844 - RNA, 22 nt, Human
aauauaguucugguauuguuaa

SEQ ID NO: 972845 - RNA, 22 nt, Human
ccaggguggaggcuggauggag

SEQ ID NO: 972846 - RNA, 22 nt, Human
aggccuccugcagggaugagug

SEQ ID NO: 972847 - RNA, 22 nt, Human
ucagacaguuugcagugugccu

SEQ ID NO: 972848 - RNA, 22 nt, Human
uuaaaauagccagugccccucu

SEQ ID NO: 972849 - RNA, 22 nt, Human
cuucaaacccagauuaaaugca

SEQ ID NO: 972850 - RNA, 22 nt, Human
aucacaggugguaggaaaagaa

SEQ ID NO: 972851 - RNA, 22 nt, Human
aucuguucuucaaaauauuaca

SEQ ID NO: 972852 - RNA, 20 nt, Human
agguccugggacuggcagag

SEQ ID NO: 972853 - RNA, 22 nt, Human
ccagagccuaagaucugauccu

SEQ ID NO: 972854 - RNA, 22 nt, Human
gagaggcugacuggcuguccug

SEQ ID NO: 972855 - RNA, 22 nt, Human
ucugucugacaggguaugaacu

SEQ ID NO: 972856 - RNA, 22 nt, Human
gauuuccuagacauggggcaga

SEQ ID NO: 972857 - RNA, 22 nt, Human
ggggacaguuaaagaccaagac

SEQ ID NO: 972858 - RNA, 22 nt, Human
gaacccaaccucacuuggggua

SEQ ID NO: 972859 - RNA, 22 nt, Human
caggaacaauguaagucucauu

SEQ ID NO: 972860 - RNA, 22 nt, Human
cuccuggaagcccgcccugcug

SEQ ID NO: 972861 - RNA, 20 nt, Human
ccuaggcaugcugagucucc

SEQ ID NO: 972862 - RNA, 22 nt, Human
aagucuuacauaauaguuugga

SEQ ID NO: 972863 - RNA, 22 nt, Human
auaaguaggaaaauuugaauau

SEQ ID NO: 972864 - RNA, 22 nt, Human
gcugcucuccauggccgugagu

SEQ ID NO: 972865 - RNA, 17 nt, Human
agaacuguaguagcucc

SEQ ID NO: 972866 - RNA, 20 nt, Human
uugauucccucuaaacucgc

SEQ ID NO: 972867 - RNA, 22 nt, Human
acuugggaguucuggaagccug

SEQ ID NO: 972868 - RNA, 22 nt, Human
uuuacauuucccucugucaguu

SEQ ID NO: 972869 - RNA, 22 nt, Human
gcccagaguucaaggcugcagu

SEQ ID NO: 972870 - RNA, 22 nt, Human
cugaggccucucuccugggcuu

SEQ ID NO: 972871 - RNA, 22 nt, Human
cuggccaggcucucacgugguc

SEQ ID NO: 972872 - RNA, 22 nt, Human
cacaaaugugcagaaaugugag

SEQ ID NO: 972873 - RNA, 22 nt, Human
ugcaggccucacaccuggcacc

SEQ ID NO: 972874 - RNA, 22 nt, Human
acuugcugguggcauuuacagu

SEQ ID NO: 972875 - RNA, 22 nt, Human
ugucauugaggaaaacuaggug

SEQ ID NO: 972876 - RNA, 22 nt, Human
uaaagguagugugacauauugu

SEQ ID NO: 972877 - RNA, 22 nt, Human
cucugcaugccuugcucagaca

SEQ ID NO: 972878 - RNA, 22 nt, Human
uauuucuguaugcauaaaagga

SEQ ID NO: 972879 - RNA, 22 nt, Human
ucugagccaccugccagugcug

SEQ ID NO: 972880 - RNA, 22 nt, Human
augagcugggccauccagugau

SEQ ID NO: 972881 - RNA, 22 nt, Human
guuucuaaauguucugaguuuu

SEQ ID NO: 972882 - RNA, 22 nt, Human
uguucuuucaguuagacacagu

SEQ ID NO: 972883 - RNA, 22 nt, Human
uuuauucaucaucuguucauau

SEQ ID NO: 972884 - RNA, 22 nt, Human
cauagagugauguaagguaugu

SEQ ID NO: 972885 - RNA, 22 nt, Human
ucaggugggaccugcuaggaca

SEQ ID NO: 972886 - RNA, 22 nt, Human
ugggcugccggcaggcucugcc

SEQ ID NO: 972887 - RNA, 22 nt, Human
agcuauguauuuguguguuaaa

SEQ ID NO: 972888 - RNA, 23 nt, Human
auuugagaaaguauuuuuaagac

SEQ ID NO: 972889 - RNA, 17 nt, Human
ucaggcugugccuggua

SEQ ID NO: 972890 - RNA, 22 nt, Human
cacccuggaaagaaggucuggg

SEQ ID NO: 972891 - RNA, 21 nt, Human
ugccagcauguaggcuaguug

SEQ ID NO: 972892 - RNA, 23 nt, Human
uucuuauuuacuuuggaaucucc

SEQ ID NO: 972893 - RNA, 22 nt, Human
ggaggccaaggcagguggauca

SEQ ID NO: 972894 - RNA, 22 nt, Human
gaaaugugcagaauguguuaga

SEQ ID NO: 972895 - RNA, 23 nt, Human
ugagcugguauuguccaucucca

SEQ ID NO: 972896 - RNA, 22 nt, Human
caguggagagacuuuuacucuu

SEQ ID NO: 972897 - RNA, 22 nt, Human
ccacccagccagaugcaggaag

SEQ ID NO: 972898 - RNA, 22 nt, Human
uaaaacuuaacuauccagauua

SEQ ID NO: 972899 - RNA, 22 nt, Human
uaugaguacaaggacucugucu

SEQ ID NO: 972900 - RNA, 22 nt, Human
cuggagccugcaguuuucacuu

SEQ ID NO: 972901 - RNA, 22 nt, Human
cuggcugcaggaaggagugggc

SEQ ID NO: 972902 - RNA, 22 nt, Human
guuuucaauuauaagauggcuu

SEQ ID NO: 972903 - RNA, 21 nt, Human
ccugcugugaucuuagugagu

SEQ ID NO: 972904 - RNA, 22 nt, Human
uuccggaagguucucuagaauu

SEQ ID NO: 972905 - RNA, 22 nt, Human
uggcagcaauuagcuagagcug

SEQ ID NO: 972906 - RNA, 22 nt, Human
accagagcuggcucugagcacc

SEQ ID NO: 972907 - RNA, 22 nt, Human
gagggaggugauacugaacgua

SEQ ID NO: 972908 - RNA, 22 nt, Human
acugcagccuugaacucugggc

SEQ ID NO: 972909 - RNA, 22 nt, Human
ugcagcagguuccaaaggguua

SEQ ID NO: 972910 - RNA, 22 nt, Human
gcagacagcauguugggcuauu

SEQ ID NO: 972911 - RNA, 22 nt, Human
ggccuggccuccagaugugggc

SEQ ID NO: 972912 - RNA, 22 nt, Human
ucuucucuacaccagcagcccc

SEQ ID NO: 972913 - RNA, 22 nt, Human
caggcagcucugcuuuuccuaa

SEQ ID NO: 972914 - RNA, 22 nt, Human
agguaaggcuguaagcuaagcc

SEQ ID NO: 972915 - RNA, 21 nt, Human
ucagggcagcugcucuucaga

SEQ ID NO: 972916 - RNA, 22 nt, Human
agcacauucuugccuuaaccuc

SEQ ID NO: 972917 - RNA, 22 nt, Human
cacugccuggaaggagagacau

SEQ ID NO: 972918 - RNA, 22 nt, Human
ggaggagacccugugucaguuu

SEQ ID NO: 972919 - RNA, 22 nt, Human
ugcaggugccucuugagcuugu

SEQ ID NO: 972920 - RNA, 23 nt, Human
uugauacagaagaaucaguuugu

SEQ ID NO: 972921 - RNA, 22 nt, Human
uccauggguagcccugguugag

SEQ ID NO: 972922 - RNA, 22 nt, Human
ucagagagugcaaaauauagcu

SEQ ID NO: 972923 - RNA, 22 nt, Human
ggccaggcuggucucagacuuc

SEQ ID NO: 972924 - RNA, 22 nt, Human
ggagagcagggaggcugcucug

SEQ ID NO: 972925 - RNA, 22 nt, Human
ugaaggaaugaguauacuguuu

SEQ ID NO: 972926 - RNA, 22 nt, Human
caggaaaggugugucaugaugg

SEQ ID NO: 972927 - RNA, 22 nt, Human
cuuuuccacugagccucacaaa

SEQ ID NO: 972928 - RNA, 21 nt, Human
ucucugguuggaguugugcca

SEQ ID NO: 972929 - RNA, 22 nt, Human
uuauuuagucuagaugaauuuu

SEQ ID NO: 972930 - RNA, 22 nt, Human
ucuccuggauagauacuaucca

SEQ ID NO: 972931 - RNA, 22 nt, Human
uugaaaguuaucuagauucuga

SEQ ID NO: 972932 - RNA, 22 nt, Human
ccucugggugggaggccgggcg

SEQ ID NO: 972933 - RNA, 20 nt, Human
ccuggaagagcuccccaggc

SEQ ID NO: 972934 - RNA, 22 nt, Human
auggccaagaauauuucucaac

SEQ ID NO: 972935 - RNA, 22 nt, Human
ucuguucaugaaauaucuuuuu

SEQ ID NO: 972936 - RNA, 21 nt, Human
ccuucuccacagggucuccgg

SEQ ID NO: 972937 - RNA, 22 nt, Human
gccaggaguucagaugcauguu

SEQ ID NO: 972938 - RNA, 22 nt, Human
uggcccugaggggcugugcccc

SEQ ID NO: 972939 - RNA, 22 nt, Human
auucaaguucuucugucuuugc

SEQ ID NO: 972940 - RNA, 22 nt, Human
ugggacagugugccuugcuccu

SEQ ID NO: 972941 - RNA, 22 nt, Human
ugcagaggaccauuguccugga

SEQ ID NO: 972942 - RNA, 22 nt, Human
auccaugaagguacuucucagg

SEQ ID NO: 972943 - RNA, 22 nt, Human
ccuguucaugaaacugcuuucc

SEQ ID NO: 972944 - RNA, 22 nt, Human
cagagccccucagcucucuccc

SEQ ID NO: 972945 - RNA, 22 nt, Human
ggcucaggaccugggauugcca

SEQ ID NO: 972946 - RNA, 22 nt, Human
gcugagggcuguaacagcagag

SEQ ID NO: 972947 - RNA, 22 nt, Human
cagacacagauaugcauauggc

SEQ ID NO: 972948 - RNA, 22 nt, Human
aucagugcuaaagcaaaugccc

SEQ ID NO: 972949 - RNA, 22 nt, Human
uugaagcauuucuuugagcuuc

SEQ ID NO: 972950 - RNA, 22 nt, Human
cugacucuccucaagcauaaau

SEQ ID NO: 972951 - RNA, 22 nt, Human
gauggcagguaguggucucauc

SEQ ID NO: 972952 - RNA, 19 nt, Human
uguuggugcggauguggag

SEQ ID NO: 972953 - RNA, 22 nt, Human
cucucugaggaaggagcaucug

SEQ ID NO: 972954 - RNA, 22 nt, Human
auucuaggcuugaaacaugaag

SEQ ID NO: 972955 - RNA, 22 nt, Human
guacaugucaaaaaaugcauaa

SEQ ID NO: 972956 - RNA, 22 nt, Human
uggagccauaacccuuucguac

SEQ ID NO: 972957 - RNA, 22 nt, Human
auuagguaagauaaagcagagg

SEQ ID NO: 972958 - RNA, 22 nt, Human
ccagcccugccucucagggccc

SEQ ID NO: 972959 - RNA, 22 nt, Human
uuucuucucgacaccuuauccc

SEQ ID NO: 972960 - RNA, 22 nt, Human
uugaaaggaauacagaggccua

SEQ ID NO: 972961 - RNA, 22 nt, Human
gagcagcugguaggugaaccca

SEQ ID NO: 972962 - RNA, 22 nt, Human
ggcugcugugaccucaggugau

SEQ ID NO: 972963 - RNA, 22 nt, Human
ggaggggccggcugccugccac

SEQ ID NO: 972964 - RNA, 22 nt, Human
uaaaugcaguacaaauuguucu

SEQ ID NO: 972965 - RNA, 22 nt, Human
uguauuuuuaggaaugcgcuau

SEQ ID NO: 972966 - RNA, 22 nt, Human
ccaucagcuccaguaucuucug

SEQ ID NO: 972967 - RNA, 22 nt, Human
gcucccagcauugcugcugaau

SEQ ID NO: 972968 - RNA, 23 nt, Human
cccaggaguuucacugcaaaggu

SEQ ID NO: 972969 - RNA, 22 nt, Human
gccugcagaacugugaggcaau

SEQ ID NO: 972970 - RNA, 22 nt, Human
guugaaagaugucuugguuccc

SEQ ID NO: 972971 - RNA, 23 nt, Human
gggugggccaaauuagguagccu

SEQ ID NO: 972972 - RNA, 22 nt, Human
uucaugcuuuuaccgcuguuaa

SEQ ID NO: 972973 - RNA, 22 nt, Human
ugagccagguuaagacaggagc

SEQ ID NO: 972974 - RNA, 22 nt, Human
cgggcuggcugcagcugcugga

SEQ ID NO: 972975 - RNA, 22 nt, Human
uccugccucaggcucuggagua

SEQ ID NO: 972976 - RNA, 22 nt, Human
cacugcuuuuuuggcuauguac

SEQ ID NO: 972977 - RNA, 18 nt, Human
gugcugugggcaguggcc

SEQ ID NO: 972978 - RNA, 22 nt, Human
ugccuugcacauaauauacauu

SEQ ID NO: 972979 - RNA, 22 nt, Human
ucccagaguauuagcaauugcu

SEQ ID NO: 972980 - RNA, 22 nt, Human
ccuguccuccaagagcacaucu

SEQ ID NO: 972981 - RNA, 22 nt, Human
aggcggcugguguccugcaggu

SEQ ID NO: 972982 - RNA, 18 nt, Human
ucucagaggccauccuag

SEQ ID NO: 972983 - RNA, 22 nt, Human
uuuucuuauggugaagcacaaa

SEQ ID NO: 972984 - RNA, 23 nt, Human
gugcugugagccccuuggccucc

SEQ ID NO: 972985 - RNA, 22 nt, Human
gcagaggcaaucagguaugugg

SEQ ID NO: 972986 - RNA, 22 nt, Human
ucagaaauuuucucaguaguuc

SEQ ID NO: 972987 - RNA, 22 nt, Human
aaaugcuacauacacaucaggg

SEQ ID NO: 972988 - RNA, 22 nt, Human
ccacugaaggucaacauagagc

SEQ ID NO: 972989 - RNA, 22 nt, Human
ccuggcagguggcgcccucggc

SEQ ID NO: 972990 - RNA, 22 nt, Human
auuauuauuguugauguuaggg

SEQ ID NO: 972991 - RNA, 22 nt, Human
gaauauuaguaucaguuauacc

SEQ ID NO: 972992 - RNA, 22 nt, Human
ugaaucauggauaaauagcuua

SEQ ID NO: 972993 - RNA, 22 nt, Human
ccuggccaguuuccaggcccug

SEQ ID NO: 972994 - RNA, 22 nt, Human
gggcagcagcaggaggucucug

SEQ ID NO: 972995 - RNA, 22 nt, Human
cugcacagagcagggcagacac

SEQ ID NO: 972996 - RNA, 22 nt, Human
ccugucugcagauaucucaggu

SEQ ID NO: 972997 - RNA, 22 nt, Human
gaaugugucacccugucccaug

SEQ ID NO: 972998 - RNA, 22 nt, Human
uuacaucuaaacugugaacaau

SEQ ID NO: 972999 - RNA, 22 nt, Human
cacucaggguacaauggagggc

SEQ ID NO: 973000 - RNA, 22 nt, Human
uaaauguguuguggaugaaguu

SEQ ID NO: 973001 - RNA, 22 nt, Human
guucacaagcugauugucuuuc

SEQ ID NO: 973002 - RNA, 22 nt, Human
agcaggguuccaggaguugcag

SEQ ID NO: 973003 - RNA, 22 nt, Human
aagauuuacuagcauaauagcu

SEQ ID NO: 973004 - RNA, 22 nt, Human
ugucucugagaugacucccacc

SEQ ID NO: 973005 - RNA, 22 nt, Human
aggacuucuccgauaagucaga

SEQ ID NO: 973006 - RNA, 22 nt, Human
cugcuguguuggcauuggauag

SEQ ID NO: 973007 - RNA, 22 nt, Human
aaaguuacuaucacaaugaaau

SEQ ID NO: 973008 - RNA, 22 nt, Human
uagucaaaccucagaauacccc

SEQ ID NO: 973009 - RNA, 22 nt, Human
auuuccuaggguagaugucaca

SEQ ID NO: 973010 - RNA, 22 nt, Human
acaggugaccugcucauaugaa

SEQ ID NO: 973011 - RNA, 21 nt, Human
ggggcagagcuaggcccugca

SEQ ID NO: 973012 - RNA, 17 nt, Human
ucagagggaugagcagg

SEQ ID NO: 973013 - RNA, 22 nt, Human
uuuuaauugcaauuaugguccc

SEQ ID NO: 973014 - RNA, 22 nt, Human
aaagucauuguaauauaugcua

SEQ ID NO: 973015 - RNA, 22 nt, Human
ggagauuuauagcacacuucag

SEQ ID NO: 973016 - RNA, 22 nt, Human
ugcucucucaggccuggcccac

SEQ ID NO: 973017 - RNA, 22 nt, Human
gugucacaagagcccaggaaac

SEQ ID NO: 973018 - RNA, 18 nt, Human
gcugagguggugucagag

SEQ ID NO: 973019 - RNA, 22 nt, Human
uaagauuuuuaaaauguccuca

SEQ ID NO: 973020 - RNA, 22 nt, Human
uugcauugauguuccuucuugc

SEQ ID NO: 973021 - RNA, 22 nt, Human
uuucaauguaugucuuucugag

SEQ ID NO: 973022 - RNA, 22 nt, Human
uauuuauaaucugccaaagaga

SEQ ID NO: 973023 - RNA, 22 nt, Human
cuguauuucccacauucucuau

SEQ ID NO: 973024 - RNA, 22 nt, Human
uuaugacaggaaaaucacagaa

SEQ ID NO: 973025 - RNA, 22 nt, Human
gcucaggaaggcucaaccagga

SEQ ID NO: 973026 - RNA, 22 nt, Human
ccagccuggagggcaguggugg

SEQ ID NO: 973027 - RNA, 20 nt, Human
uuugagaccagucugcccaa

SEQ ID NO: 973028 - RNA, 22 nt, Human
ugcugccauggucgcugguguc

SEQ ID NO: 973029 - RNA, 22 nt, Human
aagugccaucauagcauggcug

SEQ ID NO: 973030 - RNA, 22 nt, Human
auucucaaaacauaacuucacu

SEQ ID NO: 973031 - RNA, 22 nt, Human
uacuuuguggagauuaaaaaua

SEQ ID NO: 973032 - RNA, 22 nt, Human
gaugugggguugagggaccagc

SEQ ID NO: 973033 - RNA, 22 nt, Human
gugcugggcuccaccccagagg

SEQ ID NO: 973034 - RNA, 18 nt, Human
aagaggaggagcagguug

SEQ ID NO: 973035 - RNA, 22 nt, Human
gcucuggaagcaucugagagga

SEQ ID NO: 973036 - RNA, 22 nt, Human
ggucuuccgagaggccugugcu

SEQ ID NO: 973037 - RNA, 22 nt, Human
ccaugagcuucaacugacacag

SEQ ID NO: 973038 - RNA, 22 nt, Human
cugaggccuguguuggggcagu

SEQ ID NO: 973039 - RNA, 22 nt, Human
agcuucuugaccaagccuguaa

SEQ ID NO: 973040 - RNA, 21 nt, Human
gcucucugcaugguggcucag

SEQ ID NO: 973041 - RNA, 22 nt, Human
acuuuauuuccuauugcaucca

SEQ ID NO: 973042 - RNA, 17 nt, Human
auuucacuuagcaugag

SEQ ID NO: 973043 - RNA, 22 nt, Human
aaaguguggcacaagucacauc

SEQ ID NO: 973044 - RNA, 22 nt, Human
ccuguguggaaaccgcaugacg

SEQ ID NO: 973045 - RNA, 22 nt, Human
aaaugaguuuccucaauguccu

SEQ ID NO: 973046 - RNA, 22 nt, Human
cagcucuggcgucagggagcga

SEQ ID NO: 973047 - RNA, 22 nt, Human
gcuguucagaugcgauucagga

SEQ ID NO: 973048 - RNA, 22 nt, Human
gcacagcaauuucuauaagcuc

SEQ ID NO: 973049 - RNA, 22 nt, Human
guguuuccucacuucucugacu

SEQ ID NO: 973050 - RNA, 22 nt, Human
uggcugcugcuuggucuucuuc

SEQ ID NO: 973051 - RNA, 22 nt, Human
uaguaucuuucuauauuuccca

SEQ ID NO: 973052 - RNA, 22 nt, Human
auaucuuuguaugguucagcag

SEQ ID NO: 973053 - RNA, 22 nt, Human
ucaggauccauagacucccaaa

SEQ ID NO: 973054 - RNA, 22 nt, Human
aaugggagagaacacaaagucc

SEQ ID NO: 973055 - RNA, 22 nt, Human
cuggcugggagcgagcugcuca

SEQ ID NO: 973056 - RNA, 22 nt, Human
cccuggaggcuggaggcaguag

SEQ ID NO: 973057 - RNA, 22 nt, Human
aggcacugcuucuaaguaggaa

SEQ ID NO: 973058 - RNA, 22 nt, Human
auccaggcugcgggucucaagu

SEQ ID NO: 973059 - RNA, 22 nt, Human
gcaggggcuaaggacacagaga

SEQ ID NO: 973060 - RNA, 22 nt, Human
gucaccagucccagcuccugaa

SEQ ID NO: 973061 - RNA, 22 nt, Human
acuggcucagaguuccuagaga

SEQ ID NO: 973062 - RNA, 21 nt, Human
agcagccauggaugguaugua

SEQ ID NO: 973063 - RNA, 21 nt, Human
acugccugucuccauagucua

SEQ ID NO: 973064 - RNA, 19 nt, Human
aauguaguguuaugucaac

SEQ ID NO: 973065 - RNA, 21 nt, Human
uggcucaguugcugggcacag

SEQ ID NO: 973066 - RNA, 22 nt, Human
gugcauauguguguauacaaac

SEQ ID NO: 973067 - RNA, 22 nt, Human
gccccagcucugccacaacuag

SEQ ID NO: 973068 - RNA, 22 nt, Human
acagguggaggcuuuaggaggu

SEQ ID NO: 973069 - RNA, 22 nt, Human
cuggcacaugcucccugagugg

SEQ ID NO: 973070 - RNA, 22 nt, Human
uguccauggauagagcugcucg

SEQ ID NO: 973071 - RNA, 22 nt, Human
uuugaaguaccugguucugacu

SEQ ID NO: 973072 - RNA, 22 nt, Human
cagcugacccagugaggaggca

SEQ ID NO: 973073 - RNA, 22 nt, Human
uguaggacauguacuuguaaca

SEQ ID NO: 973074 - RNA, 22 nt, Human
ucaugccacuuacaaaauaaug

SEQ ID NO: 973075 - RNA, 17 nt, Human
uaugcuuuucuucucca

SEQ ID NO: 973076 - RNA, 22 nt, Human
acucugcugucugauggcagga

SEQ ID NO: 973077 - RNA, 21 nt, Human
aucagcaaaugccugucuccc

SEQ ID NO: 973078 - RNA, 22 nt, Human
cuuagaaauaaugguuucaguu

SEQ ID NO: 973079 - RNA, 22 nt, Human
cagggccacuguagaugaggag

SEQ ID NO: 973080 - RNA, 22 nt, Human
uaggauaugugaaaucauauua

SEQ ID NO: 973081 - RNA, 22 nt, Human
uccuucagggcugaccacaggc

SEQ ID NO: 973082 - RNA, 22 nt, Human
auauuagguuggugcaaaagua

SEQ ID NO: 973083 - RNA, 22 nt, Human
gagcugccugugugccaugaug

SEQ ID NO: 973084 - RNA, 22 nt, Human
auuuccucaugaucauaaugca

SEQ ID NO: 973085 - RNA, 22 nt, Human
cugccuggcauggagaagagaa

SEQ ID NO: 973086 - RNA, 22 nt, Human
gcaccuuuuucuaggagaaugu

SEQ ID NO: 973087 - RNA, 22 nt, Human
gaagccccaaacccucgccauc

SEQ ID NO: 973088 - RNA, 22 nt, Human
uggcugcugagaaggcagcugu

SEQ ID NO: 973089 - RNA, 22 nt, Human
uggggcuggggaucuugagccu

SEQ ID NO: 973090 - RNA, 22 nt, Human
cugccuuggaaaaugugguaau

SEQ ID NO: 973091 - RNA, 22 nt, Human
gaggcacugcaguacagugacu

SEQ ID NO: 973092 - RNA, 22 nt, Human
ccagcagcucccucaggguccg

SEQ ID NO: 973093 - RNA, 22 nt, Human
uuagauaaauuaagacuuuaca

SEQ ID NO: 973094 - RNA, 22 nt, Human
aggcauggcuuuaggcaggcgu

SEQ ID NO: 973095 - RNA, 21 nt, Human
uucuucaaagaagaaggcaca

SEQ ID NO: 973096 - RNA, 22 nt, Human
cuugugcauuucauuccucagg

SEQ ID NO: 973097 - RNA, 22 nt, Human
uccuucaagaugccacagcuuu

SEQ ID NO: 973098 - RNA, 22 nt, Human
uauagaaguaagcauugugaug

SEQ ID NO: 973099 - RNA, 20 nt, Human
aaaguguaagcauauaauua

SEQ ID NO: 973100 - RNA, 22 nt, Human
acuccuggguugcaguccucaa

SEQ ID NO: 973101 - RNA, 22 nt, Human
gggaggugauuaggaccaugua

SEQ ID NO: 973102 - RNA, 22 nt, Human
ugcugaaagucccaaaucucau

SEQ ID NO: 973103 - RNA, 22 nt, Human
caggaggcccaaagggcgcaga

SEQ ID NO: 973104 - RNA, 22 nt, Human
uggaaggcaugggaacuguucu

SEQ ID NO: 973105 - RNA, 18 nt, Human
ucagggaagagaauauga

SEQ ID NO: 973106 - RNA, 22 nt, Human
aaaugauugucaaaguucuguu

SEQ ID NO: 973107 - RNA, 22 nt, Human
gaugaaaaaagacgagcauaua

SEQ ID NO: 973108 - RNA, 22 nt, Human
aggccugaaggaagaugagcug

SEQ ID NO: 973109 - RNA, 22 nt, Human
gugcuuucugcugcauuccucu

SEQ ID NO: 973110 - RNA, 22 nt, Human
ugcugcugaucauuuauagucu

SEQ ID NO: 973111 - RNA, 22 nt, Human
agacaugagaaacccaccagag

SEQ ID NO: 973112 - RNA, 22 nt, Human
ugaggcagcccacuuuccuuag

SEQ ID NO: 973113 - RNA, 22 nt, Human
aaaccaaacauuugcgguggug

SEQ ID NO: 973114 - RNA, 23 nt, Human
gcugagguacauuuacaggaaga

SEQ ID NO: 973115 - RNA, 22 nt, Human
uuaaauauuuucagcaggguca

SEQ ID NO: 973116 - RNA, 22 nt, Human
uagggcuauaagagaauaagac

SEQ ID NO: 973117 - RNA, 22 nt, Human
ggaggcucugcuccguguguuc

SEQ ID NO: 973118 - RNA, 23 nt, Human
cugcuguuuucuguaccugaagc

SEQ ID NO: 973119 - RNA, 22 nt, Human
ccuggccacagggcucugcauu

SEQ ID NO: 973120 - RNA, 22 nt, Human
aggcucagauucacauuugguu

SEQ ID NO: 973121 - RNA, 22 nt, Human
gaagcccagggcguggccgggc

SEQ ID NO: 973122 - RNA, 19 nt, Human
agccagggugagaaggagc

SEQ ID NO: 973123 - RNA, 22 nt, Human
cagagcaguaaaucuggggcac

SEQ ID NO: 973124 - RNA, 22 nt, Human
ccugggagagucuguggucucc

SEQ ID NO: 973125 - RNA, 22 nt, Human
ugcuuuggaucuauuugcugag

SEQ ID NO: 973126 - RNA, 22 nt, Human
ggccucuguucugcauuccucc

SEQ ID NO: 973127 - RNA, 22 nt, Human
accccagcccugcuucugggag

SEQ ID NO: 973128 - RNA, 22 nt, Human
gccuucugaucgcuggacugac

SEQ ID NO: 973129 - RNA, 22 nt, Human
cagccagguucaaguccuuaua

SEQ ID NO: 973130 - RNA, 22 nt, Human
acucugcuaaauguaaguuggu

SEQ ID NO: 973131 - RNA, 22 nt, Human
uuuauuauagugguggggacug

SEQ ID NO: 973132 - RNA, 22 nt, Human
ggucaggguauaaucaagugag

SEQ ID NO: 973133 - RNA, 22 nt, Human
caggccuggagugcaauggcac

SEQ ID NO: 973134 - RNA, 22 nt, Human
guggcucuccauugacauggaa

SEQ ID NO: 973135 - RNA, 18 nt, Human
aggcagacacuagagguc

SEQ ID NO: 973136 - RNA, 22 nt, Human
caaauguguagagcuuuugggg

SEQ ID NO: 973137 - RNA, 22 nt, Human
aagcagaaaaacugagcuccaa

SEQ ID NO: 973138 - RNA, 22 nt, Human
uuggcaguaaaagaaaaugcuu

SEQ ID NO: 973139 - RNA, 22 nt, Human
ugaaggcccagccacagaaugg

SEQ ID NO: 973140 - RNA, 22 nt, Human
cuccugcgguacuacugugcuu

SEQ ID NO: 973141 - RNA, 22 nt, Human
uccagcagaccaucaaggcuca

SEQ ID NO: 973142 - RNA, 17 nt, Human
acacagccagguucucc

SEQ ID NO: 973143 - RNA, 22 nt, Human
uggcuuccgccgcgggccucgg

SEQ ID NO: 973144 - RNA, 22 nt, Human
gagccagcagccggcaccacca

SEQ ID NO: 973145 - RNA, 22 nt, Human
aaaauuauucauggcuuuugga

SEQ ID NO: 973146 - RNA, 22 nt, Human
ucaggcagaggauggggagcgu

SEQ ID NO: 973147 - RNA, 22 nt, Human
gggcagccucggugccugcugc

SEQ ID NO: 973148 - RNA, 22 nt, Human
cagaaguaagauuacugugaga

SEQ ID NO: 973149 - RNA, 20 nt, Human
aucagacuugcauuucagga

SEQ ID NO: 973150 - RNA, 19 nt, Human
aggguggcaaaggagggug

SEQ ID NO: 973151 - RNA, 22 nt, Human
uaaaugaagaaauggagauugu

SEQ ID NO: 973152 - RNA, 22 nt, Human
uuugcauucuagaaaaauuucu

SEQ ID NO: 973153 - RNA, 22 nt, Human
ccacagggugucaucagcuuga

SEQ ID NO: 973154 - RNA, 22 nt, Human
ccugugggaggggccuggcgcg

SEQ ID NO: 973155 - RNA, 22 nt, Human
cgcagaagagguugucuagucc

SEQ ID NO: 973156 - RNA, 22 nt, Human
agccagccgggggaccacagug

SEQ ID NO: 973157 - RNA, 22 nt, Human
gcauuccugagaaugcagagug

SEQ ID NO: 973158 - RNA, 22 nt, Human
uggcucaguuucugcccagcug

SEQ ID NO: 973159 - RNA, 22 nt, Human
ucugagccguauggcuuggcua

SEQ ID NO: 973160 - RNA, 22 nt, Human
gcugagcugcuguucauccugc

SEQ ID NO: 973161 - RNA, 21 nt, Human
uggcucugagccucauggcug

SEQ ID NO: 973162 - RNA, 22 nt, Human
uccauguggccagacacuggca

SEQ ID NO: 973163 - RNA, 22 nt, Human
ugaguucuaguggcugcagauu

SEQ ID NO: 973164 - RNA, 22 nt, Human
aggcagaaaauagucauccaaa

SEQ ID NO: 973165 - RNA, 22 nt, Human
cuuuggcaaggguuuuaauugu

SEQ ID NO: 973166 - RNA, 22 nt, Human
augcaaaagacuauuuguugcu

SEQ ID NO: 973167 - RNA, 22 nt, Human
cggggcugcgcucuuccugccg

SEQ ID NO: 973168 - RNA, 22 nt, Human
aguaggaggcgggagcaugaag

SEQ ID NO: 973169 - RNA, 22 nt, Human
ggcugcugaguuggccaggaga

SEQ ID NO: 973170 - RNA, 22 nt, Human
uauuagguuggugcaacaguaa

SEQ ID NO: 973171 - RNA, 22 nt, Human
ggagccuuccagacugcccaca

SEQ ID NO: 973172 - RNA, 22 nt, Human
ugugcagagcccacaggcagcu

SEQ ID NO: 973173 - RNA, 22 nt, Human
uuugaaaguccuaggagagucc

SEQ ID NO: 973174 - RNA, 22 nt, Human
cauugcacuccagcuugggcaa

SEQ ID NO: 973175 - RNA, 22 nt, Human
gcagcacauauaaacaaagaga

SEQ ID NO: 973176 - RNA, 18 nt, Human
gccuggcuucggagccgc

SEQ ID NO: 973177 - RNA, 21 nt, Human
ggcagcguguggacaggaagg

SEQ ID NO: 973178 - RNA, 22 nt, Human
guccaugauucugugacacccu

SEQ ID NO: 973179 - RNA, 22 nt, Human
ccuggcagacugugagggcagg

SEQ ID NO: 973180 - RNA, 22 nt, Human
ucagagaguuacacaaauuguu

SEQ ID NO: 973181 - RNA, 22 nt, Human
ccuggagcuuggucacgcugcg

SEQ ID NO: 973182 - RNA, 22 nt, Human
gcuguucauuagaaauagaaug

SEQ ID NO: 973183 - RNA, 22 nt, Human
aauugacagaaaguuuacgagg

SEQ ID NO: 973184 - RNA, 22 nt, Human
cugggaggauucauugagguga

SEQ ID NO: 973185 - RNA, 22 nt, Human
agcuagccuaggcagagugcau

SEQ ID NO: 973186 - RNA, 20 nt, Human
gcugccagugccugaugcuu

SEQ ID NO: 973187 - RNA, 22 nt, Human
ggcacugggugagggucacugg

SEQ ID NO: 973188 - RNA, 22 nt, Human
cccaggagagaggccaguuggc

SEQ ID NO: 973189 - RNA, 22 nt, Human
ccagagcccagggucaugcagg

SEQ ID NO: 973190 - RNA, 22 nt, Human
ccaggagagcucuaaauggcug

SEQ ID NO: 973191 - RNA, 22 nt, Human
uuuuaaucaugcuucuaugucc

SEQ ID NO: 973192 - RNA, 22 nt, Human
uuccauaacugaccgaaugcau

SEQ ID NO: 973193 - RNA, 22 nt, Human
ugggcagacauugaguuuguuc

SEQ ID NO: 973194 - RNA, 19 nt, Human
ggcugggucuggcagguuc

SEQ ID NO: 973195 - RNA, 22 nt, Human
uauuaggguaaauuugacaugc

SEQ ID NO: 973196 - RNA, 22 nt, Human
cugggagcuuuuagaaaugcag

SEQ ID NO: 973197 - RNA, 22 nt, Human
cugcagcuuuggaaaccuguuu

SEQ ID NO: 973198 - RNA, 22 nt, Human
acauuucuaauuuaauguaaca

SEQ ID NO: 973199 - RNA, 22 nt, Human
ucaggggaaaucucucagcgaa

SEQ ID NO: 973200 - RNA, 22 nt, Human
cuucugugauuugguuaggaua

SEQ ID NO: 973201 - RNA, 22 nt, Human
aaacuguauauuuauggcaugu

SEQ ID NO: 973202 - RNA, 22 nt, Human
cuuugaauuccaguacaauaac

SEQ ID NO: 973203 - RNA, 22 nt, Human
gaaaaguauguuuauuuugacu

SEQ ID NO: 973204 - RNA, 22 nt, Human
agcagccacagcagaucugagu

SEQ ID NO: 973205 - RNA, 22 nt, Human
cagcuggggcagccacgugcgg

SEQ ID NO: 973206 - RNA, 22 nt, Human
uugcaaaugaccauugccacau

SEQ ID NO: 973207 - RNA, 22 nt, Human
caaggaaaaagcgagcucgggg

SEQ ID NO: 973208 - RNA, 22 nt, Human
ggagcugcuuugaucugaagaa

SEQ ID NO: 973209 - RNA, 22 nt, Human
cuccugggcucaagugauccuc

SEQ ID NO: 973210 - RNA, 22 nt, Human
ccuggcugccgagugugcagcg

SEQ ID NO: 973211 - RNA, 22 nt, Human
ccucugccugcacaucauccug

SEQ ID NO: 973212 - RNA, 22 nt, Human
caggccuggcugcagcucgccu

SEQ ID NO: 973213 - RNA, 22 nt, Human
uaugcauaauuggauaaguaga

SEQ ID NO: 973214 - RNA, 22 nt, Human
augauacaucuucaugucagug

SEQ ID NO: 973215 - RNA, 22 nt, Human
gccuuccuuuuaccaccagcca

SEQ ID NO: 973216 - RNA, 22 nt, Human
uugccaggagcucaucugaggg

SEQ ID NO: 973217 - RNA, 19 nt, Human
agggaguuuauauuugcac

SEQ ID NO: 973218 - RNA, 22 nt, Human
cauuuguaauacugacuugcag

SEQ ID NO: 973219 - RNA, 22 nt, Human
ggucucuguugccuccaucaag

SEQ ID NO: 973220 - RNA, 22 nt, Human
agucccagugagaugaaccagg

SEQ ID NO: 973221 - RNA, 22 nt, Human
acaacuucucacagauaaauuu

SEQ ID NO: 973222 - RNA, 22 nt, Human
cccagcuccgagcuccgagccg

SEQ ID NO: 973223 - RNA, 22 nt, Human
aucuuucaaucaggaaaaaucu

SEQ ID NO: 973224 - RNA, 22 nt, Human
uugcaaaggggaauaaagcaau

SEQ ID NO: 973225 - RNA, 22 nt, Human
aggaagcuggugugaggaugaa

SEQ ID NO: 973226 - RNA, 22 nt, Human
agccagggacgcugcaggcuac

SEQ ID NO: 973227 - RNA, 20 nt, Human
uccaagcccuccuuccauuc

SEQ ID NO: 973228 - RNA, 22 nt, Human
caugagcugcugggagccuguc

SEQ ID NO: 973229 - RNA, 22 nt, Human
caggcucccugggcaguggcag

SEQ ID NO: 973230 - RNA, 22 nt, Human
cagaguccugcaccagcuccag

SEQ ID NO: 973231 - RNA, 22 nt, Human
uaacagaaauaguaggugaggg

SEQ ID NO: 973232 - RNA, 22 nt, Human
cuggaagaggaagccagcugga

SEQ ID NO: 973233 - RNA, 22 nt, Human
ugucugugaccucuuuggagcc

SEQ ID NO: 973234 - RNA, 22 nt, Human
agggcagcacaaggcauggacu

SEQ ID NO: 973235 - RNA, 22 nt, Human
gcaggagucacugacuuggucc

SEQ ID NO: 973236 - RNA, 22 nt, Human
ucucaggccccugaguuucucu

SEQ ID NO: 973237 - RNA, 21 nt, Human
gauuuuaaagagacugccaca

SEQ ID NO: 973238 - RNA, 22 nt, Human
aauaucaacaguguccuucuaa

SEQ ID NO: 973239 - RNA, 22 nt, Human
uggcuggggagccccgacuccc

SEQ ID NO: 973240 - RNA, 22 nt, Human
ggagugggcagcacugcccugu

SEQ ID NO: 973241 - RNA, 22 nt, Human
guuagaauaaaaggucagagag

SEQ ID NO: 973242 - RNA, 22 nt, Human
uuucuagggcucuugucuucug

SEQ ID NO: 973243 - RNA, 22 nt, Human
uuuuauuggagugauaccaagc

SEQ ID NO: 973244 - RNA, 23 nt, Human
uggagcugacagucagagggagg

SEQ ID NO: 973245 - RNA, 22 nt, Human
aaacuguaaacacagcaguaca

SEQ ID NO: 973246 - RNA, 22 nt, Human
gccugagagacccauggggcaa

SEQ ID NO: 973247 - RNA, 20 nt, Human
ggccgaaauaauaguggcuu

SEQ ID NO: 973248 - RNA, 22 nt, Human
agagccugcaucuagccucaga

SEQ ID NO: 973249 - RNA, 22 nt, Human
uguuuuuacugugauccagaaa

SEQ ID NO: 973250 - RNA, 20 nt, Human
cuuugccuauucucugccug

SEQ ID NO: 973251 - RNA, 22 nt, Human
ugggcugcccugaugguccuca

SEQ ID NO: 973252 - RNA, 22 nt, Human
uugcagcuucuaccacuguuuc

SEQ ID NO: 973253 - RNA, 22 nt, Human
cugggccucaaucucagaguuu

SEQ ID NO: 973254 - RNA, 22 nt, Human
acccaggagguggaggcugcag

SEQ ID NO: 973255 - RNA, 22 nt, Human
augcugugagugugccgcagag

SEQ ID NO: 973256 - RNA, 22 nt, Human
auugaaagauauacuguucuca

SEQ ID NO: 973257 - RNA, 22 nt, Human
ccaccagcuucagcagccgcgg

SEQ ID NO: 973258 - RNA, 22 nt, Human
uccuggcccaaucugcccauga

SEQ ID NO: 973259 - RNA, 22 nt, Human
aaugaaauguagcuuauccaua

SEQ ID NO: 973260 - RNA, 22 nt, Human
cuucuuuccuuccuccaguggc

SEQ ID NO: 973261 - RNA, 22 nt, Human
uuaauuuuuauguauagugugu

SEQ ID NO: 973262 - RNA, 22 nt, Human
gacggcagaaacucaugagguc

SEQ ID NO: 973263 - RNA, 22 nt, Human
aaauucuaugucaauguuuauu

SEQ ID NO: 973264 - RNA, 22 nt, Human
uuaucauugucgcagucuaauu

SEQ ID NO: 973265 - RNA, 22 nt, Human
gcaggauggugcccuuucugcc

SEQ ID NO: 973266 - RNA, 22 nt, Human
ggagcuggucagccuugagcau

SEQ ID NO: 973267 - RNA, 19 nt, Human
aguguguacugaaagcacu

SEQ ID NO: 973268 - RNA, 19 nt, Human
gcagcugcuugaaaagaaa

SEQ ID NO: 973269 - RNA, 21 nt, Human
gagugucuaauccaggcuguc

SEQ ID NO: 973270 - RNA, 19 nt, Human
ggcagaagguguaggggga

SEQ ID NO: 973271 - RNA, 22 nt, Human
cuuuuuaucucuuaaugauguu

SEQ ID NO: 973272 - RNA, 18 nt, Human
acaggccucaguccugca

SEQ ID NO: 973273 - RNA, 21 nt, Human
gcacagcaugaguguuggcau

SEQ ID NO: 973274 - RNA, 22 nt, Human
uguggcugacuccuggucccca

SEQ ID NO: 973275 - RNA, 22 nt, Human
ugcaccccauuuuacauuuaca

SEQ ID NO: 973276 - RNA, 22 nt, Human
cagggcagccaggccccguggg

SEQ ID NO: 973277 - RNA, 22 nt, Human
cucuccucugaaguggugaccc

SEQ ID NO: 973278 - RNA, 18 nt, Human
aaauguacuguccauggc

SEQ ID NO: 973279 - RNA, 18 nt, Human
ggcugagguugacuagaa

SEQ ID NO: 973280 - RNA, 22 nt, Human
ucuuguccuaagagcuggauuc

SEQ ID NO: 973281 - RNA, 22 nt, Human
ucuguaguagguuguaguucuu

SEQ ID NO: 973282 - RNA, 21 nt, Human
uuuauguacuucauagaguag

SEQ ID NO: 973283 - RNA, 22 nt, Human
uccaggagagguagaggguucc

SEQ ID NO: 973284 - RNA, 22 nt, Human
ccucugaguccucccugguugc

SEQ ID NO: 973285 - RNA, 21 nt, Human
ucaaagcacauauuugcacau

SEQ ID NO: 973286 - RNA, 22 nt, Human
cauuagaagaacaguuauauua

SEQ ID NO: 973287 - RNA, 22 nt, Human
uccugagauguggagcuccaug

SEQ ID NO: 973288 - RNA, 22 nt, Human
aagaaauaagacuucucugucc

SEQ ID NO: 973289 - RNA, 22 nt, Human
uuucccaguucccugcucuaua

SEQ ID NO: 973290 - RNA, 22 nt, Human
ugccaggcauauggccucuuug

SEQ ID NO: 973291 - RNA, 22 nt, Human
uggccuggugcucaggcaguag

SEQ ID NO: 973292 - RNA, 22 nt, Human
uggcagcauguuauguaaggaa

SEQ ID NO: 973293 - RNA, 22 nt, Human
ggcagggcuugucucugugaug

SEQ ID NO: 973294 - RNA, 22 nt, Human
acgcagaagggccuggcgugcc

SEQ ID NO: 973295 - RNA, 22 nt, Human
guuucuuaaauguagcaggacc

SEQ ID NO: 973296 - RNA, 22 nt, Human
uagccggguguugugucaugca

SEQ ID NO: 973297 - RNA, 22 nt, Human
cucccuggaggugagcuggcac

SEQ ID NO: 973298 - RNA, 22 nt, Human
ugaaggccucugguacaugcca

SEQ ID NO: 973299 - RNA, 21 nt, Human
aucauucuggaaaauucaagc

SEQ ID NO: 973300 - RNA, 22 nt, Human
ggcaggagggcggacaaugacc

SEQ ID NO: 973301 - RNA, 22 nt, Human
uauguacauaacaugaaaugca

SEQ ID NO: 973302 - RNA, 22 nt, Human
cagaggcaggaagaugggcagu

SEQ ID NO: 973303 - RNA, 22 nt, Human
ggccugcuuuccgagccugcag

SEQ ID NO: 973304 - RNA, 22 nt, Human
agaaaucaugacuaagagcagu

SEQ ID NO: 973305 - RNA, 22 nt, Human
ccagugcuucuuugcuagcugg

SEQ ID NO: 973306 - RNA, 22 nt, Human
aggcuuccuggaggaagaggua

SEQ ID NO: 973307 - RNA, 22 nt, Human
cauucauuuacuuucaacagcu

SEQ ID NO: 973308 - RNA, 22 nt, Human
aaugcucaaaauguuucaucua

SEQ ID NO: 973309 - RNA, 22 nt, Human
ccugggugaugugcugcccucg

SEQ ID NO: 973310 - RNA, 21 nt, Human
gcaugccugcaucuuaguguu

SEQ ID NO: 973311 - RNA, 22 nt, Human
uuugacaaaggaaaaaugcaca

SEQ ID NO: 973312 - RNA, 22 nt, Human
auguauuucuauguagugaaga

SEQ ID NO: 973313 - RNA, 22 nt, Human
cauuuguaucauauguaucuua

SEQ ID NO: 973314 - RNA, 22 nt, Human
ggugaguugggguucacagguc

SEQ ID NO: 973315 - RNA, 22 nt, Human
ccuaugccugucacucugcgcu

SEQ ID NO: 973316 - RNA, 22 nt, Human
gauggcaggugauagccgaguc

SEQ ID NO: 973317 - RNA, 22 nt, Human
cuggcagcucugagucccuucu

SEQ ID NO: 973318 - RNA, 22 nt, Human
ggcacagggagccgcaguugca

SEQ ID NO: 973319 - RNA, 22 nt, Human
uuccgcuggggccgccuggcgg

SEQ ID NO: 973320 - RNA, 22 nt, Human
aggcuggcuuggcucuccugug

SEQ ID NO: 973321 - RNA, 22 nt, Human
uaaaaaguugaaaggacuuauc

SEQ ID NO: 973322 - RNA, 22 nt, Human
cacagggcagugauuguccaca

SEQ ID NO: 973323 - RNA, 22 nt, Human
uaaguggaagguuauaugcuaa

SEQ ID NO: 973324 - RNA, 22 nt, Human
ucacucuggccucugcagcagu

SEQ ID NO: 973325 - RNA, 22 nt, Human
cagagaaaaaauccugcucuca

SEQ ID NO: 973326 - RNA, 22 nt, Human
uggugguuaugcgcuuuguggg

SEQ ID NO: 973327 - RNA, 22 nt, Human
aauggccagcaacaggagugaa

SEQ ID NO: 973328 - RNA, 22 nt, Human
cuuuauguccaccagacugcaa

SEQ ID NO: 973329 - RNA, 22 nt, Human
cauuuuauccucugggaagcua

SEQ ID NO: 973330 - RNA, 22 nt, Human
cugaaggauucaaaauggcagg

SEQ ID NO: 973331 - RNA, 22 nt, Human
ucaggagagagaaauuggggcu

SEQ ID NO: 973332 - RNA, 22 nt, Human
gccaggcucagcagucaaccug

SEQ ID NO: 973333 - RNA, 18 nt, Human
agagcagcggcaucacac

SEQ ID NO: 973334 - RNA, 22 nt, Human
gggcagaggcucuggcccaucc

SEQ ID NO: 973335 - RNA, 22 nt, Human
ggccucagaccggagcuggcca

SEQ ID NO: 973336 - RNA, 19 nt, Human
uucuccaggcugcagaggg

SEQ ID NO: 973337 - RNA, 22 nt, Human
gcagcagagaacacaaugaugg

SEQ ID NO: 973338 - RNA, 22 nt, Human
ccuuaaauucuccauuugaaag

SEQ ID NO: 973339 - RNA, 22 nt, Human
gugauuucagguuuuucauacu

SEQ ID NO: 973340 - RNA, 22 nt, Human
auucuuaauuccaaagacugag

SEQ ID NO: 973341 - RNA, 22 nt, Human
ggcugcagagcugggugggccu

SEQ ID NO: 973342 - RNA, 22 nt, Human
caggauggagaguuguugguug

SEQ ID NO: 973343 - RNA, 20 nt, Human
ucuggcaggugaacgagcug

SEQ ID NO: 973344 - RNA, 22 nt, Human
ggccaggagcugcacagggcuc

SEQ ID NO: 973345 - RNA, 22 nt, Human
agggcagagaaauguaguugag

SEQ ID NO: 973346 - RNA, 22 nt, Human
uauccaaaguuucucagaaacu

SEQ ID NO: 973347 - RNA, 22 nt, Human
cucuccagaucugcugagccag

SEQ ID NO: 973348 - RNA, 22 nt, Human
cagagcagguaucuuuggugaa

SEQ ID NO: 973349 - RNA, 22 nt, Human
ggauggagguucucagaugcuc

SEQ ID NO: 973350 - RNA, 22 nt, Human
gauggccuguauuugggccaga

SEQ ID NO: 973351 - RNA, 23 nt, Human
uccugagaugagacagugcugcc

SEQ ID NO: 973352 - RNA, 22 nt, Human
cuuucagagguuacucaggaaa

SEQ ID NO: 973353 - RNA, 22 nt, Human
auucuucaucacuaccuuguga

SEQ ID NO: 973354 - RNA, 22 nt, Human
ggccucacccaucggugccuuu

SEQ ID NO: 973355 - RNA, 22 nt, Human
aaugcacauaaauauggucuua

SEQ ID NO: 973356 - RNA, 22 nt, Human
gagugcagaugaacagaagauu

SEQ ID NO: 973357 - RNA, 22 nt, Human
accuuaaaacugacacauggag

SEQ ID NO: 973358 - RNA, 22 nt, Human
aaaaugaggucaauauccuuuu

SEQ ID NO: 973359 - RNA, 22 nt, Human
ugcagggcacacgcacgggugu

SEQ ID NO: 973360 - RNA, 22 nt, Human
ccucuggucccagcucugcugc

SEQ ID NO: 973361 - RNA, 22 nt, Human
agcuggcccucgagagccaauu

SEQ ID NO: 973362 - RNA, 22 nt, Human
aaaaagauguccugaaguuuag

SEQ ID NO: 973363 - RNA, 22 nt, Human
acauuuaaccaaacuguuuaau

SEQ ID NO: 973364 - RNA, 22 nt, Human
agggcugccugcucugcauuga

SEQ ID NO: 973365 - RNA, 22 nt, Human
ugcagaguaaaagcagaugcua

SEQ ID NO: 973366 - RNA, 22 nt, Human
gucccaggcuuauguggagcuu

SEQ ID NO: 973367 - RNA, 22 nt, Human
aagccagguguugugguaagag

SEQ ID NO: 973368 - RNA, 22 nt, Human
ugcugcacgauaaauaauuucu

SEQ ID NO: 973369 - RNA, 22 nt, Human
gcuggccugcugggcaccaccg

SEQ ID NO: 973370 - RNA, 22 nt, Human
acaggccacaguggagucucug

SEQ ID NO: 973371 - RNA, 22 nt, Human
agccagagagccccagguucua

SEQ ID NO: 973372 - RNA, 22 nt, Human
caggccugaguguggaagucuu

SEQ ID NO: 973373 - RNA, 22 nt, Human
aggaagcuaaccagggagugag

SEQ ID NO: 973374 - RNA, 22 nt, Human
ggcaucuccaaaacaugaacuc

SEQ ID NO: 973375 - RNA, 22 nt, Human
ccagcagagggucuuggccauu

SEQ ID NO: 973376 - RNA, 22 nt, Human
ugccugggagugaccaagacuc

SEQ ID NO: 973377 - RNA, 22 nt, Human
uuaggaguccagaugucuuggg

SEQ ID NO: 973378 - RNA, 22 nt, Human
uccaguggagugugggggugaa

SEQ ID NO: 973379 - RNA, 22 nt, Human
cccccagccagcagugcucagc

SEQ ID NO: 973380 - RNA, 18 nt, Human
auccuugaugagaggucu

SEQ ID NO: 973381 - RNA, 22 nt, Human
aggcucugugauccacaaugag

SEQ ID NO: 973382 - RNA, 21 nt, Human
auacauucuauuaagcauuua

SEQ ID NO: 973383 - RNA, 18 nt, Human
gucuggaggucaggagcu

SEQ ID NO: 973384 - RNA, 21 nt, Human
gaggccacuaauaggggcaga

SEQ ID NO: 973385 - RNA, 22 nt, Human
caaggagaguaauugaaugaga

SEQ ID NO: 973386 - RNA, 22 nt, Human
cugagccagagggagucggguc

SEQ ID NO: 973387 - RNA, 22 nt, Human
uccuugaaaggggcugcagggc

SEQ ID NO: 973388 - RNA, 22 nt, Human
cagcuuggaggaggaucuaaga

SEQ ID NO: 973389 - RNA, 22 nt, Human
aggagcuguuuuguucagcaaa

SEQ ID NO: 973390 - RNA, 22 nt, Human
aaggccugggaggccucucuuc

SEQ ID NO: 973391 - RNA, 22 nt, Human
aagucaauuuauguucucagac

SEQ ID NO: 973392 - RNA, 22 nt, Human
aaaguucugggggagaagaacg

SEQ ID NO: 973393 - RNA, 22 nt, Human
ucuggcuccaccuccuuuacua

SEQ ID NO: 973394 - RNA, 22 nt, Human
uagcuguguaagcuugguaaga

SEQ ID NO: 973395 - RNA, 22 nt, Human
ccugagacaugaaccaggcucc

SEQ ID NO: 973396 - RNA, 22 nt, Human
uagaaaugaauguuuaaaaguc

SEQ ID NO: 973397 - RNA, 22 nt, Human
ggugcagcugcagccugggagc

SEQ ID NO: 973398 - RNA, 22 nt, Human
ucagagugguagccuauuuucu

SEQ ID NO: 973399 - RNA, 22 nt, Human
acaaaugucuccucuuuuguua

SEQ ID NO: 973400 - RNA, 22 nt, Human
cuggccacuggagguggcaccc

SEQ ID NO: 973401 - RNA, 22 nt, Human
caaaaguaauugcaguuuuugc

SEQ ID NO: 973402 - RNA, 22 nt, Human
aucuacagugcacaggacagcc

SEQ ID NO: 973403 - RNA, 22 nt, Human
uguaugcaaauuuauuagcaca

SEQ ID NO: 973404 - RNA, 22 nt, Human
agagacugcgugucagcgcugg

SEQ ID NO: 973405 - RNA, 22 nt, Human
uugucccaggacuugcauagau

SEQ ID NO: 973406 - RNA, 22 nt, Human
cugccucuguugggcauggucu

SEQ ID NO: 973407 - RNA, 22 nt, Human
aauguacaaaagucagccaacu

SEQ ID NO: 973408 - RNA, 20 nt, Human
cucaguguggccugaguguu

SEQ ID NO: 973409 - RNA, 22 nt, Human
gagcacugauuuauuuuugucu

SEQ ID NO: 973410 - RNA, 22 nt, Human
gaggccagcuaguccaggaagu

SEQ ID NO: 973411 - RNA, 22 nt, Human
ucuggcucaucucuccagguaa

SEQ ID NO: 973412 - RNA, 22 nt, Human
ggcucagacucccaggcccucu

SEQ ID NO: 973413 - RNA, 23 nt, Human
uggaggaaacacaucagaagacc

SEQ ID NO: 973414 - RNA, 23 nt, Human
uucuuucaagaaguucacagugc

SEQ ID NO: 973415 - RNA, 22 nt, Human
auugucuuuggugcuuccagga

SEQ ID NO: 973416 - RNA, 22 nt, Human
agaggcugagaaacccucuucu

SEQ ID NO: 973417 - RNA, 22 nt, Human
uuucaguuuaugucuugaauua

SEQ ID NO: 973418 - RNA, 22 nt, Human
aaguugaagcaugaaccaaggu

SEQ ID NO: 973419 - RNA, 22 nt, Human
uggccugccccgagauccuggc

SEQ ID NO: 973420 - RNA, 22 nt, Human
uuuacugugcauuagaaucacc

SEQ ID NO: 973421 - RNA, 21 nt, Human
gcagagccggggcgagaaggc

SEQ ID NO: 973422 - RNA, 22 nt, Human
ugggagcagcagggagaugcgg

SEQ ID NO: 973423 - RNA, 22 nt, Human
ccagccuccauguagauagcug

SEQ ID NO: 973424 - RNA, 22 nt, Human
gcuggugagcaaaggagaagga

SEQ ID NO: 973425 - RNA, 20 nt, Human
uggagccacagucagguucc

SEQ ID NO: 973426 - RNA, 22 nt, Human
ugcugccaccugguggcugaag

SEQ ID NO: 973427 - RNA, 22 nt, Human
gccucugcaccaguacugugcc

SEQ ID NO: 973428 - RNA, 22 nt, Human
cagcugaguuuccaagucugcc

SEQ ID NO: 973429 - RNA, 22 nt, Human
ugggcacuguagcuggugcugg

SEQ ID NO: 973430 - RNA, 22 nt, Human
uuagauauguuuuugcuaaugc

SEQ ID NO: 973431 - RNA, 22 nt, Human
ggggauggaauguaguagugau

SEQ ID NO: 973432 - RNA, 18 nt, Human
uuucacaaccuccagagg

SEQ ID NO: 973433 - RNA, 22 nt, Human
uagcagaagaaauucagaguug

SEQ ID NO: 973434 - RNA, 22 nt, Human
ggagcugcucagagccaguccc

SEQ ID NO: 973435 - RNA, 22 nt, Human
acaauguaggauauguacuugu

SEQ ID NO: 973436 - RNA, 22 nt, Human
cagcaagauuuuuaaagcaagg

SEQ ID NO: 973437 - RNA, 22 nt, Human
uggcucugggaaucuguugcuu

SEQ ID NO: 973438 - RNA, 22 nt, Human
uccucacauggugagccacaca

SEQ ID NO: 973439 - RNA, 22 nt, Human
ucaggcaguagaauugcuugaa

SEQ ID NO: 973440 - RNA, 21 nt, Human
cauugucgacauuuuccccuc

SEQ ID NO: 973441 - RNA, 22 nt, Human
gcucugcugcuuacuagauggu

SEQ ID NO: 973442 - RNA, 22 nt, Human
cuucugaggcagcuauucaguu

SEQ ID NO: 973443 - RNA, 22 nt, Human
ugaaaugagcauuuauucuuua

SEQ ID NO: 973444 - RNA, 20 nt, Human
uguuccaagcuaaugaauga

SEQ ID NO: 973445 - RNA, 22 nt, Human
auuuguaagcuagagccaugau

SEQ ID NO: 973446 - RNA, 20 nt, Human
acaggagaucugaggaaagg

SEQ ID NO: 973447 - RNA, 22 nt, Human
cagugcaugaaacaauaugcag

SEQ ID NO: 973448 - RNA, 22 nt, Human
gaggcagcggcucacagagaaa

SEQ ID NO: 973449 - RNA, 18 nt, Human
gagagggaucccucagga

SEQ ID NO: 973450 - RNA, 22 nt, Human
gagggucccgagcccugucaga

SEQ ID NO: 973451 - RNA, 22 nt, Human
auguaucagaaauagcauuggc

SEQ ID NO: 973452 - RNA, 22 nt, Human
ccagggugaggaggcucccacg

SEQ ID NO: 973453 - RNA, 22 nt, Human
agugcacaccuuaguacaaagu

SEQ ID NO: 973454 - RNA, 22 nt, Human
gagcucagcacuaaaaucaugu

SEQ ID NO: 973455 - RNA, 22 nt, Human
ugacuucaaaggcucuacuccu

SEQ ID NO: 973456 - RNA, 22 nt, Human
ugcuugagacacauaugaauuu

SEQ ID NO: 973457 - RNA, 22 nt, Human
aaugauguauguauaaggcagg

SEQ ID NO: 973458 - RNA, 22 nt, Human
cuggccgguauuugccucuggg

SEQ ID NO: 973459 - RNA, 23 nt, Human
uccaggagaaccccugucugucc

SEQ ID NO: 973460 - RNA, 22 nt, Human
gcaaugauauugaagugaugaa

SEQ ID NO: 973461 - RNA, 21 nt, Human
agauuguauggaggugagagg

SEQ ID NO: 973462 - RNA, 22 nt, Human
uggcccugacugauguggaggg

SEQ ID NO: 973463 - RNA, 22 nt, Human
uggagcccagacacuggcauug

SEQ ID NO: 973464 - RNA, 22 nt, Human
aggauccuccuuagaaaagacc

SEQ ID NO: 973465 - RNA, 22 nt, Human
cagggcagagccaggauuucaa

SEQ ID NO: 973466 - RNA, 18 nt, Human
ucauuuguuuugcaugaa

SEQ ID NO: 973467 - RNA, 22 nt, Human
gaaggcuggcuuucugagagca

SEQ ID NO: 973468 - RNA, 22 nt, Human
cugcugcaggaugggcacucug

SEQ ID NO: 973469 - RNA, 22 nt, Human
gccucugcacuguggcacacca

SEQ ID NO: 973470 - RNA, 22 nt, Human
cagcagagcugggcuuugaauu

SEQ ID NO: 973471 - RNA, 22 nt, Human
ucacaaaagcuuuugaauuugg

SEQ ID NO: 973472 - RNA, 22 nt, Human
cuguccuccggccaccuacagu

SEQ ID NO: 973473 - RNA, 22 nt, Human
ucuuagaaguucauguuccagc

SEQ ID NO: 973474 - RNA, 22 nt, Human
gggaggaggaauguuuugugua

SEQ ID NO: 973475 - RNA, 22 nt, Human
auuuucagagacaucuggacuu

SEQ ID NO: 973476 - RNA, 22 nt, Human
cacugcuuucacaguuuguucc

SEQ ID NO: 973477 - RNA, 18 nt, Human
cuucagugacagucuggc

SEQ ID NO: 973478 - RNA, 22 nt, Human
agcaccugcuuaaugugcagug

SEQ ID NO: 973479 - RNA, 22 nt, Human
cuuccugaacaaugccaucaau

SEQ ID NO: 973480 - RNA, 22 nt, Human
uuccuuaguugacugucuuagu

SEQ ID NO: 973481 - RNA, 22 nt, Human
cugaggaagacagcagcugugu

SEQ ID NO: 973482 - RNA, 22 nt, Human
gccugugacucgucuugggcca

SEQ ID NO: 973483 - RNA, 22 nt, Human
uggaagcaucacuucuugccug

SEQ ID NO: 973484 - RNA, 19 nt, Human
agacacacuugauaugugu

SEQ ID NO: 973485 - RNA, 22 nt, Human
uaaauaaguucuucauuguuug

SEQ ID NO: 973486 - RNA, 22 nt, Human
gcucuguacgcaggaugagggg

SEQ ID NO: 973487 - RNA, 22 nt, Human
cugagccaccggcagggacauc

SEQ ID NO: 973488 - RNA, 22 nt, Human
aggcaggcucaggcccaugcuu

SEQ ID NO: 973489 - RNA, 22 nt, Human
uauuucagcacaugggauaggu

SEQ ID NO: 973490 - RNA, 22 nt, Human
ucagggacuuacaaaccagaag

SEQ ID NO: 973491 - RNA, 22 nt, Human
aggccuggccccaguugcuagg

SEQ ID NO: 973492 - RNA, 22 nt, Human
ccucucuguaagggucccuccc

SEQ ID NO: 973493 - RNA, 22 nt, Human
ccaagggcucugacuugccugc

SEQ ID NO: 973494 - RNA, 22 nt, Human
cccuggaggagcuuagagcuug

SEQ ID NO: 973495 - RNA, 22 nt, Human
agagaauuacagaagaauguca

SEQ ID NO: 973496 - RNA, 22 nt, Human
agauacauugaguuuccuccug

SEQ ID NO: 973497 - RNA, 22 nt, Human
agggugguucuuuuaguggaag

SEQ ID NO: 973498 - RNA, 22 nt, Human
ugaaaugagagcacagaauaaa

SEQ ID NO: 973499 - RNA, 20 nt, Human
cccaggagugagcagcuuua

SEQ ID NO: 973500 - RNA, 22 nt, Human
agaggccagguccagaguuugu

SEQ ID NO: 973501 - RNA, 22 nt, Human
uuuauuguuuagaagggggcug

SEQ ID NO: 973502 - RNA, 22 nt, Human
uugguuuacuaggauucaaauu

SEQ ID NO: 973503 - RNA, 22 nt, Human
aggaagcuagagccaccggacu

SEQ ID NO: 973504 - RNA, 23 nt, Human
ggaaagagaggaguugugcauag

SEQ ID NO: 973505 - RNA, 22 nt, Human
guccuggguccccgcaggucag

SEQ ID NO: 973506 - RNA, 22 nt, Human
caggcgagugaacagacucuca

SEQ ID NO: 973507 - RNA, 22 nt, Human
cccaggaggugugcccaacucg

SEQ ID NO: 973508 - RNA, 22 nt, Human
gcccagcuuuuugaggcaggca

SEQ ID NO: 973509 - RNA, 22 nt, Human
gcaucuaaacuugcaucauugu

SEQ ID NO: 973510 - RNA, 22 nt, Human
uagaaucuaguucauucauuug

SEQ ID NO: 973511 - RNA, 21 nt, Human
acagaggcauacagcuuaagg

SEQ ID NO: 973512 - RNA, 21 nt, Human
ggagucauuagucauuuccuu

SEQ ID NO: 973513 - RNA, 22 nt, Human
uaacagaaaggcucaggugcuc

SEQ ID NO: 973514 - RNA, 22 nt, Human
caggcacucagucuggaucccu

SEQ ID NO: 973515 - RNA, 22 nt, Human
guccuggcuuaguucgcuguaa

SEQ ID NO: 973516 - RNA, 22 nt, Human
cugccuggucucaggcaugggg

SEQ ID NO: 973517 - RNA, 22 nt, Human
agaggcacagaggcaguccccu

SEQ ID NO: 973518 - RNA, 22 nt, Human
ucacucugagaggucacuggaa

SEQ ID NO: 973519 - RNA, 22 nt, Human
ccuggcucucugcagauccugg

SEQ ID NO: 973520 - RNA, 22 nt, Human
aauuuuaaucaguggugcugag

SEQ ID NO: 973521 - RNA, 22 nt, Human
acagagcacugcccugugccgc

SEQ ID NO: 973522 - RNA, 22 nt, Human
acuggcagagguuggacaccau

SEQ ID NO: 973523 - RNA, 22 nt, Human
cagaggcuaagaugagugggug

SEQ ID NO: 973524 - RNA, 22 nt, Human
uuuacuguuuacagcuaaugca

SEQ ID NO: 973525 - RNA, 22 nt, Human
uuuguaagcaaguuaacauuuu

SEQ ID NO: 973526 - RNA, 22 nt, Human
ggguguguuccuaaggaaacca

SEQ ID NO: 973527 - RNA, 22 nt, Human
ggaugcugacuuuggagcaugg

SEQ ID NO: 973528 - RNA, 22 nt, Human
ugucucagaguaucccugaacu

SEQ ID NO: 973529 - RNA, 22 nt, Human
ccagagccuggcaucugcauaa

SEQ ID NO: 973530 - RNA, 22 nt, Human
ggccagcucuuguccacggagg

SEQ ID NO: 973531 - RNA, 22 nt, Human
gccaggcagcagcgaggauggu

SEQ ID NO: 973532 - RNA, 22 nt, Human
cuuggcugucuauaggaaagag

SEQ ID NO: 973533 - RNA, 22 nt, Human
ggagugucagaaacaguguccu

SEQ ID NO: 973534 - RNA, 22 nt, Human
aaauuucaagcaaaguagcuau

SEQ ID NO: 973535 - RNA, 22 nt, Human
gauucugagcugguguuuuacg

SEQ ID NO: 973536 - RNA, 21 nt, Human
uguaugcacgcacaugcacac

SEQ ID NO: 973537 - RNA, 22 nt, Human
cugcucucuguuccccuggauc

SEQ ID NO: 973538 - RNA, 22 nt, Human
cugcugcauuccucuuuaugag

SEQ ID NO: 973539 - RNA, 22 nt, Human
gccuggcaggggccugggagug

SEQ ID NO: 973540 - RNA, 22 nt, Human
cuguccccgcgaguccagagcu

SEQ ID NO: 973541 - RNA, 22 nt, Human
ugcagagguguugcugagauaa

SEQ ID NO: 973542 - RNA, 22 nt, Human
aggccagggucccacacucgca

SEQ ID NO: 973543 - RNA, 22 nt, Human
aaucagucauuagcucugaccu

SEQ ID NO: 973544 - RNA, 22 nt, Human
uucaaucauuagaaucucaggc

SEQ ID NO: 973545 - RNA, 22 nt, Human
gaguuuaaauaacacauuucca

SEQ ID NO: 973546 - RNA, 23 nt, Human
auaauaacgucugucuugucucu

SEQ ID NO: 973547 - RNA, 21 nt, Human
cccuugccugcacuccucggc

SEQ ID NO: 973548 - RNA, 21 nt, Human
uaaauaauaaguugcugagau

SEQ ID NO: 973549 - RNA, 22 nt, Human
uccagggauguccuguagcacu

SEQ ID NO: 973550 - RNA, 22 nt, Human
cuguacaggugaggagggggcu

SEQ ID NO: 973551 - RNA, 22 nt, Human
uccaggcauaaugcccaguggu

SEQ ID NO: 973552 - RNA, 22 nt, Human
cagcugccccgcuggcugacca

SEQ ID NO: 973553 - RNA, 22 nt, Human
agaugaaaauacgugacuuuaa

SEQ ID NO: 973554 - RNA, 22 nt, Human
uauuuauucauucagcaagcau

SEQ ID NO: 973555 - RNA, 22 nt, Human
agugcuuuaccuagauaauguu

SEQ ID NO: 973556 - RNA, 22 nt, Human
uagugcuuaacacaaagugauu

SEQ ID NO: 973557 - RNA, 22 nt, Human
uggggcgcgagguccuggcucc

SEQ ID NO: 973558 - RNA, 22 nt, Human
gccucugcgccucagccgaccu

SEQ ID NO: 973559 - RNA, 22 nt, Human
ugcauuauuugcaugugccugu

SEQ ID NO: 973560 - RNA, 22 nt, Human
ggcaaaaaccacaauuacuuuu

SEQ ID NO: 973561 - RNA, 22 nt, Human
gccaggcuggaaagaacagaca

SEQ ID NO: 973562 - RNA, 22 nt, Human
ggccuggcucuugcccagccug

SEQ ID NO: 973563 - RNA, 22 nt, Human
agagcuuagaauuucagaugau

SEQ ID NO: 973564 - RNA, 22 nt, Human
ugaggcagcuuuuucugugugu

SEQ ID NO: 973565 - RNA, 22 nt, Human
ugaaaugauaucugauaacaaa

SEQ ID NO: 973566 - RNA, 22 nt, Human
caaucagauaugugacauauuu

SEQ ID NO: 973567 - RNA, 22 nt, Human
uggcucagucuggguugacuga

SEQ ID NO: 973568 - RNA, 17 nt, Human
ggcugcugugcuggugc

SEQ ID NO: 973569 - RNA, 22 nt, Human
guccugucccccaaggcugugg

SEQ ID NO: 973570 - RNA, 22 nt, Human
gaccauuuuuacagagcauuca

SEQ ID NO: 973571 - RNA, 22 nt, Human
aaauugugcucacacugauauu

SEQ ID NO: 973572 - RNA, 22 nt, Human
aacuucuugguccugagcuguu

SEQ ID NO: 973573 - RNA, 22 nt, Human
uuugcaguagacaucuuauuuu

SEQ ID NO: 973574 - RNA, 22 nt, Human
uugcauugggagugaggagacc

SEQ ID NO: 973575 - RNA, 22 nt, Human
cgcuggggcuuuuugcuugaga

SEQ ID NO: 973576 - RNA, 22 nt, Human
uucugaaccauugagcacugcc

SEQ ID NO: 973577 - RNA, 22 nt, Human
uuccuucucagcccucgaggau

SEQ ID NO: 973578 - RNA, 18 nt, Human
gaggcagcuagcaauuuu

SEQ ID NO: 973579 - RNA, 22 nt, Human
augucacagcucccauuccucc

SEQ ID NO: 973580 - RNA, 17 nt, Human
ucuccuggcucuaucag

SEQ ID NO: 973581 - RNA, 22 nt, Human
agaauaguggcaaugacugcac

SEQ ID NO: 973582 - RNA, 22 nt, Human
cagcccugccauggagccuccu

SEQ ID NO: 973583 - RNA, 22 nt, Human
gagcagcucgagaaggaagcag

SEQ ID NO: 973584 - RNA, 19 nt, Human
uuuaggauaaagucuggac

SEQ ID NO: 973585 - RNA, 22 nt, Human
acuguucauauucuuagaaauu

SEQ ID NO: 973586 - RNA, 22 nt, Human
gccaggugcuaucccugcgcug

SEQ ID NO: 973587 - RNA, 19 nt, Human
cuggggcuuugguacugcc

SEQ ID NO: 973588 - RNA, 22 nt, Human
ggcagcuaguuuaagaaagagg

SEQ ID NO: 973589 - RNA, 22 nt, Human
ggucacaggggagaagagugau

SEQ ID NO: 973590 - RNA, 22 nt, Human
uaacacugguauuucauuuagu

SEQ ID NO: 973591 - RNA, 22 nt, Human
cccacucuggcucccuucuagu

SEQ ID NO: 973592 - RNA, 22 nt, Human
guugaaagaucauguggcugcc

SEQ ID NO: 973593 - RNA, 22 nt, Human
cuggcagcagcuucuggaucga

SEQ ID NO: 973594 - RNA, 22 nt, Human
ucuccuggaagaauaccacacu

SEQ ID NO: 973595 - RNA, 22 nt, Human
cagggugccucccgcucgccgg

SEQ ID NO: 973596 - RNA, 22 nt, Human
gcuggcuguguuucaucucuga

SEQ ID NO: 973597 - RNA, 22 nt, Human
uuauguagcagaaagauguuug

SEQ ID NO: 973598 - RNA, 22 nt, Human
guggcugcuaagucuccuuccu

SEQ ID NO: 973599 - RNA, 22 nt, Human
ugaagcagagaauuugacaguc

SEQ ID NO: 973600 - RNA, 22 nt, Human
uucauguauuuaucauguaaau

SEQ ID NO: 973601 - RNA, 22 nt, Human
ggaaaugacuuggugcuucguu

SEQ ID NO: 973602 - RNA, 22 nt, Human
uauaucaccaaaaacaguucug

SEQ ID NO: 973603 - RNA, 22 nt, Human
gucccagggaagaaggcagcac

SEQ ID NO: 973604 - RNA, 22 nt, Human
aaaucugguucaguaaguccuc

SEQ ID NO: 973605 - RNA, 22 nt, Human
uauuuccaaaagccuauuauga

SEQ ID NO: 973606 - RNA, 22 nt, Human
uacugccuggagcauuggugcu

SEQ ID NO: 973607 - RNA, 22 nt, Human
uuguuuaauaucgugaaguacu

SEQ ID NO: 973608 - RNA, 22 nt, Human
auuugucucugcacuuuacuca

SEQ ID NO: 973609 - RNA, 22 nt, Human
uuuaucagagauauguguggac

SEQ ID NO: 973610 - RNA, 22 nt, Human
caugcacagugauaucugaaga

SEQ ID NO: 973611 - RNA, 22 nt, Human
cugagcuggucuauggacuugg

SEQ ID NO: 973612 - RNA, 22 nt, Human
uuauccaagcagaagcugcaca

SEQ ID NO: 973613 - RNA, 22 nt, Human
agucucugcacaguaagaagca

SEQ ID NO: 973614 - RNA, 22 nt, Human
ccugggucuugguucaugcucu

SEQ ID NO: 973615 - RNA, 22 nt, Human
uggcagcuauuacaaggaaguc

SEQ ID NO: 973616 - RNA, 22 nt, Human
uauuauguagaguaaggguuaa

SEQ ID NO: 973617 - RNA, 22 nt, Human
cagcagguauguuuguucagca

SEQ ID NO: 973618 - RNA, 22 nt, Human
acaaaguuauucuuucagagga

SEQ ID NO: 973619 - RNA, 22 nt, Human
uuccucaucugugcaccucacu

SEQ ID NO: 973620 - RNA, 22 nt, Human
cucugugcccuacugcucagcu

SEQ ID NO: 973621 - RNA, 22 nt, Human
gagagucuaggaaccucauaua

SEQ ID NO: 973622 - RNA, 22 nt, Human
cugggaaggggaagguccucuc

SEQ ID NO: 973623 - RNA, 22 nt, Human
gggcauggaggucugucugcag

SEQ ID NO: 973624 - RNA, 22 nt, Human
ggacaagccugugaguggguuu

SEQ ID NO: 973625 - RNA, 22 nt, Human
guccucuggaagaugaguucuu

SEQ ID NO: 973626 - RNA, 22 nt, Human
ccuccagcgcgauccacuccgg

SEQ ID NO: 973627 - RNA, 22 nt, Human
agaaaugggccuugggacacaa

SEQ ID NO: 973628 - RNA, 22 nt, Human
uugaaaggguuaaagugguaaa

SEQ ID NO: 973629 - RNA, 22 nt, Human
agccaugcaccuuacucuugcu

SEQ ID NO: 973630 - RNA, 17 nt, Human
cagggcugucugccuag

SEQ ID NO: 973631 - RNA, 22 nt, Human
gagugaaaaaggaagggccaua

SEQ ID NO: 973632 - RNA, 22 nt, Human
cgcagggauuucaaggggccuu

SEQ ID NO: 973633 - RNA, 22 nt, Human
gagaggcuaugagguucugugu

SEQ ID NO: 973634 - RNA, 22 nt, Human
ggcugcagauagccagccacca

SEQ ID NO: 973635 - RNA, 22 nt, Human
cugucuguuuuaccuucuccag

SEQ ID NO: 973636 - RNA, 22 nt, Human
guccuggggauuauagaguguu

SEQ ID NO: 973637 - RNA, 17 nt, Human
gagugcugguggagcuc

SEQ ID NO: 973638 - RNA, 22 nt, Human
auggccuggggagcaugggaag

SEQ ID NO: 973639 - RNA, 22 nt, Human
gggcccuggggccugauuugca

SEQ ID NO: 973640 - RNA, 20 nt, Human
caguccaaucagaggccacc

SEQ ID NO: 973641 - RNA, 22 nt, Human
auuuuacuacuccaauuaauga

SEQ ID NO: 973642 - RNA, 22 nt, Human
ggggcacacuuuugguagauau

SEQ ID NO: 973643 - RNA, 22 nt, Human
ugaaaucugucccacuuuagcu

SEQ ID NO: 973644 - RNA, 22 nt, Human
ucuggagccuuggaugggaaag

SEQ ID NO: 973645 - RNA, 22 nt, Human
gugcagugagcagugcagcacc

SEQ ID NO: 973646 - RNA, 22 nt, Human
uuugacauugccaauuugcuca

SEQ ID NO: 973647 - RNA, 22 nt, Human
ccagccuucugagcugccugga

SEQ ID NO: 973648 - RNA, 17 nt, Human
gccuggcccagccuggc

SEQ ID NO: 973649 - RNA, 22 nt, Human
aauaaauguuaagauugucuca

SEQ ID NO: 973650 - RNA, 22 nt, Human
cauaacauccuugcuacuuuga

SEQ ID NO: 973651 - RNA, 22 nt, Human
uacaaagugagcaaccucuuuu

SEQ ID NO: 973652 - RNA, 22 nt, Human
gagccagcuauguagcaagagg

SEQ ID NO: 973653 - RNA, 22 nt, Human
ucacaggguuuggaagccuccu

SEQ ID NO: 973654 - RNA, 22 nt, Human
cuuuaagagaucaccaaucaca

SEQ ID NO: 973655 - RNA, 22 nt, Human
ugugucagaaggcaauggggau

SEQ ID NO: 973656 - RNA, 22 nt, Human
agagcuguagcuuccuagagcc

SEQ ID NO: 973657 - RNA, 22 nt, Human
aacuacuaccacagucaagaca

SEQ ID NO: 973658 - RNA, 22 nt, Human
ugaggggagcuagcaugccuug

SEQ ID NO: 973659 - RNA, 22 nt, Human
agggcugccauuucuggcccaa

SEQ ID NO: 973660 - RNA, 22 nt, Human
gcagcugcuggagggaggcagg

SEQ ID NO: 973661 - RNA, 22 nt, Human
ugucccagucaaggcugucauc

SEQ ID NO: 973662 - RNA, 22 nt, Human
uguagcucuccagccagcaagg

SEQ ID NO: 973663 - RNA, 22 nt, Human
agacuucucaguuuuauuagua

SEQ ID NO: 973664 - RNA, 22 nt, Human
cuuuggcacagucucauuugau

SEQ ID NO: 973665 - RNA, 22 nt, Human
ggaggccaaggcaggcggauca

SEQ ID NO: 973666 - RNA, 22 nt, Human
gucacacucagaaugacuagag

SEQ ID NO: 973667 - RNA, 22 nt, Human
uccauuuuagagaugaagaaac

SEQ ID NO: 973668 - RNA, 22 nt, Human
aggagggaccuaggaauauugc

SEQ ID NO: 973669 - RNA, 22 nt, Human
cacagggcuaaaugaaggguug

SEQ ID NO: 973670 - RNA, 22 nt, Human
gcaggaagcauagaagaaugcc

SEQ ID NO: 973671 - RNA, 22 nt, Human
cagguggggagaguguggagca

SEQ ID NO: 973672 - RNA, 22 nt, Human
gcugucugagaacaugguggaa

SEQ ID NO: 973673 - RNA, 23 nt, Human
gggcaguuauguuguccuuggcu

SEQ ID NO: 973674 - RNA, 22 nt, Human
ucuggccuacuggaguccauga

SEQ ID NO: 973675 - RNA, 22 nt, Human
ggccucaguuucuccauggguu

SEQ ID NO: 973676 - RNA, 22 nt, Human
aguggcaguagaugagcugguu

SEQ ID NO: 973677 - RNA, 22 nt, Human
auguauguuaguguauuaucua

SEQ ID NO: 973678 - RNA, 22 nt, Human
cagggcagaacauauagauagu

SEQ ID NO: 973679 - RNA, 19 nt, Human
ggccccucucacaggaguu

SEQ ID NO: 973680 - RNA, 22 nt, Human
aagcaauagcaacaacuuuaca

SEQ ID NO: 973681 - RNA, 22 nt, Human
augcaguaaaauaggagguaau

SEQ ID NO: 973682 - RNA, 22 nt, Human
cccaaggacacgggcagggaca

SEQ ID NO: 973683 - RNA, 22 nt, Human
gacuccugccuccucuguuugc

SEQ ID NO: 973684 - RNA, 22 nt, Human
uccauucauucauugaugaaca

SEQ ID NO: 973685 - RNA, 22 nt, Human
aaggagcuuguucgccuuccuc

SEQ ID NO: 973686 - RNA, 22 nt, Human
cagccuuuuaggacuauuugug

SEQ ID NO: 973687 - RNA, 22 nt, Human
gacagaagaggaacuuggacag

SEQ ID NO: 973688 - RNA, 22 nt, Human
augcacccagugucuggacuau

SEQ ID NO: 973689 - RNA, 22 nt, Human
ugaaguccuagaacuccuggua

SEQ ID NO: 973690 - RNA, 22 nt, Human
uuucagugcuucuguuuaccgg

SEQ ID NO: 973691 - RNA, 22 nt, Human
auaucaguaucuauguauuugu

SEQ ID NO: 973692 - RNA, 22 nt, Human
guggccugccgcaccccaauau

SEQ ID NO: 973693 - RNA, 22 nt, Human
aagcugcagacccccugucuca

SEQ ID NO: 973694 - RNA, 22 nt, Human
cagcaccaggcagaccuggagc

SEQ ID NO: 973695 - RNA, 22 nt, Human
aauuaacagagggcuuauuacu

SEQ ID NO: 973696 - RNA, 22 nt, Human
gggguugguuuaaaugcuugag

SEQ ID NO: 973697 - RNA, 21 nt, Human
cugagggccgcagcugggcuc

SEQ ID NO: 973698 - RNA, 22 nt, Human
uuauuuaauuuucucacucaga

SEQ ID NO: 973699 - RNA, 22 nt, Human
uugcacuaggaaaaggcagcca

SEQ ID NO: 973700 - RNA, 22 nt, Human
uccucccacauaggacaauggg

SEQ ID NO: 973701 - RNA, 22 nt, Human
uucaacuauuaugaauaaaauu

SEQ ID NO: 973702 - RNA, 22 nt, Human
accaggagccauagagucaggc

SEQ ID NO: 973703 - RNA, 18 nt, Human
agcugcagaccaggaggu

SEQ ID NO: 973704 - RNA, 22 nt, Human
aagaagagaaaugugcugcugg

SEQ ID NO: 973705 - RNA, 22 nt, Human
ugguccugccccgugcacagag

SEQ ID NO: 973706 - RNA, 22 nt, Human
guauuaggaggaacacaggccu

SEQ ID NO: 973707 - RNA, 22 nt, Human
uuauauaaagauaacuuuucuu

SEQ ID NO: 973708 - RNA, 22 nt, Human
auuuccagugcacugaauagaa

SEQ ID NO: 973709 - RNA, 23 nt, Human
gccugggacugguagugugaccu

SEQ ID NO: 973710 - RNA, 22 nt, Human
cugcuuugaaaauaaacuuguc

SEQ ID NO: 973711 - RNA, 22 nt, Human
cuggccaguuguccuggcuugg

SEQ ID NO: 973712 - RNA, 22 nt, Human
cagagguagccgagugcaaucg

SEQ ID NO: 973713 - RNA, 18 nt, Human
augcuuugcuuacguuau

SEQ ID NO: 973714 - RNA, 22 nt, Human
cuuugcaaacgauuaccacaug

SEQ ID NO: 973715 - RNA, 22 nt, Human
cugcccugggauggucugugcg

SEQ ID NO: 973716 - RNA, 22 nt, Human
cccaaggcauggcaugguggca

SEQ ID NO: 973717 - RNA, 22 nt, Human
augcugaggacaaagagaucaa

SEQ ID NO: 973718 - RNA, 19 nt, Human
ucugccucuggucaggcuc

SEQ ID NO: 973719 - RNA, 20 nt, Human
uauaacaguguugggugugu

SEQ ID NO: 973720 - RNA, 18 nt, Human
ggagagugagaucaaaca

SEQ ID NO: 973721 - RNA, 22 nt, Human
ucacaccuuuuagaauuacuau

SEQ ID NO: 973722 - RNA, 22 nt, Human
agcagcugagaugguaagauuc

SEQ ID NO: 973723 - RNA, 22 nt, Human
caggaugggauguagugggccc

SEQ ID NO: 973724 - RNA, 22 nt, Human
ggcagcaucucuggcagcagcu

SEQ ID NO: 973725 - RNA, 22 nt, Human
ucagaaguacugugcuacaaua

SEQ ID NO: 973726 - RNA, 22 nt, Human
gcagggacgccagggacagcaa

SEQ ID NO: 973727 - RNA, 22 nt, Human
cagggugccaaagaacaaauau

SEQ ID NO: 973728 - RNA, 22 nt, Human
gcucccagcuggagccucaaca

SEQ ID NO: 973729 - RNA, 22 nt, Human
acacauuauaggcaaucaaaag

SEQ ID NO: 973730 - RNA, 22 nt, Human
accaaacaaaauugugcacugu

SEQ ID NO: 973731 - RNA, 22 nt, Human
ugggggugaaagucuggacagu

SEQ ID NO: 973732 - RNA, 22 nt, Human
guucacaagaugugguggggag

SEQ ID NO: 973733 - RNA, 22 nt, Human
aauuuggcagugucuugaagua

SEQ ID NO: 973734 - RNA, 22 nt, Human
agaagccaacagggcaggagag

SEQ ID NO: 973735 - RNA, 22 nt, Human
cacuugggacaaagcuucugcu

SEQ ID NO: 973736 - RNA, 22 nt, Human
uggcaaggcugugggggcagag

SEQ ID NO: 973737 - RNA, 22 nt, Human
uuccaggauagcuuucaggaau

SEQ ID NO: 973738 - RNA, 22 nt, Human
ccacugaggcaggcaguaucua

SEQ ID NO: 973739 - RNA, 20 nt, Human
agcaguaggaccucugggcc

SEQ ID NO: 973740 - RNA, 22 nt, Human
uucauuccuucccuaagcaacu

SEQ ID NO: 973741 - RNA, 22 nt, Human
uugagggucuggaucugcugcu

SEQ ID NO: 973742 - RNA, 22 nt, Human
agcuggagcuucaagcagguaa

SEQ ID NO: 973743 - RNA, 22 nt, Human
ucaucuucuauuaauagggaga

SEQ ID NO: 973744 - RNA, 22 nt, Human
aaaugcacugaacacauguugu

SEQ ID NO: 973745 - RNA, 22 nt, Human
agcugggccugagcuggaagcu

SEQ ID NO: 973746 - RNA, 22 nt, Human
cugcugagguccuugcucagac

SEQ ID NO: 973747 - RNA, 22 nt, Human
ugcagugggccggaggccaggg

SEQ ID NO: 973748 - RNA, 22 nt, Human
agaaauguuuauggcugccuau

SEQ ID NO: 973749 - RNA, 22 nt, Human
auaauucagguuuucuggcaca

SEQ ID NO: 973750 - RNA, 22 nt, Human
agccuggaguucccaggagaag

SEQ ID NO: 973751 - RNA, 22 nt, Human
uucauucuugucuuuguauagu

SEQ ID NO: 973752 - RNA, 22 nt, Human
acacaaugcauauuuuuccaga

SEQ ID NO: 973753 - RNA, 22 nt, Human
gagcccaggcagagguugcagu

SEQ ID NO: 973754 - RNA, 23 nt, Human
uugauuucaaaugcagagaacac

SEQ ID NO: 973755 - RNA, 22 nt, Human
cugggcagugcagcuauagaac

SEQ ID NO: 973756 - RNA, 21 nt, Human
agaaaaaccagcauguuuuca

SEQ ID NO: 973757 - RNA, 21 nt, Human
gcaaggcuuuuguguuuccca

SEQ ID NO: 973758 - RNA, 22 nt, Human
uccaggaggcucugguugacgu

SEQ ID NO: 973759 - RNA, 22 nt, Human
uaaaugugggggccacgggcuu

SEQ ID NO: 973760 - RNA, 22 nt, Human
gcccucagaguuccccacagug

SEQ ID NO: 973761 - RNA, 22 nt, Human
uucacagauguauuggaacucc

SEQ ID NO: 973762 - RNA, 22 nt, Human
cauucuuacacaauauuuuaau

SEQ ID NO: 973763 - RNA, 22 nt, Human
aaggucauuuuuuccucuguug

SEQ ID NO: 973764 - RNA, 19 nt, Human
cccuggcaggcaagccugg

SEQ ID NO: 973765 - RNA, 20 nt, Human
cauuugaaucuccauucugc

SEQ ID NO: 973766 - RNA, 22 nt, Human
augucccuucuuuggugcucag

SEQ ID NO: 973767 - RNA, 22 nt, Human
gugguaauagagcuccaaacua

SEQ ID NO: 973768 - RNA, 22 nt, Human
aaaaugcuauuucauggaggag

SEQ ID NO: 973769 - RNA, 22 nt, Human
cugggccugucagggcuuuuug

SEQ ID NO: 973770 - RNA, 21 nt, Human
ggcagccucuguggaagggga

SEQ ID NO: 973771 - RNA, 22 nt, Human
uccuggccagaggacaaagcug

SEQ ID NO: 973772 - RNA, 22 nt, Human
aagauggagcacgagcagaagc

SEQ ID NO: 973773 - RNA, 22 nt, Human
cugcugcucgaccagucccagg

SEQ ID NO: 973774 - RNA, 22 nt, Human
uuucaguuuuugcucgauguau

SEQ ID NO: 973775 - RNA, 22 nt, Human
aguggcagagccaaguagagcc

SEQ ID NO: 973776 - RNA, 21 nt, Human
gccugccugcgugacccucuu

SEQ ID NO: 973777 - RNA, 22 nt, Human
guggagaccuccuaggaugugu

SEQ ID NO: 973778 - RNA, 19 nt, Human
acauuuaaauucagaucuc

SEQ ID NO: 973779 - RNA, 18 nt, Human
ucaaagucuggcuccacu

SEQ ID NO: 973780 - RNA, 22 nt, Human
uuuaauuaggaaaugggcaggg

SEQ ID NO: 973781 - RNA, 22 nt, Human
gcccacacaccagcucaggagg

SEQ ID NO: 973782 - RNA, 22 nt, Human
acuugggucaaguagcucacag

SEQ ID NO: 973783 - RNA, 22 nt, Human
cagugcauaaucuaaauggggg

SEQ ID NO: 973784 - RNA, 22 nt, Human
uuucuauagcuuucuugggagu

SEQ ID NO: 973785 - RNA, 22 nt, Human
ucuguaaauccugcucagcaac

SEQ ID NO: 973786 - RNA, 22 nt, Human
uccuggcccacuaugccagcau

SEQ ID NO: 973787 - RNA, 22 nt, Human
uccuuuccagccucaccucagc

SEQ ID NO: 973788 - RNA, 23 nt, Human
cuuuccuuucuuugacacccagc

SEQ ID NO: 973789 - RNA, 22 nt, Human
uagcuaucuguguccagaucca

SEQ ID NO: 973790 - RNA, 22 nt, Human
aggcagugcaugcaaaggucgg

SEQ ID NO: 973791 - RNA, 22 nt, Human
auguuucaccaguuuuauaaga

SEQ ID NO: 973792 - RNA, 22 nt, Human
cugugucuguggaauagcgaau

SEQ ID NO: 973793 - RNA, 22 nt, Human
gggaccaggugggugcauuccg

SEQ ID NO: 973794 - RNA, 22 nt, Human
cagacaugauguaagcagaggc

SEQ ID NO: 973795 - RNA, 22 nt, Human
cugcugucgccgagcugcaugc

SEQ ID NO: 973796 - RNA, 22 nt, Human
aaacuguaagagaauaaacuac

SEQ ID NO: 973797 - RNA, 22 nt, Human
caugcuuuaccaaagcagugau

SEQ ID NO: 973798 - RNA, 22 nt, Human
gcugccuuuuaaagccucgcuu

SEQ ID NO: 973799 - RNA, 22 nt, Human
aagauguaucaguuaagucuuc

SEQ ID NO: 973800 - RNA, 22 nt, Human
gcuguccaugucuggccucagu

SEQ ID NO: 973801 - RNA, 22 nt, Human
uguuuuuaaauaaugauagaaa

SEQ ID NO: 973802 - RNA, 22 nt, Human
ugucccagacauaaguggacau

SEQ ID NO: 973803 - RNA, 22 nt, Human
guugacagcuggugagcugcua

SEQ ID NO: 973804 - RNA, 22 nt, Human
ccucucccacguggcagaggcu

SEQ ID NO: 973805 - RNA, 22 nt, Human
uauccuuguacuauaguauuua

SEQ ID NO: 973806 - RNA, 22 nt, Human
aagagcuggucacagguccauu

SEQ ID NO: 973807 - RNA, 22 nt, Human
uuucuucaauugcuaacaagga

SEQ ID NO: 973808 - RNA, 22 nt, Human
cagagcuggagaaguggauuua

SEQ ID NO: 973809 - RNA, 22 nt, Human
gggccccaaaaugccaggcucu

SEQ ID NO: 973810 - RNA, 22 nt, Human
aaagauuaaaucaaauugguca

SEQ ID NO: 973811 - RNA, 20 nt, Human
uugauucaagggcugaugga

SEQ ID NO: 973812 - RNA, 22 nt, Human
ccuggccuccuggccuucucau

SEQ ID NO: 973813 - RNA, 21 nt, Human
guggcccugguguggcugcac

SEQ ID NO: 973814 - RNA, 22 nt, Human
ccuggcagcuaagugcuuugag

SEQ ID NO: 973815 - RNA, 22 nt, Human
agacagugcaagaagagcaggc

SEQ ID NO: 973816 - RNA, 22 nt, Human
acagcagagacacucaggaggc

SEQ ID NO: 973817 - RNA, 22 nt, Human
cagggccagccgcagcauccac

SEQ ID NO: 973818 - RNA, 22 nt, Human
acccaggauagagugcugcagu

SEQ ID NO: 973819 - RNA, 22 nt, Human
guggcugcuacagagcuggagg

SEQ ID NO: 973820 - RNA, 22 nt, Human
uggccuuguguuuuagagaaag

SEQ ID NO: 973821 - RNA, 22 nt, Human
uuuuaaguuaauauaauugagg

SEQ ID NO: 973822 - RNA, 22 nt, Human
uucuucaaugugcccuguuuuc

SEQ ID NO: 973823 - RNA, 22 nt, Human
aaggaaccuggaguagagggag

SEQ ID NO: 973824 - RNA, 22 nt, Human
gcuucccacagcuggacugggg

SEQ ID NO: 973825 - RNA, 22 nt, Human
auuuugaaaccaaguuauuucc

SEQ ID NO: 973826 - RNA, 22 nt, Human
gcucccagggaccgcagggcag

SEQ ID NO: 973827 - RNA, 22 nt, Human
cagaaauguuuauauguggugu

SEQ ID NO: 973828 - RNA, 22 nt, Human
auggagggugguaagacagaga

SEQ ID NO: 973829 - RNA, 22 nt, Human
ccugucagcugauggcuaugua

SEQ ID NO: 973830 - RNA, 22 nt, Human
uuucacaacguuguggugagag

SEQ ID NO: 973831 - RNA, 22 nt, Human
guggccaauaggagcagcuauc

SEQ ID NO: 973832 - RNA, 22 nt, Human
auccuugagccuuaucuuuugu

SEQ ID NO: 973833 - RNA, 22 nt, Human
ggaggccaaagugugggcggcu

SEQ ID NO: 973834 - RNA, 18 nt, Human
aaacuggcuuggccugug

SEQ ID NO: 973835 - RNA, 22 nt, Human
cugggagcgcagcaggcacaac

SEQ ID NO: 973836 - RNA, 22 nt, Human
gaacccaaaccuggaccucccu

SEQ ID NO: 973837 - RNA, 22 nt, Human
cagcuuggcuuccgcuuuacug

SEQ ID NO: 973838 - RNA, 22 nt, Human
aucuggcuuuuacugaauugcu

SEQ ID NO: 973839 - RNA, 22 nt, Human
uuuaacacuaguuucuuuaacu

SEQ ID NO: 973840 - RNA, 20 nt, Human
ucauugcacauaauggaagc

SEQ ID NO: 973841 - RNA, 22 nt, Human
ugaggcuguucuaccagggcca

SEQ ID NO: 973842 - RNA, 22 nt, Human
cugcuguggaugcaggaccuca

SEQ ID NO: 973843 - RNA, 17 nt, Human
ggccuugggcugcucuu

SEQ ID NO: 973844 - RNA, 22 nt, Human
ugcagaggugaaagacuagcaa

SEQ ID NO: 973845 - RNA, 22 nt, Human
gugucccaaagauuagaaauca

SEQ ID NO: 973846 - RNA, 22 nt, Human
ccagggcagccaacccagaugc

SEQ ID NO: 973847 - RNA, 22 nt, Human
ggacaggguaaguacuagugug

SEQ ID NO: 973848 - RNA, 22 nt, Human
uauuucagucacuucuucucug

SEQ ID NO: 973849 - RNA, 22 nt, Human
uuuuugcaccaaccuaauagaa

SEQ ID NO: 973850 - RNA, 22 nt, Human
uauguacauguuaaagggcaaa

SEQ ID NO: 973851 - RNA, 20 nt, Human
ggcagcuugggcagcaguua

SEQ ID NO: 973852 - RNA, 22 nt, Human
gggcagcucagccaccaugcag

SEQ ID NO: 973853 - RNA, 22 nt, Human
ugugacaugugucaucuuuucu

SEQ ID NO: 973854 - RNA, 22 nt, Human
caggcugcagugcaguggcuau

SEQ ID NO: 973855 - RNA, 22 nt, Human
agggggugucucugauuggguu

SEQ ID NO: 973856 - RNA, 22 nt, Human
cucugggcaaguaugauagaaa

SEQ ID NO: 973857 - RNA, 20 nt, Human
aggagaugauccagagucag

SEQ ID NO: 973858 - RNA, 22 nt, Human
gaaugcagauggcugguguaug

SEQ ID NO: 973859 - RNA, 22 nt, Human
uccagggagauacuggcugcca

SEQ ID NO: 973860 - RNA, 22 nt, Human
uuugacagcuuguuacaaaguu

SEQ ID NO: 973861 - RNA, 22 nt, Human
aggugccagcucucaggcagga

SEQ ID NO: 973862 - RNA, 22 nt, Human
ucaaacuagccugacugguauu

SEQ ID NO: 973863 - RNA, 22 nt, Human
ucaaguauaucuagucauuagg

SEQ ID NO: 973864 - RNA, 22 nt, Human
caggugcuguccugcacauguc

SEQ ID NO: 973865 - RNA, 21 nt, Human
uugcaccaugauaaauucaga

SEQ ID NO: 973866 - RNA, 22 nt, Human
ggcagcuccuccuagucugccc

SEQ ID NO: 973867 - RNA, 22 nt, Human
uuuauuauccaguguugucaug

SEQ ID NO: 973868 - RNA, 20 nt, Human
ugaaaggugggaauuguggg

SEQ ID NO: 973869 - RNA, 22 nt, Human
cuccugaguaguagcauuguca

SEQ ID NO: 973870 - RNA, 21 nt, Human
cugcuguggcccccgacaugc

SEQ ID NO: 973871 - RNA, 22 nt, Human
agaggccuaaccaagauguccu

SEQ ID NO: 973872 - RNA, 22 nt, Human
ucacucugggcccuacugggcu

SEQ ID NO: 973873 - RNA, 21 nt, Human
ucucuggaauuagaccauguu

SEQ ID NO: 973874 - RNA, 22 nt, Human
aaagccaugaauguuauagagg

SEQ ID NO: 973875 - RNA, 22 nt, Human
ccaggcagccaagugugugugu

SEQ ID NO: 973876 - RNA, 21 nt, Human
ugaaaguuggagucaaaugua

SEQ ID NO: 973877 - RNA, 22 nt, Human
agggcagcucucaccucuggcc

SEQ ID NO: 973878 - RNA, 22 nt, Human
aaaaucaguacacuuuauuuug

SEQ ID NO: 973879 - RNA, 22 nt, Human
ccugcucagagcgucuugugug

SEQ ID NO: 973880 - RNA, 22 nt, Human
ucauuucaaguucugacagcua

SEQ ID NO: 973881 - RNA, 22 nt, Human
accagagcuggcagaguaucaa

SEQ ID NO: 973882 - RNA, 22 nt, Human
cccaggagguggagguugcagu

SEQ ID NO: 973883 - RNA, 22 nt, Human
agcugccugggcuuguacaccu

SEQ ID NO: 973884 - RNA, 22 nt, Human
aagauucuacaguagguacauu

SEQ ID NO: 973885 - RNA, 22 nt, Human
guggagcccugguagggacccc

SEQ ID NO: 973886 - RNA, 17 nt, Human
acucugcugaaguagaa

SEQ ID NO: 973887 - RNA, 22 nt, Human
ugggagccauuuuagaggcugc

SEQ ID NO: 973888 - RNA, 22 nt, Human
ucagaaaugaucguuauucauu

SEQ ID NO: 973889 - RNA, 19 nt, Human
gcagccaccgcggcggccg

SEQ ID NO: 973890 - RNA, 22 nt, Human
augugaggcagcacggagauua

SEQ ID NO: 973891 - RNA, 22 nt, Human
gaagaagcaggaguguguagca

SEQ ID NO: 973892 - RNA, 22 nt, Human
auguuuaaauuuauagacagug

SEQ ID NO: 973893 - RNA, 22 nt, Human
ccuggcucuguccucgcgcaaa

SEQ ID NO: 973894 - RNA, 22 nt, Human
uggcuuccuggacagaugcggu

SEQ ID NO: 973895 - RNA, 22 nt, Human
uguguuaauuccacaaacauuc

SEQ ID NO: 973896 - RNA, 22 nt, Human
cugggccuagcaacagaggagu

SEQ ID NO: 973897 - RNA, 22 nt, Human
gagggcagugaauuuugaagcu

SEQ ID NO: 973898 - RNA, 22 nt, Human
uucucagauauuuacugagcau

SEQ ID NO: 973899 - RNA, 22 nt, Human
gccuggcccagggcucuuguug

SEQ ID NO: 973900 - RNA, 22 nt, Human
auauauuugagaauauucauga

SEQ ID NO: 973901 - RNA, 22 nt, Human
gaugaaaaucuugagaugucga

SEQ ID NO: 973902 - RNA, 21 nt, Human
aaggaaaagcuuggucucuga

SEQ ID NO: 973903 - RNA, 22 nt, Human
cacagguguucuugcagugaaa

SEQ ID NO: 973904 - RNA, 22 nt, Human
ggucauugucagagccuguacu

SEQ ID NO: 973905 - RNA, 22 nt, Human
aggcucagcaucugauucauau

SEQ ID NO: 973906 - RNA, 22 nt, Human
aggucauugaaguuauuuucuu

SEQ ID NO: 973907 - RNA, 22 nt, Human
uuuguuaaauauuuauugagug

SEQ ID NO: 973908 - RNA, 22 nt, Human
uagcacauuguugaccagaagg

SEQ ID NO: 973909 - RNA, 20 nt, Human
gcuuucaagcuugucauugu

SEQ ID NO: 973910 - RNA, 22 nt, Human
ccucccuggccagagcagcagc

SEQ ID NO: 973911 - RNA, 22 nt, Human
cugggcugcaguuccugguccu

SEQ ID NO: 973912 - RNA, 21 nt, Human
cucuggagucaagagcuucca

SEQ ID NO: 973913 - RNA, 22 nt, Human
aguguuccacacaucuggggaa

SEQ ID NO: 973914 - RNA, 22 nt, Human
gcugccugguuucucagcugca

SEQ ID NO: 973915 - RNA, 22 nt, Human
gcuuccuaaaugcacagggcag

SEQ ID NO: 973916 - RNA, 22 nt, Human
guuuuuccugcugacuuggguc

SEQ ID NO: 973917 - RNA, 22 nt, Human
acagaauugauggaaaucucag

SEQ ID NO: 973918 - RNA, 22 nt, Human
ccuguucaccauggucacgugc

SEQ ID NO: 973919 - RNA, 22 nt, Human
cucagcagcagggaagagguca

SEQ ID NO: 973920 - RNA, 22 nt, Human
aaguucaaggcucuagaguucc

SEQ ID NO: 973921 - RNA, 22 nt, Human
gucaggauguuuauucuccagu

SEQ ID NO: 973922 - RNA, 22 nt, Human
cagacagcugcuuucuugcugu

SEQ ID NO: 973923 - RNA, 22 nt, Human
agauuccagaucccaaaaauga

SEQ ID NO: 973924 - RNA, 22 nt, Human
ggcaagcucaggccucaggugu

SEQ ID NO: 973925 - RNA, 17 nt, Human
uucaagauauugaaaug

SEQ ID NO: 973926 - RNA, 22 nt, Human
ugcagcagcagggaggaggcuc

SEQ ID NO: 973927 - RNA, 22 nt, Human
cuuuauuagauguagacuuucu

SEQ ID NO: 973928 - RNA, 22 nt, Human
ggcuucccuuuccgagaggaga

SEQ ID NO: 973929 - RNA, 22 nt, Human
ugaggcaguucuuacuuguauu

SEQ ID NO: 973930 - RNA, 22 nt, Human
aagcacaaugaacaucuuagau

SEQ ID NO: 973931 - RNA, 22 nt, Human
caggcaggagccagggauucca

SEQ ID NO: 973932 - RNA, 22 nt, Human
cucaggagaugacagaagguau

SEQ ID NO: 973933 - RNA, 22 nt, Human
cagcuuccauaagagauggaga

SEQ ID NO: 973934 - RNA, 22 nt, Human
agaggccagggacacugcucaa

SEQ ID NO: 973935 - RNA, 22 nt, Human
aaucuucacagaaaaaugucug

SEQ ID NO: 973936 - RNA, 22 nt, Human
aggagcagcccacuccuguccu

SEQ ID NO: 973937 - RNA, 22 nt, Human
agcuggagaugcccagcaccgg

SEQ ID NO: 973938 - RNA, 21 nt, Human
cuguggaagggaacuagaggg

SEQ ID NO: 973939 - RNA, 22 nt, Human
agagccuguuuugugggagaug

SEQ ID NO: 973940 - RNA, 22 nt, Human
ucuuagcauuucauaacaacug

SEQ ID NO: 973941 - RNA, 19 nt, Human
ccuggguccacucagacua

SEQ ID NO: 973942 - RNA, 22 nt, Human
ggcagagaugugggucagaauc

SEQ ID NO: 973943 - RNA, 22 nt, Human
ucuuacauauacgucauuuagu

SEQ ID NO: 973944 - RNA, 22 nt, Human
aaggcacuagcaagcugccugg

SEQ ID NO: 973945 - RNA, 22 nt, Human
ucucuucuaauuuucccgagua

SEQ ID NO: 973946 - RNA, 22 nt, Human
ccagcucuuggugcacuuacau

SEQ ID NO: 973947 - RNA, 22 nt, Human
aaaucaaaagacauguguuuua

SEQ ID NO: 973948 - RNA, 22 nt, Human
uaacagaagagcaggcagcccu

SEQ ID NO: 973949 - RNA, 20 nt, Human
ugaaggccagcagcauaggg

SEQ ID NO: 973950 - RNA, 22 nt, Human
gggccuggcaugcagccccguu

SEQ ID NO: 973951 - RNA, 22 nt, Human
auuuaucaccaguuagcugacu

SEQ ID NO: 973952 - RNA, 22 nt, Human
aggcuggcgucaggggcuguac

SEQ ID NO: 973953 - RNA, 22 nt, Human
uugcauguguaauuuuucuaaa

SEQ ID NO: 973954 - RNA, 22 nt, Human
ucccagagcucuggagguugga

SEQ ID NO: 973955 - RNA, 20 nt, Human
ucauuucuugggguuccaag

SEQ ID NO: 973956 - RNA, 22 nt, Human
cagagcuggagcuugaauggag

SEQ ID NO: 973957 - RNA, 22 nt, Human
ucucucuuuuuaaucauguaau

SEQ ID NO: 973958 - RNA, 22 nt, Human
ggcuucuuccugugaacauguu

SEQ ID NO: 973959 - RNA, 22 nt, Human
ucauugcaguugaguuguguua

SEQ ID NO: 973960 - RNA, 22 nt, Human
uccuuggcaugccgucuucucc

SEQ ID NO: 973961 - RNA, 22 nt, Human
cccagccugugacagccguccu

SEQ ID NO: 973962 - RNA, 21 nt, Human
aacugcuggucuuuucugucu

SEQ ID NO: 973963 - RNA, 22 nt, Human
uggcaaacuggaggaagcccug

SEQ ID NO: 973964 - RNA, 22 nt, Human
agcaggugcauggcgagcgcgg

SEQ ID NO: 973965 - RNA, 22 nt, Human
uuuauguuugacaaugaucugg

SEQ ID NO: 973966 - RNA, 22 nt, Human
gagagugagauccuccugggga

SEQ ID NO: 973967 - RNA, 22 nt, Human
auauuaggugcucaauacaugc

SEQ ID NO: 973968 - RNA, 22 nt, Human
cauuucugugacacuuccaucu

SEQ ID NO: 973969 - RNA, 22 nt, Human
ccugacgaaaggcgugcuggag

SEQ ID NO: 973970 - RNA, 22 nt, Human
uacagccucacauuuacuuaca

SEQ ID NO: 973971 - RNA, 22 nt, Human
uagcugccagaccauucuuacu

SEQ ID NO: 973972 - RNA, 22 nt, Human
aggcuagcuuuggcucaguaaa

SEQ ID NO: 973973 - RNA, 22 nt, Human
ccucugaggucauggacuuggc

SEQ ID NO: 973974 - RNA, 17 nt, Human
gcagcagagagacccuc

SEQ ID NO: 973975 - RNA, 22 nt, Human
gcagggucugaggccacagagg

SEQ ID NO: 973976 - RNA, 22 nt, Human
aggccaaagcacagagcuggaa

SEQ ID NO: 973977 - RNA, 22 nt, Human
ccaggugguucaggucaccaua

SEQ ID NO: 973978 - RNA, 22 nt, Human
aaaaaugcugugguagcugugu

SEQ ID NO: 973979 - RNA, 22 nt, Human
uccugggcuuaagugauccucc

SEQ ID NO: 973980 - RNA, 22 nt, Human
auggccaaagccacagcagagg

SEQ ID NO: 973981 - RNA, 22 nt, Human
ggaggggcagccauggaacucc

SEQ ID NO: 973982 - RNA, 22 nt, Human
ccuuugggugaauuccucucuu

SEQ ID NO: 973983 - RNA, 22 nt, Human
gagcucugggaaacaaagugua

SEQ ID NO: 973984 - RNA, 22 nt, Human
cacaagacuuauuuguguagaa

SEQ ID NO: 973985 - RNA, 22 nt, Human
gucaggaucaaauugaaguuau

SEQ ID NO: 973986 - RNA, 22 nt, Human
gcagugggcaacaagagcugga

SEQ ID NO: 973987 - RNA, 22 nt, Human
aaaagguaguugccaaauaagg

SEQ ID NO: 973988 - RNA, 17 nt, Human
uuccuggaagucauucc

SEQ ID NO: 973989 - RNA, 22 nt, Human
ugucucaguauacgaaacacuu

SEQ ID NO: 973990 - RNA, 22 nt, Human
ucuuuuggguucuuaugauuua

SEQ ID NO: 973991 - RNA, 22 nt, Human
cuggggcucucuggaaugcuug

SEQ ID NO: 973992 - RNA, 22 nt, Human
uuucaaugacacaaaagagaaa

SEQ ID NO: 973993 - RNA, 22 nt, Human
uguuuaguaggaguuuaauacu

SEQ ID NO: 973994 - RNA, 22 nt, Human
agugcuguccaguuucacaggu

SEQ ID NO: 973995 - RNA, 22 nt, Human
ugugaagcuggauccuggagcu

SEQ ID NO: 973996 - RNA, 22 nt, Human
acauuucucuuagaguuggacu

SEQ ID NO: 973997 - RNA, 22 nt, Human
ucacuuagauggggaucaucac

SEQ ID NO: 973998 - RNA, 22 nt, Human
cagggcagcuuccuuuguuagg

SEQ ID NO: 973999 - RNA, 22 nt, Human
acaaaagugagugugucucaga

SEQ ID NO: 974000 - RNA, 22 nt, Human
ucucuucuaauuaggguccaug

SEQ ID NO: 974001 - RNA, 22 nt, Human
uuaguuaggaaacaaaguuguu

SEQ ID NO: 974002 - RNA, 22 nt, Human
uuggccaauuuagaacguguug

SEQ ID NO: 974003 - RNA, 22 nt, Human
ugaaagggguugaguuacagcu

SEQ ID NO: 974004 - RNA, 22 nt, Human
aggccaaagcucaccugcagcu

SEQ ID NO: 974005 - RNA, 22 nt, Human
uggcucagccagcccuaggaac

SEQ ID NO: 974006 - RNA, 20 nt, Human
uggagccaaggugugucugg

SEQ ID NO: 974007 - RNA, 22 nt, Human
agaggggaguccuaaucugauu

SEQ ID NO: 974008 - RNA, 22 nt, Human
aagaugauguuguguuuucacu

SEQ ID NO: 974009 - RNA, 21 nt, Human
agcagcagaucuggugagggc

SEQ ID NO: 974010 - RNA, 22 nt, Human
cucugcagaggcccaaggcuga

SEQ ID NO: 974011 - RNA, 22 nt, Human
guuucaaauagguuucagcaaa

SEQ ID NO: 974012 - RNA, 22 nt, Human
ucccucuguguugggcaugccu

SEQ ID NO: 974013 - RNA, 22 nt, Human
gcugcccauuccacuggauggu

SEQ ID NO: 974014 - RNA, 22 nt, Human
ugugugcauucacaugcaugcc

SEQ ID NO: 974015 - RNA, 22 nt, Human
gcugcccaguucugcugcugcc

SEQ ID NO: 974016 - RNA, 22 nt, Human
ggcugccuccucgagacaggau

SEQ ID NO: 974017 - RNA, 22 nt, Human
agaggcagccguauuucaaagg

SEQ ID NO: 974018 - RNA, 22 nt, Human
cugugugcugaaaugcagugag

SEQ ID NO: 974019 - RNA, 22 nt, Human
cccaggagguggaguucacagu

SEQ ID NO: 974020 - RNA, 22 nt, Human
agggccugcaucaggagcuugg

SEQ ID NO: 974021 - RNA, 22 nt, Human
agcugaugccauguggaacagu

SEQ ID NO: 974022 - RNA, 22 nt, Human
uccagccaacugccuagggagc

SEQ ID NO: 974023 - RNA, 22 nt, Human
gaggcagaggaagguggucucu

SEQ ID NO: 974024 - RNA, 19 nt, Human
agucuuucccacucgucuu

SEQ ID NO: 974025 - RNA, 22 nt, Human
gcugagucuugagcacugagca

SEQ ID NO: 974026 - RNA, 22 nt, Human
agguccagcuguugcagccucc

SEQ ID NO: 974027 - RNA, 23 nt, Human
auggagcugguacuagcuaccuc

SEQ ID NO: 974028 - RNA, 22 nt, Human
gggcugggauugcuugcuguga

SEQ ID NO: 974029 - RNA, 22 nt, Human
ugagcccaggaguuggaggcug

SEQ ID NO: 974030 - RNA, 21 nt, Human
gcacagggacagaucaucaca

SEQ ID NO: 974031 - RNA, 22 nt, Human
gugggcuggacccuccugcucc

SEQ ID NO: 974032 - RNA, 22 nt, Human
aagccaggcugcacuugcuggg

SEQ ID NO: 974033 - RNA, 22 nt, Human
cugggcuggcgcauccgacacg

SEQ ID NO: 974034 - RNA, 22 nt, Human
acagcagcaauagcagugacau

SEQ ID NO: 974035 - RNA, 22 nt, Human
aucagcaaucaaauugcagagu

SEQ ID NO: 974036 - RNA, 22 nt, Human
gauaaugaugacaaugacaacc

SEQ ID NO: 974037 - RNA, 22 nt, Human
uggagcagagaugguggccuuc

SEQ ID NO: 974038 - RNA, 22 nt, Human
auccaggcgaaugcagaaggcc

SEQ ID NO: 974039 - RNA, 22 nt, Human
ugccaaucuuugugauaauugc

SEQ ID NO: 974040 - RNA, 19 nt, Human
ucuggagcugaugcaggug

SEQ ID NO: 974041 - RNA, 22 nt, Human
ccacucugauuggucaccucug

SEQ ID NO: 974042 - RNA, 22 nt, Human
cuuggggcagugcuuggcacau

SEQ ID NO: 974043 - RNA, 20 nt, Human
cacagcuugccuuuuaugac

SEQ ID NO: 974044 - RNA, 22 nt, Human
gaggcagcugaaggagugacag

SEQ ID NO: 974045 - RNA, 22 nt, Human
gcuggccauggggagugaggag

SEQ ID NO: 974046 - RNA, 22 nt, Human
ccuggcugcuauagcagcaugu

SEQ ID NO: 974047 - RNA, 22 nt, Human
ucauacaucuuguauaucuauc

SEQ ID NO: 974048 - RNA, 22 nt, Human
ugagcccagagcccuuguaggg

SEQ ID NO: 974049 - RNA, 22 nt, Human
caagagcugcaaauagcgugac

SEQ ID NO: 974050 - RNA, 22 nt, Human
gugcauuuaggucacaugaugu

SEQ ID NO: 974051 - RNA, 22 nt, Human
uggcuggcuagugggcaggauu

SEQ ID NO: 974052 - RNA, 22 nt, Human
uccugccuaccuugcggaggug

SEQ ID NO: 974053 - RNA, 22 nt, Human
uagaaaugcccagauucugcua

SEQ ID NO: 974054 - RNA, 20 nt, Human
gaggccucagccucagcucc

SEQ ID NO: 974055 - RNA, 22 nt, Human
aaacacaucauucaugucguca

SEQ ID NO: 974056 - RNA, 18 nt, Human
ggucuuuaggucaguguc

SEQ ID NO: 974057 - RNA, 22 nt, Human
cucauacauaugccauuccugc

SEQ ID NO: 974058 - RNA, 22 nt, Human
agggcagagagaugaaugggau

SEQ ID NO: 974059 - RNA, 22 nt, Human
ucauccagaaaaaugucuuagc

SEQ ID NO: 974060 - RNA, 22 nt, Human
gcauuuguguucuuccuagagc

SEQ ID NO: 974061 - RNA, 22 nt, Human
gccucugcaggugcgguuaucc

SEQ ID NO: 974062 - RNA, 21 nt, Human
ccugggccaaauucccuggac

SEQ ID NO: 974063 - RNA, 22 nt, Human
gaguuauuuguagggauuauau

SEQ ID NO: 974064 - RNA, 22 nt, Human
uuuuaauucaaagugaauagug

SEQ ID NO: 974065 - RNA, 22 nt, Human
gggcugcacguauucugcucac

SEQ ID NO: 974066 - RNA, 22 nt, Human
ggccaggaagggaagaucagca

SEQ ID NO: 974067 - RNA, 22 nt, Human
gaaggagcuaaagggagcccug

SEQ ID NO: 974068 - RNA, 22 nt, Human
uguaauggaagugggauugcau

SEQ ID NO: 974069 - RNA, 22 nt, Human
gcuucuggaggagcugggcuga

SEQ ID NO: 974070 - RNA, 22 nt, Human
cuccaguaucuguaggaaaagg

SEQ ID NO: 974071 - RNA, 22 nt, Human
acuggccagaacuaagucacau

SEQ ID NO: 974072 - RNA, 22 nt, Human
acauaucuuucccucuccugaa

SEQ ID NO: 974073 - RNA, 20 nt, Human
ucuguucaaaucuuaguucc

SEQ ID NO: 974074 - RNA, 22 nt, Human
uaaaugauaauaaugcuagugu

SEQ ID NO: 974075 - RNA, 22 nt, Human
gauuucaaguaucuugggcgag

SEQ ID NO: 974076 - RNA, 22 nt, Human
aggccaaagcaagacccuguaa

SEQ ID NO: 974077 - RNA, 22 nt, Human
aggauguucgggucacauagcc

SEQ ID NO: 974078 - RNA, 22 nt, Human
caggggcuuaagugacagaagg

SEQ ID NO: 974079 - RNA, 22 nt, Human
gaaaggccagcucacagaugag

SEQ ID NO: 974080 - RNA, 20 nt, Human
cugcucugcuuugcaggugg

SEQ ID NO: 974081 - RNA, 22 nt, Human
uccaggagagguguggggacug

SEQ ID NO: 974082 - RNA, 22 nt, Human
ccucgaccuccccaggcucagg

SEQ ID NO: 974083 - RNA, 22 nt, Human
gcagaggggaagcugaggaauu

SEQ ID NO: 974084 - RNA, 22 nt, Human
cgagcaugaugacggcuguggc

SEQ ID NO: 974085 - RNA, 22 nt, Human
caagcagagacuagauagcugu

SEQ ID NO: 974086 - RNA, 22 nt, Human
gccuaggaguacagaaugguuu

SEQ ID NO: 974087 - RNA, 22 nt, Human
gggagagaugcugauugccaau

SEQ ID NO: 974088 - RNA, 22 nt, Human
cugucauugagccugucagggc

SEQ ID NO: 974089 - RNA, 23 nt, Human
cacugggcccaggguguggaggc

SEQ ID NO: 974090 - RNA, 22 nt, Human
agcucagggcgaucugucucgg

SEQ ID NO: 974091 - RNA, 22 nt, Human
aaugaugggaaggagaaaagca

SEQ ID NO: 974092 - RNA, 22 nt, Human
ucuccugguauguaugcaccug

SEQ ID NO: 974093 - RNA, 22 nt, Human
uagaauaugugguaggaucugg

SEQ ID NO: 974094 - RNA, 22 nt, Human
cacccugggcugggccuguuaa

SEQ ID NO: 974095 - RNA, 22 nt, Human
ugugcccauuacacagaggcau

SEQ ID NO: 974096 - RNA, 22 nt, Human
uguguacagcaggauuucucaa

SEQ ID NO: 974097 - RNA, 22 nt, Human
aguuauagaaccagguccucac

SEQ ID NO: 974098 - RNA, 22 nt, Human
cucaggauagcugcgcagccug

SEQ ID NO: 974099 - RNA, 22 nt, Human
ugcugucugcaacaguacuaca

SEQ ID NO: 974100 - RNA, 22 nt, Human
uuugcauuaucucacuuauaua

SEQ ID NO: 974101 - RNA, 17 nt, Human
aggcuggcucacaggga

SEQ ID NO: 974102 - RNA, 19 nt, Human
ugcagcucagggcaggggc

SEQ ID NO: 974103 - RNA, 22 nt, Human
gaggccuggucuaugagauguu

SEQ ID NO: 974104 - RNA, 22 nt, Human
uuucauuacguguuugacuugu

SEQ ID NO: 974105 - RNA, 22 nt, Human
auaaaacuuauuagaauugugu

SEQ ID NO: 974106 - RNA, 22 nt, Human
uaaaccuugguagcaucuugcu

SEQ ID NO: 974107 - RNA, 22 nt, Human
uucugugauugacauguggcuu

SEQ ID NO: 974108 - RNA, 22 nt, Human
uuguuaaagaugcagauuccau

SEQ ID NO: 974109 - RNA, 22 nt, Human
cagaaugagauaacccagauug

SEQ ID NO: 974110 - RNA, 22 nt, Human
uuuaucuuuaggacuuugcaga

SEQ ID NO: 974111 - RNA, 22 nt, Human
uaugucuuuguccaugugcagu

SEQ ID NO: 974112 - RNA, 22 nt, Human
aggccucagugaucaucaucag

SEQ ID NO: 974113 - RNA, 22 nt, Human
uuugcauuauauuuauagaaga

SEQ ID NO: 974114 - RNA, 22 nt, Human
cacugaaggcugcagcucagcc

SEQ ID NO: 974115 - RNA, 22 nt, Human
cuauugaaaguguacaauucaa

SEQ ID NO: 974116 - RNA, 22 nt, Human
agggaaagguagugaggucaca

SEQ ID NO: 974117 - RNA, 22 nt, Human
ugucacuucaggaaugcaggga

SEQ ID NO: 974118 - RNA, 22 nt, Human
cccagggcccuggacagcuaca

SEQ ID NO: 974119 - RNA, 22 nt, Human
acaugauuuuaguaucauaaua

SEQ ID NO: 974120 - RNA, 22 nt, Human
cugcaggaauucaaagugagcu

SEQ ID NO: 974121 - RNA, 22 nt, Human
cugaacucuuuaugacagcuug

SEQ ID NO: 974122 - RNA, 21 nt, Human
ucacauuucucauggguaaau

SEQ ID NO: 974123 - RNA, 22 nt, Human
cccuuagcuccaagggguuugg

SEQ ID NO: 974124 - RNA, 22 nt, Human
uccuuuuuauaguuagagaaac

SEQ ID NO: 974125 - RNA, 22 nt, Human
gcuccugggcccugggcuaacu

SEQ ID NO: 974126 - RNA, 22 nt, Human
uuagauaacaguagaauaucaa

SEQ ID NO: 974127 - RNA, 22 nt, Human
acuucauuguaauauuauagca

SEQ ID NO: 974128 - RNA, 22 nt, Human
ucauuauuuuggacuggagugu

SEQ ID NO: 974129 - RNA, 22 nt, Human
ccacaucucgguccccucuuug

SEQ ID NO: 974130 - RNA, 22 nt, Human
cugucccaggagcuguaagaca

SEQ ID NO: 974131 - RNA, 22 nt, Human
uggcccugcuaugauccugcaa

SEQ ID NO: 974132 - RNA, 21 nt, Human
uuccagagauuguuucaccug

SEQ ID NO: 974133 - RNA, 22 nt, Human
uauuugaagauucuucugaugu

SEQ ID NO: 974134 - RNA, 22 nt, Human
uuucuauaacuggacuggauug

SEQ ID NO: 974135 - RNA, 20 nt, Human
cugcccagccacugagggau

SEQ ID NO: 974136 - RNA, 22 nt, Human
ucuccuuugaaaguuaggacug

SEQ ID NO: 974137 - RNA, 22 nt, Human
augaaauguuggucccaaucgc

SEQ ID NO: 974138 - RNA, 22 nt, Human
guacauuucucuuguucuuauu

SEQ ID NO: 974139 - RNA, 20 nt, Human
aggcaguuagaaggagauga

SEQ ID NO: 974140 - RNA, 22 nt, Human
gcucacugccauucucuagaug

SEQ ID NO: 974141 - RNA, 22 nt, Human
uucagugugugauaccugcugu

SEQ ID NO: 974142 - RNA, 22 nt, Human
agcucacaguguccuuccucaa

SEQ ID NO: 974143 - RNA, 19 nt, Human
ggcugucucggcccagcca

SEQ ID NO: 974144 - RNA, 22 nt, Human
uugcccagaguccacagcguac

SEQ ID NO: 974145 - RNA, 22 nt, Human
ccagccugaaaugccucauccu

SEQ ID NO: 974146 - RNA, 22 nt, Human
ugaaagcacucacuucugcucu

SEQ ID NO: 974147 - RNA, 22 nt, Human
agagccagccuucucagcuuac

SEQ ID NO: 974148 - RNA, 22 nt, Human
uaagaacagauaaaguuucccc

SEQ ID NO: 974149 - RNA, 19 nt, Human
uggcauugguccagauaaa

SEQ ID NO: 974150 - RNA, 20 nt, Human
cagaccugcacccacuucga

SEQ ID NO: 974151 - RNA, 22 nt, Human
auguguuuauaauuacucaauc

SEQ ID NO: 974152 - RNA, 22 nt, Human
aauuucaagucuugaagaagua

SEQ ID NO: 974153 - RNA, 22 nt, Human
gcuccugggcucuaccuugcua

SEQ ID NO: 974154 - RNA, 22 nt, Human
uauguuuauacuuugauguacu

SEQ ID NO: 974155 - RNA, 22 nt, Human
uuuuuguagucauuagaagagg

SEQ ID NO: 974156 - RNA, 22 nt, Human
uacauguauugauuucucuucu

SEQ ID NO: 974157 - RNA, 22 nt, Human
gcauggcauuaacaagauggaa

SEQ ID NO: 974158 - RNA, 22 nt, Human
agaaauaugcugauuagaugaa

SEQ ID NO: 974159 - RNA, 22 nt, Human
agggcugccugacuccagagcc

SEQ ID NO: 974160 - RNA, 22 nt, Human
acauuucugucuuagggacugu

SEQ ID NO: 974161 - RNA, 22 nt, Human
uacauauagacaguuacucuag

SEQ ID NO: 974162 - RNA, 22 nt, Human
cagagccugccucuggcugugg

SEQ ID NO: 974163 - RNA, 22 nt, Human
ucccugggagaugaugaugagg

SEQ ID NO: 974164 - RNA, 22 nt, Human
aaaugcagaucccugaaucuca

SEQ ID NO: 974165 - RNA, 22 nt, Human
aaacagcuggucucaaauguuc

SEQ ID NO: 974166 - RNA, 22 nt, Human
caucuuuaacaauuuacaaugu

SEQ ID NO: 974167 - RNA, 22 nt, Human
acaggcuucucacagaaaaggg

SEQ ID NO: 974168 - RNA, 22 nt, Human
cagguccccuccccuaccaggc

SEQ ID NO: 974169 - RNA, 22 nt, Human
aucaggauguuuggcugucaua

SEQ ID NO: 974170 - RNA, 22 nt, Human
aaggcaggaugggaaaagauuu

SEQ ID NO: 974171 - RNA, 22 nt, Human
uucacaggcuuggagguggggg

SEQ ID NO: 974172 - RNA, 22 nt, Human
ccacagggucagccacucugca

SEQ ID NO: 974173 - RNA, 22 nt, Human
uuuuagauugggaaauguaaag

SEQ ID NO: 974174 - RNA, 22 nt, Human
gcccuggccuucaucucagaca

SEQ ID NO: 974175 - RNA, 22 nt, Human
aaaagaggagugguuuaugaca

SEQ ID NO: 974176 - RNA, 22 nt, Human
acugggagagcgaccagauucu

SEQ ID NO: 974177 - RNA, 20 nt, Human
caggcacacucauuccugcu

SEQ ID NO: 974178 - RNA, 22 nt, Human
uucagggagagcgggacgggug

SEQ ID NO: 974179 - RNA, 22 nt, Human
cuccagggaugagacagaguag

SEQ ID NO: 974180 - RNA, 22 nt, Human
ugcuggcuacugauggcaggcc

SEQ ID NO: 974181 - RNA, 22 nt, Human
gccuggagaagauggaacuagc

SEQ ID NO: 974182 - RNA, 22 nt, Human
ucugggagauccaagcagaacu

SEQ ID NO: 974183 - RNA, 22 nt, Human
ugugugucagagucuccauggu

SEQ ID NO: 974184 - RNA, 22 nt, Human
auugaaagauaggcuacugugg

SEQ ID NO: 974185 - RNA, 16 nt, Human
cuuccucuucacuggc

SEQ ID NO: 974186 - RNA, 22 nt, Human
uccucaugccgggucucacgcu

SEQ ID NO: 974187 - RNA, 22 nt, Human
uugcauugaugucuauacgcug

SEQ ID NO: 974188 - RNA, 22 nt, Human
aaauucagcagugaaaugcccc

SEQ ID NO: 974189 - RNA, 22 nt, Human
uuugaaagacagaauauuuuug

SEQ ID NO: 974190 - RNA, 22 nt, Human
cuggagccacugggucuuguau

SEQ ID NO: 974191 - RNA, 22 nt, Human
agguagagcuccaguagaaaau

SEQ ID NO: 974192 - RNA, 22 nt, Human
auaguuugaaggcuguucuacu

SEQ ID NO: 974193 - RNA, 22 nt, Human
auauucuugugauuauaaagua

SEQ ID NO: 974194 - RNA, 22 nt, Human
uuugcauaaaggagcauuucuc

SEQ ID NO: 974195 - RNA, 22 nt, Human
uacaagagguauauagaaacag

SEQ ID NO: 974196 - RNA, 22 nt, Human
caggccacaaguuggguucaag

SEQ ID NO: 974197 - RNA, 22 nt, Human
caaaaugugagucccaccucaa

SEQ ID NO: 974198 - RNA, 22 nt, Human
gcagcguggggcugagucagcu

SEQ ID NO: 974199 - RNA, 22 nt, Human
agcuuccugaugcaagagggcu

SEQ ID NO: 974200 - RNA, 22 nt, Human
uaggaugagggguggccaagua

SEQ ID NO: 974201 - RNA, 21 nt, Human
gucagcagauccagcacuugu

SEQ ID NO: 974202 - RNA, 22 nt, Human
uuucuauaugaggagcuaaagu

SEQ ID NO: 974203 - RNA, 22 nt, Human
ccugguccuuacgucauugcuu

SEQ ID NO: 974204 - RNA, 22 nt, Human
aggagcugagggagcgcccuug

SEQ ID NO: 974205 - RNA, 22 nt, Human
ucuucacaugaccuucaugucu

SEQ ID NO: 974206 - RNA, 22 nt, Human
agcuauguuauagcauguauca

SEQ ID NO: 974207 - RNA, 22 nt, Human
caucacccggaacugugucugc

SEQ ID NO: 974208 - RNA, 22 nt, Human
gcugcuuccuuuccugcugacc

SEQ ID NO: 974209 - RNA, 22 nt, Human
caccagggcucugagcucugaa

SEQ ID NO: 974210 - RNA, 22 nt, Human
aggagaggaaucauuauuacaa

SEQ ID NO: 974211 - RNA, 22 nt, Human
ggccccugcggacugccuagag

SEQ ID NO: 974212 - RNA, 22 nt, Human
ugggaggcagguaggugaugau

SEQ ID NO: 974213 - RNA, 22 nt, Human
gcacugcagguggguggagagg

SEQ ID NO: 974214 - RNA, 22 nt, Human
uucucagagcucacuguaguaa

SEQ ID NO: 974215 - RNA, 20 nt, Human
cuucuucauuaacccuacug

SEQ ID NO: 974216 - RNA, 22 nt, Human
aaaagacaucuauuucaggcag

SEQ ID NO: 974217 - RNA, 21 nt, Human
accaggcuugugggagggagc

SEQ ID NO: 974218 - RNA, 22 nt, Human
ugcacacacaugaaguagcaug

SEQ ID NO: 974219 - RNA, 22 nt, Human
gaggggaaaguucugcacaagg

SEQ ID NO: 974220 - RNA, 22 nt, Human
uuugauaacagugaauaucaug

SEQ ID NO: 974221 - RNA, 22 nt, Human
uuuuuccuuggaugugucucuc

SEQ ID NO: 974222 - RNA, 22 nt, Human
acuugggaugguggccagagcg

SEQ ID NO: 974223 - RNA, 22 nt, Human
gcucugggauuaccagccuuag

SEQ ID NO: 974224 - RNA, 22 nt, Human
uugcaucuaccauaucaaagau

SEQ ID NO: 974225 - RNA, 22 nt, Human
ugccugucucugacugccauua

SEQ ID NO: 974226 - RNA, 22 nt, Human
guguacauauugagucugcuga

SEQ ID NO: 974227 - RNA, 22 nt, Human
ggaugcugggagacagcaggca

SEQ ID NO: 974228 - RNA, 22 nt, Human
acuccuggggauccauuccuuu

SEQ ID NO: 974229 - RNA, 22 nt, Human
uauuucugauugcucaugaggc

SEQ ID NO: 974230 - RNA, 22 nt, Human
gagauuggauuuaauggccaaa

SEQ ID NO: 974231 - RNA, 22 nt, Human
caugauuuugucuuguguuaau

SEQ ID NO: 974232 - RNA, 22 nt, Human
gcuggccucaucacugacuucu

SEQ ID NO: 974233 - RNA, 22 nt, Human
cauucacaucuuguuccaucac

SEQ ID NO: 974234 - RNA, 22 nt, Human
agggaguuagaaauccaggaua

SEQ ID NO: 974235 - RNA, 20 nt, Human
ggguggaguugcggucugug

SEQ ID NO: 974236 - RNA, 22 nt, Human
gggcugagucugcugccuguca

SEQ ID NO: 974237 - RNA, 22 nt, Human
ggagauggaauagauucugacu

SEQ ID NO: 974238 - RNA, 22 nt, Human
uguguucaagauuaguucuagu

SEQ ID NO: 974239 - RNA, 22 nt, Human
cagcugccugcaacacaagcuu

SEQ ID NO: 974240 - RNA, 23 nt, Human
ucacacagcuggucagguacaga

SEQ ID NO: 974241 - RNA, 22 nt, Human
guauuugauacaugaaauggug

SEQ ID NO: 974242 - RNA, 22 nt, Human
uagggauguaaacauaguaauu

SEQ ID NO: 974243 - RNA, 22 nt, Human
agggcccauagaucgucagcuu

SEQ ID NO: 974244 - RNA, 22 nt, Human
ggagcugcauuuagggagccuu

SEQ ID NO: 974245 - RNA, 22 nt, Human
ggccagagagccgcuguuagga

SEQ ID NO: 974246 - RNA, 22 nt, Human
agcaucuggucaugagugagaa

SEQ ID NO: 974247 - RNA, 22 nt, Human
aaucauaauucaaauaagcuua

SEQ ID NO: 974248 - RNA, 22 nt, Human
gcagaugguggggcaggaaaau

SEQ ID NO: 974249 - RNA, 22 nt, Human
aaaguauuuuugacaggcauua

SEQ ID NO: 974250 - RNA, 22 nt, Human
ccuggccugugaaucugagagc

SEQ ID NO: 974251 - RNA, 22 nt, Human
ugaaaucugcaugcaaaguccu

SEQ ID NO: 974252 - RNA, 22 nt, Human
caguggcugugaccagggaccu

SEQ ID NO: 974253 - RNA, 22 nt, Human
ucugucugcucauuuaccucag

SEQ ID NO: 974254 - RNA, 22 nt, Human
uguguacaagaguguuuacugu

SEQ ID NO: 974255 - RNA, 22 nt, Human
uuuauagggacaguucuuggag

SEQ ID NO: 974256 - RNA, 22 nt, Human
auuuggcacacuggguucucgu

SEQ ID NO: 974257 - RNA, 22 nt, Human
uggagcagagaugggagcccaa

SEQ ID NO: 974258 - RNA, 22 nt, Human
cacagcuugggcucugacaaua

SEQ ID NO: 974259 - RNA, 22 nt, Human
caguagcacucugucagugaag

SEQ ID NO: 974260 - RNA, 22 nt, Human
ggcuguggggccggguacagug

SEQ ID NO: 974261 - RNA, 20 nt, Human
aguaggggaaugcaagagca

SEQ ID NO: 974262 - RNA, 22 nt, Human
aggcaagcugcagagaguccuu

SEQ ID NO: 974263 - RNA, 22 nt, Human
cuuccucacggugcaacaggaa

SEQ ID NO: 974264 - RNA, 22 nt, Human
ggcucugguugaccaugauggc

SEQ ID NO: 974265 - RNA, 22 nt, Human
cauuuacuguugaaucccuagc

SEQ ID NO: 974266 - RNA, 22 nt, Human
uuucaaaccuacuuguauguuu

SEQ ID NO: 974267 - RNA, 22 nt, Human
gggaaauugucaacacucucaa

SEQ ID NO: 974268 - RNA, 21 nt, Human
gagugcagcaagguagagucu

SEQ ID NO: 974269 - RNA, 22 nt, Human
gaugcaaagcauuuuugugugu

SEQ ID NO: 974270 - RNA, 22 nt, Human
ucucagggaccaugaugaugac

SEQ ID NO: 974271 - RNA, 23 nt, Human
aggcccugccugucccucuuuuu

SEQ ID NO: 974272 - RNA, 22 nt, Human
guacuuccagccaagugagaca

SEQ ID NO: 974273 - RNA, 22 nt, Human
aggcaguuguagagagggcucu

SEQ ID NO: 974274 - RNA, 22 nt, Human
acaugauuggacuccuuccccu

SEQ ID NO: 974275 - RNA, 18 nt, Human
ucucuuuuccccucauug

SEQ ID NO: 974276 - RNA, 22 nt, Human
ccugggagguggagguugcagc

SEQ ID NO: 974277 - RNA, 21 nt, Human
ugcaggcaggcagagaugcug

SEQ ID NO: 974278 - RNA, 22 nt, Human
acaaaguuaacaguuggauagu

SEQ ID NO: 974279 - RNA, 22 nt, Human
auuucuucaggucagaaauaga

SEQ ID NO: 974280 - RNA, 22 nt, Human
ugaagaugucagcagggguggu

SEQ ID NO: 974281 - RNA, 21 nt, Human
agagaagaggacuuucucaca

SEQ ID NO: 974282 - RNA, 22 nt, Human
gcugaagcccacguggcuugua

SEQ ID NO: 974283 - RNA, 22 nt, Human
gcagugcuaaguagcuggccca

SEQ ID NO: 974284 - RNA, 22 nt, Human
cauggggagacaccuagggaaa

SEQ ID NO: 974285 - RNA, 22 nt, Human
ccauaaggagccagacauucca

SEQ ID NO: 974286 - RNA, 22 nt, Human
uuugcuauuuuucugugcagcu

SEQ ID NO: 974287 - RNA, 22 nt, Human
gcuuuguguagaaggaggaugg

SEQ ID NO: 974288 - RNA, 22 nt, Human
acugugggagcgcaguggcagc

SEQ ID NO: 974289 - RNA, 22 nt, Human
cucccuggcacagcgagagguu

SEQ ID NO: 974290 - RNA, 22 nt, Human
agagucuuccaggcagccugag

SEQ ID NO: 974291 - RNA, 22 nt, Human
ggcugagccuggagcaucuggu

SEQ ID NO: 974292 - RNA, 22 nt, Human
ugaccaaaaaauucccugugag

SEQ ID NO: 974293 - RNA, 22 nt, Human
uguaugugcuugagaagguggg

SEQ ID NO: 974294 - RNA, 22 nt, Human
uuauuauuuuguguacagcaaa

SEQ ID NO: 974295 - RNA, 22 nt, Human
agccacagucuguagccagcuu

SEQ ID NO: 974296 - RNA, 22 nt, Human
cauuuccagcuccugcaucaug

SEQ ID NO: 974297 - RNA, 22 nt, Human
uugaaauauggauugaccuuga

SEQ ID NO: 974298 - RNA, 20 nt, Human
aguguuccggaagacuggca

SEQ ID NO: 974299 - RNA, 22 nt, Human
ucugggagagcugcugucagag

SEQ ID NO: 974300 - RNA, 20 nt, Human
gagacagcaaaagccucucc

SEQ ID NO: 974301 - RNA, 22 nt, Human
uagcugccuuugggcuccugcu

SEQ ID NO: 974302 - RNA, 22 nt, Human
gccugcuggaggagccucaggg

SEQ ID NO: 974303 - RNA, 21 nt, Human
uguucacauggagcagaaugu

SEQ ID NO: 974304 - RNA, 22 nt, Human
cuggugccauucuguggccuag

SEQ ID NO: 974305 - RNA, 22 nt, Human
cuguggugagcaacugacugaa

SEQ ID NO: 974306 - RNA, 22 nt, Human
gcagccacccucaaggcugaau

SEQ ID NO: 974307 - RNA, 22 nt, Human
uuucaguguaagguuuccagga

SEQ ID NO: 974308 - RNA, 18 nt, Human
ggcaucugcacagcagcc

SEQ ID NO: 974309 - RNA, 22 nt, Human
ucugaaggugcuagagaaagcu

SEQ ID NO: 974310 - RNA, 22 nt, Human
gcagggcucugcuguaguccua

SEQ ID NO: 974311 - RNA, 22 nt, Human
uugaagagugccuuccagacau

SEQ ID NO: 974312 - RNA, 22 nt, Human
agcugggucuugggccaggaga

SEQ ID NO: 974313 - RNA, 22 nt, Human
aaucuggcauguaagcuuagag

SEQ ID NO: 974314 - RNA, 22 nt, Human
aggcaagcccccagugaggcuc

SEQ ID NO: 974315 - RNA, 22 nt, Human
ccuggccucagacagagggugg

SEQ ID NO: 974316 - RNA, 22 nt, Human
gggcugcacagaucuucaaggg

SEQ ID NO: 974317 - RNA, 22 nt, Human
aacacaaagaagcugcaggauc

SEQ ID NO: 974318 - RNA, 22 nt, Human
ggagggcugccagguggagcgg

SEQ ID NO: 974319 - RNA, 22 nt, Human
aaaacuccugaaauuguuuccc

SEQ ID NO: 974320 - RNA, 22 nt, Human
ugagcccagucugucugacaug

SEQ ID NO: 974321 - RNA, 22 nt, Human
acagggcagugucuugaaaaau

SEQ ID NO: 974322 - RNA, 22 nt, Human
ccuccuggugacaaggcaaagc

SEQ ID NO: 974323 - RNA, 22 nt, Human
cucuugggagugcucuggagaa

SEQ ID NO: 974324 - RNA, 22 nt, Human
uaguaacagauuuauacagucu

SEQ ID NO: 974325 - RNA, 18 nt, Human
aggauauuaagaguacag

SEQ ID NO: 974326 - RNA, 22 nt, Human
aacaacugaaaagcuuuuucug

SEQ ID NO: 974327 - RNA, 22 nt, Human
ucucuggagcugcagauccagg

SEQ ID NO: 974328 - RNA, 22 nt, Human
caggucagagucccccuguccu

SEQ ID NO: 974329 - RNA, 22 nt, Human
aaaugugugcacaaagacagcu

SEQ ID NO: 974330 - RNA, 22 nt, Human
auaccuuuuagacauguaguug

SEQ ID NO: 974331 - RNA, 22 nt, Human
gucagcaggguccccuugagug

SEQ ID NO: 974332 - RNA, 22 nt, Human
cccuccagagcuugaccugcug

SEQ ID NO: 974333 - RNA, 22 nt, Human
cuuagaaaucgaacucagguua

SEQ ID NO: 974334 - RNA, 20 nt, Human
cccucccagaugcuucccaa

SEQ ID NO: 974335 - RNA, 22 nt, Human
ucucgacagccuggcacagugg

SEQ ID NO: 974336 - RNA, 22 nt, Human
caaagugcuggaauuacaggug

SEQ ID NO: 974337 - RNA, 22 nt, Human
agccccucuguggcucugccuc

SEQ ID NO: 974338 - RNA, 22 nt, Human
gcagccacucucauuccacgug

SEQ ID NO: 974339 - RNA, 22 nt, Human
agggcugcugcuccgggcccag

SEQ ID NO: 974340 - RNA, 22 nt, Human
agugacucacuagcucucagug

SEQ ID NO: 974341 - RNA, 22 nt, Human
cugcccugggaguaccuguccu

SEQ ID NO: 974342 - RNA, 22 nt, Human
gaaaagggcaagagagagggca

SEQ ID NO: 974343 - RNA, 22 nt, Human
cucuugaagggcaucugaguua

SEQ ID NO: 974344 - RNA, 22 nt, Human
ggcugggcaggucugcacaggg

SEQ ID NO: 974345 - RNA, 22 nt, Human
gcagggcacagacagugccaag

SEQ ID NO: 974346 - RNA, 22 nt, Human
uggguagagcaggcuggggcuu

SEQ ID NO: 974347 - RNA, 22 nt, Human
cacugcagaucagaggcugaga

SEQ ID NO: 974348 - RNA, 22 nt, Human
ggauggcaggacaaggacccag

SEQ ID NO: 974349 - RNA, 22 nt, Human
ggauccuucuuugaccucacag

SEQ ID NO: 974350 - RNA, 22 nt, Human
auucaguucuaaggucagugcc

SEQ ID NO: 974351 - RNA, 19 nt, Human
agcaaauauaauaguguuc

SEQ ID NO: 974352 - RNA, 22 nt, Human
uccugggcuuuguuucucuccu

SEQ ID NO: 974353 - RNA, 22 nt, Human
ccaggaguggcuggugaccuuc

SEQ ID NO: 974354 - RNA, 22 nt, Human
uggcagcuaucuuuaaugagau

SEQ ID NO: 974355 - RNA, 22 nt, Human
cagagcuguccaaacccugaca

SEQ ID NO: 974356 - RNA, 22 nt, Human
ucacugcucuccaauguggagu

SEQ ID NO: 974357 - RNA, 22 nt, Human
cagagcuguugcggggcuuggc

SEQ ID NO: 974358 - RNA, 22 nt, Human
ggcucagaaacuaaaggcgcug

SEQ ID NO: 974359 - RNA, 22 nt, Human
ggaggcuccacugcucuuccug

SEQ ID NO: 974360 - RNA, 22 nt, Human
cccugggcaagcccuauuuucc

SEQ ID NO: 974361 - RNA, 21 nt, Human
agagcugggacuugccugaga

SEQ ID NO: 974362 - RNA, 22 nt, Human
cuggugcuggagccuagucccu

SEQ ID NO: 974363 - RNA, 23 nt, Human
ccuccugggcacaggccugaugg

SEQ ID NO: 974364 - RNA, 19 nt, Human
aggguccagggagcggcuc

SEQ ID NO: 974365 - RNA, 22 nt, Human
acucaggaaauugagauaaugg

SEQ ID NO: 974366 - RNA, 22 nt, Human
gccuccuggccuuugcuccuca

SEQ ID NO: 974367 - RNA, 22 nt, Human
cuggcuggccggagcgaggcgg

SEQ ID NO: 974368 - RNA, 22 nt, Human
uuccuuaggcuguuugcagugc

SEQ ID NO: 974369 - RNA, 23 nt, Human
ucuguucaaggcuuucuccuuga

SEQ ID NO: 974370 - RNA, 22 nt, Human
ucucugggugauggcagggcac

SEQ ID NO: 974371 - RNA, 22 nt, Human
uggccuuggacagagcgcuccu

SEQ ID NO: 974372 - RNA, 22 nt, Human
uaaugucagcauaguuuauuuu

SEQ ID NO: 974373 - RNA, 22 nt, Human
gcaggcugaugacuggaguugg

SEQ ID NO: 974374 - RNA, 22 nt, Human
uccucagaauggauggcagggg

SEQ ID NO: 974375 - RNA, 22 nt, Human
cugcagaggguuugagcauccu

SEQ ID NO: 974376 - RNA, 18 nt, Human
cagggccccagaauuauc

SEQ ID NO: 974377 - RNA, 22 nt, Human
ggcuucugguaaagaccacacc

SEQ ID NO: 974378 - RNA, 22 nt, Human
agugaaauuuguuuagauaggu

SEQ ID NO: 974379 - RNA, 21 nt, Human
uuagcaaagcaaacacaugcu

SEQ ID NO: 974380 - RNA, 22 nt, Human
cugugccaggcccagcugacuu

SEQ ID NO: 974381 - RNA, 22 nt, Human
uggcagaguggaccauacucaa

SEQ ID NO: 974382 - RNA, 22 nt, Human
gaaauuuauuaucuacaucauu

SEQ ID NO: 974383 - RNA, 22 nt, Human
agggagcuguggucagcucagu

SEQ ID NO: 974384 - RNA, 19 nt, Human
uaaggccaaaaguaagugu

SEQ ID NO: 974385 - RNA, 22 nt, Human
gcagaggccugaagguggcggg

SEQ ID NO: 974386 - RNA, 22 nt, Human
ugucauuuaguccucugugugu

SEQ ID NO: 974387 - RNA, 22 nt, Human
uuagccauuaauguccugugca

SEQ ID NO: 974388 - RNA, 22 nt, Human
cccucaggagaugucagcugga

SEQ ID NO: 974389 - RNA, 22 nt, Human
aaaagucagucucuccuagcuc

SEQ ID NO: 974390 - RNA, 22 nt, Human
uucagcaauuuuuuaagcuaau

SEQ ID NO: 974391 - RNA, 22 nt, Human
uuaaaagaauccuguuauccuc

SEQ ID NO: 974392 - RNA, 22 nt, Human
ggaggcgauccugggaaacacc

SEQ ID NO: 974393 - RNA, 22 nt, Human
cauaccuuucucaagcacaugu

SEQ ID NO: 974394 - RNA, 22 nt, Human
auguuguagcauaugaaauaua

SEQ ID NO: 974395 - RNA, 22 nt, Human
ucagaaaagguagcugugacaa

SEQ ID NO: 974396 - RNA, 22 nt, Human
aggcucugcagaccccagcugu

SEQ ID NO: 974397 - RNA, 22 nt, Human
uagugcuugagucucuccguac

SEQ ID NO: 974398 - RNA, 22 nt, Human
cucccuggaggcccagaccugg

SEQ ID NO: 974399 - RNA, 22 nt, Human
uuguuauaaagacuaaauaugu

SEQ ID NO: 974400 - RNA, 15 nt, Human
aaucuggcggcaagu

SEQ ID NO: 974401 - RNA, 22 nt, Human
acaccuuuuauucgccaggcac

SEQ ID NO: 974402 - RNA, 20 nt, Human
ccugccuguguuugugauga

SEQ ID NO: 974403 - RNA, 22 nt, Human
uuuuagcacuaagugauaugcu

SEQ ID NO: 974404 - RNA, 22 nt, Human
cucuguccuugcacaguuccua

SEQ ID NO: 974405 - RNA, 22 nt, Human
cgggcagaucacacagggcuug

SEQ ID NO: 974406 - RNA, 22 nt, Human
gcagcuggggccacacuuaggc

SEQ ID NO: 974407 - RNA, 22 nt, Human
cagacacaccaggcccauucug

SEQ ID NO: 974408 - RNA, 22 nt, Human
uuuauuagugcuuguaucacug

SEQ ID NO: 974409 - RNA, 22 nt, Human
gccugagaaggauaggaagcga

SEQ ID NO: 974410 - RNA, 19 nt, Human
acagaaauguaagugagac

SEQ ID NO: 974411 - RNA, 22 nt, Human
ugggcagaggcagcagaaaccu

SEQ ID NO: 974412 - RNA, 22 nt, Human
aggcagcaugggcccagagucc

SEQ ID NO: 974413 - RNA, 22 nt, Human
accauccugaaaccuucaugcu

SEQ ID NO: 974414 - RNA, 22 nt, Human
uucaagaugacccagucacacg

SEQ ID NO: 974415 - RNA, 22 nt, Human
uaaugcacagaauugacauggg

SEQ ID NO: 974416 - RNA, 22 nt, Human
ccuggagguggagguugcagug

SEQ ID NO: 974417 - RNA, 22 nt, Human
gucauggaggauugugaguggu

SEQ ID NO: 974418 - RNA, 22 nt, Human
uggugccuugggccuacagcgc

SEQ ID NO: 974419 - RNA, 22 nt, Human
aacaugcucuguuucuuggaug

SEQ ID NO: 974420 - RNA, 22 nt, Human
acaggccugacacacagagggc

SEQ ID NO: 974421 - RNA, 22 nt, Human
gcccaggacucagggugucgcg

SEQ ID NO: 974422 - RNA, 22 nt, Human
ugacagcauaacacuggucuug

SEQ ID NO: 974423 - RNA, 22 nt, Human
gggcagcugccagaggccaugg

SEQ ID NO: 974424 - RNA, 22 nt, Human
uggccugcuuucauuugaugcu

SEQ ID NO: 974425 - RNA, 22 nt, Human
cccaggagauggagguugcagu

SEQ ID NO: 974426 - RNA, 22 nt, Human
aggggugaaggcccgauaggag

SEQ ID NO: 974427 - RNA, 22 nt, Human
cugugucuucaauguacuggga

SEQ ID NO: 974428 - RNA, 22 nt, Human
aauaaacugcucaauugcauca

SEQ ID NO: 974429 - RNA, 22 nt, Human
uccugccucacaguugaaguuu

SEQ ID NO: 974430 - RNA, 22 nt, Human
uugcauuugaucuuggguucuc

SEQ ID NO: 974431 - RNA, 22 nt, Human
uugcacuccagcccgagcaaca

SEQ ID NO: 974432 - RNA, 20 nt, Human
ugaggcaggagaauggcaug

SEQ ID NO: 974433 - RNA, 22 nt, Human
ccauaagguuuggggccaugca

SEQ ID NO: 974434 - RNA, 21 nt, Human
agaaaauggcguuuuagauuu

SEQ ID NO: 974435 - RNA, 22 nt, Human
aggcugaggcagguggaucacc

SEQ ID NO: 974436 - RNA, 22 nt, Human
uggcacuggcgcaggauggcgg

SEQ ID NO: 974437 - RNA, 22 nt, Human
aagcugaggcccauggcaaggu

SEQ ID NO: 974438 - RNA, 22 nt, Human
acacugaagagcacuuucaaag

SEQ ID NO: 974439 - RNA, 22 nt, Human
ugcugggcuaggguggagcucu

SEQ ID NO: 974440 - RNA, 22 nt, Human
ggugcugguucaggguggcugu

SEQ ID NO: 974441 - RNA, 22 nt, Human
uuacuuugaugaucaaugagcg

SEQ ID NO: 974442 - RNA, 22 nt, Human
ccagggcagugggagaaggugc

SEQ ID NO: 974443 - RNA, 22 nt, Human
cauuuguauagugcuuagacca

SEQ ID NO: 974444 - RNA, 22 nt, Human
auauauuuugcggucacguggc

SEQ ID NO: 974445 - RNA, 22 nt, Human
ucacacagguuugcaaugauuu

SEQ ID NO: 974446 - RNA, 22 nt, Human
ccuggcacgaagggcugagguu

SEQ ID NO: 974447 - RNA, 22 nt, Human
gcugauccuuuuaugucuagcu

SEQ ID NO: 974448 - RNA, 22 nt, Human
agggaagaaaauccaucgcugc

SEQ ID NO: 974449 - RNA, 20 nt, Human
gucucaaguaucucacaguc

SEQ ID NO: 974450 - RNA, 22 nt, Human
uuaaaucaggcaucauuucagu

SEQ ID NO: 974451 - RNA, 22 nt, Human
cccuguggaggaggagagcagu

SEQ ID NO: 974452 - RNA, 21 nt, Human
ucucugugucuuuaagcugga

SEQ ID NO: 974453 - RNA, 21 nt, Human
agccuguugguuuacugcuca

SEQ ID NO: 974454 - RNA, 22 nt, Human
agagaugucgccuugcccaggg

SEQ ID NO: 974455 - RNA, 20 nt, Human
cuguggaauuuuaccaugcg

SEQ ID NO: 974456 - RNA, 22 nt, Human
cugcaggcaucuaacugugggc

SEQ ID NO: 974457 - RNA, 19 nt, Human
ugccuggacaaaugugggg

SEQ ID NO: 974458 - RNA, 22 nt, Human
gaauuacauuguuagccuuccu

SEQ ID NO: 974459 - RNA, 23 nt, Human
acuuaaaugguucuuuaucucag

SEQ ID NO: 974460 - RNA, 22 nt, Human
ucucaggggccuggaguccugg

SEQ ID NO: 974461 - RNA, 22 nt, Human
guggccucaugucuauaaagag

SEQ ID NO: 974462 - RNA, 22 nt, Human
ucccugggccacagcugugagc

SEQ ID NO: 974463 - RNA, 22 nt, Human
aaacccaucugucugucugcag

SEQ ID NO: 974464 - RNA, 22 nt, Human
aucuggcucccuuggaauccgu

SEQ ID NO: 974465 - RNA, 22 nt, Human
ucuuagcacagcuauauaaguu

SEQ ID NO: 974466 - RNA, 22 nt, Human
cacagcuggugcacuagcucug

SEQ ID NO: 974467 - RNA, 22 nt, Human
agggagcucuaaguagagggac

SEQ ID NO: 974468 - RNA, 22 nt, Human
acugagcugcuugaagugaacu

SEQ ID NO: 974469 - RNA, 22 nt, Human
gcuggggaggcagcagagaaca

SEQ ID NO: 974470 - RNA, 22 nt, Human
uauugaaaugaaugacagugau

SEQ ID NO: 974471 - RNA, 22 nt, Human
uucugucacuuaggaggucaua

SEQ ID NO: 974472 - RNA, 22 nt, Human
ugagccagaggaggcugugugg

SEQ ID NO: 974473 - RNA, 22 nt, Human
uuauuuauuguguaccuacugu

SEQ ID NO: 974474 - RNA, 22 nt, Human
auucuucacauaagugcuguac

SEQ ID NO: 974475 - RNA, 22 nt, Human
uccuugaauugugccacuuacc

SEQ ID NO: 974476 - RNA, 22 nt, Human
aauacugccugugagguaacuc

SEQ ID NO: 974477 - RNA, 22 nt, Human
ucuggcaggcaaucggcucugg

SEQ ID NO: 974478 - RNA, 22 nt, Human
cugcccuggcagccuaccaugg

SEQ ID NO: 974479 - RNA, 22 nt, Human
guuuaauaauguugaauuacua

SEQ ID NO: 974480 - RNA, 21 nt, Human
auuuggcaaaggcgaugcaca

SEQ ID NO: 974481 - RNA, 22 nt, Human
cagucucucagcuuucagcugu

SEQ ID NO: 974482 - RNA, 22 nt, Human
cccaugagaccugguuuaaggc

SEQ ID NO: 974483 - RNA, 22 nt, Human
cucuggacagcaggugcugugg

SEQ ID NO: 974484 - RNA, 22 nt, Human
cuguuuauacgacagguggagg

SEQ ID NO: 974485 - RNA, 20 nt, Human
ggccuuggguuucgccuguu

SEQ ID NO: 974486 - RNA, 21 nt, Human
gggcuggacaugguggcucau

SEQ ID NO: 974487 - RNA, 23 nt, Human
gucagcuugaccaguggagaguc

SEQ ID NO: 974488 - RNA, 22 nt, Human
agagcccuuucuccaggcaccu

SEQ ID NO: 974489 - RNA, 18 nt, Human
cgaggcaggcggaucacg

SEQ ID NO: 974490 - RNA, 22 nt, Human
uuucuaaaauagauuuuauggu

SEQ ID NO: 974491 - RNA, 22 nt, Human
caaaggcaguuacugaaugaag

SEQ ID NO: 974492 - RNA, 22 nt, Human
ugcuauaagaauuauauuacuc

SEQ ID NO: 974493 - RNA, 22 nt, Human
uugcugaaguuaaugcuugcaa

SEQ ID NO: 974494 - RNA, 22 nt, Human
uuaagauagaacccaguagucu

SEQ ID NO: 974495 - RNA, 23 nt, Human
uggcaaggaaugggauggagacu

SEQ ID NO: 974496 - RNA, 22 nt, Human
ccucagagccuccagaaggaau

SEQ ID NO: 974497 - RNA, 22 nt, Human
acauuuguaugcguuuuuacug

SEQ ID NO: 974498 - RNA, 22 nt, Human
aggcucaguuugguuuccauug

SEQ ID NO: 974499 - RNA, 22 nt, Human
gggcguggauggucagugcagg

SEQ ID NO: 974500 - RNA, 22 nt, Human
guuuauuauacaacaaaagcua

SEQ ID NO: 974501 - RNA, 22 nt, Human
cacuuaagcaguuaauuuaucu

SEQ ID NO: 974502 - RNA, 17 nt, Human
gccaaaggguuccaauc

SEQ ID NO: 974503 - RNA, 22 nt, Human
uggagcugggguuugaaucugg

SEQ ID NO: 974504 - RNA, 22 nt, Human
ggcacugauaauguccucucuc

SEQ ID NO: 974505 - RNA, 22 nt, Human
agaaauguauagugaauuuuuc

SEQ ID NO: 974506 - RNA, 22 nt, Human
ucauugcaggcauuccccugcc

SEQ ID NO: 974507 - RNA, 22 nt, Human
cagcugccaugacauguccugc

SEQ ID NO: 974508 - RNA, 22 nt, Human
ccauggcaauggucagucuauu

SEQ ID NO: 974509 - RNA, 21 nt, Human
ugcauaaagaaauacaaauac

SEQ ID NO: 974510 - RNA, 22 nt, Human
aaaaaugucauuauggaacuga

SEQ ID NO: 974511 - RNA, 22 nt, Human
caggggcucccugggugccagu

SEQ ID NO: 974512 - RNA, 22 nt, Human
cugggccacaagccugugugau

SEQ ID NO: 974513 - RNA, 22 nt, Human
gugugcccuuguucagcagagu

SEQ ID NO: 974514 - RNA, 22 nt, Human
acagugaaugcccaagaaaagu

SEQ ID NO: 974515 - RNA, 22 nt, Human
ggcugcuugcuguuucuuggau

SEQ ID NO: 974516 - RNA, 22 nt, Human
caaacugagcaucagaaaguuu

SEQ ID NO: 974517 - RNA, 22 nt, Human
gcuucauuacugacagucugug

SEQ ID NO: 974518 - RNA, 22 nt, Human
uucaagauggcaccagugagug

SEQ ID NO: 974519 - RNA, 22 nt, Human
cuugccuguggcuaguuggcuc

SEQ ID NO: 974520 - RNA, 22 nt, Human
cacaguuagcuccagucuuagc

SEQ ID NO: 974521 - RNA, 23 nt, Human
ccugaagggucaggguccucagc

SEQ ID NO: 974522 - RNA, 22 nt, Human
cucugcugcccaggccugcuag

SEQ ID NO: 974523 - RNA, 22 nt, Human
ggccagagaauaugccuuacgu

SEQ ID NO: 974524 - RNA, 22 nt, Human
gaacaguaaauuuaugcagcac

SEQ ID NO: 974525 - RNA, 22 nt, Human
uagcugucagcaaucaaguggu

SEQ ID NO: 974526 - RNA, 23 nt, Human
gccucuggagccccagugcucag

SEQ ID NO: 974527 - RNA, 20 nt, Human
uagaaaucuuauaaaagacu

SEQ ID NO: 974528 - RNA, 21 nt, Human
gccugcagaccccaccaggcu

SEQ ID NO: 974529 - RNA, 22 nt, Human
ccuggagggcgccgcacagucc

SEQ ID NO: 974530 - RNA, 22 nt, Human
ccucugccaccucccacgaggc

SEQ ID NO: 974531 - RNA, 22 nt, Human
aaucuguucuacucuauucaga

SEQ ID NO: 974532 - RNA, 22 nt, Human
ugaaggccagggauuugcagcc

SEQ ID NO: 974533 - RNA, 22 nt, Human
gagcucagauucuggugucaga

SEQ ID NO: 974534 - RNA, 21 nt, Human
ggcagcccgcccucuccuggc

SEQ ID NO: 974535 - RNA, 22 nt, Human
agaugguguuuccccaggugga

SEQ ID NO: 974536 - RNA, 22 nt, Human
gggagcaggagccugccugcca

SEQ ID NO: 974537 - RNA, 20 nt, Human
aggcagcugggaaaugaggg

SEQ ID NO: 974538 - RNA, 22 nt, Human
gucucagagagcuacucucuua

SEQ ID NO: 974539 - RNA, 22 nt, Human
gcugguuagaaaacagagcuca

SEQ ID NO: 974540 - RNA, 22 nt, Human
acagggucaagggugcuacaag

SEQ ID NO: 974541 - RNA, 22 nt, Human
cugcugugugaccauggacagg

SEQ ID NO: 974542 - RNA, 22 nt, Human
ggucccaguccucucccugcua

SEQ ID NO: 974543 - RNA, 22 nt, Human
cuuacauuaaguaagagauuga

SEQ ID NO: 974544 - RNA, 22 nt, Human
gaggcaugucuggccuguccca

SEQ ID NO: 974545 - RNA, 22 nt, Human
aaaugugucaguuucauucucu

SEQ ID NO: 974546 - RNA, 22 nt, Human
cuucccuuggugaacagagcau

SEQ ID NO: 974547 - RNA, 22 nt, Human
agcaauauaaauguuggguaga

SEQ ID NO: 974548 - RNA, 22 nt, Human
aaugcacagcguuccaugcuug

SEQ ID NO: 974549 - RNA, 22 nt, Human
uacaguaagaugaaauagcaau

SEQ ID NO: 974550 - RNA, 22 nt, Human
cccagcccaucucaaaggucua

SEQ ID NO: 974551 - RNA, 22 nt, Human
cucuggccagagccugcgggaa

SEQ ID NO: 974552 - RNA, 22 nt, Human
uuagauaaauugcaacuugauu

SEQ ID NO: 974553 - RNA, 21 nt, Human
augucaaaugcuuuauuuuau

SEQ ID NO: 974554 - RNA, 22 nt, Human
caggcacugugcaagggucucg

SEQ ID NO: 974555 - RNA, 23 nt, Human
uggcagagacccagaaucuacau

SEQ ID NO: 974556 - RNA, 23 nt, Human
ucuuuccucagcacacaccaaga

SEQ ID NO: 974557 - RNA, 22 nt, Human
ggggcccagcaccccuccucgc

SEQ ID NO: 974558 - RNA, 21 nt, Human
acucaggagacuaacuauguc

SEQ ID NO: 974559 - RNA, 22 nt, Human
uaugucuuguguuugcuaaucu

SEQ ID NO: 974560 - RNA, 22 nt, Human
agauuucccacuccauguauug

SEQ ID NO: 974561 - RNA, 22 nt, Human
gcugaagcugcagcaggaggaa

SEQ ID NO: 974562 - RNA, 22 nt, Human
ggcuggcaagugucugcucaug

SEQ ID NO: 974563 - RNA, 22 nt, Human
cuggguggaucgcagccccagg

SEQ ID NO: 974564 - RNA, 22 nt, Human
augcuguguggucaaguuaauu

SEQ ID NO: 974565 - RNA, 22 nt, Human
ugacacaggcagcucccagcac

SEQ ID NO: 974566 - RNA, 22 nt, Human
ccagagugacgugaagugugaa

SEQ ID NO: 974567 - RNA, 22 nt, Human
uacaguucacaguaucauaaau

SEQ ID NO: 974568 - RNA, 22 nt, Human
cacagggcaggccccaggccuc

SEQ ID NO: 974569 - RNA, 22 nt, Human
gagcugucucuauaugaaugcu

SEQ ID NO: 974570 - RNA, 22 nt, Human
cauguguagugaaauaagcagu

SEQ ID NO: 974571 - RNA, 22 nt, Human
uuuccaagacuccaguucuccc

SEQ ID NO: 974572 - RNA, 22 nt, Human
ugaacaacugcaaaaaucucca

SEQ ID NO: 974573 - RNA, 22 nt, Human
cuagagggauguuaggauagca

SEQ ID NO: 974574 - RNA, 21 nt, Human
ggcagcucagcagauggggac

SEQ ID NO: 974575 - RNA, 22 nt, Human
uccucaggagagcuccuaugcc

SEQ ID NO: 974576 - RNA, 22 nt, Human
aggaagaauguuuacauaucaa

SEQ ID NO: 974577 - RNA, 22 nt, Human
cuggccuucagacucggacuga

SEQ ID NO: 974578 - RNA, 22 nt, Human
uccuugaaugaauguucucucc

SEQ ID NO: 974579 - RNA, 22 nt, Human
ucaggagaaagccaauuagagu

SEQ ID NO: 974580 - RNA, 22 nt, Human
cuccacagcucaggcucagagu

SEQ ID NO: 974581 - RNA, 19 nt, Human
uggcagggagaguuugaag

SEQ ID NO: 974582 - RNA, 22 nt, Human
auugcuaggaacagguugcacc

SEQ ID NO: 974583 - RNA, 22 nt, Human
guucuguacuccaagcucuucc

SEQ ID NO: 974584 - RNA, 22 nt, Human
gcuuccucgcugggcagaggca

SEQ ID NO: 974585 - RNA, 22 nt, Human
gaugcugagagguggagggaac

SEQ ID NO: 974586 - RNA, 22 nt, Human
gagggccagcagccucagcaug

SEQ ID NO: 974587 - RNA, 22 nt, Human
ugauugaacugagcuucaagau

SEQ ID NO: 974588 - RNA, 22 nt, Human
ugagagaugaaguuaguuguuc

SEQ ID NO: 974589 - RNA, 22 nt, Human
gcugcccaggguggagccggcu

SEQ ID NO: 974590 - RNA, 22 nt, Human
cugggagcuuggagccuuuggu

SEQ ID NO: 974591 - RNA, 22 nt, Human
aucauucuauuguugagcugcc

SEQ ID NO: 974592 - RNA, 22 nt, Human
aucaggauagugguuaccuggg

SEQ ID NO: 974593 - RNA, 22 nt, Human
uggcgcaacucauucauggugu

SEQ ID NO: 974594 - RNA, 22 nt, Human
gugggagcuucaucaagcaguu

SEQ ID NO: 974595 - RNA, 22 nt, Human
cagggcagugaagaacacacgu

SEQ ID NO: 974596 - RNA, 22 nt, Human
aggcagaugggagcuggaaguu

SEQ ID NO: 974597 - RNA, 22 nt, Human
aacaucuacuaagugccaggca

SEQ ID NO: 974598 - RNA, 22 nt, Human
gcuggccagugucccagggauc

SEQ ID NO: 974599 - RNA, 22 nt, Human
uagaagcaguaauagaaauagg

SEQ ID NO: 974600 - RNA, 21 nt, Human
aagccucaagcagaagacaga

SEQ ID NO: 974601 - RNA, 21 nt, Human
guggcucugccaggacugaaa

SEQ ID NO: 974602 - RNA, 22 nt, Human
aaggcagucugguuucaaagca

SEQ ID NO: 974603 - RNA, 22 nt, Human
cucucagacugaagggccugug

SEQ ID NO: 974604 - RNA, 22 nt, Human
agcugguucagaaauuagaugg

SEQ ID NO: 974605 - RNA, 22 nt, Human
caucugccuaaguggcccuguu

SEQ ID NO: 974606 - RNA, 22 nt, Human
gaagagcuaaaggcacaggcuu

SEQ ID NO: 974607 - RNA, 21 nt, Human
gccugggauaguggccuccgg

SEQ ID NO: 974608 - RNA, 22 nt, Human
gaaaggucuuccggucuuccag

SEQ ID NO: 974609 - RNA, 22 nt, Human
ucugggaguuucugugggagcu

SEQ ID NO: 974610 - RNA, 22 nt, Human
ugaaaugaaugugauucgauag

SEQ ID NO: 974611 - RNA, 22 nt, Human
ucuggcucagggcucugaggga

SEQ ID NO: 974612 - RNA, 22 nt, Human
cagcaggauaugguggagagag

SEQ ID NO: 974613 - RNA, 19 nt, Human
uggaagaggaagggaaaua

SEQ ID NO: 974614 - RNA, 22 nt, Human
aggcagaucacuugaggccagg

SEQ ID NO: 974615 - RNA, 22 nt, Human
gcagagcuaucuucuggauuug

SEQ ID NO: 974616 - RNA, 23 nt, Human
agucucagcuggaaacauguguc

SEQ ID NO: 974617 - RNA, 22 nt, Human
cugcuuccauaaauaaugugcu

SEQ ID NO: 974618 - RNA, 22 nt, Human
caugucuuggcuuaggcacaga

SEQ ID NO: 974619 - RNA, 22 nt, Human
cagaguguggcaucuuccaacu

SEQ ID NO: 974620 - RNA, 19 nt, Human
guggccugcgcugggugcg

SEQ ID NO: 974621 - RNA, 22 nt, Human
cagugguggaaugaggaauugu

SEQ ID NO: 974622 - RNA, 22 nt, Human
gggcugcuguagagaacauguu

SEQ ID NO: 974623 - RNA, 22 nt, Human
acagacagggcaccugccuccu

SEQ ID NO: 974624 - RNA, 22 nt, Human
aggaccuguagggccugcaucc

SEQ ID NO: 974625 - RNA, 22 nt, Human
cacccaggcagguggcugagaa

SEQ ID NO: 974626 - RNA, 18 nt, Human
ucugggcuucccgaggcu

SEQ ID NO: 974627 - RNA, 22 nt, Human
ugggcacacugaaucugcuauu

SEQ ID NO: 974628 - RNA, 22 nt, Human
gcauuuccugugcuuggcauau

SEQ ID NO: 974629 - RNA, 22 nt, Human
agaaaucagaacccugaaguuc

SEQ ID NO: 974630 - RNA, 22 nt, Human
uaaguauguuagaaaaucaagu

SEQ ID NO: 974631 - RNA, 22 nt, Human
aagcuggcaugucaccugagaa

SEQ ID NO: 974632 - RNA, 22 nt, Human
auguauguaguguacauauaca

SEQ ID NO: 974633 - RNA, 22 nt, Human
agugaaauagcauuuaugaagc

SEQ ID NO: 974634 - RNA, 22 nt, Human
aaggcagccuuuugaguugauu

SEQ ID NO: 974635 - RNA, 22 nt, Human
aaaugcacagguuuuaaauccu

SEQ ID NO: 974636 - RNA, 22 nt, Human
ucccaggaagaucccagggacc

SEQ ID NO: 974637 - RNA, 22 nt, Human
agcauuuaguuaguaaauguuu

SEQ ID NO: 974638 - RNA, 22 nt, Human
gucucagauaacauguauucua

SEQ ID NO: 974639 - RNA, 22 nt, Human
aucuggcuuucuuaaugacuua

SEQ ID NO: 974640 - RNA, 22 nt, Human
uucacauugguucuugauagcu

SEQ ID NO: 974641 - RNA, 22 nt, Human
gccugggagugcacagugaggu

SEQ ID NO: 974642 - RNA, 22 nt, Human
agccacagagguugaugugguu

SEQ ID NO: 974643 - RNA, 22 nt, Human
aggcagucuaguccccaggcaa

SEQ ID NO: 974644 - RNA, 22 nt, Human
ccacucugcugugcuccaugau

SEQ ID NO: 974645 - RNA, 22 nt, Human
acugucuguccugcucuccgug

SEQ ID NO: 974646 - RNA, 22 nt, Human
uaacagaaauuuuaguuagggg

SEQ ID NO: 974647 - RNA, 22 nt, Human
ucacagugagccaugucagaga

SEQ ID NO: 974648 - RNA, 22 nt, Human
ugcccacauggugccauggcca

SEQ ID NO: 974649 - RNA, 22 nt, Human
aggaaaaaagucugugauuaua

SEQ ID NO: 974650 - RNA, 20 nt, Human
cagcccuccaguggaggcag

SEQ ID NO: 974651 - RNA, 20 nt, Human
cagcaguggaugagaguuuu

SEQ ID NO: 974652 - RNA, 22 nt, Human
acauuaaugaggugaugacaca

SEQ ID NO: 974653 - RNA, 22 nt, Human
aggccagaaaugucagggagug

SEQ ID NO: 974654 - RNA, 22 nt, Human
cagagccuaaaacgacuccacu

SEQ ID NO: 974655 - RNA, 22 nt, Human
gcuccuucaggugguagcuguu

SEQ ID NO: 974656 - RNA, 22 nt, Human
ggggugggguuacucauugugc

SEQ ID NO: 974657 - RNA, 22 nt, Human
aggaaacuccccuacaucucaa

SEQ ID NO: 974658 - RNA, 22 nt, Human
acucugaggagugacuagaggu

SEQ ID NO: 974659 - RNA, 22 nt, Human
ccugggagguggauguugcggu

SEQ ID NO: 974660 - RNA, 22 nt, Human
gcagggccuuagcagcggcugc

SEQ ID NO: 974661 - RNA, 20 nt, Human
gucaucgccggcagcaaaga

SEQ ID NO: 974662 - RNA, 22 nt, Human
gagcagcuccagccgcaugacu

SEQ ID NO: 974663 - RNA, 22 nt, Human
gcuccagguauuugcccuuuua

SEQ ID NO: 974664 - RNA, 22 nt, Human
ggcccaaggcccaggucgagcu

SEQ ID NO: 974665 - RNA, 20 nt, Human
acauggaaggucaaacuauc

SEQ ID NO: 974666 - RNA, 22 nt, Human
auucacaauagcagcuugcaug

SEQ ID NO: 974667 - RNA, 22 nt, Human
uggcagaggaaaaagucacugg

SEQ ID NO: 974668 - RNA, 22 nt, Human
uuuuuccuagugcuuucuggua

SEQ ID NO: 974669 - RNA, 22 nt, Human
aggucauuccuugucuucuugc

SEQ ID NO: 974670 - RNA, 23 nt, Human
uggaccugaaccagugccucugu

SEQ ID NO: 974671 - RNA, 22 nt, Human
ccagggcauguaacuaauggug

SEQ ID NO: 974672 - RNA, 16 nt, Human
ucucugcuucauaggu

SEQ ID NO: 974673 - RNA, 22 nt, Human
uugcuuccaguccaagucuguu

SEQ ID NO: 974674 - RNA, 22 nt, Human
ugcagcugguuuagaacuagau

SEQ ID NO: 974675 - RNA, 22 nt, Human
cugcucuggggaagccagaugu

SEQ ID NO: 974676 - RNA, 22 nt, Human
gauuucuucauucauuagaugg

SEQ ID NO: 974677 - RNA, 22 nt, Human
agcagugaugcaugacagccua

SEQ ID NO: 974678 - RNA, 22 nt, Human
agggccagaaucccucagucua

SEQ ID NO: 974679 - RNA, 22 nt, Human
acauuucuaguuguucaucucc

SEQ ID NO: 974680 - RNA, 22 nt, Human
ugggagcugggguuggacgucu

SEQ ID NO: 974681 - RNA, 21 nt, Human
uucuuuccccagaggacuaaa

SEQ ID NO: 974682 - RNA, 22 nt, Human
uggcucugugcuucuaguaucu

SEQ ID NO: 974683 - RNA, 22 nt, Human
ccagggugugagaaggaaguag

SEQ ID NO: 974684 - RNA, 22 nt, Human
aaugugcaggcucaaaccuugu

SEQ ID NO: 974685 - RNA, 22 nt, Human
gcucagagcaucccagugaaug

SEQ ID NO: 974686 - RNA, 22 nt, Human
gcagagcagugcuugcccagcg

SEQ ID NO: 974687 - RNA, 22 nt, Human
ccugagggaaggaugcuaccca

SEQ ID NO: 974688 - RNA, 22 nt, Human
gcagggccagugcagagaggaa

SEQ ID NO: 974689 - RNA, 22 nt, Human
caguugaugggacucauguggg

SEQ ID NO: 974690 - RNA, 22 nt, Human
ucucucuugucaccccaucugc

SEQ ID NO: 974691 - RNA, 22 nt, Human
ugggcagacgggagcuugccuu

SEQ ID NO: 974692 - RNA, 22 nt, Human
guuagaaacacauucuuauuga

SEQ ID NO: 974693 - RNA, 22 nt, Human
ggcucugcaugugagugggugg

SEQ ID NO: 974694 - RNA, 22 nt, Human
uggccaagaaugauaugugaag

SEQ ID NO: 974695 - RNA, 20 nt, Human
ggcaggcuuuauauggaggg

SEQ ID NO: 974696 - RNA, 22 nt, Human
agcagcuuacauguggccuauc

SEQ ID NO: 974697 - RNA, 22 nt, Human
aaaauauuuuagggccaggaga

SEQ ID NO: 974698 - RNA, 22 nt, Human
gcucuguguccacagcuggaaa

SEQ ID NO: 974699 - RNA, 20 nt, Human
aaaauauguauaacucuucu

SEQ ID NO: 974700 - RNA, 22 nt, Human
aaacauuugcaacucgguuugg

SEQ ID NO: 974701 - RNA, 22 nt, Human
uugcaaauauguucuccuauuc

SEQ ID NO: 974702 - RNA, 22 nt, Human
ggaaagaggauaguggguaggu

SEQ ID NO: 974703 - RNA, 22 nt, Human
guggccaaggcagagaaagagc

SEQ ID NO: 974704 - RNA, 22 nt, Human
aaggcugagggcuguaccuggc

SEQ ID NO: 974705 - RNA, 18 nt, Human
cugccuguugcugagagg

SEQ ID NO: 974706 - RNA, 22 nt, Human
ccagcagcuuuauuggcucucc

SEQ ID NO: 974707 - RNA, 22 nt, Human
ggcagcaggcgacuucccuauu

SEQ ID NO: 974708 - RNA, 22 nt, Human
auggucuguuaggagcuacuuu

SEQ ID NO: 974709 - RNA, 22 nt, Human
uuaacagagugccuggcaugua

SEQ ID NO: 974710 - RNA, 22 nt, Human
ucugucugcgcuugcccuggug

SEQ ID NO: 974711 - RNA, 22 nt, Human
acauuguauaaugauuaucaca

SEQ ID NO: 974712 - RNA, 20 nt, Human
cccugagacaaaggaggggc

SEQ ID NO: 974713 - RNA, 22 nt, Human
uagagcuauuuagagcauuuua

SEQ ID NO: 974714 - RNA, 22 nt, Human
cuggcagcgguuugcagccugg

SEQ ID NO: 974715 - RNA, 22 nt, Human
uggagcugagaaguggagcucu

SEQ ID NO: 974716 - RNA, 22 nt, Human
ggcuccuguccccucagcugcu

SEQ ID NO: 974717 - RNA, 22 nt, Human
agccuugaacacugacugaagg

SEQ ID NO: 974718 - RNA, 22 nt, Human
uguucagagacagaaauucuaa

SEQ ID NO: 974719 - RNA, 22 nt, Human
cugaggugcuagggucccugcu

SEQ ID NO: 974720 - RNA, 22 nt, Human
cuaaaugccuuuccuaccuaac

SEQ ID NO: 974721 - RNA, 22 nt, Human
uucuaacucuguuauguguuuc

SEQ ID NO: 974722 - RNA, 22 nt, Human
uuucaaaauuuugcagugguaa

SEQ ID NO: 974723 - RNA, 22 nt, Human
ugaguuuuuucaacauaugaag

SEQ ID NO: 974724 - RNA, 22 nt, Human
uggccagguguggguucucaga

SEQ ID NO: 974725 - RNA, 22 nt, Human
auucuucacuguuucagaauga

SEQ ID NO: 974726 - RNA, 22 nt, Human
gggcagagaaauggacaguugg

SEQ ID NO: 974727 - RNA, 22 nt, Human
gguccuggaaauugacggaaag

SEQ ID NO: 974728 - RNA, 22 nt, Human
cugccagguuggcgcucgcucu

SEQ ID NO: 974729 - RNA, 20 nt, Human
ucagcucugugccugggaug

SEQ ID NO: 974730 - RNA, 22 nt, Human
gcugccuguccugaggaguccg

SEQ ID NO: 974731 - RNA, 22 nt, Human
aagggccauaacuugcaguguu

SEQ ID NO: 974732 - RNA, 22 nt, Human
augggaggaugcucgggugcuc

SEQ ID NO: 974733 - RNA, 22 nt, Human
agcugcccugggucuugcugcu

SEQ ID NO: 974734 - RNA, 22 nt, Human
cuucagaagaaaagcagugugu

SEQ ID NO: 974735 - RNA, 22 nt, Human
caagagcuggagaggcagucua

SEQ ID NO: 974736 - RNA, 18 nt, Human
uaaaugcauguuaauaac

SEQ ID NO: 974737 - RNA, 22 nt, Human
gccugucucuuggaacuuggua

SEQ ID NO: 974738 - RNA, 22 nt, Human
cagcaggcagccauuucacugu

SEQ ID NO: 974739 - RNA, 22 nt, Human
caugaagcacagcucucuuuuu

SEQ ID NO: 974740 - RNA, 22 nt, Human
cugaggcugcccagggccaggu

SEQ ID NO: 974741 - RNA, 22 nt, Human
uccagucauuuccauuguuccc

SEQ ID NO: 974742 - RNA, 22 nt, Human
ggccagcagucacagggucaga

SEQ ID NO: 974743 - RNA, 22 nt, Human
aguaacucauguaaaccucaca

SEQ ID NO: 974744 - RNA, 22 nt, Human
ggagccaguuuagaccucaguu

SEQ ID NO: 974745 - RNA, 22 nt, Human
gccuggccugaacuaggaggug

SEQ ID NO: 974746 - RNA, 22 nt, Human
aagugacacauggcacuucuau

SEQ ID NO: 974747 - RNA, 22 nt, Human
uccaagggcagcagccauagcc

SEQ ID NO: 974748 - RNA, 22 nt, Human
augaaaacuuuagccucauuag

SEQ ID NO: 974749 - RNA, 23 nt, Human
ccagcuccgugagccucgggcuc

SEQ ID NO: 974750 - RNA, 22 nt, Human
agcaucuggugagggccuaguu

SEQ ID NO: 974751 - RNA, 22 nt, Human
aaaacauugaauugcacacuau

SEQ ID NO: 974752 - RNA, 22 nt, Human
uuccuuccgggcaccaggcacu

SEQ ID NO: 974753 - RNA, 22 nt, Human
gauuucaauccagcuuucuucu

SEQ ID NO: 974754 - RNA, 22 nt, Human
cagagcagcagagcuuccaugg

SEQ ID NO: 974755 - RNA, 22 nt, Human
ggcuggcaggcacaguaugcaa

SEQ ID NO: 974756 - RNA, 22 nt, Human
accaaggagccacauacaaccu

SEQ ID NO: 974757 - RNA, 22 nt, Human
uaagaacaguagaacaguaggu

SEQ ID NO: 974758 - RNA, 22 nt, Human
uaugcacaauaugaucuauuug

SEQ ID NO: 974759 - RNA, 22 nt, Human
guuuuauuuccaugagagaccg

SEQ ID NO: 974760 - RNA, 22 nt, Human
gaggcagcuuaggguacugacu

SEQ ID NO: 974761 - RNA, 22 nt, Human
ugucacagggauaccauggggc

SEQ ID NO: 974762 - RNA, 22 nt, Human
uccagaggcuccaaagggagau

SEQ ID NO: 974763 - RNA, 22 nt, Human
cagaggaugaucuggccucucu

SEQ ID NO: 974764 - RNA, 22 nt, Human
cuggcucuaucuccaaggcugg

SEQ ID NO: 974765 - RNA, 22 nt, Human
gugaggugguacaauauuaacu

SEQ ID NO: 974766 - RNA, 22 nt, Human
ccaggagaagcaucugagugua

SEQ ID NO: 974767 - RNA, 22 nt, Human
gugcugucaauugcuuucagua

SEQ ID NO: 974768 - RNA, 22 nt, Human
gaguuauuuugagcagaugguu

SEQ ID NO: 974769 - RNA, 22 nt, Human
cauuggaaugcauuugaagaga

SEQ ID NO: 974770 - RNA, 22 nt, Human
gugugcaguagagaaagagcag

SEQ ID NO: 974771 - RNA, 18 nt, Human
agcagcugucagaaugcc

SEQ ID NO: 974772 - RNA, 22 nt, Human
cccagcaguuguuggugcacau

SEQ ID NO: 974773 - RNA, 22 nt, Human
gagaugaauguaaacaaaggca

SEQ ID NO: 974774 - RNA, 18 nt, Human
ucuggcucaggacugaac

SEQ ID NO: 974775 - RNA, 22 nt, Human
uuucaagcauaacugggaagag

SEQ ID NO: 974776 - RNA, 22 nt, Human
ccagggccucguguucugagug

SEQ ID NO: 974777 - RNA, 22 nt, Human
ccaggagagcagaagcccaggc

SEQ ID NO: 974778 - RNA, 18 nt, Human
uccugccugugccccagg

SEQ ID NO: 974779 - RNA, 22 nt, Human
cauuguuaauugguaucuuaca

SEQ ID NO: 974780 - RNA, 22 nt, Human
ugucucugggugauucaguccu

SEQ ID NO: 974781 - RNA, 22 nt, Human
cucacuguuuaauagcuggauc

SEQ ID NO: 974782 - RNA, 22 nt, Human
cucagaaucugccaaguucagg

SEQ ID NO: 974783 - RNA, 21 nt, Human
uggaccaaaguaauuugccuu

SEQ ID NO: 974784 - RNA, 22 nt, Human
caggcugagcucuggccugggc

SEQ ID NO: 974785 - RNA, 22 nt, Human
uggcucuggggacaguaagucc

SEQ ID NO: 974786 - RNA, 22 nt, Human
uuaauuuucucaucugugaaau

SEQ ID NO: 974787 - RNA, 22 nt, Human
cccaggaaaucaggcuuucuag

SEQ ID NO: 974788 - RNA, 22 nt, Human
uugcuagcugguguaugcauug

SEQ ID NO: 974789 - RNA, 23 nt, Human
gugauuucagggaacagaaucag

SEQ ID NO: 974790 - RNA, 22 nt, Human
cuggcccauggugagcucuggg

SEQ ID NO: 974791 - RNA, 22 nt, Human
caaagugcugagauuacaggua

SEQ ID NO: 974792 - RNA, 22 nt, Human
acccagagccagggucaggagc

SEQ ID NO: 974793 - RNA, 22 nt, Human
ggcgcuggccacgguggcucug

SEQ ID NO: 974794 - RNA, 22 nt, Human
ugagccuggcggaagcagcgug

SEQ ID NO: 974795 - RNA, 22 nt, Human
aguuucuaccgguacauucagg

SEQ ID NO: 974796 - RNA, 22 nt, Human
cagcuggguuuaguggggugug

SEQ ID NO: 974797 - RNA, 22 nt, Human
caaaaguagugaaguuguacau

SEQ ID NO: 974798 - RNA, 22 nt, Human
cccaggagguagagguugcagu

SEQ ID NO: 974799 - RNA, 22 nt, Human
gcugggagucgcgucuguggcc

SEQ ID NO: 974800 - RNA, 22 nt, Human
aguaaacauaauuuaccuguag

SEQ ID NO: 974801 - RNA, 22 nt, Human
auggccaaggggccuaggcagg

SEQ ID NO: 974802 - RNA, 18 nt, Human
ucagcuggggcugcagcc

SEQ ID NO: 974803 - RNA, 22 nt, Human
ccagcccugccagagagagcug

SEQ ID NO: 974804 - RNA, 22 nt, Human
agggcugcaucugccuggugaa

SEQ ID NO: 974805 - RNA, 22 nt, Human
cugcugugaguuuggaggucua

SEQ ID NO: 974806 - RNA, 22 nt, Human
ugaagcuuuccuguggucagga

SEQ ID NO: 974807 - RNA, 22 nt, Human
ugcagccuugccuccucccagc

SEQ ID NO: 974808 - RNA, 21 nt, Human
acagcagacaggcuuaggacc

SEQ ID NO: 974809 - RNA, 17 nt, Human
gugcagggaugaaggau

SEQ ID NO: 974810 - RNA, 22 nt, Human
cagagccugccaccuuucuccc

SEQ ID NO: 974811 - RNA, 22 nt, Human
gugggagcugcuaccuccuucc

SEQ ID NO: 974812 - RNA, 22 nt, Human
uggagcccagggugagaaggag

SEQ ID NO: 974813 - RNA, 22 nt, Human
augaaauugaucuugaacuuuu

SEQ ID NO: 974814 - RNA, 22 nt, Human
ucaaagucauggcaggcucaga

SEQ ID NO: 974815 - RNA, 22 nt, Human
ccagggcugagcugugaccaug

SEQ ID NO: 974816 - RNA, 22 nt, Human
aagaacauguuaaaagauucac

SEQ ID NO: 974817 - RNA, 22 nt, Human
ugcucuguaaggucagaaaagg

SEQ ID NO: 974818 - RNA, 22 nt, Human
guagcuuaugaaaugugagggg

SEQ ID NO: 974819 - RNA, 20 nt, Human
ucugaggcugagcucuacuu

SEQ ID NO: 974820 - RNA, 22 nt, Human
agcugaguuaauucaucacuua

SEQ ID NO: 974821 - RNA, 22 nt, Human
uccagagggcgauggcuggggg

SEQ ID NO: 974822 - RNA, 22 nt, Human
aagauauucaaagauuuauuag

SEQ ID NO: 974823 - RNA, 22 nt, Human
cauuuugugcuagacacuaugg

SEQ ID NO: 974824 - RNA, 22 nt, Human
agcuggcaguaugacuggugac

SEQ ID NO: 974825 - RNA, 22 nt, Human
ggccuugguaaagggaugcaug

SEQ ID NO: 974826 - RNA, 22 nt, Human
agcaccugccugcauuggcuau

SEQ ID NO: 974827 - RNA, 22 nt, Human
cacuggggaaaacaggcuucuu

SEQ ID NO: 974828 - RNA, 22 nt, Human
aagcagaaguugaucuaccaua

SEQ ID NO: 974829 - RNA, 22 nt, Human
acccaggaggcagagguugcag

SEQ ID NO: 974830 - RNA, 22 nt, Human
uuucauaauacuguacaugaaa

SEQ ID NO: 974831 - RNA, 22 nt, Human
cugcucuggcuguguacuucag

SEQ ID NO: 974832 - RNA, 22 nt, Human
cucagggggaaucaggucacag

SEQ ID NO: 974833 - RNA, 22 nt, Human
agagggauaauauguauuguaa

SEQ ID NO: 974834 - RNA, 22 nt, Human
ucugccuguucaagucuucuag

SEQ ID NO: 974835 - RNA, 22 nt, Human
ucacauuuuccuugguaucugu

SEQ ID NO: 974836 - RNA, 22 nt, Human
cagccagaaccuaggaugagcu

SEQ ID NO: 974837 - RNA, 22 nt, Human
uuaauaaaguaugaauuggaaa

SEQ ID NO: 974838 - RNA, 22 nt, Human
ucacucuguuagaggaaagugc

SEQ ID NO: 974839 - RNA, 22 nt, Human
uggugucugcacucccuggcgu

SEQ ID NO: 974840 - RNA, 22 nt, Human
agagcuguucaacguagcaaug

SEQ ID NO: 974841 - RNA, 22 nt, Human
uuguuuaaaauguagcaagaaa

SEQ ID NO: 974842 - RNA, 22 nt, Human
uaaccauauuuuccauuaaguu

SEQ ID NO: 974843 - RNA, 22 nt, Human
gcugugugacugagagccuggc

SEQ ID NO: 974844 - RNA, 22 nt, Human
auaaguucagguaaagaaauca

SEQ ID NO: 974845 - RNA, 22 nt, Human
uauuucuuguuauucucguuga

SEQ ID NO: 974846 - RNA, 22 nt, Human
uugcauuguugcaaugaaguau

SEQ ID NO: 974847 - RNA, 22 nt, Human
cugucugucaaguucaucucca

SEQ ID NO: 974848 - RNA, 22 nt, Human
caguccuggggaccaggcugag

SEQ ID NO: 974849 - RNA, 22 nt, Human
uuuuagaaauacugauuuagug

SEQ ID NO: 974850 - RNA, 22 nt, Human
uccugggcugugugccacucug

SEQ ID NO: 974851 - RNA, 22 nt, Human
auuuaaaugcuuaagaggguuu

SEQ ID NO: 974852 - RNA, 22 nt, Human
uggagcaggugcucaggguaau

SEQ ID NO: 974853 - RNA, 22 nt, Human
aguuauaugugaaaacacguau

SEQ ID NO: 974854 - RNA, 22 nt, Human
gggagggacacaaagaguuccc

SEQ ID NO: 974855 - RNA, 22 nt, Human
ucauucuccucuggaaaaggca

SEQ ID NO: 974856 - RNA, 22 nt, Human
cagagcuguuacuauucaugaa

SEQ ID NO: 974857 - RNA, 22 nt, Human
agggccugugcuuccugagaua

SEQ ID NO: 974858 - RNA, 22 nt, Human
aauucuugguccuaguguauaa

SEQ ID NO: 974859 - RNA, 22 nt, Human
uuaggaaauuaugguuucagau

SEQ ID NO: 974860 - RNA, 22 nt, Human
uacuaggaagcagcugcauugg

SEQ ID NO: 974861 - RNA, 22 nt, Human
aguggcaggcggagauguagga

SEQ ID NO: 974862 - RNA, 22 nt, Human
agggaaauuaaugugagcaaug

SEQ ID NO: 974863 - RNA, 22 nt, Human
aacuuugucuuuuaugcuuaca

SEQ ID NO: 974864 - RNA, 22 nt, Human
guugggaagcagauggaugagc

SEQ ID NO: 974865 - RNA, 22 nt, Human
caaggccacuccagagacuggu

SEQ ID NO: 974866 - RNA, 22 nt, Human
ggucccaggagaauaggugcaa

SEQ ID NO: 974867 - RNA, 22 nt, Human
acccaggacaaaauaaccaggu

SEQ ID NO: 974868 - RNA, 23 nt, Human
uacaugcuauaauuucacccuca

SEQ ID NO: 974869 - RNA, 22 nt, Human
guuggccugaauggucaagagg

SEQ ID NO: 974870 - RNA, 19 nt, Human
aggugaugugacucuagaa

SEQ ID NO: 974871 - RNA, 22 nt, Human
uuacuuuggguccugcuuauaa

SEQ ID NO: 974872 - RNA, 22 nt, Human
auagcuguuagauuggggucga

SEQ ID NO: 974873 - RNA, 22 nt, Human
uuagaaagcuuuccauagucaa

SEQ ID NO: 974874 - RNA, 22 nt, Human
agucagcagccuggccaggaga

SEQ ID NO: 974875 - RNA, 22 nt, Human
gacccuggaacuuucagcagag

SEQ ID NO: 974876 - RNA, 20 nt, Human
cuccagggaacagacuggag

SEQ ID NO: 974877 - RNA, 22 nt, Human
ugagacaguucugcagcugggu

SEQ ID NO: 974878 - RNA, 22 nt, Human
ggaugcugcuaucaggcuucga

SEQ ID NO: 974879 - RNA, 23 nt, Human
aggagccaggaaccagcuucccc

SEQ ID NO: 974880 - RNA, 21 nt, Human
agcugagcccagaagacuggu

SEQ ID NO: 974881 - RNA, 21 nt, Human
agcagaggcugccuggugacu

SEQ ID NO: 974882 - RNA, 22 nt, Human
acugccuuauaugcugugugug

SEQ ID NO: 974883 - RNA, 22 nt, Human
gagcugcugguugcuggugccu

SEQ ID NO: 974884 - RNA, 22 nt, Human
ucgagucauguucucccauuaa

SEQ ID NO: 974885 - RNA, 22 nt, Human
cuguuuucaaagagagagaaug

SEQ ID NO: 974886 - RNA, 22 nt, Human
caggcagcagccacucugguau

SEQ ID NO: 974887 - RNA, 22 nt, Human
ucugggcucuuaguguacccuc

SEQ ID NO: 974888 - RNA, 23 nt, Human
uugcacauuggagcuggucuucu

SEQ ID NO: 974889 - RNA, 22 nt, Human
aguucacauuccgagguacugg

SEQ ID NO: 974890 - RNA, 22 nt, Human
caggugggcguggcgagaaggc

SEQ ID NO: 974891 - RNA, 22 nt, Human
ggcagaggaaggaugaauucac

SEQ ID NO: 974892 - RNA, 22 nt, Human
cucccuggcuuuguccugaggc

SEQ ID NO: 974893 - RNA, 20 nt, Human
ccugucuccucuuaccuggc

SEQ ID NO: 974894 - RNA, 19 nt, Human
ugaguucugugguucucaa

SEQ ID NO: 974895 - RNA, 22 nt, Human
uuuguuuagaaagagauuggug

SEQ ID NO: 974896 - RNA, 23 nt, Human
uucuucucaauuaguugauucag

SEQ ID NO: 974897 - RNA, 22 nt, Human
ugaggccagucucaucacaggc

SEQ ID NO: 974898 - RNA, 22 nt, Human
cagaccagcucuaugaacccaa

SEQ ID NO: 974899 - RNA, 22 nt, Human
ggugugccuggggcuuagcugc

SEQ ID NO: 974900 - RNA, 20 nt, Human
agcugccccugggcacugcc

SEQ ID NO: 974901 - RNA, 22 nt, Human
ggggcacuuccaggcugaggcu

SEQ ID NO: 974902 - RNA, 21 nt, Human
ccugccaggaaacugaguguc

SEQ ID NO: 974903 - RNA, 22 nt, Human
cccaggaguucgaggcuguagu

SEQ ID NO: 974904 - RNA, 20 nt, Human
cccuccagcaaccaggacuu

SEQ ID NO: 974905 - RNA, 22 nt, Human
cuggaguuagaguagacacuga

SEQ ID NO: 974906 - RNA, 22 nt, Human
acagagauguggaugagggauu

SEQ ID NO: 974907 - RNA, 22 nt, Human
cagggagaagucuggucagucc

SEQ ID NO: 974908 - RNA, 22 nt, Human
acagccagaggagccaggcugg

SEQ ID NO: 974909 - RNA, 22 nt, Human
gggugcaggcagcccaggcagg

SEQ ID NO: 974910 - RNA, 22 nt, Human
agcccugggaggccagcuugua

SEQ ID NO: 974911 - RNA, 22 nt, Human
cauggagauaaacugaaauauu

SEQ ID NO: 974912 - RNA, 19 nt, Human
agauggcaaaaugcaaaga

SEQ ID NO: 974913 - RNA, 22 nt, Human
uuggagguuugaaaauaugugu

SEQ ID NO: 974914 - RNA, 19 nt, Human
ugggcagcucccucugucc

SEQ ID NO: 974915 - RNA, 22 nt, Human
guucauuuuacuguaaauagca

SEQ ID NO: 974916 - RNA, 22 nt, Human
cccaggaaagagacugcugggu

SEQ ID NO: 974917 - RNA, 22 nt, Human
guaggaagcucugaggcuaguu

SEQ ID NO: 974918 - RNA, 22 nt, Human
aaauaauuauagcgagucuauc

SEQ ID NO: 974919 - RNA, 22 nt, Human
cauuugaaauaguucauucuug

SEQ ID NO: 974920 - RNA, 22 nt, Human
uccugaggcucacuuugaaugu

SEQ ID NO: 974921 - RNA, 22 nt, Human
ucccccacucuaaaggagccuu

SEQ ID NO: 974922 - RNA, 22 nt, Human
gucuuuauuugagauugucauu

SEQ ID NO: 974923 - RNA, 22 nt, Human
ugggcuggcccaccacaccucg

SEQ ID NO: 974924 - RNA, 22 nt, Human
uagaaacacagaucugguguca

SEQ ID NO: 974925 - RNA, 22 nt, Human
gaggguggguuucuugcacguc

SEQ ID NO: 974926 - RNA, 22 nt, Human
acucugcuuccacuuuugcuaa

SEQ ID NO: 974927 - RNA, 23 nt, Human
gccuucagcucgggaaggcuccc

SEQ ID NO: 974928 - RNA, 22 nt, Human
uagaauaugugguguauacuuu

SEQ ID NO: 974929 - RNA, 22 nt, Human
cugccuccugccgugcagcuuc

SEQ ID NO: 974930 - RNA, 22 nt, Human
agaagccauguuuaguaggaug

SEQ ID NO: 974931 - RNA, 22 nt, Human
gugcaagguacauccuugaugu

SEQ ID NO: 974932 - RNA, 22 nt, Human
ggcugcuggggacgugggagag

SEQ ID NO: 974933 - RNA, 21 nt, Human
uaaggccaagucuauuucugu

SEQ ID NO: 974934 - RNA, 19 nt, Human
ucugcuggcagaauucccu

SEQ ID NO: 974935 - RNA, 22 nt, Human
aagacaauuugauacuaguugc

SEQ ID NO: 974936 - RNA, 22 nt, Human
cacagcagagggagccauugaa

SEQ ID NO: 974937 - RNA, 22 nt, Human
gagagucuagugcaccuaguuu

SEQ ID NO: 974938 - RNA, 22 nt, Human
ucaucugucauccacaaagcug

SEQ ID NO: 974939 - RNA, 22 nt, Human
ccuguucacuuugacuucucca

SEQ ID NO: 974940 - RNA, 22 nt, Human
agccuggccacucagggccuga

SEQ ID NO: 974941 - RNA, 22 nt, Human
cuggagccccaggcugugcaga

SEQ ID NO: 974942 - RNA, 22 nt, Human
cuggccacaacuagcccaggac

SEQ ID NO: 974943 - RNA, 22 nt, Human
agcugcucaggagagccagguc

SEQ ID NO: 974944 - RNA, 23 nt, Human
acaaaugcccauacaucuaguuc

SEQ ID NO: 974945 - RNA, 23 nt, Human
uuggcagcgggucaggcuguggg

SEQ ID NO: 974946 - RNA, 22 nt, Human
aagaauaaauuaagauacuuag

SEQ ID NO: 974947 - RNA, 22 nt, Human
uccagucaucucccuucacauu

SEQ ID NO: 974948 - RNA, 22 nt, Human
cugcucugaguauuaacggagg

SEQ ID NO: 974949 - RNA, 22 nt, Human
uucuguuuuagaaauaaguagu

SEQ ID NO: 974950 - RNA, 22 nt, Human
ucuggcaaaggcaaccacaguu

SEQ ID NO: 974951 - RNA, 22 nt, Human
aagggcugcuguagaagcagag

SEQ ID NO: 974952 - RNA, 22 nt, Human
ugggccuguugggguugaguua

SEQ ID NO: 974953 - RNA, 22 nt, Human
auucuguauggaaaagcacuau

SEQ ID NO: 974954 - RNA, 22 nt, Human
acaaggaggucuggggggcccu

SEQ ID NO: 974955 - RNA, 22 nt, Human
ccucuggcaacuucacagccca

SEQ ID NO: 974956 - RNA, 22 nt, Human
ugaaaugauuauaugguguuug

SEQ ID NO: 974957 - RNA, 21 nt, Human
ccuggccaaucugauaggguu

SEQ ID NO: 974958 - RNA, 22 nt, Human
agcucccagagcucgagaguaa

SEQ ID NO: 974959 - RNA, 22 nt, Human
ugcagcuccucuggcugccuga

SEQ ID NO: 974960 - RNA, 22 nt, Human
gagcaggcauucuaguggcuga

SEQ ID NO: 974961 - RNA, 22 nt, Human
auaugcuuaugaugucucaagu

SEQ ID NO: 974962 - RNA, 22 nt, Human
acccagcuggaugcauggaggc

SEQ ID NO: 974963 - RNA, 22 nt, Human
ucauacaucuguccuggagcuc

SEQ ID NO: 974964 - RNA, 22 nt, Human
gaccagucauuacucaugcccu

SEQ ID NO: 974965 - RNA, 22 nt, Human
auuuaugacuggugaauagaac

SEQ ID NO: 974966 - RNA, 22 nt, Human
ccacagggcacagacaggaagc

SEQ ID NO: 974967 - RNA, 22 nt, Human
aguuuuucuccccuggcuucau

SEQ ID NO: 974968 - RNA, 22 nt, Human
gggcccuggacguggcggcaga

SEQ ID NO: 974969 - RNA, 22 nt, Human
gucuucuuguguugccugucuu

SEQ ID NO: 974970 - RNA, 17 nt, Human
gucauucucagaaaaug

SEQ ID NO: 974971 - RNA, 22 nt, Human
guauuaggugguggaauuguag

SEQ ID NO: 974972 - RNA, 22 nt, Human
ucuccugguacccuuccuagca

SEQ ID NO: 974973 - RNA, 22 nt, Human
uaaaagacccucuagaguccca

SEQ ID NO: 974974 - RNA, 22 nt, Human
agagccuggaccugagcuacaa

SEQ ID NO: 974975 - RNA, 22 nt, Human
uagcacugaaucacaugcugcu

SEQ ID NO: 974976 - RNA, 22 nt, Human
cagcucucacacccuccuccca

SEQ ID NO: 974977 - RNA, 20 nt, Human
cucaggauacugcaaaguug

SEQ ID NO: 974978 - RNA, 22 nt, Human
gggcuggcgggaaaggcaauuc

SEQ ID NO: 974979 - RNA, 22 nt, Human
ugaagcagagugaaggugaauu

SEQ ID NO: 974980 - RNA, 22 nt, Human
cagcagccuacaaugcacagaa

SEQ ID NO: 974981 - RNA, 22 nt, Human
uaugccugauaacugugucucu

SEQ ID NO: 974982 - RNA, 22 nt, Human
ugaaucaguauaaauucucaaa

SEQ ID NO: 974983 - RNA, 22 nt, Human
cucccaggguagggagagacua

SEQ ID NO: 974984 - RNA, 22 nt, Human
cagcugcuguuacugcuuauua

SEQ ID NO: 974985 - RNA, 22 nt, Human
uuauauguuucuguuuggaggc

SEQ ID NO: 974986 - RNA, 18 nt, Human
uugagggaggggcagagu

SEQ ID NO: 974987 - RNA, 22 nt, Human
agagcccucuucacugccccuu

SEQ ID NO: 974988 - RNA, 22 nt, Human
ucaggagaaucagggcuguccu

SEQ ID NO: 974989 - RNA, 22 nt, Human
agcagccaaaugaagauuuuac

SEQ ID NO: 974990 - RNA, 22 nt, Human
cagagccuuccuagcagacucu

SEQ ID NO: 974991 - RNA, 22 nt, Human
uaggcacuagacaugguuacca

SEQ ID NO: 974992 - RNA, 22 nt, Human
acucugcuaaauguguaggcuc

SEQ ID NO: 974993 - RNA, 22 nt, Human
gaggagagaacauuccuccaua

SEQ ID NO: 974994 - RNA, 22 nt, Human
ccugggccugaaaacauuucuc

SEQ ID NO: 974995 - RNA, 22 nt, Human
guuucauacagauuauucaugg

SEQ ID NO: 974996 - RNA, 22 nt, Human
aacauucaccucuaccuccuuc

SEQ ID NO: 974997 - RNA, 22 nt, Human
uaaggccauuauggugggcccg

SEQ ID NO: 974998 - RNA, 22 nt, Human
uugaaagggauauaucuuucug

SEQ ID NO: 974999 - RNA, 22 nt, Human
aaggcugaguaaaacagagaac

SEQ ID NO: 975000 - RNA, 22 nt, Human
ccaucagcaugggagcaugggc

SEQ ID NO: 975001 - RNA, 22 nt, Human
agaccauagggaccucagguug

SEQ ID NO: 975002 - RNA, 22 nt, Human
cagcugccuucugcgggaaguc

SEQ ID NO: 975003 - RNA, 22 nt, Human
uuauuuuuaaaaguucacacag

SEQ ID NO: 975004 - RNA, 22 nt, Human
cugaacuuauugagugcuugcu

SEQ ID NO: 975005 - RNA, 22 nt, Human
auacacauauguguguauaugu

SEQ ID NO: 975006 - RNA, 22 nt, Human
uggaaggggagcuggaaagggg

SEQ ID NO: 975007 - RNA, 22 nt, Human
auguucaaacuuuuuacacacc

SEQ ID NO: 975008 - RNA, 22 nt, Human
auuuucuauguuguaauuguua

SEQ ID NO: 975009 - RNA, 22 nt, Human
ucuuugcagaauuuaacuuugc

SEQ ID NO: 975010 - RNA, 22 nt, Human
uuggcacagagcugcagccugg

SEQ ID NO: 975011 - RNA, 22 nt, Human
cccagccuuugcuuccugguuc

SEQ ID NO: 975012 - RNA, 22 nt, Human
aggagcugcuuaaaugguuggu

SEQ ID NO: 975013 - RNA, 22 nt, Human
gccucugcggagcuguacauca

SEQ ID NO: 975014 - RNA, 17 nt, Human
cccaugagcccacuccc

SEQ ID NO: 975015 - RNA, 21 nt, Human
acacauuaugagcauagacuc

SEQ ID NO: 975016 - RNA, 22 nt, Human
ugugcaguuucuauguugucca

SEQ ID NO: 975017 - RNA, 22 nt, Human
gcagugaaacaauaggaucaaa

SEQ ID NO: 975018 - RNA, 22 nt, Human
aggacuucaucaccuguauaaa

SEQ ID NO: 975019 - RNA, 22 nt, Human
cccaggaaugggaaggaggaau

SEQ ID NO: 975020 - RNA, 22 nt, Human
cuucacaacgacaucugguuag

SEQ ID NO: 975021 - RNA, 22 nt, Human
gggcagcugccccucucugggc

SEQ ID NO: 975022 - RNA, 19 nt, Human
agucugcauuucuagcaag

SEQ ID NO: 975023 - RNA, 22 nt, Human
aggccuuccucggagacaggga

SEQ ID NO: 975024 - RNA, 22 nt, Human
cucaacagcucugccauacucc

SEQ ID NO: 975025 - RNA, 21 nt, Human
uucuucaugaugauuaauggc

SEQ ID NO: 975026 - RNA, 22 nt, Human
guccagggcuaaaucagguucc

SEQ ID NO: 975027 - RNA, 19 nt, Human
uuagccauccacagugaaa

SEQ ID NO: 975028 - RNA, 19 nt, Human
uccucaggggcucacagac

SEQ ID NO: 975029 - RNA, 22 nt, Human
agcuuuaugggagcuuagauaa

SEQ ID NO: 975030 - RNA, 22 nt, Human
acugucugcuggccccugguua

SEQ ID NO: 975031 - RNA, 20 nt, Human
cugggccauccuuuuacaau

SEQ ID NO: 975032 - RNA, 23 nt, Human
guggccuccccggaaugccucgc

SEQ ID NO: 975033 - RNA, 22 nt, Human
uacuccugcugauccugccagc

SEQ ID NO: 975034 - RNA, 22 nt, Human
ugaaaucuucacuaagucucuu

SEQ ID NO: 975035 - RNA, 22 nt, Human
gaggcugcuuugaugacaggag

SEQ ID NO: 975036 - RNA, 22 nt, Human
ccugcuguaaugugucuuuauu

SEQ ID NO: 975037 - RNA, 22 nt, Human
gggagcugaauggcaauggaga

SEQ ID NO: 975038 - RNA, 22 nt, Human
auguacaguuucuagacucaaa

SEQ ID NO: 975039 - RNA, 22 nt, Human
ggggcggggcucugagaagcau

SEQ ID NO: 975040 - RNA, 22 nt, Human
uggccugucuuguugugcuaga

SEQ ID NO: 975041 - RNA, 22 nt, Human
gccuggagggcucuagagaggc

SEQ ID NO: 975042 - RNA, 20 nt, Human
ugcugucguguuuucugcuu

SEQ ID NO: 975043 - RNA, 22 nt, Human
cccaggagauggugcguggucu

SEQ ID NO: 975044 - RNA, 22 nt, Human
ggcagaguggagugcggccucc

SEQ ID NO: 975045 - RNA, 22 nt, Human
gaggcagcuggguccggucggg

SEQ ID NO: 975046 - RNA, 22 nt, Human
uauggcauauaguccagcauaa

SEQ ID NO: 975047 - RNA, 22 nt, Human
ucaugacaucuguuuaucucaa

SEQ ID NO: 975048 - RNA, 22 nt, Human
ccugggcucaagugauccuccu

SEQ ID NO: 975049 - RNA, 22 nt, Human
gcaagcaagcagguagagcuga

SEQ ID NO: 975050 - RNA, 22 nt, Human
gcagcugccgugagcucacgcc

SEQ ID NO: 975051 - RNA, 22 nt, Human
agauggggcagaauggagccau

SEQ ID NO: 975052 - RNA, 22 nt, Human
cuguggaaauaaacaaugcuaa

SEQ ID NO: 975053 - RNA, 20 nt, Human
cugccaugauugauagagug

SEQ ID NO: 975054 - RNA, 19 nt, Human
uucaggauugacccuacug

SEQ ID NO: 975055 - RNA, 19 nt, Human
gccugccuggguuucugag

SEQ ID NO: 975056 - RNA, 22 nt, Human
cuuauguauaauguuccacaua

SEQ ID NO: 975057 - RNA, 22 nt, Human
aucaggaugaagcuguagcgaa

SEQ ID NO: 975058 - RNA, 22 nt, Human
uauucacagcugccgcacucag

SEQ ID NO: 975059 - RNA, 22 nt, Human
ggaggccacgguuuagcaccga

SEQ ID NO: 975060 - RNA, 22 nt, Human
aagagggaggugcgggugcaga

SEQ ID NO: 975061 - RNA, 22 nt, Human
uuuauuaaaacuguuggcucug

SEQ ID NO: 975062 - RNA, 21 nt, Human
uuacuuuugcaccaaccuaau

SEQ ID NO: 975063 - RNA, 22 nt, Human
gccacaugcaauugcagcacgu

SEQ ID NO: 975064 - RNA, 22 nt, Human
aguugacauccagagacauucu

SEQ ID NO: 975065 - RNA, 22 nt, Human
caguucuuaauaccaugugguu

SEQ ID NO: 975066 - RNA, 22 nt, Human
cagcugccacuugcucucggcu

SEQ ID NO: 975067 - RNA, 22 nt, Human
uggcagcagggaggccaguguu

SEQ ID NO: 975068 - RNA, 23 nt, Human
uuugaaaguaucaacucgccuga

SEQ ID NO: 975069 - RNA, 22 nt, Human
auauuagggucucuaaauucua

SEQ ID NO: 975070 - RNA, 22 nt, Human
uacauugugauguuucaauaca

SEQ ID NO: 975071 - RNA, 22 nt, Human
gaaucauuuauuuuugacagca

SEQ ID NO: 975072 - RNA, 22 nt, Human
uggcccugacuuggaggccuga

SEQ ID NO: 975073 - RNA, 22 nt, Human
uaucuugagagacaacacagca

SEQ ID NO: 975074 - RNA, 22 nt, Human
ucaaaguuuuugagaauuacau

SEQ ID NO: 975075 - RNA, 22 nt, Human
auauugaacccuacagacugua

SEQ ID NO: 975076 - RNA, 22 nt, Human
ugccucugaggaagauuguguu

SEQ ID NO: 975077 - RNA, 22 nt, Human
gaaaauguuuguccggagcuga

SEQ ID NO: 975078 - RNA, 22 nt, Human
aacaugaaaguugcuaagugca

SEQ ID NO: 975079 - RNA, 22 nt, Human
agcacaggaccaaggaagcugu

SEQ ID NO: 975080 - RNA, 22 nt, Human
caggggcuguggcacauggugu

SEQ ID NO: 975081 - RNA, 22 nt, Human
gcccuuccuuagacagcaggau

SEQ ID NO: 975082 - RNA, 22 nt, Human
gcuccuggagagauugagaaag

SEQ ID NO: 975083 - RNA, 22 nt, Human
augugucuuugagacucugcua

SEQ ID NO: 975084 - RNA, 22 nt, Human
aucuagauuagguauaagagcu

SEQ ID NO: 975085 - RNA, 22 nt, Human
ccauccugcauugcuauucaga

SEQ ID NO: 975086 - RNA, 22 nt, Human
gucuggccuuuuuagcuugugg

SEQ ID NO: 975087 - RNA, 22 nt, Human
uggccaggcagguagaacggcc

SEQ ID NO: 975088 - RNA, 22 nt, Human
auccuucaaggggcugacagcu

SEQ ID NO: 975089 - RNA, 22 nt, Human
gaagcagcagcuggggacaguu

SEQ ID NO: 975090 - RNA, 22 nt, Human
ccaggagagcgcccucccggcc

SEQ ID NO: 975091 - RNA, 21 nt, Human
ucccugcuuucuggcccaguc

SEQ ID NO: 975092 - RNA, 22 nt, Human
auaguuugugaaacacagcagu

SEQ ID NO: 975093 - RNA, 22 nt, Human
uuuauuaauguagcauccaugg

SEQ ID NO: 975094 - RNA, 22 nt, Human
cuuuuuccagcuucaggguggg

SEQ ID NO: 975095 - RNA, 22 nt, Human
cagaggcauacucccagucuug

SEQ ID NO: 975096 - RNA, 19 nt, Human
agugaaauggaguauucaa

SEQ ID NO: 975097 - RNA, 22 nt, Human
uuuaagagcuaguaugucauuu

SEQ ID NO: 975098 - RNA, 22 nt, Human
acugcaggagacacagcugcug

SEQ ID NO: 975099 - RNA, 22 nt, Human
acauuucugcaucucagagcua

SEQ ID NO: 975100 - RNA, 22 nt, Human
caaaugcuacuaauaggcaagu

SEQ ID NO: 975101 - RNA, 22 nt, Human
aucucagggcuggagcccugga

SEQ ID NO: 975102 - RNA, 22 nt, Human
agggaucaaaaaauguacaugc

SEQ ID NO: 975103 - RNA, 22 nt, Human
uccagccaagggagguuacuag

SEQ ID NO: 975104 - RNA, 22 nt, Human
aaguaugugauacauguuaauu

SEQ ID NO: 975105 - RNA, 22 nt, Human
ugcaccuuguccauuuuuggcc

SEQ ID NO: 975106 - RNA, 22 nt, Human
cacagggcagguacucucagag

SEQ ID NO: 975107 - RNA, 22 nt, Human
ggaggaccugcuggcccugcaa

SEQ ID NO: 975108 - RNA, 19 nt, Human
uugaaauuguuugauaugg

SEQ ID NO: 975109 - RNA, 22 nt, Human
agacucugcuaagaauauaauu

SEQ ID NO: 975110 - RNA, 22 nt, Human
caggagcagaggguggucagca

SEQ ID NO: 975111 - RNA, 22 nt, Human
ugaggcaggaguuaaugugcuc

SEQ ID NO: 975112 - RNA, 22 nt, Human
agccagcuguacugccugcuca

SEQ ID NO: 975113 - RNA, 22 nt, Human
ggaggagacaguaaaaagcacg

SEQ ID NO: 975114 - RNA, 22 nt, Human
ugaacucucucaagugacagaa

SEQ ID NO: 975115 - RNA, 22 nt, Human
cuguuuuugugcugugucuccc

SEQ ID NO: 975116 - RNA, 22 nt, Human
cacugugucaguuugguuagac

SEQ ID NO: 975117 - RNA, 22 nt, Human
gaaaugcauggaucuuggcaga

SEQ ID NO: 975118 - RNA, 20 nt, Human
ucaggcaguggggaaaggca

SEQ ID NO: 975119 - RNA, 22 nt, Human
ucagagcuuaucucuugcugga

SEQ ID NO: 975120 - RNA, 22 nt, Human
aucauuacuccuguaaaauugu

SEQ ID NO: 975121 - RNA, 22 nt, Human
uuuccuuccuugcuagccugag

SEQ ID NO: 975122 - RNA, 22 nt, Human
gcuguucacaucuggaccauuu

SEQ ID NO: 975123 - RNA, 22 nt, Human
ccuccuggaggcucuagggaaa

SEQ ID NO: 975124 - RNA, 22 nt, Human
cugccuggaaggagcaagggga

SEQ ID NO: 975125 - RNA, 22 nt, Human
ggcuguggcagcuggaaguggu

SEQ ID NO: 975126 - RNA, 22 nt, Human
cgucccaguuccagccgcgcug

SEQ ID NO: 975127 - RNA, 22 nt, Human
gacagcuguggagaggcaugug

SEQ ID NO: 975128 - RNA, 23 nt, Human
agucaguguaaguuuggaaugca

SEQ ID NO: 975129 - RNA, 22 nt, Human
cccucugaccuccugccacagu

SEQ ID NO: 975130 - RNA, 22 nt, Human
cacacaggagagugcuggaggu

SEQ ID NO: 975131 - RNA, 22 nt, Human
uccugccugagcguggaggagg

SEQ ID NO: 975132 - RNA, 22 nt, Human
cagagacauuaagugccaugau

SEQ ID NO: 975133 - RNA, 22 nt, Human
uuaaugcagaaaucaaacugac

SEQ ID NO: 975134 - RNA, 22 nt, Human
ucugggaaccagugcggcuggg

SEQ ID NO: 975135 - RNA, 23 nt, Human
guaaaauacgcagugcaguguga

SEQ ID NO: 975136 - RNA, 19 nt, Human
ucucaauguucagaaagcu

SEQ ID NO: 975137 - RNA, 22 nt, Human
aaggcagcccuggcucagccug

SEQ ID NO: 975138 - RNA, 22 nt, Human
caugcacaacauacucaagagg

SEQ ID NO: 975139 - RNA, 20 nt, Human
uuucacaaugaacaugucuc

SEQ ID NO: 975140 - RNA, 22 nt, Human
uuccaguucccaugaggauuaa

SEQ ID NO: 975141 - RNA, 20 nt, Human
cuguggcucaugcaucugcc

SEQ ID NO: 975142 - RNA, 22 nt, Human
aagcacuuagaagagugccugc

SEQ ID NO: 975143 - RNA, 22 nt, Human
ucauccuuuugcaugggaaggc

SEQ ID NO: 975144 - RNA, 22 nt, Human
ucaaaugcuguauuguaguaau

SEQ ID NO: 975145 - RNA, 22 nt, Human
aggcagcuaagauggauaauga

SEQ ID NO: 975146 - RNA, 22 nt, Human
uggcucagcagguuagaaacua

SEQ ID NO: 975147 - RNA, 22 nt, Human
gccuggagcucaugugggcauu

SEQ ID NO: 975148 - RNA, 22 nt, Human
uauuuccugcauggugauguaa

SEQ ID NO: 975149 - RNA, 22 nt, Human
agaaauguauucuguauguuuu

SEQ ID NO: 975150 - RNA, 22 nt, Human
agucuugcucuugcaucugcuu

SEQ ID NO: 975151 - RNA, 21 nt, Human
acaggagaccgccuggcaguc

SEQ ID NO: 975152 - RNA, 22 nt, Human
guaauguguuuugaaaaacagu

SEQ ID NO: 975153 - RNA, 22 nt, Human
aggcagccagauggcagccugc

SEQ ID NO: 975154 - RNA, 22 nt, Human
ccacccuuggguucggaggccg

SEQ ID NO: 975155 - RNA, 22 nt, Human
ccuggcugggccugauuucuca

SEQ ID NO: 975156 - RNA, 22 nt, Human
acaaacuaccuacagauguuca

SEQ ID NO: 975157 - RNA, 22 nt, Human
gggcacugcuuugcucugucac

SEQ ID NO: 975158 - RNA, 22 nt, Human
uucucagauccaucagaagucc

SEQ ID NO: 975159 - RNA, 22 nt, Human
aucaguuugauaauaaggcuug

SEQ ID NO: 975160 - RNA, 22 nt, Human
gggucuggcaugcugagaugga

SEQ ID NO: 975161 - RNA, 22 nt, Human
uugaauaguuuuggauagcaua

SEQ ID NO: 975162 - RNA, 22 nt, Human
ugguuuauuucucugaaagguu

SEQ ID NO: 975163 - RNA, 22 nt, Human
aacaauaauugcgguucucuau

SEQ ID NO: 975164 - RNA, 22 nt, Human
auucacaauuagaaguagauaa

SEQ ID NO: 975165 - RNA, 22 nt, Human
ccuuggcccuagccucaggcaa

SEQ ID NO: 975166 - RNA, 22 nt, Human
cugggccauggaagucucugcc

SEQ ID NO: 975167 - RNA, 22 nt, Human
ccagggcuggguuugucggugu

SEQ ID NO: 975168 - RNA, 22 nt, Human
ggcagagacuggguuggcagag

SEQ ID NO: 975169 - RNA, 22 nt, Human
gcucugaggcugggagcacucu

SEQ ID NO: 975170 - RNA, 22 nt, Human
uauuggaugauucacuuggcag

SEQ ID NO: 975171 - RNA, 22 nt, Human
gcccugcugucuucagaguaua

SEQ ID NO: 975172 - RNA, 22 nt, Human
auguuuauguugggcuauauuu

SEQ ID NO: 975173 - RNA, 22 nt, Human
cuggggacuugcagacacaauu

SEQ ID NO: 975174 - RNA, 22 nt, Human
gcuccucuucucccacugaaug

SEQ ID NO: 975175 - RNA, 22 nt, Human
ucagggcacaggccuguggguu

SEQ ID NO: 975176 - RNA, 19 nt, Human
gccagcagaaugaugaggc

SEQ ID NO: 975177 - RNA, 22 nt, Human
uguacaaugccagggaacacca

SEQ ID NO: 975178 - RNA, 22 nt, Human
ucaucaaagcgcuuggaguagg

SEQ ID NO: 975179 - RNA, 22 nt, Human
uguacaguguagucaugagguu

SEQ ID NO: 975180 - RNA, 22 nt, Human
ugagcuuccucccugcauccau

SEQ ID NO: 975181 - RNA, 22 nt, Human
uacaaaguuugggguccucaaa

SEQ ID NO: 975182 - RNA, 22 nt, Human
gggcagcaucaggaggggcuuu

SEQ ID NO: 975183 - RNA, 23 nt, Human
uggcagugaucaaaagcuuacau

SEQ ID NO: 975184 - RNA, 22 nt, Human
augauguuaccaguacuuagag

SEQ ID NO: 975185 - RNA, 22 nt, Human
uagcugugagcacccaggcugu

SEQ ID NO: 975186 - RNA, 22 nt, Human
gcuggggcugggcugaggaaga

SEQ ID NO: 975187 - RNA, 22 nt, Human
agggcugcuauguugauucaga

SEQ ID NO: 975188 - RNA, 22 nt, Human
uguugagacugagggagucagc

SEQ ID NO: 975189 - RNA, 22 nt, Human
aaagacagagcuguaggggaaa

SEQ ID NO: 975190 - RNA, 22 nt, Human
ccuggcagcgugccgagcugcg

SEQ ID NO: 975191 - RNA, 22 nt, Human
aaagaggaaccaagagcacgug

SEQ ID NO: 975192 - RNA, 22 nt, Human
gcuacugauugaccuuggagag

SEQ ID NO: 975193 - RNA, 22 nt, Human
cucuggagaacuccuugugucu

SEQ ID NO: 975194 - RNA, 22 nt, Human
cuuaaagaaauugaggagagga

SEQ ID NO: 975195 - RNA, 22 nt, Human
ucagcuccacagcuccucugcc

SEQ ID NO: 975196 - RNA, 21 nt, Human
uucuucaguuuaauauaaaau

SEQ ID NO: 975197 - RNA, 22 nt, Human
agggcagccucucagccuaggu

SEQ ID NO: 975198 - RNA, 22 nt, Human
ccaggagauuuuuccauagcac

SEQ ID NO: 975199 - RNA, 22 nt, Human
auuccaguuggguucuaauaca

SEQ ID NO: 975200 - RNA, 22 nt, Human
auuucaguguugguuagcaagc

SEQ ID NO: 975201 - RNA, 22 nt, Human
uggcugggcccccaccugccuc

SEQ ID NO: 975202 - RNA, 22 nt, Human
uucucuuuugugaugugagaug

SEQ ID NO: 975203 - RNA, 22 nt, Human
aggcaggcugcuauggaguaga

SEQ ID NO: 975204 - RNA, 22 nt, Human
cugaggucaauuaaucaacaac

SEQ ID NO: 975205 - RNA, 19 nt, Human
ucucagaggaaaaauugcu

SEQ ID NO: 975206 - RNA, 22 nt, Human
ugaggcuggcaaggcugguauu

SEQ ID NO: 975207 - RNA, 22 nt, Human
cugcccaggaaccagaggggca

SEQ ID NO: 975208 - RNA, 22 nt, Human
uuggccaaagcucaccagugcu

SEQ ID NO: 975209 - RNA, 17 nt, Human
agugaaauuuacauugc

SEQ ID NO: 975210 - RNA, 22 nt, Human
gcuggcaggguucucacugaaa

SEQ ID NO: 975211 - RNA, 22 nt, Human
uaugcacaacaugcagguuugu

SEQ ID NO: 975212 - RNA, 22 nt, Human
agucuuaugguuaaauagaugc

SEQ ID NO: 975213 - RNA, 22 nt, Human
ugaaacauuugaugaucuuugg

SEQ ID NO: 975214 - RNA, 22 nt, Human
agcaagcuaccuagauagucua

SEQ ID NO: 975215 - RNA, 22 nt, Human
ucugggcuuuacacugugcuua

SEQ ID NO: 975216 - RNA, 22 nt, Human
ggugggcacccgagacuggauc

SEQ ID NO: 975217 - RNA, 22 nt, Human
uuuccauauucugcgucugcca

SEQ ID NO: 975218 - RNA, 20 nt, Human
caguuuaacuuugagcaguu

SEQ ID NO: 975219 - RNA, 22 nt, Human
ccagcagcagcguccaaggaga

SEQ ID NO: 975220 - RNA, 22 nt, Human
agcugucagugcugugccugua

SEQ ID NO: 975221 - RNA, 22 nt, Human
cucacagcagcucugcgagaua

SEQ ID NO: 975222 - RNA, 22 nt, Human
ugcucugguaacucacuuccau

SEQ ID NO: 975223 - RNA, 22 nt, Human
aaaaguaauugcaauuuuguag

SEQ ID NO: 975224 - RNA, 22 nt, Human
agcagagccagaauuggaccag

SEQ ID NO: 975225 - RNA, 22 nt, Human
gccuggcucacagagcagccuu

SEQ ID NO: 975226 - RNA, 22 nt, Human
uaggauguagcuaugucaucau

SEQ ID NO: 975227 - RNA, 22 nt, Human
caggagcaaggagcagugggau

SEQ ID NO: 975228 - RNA, 22 nt, Human
ggccuggaaugcuuuccuacca

SEQ ID NO: 975229 - RNA, 22 nt, Human
acuauacauugaauguuaaggu

SEQ ID NO: 975230 - RNA, 22 nt, Human
uuuuacuuaauucuuggucaug

SEQ ID NO: 975231 - RNA, 22 nt, Human
augggaggguggaaaggcucug

SEQ ID NO: 975232 - RNA, 22 nt, Human
ccuggccuggcacucccucugc

SEQ ID NO: 975233 - RNA, 21 nt, Human
agcuggcagauauggugucug

SEQ ID NO: 975234 - RNA, 22 nt, Human
caggcagcgcucguggccuggc

SEQ ID NO: 975235 - RNA, 22 nt, Human
ccaggacuuauuacaguauaac

SEQ ID NO: 975236 - RNA, 22 nt, Human
agcagcugggcucagagcuggg

SEQ ID NO: 975237 - RNA, 22 nt, Human
ucaagucucaauguauuauggu

SEQ ID NO: 975238 - RNA, 22 nt, Human
ucugcuguugccaugaguaaua

SEQ ID NO: 975239 - RNA, 18 nt, Human
ucacagugcucuugccua

SEQ ID NO: 975240 - RNA, 22 nt, Human
ucacaaaucauuuuaucugugu

SEQ ID NO: 975241 - RNA, 22 nt, Human
gcccaggaguugguggcugcag

SEQ ID NO: 975242 - RNA, 22 nt, Human
acagggccucagcugauucugg

SEQ ID NO: 975243 - RNA, 22 nt, Human
uuccuguuucauagaaaacuga

SEQ ID NO: 975244 - RNA, 22 nt, Human
ugucucagaauggcucauaaua

SEQ ID NO: 975245 - RNA, 22 nt, Human
gugcauguuaaugguguacaaa

SEQ ID NO: 975246 - RNA, 22 nt, Human
aggagguggccugagcgugccc

SEQ ID NO: 975247 - RNA, 23 nt, Human
cagugcagggcaacucagacucc

SEQ ID NO: 975248 - RNA, 22 nt, Human
ugaagcaggaaccagcagcauu

SEQ ID NO: 975249 - RNA, 22 nt, Human
aaugucugcucuacucaggagg

SEQ ID NO: 975250 - RNA, 22 nt, Human
uuugaaagagcugauacaugaa

SEQ ID NO: 975251 - RNA, 22 nt, Human
augauguugauaaauuacuuua

SEQ ID NO: 975252 - RNA, 22 nt, Human
gguggguuuggaagagcaggcu

SEQ ID NO: 975253 - RNA, 22 nt, Human
cagggcugguuugucgaagaaa

SEQ ID NO: 975254 - RNA, 22 nt, Human
agaauuagucacaauuauagga

SEQ ID NO: 975255 - RNA, 22 nt, Human
gagcccuguagcaagucauguc

SEQ ID NO: 975256 - RNA, 22 nt, Human
ggcagcuccucaaaaaauuaaa

SEQ ID NO: 975257 - RNA, 20 nt, Human
acugcuucuuucucugaccu

SEQ ID NO: 975258 - RNA, 22 nt, Human
uuugacagacauuuacuacauu

SEQ ID NO: 975259 - RNA, 22 nt, Human
ugucugguggguugacaggcag

SEQ ID NO: 975260 - RNA, 22 nt, Human
auacauguucguguacauguuc

SEQ ID NO: 975261 - RNA, 21 nt, Human
gccuggcagguggaagggcuc

SEQ ID NO: 975262 - RNA, 20 nt, Human
acugugaaugcugaauuagc

SEQ ID NO: 975263 - RNA, 22 nt, Human
ccaaaguccacaguuuacauua

SEQ ID NO: 975264 - RNA, 22 nt, Human
cagaauggcuuuuauggcucag

SEQ ID NO: 975265 - RNA, 22 nt, Human
caaaaguaauguaugcucaucg

SEQ ID NO: 975266 - RNA, 22 nt, Human
gcaugguggccuuaggguagcc

SEQ ID NO: 975267 - RNA, 22 nt, Human
aaaggccauuacuugcuuuuag

SEQ ID NO: 975268 - RNA, 22 nt, Human
acuggcagagacccugauggcc

SEQ ID NO: 975269 - RNA, 22 nt, Human
uauuuugagguauuuuugagcu

SEQ ID NO: 975270 - RNA, 22 nt, Human
cuggcagcuuagcacucugguu

SEQ ID NO: 975271 - RNA, 22 nt, Human
agagaggcugggcguagggcuu

SEQ ID NO: 975272 - RNA, 23 nt, Human
uaugaacugcauugcuggugugu

SEQ ID NO: 975273 - RNA, 22 nt, Human
gcuggcaguaaaggguuuggca

SEQ ID NO: 975274 - RNA, 22 nt, Human
ucaaggugcugugcugugcuag

SEQ ID NO: 975275 - RNA, 22 nt, Human
uggggccuggucagagcugcac

SEQ ID NO: 975276 - RNA, 22 nt, Human
ucugcaucauuuuucagagccg

SEQ ID NO: 975277 - RNA, 22 nt, Human
ucaagauaccaccauuauaugu

SEQ ID NO: 975278 - RNA, 22 nt, Human
auuagagaaauguugccaagau

SEQ ID NO: 975279 - RNA, 22 nt, Human
augugagguaucuaggucuucg

SEQ ID NO: 975280 - RNA, 22 nt, Human
gcaucuaauccaguccagcauc

SEQ ID NO: 975281 - RNA, 22 nt, Human
gucucuggguuaagcagugcau

SEQ ID NO: 975282 - RNA, 22 nt, Human
gagaggaguagacacuuugguu

SEQ ID NO: 975283 - RNA, 22 nt, Human
acucugccccgaguucugggaa

SEQ ID NO: 975284 - RNA, 22 nt, Human
auucugagacaauugccgucag

SEQ ID NO: 975285 - RNA, 22 nt, Human
aggccuggugaaugaaguaucu

SEQ ID NO: 975286 - RNA, 22 nt, Human
ccagcccucacugaggccucuc

SEQ ID NO: 975287 - RNA, 22 nt, Human
aucauucuagcuguuguguuga

SEQ ID NO: 975288 - RNA, 22 nt, Human
ggucccaggcucccucuugucc

SEQ ID NO: 975289 - RNA, 19 nt, Human
cugugcuuuaaacuccuau

SEQ ID NO: 975290 - RNA, 22 nt, Human
caggcagaguuagagcaacugg

SEQ ID NO: 975291 - RNA, 22 nt, Human
acaauucucucauaucuuauua

SEQ ID NO: 975292 - RNA, 20 nt, Human
ggaggguggaagaaagcaag

SEQ ID NO: 975293 - RNA, 19 nt, Human
gagcugccuuuugaagacc

SEQ ID NO: 975294 - RNA, 22 nt, Human
aaggcaggaugcggacccaucu

SEQ ID NO: 975295 - RNA, 22 nt, Human
acaaaguaggucaucaaagcuc

SEQ ID NO: 975296 - RNA, 22 nt, Human
cccucccagaugggcuugaggu

SEQ ID NO: 975297 - RNA, 22 nt, Human
uggcuuucucccccagcuucuc

SEQ ID NO: 975298 - RNA, 22 nt, Human
agccacagcgaaccucucuucc

SEQ ID NO: 975299 - RNA, 22 nt, Human
ugccucugugggcagagcugcc

SEQ ID NO: 975300 - RNA, 22 nt, Human
ggcagcaguaggagcuaaucuu

SEQ ID NO: 975301 - RNA, 22 nt, Human
cagcaggguuaagugacucacc

SEQ ID NO: 975302 - RNA, 22 nt, Human
gucccuuggcucacaaacagcu

SEQ ID NO: 975303 - RNA, 22 nt, Human
cuacacaguucugccuaauggc

SEQ ID NO: 975304 - RNA, 22 nt, Human
uccugagagcagcugcuuugga

SEQ ID NO: 975305 - RNA, 22 nt, Human
uacaguauuaugagugauugaa

SEQ ID NO: 975306 - RNA, 22 nt, Human
gugaggggaguaaagccauguu

SEQ ID NO: 975307 - RNA, 22 nt, Human
agcuccugaaaauccagacugg

SEQ ID NO: 975308 - RNA, 22 nt, Human
agucucugucguagaucagcgu

SEQ ID NO: 975309 - RNA, 20 nt, Human
agaguaacuggcacauaggg

SEQ ID NO: 975310 - RNA, 22 nt, Human
uuuacagaucuguugauuuguu

SEQ ID NO: 975311 - RNA, 22 nt, Human
gaagaacaagcagugcuuuccu

SEQ ID NO: 975312 - RNA, 22 nt, Human
uagugauuaaaggcagaauguu

SEQ ID NO: 975313 - RNA, 22 nt, Human
aaugcagugagccauuaaaugg

SEQ ID NO: 975314 - RNA, 17 nt, Human
agcugagcuggccaggg

SEQ ID NO: 975315 - RNA, 23 nt, Human
aguaaagcaauuguuggcgagag

SEQ ID NO: 975316 - RNA, 22 nt, Human
gcaggagacuggcugugguagu

SEQ ID NO: 975317 - RNA, 22 nt, Human
aaaggcaggcuuucacaucuca

SEQ ID NO: 975318 - RNA, 22 nt, Human
gcagacaucaagcacaggccca

SEQ ID NO: 975319 - RNA, 22 nt, Human
gccugagcccaggugugcagag

SEQ ID NO: 975320 - RNA, 22 nt, Human
uugggagcaaauaggaaagagg

SEQ ID NO: 975321 - RNA, 22 nt, Human
cuguguuggcuuuucucuugua

SEQ ID NO: 975322 - RNA, 22 nt, Human
agcugcagucaagcugggccac

SEQ ID NO: 975323 - RNA, 22 nt, Human
guggccuuuccugaagaaauga

SEQ ID NO: 975324 - RNA, 22 nt, Human
ccuuuuauaaaguuguauugaa

SEQ ID NO: 975325 - RNA, 22 nt, Human
cucucuggcacuucauugcugu

SEQ ID NO: 975326 - RNA, 22 nt, Human
cugagcccaggcgggagcugag

SEQ ID NO: 975327 - RNA, 22 nt, Human
uccaagggaaacugcacuucua

SEQ ID NO: 975328 - RNA, 22 nt, Human
cagcaauaagguaagcuucucc

SEQ ID NO: 975329 - RNA, 22 nt, Human
acauuguagacuuuucauaugu

SEQ ID NO: 975330 - RNA, 22 nt, Human
aaagcagagcagggcacuuaug

SEQ ID NO: 975331 - RNA, 22 nt, Human
gcauuauuaauagcugcaugag

SEQ ID NO: 975332 - RNA, 22 nt, Human
caggagauguaagacuucuguu

SEQ ID NO: 975333 - RNA, 22 nt, Human
ugaaagcacaaguucuaacagg

SEQ ID NO: 975334 - RNA, 22 nt, Human
uccuggccugucuggaguagcu

SEQ ID NO: 975335 - RNA, 22 nt, Human
aggcacugaauauccaguaaaa

SEQ ID NO: 975336 - RNA, 22 nt, Human
uacauuaacuuacguccacaug

SEQ ID NO: 975337 - RNA, 20 nt, Human
guccugggagccacagcaca

SEQ ID NO: 975338 - RNA, 22 nt, Human
cugaggcucaagggcagguggg

SEQ ID NO: 975339 - RNA, 22 nt, Human
aaugucugccugaacuuuauau

SEQ ID NO: 975340 - RNA, 22 nt, Human
gcuugcucaacccccgucucuc

SEQ ID NO: 975341 - RNA, 18 nt, Human
acauuucucucugcguga

SEQ ID NO: 975342 - RNA, 22 nt, Human
acucccacuccagaguagaagc

SEQ ID NO: 975343 - RNA, 21 nt, Human
ccccugggagcccugucagua

SEQ ID NO: 975344 - RNA, 22 nt, Human
ccugagggcgccgagcucccag

SEQ ID NO: 975345 - RNA, 22 nt, Human
ugugaaggcagcagcucugucc

SEQ ID NO: 975346 - RNA, 22 nt, Human
ugcuggcccaugaagacgcagu

SEQ ID NO: 975347 - RNA, 22 nt, Human
ggaagagccuggggugucaggc

SEQ ID NO: 975348 - RNA, 22 nt, Human
gugggccucuugaggguggcua

SEQ ID NO: 975349 - RNA, 22 nt, Human
gaaggaagucauuagugcagac

SEQ ID NO: 975350 - RNA, 22 nt, Human
ccagcagagcauggggaggaag

SEQ ID NO: 975351 - RNA, 22 nt, Human
guggccugggguuuguucugag

SEQ ID NO: 975352 - RNA, 22 nt, Human
ucagcagggagaggagaaugca

SEQ ID NO: 975353 - RNA, 22 nt, Human
aggaccugacuggcuccugcuu

SEQ ID NO: 975354 - RNA, 22 nt, Human
agccagaggccagccugccuca

SEQ ID NO: 975355 - RNA, 22 nt, Human
cagaguacugggagaacagaag

SEQ ID NO: 975356 - RNA, 22 nt, Human
uagaaagugaagguuaauuaau

SEQ ID NO: 975357 - RNA, 22 nt, Human
acuugaaaggaagcucuaaaac

SEQ ID NO: 975358 - RNA, 22 nt, Human
caaagguauaaguuaauauaca

SEQ ID NO: 975359 - RNA, 22 nt, Human
gcuguucauagaaauggucuca

SEQ ID NO: 975360 - RNA, 22 nt, Human
caggagacaauggcuguggggc

SEQ ID NO: 975361 - RNA, 22 nt, Human
ucaggcugguggucagauggcu

SEQ ID NO: 975362 - RNA, 22 nt, Human
cacucugcugaaaucgccuugu

SEQ ID NO: 975363 - RNA, 22 nt, Human
gagauuggccuggcuugccaac

SEQ ID NO: 975364 - RNA, 22 nt, Human
augacaguucuacacuuaaucu

SEQ ID NO: 975365 - RNA, 22 nt, Human
cagacaggguccuguccgucac

SEQ ID NO: 975366 - RNA, 22 nt, Human
uaugaagaaguucugugaaaug

SEQ ID NO: 975367 - RNA, 22 nt, Human
cccaggaggcagagauagcagu

SEQ ID NO: 975368 - RNA, 22 nt, Human
aggaggccgggauucuggagau

SEQ ID NO: 975369 - RNA, 22 nt, Human
auuuugaaaagcauuugaguaa

SEQ ID NO: 975370 - RNA, 22 nt, Human
agggcagaccacgugcaaggau

SEQ ID NO: 975371 - RNA, 22 nt, Human
gugcugugucuaucaggaauaa

SEQ ID NO: 975372 - RNA, 22 nt, Human
cuggccaagcuucucuaagcag

SEQ ID NO: 975373 - RNA, 22 nt, Human
ugauucacagacuucacaaggc

SEQ ID NO: 975374 - RNA, 22 nt, Human
ccaagcuacuuaggagucugag

SEQ ID NO: 975375 - RNA, 22 nt, Human
ugggccuggacaaggccacuag

SEQ ID NO: 975376 - RNA, 22 nt, Human
cugcagcuauauuuucccacag

SEQ ID NO: 975377 - RNA, 22 nt, Human
ggccucucucccuggcuugcag

SEQ ID NO: 975378 - RNA, 22 nt, Human
acagaauucuaguauguggcuu

SEQ ID NO: 975379 - RNA, 18 nt, Human
uggcagggaggaaauaua

SEQ ID NO: 975380 - RNA, 17 nt, Human
aaaauucuguaaagagg

SEQ ID NO: 975381 - RNA, 22 nt, Human
uggcugccuagucccucagccu

SEQ ID NO: 975382 - RNA, 22 nt, Human
cuauuagguaugugguugcuau

SEQ ID NO: 975383 - RNA, 22 nt, Human
acccaggguagagugcaguggc

SEQ ID NO: 975384 - RNA, 22 nt, Human
uaagucauaagucaugauguua

SEQ ID NO: 975385 - RNA, 22 nt, Human
agugaacaaagguagugagcau

SEQ ID NO: 975386 - RNA, 22 nt, Human
ugaugaaacugagguuccaaga

SEQ ID NO: 975387 - RNA, 22 nt, Human
augucacauggccuguacuuug

SEQ ID NO: 975388 - RNA, 22 nt, Human
agcugcaggccucuccugggga

SEQ ID NO: 975389 - RNA, 22 nt, Human
aaggagaguacaggaguuggua

SEQ ID NO: 975390 - RNA, 22 nt, Human
ucccuggguucccguggaagug

SEQ ID NO: 975391 - RNA, 22 nt, Human
gcagcaggcacggucucgacau

SEQ ID NO: 975392 - RNA, 22 nt, Human
ggugaagggugucauggcauuu

SEQ ID NO: 975393 - RNA, 22 nt, Human
cagaaauggaauuuuccaucac

SEQ ID NO: 975394 - RNA, 22 nt, Human
aggguggccaugagggagagau

SEQ ID NO: 975395 - RNA, 22 nt, Human
uuucacaaacucagggugugug

SEQ ID NO: 975396 - RNA, 22 nt, Human
agcugaaagugcuuugaggacu

SEQ ID NO: 975397 - RNA, 22 nt, Human
gaugccuccaaaugagggcaga

SEQ ID NO: 975398 - RNA, 22 nt, Human
aaacucuggagauguuuaugca

SEQ ID NO: 975399 - RNA, 19 nt, Human
gcugugccucucuccugcu

SEQ ID NO: 975400 - RNA, 22 nt, Human
accucugcuucccggguucaag

SEQ ID NO: 975401 - RNA, 22 nt, Human
ccagaagggcuauugcagugac

SEQ ID NO: 975402 - RNA, 22 nt, Human
ucauugcauuuauucacuggca

SEQ ID NO: 975403 - RNA, 22 nt, Human
agacaaaugguaauuaugucua

SEQ ID NO: 975404 - RNA, 22 nt, Human
agauuuagacugccuuaaucau

SEQ ID NO: 975405 - RNA, 20 nt, Human
uuucaagucagcaauucuca

SEQ ID NO: 975406 - RNA, 20 nt, Human
cuguaucagguuacaaagua

SEQ ID NO: 975407 - RNA, 22 nt, Human
cagggagaggcaucauagggaa

SEQ ID NO: 975408 - RNA, 22 nt, Human
caguggguccuaaguacaguuc

SEQ ID NO: 975409 - RNA, 22 nt, Human
auuuucuagauagaugaugcau

SEQ ID NO: 975410 - RNA, 22 nt, Human
acagagcugggaucugaaccca

SEQ ID NO: 975411 - RNA, 22 nt, Human
gcugccugaucauacaccaggg

SEQ ID NO: 975412 - RNA, 22 nt, Human
uuguaacagguacuaaauaacu

SEQ ID NO: 975413 - RNA, 22 nt, Human
cauugcacuccacccuaggcaa

SEQ ID NO: 975414 - RNA, 22 nt, Human
gaggagaggcuggacgcgguga

SEQ ID NO: 975415 - RNA, 22 nt, Human
caggggaguuuuaugcaacaga

SEQ ID NO: 975416 - RNA, 22 nt, Human
cugucaggggcggguggagcgg

SEQ ID NO: 975417 - RNA, 20 nt, Human
aggcagcuggccaggcaggu

SEQ ID NO: 975418 - RNA, 22 nt, Human
gaggcagcaugguaccuuggag

SEQ ID NO: 975419 - RNA, 22 nt, Human
uuauuccagcuaagaguccugg

SEQ ID NO: 975420 - RNA, 22 nt, Human
cuuuggcaaugucauuuucaau

SEQ ID NO: 975421 - RNA, 22 nt, Human
uaaggccaauuacauauguuca

SEQ ID NO: 975422 - RNA, 22 nt, Human
ccagcccugaacccugcugcau

SEQ ID NO: 975423 - RNA, 22 nt, Human
guuugauucaagaacaaagagu

SEQ ID NO: 975424 - RNA, 22 nt, Human
cuggccugaucucaugcugucc

SEQ ID NO: 975425 - RNA, 22 nt, Human
aucagcaagacuaggggaauac

SEQ ID NO: 975426 - RNA, 22 nt, Human
auaauaacaccugaauaggaaa

SEQ ID NO: 975427 - RNA, 22 nt, Human
caaauccagaucccagucguag

SEQ ID NO: 975428 - RNA, 22 nt, Human
auguacaaaaugccacugaauu

SEQ ID NO: 975429 - RNA, 22 nt, Human
uugaagaggacuuugcagcugu

SEQ ID NO: 975430 - RNA, 22 nt, Human
uuucucaguuacuagcuguggu

SEQ ID NO: 975431 - RNA, 22 nt, Human
gcagaagcagcagaugggcgca

SEQ ID NO: 975432 - RNA, 21 nt, Human
ugacugaggcuucuucacaca

SEQ ID NO: 975433 - RNA, 20 nt, Human
gcauggcauguagugaagug

SEQ ID NO: 975434 - RNA, 22 nt, Human
agucaguguucuccggagaggc

SEQ ID NO: 975435 - RNA, 22 nt, Human
auuuccagcagcauauuugucu

SEQ ID NO: 975436 - RNA, 22 nt, Human
auguuauaguuauaaaaugagg

SEQ ID NO: 975437 - RNA, 22 nt, Human
agacagcugcucgcagagcuau

SEQ ID NO: 975438 - RNA, 19 nt, Human
cagcugccuuuucuuugca

SEQ ID NO: 975439 - RNA, 22 nt, Human
aguacuuugcacuuugcucaga

SEQ ID NO: 975440 - RNA, 22 nt, Human
gccugaggaaugcuccugacuu

SEQ ID NO: 975441 - RNA, 17 nt, Human
gagacagcaggagcccc

SEQ ID NO: 975442 - RNA, 22 nt, Human
uuugacaucuaagaauucuuac

SEQ ID NO: 975443 - RNA, 22 nt, Human
agggccugcucuaucacucuca

SEQ ID NO: 975444 - RNA, 22 nt, Human
auuccaaagccugaauaaugga

SEQ ID NO: 975445 - RNA, 21 nt, Human
uucaaagagugggcauuguca

SEQ ID NO: 975446 - RNA, 22 nt, Human
ccagagucuaugaguccucauu

SEQ ID NO: 975447 - RNA, 22 nt, Human
acuucucuucauagguggcaau

SEQ ID NO: 975448 - RNA, 17 nt, Human
ugagaaguaggcaucau

SEQ ID NO: 975449 - RNA, 20 nt, Human
agaaucugacccagagagac

SEQ ID NO: 975450 - RNA, 22 nt, Human
uccuugaacagagggccugggu

SEQ ID NO: 975451 - RNA, 22 nt, Human
cugcuuugacuguuaagaacca

SEQ ID NO: 975452 - RNA, 22 nt, Human
cuggaaggucuguccccacugc

SEQ ID NO: 975453 - RNA, 22 nt, Human
ggcagcuucuuaauauggagac

SEQ ID NO: 975454 - RNA, 22 nt, Human
uuuuuuaguuaggucagaaugu

SEQ ID NO: 975455 - RNA, 22 nt, Human
ucagugcuucggcgagcaccua

SEQ ID NO: 975456 - RNA, 22 nt, Human
aucagcaagcaugguuaggugu

SEQ ID NO: 975457 - RNA, 22 nt, Human
gcccaggaagugacucagaugu

SEQ ID NO: 975458 - RNA, 22 nt, Human
ugcugucuguuuacuggcuaua

SEQ ID NO: 975459 - RNA, 22 nt, Human
agggaagagcuugcaagaaacc

SEQ ID NO: 975460 - RNA, 22 nt, Human
cuuucacauaauugaccuugaa

SEQ ID NO: 975461 - RNA, 22 nt, Human
gucaucuucgcagagugauuuu

SEQ ID NO: 975462 - RNA, 22 nt, Human
cagguggguguaugaaugcaaa

SEQ ID NO: 975463 - RNA, 22 nt, Human
aagcuggaacaucuugaggaag

SEQ ID NO: 975464 - RNA, 22 nt, Human
gcuggcuugauaguuucugcuu

SEQ ID NO: 975465 - RNA, 22 nt, Human
ccugugucuuccccacuggugu

SEQ ID NO: 975466 - RNA, 22 nt, Human
cugcuggggucagagcacuggg

SEQ ID NO: 975467 - RNA, 22 nt, Human
cacaguggcagguguggguugu

SEQ ID NO: 975468 - RNA, 18 nt, Human
gccugcaggcacgggggu

SEQ ID NO: 975469 - RNA, 22 nt, Human
gccagcuggagugagagugggc

SEQ ID NO: 975470 - RNA, 23 nt, Human
agaggccagccuuuggagacacc

SEQ ID NO: 975471 - RNA, 22 nt, Human
cuuuauauccagauguuuggug

SEQ ID NO: 975472 - RNA, 22 nt, Human
ugacauaauaauccaaacauac

SEQ ID NO: 975473 - RNA, 22 nt, Human
agagggcaaguguaguccagua

SEQ ID NO: 975474 - RNA, 18 nt, Human
cccacggugcuguagggc

SEQ ID NO: 975475 - RNA, 22 nt, Human
gggagggaaggaggcgccgugu

SEQ ID NO: 975476 - RNA, 22 nt, Human
gugggcuucuguuagggaggcu

SEQ ID NO: 975477 - RNA, 23 nt, Human
ucccaggaaucugcauuuuuaac

SEQ ID NO: 975478 - RNA, 18 nt, Human
uggcucugcagccagaug

SEQ ID NO: 975479 - RNA, 19 nt, Human
accaggagacagugagcuu

SEQ ID NO: 975480 - RNA, 22 nt, Human
ugacagaaauaguucuuaauuu

SEQ ID NO: 975481 - RNA, 22 nt, Human
uguguauucagcaagcgaaaca

SEQ ID NO: 975482 - RNA, 22 nt, Human
ccuggcagcuguuuggcuuggc

SEQ ID NO: 975483 - RNA, 22 nt, Human
gauuuuauuagcccaaacuuug

SEQ ID NO: 975484 - RNA, 22 nt, Human
gcaccuggcugcccagguggag

SEQ ID NO: 975485 - RNA, 23 nt, Human
acaguuauagcugugaauaacau

SEQ ID NO: 975486 - RNA, 22 nt, Human
aucaguuucuaccauguggaau

SEQ ID NO: 975487 - RNA, 22 nt, Human
aacauuucauuggaagcuaugu

SEQ ID NO: 975488 - RNA, 22 nt, Human
gagccagccuucuucugagguc

SEQ ID NO: 975489 - RNA, 22 nt, Human
aauaauguuaugucauucuucu

SEQ ID NO: 975490 - RNA, 22 nt, Human
cauggccuugagugacugcacu

SEQ ID NO: 975491 - RNA, 22 nt, Human
cagccuuugggucagaagauuc

SEQ ID NO: 975492 - RNA, 22 nt, Human
cucuuaaaauuaccuuugcaaa

SEQ ID NO: 975493 - RNA, 22 nt, Human
aagaauguggguggauaugaug

SEQ ID NO: 975494 - RNA, 22 nt, Human
agugcauugcaucucugcuuca

SEQ ID NO: 975495 - RNA, 22 nt, Human
gucuucuguaagaugagguccc

SEQ ID NO: 975496 - RNA, 22 nt, Human
gagaccaggaaguacagcagcc

SEQ ID NO: 975497 - RNA, 22 nt, Human
ucagccacuacccaccuuaaca

SEQ ID NO: 975498 - RNA, 22 nt, Human
gcugccugcacagagcugcuuu

SEQ ID NO: 975499 - RNA, 22 nt, Human
gccucugcggggcccgagcccg

SEQ ID NO: 975500 - RNA, 22 nt, Human
agcuucuguucaucuuccaggc

SEQ ID NO: 975501 - RNA, 22 nt, Human
aggucauuaaaguuaaaugagg

SEQ ID NO: 975502 - RNA, 22 nt, Human
agucccagaucuccauucgguc

SEQ ID NO: 975503 - RNA, 22 nt, Human
acaaaaagggagaugagguaga

SEQ ID NO: 975504 - RNA, 22 nt, Human
cugcugugcacccaggaaggcu

SEQ ID NO: 975505 - RNA, 22 nt, Human
ggcagcuauuccaagcagcacu

SEQ ID NO: 975506 - RNA, 20 nt, Human
cuguagggugcagcaggcuc

SEQ ID NO: 975507 - RNA, 22 nt, Human
uuccuggcaugaaaaauaucac

SEQ ID NO: 975508 - RNA, 22 nt, Human
acauagaaccuggcacauagua

SEQ ID NO: 975509 - RNA, 22 nt, Human
uccucuggcucuuucccuagga

SEQ ID NO: 975510 - RNA, 22 nt, Human
ugcuucuggaaacaguggcugu

SEQ ID NO: 975511 - RNA, 22 nt, Human
cccugagcccauaguugacauu

SEQ ID NO: 975512 - RNA, 22 nt, Human
caggauagaaaggccauggagu

SEQ ID NO: 975513 - RNA, 22 nt, Human
uaacugauauugaaaaacauca

SEQ ID NO: 975514 - RNA, 22 nt, Human
ugcccagggauaagccuagaga

SEQ ID NO: 975515 - RNA, 22 nt, Human
caagagagaugcagcucacuca

SEQ ID NO: 975516 - RNA, 22 nt, Human
caaauaguaugagcaaugauuc

SEQ ID NO: 975517 - RNA, 22 nt, Human
aaacaugagcacuugcuucaua

SEQ ID NO: 975518 - RNA, 22 nt, Human
uuccauaauaggcuuaagugaa

SEQ ID NO: 975519 - RNA, 19 nt, Human
gagcacagcggcauuuggu

SEQ ID NO: 975520 - RNA, 22 nt, Human
uagaguguuguaauugaaaagg

SEQ ID NO: 975521 - RNA, 22 nt, Human
cugcagaggccucgccuccucu

SEQ ID NO: 975522 - RNA, 22 nt, Human
aggaguggaauuacuggguucu

SEQ ID NO: 975523 - RNA, 20 nt, Human
cugggcagguguuugaucuc

SEQ ID NO: 975524 - RNA, 22 nt, Human
gucacuguauccagguuccagc

SEQ ID NO: 975525 - RNA, 22 nt, Human
aggagagcuggugucuggaauc

SEQ ID NO: 975526 - RNA, 22 nt, Human
uuuucauuguuacuaugagcua

SEQ ID NO: 975527 - RNA, 22 nt, Human
uccucugcuccaggcuggacuu

SEQ ID NO: 975528 - RNA, 22 nt, Human
cccagcagccagaaugaggagc

SEQ ID NO: 975529 - RNA, 20 nt, Human
uaggcagagcugugcagccu

SEQ ID NO: 975530 - RNA, 22 nt, Human
gaggccuggcucugcccuccug

SEQ ID NO: 975531 - RNA, 22 nt, Human
gucccagagagcacuaguccau

SEQ ID NO: 975532 - RNA, 22 nt, Human
acagaauauugguuacuguugc

SEQ ID NO: 975533 - RNA, 22 nt, Human
ugcaagagguaaaaugaaagga

SEQ ID NO: 975534 - RNA, 22 nt, Human
acauaaauagauuauugggagg

SEQ ID NO: 975535 - RNA, 22 nt, Human
uuugugaaaugaagucacaacu

SEQ ID NO: 975536 - RNA, 22 nt, Human
uccugagagcagaguccaggug

SEQ ID NO: 975537 - RNA, 22 nt, Human
uuggcagagaguaugcugaaga

SEQ ID NO: 975538 - RNA, 22 nt, Human
gagguucacaggcuaucacagu

SEQ ID NO: 975539 - RNA, 22 nt, Human
auuguauaacagcauguauuuu

SEQ ID NO: 975540 - RNA, 22 nt, Human
cagagccaucccagccuguggu

SEQ ID NO: 975541 - RNA, 22 nt, Human
cacugaaggaaggacuacugca

SEQ ID NO: 975542 - RNA, 22 nt, Human
augaaugacugucuacuuuggg

SEQ ID NO: 975543 - RNA, 22 nt, Human
gcugagcuagcuaucucagucu

SEQ ID NO: 975544 - RNA, 22 nt, Human
gccagugguagaggggaggccg

SEQ ID NO: 975545 - RNA, 22 nt, Human
auuuauuaugggauuuggcaca

SEQ ID NO: 975546 - RNA, 22 nt, Human
uagagcuggaaaacugcaggua

SEQ ID NO: 975547 - RNA, 22 nt, Human
aagacauuuauuugaaucaauu

SEQ ID NO: 975548 - RNA, 22 nt, Human
agucucuuuaaucacagugucu

SEQ ID NO: 975549 - RNA, 22 nt, Human
guuauaaaugacugcaaaaguu

SEQ ID NO: 975550 - RNA, 22 nt, Human
cugccaucugagccaaaagugc

SEQ ID NO: 975551 - RNA, 22 nt, Human
cucuggcuucuaccuugcaguu

SEQ ID NO: 975552 - RNA, 22 nt, Human
acuuucucaaaucagacuuuaa

SEQ ID NO: 975553 - RNA, 22 nt, Human
uucuuucccaguagaugugaaa

SEQ ID NO: 975554 - RNA, 18 nt, Human
accugccuguucuucucu

SEQ ID NO: 975555 - RNA, 22 nt, Human
uagggcagauucgguggaguuu

SEQ ID NO: 975556 - RNA, 22 nt, Human
uuuguaaagucuguucugaguu

SEQ ID NO: 975557 - RNA, 19 nt, Human
cugagcagcggcagcacuu

SEQ ID NO: 975558 - RNA, 22 nt, Human
ugggcacuauggcucugugcac

SEQ ID NO: 975559 - RNA, 22 nt, Human
gcucaggagcugacagccucaa

SEQ ID NO: 975560 - RNA, 22 nt, Human
agagccuggcucccagcuaccg

SEQ ID NO: 975561 - RNA, 22 nt, Human
ucucccacagccgugcuucaag

SEQ ID NO: 975562 - RNA, 19 nt, Human
gcuggccacgccccaguug

SEQ ID NO: 975563 - RNA, 22 nt, Human
cugggccagucucggccgcucu

SEQ ID NO: 975564 - RNA, 20 nt, Human
ccuggcuuugcaucugugau

SEQ ID NO: 975565 - RNA, 22 nt, Human
cccaggagaucuggaucucguc

SEQ ID NO: 975566 - RNA, 22 nt, Human
accaaggaagagauucucaguu

SEQ ID NO: 975567 - RNA, 22 nt, Human
uggaggcaccacuggcugcccg

SEQ ID NO: 975568 - RNA, 22 nt, Human
ugcucaggaaauaaugucugug

SEQ ID NO: 975569 - RNA, 22 nt, Human
uccagaguacggaagagucauc

SEQ ID NO: 975570 - RNA, 20 nt, Human
uggagcugugguaaggagca

SEQ ID NO: 975571 - RNA, 22 nt, Human
ugaaacacugcgauaaaauccu

SEQ ID NO: 975572 - RNA, 22 nt, Human
ucccuggcagcuaagggugguc

SEQ ID NO: 975573 - RNA, 22 nt, Human
gccuggcccagggcuccgcagg

SEQ ID NO: 975574 - RNA, 22 nt, Human
guccaugauucuguguaguaga

SEQ ID NO: 975575 - RNA, 22 nt, Human
ucagggauugcaaaauucaucc

SEQ ID NO: 975576 - RNA, 22 nt, Human
agccccacacucucucugagaa

SEQ ID NO: 975577 - RNA, 22 nt, Human
agaauucucuuccauugaaaca

SEQ ID NO: 975578 - RNA, 18 nt, Human
ucaagacaucaugaaaua

SEQ ID NO: 975579 - RNA, 22 nt, Human
aggcucuguuugcugugguacc

SEQ ID NO: 975580 - RNA, 22 nt, Human
agcaccuguggcucaugcucgu

SEQ ID NO: 975581 - RNA, 22 nt, Human
cuggccuggucuggccucucca

SEQ ID NO: 975582 - RNA, 22 nt, Human
ccaguggguaggccauggugag

SEQ ID NO: 975583 - RNA, 22 nt, Human
ucaguucuuuauuucacaguga

SEQ ID NO: 975584 - RNA, 22 nt, Human
uuccgcuguuuaguugaaguuu

SEQ ID NO: 975585 - RNA, 22 nt, Human
uauaacacucagaaagaaucau

SEQ ID NO: 975586 - RNA, 22 nt, Human
gagccugaauuugaccugcuua

SEQ ID NO: 975587 - RNA, 22 nt, Human
uaucuguuguccaugcagaaag

SEQ ID NO: 975588 - RNA, 22 nt, Human
ucauuacagagauauaaucuac

SEQ ID NO: 975589 - RNA, 22 nt, Human
ucagggcucaccagccucugcc

SEQ ID NO: 975590 - RNA, 22 nt, Human
uccaggaggaggaaggcugcca

SEQ ID NO: 975591 - RNA, 22 nt, Human
agaugcugugucuguucccuug

SEQ ID NO: 975592 - RNA, 22 nt, Human
aaaugucuuucaauagagaaau

SEQ ID NO: 975593 - RNA, 22 nt, Human
cccaggaaguggagguugcagu

SEQ ID NO: 975594 - RNA, 22 nt, Human
ucuguuuaggcaaaauagcuac

SEQ ID NO: 975595 - RNA, 22 nt, Human
guggagcccugccuugcucaug

SEQ ID NO: 975596 - RNA, 22 nt, Human
uaauuauuugaagacauuagag

SEQ ID NO: 975597 - RNA, 22 nt, Human
ugggaugggaucucgcuguguc

SEQ ID NO: 975598 - RNA, 22 nt, Human
uauuccaagcacagcaacccag

SEQ ID NO: 975599 - RNA, 22 nt, Human
aagcgccacgagaagcuggacc

SEQ ID NO: 975600 - RNA, 22 nt, Human
ucugucacucuagagauggcag

SEQ ID NO: 975601 - RNA, 22 nt, Human
cugcugugccuuaaaaugcaag

SEQ ID NO: 975602 - RNA, 22 nt, Human
agagacaccgcgcaucauggcu

SEQ ID NO: 975603 - RNA, 22 nt, Human
ggucccugcugaagccuuggug

SEQ ID NO: 975604 - RNA, 21 nt, Human
ucugagagcaacugcccuuua

SEQ ID NO: 975605 - RNA, 22 nt, Human
auaaugugaagauaaugcaaga

SEQ ID NO: 975606 - RNA, 22 nt, Human
aaagccauuacaaaauuucaua

SEQ ID NO: 975607 - RNA, 22 nt, Human
auguaagguucagaguauguga

SEQ ID NO: 975608 - RNA, 22 nt, Human
gcucucuguuauuaagaucuuu

SEQ ID NO: 975609 - RNA, 22 nt, Human
agcugucuuucugccuccugau

SEQ ID NO: 975610 - RNA, 22 nt, Human
uucauucuugggaucagagagu

SEQ ID NO: 975611 - RNA, 22 nt, Human
aaaagcucuuucugcuguagau

SEQ ID NO: 975612 - RNA, 22 nt, Human
ucccagccauuccuuuaggugu

SEQ ID NO: 975613 - RNA, 22 nt, Human
aggggagccccugguccuggug

SEQ ID NO: 975614 - RNA, 22 nt, Human
agucccagcuacucaagaggcu

SEQ ID NO: 975615 - RNA, 20 nt, Human
ugggcagcacugcuggcugg

SEQ ID NO: 975616 - RNA, 22 nt, Human
ucugggaagcugcgugccuguu

SEQ ID NO: 975617 - RNA, 19 nt, Human
gaucuuugccaauuuaagc

SEQ ID NO: 975618 - RNA, 22 nt, Human
uggcacugggaugcuacuguua

SEQ ID NO: 975619 - RNA, 22 nt, Human
agagccagcauuugacacuggc

SEQ ID NO: 975620 - RNA, 22 nt, Human
gcugggagcccuggucugcucc

SEQ ID NO: 975621 - RNA, 22 nt, Human
caggcacuucugcugcuugucu

SEQ ID NO: 975622 - RNA, 22 nt, Human
aaaucagacuugaauuuucauc

SEQ ID NO: 975623 - RNA, 22 nt, Human
agacaaauggaguaugagcaac

SEQ ID NO: 975624 - RNA, 23 nt, Human
ucaugcccaggcuccagauguca

SEQ ID NO: 975625 - RNA, 22 nt, Human
aauauuuguuaguguuuuaaug

SEQ ID NO: 975626 - RNA, 22 nt, Human
uggaaggaagccaaggaagguu

SEQ ID NO: 975627 - RNA, 22 nt, Human
ucacugaauacuugucucaucc

SEQ ID NO: 975628 - RNA, 22 nt, Human
gcucugagucucagcuaccaca

SEQ ID NO: 975629 - RNA, 22 nt, Human
gccuccccugcaauuguccuug

SEQ ID NO: 975630 - RNA, 22 nt, Human
uuccaugagcucugaguucaca

SEQ ID NO: 975631 - RNA, 21 nt, Human
uuucuuaggcucuaaaaugac

SEQ ID NO: 975632 - RNA, 20 nt, Human
ccugggcuccaggagccccg

SEQ ID NO: 975633 - RNA, 22 nt, Human
gcucagagggaacaaggggcug

SEQ ID NO: 975634 - RNA, 21 nt, Human
uucagcaagcacucuggacac

SEQ ID NO: 975635 - RNA, 22 nt, Human
ucaguguaaguuauguagaugu

SEQ ID NO: 975636 - RNA, 22 nt, Human
agguuuucagcuguauccugag

SEQ ID NO: 975637 - RNA, 22 nt, Human
auuggcaaggcugcggugucug

SEQ ID NO: 975638 - RNA, 22 nt, Human
acccaggacaugggcacccgug

SEQ ID NO: 975639 - RNA, 22 nt, Human
agggccugggauguccuccuag

SEQ ID NO: 975640 - RNA, 22 nt, Human
uauggcauaucugggagacucu

SEQ ID NO: 975641 - RNA, 22 nt, Human
aggugaaguugaggaggcagaa

SEQ ID NO: 975642 - RNA, 20 nt, Human
gagccugggaagucuaaggu

SEQ ID NO: 975643 - RNA, 22 nt, Human
caggggccaggcugucugcugu

SEQ ID NO: 975644 - RNA, 22 nt, Human
uaaucacaucaggguaaauggg

SEQ ID NO: 975645 - RNA, 22 nt, Human
uaguaaaaguuuaguugaaagu

SEQ ID NO: 975646 - RNA, 22 nt, Human
uggugagcucuuuagacuggga

SEQ ID NO: 975647 - RNA, 22 nt, Human
cuggagccauguauagccuaug

SEQ ID NO: 975648 - RNA, 22 nt, Human
ugcagcccuuccuuccucuggg

SEQ ID NO: 975649 - RNA, 22 nt, Human
uauuucuaagagauaucuguac

SEQ ID NO: 975650 - RNA, 22 nt, Human
cugggccuagaggaagcugaca

SEQ ID NO: 975651 - RNA, 22 nt, Human
aaguuucaugauguaauuauug

SEQ ID NO: 975652 - RNA, 22 nt, Human
ccaggcugcuuagccuuaucuu

SEQ ID NO: 975653 - RNA, 22 nt, Human
cagcagagaaauuaaacuucug

SEQ ID NO: 975654 - RNA, 22 nt, Human
uccaugagcuagcuuuccaaag

SEQ ID NO: 975655 - RNA, 22 nt, Human
cuacauuaaauuggcuuacuua

SEQ ID NO: 975656 - RNA, 22 nt, Human
ucucaggaucuaauacauggua

SEQ ID NO: 975657 - RNA, 22 nt, Human
agaggcccucucucuccugaug

SEQ ID NO: 975658 - RNA, 22 nt, Human
ucagagugaccuuacauggucu

SEQ ID NO: 975659 - RNA, 22 nt, Human
cugagguguugaugaccuaugc

SEQ ID NO: 975660 - RNA, 23 nt, Human
uuccagaguccacaucugccacc

SEQ ID NO: 975661 - RNA, 22 nt, Human
caaaguccauaguuuacaauag

SEQ ID NO: 975662 - RNA, 22 nt, Human
aacagcaugcuggguaacauug

SEQ ID NO: 975663 - RNA, 22 nt, Human
ucagagaaaugaaguagggauu

SEQ ID NO: 975664 - RNA, 20 nt, Human
gcccaggaauuugcauuucu

SEQ ID NO: 975665 - RNA, 22 nt, Human
uuuuccuauaugcaaagaaugc

SEQ ID NO: 975666 - RNA, 22 nt, Human
uugcucaggcuggugugcagug

SEQ ID NO: 975667 - RNA, 22 nt, Human
ccucugggagacugcuacugag

SEQ ID NO: 975668 - RNA, 22 nt, Human
ccugggagaacugcuggguugg

SEQ ID NO: 975669 - RNA, 22 nt, Human
uggcagcuguguccagguagaa

SEQ ID NO: 975670 - RNA, 22 nt, Human
aggcaugugacccuggacucag

SEQ ID NO: 975671 - RNA, 22 nt, Human
ggugaaggucagagcaggaaaa

SEQ ID NO: 975672 - RNA, 22 nt, Human
ucccagagucuucuccuguaau

SEQ ID NO: 975673 - RNA, 22 nt, Human
gggcagcugucuugguucucaa

SEQ ID NO: 975674 - RNA, 22 nt, Human
aagaauguucuuguagucauga

SEQ ID NO: 975675 - RNA, 22 nt, Human
aaucaguucuacaucuuaucca

SEQ ID NO: 975676 - RNA, 23 nt, Human
uucaaaacuggaaaaucagaugc

SEQ ID NO: 975677 - RNA, 22 nt, Human
cugggcagagcuaacaccugag

SEQ ID NO: 975678 - RNA, 22 nt, Human
aagugagauuauauguacggga

SEQ ID NO: 975679 - RNA, 22 nt, Human
ggcucugcccagaugaagagga

SEQ ID NO: 975680 - RNA, 22 nt, Human
aagucuuacagacaagcugaag

SEQ ID NO: 975681 - RNA, 22 nt, Human
acuguguccuauuuccuugaca

SEQ ID NO: 975682 - RNA, 22 nt, Human
gaggggcuggcuguggucccau

SEQ ID NO: 975683 - RNA, 22 nt, Human
uuucuguuaggcaucauuuuaa

SEQ ID NO: 975684 - RNA, 22 nt, Human
cagaaaaccugacucuagaacu

SEQ ID NO: 975685 - RNA, 22 nt, Human
cuguccauuuucgugccuccuu

SEQ ID NO: 975686 - RNA, 22 nt, Human
cuggucugagggcucuugaggc

SEQ ID NO: 975687 - RNA, 22 nt, Human
aggugaguugguaggaaguuug

SEQ ID NO: 975688 - RNA, 22 nt, Human
ugaugcugcugggaguggugcu

SEQ ID NO: 975689 - RNA, 22 nt, Human
uuauuccaguaaucucuguaau

SEQ ID NO: 975690 - RNA, 20 nt, Human
aucuggcucagauccugcag

SEQ ID NO: 975691 - RNA, 22 nt, Human
cucaggauugugccuagggaga

SEQ ID NO: 975692 - RNA, 22 nt, Human
uaagcuauuccugaagaagguu

SEQ ID NO: 975693 - RNA, 22 nt, Human
cugcugagaaaagacugaggga

SEQ ID NO: 975694 - RNA, 22 nt, Human
uguucaaaugaucuucuuaaau

SEQ ID NO: 975695 - RNA, 22 nt, Human
uuuuucuaauggcuuaggaugu

SEQ ID NO: 975696 - RNA, 22 nt, Human
caggugggagccacagcguaca

SEQ ID NO: 975697 - RNA, 22 nt, Human
cccuucagcugagugggacagc

SEQ ID NO: 975698 - RNA, 22 nt, Human
agugugaccuuauuuggaaaca

SEQ ID NO: 975699 - RNA, 22 nt, Human
aauguauaaaguguuaauaacu

SEQ ID NO: 975700 - RNA, 22 nt, Human
aauguguagauguugcauuccu

SEQ ID NO: 975701 - RNA, 22 nt, Human
cccagguggguuggccucuguc

SEQ ID NO: 975702 - RNA, 22 nt, Human
gagcuggugugugcccgagcac

SEQ ID NO: 975703 - RNA, 22 nt, Human
ucuucagugaauggcaagaucu

SEQ ID NO: 975704 - RNA, 17 nt, Human
ucagcaggggccaagcu

SEQ ID NO: 975705 - RNA, 22 nt, Human
cucuuaaagcuuccaguuucaa

SEQ ID NO: 975706 - RNA, 22 nt, Human
ugagggagagggcgaaaaugaa

SEQ ID NO: 975707 - RNA, 22 nt, Human
cuaauacucauuucuguaacuc

SEQ ID NO: 975708 - RNA, 22 nt, Human
ggcugccugggagcccuccucu

SEQ ID NO: 975709 - RNA, 22 nt, Human
gugauaaagacgugucauaauu

SEQ ID NO: 975710 - RNA, 22 nt, Human
gcccaggaggucaaguagcuau

SEQ ID NO: 975711 - RNA, 22 nt, Human
uacaaagccugguagauaucug

SEQ ID NO: 975712 - RNA, 23 nt, Human
ccuggcagcaaacgaggagguua

SEQ ID NO: 975713 - RNA, 22 nt, Human
gcagaagcccggucagcgcacg

SEQ ID NO: 975714 - RNA, 22 nt, Human
uaggcagcuuagguuagaagug

SEQ ID NO: 975715 - RNA, 22 nt, Human
gcaguggcuaggagucuggcgu

SEQ ID NO: 975716 - RNA, 22 nt, Human
ucagaguguuuuacuaaacaag

SEQ ID NO: 975717 - RNA, 22 nt, Human
uuuuccucugagcuuugaauaa

SEQ ID NO: 975718 - RNA, 22 nt, Human
acagagcacauagauuggaguu

SEQ ID NO: 975719 - RNA, 22 nt, Human
aaagcuauuugugaguuauaga

SEQ ID NO: 975720 - RNA, 22 nt, Human
uggaguucauccaugacagcuu

SEQ ID NO: 975721 - RNA, 22 nt, Human
cagcaggaggugaguagcaggu

SEQ ID NO: 975722 - RNA, 23 nt, Human
aaaugcagggucgcagguuacag

SEQ ID NO: 975723 - RNA, 22 nt, Human
ucuccuggcauuugguugagua

SEQ ID NO: 975724 - RNA, 19 nt, Human
cccucaggucugagcaguc

SEQ ID NO: 975725 - RNA, 22 nt, Human
ugagaauuacaaaugagucaca

SEQ ID NO: 975726 - RNA, 22 nt, Human
ugauuuccuaggucuggagaag

SEQ ID NO: 975727 - RNA, 22 nt, Human
guggcugcagagggcacagcau

SEQ ID NO: 975728 - RNA, 22 nt, Human
acagagcuguacaugugccaug

SEQ ID NO: 975729 - RNA, 22 nt, Human
uuuccucuccaccaggaggucu

SEQ ID NO: 975730 - RNA, 22 nt, Human
cuggggugugcucagagcaggg

SEQ ID NO: 975731 - RNA, 22 nt, Human
gugucccaauguucaggacggc

SEQ ID NO: 975732 - RNA, 22 nt, Human
ugucaucucacugauauagaug

SEQ ID NO: 975733 - RNA, 22 nt, Human
cugggagcccugacuagccugg

SEQ ID NO: 975734 - RNA, 22 nt, Human
cucugagaaagcugugagcuaa

SEQ ID NO: 975735 - RNA, 22 nt, Human
gugcaugucggggugcauguca

SEQ ID NO: 975736 - RNA, 22 nt, Human
uuuuaauacugcuauuguagga

SEQ ID NO: 975737 - RNA, 22 nt, Human
ugggcugcagagcccggccuuc

SEQ ID NO: 975738 - RNA, 22 nt, Human
ucagcaguuuuauaugcagcuu

SEQ ID NO: 975739 - RNA, 22 nt, Human
augcccaaugucacaauuuuug

SEQ ID NO: 975740 - RNA, 22 nt, Human
aguuguaagagacagauauaaa

SEQ ID NO: 975741 - RNA, 22 nt, Human
cacagggcagagaccugggugc

SEQ ID NO: 975742 - RNA, 22 nt, Human
gucaucuuaucauuguugcugu

SEQ ID NO: 975743 - RNA, 22 nt, Human
uuuuuccuaagcaguggagcug

SEQ ID NO: 975744 - RNA, 22 nt, Human
ugucccaguuuugcagguuaga

SEQ ID NO: 975745 - RNA, 22 nt, Human
cccugagagugagugccaccuu

SEQ ID NO: 975746 - RNA, 22 nt, Human
ugcaggcuuuagccccauggcu

SEQ ID NO: 975747 - RNA, 22 nt, Human
cugggcacugcaggguguugag

SEQ ID NO: 975748 - RNA, 22 nt, Human
auuucuuuucaagagggugcuu

SEQ ID NO: 975749 - RNA, 22 nt, Human
ggggaggcugaugugggcaaag

SEQ ID NO: 975750 - RNA, 22 nt, Human
cuacauuuuucaccgagccucu

SEQ ID NO: 975751 - RNA, 22 nt, Human
caccaucagcagcaggugucaa

SEQ ID NO: 975752 - RNA, 21 nt, Human
cagaggggcuagccuggcugc

SEQ ID NO: 975753 - RNA, 22 nt, Human
gugguaauuuaauccuacacug

SEQ ID NO: 975754 - RNA, 22 nt, Human
cccagccucugggcucacccaa

SEQ ID NO: 975755 - RNA, 22 nt, Human
aggccaaguagcuagcauugaa

SEQ ID NO: 975756 - RNA, 19 nt, Human
ugaggccaaggucacagau

SEQ ID NO: 975757 - RNA, 22 nt, Human
ggcucugcccagguggacagca

SEQ ID NO: 975758 - RNA, 22 nt, Human
ccacugggcguuucuguccaau

SEQ ID NO: 975759 - RNA, 22 nt, Human
ggccucucuccuuggcuugcag

SEQ ID NO: 975760 - RNA, 22 nt, Human
aggcacuucucaaauucaugcc

SEQ ID NO: 975761 - RNA, 22 nt, Human
ggggccugcgagguucaacuuc

SEQ ID NO: 975762 - RNA, 22 nt, Human
ggccugggcccacugucaagag

SEQ ID NO: 975763 - RNA, 22 nt, Human
auaaggcacacauagauagggu

SEQ ID NO: 975764 - RNA, 22 nt, Human
ugucccuggaacuauggcucca

SEQ ID NO: 975765 - RNA, 22 nt, Human
caaggccaaagggccacuguca

SEQ ID NO: 975766 - RNA, 22 nt, Human
gaugccucuuuuggcugaauua

SEQ ID NO: 975767 - RNA, 19 nt, Human
ugcagaagacacaguggug

SEQ ID NO: 975768 - RNA, 22 nt, Human
ugcaccugagaggucucugagg

SEQ ID NO: 975769 - RNA, 22 nt, Human
guguggcugugggagauguuca

SEQ ID NO: 975770 - RNA, 22 nt, Human
ucagcaguguaguuuaucauuc

SEQ ID NO: 975771 - RNA, 17 nt, Human
cugaggcccagggccca

SEQ ID NO: 975772 - RNA, 22 nt, Human
aggcagugcugugcccugaacc

SEQ ID NO: 975773 - RNA, 22 nt, Human
uauugaggauugaggaaagcac

SEQ ID NO: 975774 - RNA, 22 nt, Human
uauuacugagguuuuauggagu

SEQ ID NO: 975775 - RNA, 22 nt, Human
ucaggagagaaagaauacaauu

SEQ ID NO: 975776 - RNA, 22 nt, Human
gaaauauugggacucagagcuu

SEQ ID NO: 975777 - RNA, 22 nt, Human
uagcagaaccagcagucaauuu

SEQ ID NO: 975778 - RNA, 22 nt, Human
cugugucugccugggauccauu

SEQ ID NO: 975779 - RNA, 22 nt, Human
ucacaccuguaaucccaggccu

SEQ ID NO: 975780 - RNA, 22 nt, Human
uggcagcugcguuguguuucug

SEQ ID NO: 975781 - RNA, 22 nt, Human
uggggaggacgggcgccuuccu

SEQ ID NO: 975782 - RNA, 22 nt, Human
ugugacagaucuuuaaauaaug

SEQ ID NO: 975783 - RNA, 22 nt, Human
gagaggcagaggccugaaaccg

SEQ ID NO: 975784 - RNA, 22 nt, Human
ucuacugcacuggugucucauc

SEQ ID NO: 975785 - RNA, 22 nt, Human
gggcagcucugcccaucagagg

SEQ ID NO: 975786 - RNA, 22 nt, Human
agaggccacuuugccugugaug

SEQ ID NO: 975787 - RNA, 22 nt, Human
acagaggccaugagcugccacc

SEQ ID NO: 975788 - RNA, 22 nt, Human
auacagaagaacuauagccacu

SEQ ID NO: 975789 - RNA, 22 nt, Human
uuucagggagccuagaagagcu

SEQ ID NO: 975790 - RNA, 22 nt, Human
ucaggagauggucuuuauaggc

SEQ ID NO: 975791 - RNA, 22 nt, Human
ugucuguaagguguuuauguua

SEQ ID NO: 975792 - RNA, 22 nt, Human
agcagcugagccccagcuguga

SEQ ID NO: 975793 - RNA, 22 nt, Human
agaaaucuaagaugcucaagga

SEQ ID NO: 975794 - RNA, 22 nt, Human
acagcuguauccccagagcuca

SEQ ID NO: 975795 - RNA, 22 nt, Human
uggcagcuccuggggccagcac

SEQ ID NO: 975796 - RNA, 22 nt, Human
gcggagggcgagcccgcggagc

SEQ ID NO: 975797 - RNA, 22 nt, Human
cucugagagcggucuguggcuu

SEQ ID NO: 975798 - RNA, 21 nt, Human
ggccugagcaccuguccaccu

SEQ ID NO: 975799 - RNA, 22 nt, Human
ggaggagggguuuacauuggaa

SEQ ID NO: 975800 - RNA, 22 nt, Human
cuugcuucauuagugucuuagu

SEQ ID NO: 975801 - RNA, 22 nt, Human
uuagccauggacugaauugacu

SEQ ID NO: 975802 - RNA, 22 nt, Human
cuggguaaguuccuaaggcuca

SEQ ID NO: 975803 - RNA, 22 nt, Human
ugguccuggggaucugcaguga

SEQ ID NO: 975804 - RNA, 22 nt, Human
cagcuuucaucagugacacuca

SEQ ID NO: 975805 - RNA, 22 nt, Human
ucaggaugaccacgagccucua

SEQ ID NO: 975806 - RNA, 22 nt, Human
gcauuuaaauuugaacuucaga

SEQ ID NO: 975807 - RNA, 22 nt, Human
agcugcccccagggcugugcuu

SEQ ID NO: 975808 - RNA, 22 nt, Human
ucuauacaaguuucacuuugac

SEQ ID NO: 975809 - RNA, 22 nt, Human
uuaagacaguguauuuguuuuc

SEQ ID NO: 975810 - RNA, 22 nt, Human
ugugcuucagguugucgccacg

SEQ ID NO: 975811 - RNA, 20 nt, Human
agugucugggccucaggccc

SEQ ID NO: 975812 - RNA, 22 nt, Human
cagcagcugauggggaagugau

SEQ ID NO: 975813 - RNA, 22 nt, Human
uaucuacaggugucagguaaga

SEQ ID NO: 975814 - RNA, 22 nt, Human
gcaaggcuuugugaauuuuaaa

SEQ ID NO: 975815 - RNA, 22 nt, Human
gcugccuucaguucugauucau

SEQ ID NO: 975816 - RNA, 22 nt, Human
cagcagugcuucagugugagau

SEQ ID NO: 975817 - RNA, 22 nt, Human
ucuggcucacuucaggcuucac

SEQ ID NO: 975818 - RNA, 22 nt, Human
aguguggguuuuauggagcccu

SEQ ID NO: 975819 - RNA, 22 nt, Human
ucugucacuuauuaagauggau

SEQ ID NO: 975820 - RNA, 20 nt, Human
uugcauuggaugugcaggug

SEQ ID NO: 975821 - RNA, 16 nt, Human
ccaccugcagcucuca

SEQ ID NO: 975822 - RNA, 22 nt, Human
ucugggagcacacgcagugauc

SEQ ID NO: 975823 - RNA, 22 nt, Human
caggcuugauuauucagacaau

SEQ ID NO: 975824 - RNA, 22 nt, Human
cuggaugcuuccucucugcuag

SEQ ID NO: 975825 - RNA, 22 nt, Human
uguaagauauucagcuuauuga

SEQ ID NO: 975826 - RNA, 22 nt, Human
cuccagggaaaggggcguccgc

SEQ ID NO: 975827 - RNA, 22 nt, Human
gcugcugugccuggcguccugu

SEQ ID NO: 975828 - RNA, 22 nt, Human
cucaggauuuacuaauuucaag

SEQ ID NO: 975829 - RNA, 21 nt, Human
gggugcuguggucaugcagga

SEQ ID NO: 975830 - RNA, 22 nt, Human
cggcagcugauugcagagcacc

SEQ ID NO: 975831 - RNA, 22 nt, Human
ggugaggcagguggcugcugag

SEQ ID NO: 975832 - RNA, 22 nt, Human
ccuggcugcauuuugcuggaug

SEQ ID NO: 975833 - RNA, 22 nt, Human
ugcugcuguauccuuaguguca

SEQ ID NO: 975834 - RNA, 22 nt, Human
aaacuacuaugggaauguacuu

SEQ ID NO: 975835 - RNA, 22 nt, Human
uggguggcggccugguucugag

SEQ ID NO: 975836 - RNA, 22 nt, Human
cuggugggagcagcaggcagcu

SEQ ID NO: 975837 - RNA, 22 nt, Human
cacgggagacgugaucuuggac

SEQ ID NO: 975838 - RNA, 22 nt, Human
agggcagcuaaggugcugacug

SEQ ID NO: 975839 - RNA, 22 nt, Human
caugcuuucuguccaaauguua

SEQ ID NO: 975840 - RNA, 22 nt, Human
aaagguaacaguuauaaccagg

SEQ ID NO: 975841 - RNA, 22 nt, Human
cugggaaauggcuucgagcuca

SEQ ID NO: 975842 - RNA, 22 nt, Human
ggcuggucacaccacugcaggg

SEQ ID NO: 975843 - RNA, 22 nt, Human
caguguacuuggaauguaacag

SEQ ID NO: 975844 - RNA, 22 nt, Human
auaugcacacucugcccacaga

SEQ ID NO: 975845 - RNA, 22 nt, Human
agcauccaacaggagggaaggg

SEQ ID NO: 975846 - RNA, 22 nt, Human
cugggcacacagugacucugca

SEQ ID NO: 975847 - RNA, 22 nt, Human
gccugcagauauauaggauggu

SEQ ID NO: 975848 - RNA, 22 nt, Human
auaacagauacucucugugagg

SEQ ID NO: 975849 - RNA, 22 nt, Human
caggaggaagaacucugcaaca

SEQ ID NO: 975850 - RNA, 22 nt, Human
gcucucuggaggccauggacag

SEQ ID NO: 975851 - RNA, 22 nt, Human
uugccuugauucuucucaugug

SEQ ID NO: 975852 - RNA, 22 nt, Human
uuaauguguguacaggauuuug

SEQ ID NO: 975853 - RNA, 22 nt, Human
accaucagucacauguagagaa

SEQ ID NO: 975854 - RNA, 22 nt, Human
ccaggcaggcgauggugcagug

SEQ ID NO: 975855 - RNA, 22 nt, Human
cccaggagguguagcugcgugg

SEQ ID NO: 975856 - RNA, 22 nt, Human
ugggcuccucgucacucgcugu

SEQ ID NO: 975857 - RNA, 22 nt, Human
gcucaaggcaggcagacaugag

SEQ ID NO: 975858 - RNA, 22 nt, Human
gugggacagcuggagggucccu

SEQ ID NO: 975859 - RNA, 22 nt, Human
gcagggcagccacaggcccccu

SEQ ID NO: 975860 - RNA, 23 nt, Human
agacaguggccgagagguacuag

SEQ ID NO: 975861 - RNA, 22 nt, Human
guguuuccuaguuuaaugaaug

SEQ ID NO: 975862 - RNA, 18 nt, Human
aggccaaacuuguaagca

SEQ ID NO: 975863 - RNA, 23 nt, Human
agcaauaagaagggauacaugug

SEQ ID NO: 975864 - RNA, 22 nt, Human
uagccaggcgaggucagugucg

SEQ ID NO: 975865 - RNA, 22 nt, Human
ggcagauggaagaggcuggguc

SEQ ID NO: 975866 - RNA, 22 nt, Human
cagcaauaacucaaagccauuu

SEQ ID NO: 975867 - RNA, 22 nt, Human
ucuggcucauaggaaggccauu

SEQ ID NO: 975868 - RNA, 22 nt, Human
caggcacagaguuauucauuua

SEQ ID NO: 975869 - RNA, 22 nt, Human
gagcacagcuggagguagcauu

SEQ ID NO: 975870 - RNA, 19 nt, Human
ccagguggaacugagguag

SEQ ID NO: 975871 - RNA, 22 nt, Human
gagcucccuggagguucagaua

SEQ ID NO: 975872 - RNA, 22 nt, Human
gcacugggaaugagggcagcuu

SEQ ID NO: 975873 - RNA, 22 nt, Human
uggcagcacuugaacuugagcc

SEQ ID NO: 975874 - RNA, 22 nt, Human
ugggggcauggaccagccuggc

SEQ ID NO: 975875 - RNA, 22 nt, Human
cuuggcagagggcugggcucag

SEQ ID NO: 975876 - RNA, 20 nt, Human
gugaccagaagacagugggu

SEQ ID NO: 975877 - RNA, 22 nt, Human
acagagguaggacaugagauau

SEQ ID NO: 975878 - RNA, 22 nt, Human
uucagauaaacuacaaauaauu

SEQ ID NO: 975879 - RNA, 22 nt, Human
gcacugggaaugugagcagcug

SEQ ID NO: 975880 - RNA, 22 nt, Human
cuuacagagaagaaaauguagu

SEQ ID NO: 975881 - RNA, 22 nt, Human
auggccaagagucgauuugggg

SEQ ID NO: 975882 - RNA, 22 nt, Human
aacugcauuugcauaaguccau

SEQ ID NO: 975883 - RNA, 22 nt, Human
guguuuuaagaaagaagcucag

SEQ ID NO: 975884 - RNA, 22 nt, Human
uauguguacaucugguugagca

SEQ ID NO: 975885 - RNA, 22 nt, Human
gagagcuggguucaaguagcug

SEQ ID NO: 975886 - RNA, 21 nt, Human
uggcagacuagaguauagaug

SEQ ID NO: 975887 - RNA, 23 nt, Human
ugaguucucaucuuggcuucuau

SEQ ID NO: 975888 - RNA, 22 nt, Human
caguuauuaugaggucauuagg

SEQ ID NO: 975889 - RNA, 22 nt, Human
caaggcaggaagccugucuuau

SEQ ID NO: 975890 - RNA, 22 nt, Human
cugagagccuccuguuggcuag

SEQ ID NO: 975891 - RNA, 21 nt, Human
gagugcaggucugaugccauc

SEQ ID NO: 975892 - RNA, 22 nt, Human
ucucagagggaaaggccaauuu

SEQ ID NO: 975893 - RNA, 22 nt, Human
aguaaaauuguauuggaaaaca

SEQ ID NO: 975894 - RNA, 19 nt, Human
cuguggcugaccucuggcc

SEQ ID NO: 975895 - RNA, 22 nt, Human
uuagagucaagcugcauguucu

SEQ ID NO: 975896 - RNA, 22 nt, Human
uuucaaauagaaucuuuccaaa

SEQ ID NO: 975897 - RNA, 22 nt, Human
cugagccauaagggaggcuggg

SEQ ID NO: 975898 - RNA, 19 nt, Human
augucuguugaauuucaua

SEQ ID NO: 975899 - RNA, 22 nt, Human
ucaagaaagggcuucaccagga

SEQ ID NO: 975900 - RNA, 22 nt, Human
cagucuuagaggugacugugga

SEQ ID NO: 975901 - RNA, 22 nt, Human
uggaggagaauuuauggucgaa

SEQ ID NO: 975902 - RNA, 22 nt, Human
ggugaggcccagugaucugugu

SEQ ID NO: 975903 - RNA, 18 nt, Human
acucaggaaaugaugaca

SEQ ID NO: 975904 - RNA, 22 nt, Human
uggccugggcaugaagcaucgu

SEQ ID NO: 975905 - RNA, 22 nt, Human
gauaccagacagggagggagaa

SEQ ID NO: 975906 - RNA, 22 nt, Human
aaaugcacacaccaggaaacua

SEQ ID NO: 975907 - RNA, 22 nt, Human
aggccugaggaccuucuggagg

SEQ ID NO: 975908 - RNA, 22 nt, Human
uggcucucaggccugcugcguu

SEQ ID NO: 975909 - RNA, 22 nt, Human
ggcaggcuggcuuuguuccagg

SEQ ID NO: 975910 - RNA, 22 nt, Human
uccuggcccuguggccugcagu

SEQ ID NO: 975911 - RNA, 22 nt, Human
uaugugucugucgugcauaaau

SEQ ID NO: 975912 - RNA, 22 nt, Human
auccaguuuaugucauauucuu

SEQ ID NO: 975913 - RNA, 22 nt, Human
ucugucacucccugaugaugaa

SEQ ID NO: 975914 - RNA, 22 nt, Human
ucucacucauuuccuaggucuu

SEQ ID NO: 975915 - RNA, 22 nt, Human
guaacauaguuugugcuucauc

SEQ ID NO: 975916 - RNA, 22 nt, Human
agugaccaacaaugcugagaag

SEQ ID NO: 975917 - RNA, 22 nt, Human
agaggcagaaguguucaaaccc

SEQ ID NO: 975918 - RNA, 22 nt, Human
gcagauggacuguaugaccuga

SEQ ID NO: 975919 - RNA, 21 nt, Human
aaggccugcuuacugcuaguu

SEQ ID NO: 975920 - RNA, 22 nt, Human
cagucacauggaugauggauag

SEQ ID NO: 975921 - RNA, 22 nt, Human
agacaggacacaagcugcauaa

SEQ ID NO: 975922 - RNA, 22 nt, Human
uuugacagauccuuaacucagc

SEQ ID NO: 975923 - RNA, 22 nt, Human
uuagaaaauuugcuucuuugga

SEQ ID NO: 975924 - RNA, 22 nt, Human
gcccuuccaacccagagggcaa

SEQ ID NO: 975925 - RNA, 22 nt, Human
ucucugggauaaacugggccag

SEQ ID NO: 975926 - RNA, 22 nt, Human
auugcagcuggucaggguaauu

SEQ ID NO: 975927 - RNA, 20 nt, Human
auguaaaauuauaaggcuga

SEQ ID NO: 975928 - RNA, 22 nt, Human
ggagcagacauaaccuuacaga

SEQ ID NO: 975929 - RNA, 22 nt, Human
ggcaguagccagggacuggcag

SEQ ID NO: 975930 - RNA, 22 nt, Human
aucaggaucugcaucauaagaa

SEQ ID NO: 975931 - RNA, 22 nt, Human
cuggcuccacucccugccugac

SEQ ID NO: 975932 - RNA, 22 nt, Human
gagaaagacguaggcugggagg

SEQ ID NO: 975933 - RNA, 22 nt, Human
uagaggugacacugagaccaua

SEQ ID NO: 975934 - RNA, 22 nt, Human
agucaaagcuacaggcauuuga

SEQ ID NO: 975935 - RNA, 22 nt, Human
aggcucuggaguguggugcugg

SEQ ID NO: 975936 - RNA, 22 nt, Human
cagugguugguagauacuugag

SEQ ID NO: 975937 - RNA, 22 nt, Human
accugaggccuccccagcagac

SEQ ID NO: 975938 - RNA, 21 nt, Human
gcugagagguugggaaguuca

SEQ ID NO: 975939 - RNA, 19 nt, Human
gcacacccugcaccaccau

SEQ ID NO: 975940 - RNA, 22 nt, Human
aaggcacuuuucuaaagaccuu

SEQ ID NO: 975941 - RNA, 22 nt, Human
ccugggucacucaggcaggcgg

SEQ ID NO: 975942 - RNA, 22 nt, Human
acaugcauaggagaagucuuua

SEQ ID NO: 975943 - RNA, 22 nt, Human
uaugcacaccuggguccuuguc

SEQ ID NO: 975944 - RNA, 22 nt, Human
cuucugugcuucacaguugcca

SEQ ID NO: 975945 - RNA, 22 nt, Human
uccagccuuucuacucacugag

SEQ ID NO: 975946 - RNA, 22 nt, Human
ccugugugcacacgaggccaug

SEQ ID NO: 975947 - RNA, 22 nt, Human
ccuggccaggcuccaaguacug

SEQ ID NO: 975948 - RNA, 22 nt, Human
uggcucaguggcagccgcagcu

SEQ ID NO: 975949 - RNA, 21 nt, Human
uuugaaagugggugauucuuu

SEQ ID NO: 975950 - RNA, 22 nt, Human
gcuuccugucccucagccauga

SEQ ID NO: 975951 - RNA, 22 nt, Human
ucauugcacuccagccugggca

SEQ ID NO: 975952 - RNA, 22 nt, Human
cuucagaauccagaaucagaau

SEQ ID NO: 975953 - RNA, 22 nt, Human
uugcuuuguggugguucuucca

SEQ ID NO: 975954 - RNA, 22 nt, Human
ccugggagcuguggaaaggcug

SEQ ID NO: 975955 - RNA, 22 nt, Human
auaugugugccauuucagcagu

SEQ ID NO: 975956 - RNA, 22 nt, Human
ccagaaaaugcagaacauagaa

SEQ ID NO: 975957 - RNA, 22 nt, Human
gcuuuggaugugugccugaggu

SEQ ID NO: 975958 - RNA, 22 nt, Human
cagaggccuuucuacagugaua

SEQ ID NO: 975959 - RNA, 22 nt, Human
gcuggccauucucuuugagaug

SEQ ID NO: 975960 - RNA, 21 nt, Human
gcagccacagccaccaagcua

SEQ ID NO: 975961 - RNA, 22 nt, Human
agauaauuugaguaaauuaauu

SEQ ID NO: 975962 - RNA, 22 nt, Human
guaacacagaaaugaaauucca

SEQ ID NO: 975963 - RNA, 22 nt, Human
gcuguguuugacaguagcagac

SEQ ID NO: 975964 - RNA, 22 nt, Human
acucugcuauugcagugcaaaa

SEQ ID NO: 975965 - RNA, 22 nt, Human
ccaaaaaguacauuuaggugug

SEQ ID NO: 975966 - RNA, 22 nt, Human
gccagccugugggggcucugug

SEQ ID NO: 975967 - RNA, 22 nt, Human
cuuauggcuguagucuggaagu

SEQ ID NO: 975968 - RNA, 22 nt, Human
ucucagaguuccucuggagucc

SEQ ID NO: 975969 - RNA, 22 nt, Human
ugugugacccccagugaagccu

SEQ ID NO: 975970 - RNA, 22 nt, Human
ucccagcagggccgaccagccu

SEQ ID NO: 975971 - RNA, 22 nt, Human
aagauuucuuacuuauugaugc

SEQ ID NO: 975972 - RNA, 22 nt, Human
cccuuggggaugcugugucugg

SEQ ID NO: 975973 - RNA, 22 nt, Human
guucccauacaguaucagugcu

SEQ ID NO: 975974 - RNA, 22 nt, Human
cccuggugguacggcacuggca

SEQ ID NO: 975975 - RNA, 22 nt, Human
ugcuuuggccacuagaauucag

SEQ ID NO: 975976 - RNA, 22 nt, Human
uaaguucaagucuuggauauaa

SEQ ID NO: 975977 - RNA, 22 nt, Human
cagggccugccugguuccugga

SEQ ID NO: 975978 - RNA, 22 nt, Human
aaguuuguuguacauguuagua

SEQ ID NO: 975979 - RNA, 22 nt, Human
agcucuccacacauaggacuag

SEQ ID NO: 975980 - RNA, 20 nt, Human
auaauuuacccugcaccacu

SEQ ID NO: 975981 - RNA, 19 nt, Human
gcccugcaggagguggggc

SEQ ID NO: 975982 - RNA, 22 nt, Human
gaagagcuuagacagaaucaaa

SEQ ID NO: 975983 - RNA, 22 nt, Human
uccaugaggaccaaauucguag

SEQ ID NO: 975984 - RNA, 18 nt, Human
uuugcaaaggaaguaugg

SEQ ID NO: 975985 - RNA, 22 nt, Human
acagaguaucuaucaggaguau

SEQ ID NO: 975986 - RNA, 22 nt, Human
cacauacaaugguguuauuugg

SEQ ID NO: 975987 - RNA, 22 nt, Human
cuggggcuggugaggcaggcuc

SEQ ID NO: 975988 - RNA, 22 nt, Human
cccaggaggcagaaguugcagu

SEQ ID NO: 975989 - RNA, 22 nt, Human
aguuugaauugaaaugcagaug

SEQ ID NO: 975990 - RNA, 22 nt, Human
gaggcuguuagggccugaggua

SEQ ID NO: 975991 - RNA, 20 nt, Human
gugccuggagaagaggcugu

SEQ ID NO: 975992 - RNA, 22 nt, Human
ugggacaguuguccuccacucu

SEQ ID NO: 975993 - RNA, 19 nt, Human
cugggccagaaucagcuca

SEQ ID NO: 975994 - RNA, 22 nt, Human
cagcucucuaaggucuugcuuu

SEQ ID NO: 975995 - RNA, 22 nt, Human
uacccagcuucaagucaggacu

SEQ ID NO: 975996 - RNA, 22 nt, Human
acugcuuacaaaaggaaagaau

SEQ ID NO: 975997 - RNA, 22 nt, Human
auaauuuuuguuugauguccaa

SEQ ID NO: 975998 - RNA, 22 nt, Human
uuauccuggauuauauauguga

SEQ ID NO: 975999 - RNA, 22 nt, Human
cucuguccuaugcuugauagaa

SEQ ID NO: 976000 - RNA, 22 nt, Human
agcagccagugggagugauaca

SEQ ID NO: 976001 - RNA, 22 nt, Human
agagccugugauugucaucacc

SEQ ID NO: 976002 - RNA, 18 nt, Human
ucuuccaacacugacacc

SEQ ID NO: 976003 - RNA, 22 nt, Human
gcccucagcuccuggacacaug

SEQ ID NO: 976004 - RNA, 22 nt, Human
cuccugggaauuuaguugugag

SEQ ID NO: 976005 - RNA, 22 nt, Human
cacaaugugguuugucaucuuu

SEQ ID NO: 976006 - RNA, 22 nt, Human
cugggcuggagugcaauggcgc

SEQ ID NO: 976007 - RNA, 22 nt, Human
uugggcugaaguagagggcaga

SEQ ID NO: 976008 - RNA, 22 nt, Human
cuggggugagcagaaacagggg

SEQ ID NO: 976009 - RNA, 17 nt, Human
ggugaguguccaggugg

SEQ ID NO: 976010 - RNA, 22 nt, Human
gagcagcuagauaaagcccuuc

SEQ ID NO: 976011 - RNA, 22 nt, Human
aguguuucucagaagggccuau

SEQ ID NO: 976012 - RNA, 22 nt, Human
cagucauuuuauuugaaaauua

SEQ ID NO: 976013 - RNA, 22 nt, Human
uacauauuugucuuuguacugu

SEQ ID NO: 976014 - RNA, 22 nt, Human
gcuguccugggaacaggcacua

SEQ ID NO: 976015 - RNA, 22 nt, Human
uucaaacaaaacuguucccaua

SEQ ID NO: 976016 - RNA, 22 nt, Human
uccugucagugaggcagaugaa

SEQ ID NO: 976017 - RNA, 22 nt, Human
cacagaauaaauugguaucaga

SEQ ID NO: 976018 - RNA, 22 nt, Human
auaugcacauacauacauaggu

SEQ ID NO: 976019 - RNA, 22 nt, Human
cugggcugagccugggcugugu

SEQ ID NO: 976020 - RNA, 22 nt, Human
aaagacuuggcuuaugauuugc

SEQ ID NO: 976021 - RNA, 23 nt, Human
ggguccagagacaggcaugggug

SEQ ID NO: 976022 - RNA, 22 nt, Human
ccacagagcauuagauuucaga

SEQ ID NO: 976023 - RNA, 22 nt, Human
ucccaggaaugucugaaaguga

SEQ ID NO: 976024 - RNA, 22 nt, Human
gcucugcugacagcugggacag

SEQ ID NO: 976025 - RNA, 22 nt, Human
uugaagcagagaaauacuugaa

SEQ ID NO: 976026 - RNA, 22 nt, Human
aaacaugaauagauauuaaaca

SEQ ID NO: 976027 - RNA, 22 nt, Human
gcucuggacuggggccugagaa

SEQ ID NO: 976028 - RNA, 22 nt, Human
uaaaauguguuucuguaugguu

SEQ ID NO: 976029 - RNA, 22 nt, Human
ugccuggcaagaggggcuggcu

SEQ ID NO: 976030 - RNA, 21 nt, Human
gggagcuggaaacugggugac

SEQ ID NO: 976031 - RNA, 22 nt, Human
ccagucagccaagcugcagcgg

SEQ ID NO: 976032 - RNA, 22 nt, Human
aguguugucaaacggcucagca

SEQ ID NO: 976033 - RNA, 22 nt, Human
gccucuggucccucaugcugug

SEQ ID NO: 976034 - RNA, 22 nt, Human
augaacacauguacacauuucu

SEQ ID NO: 976035 - RNA, 22 nt, Human
uggccacaugcgucugugaggc

SEQ ID NO: 976036 - RNA, 22 nt, Human
cuggagcucuguguguuccuga

SEQ ID NO: 976037 - RNA, 22 nt, Human
cagcucaaguuucccaggucag

SEQ ID NO: 976038 - RNA, 20 nt, Human
gggagucuggaugaaagaug

SEQ ID NO: 976039 - RNA, 22 nt, Human
cagcuggcuggucagugcacaa

SEQ ID NO: 976040 - RNA, 22 nt, Human
cugcauuagucaugcuuugcag

SEQ ID NO: 976041 - RNA, 20 nt, Human
cagaggcaaggagacuugga

SEQ ID NO: 976042 - RNA, 22 nt, Human
ugcauuaugcuacccagaagcu

SEQ ID NO: 976043 - RNA, 22 nt, Human
uggcagagucaucacaucugga

SEQ ID NO: 976044 - RNA, 22 nt, Human
gcaggagccacuucagggaugc

SEQ ID NO: 976045 - RNA, 22 nt, Human
aaguucaagaucaagguuccag

SEQ ID NO: 976046 - RNA, 22 nt, Human
cugggcagugguggcaucuuug

SEQ ID NO: 976047 - RNA, 23 nt, Human
ucuccuggcugcacuguggccac

SEQ ID NO: 976048 - RNA, 22 nt, Human
gaggccacagcuaucagggaca

SEQ ID NO: 976049 - RNA, 22 nt, Human
uguauuuuuagaccuuuagacc

SEQ ID NO: 976050 - RNA, 22 nt, Human
aggauccugcgcuuugggggag

SEQ ID NO: 976051 - RNA, 22 nt, Human
ugggaggcuuccagaccuugcu

SEQ ID NO: 976052 - RNA, 22 nt, Human
ugccaggcuaaguggaggacuu

SEQ ID NO: 976053 - RNA, 22 nt, Human
uggagcagcaucacuuugagcu

SEQ ID NO: 976054 - RNA, 22 nt, Human
cugggcuguucugccccugggu

SEQ ID NO: 976055 - RNA, 22 nt, Human
aagcaaagaguuuaguggguga

SEQ ID NO: 976056 - RNA, 22 nt, Human
cccagcaucccagugggcagca

SEQ ID NO: 976057 - RNA, 19 nt, Human
gaaggagagcugaguuagg

SEQ ID NO: 976058 - RNA, 22 nt, Human
cuccucugucuggcccugagcc

SEQ ID NO: 976059 - RNA, 22 nt, Human
uucuggaggccccuuccuucuc

SEQ ID NO: 976060 - RNA, 16 nt, Human
cagaguguaaacagga

SEQ ID NO: 976061 - RNA, 22 nt, Human
agcaguggcuggauggugugcu

SEQ ID NO: 976062 - RNA, 22 nt, Human
caggggaagaugccaagggaga

SEQ ID NO: 976063 - RNA, 22 nt, Human
caaagguauucucauuuuggaa

SEQ ID NO: 976064 - RNA, 22 nt, Human
aggucaaguuuagauagaguua

SEQ ID NO: 976065 - RNA, 22 nt, Human
ggggcagaaagcccacagagug

SEQ ID NO: 976066 - RNA, 22 nt, Human
uuauuacacugaaagaauugcg

SEQ ID NO: 976067 - RNA, 22 nt, Human
uacaguaaagcugcuaugaauu

SEQ ID NO: 976068 - RNA, 22 nt, Human
cuggccuggggccucagcugcu

SEQ ID NO: 976069 - RNA, 22 nt, Human
cuuaaauucuuaaugcccucau

SEQ ID NO: 976070 - RNA, 22 nt, Human
cccaggaguuagagguuguggu

SEQ ID NO: 976071 - RNA, 22 nt, Human
ggaggccaaggugggcggauca

SEQ ID NO: 976072 - RNA, 22 nt, Human
guauguguaaguaugccaccuu

SEQ ID NO: 976073 - RNA, 22 nt, Human
uaugaacucuggagucugagug

SEQ ID NO: 976074 - RNA, 22 nt, Human
ugcagcauugcaaagcagucuu

SEQ ID NO: 976075 - RNA, 22 nt, Human
acucugcucuuuggacaaugcc

SEQ ID NO: 976076 - RNA, 22 nt, Human
ucagaggagaaguugggaaaau

SEQ ID NO: 976077 - RNA, 22 nt, Human
acauuucuauagugcaucuguu

SEQ ID NO: 976078 - RNA, 22 nt, Human
uuugcacuagcauuuguccaug

SEQ ID NO: 976079 - RNA, 22 nt, Human
ucauguaaguauagaaagcagu

SEQ ID NO: 976080 - RNA, 22 nt, Human
guggauggacaugggcaagagg

SEQ ID NO: 976081 - RNA, 21 nt, Human
ccagacuggccuaugugguag

SEQ ID NO: 976082 - RNA, 22 nt, Human
aggcagcagccacaaggccuga

SEQ ID NO: 976083 - RNA, 22 nt, Human
uuggaaggagucaaccagcuga

SEQ ID NO: 976084 - RNA, 22 nt, Human
aagaguuaagcaacagauacca

SEQ ID NO: 976085 - RNA, 21 nt, Human
cucaggauggcggccuggugg

SEQ ID NO: 976086 - RNA, 21 nt, Human
agccagcuaucacacagcauu

SEQ ID NO: 976087 - RNA, 23 nt, Human
uacauuguggauggaguccuggg

SEQ ID NO: 976088 - RNA, 22 nt, Human
uguaugcagggcuuguaugcag

SEQ ID NO: 976089 - RNA, 22 nt, Human
caggugggagcgaggagcuacu

SEQ ID NO: 976090 - RNA, 22 nt, Human
ccucagagaaagguauggcuga

SEQ ID NO: 976091 - RNA, 22 nt, Human
uggaaggagcuaaggaccuggg

SEQ ID NO: 976092 - RNA, 22 nt, Human
aaaggccagguuggcugguauu

SEQ ID NO: 976093 - RNA, 22 nt, Human
auccaugaucaauuuauuacua

SEQ ID NO: 976094 - RNA, 22 nt, Human
ucaggcagaugcagggauggau

SEQ ID NO: 976095 - RNA, 22 nt, Human
aggagcagaccguaguccugca

SEQ ID NO: 976096 - RNA, 22 nt, Human
gcugucugucucugucccacca

SEQ ID NO: 976097 - RNA, 22 nt, Human
gcagauggcucagacacugggg

SEQ ID NO: 976098 - RNA, 22 nt, Human
agagcagcuggggcagagacca

SEQ ID NO: 976099 - RNA, 22 nt, Human
ccagguggacggcgaguacagg

SEQ ID NO: 976100 - RNA, 22 nt, Human
ugcuuccugaggccgucuucuc

SEQ ID NO: 976101 - RNA, 22 nt, Human
gccugccuagaauugcagcuuu

SEQ ID NO: 976102 - RNA, 22 nt, Human
aaauauaauuucugccucaaua

SEQ ID NO: 976103 - RNA, 22 nt, Human
gccagagcugagacacgagucc

SEQ ID NO: 976104 - RNA, 22 nt, Human
ucugugccaccucuccaguguc

SEQ ID NO: 976105 - RNA, 22 nt, Human
ugcagccauuuucugccaaugc

SEQ ID NO: 976106 - RNA, 22 nt, Human
aauauaugugguauugaccagc

SEQ ID NO: 976107 - RNA, 22 nt, Human
aguggcagagugcacucaggca

SEQ ID NO: 976108 - RNA, 23 nt, Human
ggccucuguguucugcccacaug

SEQ ID NO: 976109 - RNA, 22 nt, Human
auuaauaugagaaaguggcaga

SEQ ID NO: 976110 - RNA, 22 nt, Human
aggucacacaacugucagaggc

SEQ ID NO: 976111 - RNA, 22 nt, Human
agcugcaguaaagcucuccagg

SEQ ID NO: 976112 - RNA, 22 nt, Human
gcccaggaguugaagggcugac

SEQ ID NO: 976113 - RNA, 22 nt, Human
uguaugcuuuccaaaaaugcug

SEQ ID NO: 976114 - RNA, 22 nt, Human
ugauuuccacgugcacccaggu

SEQ ID NO: 976115 - RNA, 22 nt, Human
uggguagagacacagucugggg

SEQ ID NO: 976116 - RNA, 22 nt, Human
cagaguggcacucugcuggaug

SEQ ID NO: 976117 - RNA, 22 nt, Human
ugaggcaguugagcuuccugag

SEQ ID NO: 976118 - RNA, 22 nt, Human
uaaggcaccuguccaggcuggg

SEQ ID NO: 976119 - RNA, 22 nt, Human
gaggggcugggcagucccugga

SEQ ID NO: 976120 - RNA, 22 nt, Human
cugcugugugcuuacuuggguu

SEQ ID NO: 976121 - RNA, 22 nt, Human
ucucugauguauaucagagaac

SEQ ID NO: 976122 - RNA, 22 nt, Human
gugcccugguccccagcauaua

SEQ ID NO: 976123 - RNA, 22 nt, Human
cucaagacugaucgcaguggaa

SEQ ID NO: 976124 - RNA, 22 nt, Human
uccagggaucuuuagagucuuu

SEQ ID NO: 976125 - RNA, 22 nt, Human
cuugcuggugguguuuucuaug

SEQ ID NO: 976126 - RNA, 20 nt, Human
aucaggauucuugcuuuguu

SEQ ID NO: 976127 - RNA, 22 nt, Human
gggcuggcaucgguugcugaga

SEQ ID NO: 976128 - RNA, 22 nt, Human
uccaggagauucauuaggucau

SEQ ID NO: 976129 - RNA, 22 nt, Human
gcugugcagccaagugccucug

SEQ ID NO: 976130 - RNA, 22 nt, Human
uccuugaauggacauuacacug

SEQ ID NO: 976131 - RNA, 22 nt, Human
uguucuuuggcuucacagcucu

SEQ ID NO: 976132 - RNA, 22 nt, Human
ccauuguaaagaguauacuuug

SEQ ID NO: 976133 - RNA, 22 nt, Human
gcuuccuagaucugugguacuc

SEQ ID NO: 976134 - RNA, 22 nt, Human
ugaagcaaacgcuucuguuccu

SEQ ID NO: 976135 - RNA, 22 nt, Human
caggaugguggcaugaucagaa

SEQ ID NO: 976136 - RNA, 22 nt, Human
uuuguguuuguacaaugcacua

SEQ ID NO: 976137 - RNA, 22 nt, Human
gacagcagccacagggagaggg

SEQ ID NO: 976138 - RNA, 22 nt, Human
gaaacacaugcagcuccauaga

SEQ ID NO: 976139 - RNA, 22 nt, Human
gccagccugugcuuggccaggc

SEQ ID NO: 976140 - RNA, 22 nt, Human
ccuccaggauaagucagggccu

SEQ ID NO: 976141 - RNA, 22 nt, Human
cuucacaaagcucucuuuaugu

SEQ ID NO: 976142 - RNA, 21 nt, Human
ucccagagugcuugggacugc

SEQ ID NO: 976143 - RNA, 22 nt, Human
ugcauuguugaauauuucauag

SEQ ID NO: 976144 - RNA, 22 nt, Human
gauccuugcaacucugugaggu

SEQ ID NO: 976145 - RNA, 19 nt, Human
uucauucuuucuacuuacc

SEQ ID NO: 976146 - RNA, 22 nt, Human
cagcaggcccagaguuucaugg

SEQ ID NO: 976147 - RNA, 22 nt, Human
aucacauugccagugauuaccc

SEQ ID NO: 976148 - RNA, 22 nt, Human
agcugcccuggcggagcugcuc

SEQ ID NO: 976149 - RNA, 22 nt, Human
cacaugggugugccuggaggaa

SEQ ID NO: 976150 - RNA, 22 nt, Human
aaguguguugacugaauugggg

SEQ ID NO: 976151 - RNA, 22 nt, Human
cuuauguaaaacggaaagggaa

SEQ ID NO: 976152 - RNA, 22 nt, Human
cauucacauucuucuuacuguu

SEQ ID NO: 976153 - RNA, 22 nt, Human
cccaggaacuccagagcuccuc

SEQ ID NO: 976154 - RNA, 22 nt, Human
uggcucaggugugagcugaaga

SEQ ID NO: 976155 - RNA, 22 nt, Human
cucugugauuuugugagccaga

SEQ ID NO: 976156 - RNA, 22 nt, Human
acagcagcuugcgugucugguc

SEQ ID NO: 976157 - RNA, 22 nt, Human
ccagcugguuaaaauagagaaa

SEQ ID NO: 976158 - RNA, 22 nt, Human
uaugcauuuuauagugcaaagc

SEQ ID NO: 976159 - RNA, 22 nt, Human
gcugccaugccacagcacucac

SEQ ID NO: 976160 - RNA, 18 nt, Human
aaguaugccuauguuauu

SEQ ID NO: 976161 - RNA, 22 nt, Human
gagagaggccuccauguacuga

SEQ ID NO: 976162 - RNA, 22 nt, Human
gccaggcuggcaaaaggaaacc

SEQ ID NO: 976163 - RNA, 22 nt, Human
gugcuuaauacaugucaauaac

SEQ ID NO: 976164 - RNA, 22 nt, Human
cugggcagaauuuuaggauggc

SEQ ID NO: 976165 - RNA, 22 nt, Human
acacugaaugcuguuuagaaau

SEQ ID NO: 976166 - RNA, 22 nt, Human
gugucauggaaaauugcaaugg

SEQ ID NO: 976167 - RNA, 22 nt, Human
cacaggaauuagcagccuaaaa

SEQ ID NO: 976168 - RNA, 22 nt, Human
cucucugggggccaugccaaga

SEQ ID NO: 976169 - RNA, 22 nt, Human
ucugggaacucugucauuuccc

SEQ ID NO: 976170 - RNA, 18 nt, Human
ugugguggagcugccuuc

SEQ ID NO: 976171 - RNA, 22 nt, Human
gaggcacugcugggccccugua

SEQ ID NO: 976172 - RNA, 22 nt, Human
cccaggaaaugggcucuugccu

SEQ ID NO: 976173 - RNA, 22 nt, Human
acccugggcuuggccugcucag

SEQ ID NO: 976174 - RNA, 22 nt, Human
ucagaggacaagcucccuggug

SEQ ID NO: 976175 - RNA, 21 nt, Human
uggcagaguugaguaguuaug

SEQ ID NO: 976176 - RNA, 22 nt, Human
gccaggccugcaagugcuggug

SEQ ID NO: 976177 - RNA, 22 nt, Human
aggccugggucucgugccuacc

SEQ ID NO: 976178 - RNA, 22 nt, Human
auguaucaacaaauuguacagu

SEQ ID NO: 976179 - RNA, 22 nt, Human
cuucuuaaagauuacacaauga

SEQ ID NO: 976180 - RNA, 22 nt, Human
cagaccugagguugaguaccag

SEQ ID NO: 976181 - RNA, 22 nt, Human
agucucugggcaugguugugac

SEQ ID NO: 976182 - RNA, 22 nt, Human
gauuauguucgacuuuagaaau

SEQ ID NO: 976183 - RNA, 22 nt, Human
gaaaggugccccauaggcagga

SEQ ID NO: 976184 - RNA, 19 nt, Human
uguagcaguuuaaaacaac

SEQ ID NO: 976185 - RNA, 22 nt, Human
ucugaaaucuguaagcacuagc

SEQ ID NO: 976186 - RNA, 22 nt, Human
ucuuuucuggacucugcaugga

SEQ ID NO: 976187 - RNA, 22 nt, Human
uaggcugggagccugaggcuag

SEQ ID NO: 976188 - RNA, 22 nt, Human
uuacaguaugaucaacuuuuca

SEQ ID NO: 976189 - RNA, 22 nt, Human
cugugaggcccugggugcugga

SEQ ID NO: 976190 - RNA, 22 nt, Human
aauggccagcugggagaguuga

SEQ ID NO: 976191 - RNA, 22 nt, Human
uggccugccucccggcuucuuu

SEQ ID NO: 976192 - RNA, 22 nt, Human
gcacagggaggcuggccuggcc

SEQ ID NO: 976193 - RNA, 21 nt, Human
uagcagaaacaguucaggcca

SEQ ID NO: 976194 - RNA, 22 nt, Human
uguaagauaugaguacauguaa

SEQ ID NO: 976195 - RNA, 22 nt, Human
uuauuucauugauuucuaagac

SEQ ID NO: 976196 - RNA, 22 nt, Human
uccaggagacacaagguacaua

SEQ ID NO: 976197 - RNA, 22 nt, Human
ccugaagagcacucuagaguug

SEQ ID NO: 976198 - RNA, 22 nt, Human
cugucaguucuuccagauagag

SEQ ID NO: 976199 - RNA, 22 nt, Human
aagcugccuuccaugugaggaa

SEQ ID NO: 976200 - RNA, 22 nt, Human
agcuagaauguuccuuuucauu

SEQ ID NO: 976201 - RNA, 22 nt, Human
uaucuguucaauggaagaugac

SEQ ID NO: 976202 - RNA, 22 nt, Human
ccagggcaacgcugucucagag

SEQ ID NO: 976203 - RNA, 22 nt, Human
ccagcuccaaguuugggcauca

SEQ ID NO: 976204 - RNA, 22 nt, Human
agaaauguggaucguuuuaaaa

SEQ ID NO: 976205 - RNA, 22 nt, Human
agauguuccagccaaugggaau

SEQ ID NO: 976206 - RNA, 19 nt, Human
cugggagguguucagagaa

SEQ ID NO: 976207 - RNA, 22 nt, Human
ggccuugggcagacacgucaca

SEQ ID NO: 976208 - RNA, 22 nt, Human
agggccugggguagcuuacugc

SEQ ID NO: 976209 - RNA, 22 nt, Human
aguaaaucagaccucauuaugu

SEQ ID NO: 976210 - RNA, 22 nt, Human
uuaaaugugauuucauuuaugu

SEQ ID NO: 976211 - RNA, 22 nt, Human
acauacuuuuuaaaagauugcu

SEQ ID NO: 976212 - RNA, 22 nt, Human
guguaauugaaauugagaacca

SEQ ID NO: 976213 - RNA, 22 nt, Human
gccacagggcagaugcgcagag

SEQ ID NO: 976214 - RNA, 22 nt, Human
gucaugccuggcuucuuagaca

SEQ ID NO: 976215 - RNA, 22 nt, Human
ucuucaaaaaauauccaucagu

SEQ ID NO: 976216 - RNA, 22 nt, Human
agcucccagaagccagagucgg

SEQ ID NO: 976217 - RNA, 22 nt, Human
aggccuccuggcuccaggccuu

SEQ ID NO: 976218 - RNA, 22 nt, Human
acagucauuagauacaaugucu

SEQ ID NO: 976219 - RNA, 22 nt, Human
ugaaaugaaacagaacauauca

SEQ ID NO: 976220 - RNA, 22 nt, Human
ugggcagaucuuugguggcuag

SEQ ID NO: 976221 - RNA, 22 nt, Human
aaggccugaacaugaggagaug

SEQ ID NO: 976222 - RNA, 22 nt, Human
ucaggagaaggcaauguggaaa

SEQ ID NO: 976223 - RNA, 22 nt, Human
guucacaaaguacuguaugcau

SEQ ID NO: 976224 - RNA, 22 nt, Human
ggaagggccucgggcgugggac

SEQ ID NO: 976225 - RNA, 22 nt, Human
agccuccaguagcugaagagac

SEQ ID NO: 976226 - RNA, 22 nt, Human
uggaagaggcccaugacugccu

SEQ ID NO: 976227 - RNA, 22 nt, Human
gaccuuuuuacuguguacgcug

SEQ ID NO: 976228 - RNA, 22 nt, Human
acagagcaugcucaguguguga

SEQ ID NO: 976229 - RNA, 22 nt, Human
ugccugaggagucagggcaggu

SEQ ID NO: 976230 - RNA, 22 nt, Human
gaagcuucguggcucuucaaau

SEQ ID NO: 976231 - RNA, 22 nt, Human
cuguauuuguccucuauuuauu

SEQ ID NO: 976232 - RNA, 22 nt, Human
gucugucucucuccagagugca

SEQ ID NO: 976233 - RNA, 22 nt, Human
guccucuguuagaaaugugcuu

SEQ ID NO: 976234 - RNA, 22 nt, Human
agggcagagcacugaauuggga

SEQ ID NO: 976235 - RNA, 20 nt, Human
caggagggacauuucagcau

SEQ ID NO: 976236 - RNA, 22 nt, Human
ugagauuuucagcaucacuuca

SEQ ID NO: 976237 - RNA, 22 nt, Human
ggaagaggaggagccaggcuuu

SEQ ID NO: 976238 - RNA, 22 nt, Human
ccuuucucuuggauaccgauug

SEQ ID NO: 976239 - RNA, 22 nt, Human
gcacccagaauaaggacaggac

SEQ ID NO: 976240 - RNA, 22 nt, Human
agagugggugaucucuguuguc

SEQ ID NO: 976241 - RNA, 22 nt, Human
uuaggaaucaccugcagaucuu

SEQ ID NO: 976242 - RNA, 22 nt, Human
cucuggagugcagccugguggc

SEQ ID NO: 976243 - RNA, 22 nt, Human
cagggacagccuugggguggcg

SEQ ID NO: 976244 - RNA, 22 nt, Human
cucaccacagagccuguccagc

SEQ ID NO: 976245 - RNA, 22 nt, Human
caaggcaggcaguucacuugag

SEQ ID NO: 976246 - RNA, 22 nt, Human
aggggcuguggaaaccaacucu

SEQ ID NO: 976247 - RNA, 22 nt, Human
uuauugagcacauaguaugugg

SEQ ID NO: 976248 - RNA, 22 nt, Human
cauugacaguucuuuaaguugc

SEQ ID NO: 976249 - RNA, 22 nt, Human
uuuauuauucucuggagaaugu

SEQ ID NO: 976250 - RNA, 22 nt, Human
aaauuauuacaagcuaguuggc

SEQ ID NO: 976251 - RNA, 22 nt, Human
aucuccaggcauuucaagagac

SEQ ID NO: 976252 - RNA, 22 nt, Human
uauuucuguaacucagggucug

SEQ ID NO: 976253 - RNA, 22 nt, Human
ugugaggagaggcccagcuccc

SEQ ID NO: 976254 - RNA, 22 nt, Human
augaugguaaauucaguauccg

SEQ ID NO: 976255 - RNA, 22 nt, Human
aggccuggccugggcggcauug

SEQ ID NO: 976256 - RNA, 22 nt, Human
ggacucuguuuuccugaucacu

SEQ ID NO: 976257 - RNA, 22 nt, Human
ccugcagcuguaggagaaggcg

SEQ ID NO: 976258 - RNA, 22 nt, Human
uggccugguaccacauagauuu

SEQ ID NO: 976259 - RNA, 22 nt, Human
agcccccaaaagugcuuaugau

SEQ ID NO: 976260 - RNA, 22 nt, Human
uuucuguaauuaaaagggcagg

SEQ ID NO: 976261 - RNA, 22 nt, Human
uacauuguucaugcaugagaaa

SEQ ID NO: 976262 - RNA, 19 nt, Human
gauuucuacaaaugucaga

SEQ ID NO: 976263 - RNA, 22 nt, Human
uuccaggggcagcagugauggu

SEQ ID NO: 976264 - RNA, 22 nt, Human
uugauuaaacaggcauauucaa

SEQ ID NO: 976265 - RNA, 22 nt, Human
cacagaaguuucauagucucga

SEQ ID NO: 976266 - RNA, 22 nt, Human
aggagcccugcgggaggcagag

SEQ ID NO: 976267 - RNA, 22 nt, Human
gaggaagcagggcuuggcugag

SEQ ID NO: 976268 - RNA, 22 nt, Human
cugggccaaaagaaguguucuu

SEQ ID NO: 976269 - RNA, 22 nt, Human
ggcagcuggccuccucgcccac

SEQ ID NO: 976270 - RNA, 20 nt, Human
ggcugcugugggcagagagg

SEQ ID NO: 976271 - RNA, 20 nt, Human
acaauagauuugagcaaagu

SEQ ID NO: 976272 - RNA, 22 nt, Human
ucaguuuucucaucugugaaau

SEQ ID NO: 976273 - RNA, 22 nt, Human
aaaaagcuuaaaugagcaguuc

SEQ ID NO: 976274 - RNA, 22 nt, Human
uuuuucaugagacuagaaguca

SEQ ID NO: 976275 - RNA, 22 nt, Human
aauguucaacagauggauauuu

SEQ ID NO: 976276 - RNA, 23 nt, Human
accaggagccaagaucucccugg

SEQ ID NO: 976277 - RNA, 22 nt, Human
gccaggugcauggcugagucuc

SEQ ID NO: 976278 - RNA, 22 nt, Human
aaaugcacagagccuuagagau

SEQ ID NO: 976279 - RNA, 22 nt, Human
uagcugccuagacagcuauagc

SEQ ID NO: 976280 - RNA, 22 nt, Human
guuauuuuaucucugagagguu

SEQ ID NO: 976281 - RNA, 22 nt, Human
cagaccucaguccucaguagga

SEQ ID NO: 976282 - RNA, 22 nt, Human
uuaggauaugaaacaguauaag

SEQ ID NO: 976283 - RNA, 22 nt, Human
uucugagcuacauaguacuggg

SEQ ID NO: 976284 - RNA, 22 nt, Human
ccaaagugcugggguuacaggc

SEQ ID NO: 976285 - RNA, 22 nt, Human
aagguacagaaauuaacaagga

SEQ ID NO: 976286 - RNA, 19 nt, Human
ccaggagagcuuggagaag

SEQ ID NO: 976287 - RNA, 22 nt, Human
ugccugggguuggcaaacugcu

SEQ ID NO: 976288 - RNA, 22 nt, Human
cugcacaguuugauuucuugcu

SEQ ID NO: 976289 - RNA, 22 nt, Human
cuguuuauaaauagaggggagu

SEQ ID NO: 976290 - RNA, 22 nt, Human
ucccagaaaaaggaggcuauga

SEQ ID NO: 976291 - RNA, 22 nt, Human
ucauauaccagagaguuuauau

SEQ ID NO: 976292 - RNA, 22 nt, Human
ggcuggagauaugucuggaaca

SEQ ID NO: 976293 - RNA, 22 nt, Human
acagccauagaugcuuauguaa

SEQ ID NO: 976294 - RNA, 22 nt, Human
cugcugccggcgagccucccuu

SEQ ID NO: 976295 - RNA, 22 nt, Human
ugccugggugcuggcuggucac

SEQ ID NO: 976296 - RNA, 22 nt, Human
cccuggagugugacgaggcauu

SEQ ID NO: 976297 - RNA, 22 nt, Human
auugacaaggaaacuauaccag

SEQ ID NO: 976298 - RNA, 22 nt, Human
ccagucacagguguguuuauau

SEQ ID NO: 976299 - RNA, 22 nt, Human
ugugccaugaggcucugauaug

SEQ ID NO: 976300 - RNA, 22 nt, Human
cacagguggcuccaaguuagag

SEQ ID NO: 976301 - RNA, 22 nt, Human
cucuggccugcuuccucaggua

SEQ ID NO: 976302 - RNA, 22 nt, Human
uuauggcauauuccucauugua

SEQ ID NO: 976303 - RNA, 22 nt, Human
aaguucaagucuccugaguaua

SEQ ID NO: 976304 - RNA, 22 nt, Human
ugggcagaggcucugaagucca

SEQ ID NO: 976305 - RNA, 22 nt, Human
cugcagggcagggccuccuggc

SEQ ID NO: 976306 - RNA, 22 nt, Human
uuuccucugacugcuccccugc

SEQ ID NO: 976307 - RNA, 22 nt, Human
cagagccccccuucugaucaca

SEQ ID NO: 976308 - RNA, 23 nt, Human
uuuauauuccuaaugucuugagc

SEQ ID NO: 976309 - RNA, 22 nt, Human
gggacgggcaguccaagggguc

SEQ ID NO: 976310 - RNA, 22 nt, Human
acagccuguuugaucuggugcu

SEQ ID NO: 976311 - RNA, 22 nt, Human
ucauucuugaucacuaguuagu

SEQ ID NO: 976312 - RNA, 22 nt, Human
uacuuucuuguuccuuucauaa

SEQ ID NO: 976313 - RNA, 22 nt, Human
gccugagccgccugagcggcgg

SEQ ID NO: 976314 - RNA, 22 nt, Human
ucauaaaaauagacucuaaagu

SEQ ID NO: 976315 - RNA, 22 nt, Human
ggugggcaggucacucugccuc

SEQ ID NO: 976316 - RNA, 22 nt, Human
gaguuauuagucaaauagggaa

SEQ ID NO: 976317 - RNA, 22 nt, Human
augacagaaggccucccugaca

SEQ ID NO: 976318 - RNA, 22 nt, Human
ggcaggaggugaguggcgggug

SEQ ID NO: 976319 - RNA, 17 nt, Human
ccagguggaaucgugga

SEQ ID NO: 976320 - RNA, 22 nt, Human
gcugucagaaggugaaggguaa

SEQ ID NO: 976321 - RNA, 22 nt, Human
acauuucuuagccuaguuccag

SEQ ID NO: 976322 - RNA, 22 nt, Human
ucaaaugcucuuugcagagagg

SEQ ID NO: 976323 - RNA, 22 nt, Human
ucaaagucacaacucucuaauu

SEQ ID NO: 976324 - RNA, 22 nt, Human
gccagaaacauacacaucacuu

SEQ ID NO: 976325 - RNA, 22 nt, Human
uggcaacaugucgaagugcugu

SEQ ID NO: 976326 - RNA, 22 nt, Human
cccuaggguuuggccagagccc

SEQ ID NO: 976327 - RNA, 22 nt, Human
cugggccucauccucagaguuu

SEQ ID NO: 976328 - RNA, 22 nt, Human
gugaaaucugaggcccaugaug

SEQ ID NO: 976329 - RNA, 22 nt, Human
uucuccagaccuugugacuaug

SEQ ID NO: 976330 - RNA, 22 nt, Human
ugcugaggagguggcugugcuu

SEQ ID NO: 976331 - RNA, 20 nt, Human
gagauuuccaaucaugccca

SEQ ID NO: 976332 - RNA, 22 nt, Human
cuggcagcgugagcagcaucca

SEQ ID NO: 976333 - RNA, 22 nt, Human
ucuguucauuugccucggcucu

SEQ ID NO: 976334 - RNA, 22 nt, Human
aaaaugaugcuguaauuuggca

SEQ ID NO: 976335 - RNA, 22 nt, Human
guggauggauugaggcaguggg

SEQ ID NO: 976336 - RNA, 22 nt, Human
acucaggaaaaauguagugaua

SEQ ID NO: 976337 - RNA, 22 nt, Human
cccagggcuuuucucacuagac

SEQ ID NO: 976338 - RNA, 22 nt, Human
gggcugggcaugguguucccuc

SEQ ID NO: 976339 - RNA, 22 nt, Human
aagggacuuugucagcuuucca

SEQ ID NO: 976340 - RNA, 22 nt, Human
uccuugacugugaggaacuagc

SEQ ID NO: 976341 - RNA, 22 nt, Human
cugccacuuucacccagugcuc

SEQ ID NO: 976342 - RNA, 22 nt, Human
uggucaaaaaggccuagacaca

SEQ ID NO: 976343 - RNA, 22 nt, Human
uucaaucauuuuuacauagucc

SEQ ID NO: 976344 - RNA, 22 nt, Human
uuuuuaguagagguggguuuca

SEQ ID NO: 976345 - RNA, 22 nt, Human
auuuguacaaauuuauguuagu

SEQ ID NO: 976346 - RNA, 22 nt, Human
uaagcauaacuaaaaaugauuu

SEQ ID NO: 976347 - RNA, 22 nt, Human
uuccaugaagggcagccucuca

SEQ ID NO: 976348 - RNA, 22 nt, Human
uuagagaaauucugguaaugua

SEQ ID NO: 976349 - RNA, 21 nt, Human
ucucuggaguuagcagagaga

SEQ ID NO: 976350 - RNA, 22 nt, Human
uugcauuguaggauguuagaag

SEQ ID NO: 976351 - RNA, 22 nt, Human
uuaaacagagucugaaauguaa

SEQ ID NO: 976352 - RNA, 22 nt, Human
uguuccauaaguggugcuuugu

SEQ ID NO: 976353 - RNA, 19 nt, Human
aggcagcacccaguccuug

SEQ ID NO: 976354 - RNA, 22 nt, Human
gagggacagcuaaagagaaauu

SEQ ID NO: 976355 - RNA, 23 nt, Human
gcugcagcuguggauguucucag

SEQ ID NO: 976356 - RNA, 22 nt, Human
aacuuucuuggaugucucaaca

SEQ ID NO: 976357 - RNA, 22 nt, Human
cagagccagcaguggggacagg

SEQ ID NO: 976358 - RNA, 22 nt, Human
gggaguggguuuggccuaggcc

SEQ ID NO: 976359 - RNA, 22 nt, Human
ugggagcaagcuggugcuggag

SEQ ID NO: 976360 - RNA, 22 nt, Human
auguguaaaaagugcuuaauau

SEQ ID NO: 976361 - RNA, 22 nt, Human
auuuggcaaauaauuugagggu

SEQ ID NO: 976362 - RNA, 22 nt, Human
gccagccuucuguggccugcaa

SEQ ID NO: 976363 - RNA, 22 nt, Human
aaugaugguauugaugagcuaa

SEQ ID NO: 976364 - RNA, 17 nt, Human
gcuuccucaugcaguuc

SEQ ID NO: 976365 - RNA, 22 nt, Human
aaaaugcugggaaaguuggaau

SEQ ID NO: 976366 - RNA, 22 nt, Human
gcugagcuagaaaaggaccaca

SEQ ID NO: 976367 - RNA, 18 nt, Human
cuuucagauggauaugcu

SEQ ID NO: 976368 - RNA, 22 nt, Human
aaauaaguuaaacuagaaugau

SEQ ID NO: 976369 - RNA, 22 nt, Human
cauuguuauagcauuacacacc

SEQ ID NO: 976370 - RNA, 22 nt, Human
guggccuggaaaggcuggucug

SEQ ID NO: 976371 - RNA, 22 nt, Human
auucacaaguugauggauauuu

SEQ ID NO: 976372 - RNA, 22 nt, Human
uaaaauguuugcaagagaccag

SEQ ID NO: 976373 - RNA, 22 nt, Human
agcccagguucuaaagccaaac

SEQ ID NO: 976374 - RNA, 22 nt, Human
agaggcccugggcuggugugcu

SEQ ID NO: 976375 - RNA, 22 nt, Human
cuggcagucugccucuucacug

SEQ ID NO: 976376 - RNA, 22 nt, Human
aaucaguuagaaggaagagaau

SEQ ID NO: 976377 - RNA, 22 nt, Human
gugcagcugugugagagcucca

SEQ ID NO: 976378 - RNA, 22 nt, Human
ggcucuggagcacagacgucug

SEQ ID NO: 976379 - RNA, 22 nt, Human
aguuauuacucuuuaacauauu

SEQ ID NO: 976380 - RNA, 22 nt, Human
uuagccaugugggaaaaacagc

SEQ ID NO: 976381 - RNA, 22 nt, Human
caggugccucaggaugagacaa

SEQ ID NO: 976382 - RNA, 18 nt, Human
aucucccauuggccaagg

SEQ ID NO: 976383 - RNA, 22 nt, Human
uuucuucagccacuccaaacug

SEQ ID NO: 976384 - RNA, 22 nt, Human
auucuguauggggaaacuagag

SEQ ID NO: 976385 - RNA, 22 nt, Human
caggccagguggcaggcaaaac

SEQ ID NO: 976386 - RNA, 22 nt, Human
aguacuuuacuucuuacaguuu

SEQ ID NO: 976387 - RNA, 22 nt, Human
ggaggaggggcgcuuugucuau

SEQ ID NO: 976388 - RNA, 22 nt, Human
agggcagccaugagccuucagg

SEQ ID NO: 976389 - RNA, 22 nt, Human
aggcacugggggaugagcaagg

SEQ ID NO: 976390 - RNA, 22 nt, Human
agaaggaguguacaggucaugc

SEQ ID NO: 976391 - RNA, 22 nt, Human
caguuucugggcguucacaggu

SEQ ID NO: 976392 - RNA, 22 nt, Human
ugcuuuauuuauaaaauagcaa

SEQ ID NO: 976393 - RNA, 22 nt, Human
gccaggagccagcuucuuagca

SEQ ID NO: 976394 - RNA, 21 nt, Human
ucacucugauuaggugucucu

SEQ ID NO: 976395 - RNA, 22 nt, Human
uuugcauuaguuuagauuucaa

SEQ ID NO: 976396 - RNA, 22 nt, Human
auugacaagcaguaugucuuag

SEQ ID NO: 976397 - RNA, 20 nt, Human
agaggccaguuaggagucua

SEQ ID NO: 976398 - RNA, 22 nt, Human
ucucauucauacccuacaugcu

SEQ ID NO: 976399 - RNA, 22 nt, Human
gagcccuccauggagccaggca

SEQ ID NO: 976400 - RNA, 22 nt, Human
cugcugggaaggucugcucagu

SEQ ID NO: 976401 - RNA, 22 nt, Human
ugcauguggaccccuggugccu

SEQ ID NO: 976402 - RNA, 22 nt, Human
augauacaagcaaaacuaauca

SEQ ID NO: 976403 - RNA, 22 nt, Human
aagagagggguugcauggaaau

SEQ ID NO: 976404 - RNA, 22 nt, Human
caggaggggguggaguuucgcc

SEQ ID NO: 976405 - RNA, 22 nt, Human
agccaggggauucaucagggac

SEQ ID NO: 976406 - RNA, 22 nt, Human
gugccugcugcagagucgcugu

SEQ ID NO: 976407 - RNA, 22 nt, Human
agcccaaggcuucccugcuggc

SEQ ID NO: 976408 - RNA, 22 nt, Human
caaaugugacuuuugggcuucu

SEQ ID NO: 976409 - RNA, 22 nt, Human
cugcagagguugguucuaagau

SEQ ID NO: 976410 - RNA, 22 nt, Human
gaaaauguuagcuucauaguca

SEQ ID NO: 976411 - RNA, 22 nt, Human
auucugaguccaugggggcagg

SEQ ID NO: 976412 - RNA, 22 nt, Human
uggcucugucacugugagcuau

SEQ ID NO: 976413 - RNA, 22 nt, Human
cugagccauccauaccagcuua

SEQ ID NO: 976414 - RNA, 19 nt, Human
uguuuuguuaaagcagucc

SEQ ID NO: 976415 - RNA, 22 nt, Human
gccaucacauccaggcuaccuc

SEQ ID NO: 976416 - RNA, 19 nt, Human
ccuggccagacuucugccc

SEQ ID NO: 976417 - RNA, 23 nt, Human
uggcucagcuaguuuuccauuuc

SEQ ID NO: 976418 - RNA, 22 nt, Human
cccagcucucucaguucugcuu

SEQ ID NO: 976419 - RNA, 22 nt, Human
ggaaggagggcggcaaugauga

SEQ ID NO: 976420 - RNA, 22 nt, Human
gcagugggaagguuggcacaug

SEQ ID NO: 976421 - RNA, 22 nt, Human
ugggcagacugagcccuguccc

SEQ ID NO: 976422 - RNA, 22 nt, Human
gggaggagggugcuggcuaaac

SEQ ID NO: 976423 - RNA, 22 nt, Human
agaggggcucaagcaguggucu

SEQ ID NO: 976424 - RNA, 22 nt, Human
auauuucuugagcaccugguau

SEQ ID NO: 976425 - RNA, 22 nt, Human
uuagccauauagaaaaagagcu

SEQ ID NO: 976426 - RNA, 22 nt, Human
auuaggcagggcaugguggcuc

SEQ ID NO: 976427 - RNA, 22 nt, Human
agcccuggcccggcugugcuuu

SEQ ID NO: 976428 - RNA, 22 nt, Human
gaagcccuauccucuccuggga

SEQ ID NO: 976429 - RNA, 22 nt, Human
gccugcagccucaagggcugag

SEQ ID NO: 976430 - RNA, 21 nt, Human
uggcacugcuuagcagguucc

SEQ ID NO: 976431 - RNA, 22 nt, Human
guggcaggucccauuggagcag

SEQ ID NO: 976432 - RNA, 22 nt, Human
aucuggcucgcuaggcucuggg

SEQ ID NO: 976433 - RNA, 22 nt, Human
uggcagugccccuugaccagug

SEQ ID NO: 976434 - RNA, 22 nt, Human
uguagaaagaauauguuucaua

SEQ ID NO: 976435 - RNA, 22 nt, Human
agcaggagcugugggaagaugg

SEQ ID NO: 976436 - RNA, 22 nt, Human
agagccacugggagacagagca

SEQ ID NO: 976437 - RNA, 22 nt, Human
ggcaaggccuugcccagcauuc

SEQ ID NO: 976438 - RNA, 22 nt, Human
uuucacaaacugaggagacaau

SEQ ID NO: 976439 - RNA, 22 nt, Human
ugcagaagcugcaggucagugg

SEQ ID NO: 976440 - RNA, 23 nt, Human
uuagagaugauuaaaaaaucuug

SEQ ID NO: 976441 - RNA, 22 nt, Human
cuggccauguugccucugagac

SEQ ID NO: 976442 - RNA, 22 nt, Human
gagacauggcaaaagcacuggu

SEQ ID NO: 976443 - RNA, 22 nt, Human
ucagggcaggcgagcagcugcu

SEQ ID NO: 976444 - RNA, 22 nt, Human
uucaagauccagcacaacagug

SEQ ID NO: 976445 - RNA, 22 nt, Human
aggcccugaagucggccccuca

SEQ ID NO: 976446 - RNA, 22 nt, Human
cuguaauucacuagggucagcg

SEQ ID NO: 976447 - RNA, 22 nt, Human
auuuagaacuuuguuugccaau

SEQ ID NO: 976448 - RNA, 22 nt, Human
gcacagggcaacaggucuguua

SEQ ID NO: 976449 - RNA, 22 nt, Human
cucacugucuguacuagcugau

SEQ ID NO: 976450 - RNA, 22 nt, Human
ucugggcacugcugagccugua

SEQ ID NO: 976451 - RNA, 22 nt, Human
ucaggauggcuucugcaucaaa

SEQ ID NO: 976452 - RNA, 22 nt, Human
ggcagccuccagggcacuggug

SEQ ID NO: 976453 - RNA, 22 nt, Human
uggcaccugaacuuagaggugu

SEQ ID NO: 976454 - RNA, 22 nt, Human
guuaggauguggggacuuuggg

SEQ ID NO: 976455 - RNA, 22 nt, Human
agcagcugcagggagggucugc

SEQ ID NO: 976456 - RNA, 18 nt, Human
ugcagcaagugcuaaaua

SEQ ID NO: 976457 - RNA, 22 nt, Human
uucccucuccuacucaggaaag

SEQ ID NO: 976458 - RNA, 22 nt, Human
caagagcucagaaacccuugcu

SEQ ID NO: 976459 - RNA, 22 nt, Human
ggcaagaaggcuucagguagcu

SEQ ID NO: 976460 - RNA, 22 nt, Human
guguccacggcugagaaugauu

SEQ ID NO: 976461 - RNA, 22 nt, Human
cagagcagagugauuguucugg

SEQ ID NO: 976462 - RNA, 20 nt, Human
gggugagauguaggagaggg

SEQ ID NO: 976463 - RNA, 22 nt, Human
ucacacgugagguucuauccug

SEQ ID NO: 976464 - RNA, 22 nt, Human
gaguguuccagaaacuggcccu

SEQ ID NO: 976465 - RNA, 22 nt, Human
aauauuguuucaagaucacaga

SEQ ID NO: 976466 - RNA, 20 nt, Human
ucugcucagcccucaguggc

SEQ ID NO: 976467 - RNA, 22 nt, Human
cagagcugauuggauccagaga

SEQ ID NO: 976468 - RNA, 22 nt, Human
ucacuguaucauguugcacuua

SEQ ID NO: 976469 - RNA, 22 nt, Human
ucaggccacuucacaggugauu

SEQ ID NO: 976470 - RNA, 22 nt, Human
aauuuagauugauaaacaugga

SEQ ID NO: 976471 - RNA, 22 nt, Human
cugugccuggggggcagagcug

SEQ ID NO: 976472 - RNA, 22 nt, Human
cccugccuacaggguuuucuuu

SEQ ID NO: 976473 - RNA, 22 nt, Human
gacccuguuucuacaaauaauu

SEQ ID NO: 976474 - RNA, 22 nt, Human
ggcuggcaagucagugcugaug

SEQ ID NO: 976475 - RNA, 22 nt, Human
ggaggggaugguuugacccugg

SEQ ID NO: 976476 - RNA, 22 nt, Human
aggccagccucaggcagggacc

SEQ ID NO: 976477 - RNA, 22 nt, Human
auguaucagauaaagcaugugg

SEQ ID NO: 976478 - RNA, 22 nt, Human
cagauggaacacagaaaggaga

SEQ ID NO: 976479 - RNA, 22 nt, Human
aagcugccauagaacgagaggu

SEQ ID NO: 976480 - RNA, 22 nt, Human
ggagagugggagcaacuguugc

SEQ ID NO: 976481 - RNA, 22 nt, Human
aggccuguuggcgugggcucua

SEQ ID NO: 976482 - RNA, 21 nt, Human
auugaaagucaacaaucaguu

SEQ ID NO: 976483 - RNA, 22 nt, Human
aucuggcuggauucuuagcguu

SEQ ID NO: 976484 - RNA, 22 nt, Human
ucccugggccuccugcuaugca

SEQ ID NO: 976485 - RNA, 22 nt, Human
uuuuccucugcaauaaaagcag

SEQ ID NO: 976486 - RNA, 23 nt, Human
acucacaaagcaggaucauguug

SEQ ID NO: 976487 - RNA, 22 nt, Human
cucuggaaaaccacuagcagga

SEQ ID NO: 976488 - RNA, 22 nt, Human
ucaaacuguuuacagugagaua

SEQ ID NO: 976489 - RNA, 22 nt, Human
cacuugggagcauugcacaugu

SEQ ID NO: 976490 - RNA, 22 nt, Human
aguguacaguuuguaguacuac

SEQ ID NO: 976491 - RNA, 22 nt, Human
cucccagagagcaggugggccg

SEQ ID NO: 976492 - RNA, 22 nt, Human
augcugugccuucucugugcca

SEQ ID NO: 976493 - RNA, 22 nt, Human
cugagauggaguuuugcucuug

SEQ ID NO: 976494 - RNA, 22 nt, Human
agcaggugaauuccuggaugug

SEQ ID NO: 976495 - RNA, 22 nt, Human
gcucugcuaauauuguaguacc

SEQ ID NO: 976496 - RNA, 22 nt, Human
ccagccagucccgcaugaccgc

SEQ ID NO: 976497 - RNA, 22 nt, Human
ucugggcucugucagcaccucu

SEQ ID NO: 976498 - RNA, 22 nt, Human
aggagacauaacuaugaugaga

SEQ ID NO: 976499 - RNA, 22 nt, Human
caaugugguggcagaugucagu

SEQ ID NO: 976500 - RNA, 22 nt, Human
ugccugggccuucccaccucug

SEQ ID NO: 976501 - RNA, 22 nt, Human
uuuaagacuuagauuuauuggg

SEQ ID NO: 976502 - RNA, 22 nt, Human
ggucaggguuccagguaucuuc

SEQ ID NO: 976503 - RNA, 22 nt, Human
ucuuguuaucaggaaaacagua

SEQ ID NO: 976504 - RNA, 22 nt, Human
cauugcacagcccuguggugau

SEQ ID NO: 976505 - RNA, 22 nt, Human
ccugggcuucugucuagauguu

SEQ ID NO: 976506 - RNA, 22 nt, Human
ugacagggugauuaugagagcu

SEQ ID NO: 976507 - RNA, 22 nt, Human
gaguuauuugguuugcaugcag

SEQ ID NO: 976508 - RNA, 22 nt, Human
aguauugugacucaaguauucu

SEQ ID NO: 976509 - RNA, 22 nt, Human
gcuggccuugugucugaggaag

SEQ ID NO: 976510 - RNA, 22 nt, Human
gccuugcuuugcuucuggacag

SEQ ID NO: 976511 - RNA, 22 nt, Human
guuuaagaaaauucauguuguu

SEQ ID NO: 976512 - RNA, 22 nt, Human
gggcuggaggaccggccucgga

SEQ ID NO: 976513 - RNA, 22 nt, Human
acacagggcagagagcuggcuc

SEQ ID NO: 976514 - RNA, 22 nt, Human
uucuuucccagaagauauguuu

SEQ ID NO: 976515 - RNA, 22 nt, Human
uucaguuucagucuugcaaaaa

SEQ ID NO: 976516 - RNA, 22 nt, Human
ggcacugaauuucuuggcaucu

SEQ ID NO: 976517 - RNA, 22 nt, Human
uuacaguuuaguccaagccaga

SEQ ID NO: 976518 - RNA, 22 nt, Human
gaggcugugugucccucuggac

SEQ ID NO: 976519 - RNA, 22 nt, Human
aaagacauugaagaaggacuua

SEQ ID NO: 976520 - RNA, 22 nt, Human
ucacaaaugaggaaaucgagca

SEQ ID NO: 976521 - RNA, 22 nt, Human
gcagacuguaucaaugucagua

SEQ ID NO: 976522 - RNA, 22 nt, Human
aagcugccugccacgcuagaua

SEQ ID NO: 976523 - RNA, 22 nt, Human
auugacaaauggauguugacau

SEQ ID NO: 976524 - RNA, 22 nt, Human
uuguuuugcuaaagggucauca

SEQ ID NO: 976525 - RNA, 22 nt, Human
caggguggggaaauagcgcccu

SEQ ID NO: 976526 - RNA, 22 nt, Human
ugcagaagaaaacagcugugug

SEQ ID NO: 976527 - RNA, 22 nt, Human
uggcucagccuggcccuuucau

SEQ ID NO: 976528 - RNA, 22 nt, Human
uucaauucugcucugaucuuag

SEQ ID NO: 976529 - RNA, 22 nt, Human
aagccagcauuuucccauuccu

SEQ ID NO: 976530 - RNA, 22 nt, Human
cagcauggagacaaagugggca

SEQ ID NO: 976531 - RNA, 22 nt, Human
acagaaauugggcaaauggaag

SEQ ID NO: 976532 - RNA, 22 nt, Human
ccugucuguccucucaugagcc

SEQ ID NO: 976533 - RNA, 22 nt, Human
acauccagaucucagcauggcu

SEQ ID NO: 976534 - RNA, 22 nt, Human
gagguagccacagauagagacu

SEQ ID NO: 976535 - RNA, 22 nt, Human
guugaaugaaucauucuaugua

SEQ ID NO: 976536 - RNA, 22 nt, Human
ucauguuugagacuaauuuuuc

SEQ ID NO: 976537 - RNA, 20 nt, Human
gcagcagacagacaggggac

SEQ ID NO: 976538 - RNA, 22 nt, Human
aggcagacaaggacacaguggg

SEQ ID NO: 976539 - RNA, 22 nt, Human
ggcagaggagcuggaaacaugg

SEQ ID NO: 976540 - RNA, 18 nt, Human
caugucugcgccacaagg

SEQ ID NO: 976541 - RNA, 22 nt, Human
gggcaguugauggaggucugga

SEQ ID NO: 976542 - RNA, 22 nt, Human
cugaggaguuuggguuguucaa

SEQ ID NO: 976543 - RNA, 22 nt, Human
acauuucuuucuauucaguagc

SEQ ID NO: 976544 - RNA, 22 nt, Human
uugcugaauugaauccuuuggu

SEQ ID NO: 976545 - RNA, 22 nt, Human
ucagcacugauguuucagaaga

SEQ ID NO: 976546 - RNA, 22 nt, Human
aauuucaauuacuuuugcacca

SEQ ID NO: 976547 - RNA, 20 nt, Human
augauuuugcacuaacuuca

SEQ ID NO: 976548 - RNA, 21 nt, Human
acagcaagccuuccuuucagg

SEQ ID NO: 976549 - RNA, 22 nt, Human
uuauugccugauugaggucauu

SEQ ID NO: 976550 - RNA, 22 nt, Human
uguccucuaauuggccucuugc

SEQ ID NO: 976551 - RNA, 22 nt, Human
caucacuguccaaaguucaguu

SEQ ID NO: 976552 - RNA, 22 nt, Human
uguccugcaacugaaggagaag

SEQ ID NO: 976553 - RNA, 22 nt, Human
aggagacaucuaacuguagguu

SEQ ID NO: 976554 - RNA, 22 nt, Human
ucaugcacaugugucaccauca

SEQ ID NO: 976555 - RNA, 22 nt, Human
auuugagaugguaaauaacuuu

SEQ ID NO: 976556 - RNA, 22 nt, Human
aauccugugugacucuggggag

SEQ ID NO: 976557 - RNA, 21 nt, Human
guggccugauuaugaaugggu

SEQ ID NO: 976558 - RNA, 22 nt, Human
cugggacacccaaggaaagagc

SEQ ID NO: 976559 - RNA, 22 nt, Human
uccuuccuggggucucugcugc

SEQ ID NO: 976560 - RNA, 22 nt, Human
gacacagagauaggccuguguu

SEQ ID NO: 976561 - RNA, 22 nt, Human
cagaggcugcucuggguggcau

SEQ ID NO: 976562 - RNA, 22 nt, Human
aguccaggucucugagucacaa

SEQ ID NO: 976563 - RNA, 22 nt, Human
ucuuaaagagcgcaauuugagg

SEQ ID NO: 976564 - RNA, 23 nt, Human
aaguucaagucacagccugucuu

SEQ ID NO: 976565 - RNA, 19 nt, Human
ggaaacaggggccagagga

SEQ ID NO: 976566 - RNA, 22 nt, Human
acaugcuuucuagguccuucug

SEQ ID NO: 976567 - RNA, 22 nt, Human
aggcucugaugcaagcccaggg

SEQ ID NO: 976568 - RNA, 22 nt, Human
aggcacagcacaccuggccccc

SEQ ID NO: 976569 - RNA, 22 nt, Human
uguuuacaaggagaauuugagg

SEQ ID NO: 976570 - RNA, 23 nt, Human
cagagcuggcucagagcugccug

SEQ ID NO: 976571 - RNA, 22 nt, Human
guggcugguuuccugcaugcaa

SEQ ID NO: 976572 - RNA, 22 nt, Human
aggacccagaggcagaggacgu

SEQ ID NO: 976573 - RNA, 22 nt, Human
aggcaguuucugggacagcaua

SEQ ID NO: 976574 - RNA, 22 nt, Human
uguuuaauugggccaacagcgg

SEQ ID NO: 976575 - RNA, 22 nt, Human
caggaaagguagucacaaugua

SEQ ID NO: 976576 - RNA, 22 nt, Human
acacaugcauaagccuucccuu

SEQ ID NO: 976577 - RNA, 22 nt, Human
gaccauuuguugaaaagauuau

SEQ ID NO: 976578 - RNA, 22 nt, Human
ccugggugaaaucucuccugca

SEQ ID NO: 976579 - RNA, 22 nt, Human
guggcucuaggugagcauggag

SEQ ID NO: 976580 - RNA, 22 nt, Human
cagagccacugucugccaggca

SEQ ID NO: 976581 - RNA, 21 nt, Human
ucaggagagcccaucuacaaa

SEQ ID NO: 976582 - RNA, 22 nt, Human
caaaugcaaaauauaacccugu

SEQ ID NO: 976583 - RNA, 19 nt, Human
uggcaucuguaaaauggug

SEQ ID NO: 976584 - RNA, 22 nt, Human
agucucagaaaauaugcuuuuu

SEQ ID NO: 976585 - RNA, 22 nt, Human
cagcuccacuugaguggggccu

SEQ ID NO: 976586 - RNA, 22 nt, Human
uuccaaaggaauggggagcuau

SEQ ID NO: 976587 - RNA, 19 nt, Human
ucaguuuuagucaucaguu

SEQ ID NO: 976588 - RNA, 22 nt, Human
ucucuguacaguacaugccgug

SEQ ID NO: 976589 - RNA, 22 nt, Human
cccagggacagaugggcagcua

SEQ ID NO: 976590 - RNA, 22 nt, Human
ugagccaaacuucuccuugguc

SEQ ID NO: 976591 - RNA, 22 nt, Human
cuggagccuucaccaggggaaa

SEQ ID NO: 976592 - RNA, 22 nt, Human
guauuagguuggugcaaaagua

SEQ ID NO: 976593 - RNA, 23 nt, Human
uguaaaaugggguaguguuacca

SEQ ID NO: 976594 - RNA, 22 nt, Human
ccagagcccagcacacggugcu

SEQ ID NO: 976595 - RNA, 19 nt, Human
gcugcucugggucucaucu

SEQ ID NO: 976596 - RNA, 22 nt, Human
ggucugaaaauggugaccacca

SEQ ID NO: 976597 - RNA, 21 nt, Human
agaagccuggguggagguggg

SEQ ID NO: 976598 - RNA, 23 nt, Human
aggugcagcccuggaccugcccc

SEQ ID NO: 976599 - RNA, 22 nt, Human
guucacaagcuggguuucugca

SEQ ID NO: 976600 - RNA, 22 nt, Human
aagaguaugcaugcauguuugu

SEQ ID NO: 976601 - RNA, 22 nt, Human
ugccagcacaaguuaagagauc

SEQ ID NO: 976602 - RNA, 22 nt, Human
ucagaaguaggagacauucuug

SEQ ID NO: 976603 - RNA, 22 nt, Human
aggugagguuugggagguguca

SEQ ID NO: 976604 - RNA, 22 nt, Human
ucaggggcccuucccucagcag

SEQ ID NO: 976605 - RNA, 22 nt, Human
ucuuggagaauggcagagaagc

SEQ ID NO: 976606 - RNA, 22 nt, Human
cacuacuugaaagaauuacaga

SEQ ID NO: 976607 - RNA, 22 nt, Human
cagcagcccacgcgugcugucc

SEQ ID NO: 976608 - RNA, 22 nt, Human
cuacuucugugaugaaacuaca

SEQ ID NO: 976609 - RNA, 21 nt, Human
ugugugcauaugcauguacau

SEQ ID NO: 976610 - RNA, 22 nt, Human
uucuuacagcccuauuacuaaa

SEQ ID NO: 976611 - RNA, 20 nt, Human
aagauucauuguaauuaggg

SEQ ID NO: 976612 - RNA, 22 nt, Human
aaacagaaggguagguaaacau

SEQ ID NO: 976613 - RNA, 22 nt, Human
agggagcuaggauccugaaggu

SEQ ID NO: 976614 - RNA, 22 nt, Human
gcuggccaggugcuuugguucu

SEQ ID NO: 976615 - RNA, 22 nt, Human
aggagucacucagggcuucauc

SEQ ID NO: 976616 - RNA, 22 nt, Human
aaucagaauuuauugaaucuuu

SEQ ID NO: 976617 - RNA, 22 nt, Human
acucugcuugcccaauggaaac

SEQ ID NO: 976618 - RNA, 22 nt, Human
augccagggucacagucauauu

SEQ ID NO: 976619 - RNA, 22 nt, Human
aaccauuugccauuaucuuaag

SEQ ID NO: 976620 - RNA, 22 nt, Human
ucucaccaaagccuugaccaua

SEQ ID NO: 976621 - RNA, 22 nt, Human
gcugucugcaagccaggaaaug

SEQ ID NO: 976622 - RNA, 22 nt, Human
uuucaaauggagucgugaaaug

SEQ ID NO: 976623 - RNA, 22 nt, Human
cugccuuccaaccccagacucc

SEQ ID NO: 976624 - RNA, 22 nt, Human
gugggagcauggucccagugcc

SEQ ID NO: 976625 - RNA, 22 nt, Human
caaaucuauauguugauauucu

SEQ ID NO: 976626 - RNA, 18 nt, Human
uguacaguuaugagcauu

SEQ ID NO: 976627 - RNA, 22 nt, Human
ggcuucucgugccgaagcaaga

SEQ ID NO: 976628 - RNA, 22 nt, Human
auuaguaaaacauuguauaugu

SEQ ID NO: 976629 - RNA, 22 nt, Human
uuaauuuauguccaaaccagau

SEQ ID NO: 976630 - RNA, 22 nt, Human
cccuggaguccggagcucaccu

SEQ ID NO: 976631 - RNA, 20 nt, Human
aaggcacuaugucugcuagc

SEQ ID NO: 976632 - RNA, 23 nt, Human
caguacuuaguguagcguuaauu

SEQ ID NO: 976633 - RNA, 22 nt, Human
ucacagggauggaauagaaaua

SEQ ID NO: 976634 - RNA, 23 nt, Human
uggggagaguuacccuggaagcg

SEQ ID NO: 976635 - RNA, 22 nt, Human
uuggccuuaaccucucugugcc

SEQ ID NO: 976636 - RNA, 22 nt, Human
ccugcacuaccuggggcugcug

SEQ ID NO: 976637 - RNA, 22 nt, Human
ugaaagcucugucaucauuccu

SEQ ID NO: 976638 - RNA, 22 nt, Human
gaggagggagcuggaagcucuu

SEQ ID NO: 976639 - RNA, 22 nt, Human
gagagugaggccugggaaucua

SEQ ID NO: 976640 - RNA, 22 nt, Human
ucaacacuauccaggcaaucuu

SEQ ID NO: 976641 - RNA, 22 nt, Human
uagccgcuuaauuauuugguga

SEQ ID NO: 976642 - RNA, 22 nt, Human
aggguauaaagagcaagcagaa

SEQ ID NO: 976643 - RNA, 22 nt, Human
ccugucuggccuuccacggggg

SEQ ID NO: 976644 - RNA, 22 nt, Human
gcugugcagguccccacugccu

SEQ ID NO: 976645 - RNA, 22 nt, Human
ggcucuggugggaagguuagau

SEQ ID NO: 976646 - RNA, 22 nt, Human
gaggcaggcccugaaugaguca

SEQ ID NO: 976647 - RNA, 22 nt, Human
aggaccagccuccaggucucuu

SEQ ID NO: 976648 - RNA, 22 nt, Human
gcuggccuuugaggaagcugcg

SEQ ID NO: 976649 - RNA, 22 nt, Human
ggaggccauaguuugggaguca

SEQ ID NO: 976650 - RNA, 22 nt, Human
caagggaguuacugagggcggg

SEQ ID NO: 976651 - RNA, 22 nt, Human
auuaaauuggaucugcauaguu

SEQ ID NO: 976652 - RNA, 22 nt, Human
uggggcacuuaugaugugccac

SEQ ID NO: 976653 - RNA, 22 nt, Human
gaaggccaagaggcuccaagau

SEQ ID NO: 976654 - RNA, 22 nt, Human
cuuccuucugaagcauagaagc

SEQ ID NO: 976655 - RNA, 22 nt, Human
agugaaauggaugcugcuacug

SEQ ID NO: 976656 - RNA, 22 nt, Human
guggccuggauagacuccaucu

SEQ ID NO: 976657 - RNA, 22 nt, Human
ucagugcacagagauuuuuguu

SEQ ID NO: 976658 - RNA, 22 nt, Human
uacacacaugcauuugccuuau

SEQ ID NO: 976659 - RNA, 22 nt, Human
gccuaggaguggggauggcggu

SEQ ID NO: 976660 - RNA, 22 nt, Human
uauuggcagcaugagcuccugg

SEQ ID NO: 976661 - RNA, 22 nt, Human
ccucuucuaggacguccuugug

SEQ ID NO: 976662 - RNA, 22 nt, Human
uacccaggaggaaacugaggcu

SEQ ID NO: 976663 - RNA, 17 nt, Human
agugacuuggaaagagc

SEQ ID NO: 976664 - RNA, 22 nt, Human
uaucuuugaugccagauguuac

SEQ ID NO: 976665 - RNA, 16 nt, Human
ccuuucucugccuucc

SEQ ID NO: 976666 - RNA, 22 nt, Human
aaagccuugggauuugugauca

SEQ ID NO: 976667 - RNA, 22 nt, Human
uucuaaaauaaguuuaucuggu

SEQ ID NO: 976668 - RNA, 22 nt, Human
cugagggcccugaagcuuggca

SEQ ID NO: 976669 - RNA, 22 nt, Human
agugacagcugggaaggugaaa

SEQ ID NO: 976670 - RNA, 22 nt, Human
uguuaacaucuuggacucguga

SEQ ID NO: 976671 - RNA, 22 nt, Human
gauuuuaauuauaggagguccu

SEQ ID NO: 976672 - RNA, 22 nt, Human
uuugcauuacuugacuuuaguu

SEQ ID NO: 976673 - RNA, 22 nt, Human
uuuccagguauuaauacuguau

SEQ ID NO: 976674 - RNA, 21 nt, Human
gccaccucgucucggagcagc

SEQ ID NO: 976675 - RNA, 22 nt, Human
aggguggcugaguagauggaag

SEQ ID NO: 976676 - RNA, 22 nt, Human
ccaggagucaauaaaggaagcu

SEQ ID NO: 976677 - RNA, 22 nt, Human
gggaagcaggugcagcucgccu

SEQ ID NO: 976678 - RNA, 22 nt, Human
gccaggaggggagaguguguca

SEQ ID NO: 976679 - RNA, 22 nt, Human
gguuggggcgagcuggaggccc

SEQ ID NO: 976680 - RNA, 22 nt, Human
auuuuacuuugugaauauugac

SEQ ID NO: 976681 - RNA, 22 nt, Human
cugggccaucuccuuugugugg

SEQ ID NO: 976682 - RNA, 22 nt, Human
agccaaggagugcagguggcuu

SEQ ID NO: 976683 - RNA, 22 nt, Human
uagucuuuugagaaguauaucu

SEQ ID NO: 976684 - RNA, 22 nt, Human
auuuggcauaggcagaggccca

SEQ ID NO: 976685 - RNA, 22 nt, Human
aaugucugccagaacugaucau

SEQ ID NO: 976686 - RNA, 21 nt, Human
ucagggcagugggagguuccu

SEQ ID NO: 976687 - RNA, 20 nt, Human
ugaaauaaggaguuguccuu

SEQ ID NO: 976688 - RNA, 22 nt, Human
gauuuucaugauaaacuuguga

SEQ ID NO: 976689 - RNA, 22 nt, Human
ugucccaguucccaggguugcu

SEQ ID NO: 976690 - RNA, 22 nt, Human
guguaauuauauaaagaucuac

SEQ ID NO: 976691 - RNA, 20 nt, Human
uuucagugguuugugccuag

SEQ ID NO: 976692 - RNA, 22 nt, Human
gagagucacugucugcauuucc

SEQ ID NO: 976693 - RNA, 22 nt, Human
ucuggccaauguugugaucaca

SEQ ID NO: 976694 - RNA, 22 nt, Human
caggugcccagcuccugcugug

SEQ ID NO: 976695 - RNA, 22 nt, Human
uucuuuugggaauuacguaugc

SEQ ID NO: 976696 - RNA, 22 nt, Human
gggagcaggacauaauagcaau

SEQ ID NO: 976697 - RNA, 22 nt, Human
uuuccucuuccgagggggaggc

SEQ ID NO: 976698 - RNA, 22 nt, Human
ucccagagugugggcaucaagg

SEQ ID NO: 976699 - RNA, 22 nt, Human
cuggggggagcugcguccagca

SEQ ID NO: 976700 - RNA, 22 nt, Human
cugcugcugagagcucagccug

SEQ ID NO: 976701 - RNA, 23 nt, Human
auuguuuuuggcucucagggaau

SEQ ID NO: 976702 - RNA, 22 nt, Human
gcugggagugggcaagaugaga

SEQ ID NO: 976703 - RNA, 22 nt, Human
agccagcaggugagugcagccu

SEQ ID NO: 976704 - RNA, 23 nt, Human
acagagguccaaacaguauaagc

SEQ ID NO: 976705 - RNA, 22 nt, Human
caaaaguaauuaugguuuuugc

SEQ ID NO: 976706 - RNA, 22 nt, Human
ugcucccaaacgaccuacugug

SEQ ID NO: 976707 - RNA, 22 nt, Human
ucuccucucuuaccugguacaa

SEQ ID NO: 976708 - RNA, 22 nt, Human
acaggcugcugggcuccgugcu

SEQ ID NO: 976709 - RNA, 22 nt, Human
ccagggugugggcgucggcacg

SEQ ID NO: 976710 - RNA, 22 nt, Human
uucauucccaagaguaaacaua

SEQ ID NO: 976711 - RNA, 22 nt, Human
ugucugugaccucuuaggcaag

SEQ ID NO: 976712 - RNA, 22 nt, Human
ugagacaguuuuucuauuucca

SEQ ID NO: 976713 - RNA, 22 nt, Human
uccagccaccaccuugauugcc

SEQ ID NO: 976714 - RNA, 22 nt, Human
agagggaucacccuguuucugg

SEQ ID NO: 976715 - RNA, 22 nt, Human
cacagggccuggggcagcugcu

SEQ ID NO: 976716 - RNA, 22 nt, Human
ccucauggaccucagacugucc

SEQ ID NO: 976717 - RNA, 22 nt, Human
gagccuggggacccuccugagu

SEQ ID NO: 976718 - RNA, 22 nt, Human
cagaaugcaaauuuuauaauau

SEQ ID NO: 976719 - RNA, 22 nt, Human
gcagggacaaggcagguguucu

SEQ ID NO: 976720 - RNA, 22 nt, Human
augcucugggcaggagcccugg

SEQ ID NO: 976721 - RNA, 22 nt, Human
uggccucucuaccaggcagccu

SEQ ID NO: 976722 - RNA, 22 nt, Human
ucugaaagaagggcagucuuuu

SEQ ID NO: 976723 - RNA, 22 nt, Human
ugcuucaggaagaaacgccagg

SEQ ID NO: 976724 - RNA, 22 nt, Human
ucaaauaaggagucaugaccau

SEQ ID NO: 976725 - RNA, 22 nt, Human
uggcagggaguugcaggauuuc

SEQ ID NO: 976726 - RNA, 22 nt, Human
gggcacuguggggcccaugcug

SEQ ID NO: 976727 - RNA, 22 nt, Human
ugcuauugugaacagugccaca

SEQ ID NO: 976728 - RNA, 22 nt, Human
uacucugccacuaggaguucug

SEQ ID NO: 976729 - RNA, 22 nt, Human
ugagcuguagcagaugcuguug

SEQ ID NO: 976730 - RNA, 22 nt, Human
uuagaaaacauaagugguaaag

SEQ ID NO: 976731 - RNA, 22 nt, Human
uuaucguacgcuucagaaauuu

SEQ ID NO: 976732 - RNA, 22 nt, Human
ccagugcacagccaggcaggug

SEQ ID NO: 976733 - RNA, 22 nt, Human
uuucuuauacuauauugucauc

SEQ ID NO: 976734 - RNA, 22 nt, Human
gcucaggaccgaggggugggaa

SEQ ID NO: 976735 - RNA, 22 nt, Human
ggggaugguggcauuuguaaaa

SEQ ID NO: 976736 - RNA, 22 nt, Human
agaggcacuccagccacugguc

SEQ ID NO: 976737 - RNA, 22 nt, Human
ccaccagcuuugccacccugcu

SEQ ID NO: 976738 - RNA, 22 nt, Human
gcauucuuuuuaggagguuccu

SEQ ID NO: 976739 - RNA, 22 nt, Human
uuccaagaguaaauucaaauug

SEQ ID NO: 976740 - RNA, 22 nt, Human
acagucucuccacacugcaggg

SEQ ID NO: 976741 - RNA, 22 nt, Human
gcucugcuugcaucaugacugc

SEQ ID NO: 976742 - RNA, 22 nt, Human
ccuuuuucaauauagaauugca

SEQ ID NO: 976743 - RNA, 22 nt, Human
acagggucauuuuaugaucugu

SEQ ID NO: 976744 - RNA, 22 nt, Human
ugcuuucaaaggcuuucuagau

SEQ ID NO: 976745 - RNA, 22 nt, Human
cuucagagugcagaagauuggg

SEQ ID NO: 976746 - RNA, 22 nt, Human
cccugccuugggguccacaccg

SEQ ID NO: 976747 - RNA, 20 nt, Human
cugggcugcccagcuauggg

SEQ ID NO: 976748 - RNA, 19 nt, Human
caggaaggggcgaaucugg

SEQ ID NO: 976749 - RNA, 22 nt, Human
gcucucugucguuaugcuucau

SEQ ID NO: 976750 - RNA, 22 nt, Human
uagagcuguaucaaagagccuu

SEQ ID NO: 976751 - RNA, 22 nt, Human
cagagguacaagcuaaguuggg

SEQ ID NO: 976752 - RNA, 20 nt, Human
gggcagcuccccucauucug

SEQ ID NO: 976753 - RNA, 22 nt, Human
agcaccaugaccuugccauuga

SEQ ID NO: 976754 - RNA, 22 nt, Human
gguaaaaugcagauucuuagcc

SEQ ID NO: 976755 - RNA, 22 nt, Human
aaagauaauguuuccuuauucu

SEQ ID NO: 976756 - RNA, 22 nt, Human
aaaaauagcuucucuugucccu

SEQ ID NO: 976757 - RNA, 19 nt, Human
aguagcagaaagugcagug

SEQ ID NO: 976758 - RNA, 22 nt, Human
uggagggcaucuguggucaggc

SEQ ID NO: 976759 - RNA, 22 nt, Human
uugccacugaaccagucuugca

SEQ ID NO: 976760 - RNA, 22 nt, Human
ccuggacucaggcugugggcac

SEQ ID NO: 976761 - RNA, 22 nt, Human
ucuaggagaaccaucagggagg

SEQ ID NO: 976762 - RNA, 22 nt, Human
auguacauuuagaucauuucug

SEQ ID NO: 976763 - RNA, 22 nt, Human
aaggcagccaugugcuuugggu

SEQ ID NO: 976764 - RNA, 21 nt, Human
cggccaaauuccuccuaggga

SEQ ID NO: 976765 - RNA, 22 nt, Human
ucugcaggcuuggaguggcagc

SEQ ID NO: 976766 - RNA, 22 nt, Human
aaaggucagcugccaucguucu

SEQ ID NO: 976767 - RNA, 22 nt, Human
uauucacuguaacucagcaaua

SEQ ID NO: 976768 - RNA, 22 nt, Human
guaacugaggcagcuuuuaaga

SEQ ID NO: 976769 - RNA, 22 nt, Human
caaauguguuuuuucuucuaca

SEQ ID NO: 976770 - RNA, 22 nt, Human
ucagaggucccuagcaggagug

SEQ ID NO: 976771 - RNA, 22 nt, Human
uuggcagucucagucagauggc

SEQ ID NO: 976772 - RNA, 22 nt, Human
ugcaggcaggggaugagcagcc

SEQ ID NO: 976773 - RNA, 22 nt, Human
accaggagccacaggaggagcc

SEQ ID NO: 976774 - RNA, 22 nt, Human
aauguauuccucaugcaagagu

SEQ ID NO: 976775 - RNA, 22 nt, Human
cucucugagugagggacaagcu

SEQ ID NO: 976776 - RNA, 22 nt, Human
ucugugccuccguaacacacca

SEQ ID NO: 976777 - RNA, 22 nt, Human
ccuggcugcuuucacuauggag

SEQ ID NO: 976778 - RNA, 22 nt, Human
uaaaugugaccuucauuuuaua

SEQ ID NO: 976779 - RNA, 22 nt, Human
uggagccaaggccaguucucag

SEQ ID NO: 976780 - RNA, 22 nt, Human
cauugcacuccaucuugggcaa

SEQ ID NO: 976781 - RNA, 22 nt, Human
cuggcugcgucugcucugacag

SEQ ID NO: 976782 - RNA, 22 nt, Human
gccuggcaggccugggccagca

SEQ ID NO: 976783 - RNA, 22 nt, Human
cucugcugggauguaaagucuu

SEQ ID NO: 976784 - RNA, 22 nt, Human
aauuaggaaauucagccauuuu

SEQ ID NO: 976785 - RNA, 22 nt, Human
ugucaaaaauaagagagauugu

SEQ ID NO: 976786 - RNA, 22 nt, Human
cccuugggugccagccacaagu

SEQ ID NO: 976787 - RNA, 22 nt, Human
ccccaggagauuugggagcaca

SEQ ID NO: 976788 - RNA, 22 nt, Human
aggcugcuuccuuacguggcug

SEQ ID NO: 976789 - RNA, 20 nt, Human
gagcagcuguuugcauugca

SEQ ID NO: 976790 - RNA, 22 nt, Human
cugugucuaaucaggucaguca

SEQ ID NO: 976791 - RNA, 22 nt, Human
cuccucccugcgauugcucugc

SEQ ID NO: 976792 - RNA, 22 nt, Human
uuaugaaagacauuucuguugg

SEQ ID NO: 976793 - RNA, 22 nt, Human
uggcagacacugucgaagccua

SEQ ID NO: 976794 - RNA, 22 nt, Human
aaaauggucucagcuggcacca

SEQ ID NO: 976795 - RNA, 22 nt, Human
gcacccagcccagggcgugaug

SEQ ID NO: 976796 - RNA, 22 nt, Human
uggggugccgacagggagggca

SEQ ID NO: 976797 - RNA, 22 nt, Human
caguggcgugaucucugcucac

SEQ ID NO: 976798 - RNA, 22 nt, Human
aggcuggggaauugaauuugcu

SEQ ID NO: 976799 - RNA, 17 nt, Human
uagaauauggugggcug

SEQ ID NO: 976800 - RNA, 19 nt, Human
ccaggagcaguggugagcu

SEQ ID NO: 976801 - RNA, 20 nt, Human
caggaugauuggacacgaug

SEQ ID NO: 976802 - RNA, 22 nt, Human
cuguucaugcugauucuguaug

SEQ ID NO: 976803 - RNA, 22 nt, Human
agacaaagacagcaucucaggu

SEQ ID NO: 976804 - RNA, 22 nt, Human
gaggaguggaguugcuggguug

SEQ ID NO: 976805 - RNA, 22 nt, Human
aggcucaggcaggaauggcgga

SEQ ID NO: 976806 - RNA, 22 nt, Human
gccagcagccacagaagucacu

SEQ ID NO: 976807 - RNA, 22 nt, Human
gcaucuuucuguccauucagca

SEQ ID NO: 976808 - RNA, 22 nt, Human
ugucagugaguuaguugcaagu

SEQ ID NO: 976809 - RNA, 22 nt, Human
cucuguagaaacagggcagaag

SEQ ID NO: 976810 - RNA, 22 nt, Human
ggagucaggagcaggcugggcu

SEQ ID NO: 976811 - RNA, 22 nt, Human
ggugcuggacacguggcacucc

SEQ ID NO: 976812 - RNA, 20 nt, Human
uucuucucuaguuaucuuca

SEQ ID NO: 976813 - RNA, 21 nt, Human
auuauuauuucuguguccagc

SEQ ID NO: 976814 - RNA, 22 nt, Human
gcagcuuggauuucuguaguuu

SEQ ID NO: 976815 - RNA, 22 nt, Human
uguguacauaucuauccuagau

SEQ ID NO: 976816 - RNA, 22 nt, Human
gcugucugggaggccuccacuu

SEQ ID NO: 976817 - RNA, 22 nt, Human
uacaguagacaauguuaguaug

SEQ ID NO: 976818 - RNA, 22 nt, Human
agggaggauaguagucaguuua

SEQ ID NO: 976819 - RNA, 22 nt, Human
uggacaggaucugagacugaga

SEQ ID NO: 976820 - RNA, 22 nt, Human
aggcccugcccagugccacaag

SEQ ID NO: 976821 - RNA, 22 nt, Human
ucaguuuugaaaacauugaaug

SEQ ID NO: 976822 - RNA, 22 nt, Human
uguuccaugucuuuguaggacu

SEQ ID NO: 976823 - RNA, 22 nt, Human
auuguauuuccagcuugaaugu

SEQ ID NO: 976824 - RNA, 22 nt, Human
gggcagugguuacacagcugag

SEQ ID NO: 976825 - RNA, 22 nt, Human
aucuggcuuaccuagggugccu

SEQ ID NO: 976826 - RNA, 22 nt, Human
ucuccuggcucuaaaaggcugu

SEQ ID NO: 976827 - RNA, 22 nt, Human
aaguuauuuccucgugacugaa

SEQ ID NO: 976828 - RNA, 22 nt, Human
caagagcauuuaguuagcuggu

SEQ ID NO: 976829 - RNA, 22 nt, Human
acuaaauaguuuugacagaaca

SEQ ID NO: 976830 - RNA, 21 nt, Human
uggcagggguaguaguacagc

SEQ ID NO: 976831 - RNA, 22 nt, Human
ucugccuucgcugcucccugaa

SEQ ID NO: 976832 - RNA, 19 nt, Human
ucucacaucagcuccuagc

SEQ ID NO: 976833 - RNA, 22 nt, Human
cauuuguauguuccuccuuagg

SEQ ID NO: 976834 - RNA, 22 nt, Human
cacagcagaaauaugaaggcag

SEQ ID NO: 976835 - RNA, 22 nt, Human
uagcugccuaugugauaagaga

SEQ ID NO: 976836 - RNA, 22 nt, Human
cagggccauuggcguggcuguc

SEQ ID NO: 976837 - RNA, 22 nt, Human
cuaggccacuugcucucaugga

SEQ ID NO: 976838 - RNA, 22 nt, Human
cugcugugcauauuuaucuagg

SEQ ID NO: 976839 - RNA, 22 nt, Human
uccaggcuagguuuacaggaca

SEQ ID NO: 976840 - RNA, 22 nt, Human
auaacagagagcuacugaacug

SEQ ID NO: 976841 - RNA, 22 nt, Human
gaauacauuggaaaucagaaua

SEQ ID NO: 976842 - RNA, 22 nt, Human
ugugaaaagcaggcuacuuucu

SEQ ID NO: 976843 - RNA, 20 nt, Human
ucuccuggugacaguaccca

SEQ ID NO: 976844 - RNA, 22 nt, Human
agcagcugaccagugaguccug

SEQ ID NO: 976845 - RNA, 22 nt, Human
uacuuuggauccuuacaauagc

SEQ ID NO: 976846 - RNA, 22 nt, Human
cugcagccuaggugcagcuggg

SEQ ID NO: 976847 - RNA, 17 nt, Human
ucagcaaagacaaagga

SEQ ID NO: 976848 - RNA, 22 nt, Human
aaauguguuccuuugcuacaga

SEQ ID NO: 976849 - RNA, 22 nt, Human
ggccagugugcaggucagagau

SEQ ID NO: 976850 - RNA, 21 nt, Human
gccagagcaguacaaugaggu

SEQ ID NO: 976851 - RNA, 22 nt, Human
ccuggccacccagccuuggcca

SEQ ID NO: 976852 - RNA, 21 nt, Human
ccaggaaggacugagcucccu

SEQ ID NO: 976853 - RNA, 21 nt, Human
gcucuuggaaggggcucagcu

SEQ ID NO: 976854 - RNA, 22 nt, Human
aagggcagaaagggacgcuuug

SEQ ID NO: 976855 - RNA, 22 nt, Human
agaggagcugggaggcccucgu

SEQ ID NO: 976856 - RNA, 21 nt, Human
uuacuuuugcagcaaccuaau

SEQ ID NO: 976857 - RNA, 22 nt, Human
aaaugcagguucuugagccaag

SEQ ID NO: 976858 - RNA, 22 nt, Human
ccaggaggcagagguuacagug

SEQ ID NO: 976859 - RNA, 22 nt, Human
agccugagccccauccagcuga

SEQ ID NO: 976860 - RNA, 22 nt, Human
auguuuuauauuuugcagcagu

SEQ ID NO: 976861 - RNA, 22 nt, Human
cagauggccagaggcagcugca

SEQ ID NO: 976862 - RNA, 22 nt, Human
caagagcucaccggagagcauu

SEQ ID NO: 976863 - RNA, 22 nt, Human
caguggaggcucaagugugcuu

SEQ ID NO: 976864 - RNA, 22 nt, Human
ucuguucuuguccccacuucag

SEQ ID NO: 976865 - RNA, 22 nt, Human
cuaagccacucaaaucuugugg

SEQ ID NO: 976866 - RNA, 22 nt, Human
acaaaaagcuccauuacugucc

SEQ ID NO: 976867 - RNA, 22 nt, Human
aaaugguaagacaacacauuau

SEQ ID NO: 976868 - RNA, 23 nt, Human
gcuguuagauuuaauaagcauuu

SEQ ID NO: 976869 - RNA, 22 nt, Human
gccagugugcaagaggccacca

SEQ ID NO: 976870 - RNA, 18 nt, Human
ggcugugcguggaggcug

SEQ ID NO: 976871 - RNA, 22 nt, Human
acacuuuacagcuuccuuugca

SEQ ID NO: 976872 - RNA, 22 nt, Human
gccugccuucggugcgcagcgg

SEQ ID NO: 976873 - RNA, 22 nt, Human
cagauggcagggcagcucugca

SEQ ID NO: 976874 - RNA, 22 nt, Human
agcuccugcacccagccuugag

SEQ ID NO: 976875 - RNA, 22 nt, Human
cagaauaugacaagauuuuccu

SEQ ID NO: 976876 - RNA, 22 nt, Human
uggcucagccauucguguugcc

SEQ ID NO: 976877 - RNA, 22 nt, Human
gcucucugaggugcuggcagag

SEQ ID NO: 976878 - RNA, 22 nt, Human
uccauaagcagguucuuccuga

SEQ ID NO: 976879 - RNA, 22 nt, Human
agcaggaguguccccuggcugu

SEQ ID NO: 976880 - RNA, 18 nt, Human
cccagcccaccauuucuc

SEQ ID NO: 976881 - RNA, 22 nt, Human
acauaccauacauggugagaug

SEQ ID NO: 976882 - RNA, 22 nt, Human
aggcccugaccugggagaucua

SEQ ID NO: 976883 - RNA, 21 nt, Human
ucugggcccaugcugccucac

SEQ ID NO: 976884 - RNA, 22 nt, Human
aguggcagccgagcaggagaug

SEQ ID NO: 976885 - RNA, 22 nt, Human
aucuggcuccuacacuugaaga

SEQ ID NO: 976886 - RNA, 22 nt, Human
cucuggaauguuuacaugcccu

SEQ ID NO: 976887 - RNA, 22 nt, Human
gguggggccugcuccagcggcc

SEQ ID NO: 976888 - RNA, 22 nt, Human
ggcucagguuuccuucccagcu

SEQ ID NO: 976889 - RNA, 22 nt, Human
gagggguguggagccaucaguu

SEQ ID NO: 976890 - RNA, 22 nt, Human
uggcucugaucagauguccagu

SEQ ID NO: 976891 - RNA, 22 nt, Human
gucuagagugcuuccuagucau

SEQ ID NO: 976892 - RNA, 22 nt, Human
accaggaggccuggagcacaaa

SEQ ID NO: 976893 - RNA, 22 nt, Human
cagugaaaucacaacuuuaguu

SEQ ID NO: 976894 - RNA, 22 nt, Human
gggaggcuggcucuggccacag

SEQ ID NO: 976895 - RNA, 22 nt, Human
cucugagaggugagaagcagca

SEQ ID NO: 976896 - RNA, 22 nt, Human
ucagugucuugaccugggugug

SEQ ID NO: 976897 - RNA, 22 nt, Human
uaaaauguagcuucuaggcugg

SEQ ID NO: 976898 - RNA, 22 nt, Human
cccuggaggucagaggccuggg

SEQ ID NO: 976899 - RNA, 23 nt, Human
ugagcccaggaggucaaggcugc

SEQ ID NO: 976900 - RNA, 22 nt, Human
gccagcagggcccaaaugcugg

SEQ ID NO: 976901 - RNA, 22 nt, Human
cuacccagagugaaucucuuaa

SEQ ID NO: 976902 - RNA, 21 nt, Human
aagggagauaggaaucaggcc

SEQ ID NO: 976903 - RNA, 22 nt, Human
gcagggugugucucauacaguu

SEQ ID NO: 976904 - RNA, 22 nt, Human
uucagucagugacuaagcaguu

SEQ ID NO: 976905 - RNA, 22 nt, Human
aggagggagaugcccauccugg

SEQ ID NO: 976906 - RNA, 22 nt, Human
ccaggagguggagauugcagug

SEQ ID NO: 976907 - RNA, 22 nt, Human
ggcaugggagugagcaaccuua

SEQ ID NO: 976908 - RNA, 22 nt, Human
agaaaucacaggaggcagaagg

SEQ ID NO: 976909 - RNA, 22 nt, Human
augugucuugagggggauggag

SEQ ID NO: 976910 - RNA, 22 nt, Human
uugaagauggaucgccacucuc

SEQ ID NO: 976911 - RNA, 22 nt, Human
cacaguggauugggugaugccc

SEQ ID NO: 976912 - RNA, 22 nt, Human
gcccaguaguucaagguugcag

SEQ ID NO: 976913 - RNA, 22 nt, Human
guguggcugccagccaagaggc

SEQ ID NO: 976914 - RNA, 22 nt, Human
acuugggagggugugggcagcu

SEQ ID NO: 976915 - RNA, 22 nt, Human
augucccuugucugugaugucu

SEQ ID NO: 976916 - RNA, 20 nt, Human
cccuggccuguuucaugccc

SEQ ID NO: 976917 - RNA, 22 nt, Human
acuguucauccuuuuugaacaa

SEQ ID NO: 976918 - RNA, 22 nt, Human
caaguuaucagaaggcacuuuu

SEQ ID NO: 976919 - RNA, 22 nt, Human
gcugcucuggcucugcaguguc

SEQ ID NO: 976920 - RNA, 22 nt, Human
auucacagggacaaugggagag

SEQ ID NO: 976921 - RNA, 22 nt, Human
cucacugcaaguuccaccuacc

SEQ ID NO: 976922 - RNA, 22 nt, Human
cagagacagaaaauggaucuag

SEQ ID NO: 976923 - RNA, 22 nt, Human
agauaaauuccuaagauuucag

SEQ ID NO: 976924 - RNA, 22 nt, Human
acuggcugaaguuuacuuuuug

SEQ ID NO: 976925 - RNA, 22 nt, Human
acugcuuuucagagucugccug

SEQ ID NO: 976926 - RNA, 22 nt, Human
agugaaaacacuaguucuugcc

SEQ ID NO: 976927 - RNA, 22 nt, Human
caguauguuugggagacaugac

SEQ ID NO: 976928 - RNA, 22 nt, Human
ggcugccucaaagcucaagcuc

SEQ ID NO: 976929 - RNA, 22 nt, Human
ucauccaguucacauggugagu

SEQ ID NO: 976930 - RNA, 19 nt, Human
gcugcuggcucuggcugga

SEQ ID NO: 976931 - RNA, 22 nt, Human
uggcuucugggacuugugagca

SEQ ID NO: 976932 - RNA, 22 nt, Human
ucagaagucccagaauucacau

SEQ ID NO: 976933 - RNA, 22 nt, Human
aggccugacuugaauuuagggc

SEQ ID NO: 976934 - RNA, 20 nt, Human
cugcugugguccuuuauuuu

SEQ ID NO: 976935 - RNA, 22 nt, Human
aaaaaugaauucuucaguggca

SEQ ID NO: 976936 - RNA, 22 nt, Human
uuguauucauugcuuacccaau

SEQ ID NO: 976937 - RNA, 22 nt, Human
ggcugccacgucgaggguccaa

SEQ ID NO: 976938 - RNA, 22 nt, Human
acagcagccugcagcccugugu

SEQ ID NO: 976939 - RNA, 22 nt, Human
aacuuuauuguuaggggcuaaa

SEQ ID NO: 976940 - RNA, 22 nt, Human
ugcgcggcucagucaucuccag

SEQ ID NO: 976941 - RNA, 17 nt, Human
ucuggccuuccugaacu

SEQ ID NO: 976942 - RNA, 22 nt, Human
ugcagcuucuccaucuccuugu

SEQ ID NO: 976943 - RNA, 20 nt, Human
cacugaagacuucuugcuca

SEQ ID NO: 976944 - RNA, 22 nt, Human
augugugccccuuuuacucuuu

SEQ ID NO: 976945 - RNA, 22 nt, Human
ugggcugcuuccucagcugaga

SEQ ID NO: 976946 - RNA, 20 nt, Human
cuguccccgaggucaccagg

SEQ ID NO: 976947 - RNA, 22 nt, Human
cagccaggagccucugcaacua

SEQ ID NO: 976948 - RNA, 22 nt, Human
cacauauuugaugaagcuuugu

SEQ ID NO: 976949 - RNA, 20 nt, Human
cuuagaaauuuuuacccugg

SEQ ID NO: 976950 - RNA, 22 nt, Human
aaacaaguuuagaauaaugaau

SEQ ID NO: 976951 - RNA, 22 nt, Human
uccucugcuccaucuuuacugu

SEQ ID NO: 976952 - RNA, 22 nt, Human
auucuuucaaggaauaguuauu

SEQ ID NO: 976953 - RNA, 22 nt, Human
cugguccuccuugccuucagau

SEQ ID NO: 976954 - RNA, 22 nt, Human
ugucucugaggugagggucagc

SEQ ID NO: 976955 - RNA, 22 nt, Human
aaauguggguaaugggacugga

SEQ ID NO: 976956 - RNA, 22 nt, Human
agguggggaggagugucucuuu

SEQ ID NO: 976957 - RNA, 21 nt, Human
ccugagggugguugugaagau

SEQ ID NO: 976958 - RNA, 22 nt, Human
auuagagaaugugcugacauug

SEQ ID NO: 976959 - RNA, 22 nt, Human
ucacaggguguacaucaccuau

SEQ ID NO: 976960 - RNA, 21 nt, Human
cccaggaggagcuccggcucc

SEQ ID NO: 976961 - RNA, 22 nt, Human
acuccaggguuuugcaccugga

SEQ ID NO: 976962 - RNA, 22 nt, Human
cugaagaggacgcagcagcaag

SEQ ID NO: 976963 - RNA, 22 nt, Human
ugguccaagugagguggccucu

SEQ ID NO: 976964 - RNA, 21 nt, Human
auguaggaguuauuggaacag

SEQ ID NO: 976965 - RNA, 22 nt, Human
uggccaguagauaggcaggcaa

SEQ ID NO: 976966 - RNA, 22 nt, Human
aaugaacaucaaaugccuacca

SEQ ID NO: 976967 - RNA, 22 nt, Human
acuggcaguagagggagcgcau

SEQ ID NO: 976968 - RNA, 22 nt, Human
aaaugcacagaggccagagagg

SEQ ID NO: 976969 - RNA, 22 nt, Human
augggaggaaggaggcccuuga

SEQ ID NO: 976970 - RNA, 22 nt, Human
ucuggcucaggucagacaggga

SEQ ID NO: 976971 - RNA, 22 nt, Human
gcaaauauucaagacuuuucca

SEQ ID NO: 976972 - RNA, 22 nt, Human
auuuggaaaugcaucucuugag

SEQ ID NO: 976973 - RNA, 22 nt, Human
auuugcauaauagugauuugua

SEQ ID NO: 976974 - RNA, 22 nt, Human
gagcugucuggggacucugggu

SEQ ID NO: 976975 - RNA, 22 nt, Human
ggaggccaggaaggcucggaga

SEQ ID NO: 976976 - RNA, 22 nt, Human
ggcucugcuggauugaggccag

SEQ ID NO: 976977 - RNA, 22 nt, Human
ccuguucacugcacaguuuccg

SEQ ID NO: 976978 - RNA, 22 nt, Human
ugagcuggucuugaguguagcu

SEQ ID NO: 976979 - RNA, 22 nt, Human
cagagguaccagcagccucugg

SEQ ID NO: 976980 - RNA, 22 nt, Human
uucaaaacaaucuguuugcauu

SEQ ID NO: 976981 - RNA, 22 nt, Human
ugccucugugggccuuccuggc

SEQ ID NO: 976982 - RNA, 22 nt, Human
caggggcucuaaugcaugauca

SEQ ID NO: 976983 - RNA, 22 nt, Human
acauuuuuuagagucccacauu

SEQ ID NO: 976984 - RNA, 22 nt, Human
gugcagcugugguggagccagg

SEQ ID NO: 976985 - RNA, 20 nt, Human
aagagcauaguacaggaaga

SEQ ID NO: 976986 - RNA, 22 nt, Human
gccugaagaacagcugugagga

SEQ ID NO: 976987 - RNA, 22 nt, Human
auccaaagcccuaaguuaacug

SEQ ID NO: 976988 - RNA, 22 nt, Human
uagagcuggccgggacagcugg

SEQ ID NO: 976989 - RNA, 22 nt, Human
ggccuugggcuggcugcaguau

SEQ ID NO: 976990 - RNA, 22 nt, Human
ucagaaauacuaucagcuuuug

SEQ ID NO: 976991 - RNA, 22 nt, Human
uauuccagguuucuuguuguau

SEQ ID NO: 976992 - RNA, 22 nt, Human
cuggcagccaagugggauacuc

SEQ ID NO: 976993 - RNA, 22 nt, Human
ucccaggacaggccacauggaa

SEQ ID NO: 976994 - RNA, 22 nt, Human
agcagaagaaagccacaugacu

SEQ ID NO: 976995 - RNA, 22 nt, Human
ugcaggagcagagauggcugga

SEQ ID NO: 976996 - RNA, 22 nt, Human
cacagugcaugaugggcagaag

SEQ ID NO: 976997 - RNA, 18 nt, Human
aggcuucccaggcaggcc

SEQ ID NO: 976998 - RNA, 22 nt, Human
guuuaaguuucagaagcuaaga

SEQ ID NO: 976999 - RNA, 22 nt, Human
ucuggcagggguucugcacuug

SEQ ID NO: 977000 - RNA, 21 nt, Human
ucagaguggaagacaguuuga

SEQ ID NO: 977001 - RNA, 22 nt, Human
cugaggugagcuucccugggcu

SEQ ID NO: 977002 - RNA, 22 nt, Human
uauauuaguggaaugauaugaa

SEQ ID NO: 977003 - RNA, 22 nt, Human
aaauuauuuucagaauggagaa

SEQ ID NO: 977004 - RNA, 22 nt, Human
cuucaagaagacagcagagcau

SEQ ID NO: 977005 - RNA, 22 nt, Human
gggcagcuccuguggaauccac

SEQ ID NO: 977006 - RNA, 22 nt, Human
auucucaaacaagugguuugau

SEQ ID NO: 977007 - RNA, 22 nt, Human
auuauaaagaacaugugugugg

SEQ ID NO: 977008 - RNA, 23 nt, Human
uuuuaauuuggacauaagaagau

SEQ ID NO: 977009 - RNA, 22 nt, Human
acagccaggagccaugggcagg

SEQ ID NO: 977010 - RNA, 22 nt, Human
ugcagcaggagccaggccuggu

SEQ ID NO: 977011 - RNA, 22 nt, Human
gcccaggaggcagagguugugg

SEQ ID NO: 977012 - RNA, 21 nt, Human
ggcauggcaccucugggcagg

SEQ ID NO: 977013 - RNA, 22 nt, Human
gcagacuggucuucagccuugg

SEQ ID NO: 977014 - RNA, 20 nt, Human
ucuguaaagacuccagaagc

SEQ ID NO: 977015 - RNA, 22 nt, Human
gccaugccugugucuccaggcc

SEQ ID NO: 977016 - RNA, 22 nt, Human
ggcaugggccgaggugccuccu

SEQ ID NO: 977017 - RNA, 22 nt, Human
gagggcugauaaaugcgcaugg

SEQ ID NO: 977018 - RNA, 22 nt, Human
cagggugcagugucgcugcuag

SEQ ID NO: 977019 - RNA, 22 nt, Human
aagacagaccacgugacagggc

SEQ ID NO: 977020 - RNA, 22 nt, Human
aucuggcugcugugcuuaagcu

SEQ ID NO: 977021 - RNA, 21 nt, Human
agcugcuuucagcuccuagag

SEQ ID NO: 977022 - RNA, 22 nt, Human
uuccaggaggcacugacagagg

SEQ ID NO: 977023 - RNA, 22 nt, Human
agccccaggcccggacgccucu

SEQ ID NO: 977024 - RNA, 22 nt, Human
ugccaggcgugguggugcgcac

SEQ ID NO: 977025 - RNA, 22 nt, Human
ugaugguuuuauuaauaggacc

SEQ ID NO: 977026 - RNA, 22 nt, Human
agggccugucagcgguguccug

SEQ ID NO: 977027 - RNA, 22 nt, Human
cugaggucuagacaccccaggg

SEQ ID NO: 977028 - RNA, 22 nt, Human
ugcuggccaacaaggcuccaag

SEQ ID NO: 977029 - RNA, 22 nt, Human
agggcugagacuaaggccagau

SEQ ID NO: 977030 - RNA, 22 nt, Human
agcagcucuuaacaaagcaugg

SEQ ID NO: 977031 - RNA, 22 nt, Human
aguguccccuacagaggcauuc

SEQ ID NO: 977032 - RNA, 22 nt, Human
uaaacauuuguuauucuuguuu

SEQ ID NO: 977033 - RNA, 22 nt, Human
uuugcaaauaccaugaaacuug

SEQ ID NO: 977034 - RNA, 22 nt, Human
ggggcagagagaaggaagcuug

SEQ ID NO: 977035 - RNA, 22 nt, Human
ccugugucagccccugccucca

SEQ ID NO: 977036 - RNA, 21 nt, Human
uagcacuucgcuguaauuggg

SEQ ID NO: 977037 - RNA, 22 nt, Human
ugagccuggagucguggagggg

SEQ ID NO: 977038 - RNA, 22 nt, Human
auguagcagaagauguuuuccu

SEQ ID NO: 977039 - RNA, 23 nt, Human
ugcaugugaauucauacuuguuu

SEQ ID NO: 977040 - RNA, 22 nt, Human
cacagcugaaguagccaugugg

SEQ ID NO: 977041 - RNA, 22 nt, Human
agaauucuggaguugggaggaa

SEQ ID NO: 977042 - RNA, 18 nt, Human
gcagagugcgucucugug

SEQ ID NO: 977043 - RNA, 22 nt, Human
uaggaaaaauacagaauuauau

SEQ ID NO: 977044 - RNA, 22 nt, Human
aaauacagcagacuccuguugu

SEQ ID NO: 977045 - RNA, 22 nt, Human
uccaggagggauugggcugugg

SEQ ID NO: 977046 - RNA, 22 nt, Human
ucagaccauccugcuguuagug

SEQ ID NO: 977047 - RNA, 22 nt, Human
cggccaagccggggccccgaag

SEQ ID NO: 977048 - RNA, 22 nt, Human
uuuuauuaucuuugaaugggac

SEQ ID NO: 977049 - RNA, 22 nt, Human
uugaaggacauccuauuucuag

SEQ ID NO: 977050 - RNA, 22 nt, Human
cagcucugaagaaaggugucua

SEQ ID NO: 977051 - RNA, 22 nt, Human
gagccagcugagcugcacuguc

SEQ ID NO: 977052 - RNA, 22 nt, Human
gcagggcuguggacacuuuggu

SEQ ID NO: 977053 - RNA, 17 nt, Human
uauguaguacuuauaaa

SEQ ID NO: 977054 - RNA, 22 nt, Human
gccaggagacuccauucauuug

SEQ ID NO: 977055 - RNA, 20 nt, Human
accauaauguuaauuacaaa

SEQ ID NO: 977056 - RNA, 22 nt, Human
ugggcucugaagucagucugcu

SEQ ID NO: 977057 - RNA, 23 nt, Human
uccaggagcaugcuggcuggcga

SEQ ID NO: 977058 - RNA, 22 nt, Human
ggaggaugccaagcugugcaca

SEQ ID NO: 977059 - RNA, 22 nt, Human
uggcagcagaacaugaaaccca

SEQ ID NO: 977060 - RNA, 22 nt, Human
ucccaggaugugcgugccgccg

SEQ ID NO: 977061 - RNA, 23 nt, Human
gugagcagcccacuaggaaugcc

SEQ ID NO: 977062 - RNA, 19 nt, Human
ucuaacagaagugucgucc

SEQ ID NO: 977063 - RNA, 22 nt, Human
gcuguucacagacucugcucug

SEQ ID NO: 977064 - RNA, 22 nt, Human
ccuggcucuucagagguuccua

SEQ ID NO: 977065 - RNA, 22 nt, Human
cugggcugcaggaguggggcaa

SEQ ID NO: 977066 - RNA, 22 nt, Human
ucagaaguugagauauucaggg

SEQ ID NO: 977067 - RNA, 22 nt, Human
agcagcuccugccaugagugcu

SEQ ID NO: 977068 - RNA, 22 nt, Human
uguacaauagcuauuaucucca

SEQ ID NO: 977069 - RNA, 22 nt, Human
auugacaagugagcugggcugc

SEQ ID NO: 977070 - RNA, 22 nt, Human
gcuguucccauguggggcucag

SEQ ID NO: 977071 - RNA, 22 nt, Human
gaggcagccagagguucucauu

SEQ ID NO: 977072 - RNA, 22 nt, Human
agcugccacauggugucacugu

SEQ ID NO: 977073 - RNA, 22 nt, Human
ugcaggccggcccuaggccuca

SEQ ID NO: 977074 - RNA, 22 nt, Human
aaagcuauuuuauugcagcucu

SEQ ID NO: 977075 - RNA, 22 nt, Human
uggccuggccacauccagcagg

SEQ ID NO: 977076 - RNA, 22 nt, Human
ccaaaguccauaguuuacauua

SEQ ID NO: 977077 - RNA, 22 nt, Human
cuggcugugcugcaggcuuugg

SEQ ID NO: 977078 - RNA, 22 nt, Human
uucccaugccuggccccuaucc

SEQ ID NO: 977079 - RNA, 22 nt, Human
ggcaaggccaggccuccaagac

SEQ ID NO: 977080 - RNA, 22 nt, Human
gcagaggcacagccccagauga

SEQ ID NO: 977081 - RNA, 22 nt, Human
uaaguuaucggaguguguuuca

SEQ ID NO: 977082 - RNA, 22 nt, Human
auaaggcagucccuuaacaagg

SEQ ID NO: 977083 - RNA, 21 nt, Human
gcugcccaacccugcaucucc

SEQ ID NO: 977084 - RNA, 22 nt, Human
aggugcuggagucugggcagga

SEQ ID NO: 977085 - RNA, 22 nt, Human
guuuagaauucuaacuuuaagg

SEQ ID NO: 977086 - RNA, 20 nt, Human
agcauuugaaauaugacuau

SEQ ID NO: 977087 - RNA, 22 nt, Human
uguaauauuguagugacaguac

SEQ ID NO: 977088 - RNA, 22 nt, Human
aaauaggagcuuaagcacuucu

SEQ ID NO: 977089 - RNA, 22 nt, Human
gaggcaguuugccaugccagga

SEQ ID NO: 977090 - RNA, 22 nt, Human
caggcacuguguuaggcacugu

SEQ ID NO: 977091 - RNA, 22 nt, Human
uuuuccucugcagagcaguuag

SEQ ID NO: 977092 - RNA, 22 nt, Human
gggcaugagagggcagcuggca

SEQ ID NO: 977093 - RNA, 22 nt, Human
ccaaggagcugcaggcacuugu

SEQ ID NO: 977094 - RNA, 22 nt, Human
acucugcucccuaagccaugau

SEQ ID NO: 977095 - RNA, 22 nt, Human
ucuggcucuaacuaggcaucag

SEQ ID NO: 977096 - RNA, 22 nt, Human
auuuggcaacauuaauugaauc

SEQ ID NO: 977097 - RNA, 22 nt, Human
gagccugaugaaacaggcagac

SEQ ID NO: 977098 - RNA, 22 nt, Human
agcugccugcuuaugagcucca

SEQ ID NO: 977099 - RNA, 22 nt, Human
cacaagucuguggucuccaaca

SEQ ID NO: 977100 - RNA, 22 nt, Human
cauugcuuugugcauauuuaaa

SEQ ID NO: 977101 - RNA, 22 nt, Human
ugcaggugcguuuucaagccuc

SEQ ID NO: 977102 - RNA, 17 nt, Human
guuugcaugguguuaac

SEQ ID NO: 977103 - RNA, 22 nt, Human
gcagagcuccccaagacaccaa

SEQ ID NO: 977104 - RNA, 17 nt, Human
ggccuguguggcugcag

SEQ ID NO: 977105 - RNA, 22 nt, Human
caggguggaauggaaugcuggc

SEQ ID NO: 977106 - RNA, 22 nt, Human
agccucugacugucagcaaggu

SEQ ID NO: 977107 - RNA, 22 nt, Human
acacaguauuacaauaggugcu

SEQ ID NO: 977108 - RNA, 22 nt, Human
ccugggcauucuuugaguucuc

SEQ ID NO: 977109 - RNA, 22 nt, Human
ugcagucuggauguccucagau

SEQ ID NO: 977110 - RNA, 22 nt, Human
caucaucaaaacaaauggaguc

SEQ ID NO: 977111 - RNA, 22 nt, Human
uagcucuucaaucacugucucc

SEQ ID NO: 977112 - RNA, 22 nt, Human
gagguggguguaucacagguca

SEQ ID NO: 977113 - RNA, 23 nt, Human
gaggcagcuccugcagugcccug

SEQ ID NO: 977114 - RNA, 22 nt, Human
acagaggccucggccugcccag

SEQ ID NO: 977115 - RNA, 15 nt, Human
ugauuuccuacuaac

SEQ ID NO: 977116 - RNA, 22 nt, Human
uauaaaguuucgaaagauguau

SEQ ID NO: 977117 - RNA, 22 nt, Human
uggaaagaaaaacaggccauga

SEQ ID NO: 977118 - RNA, 22 nt, Human
auacuguagaggcauagcuagu

SEQ ID NO: 977119 - RNA, 22 nt, Human
ugcaggugguuuggacacugcu

SEQ ID NO: 977120 - RNA, 20 nt, Human
agagccuugaggaagaugau

SEQ ID NO: 977121 - RNA, 20 nt, Human
gcacugaaauucaauguuug

SEQ ID NO: 977122 - RNA, 22 nt, Human
cuuguggcccauggcuuccugc

SEQ ID NO: 977123 - RNA, 20 nt, Human
ggaccagguggggcgguggc

SEQ ID NO: 977124 - RNA, 22 nt, Human
caaugauucugcaacugugugc

SEQ ID NO: 977125 - RNA, 22 nt, Human
cagaauuuuucgaauguacugu

SEQ ID NO: 977126 - RNA, 22 nt, Human
cauuuguagcuauuuacuguau

SEQ ID NO: 977127 - RNA, 22 nt, Human
gcaagcugcucuuauguggagg

SEQ ID NO: 977128 - RNA, 22 nt, Human
ugaaaguugcacauaagagaau

SEQ ID NO: 977129 - RNA, 22 nt, Human
agacagcuaauaaaugagugug

SEQ ID NO: 977130 - RNA, 22 nt, Human
gaaagaagcuuuagauggcuau

SEQ ID NO: 977131 - RNA, 22 nt, Human
uucuaugccauguucagcuacu

SEQ ID NO: 977132 - RNA, 22 nt, Human
cauugucacccaaagcucauag

SEQ ID NO: 977133 - RNA, 22 nt, Human
gggacagaaggaagugagcaca

SEQ ID NO: 977134 - RNA, 19 nt, Human
gggcuccuugggccucucu

SEQ ID NO: 977135 - RNA, 22 nt, Human
uuauuaugguauuucuuugcag

SEQ ID NO: 977136 - RNA, 22 nt, Human
gcugugcuauaucucugagugu

SEQ ID NO: 977137 - RNA, 22 nt, Human
uugaaaggcacaggcaccuggg

SEQ ID NO: 977138 - RNA, 22 nt, Human
cagaauuugaaguaauauucca

SEQ ID NO: 977139 - RNA, 22 nt, Human
cacucugagccaaaacuaauuc

SEQ ID NO: 977140 - RNA, 22 nt, Human
ggguggcuccuaugggcauagc

SEQ ID NO: 977141 - RNA, 22 nt, Human
caggguccaucuuucaucacug

SEQ ID NO: 977142 - RNA, 22 nt, Human
uucacaggaggguggaugcaug

SEQ ID NO: 977143 - RNA, 22 nt, Human
ggagguggcagagggacauucu

SEQ ID NO: 977144 - RNA, 22 nt, Human
agcaguggagcgagauguuuaa

SEQ ID NO: 977145 - RNA, 20 nt, Human
gccuguccugagugucaugg

SEQ ID NO: 977146 - RNA, 22 nt, Human
cucaaguaagaaacagaauugg

SEQ ID NO: 977147 - RNA, 22 nt, Human
ggcucaggagaggggcuaaaag

SEQ ID NO: 977148 - RNA, 22 nt, Human
accacugcccauggugaaaacu

SEQ ID NO: 977149 - RNA, 18 nt, Human
cugaaggauccaggugua

SEQ ID NO: 977150 - RNA, 22 nt, Human
gcugccacgaucucugcuguag

SEQ ID NO: 977151 - RNA, 22 nt, Human
ugggcugcuguuacaggggcug

SEQ ID NO: 977152 - RNA, 22 nt, Human
auuaggauguuccuaugcacau

SEQ ID NO: 977153 - RNA, 22 nt, Human
cagagggcucuuggcugccugc

SEQ ID NO: 977154 - RNA, 22 nt, Human
cagcuccugggccaucuccuag

SEQ ID NO: 977155 - RNA, 22 nt, Human
ccagcagcccucuuccaagacu

SEQ ID NO: 977156 - RNA, 22 nt, Human
cagagcugugauaaauagauau

SEQ ID NO: 977157 - RNA, 22 nt, Human
ccuccugggcuccugucugcac

SEQ ID NO: 977158 - RNA, 22 nt, Human
cacuucaauuaacuucagcauu

SEQ ID NO: 977159 - RNA, 22 nt, Human
agucccagcuucccccaugcag

SEQ ID NO: 977160 - RNA, 22 nt, Human
gcaggaugggagcuucacuuug

SEQ ID NO: 977161 - RNA, 22 nt, Human
cacacaugagucuccccauugg

SEQ ID NO: 977162 - RNA, 22 nt, Human
ccagcucuuuuggcugagugag

SEQ ID NO: 977163 - RNA, 22 nt, Human
ggggauggugggaaggcaaucu

SEQ ID NO: 977164 - RNA, 22 nt, Human
agcagcuggggccugugacgau

SEQ ID NO: 977165 - RNA, 19 nt, Human
gcacugaagaguuggucac

SEQ ID NO: 977166 - RNA, 22 nt, Human
ucuccaagcagggcugcaaggc

SEQ ID NO: 977167 - RNA, 22 nt, Human
augugaaacugaagcauccaua

SEQ ID NO: 977168 - RNA, 22 nt, Human
gcacagguugcaaaaguucaca

SEQ ID NO: 977169 - RNA, 22 nt, Human
ugccuugcgguguauuucuggg

SEQ ID NO: 977170 - RNA, 22 nt, Human
agcugagcacauucaaacaggu

SEQ ID NO: 977171 - RNA, 20 nt, Human
cagaaggucuaagcuuuaga

SEQ ID NO: 977172 - RNA, 22 nt, Human
cagccccucacagagcuguccu

SEQ ID NO: 977173 - RNA, 22 nt, Human
cagcucugugcaggccugggga

SEQ ID NO: 977174 - RNA, 22 nt, Human
acccaggacuuggcaaccucau

SEQ ID NO: 977175 - RNA, 22 nt, Human
cuccuggcacugucuugaccca

SEQ ID NO: 977176 - RNA, 22 nt, Human
aguacagaccugucucuuccug

SEQ ID NO: 977177 - RNA, 22 nt, Human
uucuuaaagaggcaaaacacag

SEQ ID NO: 977178 - RNA, 22 nt, Human
ucccuggcuguguucaggugcg

SEQ ID NO: 977179 - RNA, 22 nt, Human
cccaggaguaagugacauuguu

SEQ ID NO: 977180 - RNA, 22 nt, Human
uccagggccaagucauggaacc

SEQ ID NO: 977181 - RNA, 22 nt, Human
ggcacugggcaccggcugaggg

SEQ ID NO: 977182 - RNA, 22 nt, Human
auuuuuccaugauacuuaucug

SEQ ID NO: 977183 - RNA, 22 nt, Human
ugccuguguccccuucuuggca

SEQ ID NO: 977184 - RNA, 22 nt, Human
agaugagggguagaaaggacuu

SEQ ID NO: 977185 - RNA, 22 nt, Human
cuguacauauacauuuuuuucc

SEQ ID NO: 977186 - RNA, 22 nt, Human
ucuccuggguaaaaggguugau

SEQ ID NO: 977187 - RNA, 22 nt, Human
gcuggcagucccaucagcuggg

SEQ ID NO: 977188 - RNA, 22 nt, Human
uuucacaagacagcuacuguug

SEQ ID NO: 977189 - RNA, 22 nt, Human
agaaguauaaagaauguuuaug

SEQ ID NO: 977190 - RNA, 22 nt, Human
gccuucagcggccgcucgcugc

SEQ ID NO: 977191 - RNA, 22 nt, Human
ggccugcugcuaugacuuccug

SEQ ID NO: 977192 - RNA, 22 nt, Human
ugggugcaugugagcacgugca

SEQ ID NO: 977193 - RNA, 22 nt, Human
cagcagcuggugagacacagcc

SEQ ID NO: 977194 - RNA, 22 nt, Human
gagcugagccuggguggaccgc

SEQ ID NO: 977195 - RNA, 22 nt, Human
cccuggagggauuucucaauca

SEQ ID NO: 977196 - RNA, 22 nt, Human
guccucagggaauguggcgggu

SEQ ID NO: 977197 - RNA, 22 nt, Human
aguguacacuaaaugaauacaa

SEQ ID NO: 977198 - RNA, 22 nt, Human
aggcagcccugugcuggaugcu

SEQ ID NO: 977199 - RNA, 20 nt, Human
agccagaagaaggcuggaga

SEQ ID NO: 977200 - RNA, 23 nt, Human
uccagcagccaagaaggguagaa

SEQ ID NO: 977201 - RNA, 22 nt, Human
cagacacagcaauucuguguug

SEQ ID NO: 977202 - RNA, 22 nt, Human
cugccuggaccggcagcccucc

SEQ ID NO: 977203 - RNA, 22 nt, Human
gagaaaugcaugcaugucauca

SEQ ID NO: 977204 - RNA, 22 nt, Human
uggcugaauaaaauaugguguu

SEQ ID NO: 977205 - RNA, 22 nt, Human
aguaacaagugccaacguuaga

SEQ ID NO: 977206 - RNA, 22 nt, Human
ugcagcucauugguguccuggu

SEQ ID NO: 977207 - RNA, 22 nt, Human
gcagcugcuggaaguuccugcc

SEQ ID NO: 977208 - RNA, 22 nt, Human
caacugagcaguagcgucugga

SEQ ID NO: 977209 - RNA, 22 nt, Human
aggcacugaagaacucuuuuug

SEQ ID NO: 977210 - RNA, 22 nt, Human
uacaguaaccuuauuugucauu

SEQ ID NO: 977211 - RNA, 22 nt, Human
cugcucuguucccccaucaucu

SEQ ID NO: 977212 - RNA, 22 nt, Human
ccaaagugcugagauuacaggu

SEQ ID NO: 977213 - RNA, 21 nt, Human
aacauuucaggauccaaauug

SEQ ID NO: 977214 - RNA, 22 nt, Human
ggcaggagcucuccaguuugcc

SEQ ID NO: 977215 - RNA, 22 nt, Human
gcaguggcaugaugugggcuca

SEQ ID NO: 977216 - RNA, 17 nt, Human
uagcuguguuucagcua

SEQ ID NO: 977217 - RNA, 20 nt, Human
uauuuguauuugggaaaguu

SEQ ID NO: 977218 - RNA, 22 nt, Human
gcugccagcucacucuccugag

SEQ ID NO: 977219 - RNA, 22 nt, Human
auucacaaagaagggaaguaca

SEQ ID NO: 977220 - RNA, 22 nt, Human
gggcugcugcugccagcgacac

SEQ ID NO: 977221 - RNA, 22 nt, Human
gacucugcuaggaaaaucucag

SEQ ID NO: 977222 - RNA, 22 nt, Human
guuuccaaccccaccaaagugc

SEQ ID NO: 977223 - RNA, 19 nt, Human
uccuucagucagaucuggg

SEQ ID NO: 977224 - RNA, 22 nt, Human
agugcagcaugcuggggaggcu

SEQ ID NO: 977225 - RNA, 22 nt, Human
aauuuccaaauuucugucacac

SEQ ID NO: 977226 - RNA, 22 nt, Human
ggugggcagcucuuggcaggca

SEQ ID NO: 977227 - RNA, 21 nt, Human
ggucagggggugccuccaggu

SEQ ID NO: 977228 - RNA, 22 nt, Human
ucuuuuggaaaugaugugcagg

SEQ ID NO: 977229 - RNA, 22 nt, Human
ggagccaguauuuaguggucuu

SEQ ID NO: 977230 - RNA, 22 nt, Human
gagggcugccacguugggcgag

SEQ ID NO: 977231 - RNA, 22 nt, Human
ggcagcuggggcagugcccugu

SEQ ID NO: 977232 - RNA, 22 nt, Human
ccagcucugcauguuucccuug

SEQ ID NO: 977233 - RNA, 19 nt, Human
gcuggggccugaccagaca

SEQ ID NO: 977234 - RNA, 17 nt, Human
ugaaacaccaagacugu

SEQ ID NO: 977235 - RNA, 22 nt, Human
aaaggccaauaaagacaagcug

SEQ ID NO: 977236 - RNA, 22 nt, Human
ucucugggaaugggccugggua

SEQ ID NO: 977237 - RNA, 22 nt, Human
acucugcucuguauuucacugu

SEQ ID NO: 977238 - RNA, 19 nt, Human
augauacaggugaaaauug

SEQ ID NO: 977239 - RNA, 22 nt, Human
acugcuuuaucugagaaguccu

SEQ ID NO: 977240 - RNA, 21 nt, Human
cagcaaaucauugggcagacu

SEQ ID NO: 977241 - RNA, 22 nt, Human
uuccuccacgugacaggagcca

SEQ ID NO: 977242 - RNA, 22 nt, Human
uggaggggcaauggagcgcgga

SEQ ID NO: 977243 - RNA, 22 nt, Human
uggguaaacugggucuggagag

SEQ ID NO: 977244 - RNA, 22 nt, Human
gacauguugaagaauauuugga

SEQ ID NO: 977245 - RNA, 22 nt, Human
uaaggcacuucaauguuuagaa

SEQ ID NO: 977246 - RNA, 22 nt, Human
acagggcccuugccagcacaag

SEQ ID NO: 977247 - RNA, 22 nt, Human
gcuccucugucaaaugagagug

SEQ ID NO: 977248 - RNA, 22 nt, Human
gccaggcagccacccucugcga

SEQ ID NO: 977249 - RNA, 22 nt, Human
cagcagaggugguucacauugu

SEQ ID NO: 977250 - RNA, 21 nt, Human
gcacagugccaggcacacagu

SEQ ID NO: 977251 - RNA, 22 nt, Human
accuguuuuccuaucuagauug

SEQ ID NO: 977252 - RNA, 22 nt, Human
cagacagggaccucgcuccaga

SEQ ID NO: 977253 - RNA, 20 nt, Human
ccuggagccuggaaggaguc

SEQ ID NO: 977254 - RNA, 22 nt, Human
gaaaucugcggugaggccugag

SEQ ID NO: 977255 - RNA, 22 nt, Human
gccauccucugagcacuaggca

SEQ ID NO: 977256 - RNA, 22 nt, Human
uagugcuuuaaguuuacagaga

SEQ ID NO: 977257 - RNA, 22 nt, Human
uauuuugucuucugcucaucac

SEQ ID NO: 977258 - RNA, 22 nt, Human
ucccagggucaguggugaggcc

SEQ ID NO: 977259 - RNA, 22 nt, Human
aaauguguuugauaggaauauu

SEQ ID NO: 977260 - RNA, 22 nt, Human
ucuuuacaguccucugucaauc

SEQ ID NO: 977261 - RNA, 22 nt, Human
gggcuugcugauuugggcagga

SEQ ID NO: 977262 - RNA, 22 nt, Human
gagcuggcuaauacugacuuau

SEQ ID NO: 977263 - RNA, 22 nt, Human
auacagaaaaugaugcagaguu

SEQ ID NO: 977264 - RNA, 19 nt, Human
ucacaggcaucuccccaga

SEQ ID NO: 977265 - RNA, 22 nt, Human
cagcugccccauaaaucacagu

SEQ ID NO: 977266 - RNA, 22 nt, Human
ucacuugccuagcccaguucag

SEQ ID NO: 977267 - RNA, 22 nt, Human
ucuucacaggagccugccugcc

SEQ ID NO: 977268 - RNA, 22 nt, Human
gccaggagugucccacucauuu

SEQ ID NO: 977269 - RNA, 22 nt, Human
acuuccuggcguagcugacauu

SEQ ID NO: 977270 - RNA, 22 nt, Human
uggucaacaggcagggaugaaa

SEQ ID NO: 977271 - RNA, 22 nt, Human
uuucagcugguaaaggaguagc

SEQ ID NO: 977272 - RNA, 22 nt, Human
cacaggcucuucucacuugauu

SEQ ID NO: 977273 - RNA, 22 nt, Human
uauaugcaugcccauguauaca

SEQ ID NO: 977274 - RNA, 22 nt, Human
ucccaggauuuuaggcucucag

SEQ ID NO: 977275 - RNA, 22 nt, Human
gccccagccaaggugacacgaa

SEQ ID NO: 977276 - RNA, 22 nt, Human
auguagcagauauuugugcaca

SEQ ID NO: 977277 - RNA, 21 nt, Human
uaauaauuccacuacagagua

SEQ ID NO: 977278 - RNA, 22 nt, Human
auuucagauucagaaauguagg

SEQ ID NO: 977279 - RNA, 22 nt, Human
uaaagguaguuuuaaaggugcu

SEQ ID NO: 977280 - RNA, 22 nt, Human
uuuucuuacugucugugauccu

SEQ ID NO: 977281 - RNA, 23 nt, Human
gugugccaagcacugugccagga

SEQ ID NO: 977282 - RNA, 23 nt, Human
gccucugcagccuaguuaguguc

SEQ ID NO: 977283 - RNA, 22 nt, Human
acagagcauuugggacagagag

SEQ ID NO: 977284 - RNA, 22 nt, Human
uuauuagagauauuugguuagg

SEQ ID NO: 977285 - RNA, 22 nt, Human
guggagccaggggcuguaggua

SEQ ID NO: 977286 - RNA, 22 nt, Human
accaggaggcuacacuguccca

SEQ ID NO: 977287 - RNA, 22 nt, Human
cuccagggagcuguggagguuu

SEQ ID NO: 977288 - RNA, 22 nt, Human
cuggccagaguuggagggugug

SEQ ID NO: 977289 - RNA, 22 nt, Human
cugagcugaaacuugagaggcu

SEQ ID NO: 977290 - RNA, 22 nt, Human
ugagcccuaagggucaagcagg

SEQ ID NO: 977291 - RNA, 22 nt, Human
uuugaaguguuauuucuaucac

SEQ ID NO: 977292 - RNA, 22 nt, Human
ccugggcuuucaaaaccagccu

SEQ ID NO: 977293 - RNA, 22 nt, Human
cagggguguuuuuggccaggag

SEQ ID NO: 977294 - RNA, 22 nt, Human
cauauucuuuaagcaaugcucu

SEQ ID NO: 977295 - RNA, 18 nt, Human
gugagcagagagcaucac

SEQ ID NO: 977296 - RNA, 22 nt, Human
aggcccugagcauccgagggca

SEQ ID NO: 977297 - RNA, 22 nt, Human
ucuucauuuuauagcaucugug

SEQ ID NO: 977298 - RNA, 22 nt, Human
auagaauaaggcacagauucuu

SEQ ID NO: 977299 - RNA, 21 nt, Human
cauuucuauugaugagaaaag

SEQ ID NO: 977300 - RNA, 23 nt, Human
aggucagcaggcaaggaaauggc

SEQ ID NO: 977301 - RNA, 22 nt, Human
cagggagaucuuggcuccuggu

SEQ ID NO: 977302 - RNA, 22 nt, Human
gcugucugcaucucuagagcuu

SEQ ID NO: 977303 - RNA, 22 nt, Human
uuguuacagcagugauuucaga

SEQ ID NO: 977304 - RNA, 22 nt, Human
uuccauauuuguguggcaaaag

SEQ ID NO: 977305 - RNA, 22 nt, Human
cuuuguaagucuuucuccaaga

SEQ ID NO: 977306 - RNA, 22 nt, Human
ggccagggccuggggacugucc

SEQ ID NO: 977307 - RNA, 22 nt, Human
acauguggucaaucuguguagg

SEQ ID NO: 977308 - RNA, 22 nt, Human
aggccugagccccagguuuguu

SEQ ID NO: 977309 - RNA, 22 nt, Human
uaauuauucuagucacauagca

SEQ ID NO: 977310 - RNA, 20 nt, Human
uacuuaggcuuguuuuggcc

SEQ ID NO: 977311 - RNA, 19 nt, Human
gugauuucuuuccacaagc

SEQ ID NO: 977312 - RNA, 22 nt, Human
aaaugcagguaguauuuauuuu

SEQ ID NO: 977313 - RNA, 22 nt, Human
ugaaagaacuagcaucuucaag

SEQ ID NO: 977314 - RNA, 22 nt, Human
aggcagccaucugcaggaagga

SEQ ID NO: 977315 - RNA, 22 nt, Human
agcagugggugacagagcugag

SEQ ID NO: 977316 - RNA, 22 nt, Human
uuaagaauggaaugaggaauuu

SEQ ID NO: 977317 - RNA, 22 nt, Human
caaggccacguucugcaugcgg

SEQ ID NO: 977318 - RNA, 22 nt, Human
agacauaagugcuaugacauug

SEQ ID NO: 977319 - RNA, 22 nt, Human
gauuucaaagguucugcaugcc

SEQ ID NO: 977320 - RNA, 22 nt, Human
ccuguucaaguugcagggcugg

SEQ ID NO: 977321 - RNA, 18 nt, Human
acuaugcugaauaaaugg

SEQ ID NO: 977322 - RNA, 22 nt, Human
gggcucugggaugcucuuagag

SEQ ID NO: 977323 - RNA, 22 nt, Human
guggcuucugcggugugcgcag

SEQ ID NO: 977324 - RNA, 22 nt, Human
caggguagacaguaggugucug

SEQ ID NO: 977325 - RNA, 23 nt, Human
cauguacacacagcuguacagug

SEQ ID NO: 977326 - RNA, 22 nt, Human
uuccucagcuggccugauuggg

SEQ ID NO: 977327 - RNA, 20 nt, Human
gccugcagagaaggucagag

SEQ ID NO: 977328 - RNA, 21 nt, Human
agcaccuuacagcuauaaugg

SEQ ID NO: 977329 - RNA, 22 nt, Human
caaaagcaguucuaucugaguu

SEQ ID NO: 977330 - RNA, 22 nt, Human
gccuggagggauagaaugcaag

SEQ ID NO: 977331 - RNA, 22 nt, Human
agagccugcagcugugaagaaa

SEQ ID NO: 977332 - RNA, 22 nt, Human
uaugcacauuaucuaauccauu

SEQ ID NO: 977333 - RNA, 22 nt, Human
auauguuuugugcuucauuggu

SEQ ID NO: 977334 - RNA, 22 nt, Human
cuacugaguccuucagcugcca

SEQ ID NO: 977335 - RNA, 17 nt, Human
uguuccauuugaccacc

SEQ ID NO: 977336 - RNA, 22 nt, Human
agugcuuuagagaaauggugcu

SEQ ID NO: 977337 - RNA, 22 nt, Human
auagauguucaaucagauauuu

SEQ ID NO: 977338 - RNA, 22 nt, Human
ucaugucaguuucuucuauaaa

SEQ ID NO: 977339 - RNA, 22 nt, Human
gcacagaacagagaaauagcca

SEQ ID NO: 977340 - RNA, 22 nt, Human
acauucuauuucaucaugucua

SEQ ID NO: 977341 - RNA, 20 nt, Human
aagagcugacucacaguggu

SEQ ID NO: 977342 - RNA, 22 nt, Human
ugggccacaagccaugggacca

SEQ ID NO: 977343 - RNA, 22 nt, Human
caggagccccaggcugacaaua

SEQ ID NO: 977344 - RNA, 22 nt, Human
agcuucucaggagucugaggca

SEQ ID NO: 977345 - RNA, 22 nt, Human
ccuuccaggugcaggcaagccu

SEQ ID NO: 977346 - RNA, 22 nt, Human
cagccuccugggacacucaccg

SEQ ID NO: 977347 - RNA, 22 nt, Human
aggcucugggaagcagugaguu

SEQ ID NO: 977348 - RNA, 22 nt, Human
agggaagaagcugguaguaggu

SEQ ID NO: 977349 - RNA, 22 nt, Human
ucccucagaaauucucucugaa

SEQ ID NO: 977350 - RNA, 22 nt, Human
uggcuggacagugggcagugga

SEQ ID NO: 977351 - RNA, 22 nt, Human
ucuggccaggauggcaagacca

SEQ ID NO: 977352 - RNA, 22 nt, Human
ucccacacagcccgcucaccgg

SEQ ID NO: 977353 - RNA, 22 nt, Human
ccuuuuauacucagugauauca

SEQ ID NO: 977354 - RNA, 21 nt, Human
acucugcugcgggcuuggccu

SEQ ID NO: 977355 - RNA, 22 nt, Human
ugcacauuaguguuugagaugc

SEQ ID NO: 977356 - RNA, 22 nt, Human
gugucccaaucuacuuuucccu

SEQ ID NO: 977357 - RNA, 22 nt, Human
acagccugagaguggagcuggc

SEQ ID NO: 977358 - RNA, 22 nt, Human
cacagagagcuacgugcagcgu

SEQ ID NO: 977359 - RNA, 22 nt, Human
uugcugaaaucuaugacauccu

SEQ ID NO: 977360 - RNA, 22 nt, Human
ugaggcaggagaaucacaugaa

SEQ ID NO: 977361 - RNA, 22 nt, Human
gucuggaguggggccugagaau

SEQ ID NO: 977362 - RNA, 22 nt, Human
gggccuggggacaccaccauga

SEQ ID NO: 977363 - RNA, 21 nt, Human
agucuguuaggaugacucuga

SEQ ID NO: 977364 - RNA, 22 nt, Human
ccucccacauugaggacaugcu

SEQ ID NO: 977365 - RNA, 22 nt, Human
ggguggaggagaacaggcccca

SEQ ID NO: 977366 - RNA, 22 nt, Human
ggccauggugguuugagcaccu

SEQ ID NO: 977367 - RNA, 20 nt, Human
auguagaugaaagcaaaggc

SEQ ID NO: 977368 - RNA, 22 nt, Human
auguggcauucuuggucauuuc

SEQ ID NO: 977369 - RNA, 22 nt, Human
gggcaguggguggcugcagccu

SEQ ID NO: 977370 - RNA, 22 nt, Human
caagagcucccagaccugggca

SEQ ID NO: 977371 - RNA, 22 nt, Human
cagcugugcuguauuaagcucu

SEQ ID NO: 977372 - RNA, 22 nt, Human
cucaggcccacagcagacccac

SEQ ID NO: 977373 - RNA, 22 nt, Human
agaggagguggugaugcuuuaa

SEQ ID NO: 977374 - RNA, 22 nt, Human
cucuggagcaccgggcuaucca

SEQ ID NO: 977375 - RNA, 22 nt, Human
ccagguggaaggucugugcucu

SEQ ID NO: 977376 - RNA, 22 nt, Human
ggggcagagaauaaaaaccuaa

SEQ ID NO: 977377 - RNA, 22 nt, Human
cuguguggccucaagccagccu

SEQ ID NO: 977378 - RNA, 22 nt, Human
cucugcauuuuaacagaugauu

SEQ ID NO: 977379 - RNA, 22 nt, Human
ccaggagucuggaugagguguc

SEQ ID NO: 977380 - RNA, 22 nt, Human
uagucucuggagacucuagggg

SEQ ID NO: 977381 - RNA, 22 nt, Human
ucuuugaauccuuuacaucuga

SEQ ID NO: 977382 - RNA, 22 nt, Human
ccuuccagaguucagucugccc

SEQ ID NO: 977383 - RNA, 22 nt, Human
ugcccaggguggagugcagcgg

SEQ ID NO: 977384 - RNA, 22 nt, Human
cugggccugggaggccaggucu

SEQ ID NO: 977385 - RNA, 22 nt, Human
uggaaggcaacggagugagcug

SEQ ID NO: 977386 - RNA, 22 nt, Human
acaggcagcgucauugcugcuc

SEQ ID NO: 977387 - RNA, 22 nt, Human
ucagagugugagacauauugga

SEQ ID NO: 977388 - RNA, 22 nt, Human
ugaggggagaagcagcagccug

SEQ ID NO: 977389 - RNA, 17 nt, Human
uggcuucccugggccac

SEQ ID NO: 977390 - RNA, 22 nt, Human
ugcagaagaauguaggcauaag

SEQ ID NO: 977391 - RNA, 23 nt, Human
auguauuuaaauuucagugauga

SEQ ID NO: 977392 - RNA, 22 nt, Human
uugcauugaucccagcuugggc

SEQ ID NO: 977393 - RNA, 22 nt, Human
agccaaggacacggagccuccu

SEQ ID NO: 977394 - RNA, 20 nt, Human
uggcccaguggggcagggug

SEQ ID NO: 977395 - RNA, 22 nt, Human
cugugucuugaguaauucggug

SEQ ID NO: 977396 - RNA, 22 nt, Human
aacaugucuggguauucacaag

SEQ ID NO: 977397 - RNA, 22 nt, Human
cugcgcagggguggcgccagaa

SEQ ID NO: 977398 - RNA, 22 nt, Human
gcucagggaacuuuuugcaggc

SEQ ID NO: 977399 - RNA, 22 nt, Human
uauauucaaugauuaguaucag

SEQ ID NO: 977400 - RNA, 22 nt, Human
ucugcugcugagcacacuccua

SEQ ID NO: 977401 - RNA, 20 nt, Human
ccagguggugccuggagagg

SEQ ID NO: 977402 - RNA, 22 nt, Human
acaggacuguggaaggaucucu

SEQ ID NO: 977403 - RNA, 22 nt, Human
agcuuguagaaggccacgagca

SEQ ID NO: 977404 - RNA, 22 nt, Human
ccuucugcucccuggccagggc

SEQ ID NO: 977405 - RNA, 22 nt, Human
augugucugauggcccugaauu

SEQ ID NO: 977406 - RNA, 22 nt, Human
aggauuucugugccuggaaaau

SEQ ID NO: 977407 - RNA, 22 nt, Human
acuccagggcuccaucccuugu

SEQ ID NO: 977408 - RNA, 22 nt, Human
uggcucugggcaccguguccac

SEQ ID NO: 977409 - RNA, 22 nt, Human
ugagcuuacuucuguacacaga

SEQ ID NO: 977410 - RNA, 22 nt, Human
ucacaggaaccaucagagaaau

SEQ ID NO: 977411 - RNA, 22 nt, Human
cagacccucgggugaguuggcc

SEQ ID NO: 977412 - RNA, 22 nt, Human
cuguguccugcgucaagccaau

SEQ ID NO: 977413 - RNA, 20 nt, Human
gcauccagacacccagcugc

SEQ ID NO: 977414 - RNA, 22 nt, Human
ugcagccaucgcagagucugua

SEQ ID NO: 977415 - RNA, 22 nt, Human
ucauugaauauggggccauaca

SEQ ID NO: 977416 - RNA, 23 nt, Human
ucagucuucccugucaguaauag

SEQ ID NO: 977417 - RNA, 22 nt, Human
gugcagcagggggaagacagug

SEQ ID NO: 977418 - RNA, 18 nt, Human
ucauuagggauugcaaag

SEQ ID NO: 977419 - RNA, 22 nt, Human
uucauugugaacacauucugcc

SEQ ID NO: 977420 - RNA, 22 nt, Human
gcaggcaguuugcuuuucccuc

SEQ ID NO: 977421 - RNA, 22 nt, Human
uacauuccacuagugacuggcg

SEQ ID NO: 977422 - RNA, 22 nt, Human
auguguacaaccaagcacuaaa

SEQ ID NO: 977423 - RNA, 22 nt, Human
agggcaguucaacuucauagug

SEQ ID NO: 977424 - RNA, 22 nt, Human
aucugacaaccuauugacuuga

SEQ ID NO: 977425 - RNA, 22 nt, Human
gagaaggggugauguggguaau

SEQ ID NO: 977426 - RNA, 22 nt, Human
aacauuuaugauugagguaaau

SEQ ID NO: 977427 - RNA, 22 nt, Human
caggguggcacaucacagcauu

SEQ ID NO: 977428 - RNA, 22 nt, Human
ccacccuggacaggccucugag

SEQ ID NO: 977429 - RNA, 22 nt, Human
acaauucugaugguuucccagu

SEQ ID NO: 977430 - RNA, 22 nt, Human
acagauauaugauuguguaaau

SEQ ID NO: 977431 - RNA, 22 nt, Human
gccccuggcuggccagcuccuc

SEQ ID NO: 977432 - RNA, 22 nt, Human
uggccugguuguugcugccguu

SEQ ID NO: 977433 - RNA, 22 nt, Human
ggcuggagacaacguccugccc

SEQ ID NO: 977434 - RNA, 22 nt, Human
aguggacucuucccagugcuug

SEQ ID NO: 977435 - RNA, 22 nt, Human
ucccagaggcaguugguaacuu

SEQ ID NO: 977436 - RNA, 22 nt, Human
cugcugugccucuuuucacgug

SEQ ID NO: 977437 - RNA, 22 nt, Human
cagggcuccccgcaccgcagcc

SEQ ID NO: 977438 - RNA, 22 nt, Human
uggcacuggaaucguagccuug

SEQ ID NO: 977439 - RNA, 22 nt, Human
ucacaucuuauuagaguaucuc

SEQ ID NO: 977440 - RNA, 22 nt, Human
gggcagcuggauaguuuuaaau

SEQ ID NO: 977441 - RNA, 22 nt, Human
aggccucacucucagagcuucu

SEQ ID NO: 977442 - RNA, 22 nt, Human
ugugucaagacauuuagucauu

SEQ ID NO: 977443 - RNA, 22 nt, Human
cuuacauugucuuaguuuucaa

SEQ ID NO: 977444 - RNA, 22 nt, Human
guuuucaaggggauuuaacuga

SEQ ID NO: 977445 - RNA, 22 nt, Human
gugcugucguggaacugggcug

SEQ ID NO: 977446 - RNA, 22 nt, Human
acugucuuccaggucuggaggu

SEQ ID NO: 977447 - RNA, 22 nt, Human
uucuucuugucugcccucacau

SEQ ID NO: 977448 - RNA, 22 nt, Human
ugggcccugacuucaagcaucc

SEQ ID NO: 977449 - RNA, 22 nt, Human
ucacuaaguuacauuuaguauu

SEQ ID NO: 977450 - RNA, 22 nt, Human
cuguaaaacugcuuaaguaugc

SEQ ID NO: 977451 - RNA, 22 nt, Human
agcauugccugccuauugcuaa

SEQ ID NO: 977452 - RNA, 22 nt, Human
aaugauguuuuuaaagaacaua

SEQ ID NO: 977453 - RNA, 22 nt, Human
aagaggucauaccagauaaggg

SEQ ID NO: 977454 - RNA, 22 nt, Human
caggggacaguaugguggauga

SEQ ID NO: 977455 - RNA, 22 nt, Human
agccagcuggugggucagcugg

SEQ ID NO: 977456 - RNA, 22 nt, Human
uggagccagcccaggccccucu

SEQ ID NO: 977457 - RNA, 22 nt, Human
uccagugguaguaaagaggucu

SEQ ID NO: 977458 - RNA, 22 nt, Human
cugcuguguggugaaacucagu

SEQ ID NO: 977459 - RNA, 22 nt, Human
ugggcagauguccucugaagug

SEQ ID NO: 977460 - RNA, 22 nt, Human
aaaggccacacagagcagggag

SEQ ID NO: 977461 - RNA, 22 nt, Human
aucuuucuccauauacaucuuu

SEQ ID NO: 977462 - RNA, 22 nt, Human
gcugcucuugaggggcucacug

SEQ ID NO: 977463 - RNA, 22 nt, Human
auucuuauuauaguaaaacagu

SEQ ID NO: 977464 - RNA, 22 nt, Human
uagaaaguaaaucaguuuuauu

SEQ ID NO: 977465 - RNA, 22 nt, Human
agggagaacaguugcagcagac

SEQ ID NO: 977466 - RNA, 22 nt, Human
cauugcacuucugcuuuuccuc

SEQ ID NO: 977467 - RNA, 22 nt, Human
gguucacacuaagcuuaagugg

SEQ ID NO: 977468 - RNA, 22 nt, Human
cuggcccaggaagacguguccc

SEQ ID NO: 977469 - RNA, 22 nt, Human
cgggcagauugggaagguucau

SEQ ID NO: 977470 - RNA, 22 nt, Human
uucuggagagaaaccuuacaaa

SEQ ID NO: 977471 - RNA, 22 nt, Human
uccuggagcuuccuucauggua

SEQ ID NO: 977472 - RNA, 19 nt, Human
uuugcagugguuccuuugu

SEQ ID NO: 977473 - RNA, 20 nt, Human
cagcuuggaugagaggcuga

SEQ ID NO: 977474 - RNA, 22 nt, Human
accugagccuagggagguugag

SEQ ID NO: 977475 - RNA, 22 nt, Human
ucauggauggccgggaggugau

SEQ ID NO: 977476 - RNA, 22 nt, Human
cugaagaugucugagaugcuca

SEQ ID NO: 977477 - RNA, 22 nt, Human
cccaggaaaagcagugccagca

SEQ ID NO: 977478 - RNA, 22 nt, Human
gagauggggucagcugggacau

SEQ ID NO: 977479 - RNA, 22 nt, Human
aauguguagcauuuaaugcagu

SEQ ID NO: 977480 - RNA, 21 nt, Human
caugaagccgguucccuguuu

SEQ ID NO: 977481 - RNA, 22 nt, Human
acaguuaucuuugaaauagaga

SEQ ID NO: 977482 - RNA, 22 nt, Human
acauuaucccuggcacaacugc

SEQ ID NO: 977483 - RNA, 22 nt, Human
auacaacagaaaaugauuauuc

SEQ ID NO: 977484 - RNA, 22 nt, Human
acccugagggguauagcagaag

SEQ ID NO: 977485 - RNA, 22 nt, Human
acuccagggcugaacgaggccc

SEQ ID NO: 977486 - RNA, 22 nt, Human
uaauacuuaccuugcagagucu

SEQ ID NO: 977487 - RNA, 22 nt, Human
cauuuacauuuaagguuaauau

SEQ ID NO: 977488 - RNA, 22 nt, Human
cgagaguggacagggcgcagcu

SEQ ID NO: 977489 - RNA, 22 nt, Human
acuccagguuuuuucacugaag

SEQ ID NO: 977490 - RNA, 22 nt, Human
cuguggcugcagccuugguccu

SEQ ID NO: 977491 - RNA, 22 nt, Human
ucuuuuaaaagcccugcugucu

SEQ ID NO: 977492 - RNA, 22 nt, Human
cuggccucaccucagacuuacu

SEQ ID NO: 977493 - RNA, 22 nt, Human
uggauaaacucacuguaaguug

SEQ ID NO: 977494 - RNA, 22 nt, Human
cacugcuuauaaauucuaggca

SEQ ID NO: 977495 - RNA, 22 nt, Human
cagcagaggcacgucugugaau

SEQ ID NO: 977496 - RNA, 22 nt, Human
gccuugccucagccauggaaac

SEQ ID NO: 977497 - RNA, 22 nt, Human
cuggcucccucgcugaggugcu

SEQ ID NO: 977498 - RNA, 22 nt, Human
ucugucugcaccuaagcacagu

SEQ ID NO: 977499 - RNA, 22 nt, Human
gaggccaggggccuggagauga

SEQ ID NO: 977500 - RNA, 23 nt, Human
uggcuggcagaaacugaagcaug

SEQ ID NO: 977501 - RNA, 22 nt, Human
ucaggaggccaccaggaccugu

SEQ ID NO: 977502 - RNA, 22 nt, Human
cuggccuuuuguuucuggagaa

SEQ ID NO: 977503 - RNA, 22 nt, Human
aagauuauggcagauaacaauu

SEQ ID NO: 977504 - RNA, 22 nt, Human
agaaaagguugaaaguaggauu

SEQ ID NO: 977505 - RNA, 22 nt, Human
ucucagagauguuagggaagag

SEQ ID NO: 977506 - RNA, 22 nt, Human
ggcuggcacagagggcuggugu

SEQ ID NO: 977507 - RNA, 21 nt, Human
gacucugcaccaaauuaagcc

SEQ ID NO: 977508 - RNA, 22 nt, Human
uggaaauguauuugggcaugcc

SEQ ID NO: 977509 - RNA, 22 nt, Human
uggcagccacaucucguggauu

SEQ ID NO: 977510 - RNA, 22 nt, Human
cuggggcauugggagaggccug

SEQ ID NO: 977511 - RNA, 22 nt, Human
ucuuugaauuucugacugucuu

SEQ ID NO: 977512 - RNA, 22 nt, Human
uguaaucauuacaguacaugga

SEQ ID NO: 977513 - RNA, 22 nt, Human
gcugucuuccuugcuccaaggg

SEQ ID NO: 977514 - RNA, 22 nt, Human
cagaggcugggaccucaggcau

SEQ ID NO: 977515 - RNA, 22 nt, Human
ccccagccuuccaugggaauug

SEQ ID NO: 977516 - RNA, 22 nt, Human
aggaggggcauagaaauguaau

SEQ ID NO: 977517 - RNA, 22 nt, Human
cugggagagaagcgaagcuggg

SEQ ID NO: 977518 - RNA, 22 nt, Human
auuuccuagccucucuugcagu

SEQ ID NO: 977519 - RNA, 22 nt, Human
guucaaagcuccugguacagua

SEQ ID NO: 977520 - RNA, 22 nt, Human
cucagaguggggcucccugagg

SEQ ID NO: 977521 - RNA, 22 nt, Human
uucaugugauaaaugugugacu

SEQ ID NO: 977522 - RNA, 22 nt, Human
cagcuugcuaauuuugacuuca

SEQ ID NO: 977523 - RNA, 22 nt, Human
aagucaaaccuugcucacagga

SEQ ID NO: 977524 - RNA, 22 nt, Human
agggcaaguugagugugcgugg

SEQ ID NO: 977525 - RNA, 23 nt, Human
uugcauguagcccaugaguaacu

SEQ ID NO: 977526 - RNA, 22 nt, Human
gcagccagccccucugaccucu

SEQ ID NO: 977527 - RNA, 22 nt, Human
ccuggcagucaggggaguccuu

SEQ ID NO: 977528 - RNA, 22 nt, Human
aggcacugaccugcuuccuuga

SEQ ID NO: 977529 - RNA, 22 nt, Human
uuuaacagaugcuaugucuacc

SEQ ID NO: 977530 - RNA, 20 nt, Human
ugugggcccuuggcuggcaa

SEQ ID NO: 977531 - RNA, 22 nt, Human
aggaagcucggagagggcaaau

SEQ ID NO: 977532 - RNA, 22 nt, Human
augaaacaugagaaauggagag

SEQ ID NO: 977533 - RNA, 19 nt, Human
uccaccuuucuucauuugg

SEQ ID NO: 977534 - RNA, 22 nt, Human
cuggcucaccuccgcuccagca

SEQ ID NO: 977535 - RNA, 22 nt, Human
acccaggacacagagaugaccc

SEQ ID NO: 977536 - RNA, 22 nt, Human
ucaguggagcuaagcaugagau

SEQ ID NO: 977537 - RNA, 22 nt, Human
ccaaaguccuuucuccaccugc

SEQ ID NO: 977538 - RNA, 20 nt, Human
ucugccacugcacucugccc

SEQ ID NO: 977539 - RNA, 22 nt, Human
ucucccacuggccuuguaugau

SEQ ID NO: 977540 - RNA, 22 nt, Human
gugacucacacaggccugggcu

SEQ ID NO: 977541 - RNA, 22 nt, Human
aggccugucuggggcucagcca

SEQ ID NO: 977542 - RNA, 22 nt, Human
gcccaggccggagagcagugcu

SEQ ID NO: 977543 - RNA, 22 nt, Human
guucuucaggccauccucccag

SEQ ID NO: 977544 - RNA, 22 nt, Human
cuggcgcaacagaaaaucugga

SEQ ID NO: 977545 - RNA, 17 nt, Human
ccagagcuacugagacu

SEQ ID NO: 977546 - RNA, 22 nt, Human
agagcuuauaucuuggccaucc

SEQ ID NO: 977547 - RNA, 22 nt, Human
aaacugcugguugcuggccagc

SEQ ID NO: 977548 - RNA, 22 nt, Human
uauuuuaucugccagaguggag

SEQ ID NO: 977549 - RNA, 17 nt, Human
auccccagcaucuagaa

SEQ ID NO: 977550 - RNA, 22 nt, Human
guuccaggcaagugggauagga

SEQ ID NO: 977551 - RNA, 22 nt, Human
ugcauauuauguguaucugucu

SEQ ID NO: 977552 - RNA, 22 nt, Human
cuggcucagugccuucagaagu

SEQ ID NO: 977553 - RNA, 22 nt, Human
ucugaggccccugggcaggaug

SEQ ID NO: 977554 - RNA, 22 nt, Human
acaguggagaaggcaugaggcu

SEQ ID NO: 977555 - RNA, 22 nt, Human
ucaguuuugauuccugguucuc

SEQ ID NO: 977556 - RNA, 22 nt, Human
uuccuggugguggugacagcac

SEQ ID NO: 977557 - RNA, 22 nt, Human
agcccaggugagggguucgaaa

SEQ ID NO: 977558 - RNA, 22 nt, Human
uuuauguaauuucauaggugug

SEQ ID NO: 977559 - RNA, 22 nt, Human
ucugcucagugcuuaucucuaa

SEQ ID NO: 977560 - RNA, 22 nt, Human
gaggccuggaccagccacagag

SEQ ID NO: 977561 - RNA, 22 nt, Human
augcagaaugaguucacgaucu

SEQ ID NO: 977562 - RNA, 22 nt, Human
gcuggcuccucuguccucacgg

SEQ ID NO: 977563 - RNA, 22 nt, Human
cauugcuuccuaugucccuucu

SEQ ID NO: 977564 - RNA, 22 nt, Human
cauacuuuugcccugacauucu

SEQ ID NO: 977565 - RNA, 22 nt, Human
gccagcagcccagaaggacuuu

SEQ ID NO: 977566 - RNA, 22 nt, Human
acagucuugcuguauggucagg

SEQ ID NO: 977567 - RNA, 22 nt, Human
uccagccacucagcagggauug

SEQ ID NO: 977568 - RNA, 22 nt, Human
uagacagauuucuuguuagaca

SEQ ID NO: 977569 - RNA, 22 nt, Human
gagucccaugaugauagccaca

SEQ ID NO: 977570 - RNA, 22 nt, Human
cugagccagcuggcaugugcua

SEQ ID NO: 977571 - RNA, 22 nt, Human
gcucaggaaacagcagggcuug

SEQ ID NO: 977572 - RNA, 22 nt, Human
uuugcauuuguucaaguauuga

SEQ ID NO: 977573 - RNA, 22 nt, Human
cagggccugagggcugcucugc

SEQ ID NO: 977574 - RNA, 22 nt, Human
ucacauuuguuccucugcacuu

SEQ ID NO: 977575 - RNA, 22 nt, Human
cagcugcccaagccccagaugu

SEQ ID NO: 977576 - RNA, 21 nt, Human
acagcauguuuguguguuugc

SEQ ID NO: 977577 - RNA, 22 nt, Human
gacagugcauuuccuggcaugg

SEQ ID NO: 977578 - RNA, 22 nt, Human
caggcuggagugaguguagugg

SEQ ID NO: 977579 - RNA, 22 nt, Human
cuggagcuaggaaguccaagau

SEQ ID NO: 977580 - RNA, 22 nt, Human
gaagagcuguagccugcucuuu

SEQ ID NO: 977581 - RNA, 22 nt, Human
ggcuggcagaggggagucugug

SEQ ID NO: 977582 - RNA, 22 nt, Human
augcugugucaggaauuugaua

SEQ ID NO: 977583 - RNA, 22 nt, Human
ucagcaauaugauaggcuuugu

SEQ ID NO: 977584 - RNA, 22 nt, Human
aagagcuggcccaaucugagca

SEQ ID NO: 977585 - RNA, 20 nt, Human
gcugaccccugcugucaugc

SEQ ID NO: 977586 - RNA, 22 nt, Human
uccaagaagucaucuaaacugu

SEQ ID NO: 977587 - RNA, 22 nt, Human
gcucucugguuccagucaggaa

SEQ ID NO: 977588 - RNA, 22 nt, Human
agaggcuccaccuucucugucc

SEQ ID NO: 977589 - RNA, 22 nt, Human
aauuccugucuuaacaguucug

SEQ ID NO: 977590 - RNA, 22 nt, Human
uggagcugagagccaggcuggc

SEQ ID NO: 977591 - RNA, 22 nt, Human
agcaguggcugaagauguuccu

SEQ ID NO: 977592 - RNA, 22 nt, Human
ccagggcaauuauuuggagggu

SEQ ID NO: 977593 - RNA, 22 nt, Human
cugggagauugaggccauggug

SEQ ID NO: 977594 - RNA, 22 nt, Human
aagauguaucuuuccuuuaauu

SEQ ID NO: 977595 - RNA, 22 nt, Human
ggcaggugcucugugggccugg

SEQ ID NO: 977596 - RNA, 22 nt, Human
cuggucaaggagagucucugca

SEQ ID NO: 977597 - RNA, 23 nt, Human
ggcagcucucaucugaugacuga

SEQ ID NO: 977598 - RNA, 22 nt, Human
gucugagaaucuugcauaucau

SEQ ID NO: 977599 - RNA, 22 nt, Human
ggaggugggcuaaggacucucu

SEQ ID NO: 977600 - RNA, 22 nt, Human
aagggcaggcacccacccucac

SEQ ID NO: 977601 - RNA, 22 nt, Human
aggaagcuccuggagagccagu

SEQ ID NO: 977602 - RNA, 22 nt, Human
gccuggguuccaugaucuccag

SEQ ID NO: 977603 - RNA, 22 nt, Human
cauguugaauggccuugauuuu

SEQ ID NO: 977604 - RNA, 22 nt, Human
aagcagcuuuugaagagugagg

SEQ ID NO: 977605 - RNA, 22 nt, Human
aagaugcagcaaacuacuuuuu

SEQ ID NO: 977606 - RNA, 22 nt, Human
ggguggaguagaaagaugaauu

SEQ ID NO: 977607 - RNA, 22 nt, Human
aauucacaauguguagucaugc

SEQ ID NO: 977608 - RNA, 22 nt, Human
uggcagcugagugcacccccuc

SEQ ID NO: 977609 - RNA, 22 nt, Human
uaggagagcugaacuauugucu

SEQ ID NO: 977610 - RNA, 22 nt, Human
aagccagggauuccugagggag

SEQ ID NO: 977611 - RNA, 23 nt, Human
uugaaagguagcuggcagcuaga

SEQ ID NO: 977612 - RNA, 22 nt, Human
ucucuccuuaucauuguguuua

SEQ ID NO: 977613 - RNA, 22 nt, Human
cagcucuguaaauuccuucauc

SEQ ID NO: 977614 - RNA, 22 nt, Human
uccuugaagagugggcggucga

SEQ ID NO: 977615 - RNA, 22 nt, Human
uccugcugagcgucugucauuu

SEQ ID NO: 977616 - RNA, 21 nt, Human
gccacguuucagucuucucag

SEQ ID NO: 977617 - RNA, 22 nt, Human
ucauugcaagcucauuuaucug

SEQ ID NO: 977618 - RNA, 22 nt, Human
ugacuuccugcacucaggugau

SEQ ID NO: 977619 - RNA, 21 nt, Human
gcccagcaaggugagaaggcc

SEQ ID NO: 977620 - RNA, 22 nt, Human
uugauuuuaaaauagugacacu

SEQ ID NO: 977621 - RNA, 22 nt, Human
agcugccaucugaagaacugca

SEQ ID NO: 977622 - RNA, 22 nt, Human
uggcagcuggcucugcgcaggc

SEQ ID NO: 977623 - RNA, 20 nt, Human
ugcuugucaugcacucaggc

SEQ ID NO: 977624 - RNA, 22 nt, Human
uugauaaaaugauaucuucuuu

SEQ ID NO: 977625 - RNA, 22 nt, Human
gcagcagaggcccuacucuuug

SEQ ID NO: 977626 - RNA, 21 nt, Human
ucagaacaauuccaugccucc

SEQ ID NO: 977627 - RNA, 22 nt, Human
uuugaaagggacaaagucacug

SEQ ID NO: 977628 - RNA, 22 nt, Human
ccagagccccugagcuucccug

SEQ ID NO: 977629 - RNA, 22 nt, Human
gacagacauuuccugauccaau

SEQ ID NO: 977630 - RNA, 23 nt, Human
ucagugauguugaaccuagcagu

SEQ ID NO: 977631 - RNA, 22 nt, Human
ggaggccaggguggguggaucg

SEQ ID NO: 977632 - RNA, 22 nt, Human
aggagaguucacacuggucaga

SEQ ID NO: 977633 - RNA, 22 nt, Human
agcuucuggaagccuggcagca

SEQ ID NO: 977634 - RNA, 22 nt, Human
uaguccaguaaaacagcuaacg

SEQ ID NO: 977635 - RNA, 22 nt, Human
gggcagaggggcgcuucccucu

SEQ ID NO: 977636 - RNA, 22 nt, Human
uauaucuuauaugugcagguac

SEQ ID NO: 977637 - RNA, 22 nt, Human
gauguagagggaagauuuuaaa

SEQ ID NO: 977638 - RNA, 21 nt, Human
cugaggcagcacagcuaguca

SEQ ID NO: 977639 - RNA, 22 nt, Human
ucaaugaaagagcaugcauuuu

SEQ ID NO: 977640 - RNA, 22 nt, Human
auuauguagguuaggugguugu

SEQ ID NO: 977641 - RNA, 22 nt, Human
uuuaggauaacuccaguuuucc

SEQ ID NO: 977642 - RNA, 22 nt, Human
aggucacacuuggaucauagaa

SEQ ID NO: 977643 - RNA, 22 nt, Human
ugucuccucauacugucauauu

SEQ ID NO: 977644 - RNA, 22 nt, Human
cagguggggcgcccucaggcag

SEQ ID NO: 977645 - RNA, 22 nt, Human
gcugccuggagcucagccugcc

SEQ ID NO: 977646 - RNA, 22 nt, Human
gcagcagcccagggcucucaga

SEQ ID NO: 977647 - RNA, 22 nt, Human
ugaagccacagagcaucugccu

SEQ ID NO: 977648 - RNA, 18 nt, Human
ccugcagcccaggaggcc

SEQ ID NO: 977649 - RNA, 22 nt, Human
gcagagugauggaaugugggug

SEQ ID NO: 977650 - RNA, 22 nt, Human
ucaucaaagucaaagaaugacu

SEQ ID NO: 977651 - RNA, 22 nt, Human
uuuuauuaguggcuagaugggg

SEQ ID NO: 977652 - RNA, 22 nt, Human
augguuuguaacccaauacucc

SEQ ID NO: 977653 - RNA, 22 nt, Human
ucugaggcuucagacuguacug

SEQ ID NO: 977654 - RNA, 22 nt, Human
gagcugggacauggguccucuc

SEQ ID NO: 977655 - RNA, 22 nt, Human
gcuccuggcuucacugacauca

SEQ ID NO: 977656 - RNA, 22 nt, Human
gcuccuggccagcacagggccc

SEQ ID NO: 977657 - RNA, 22 nt, Human
auuucugugcaguaaaugguga

SEQ ID NO: 977658 - RNA, 22 nt, Human
aucaauucuuaggaaaauagcu

SEQ ID NO: 977659 - RNA, 22 nt, Human
aaagccaugggucuuuggcaua

SEQ ID NO: 977660 - RNA, 22 nt, Human
cugccucuugacagaucguggc

SEQ ID NO: 977661 - RNA, 18 nt, Human
uuccauaauguauguaac

SEQ ID NO: 977662 - RNA, 22 nt, Human
aaacaaguguaaacuagucugu

SEQ ID NO: 977663 - RNA, 22 nt, Human
augucagauguuuaucugauuu

SEQ ID NO: 977664 - RNA, 22 nt, Human
ggucucagacuggcaggcagug

SEQ ID NO: 977665 - RNA, 22 nt, Human
cuuuuacugugaaaagaaacug

SEQ ID NO: 977666 - RNA, 22 nt, Human
caguuucuauggcugggcucug

SEQ ID NO: 977667 - RNA, 22 nt, Human
gagccaggcaccuucuguguug

SEQ ID NO: 977668 - RNA, 22 nt, Human
uucucagaugauucagauaaac

SEQ ID NO: 977669 - RNA, 22 nt, Human
aggugccagaugcacagcugaa

SEQ ID NO: 977670 - RNA, 21 nt, Human
uggcagacaggaggagcucac

SEQ ID NO: 977671 - RNA, 22 nt, Human
cuacagacccaccuuggaagaa

SEQ ID NO: 977672 - RNA, 21 nt, Human
uggcaggcagcuggaagcuug

SEQ ID NO: 977673 - RNA, 22 nt, Human
acaaagugaauugcaucgaguu

SEQ ID NO: 977674 - RNA, 22 nt, Human
uuccaagagcuuuaauuguuga

SEQ ID NO: 977675 - RNA, 22 nt, Human
ccccaggacacauggaccaagu

SEQ ID NO: 977676 - RNA, 22 nt, Human
cugagagcagggacuugagcca

SEQ ID NO: 977677 - RNA, 22 nt, Human
aggcagugcagaguccucuucu

SEQ ID NO: 977678 - RNA, 22 nt, Human
aaggcagcaccgccuccugaaa

SEQ ID NO: 977679 - RNA, 22 nt, Human
ucauguuuggaguuugcucacu

SEQ ID NO: 977680 - RNA, 20 nt, Human
cuuggccuacuuagcuuugu

SEQ ID NO: 977681 - RNA, 22 nt, Human
gggaagauaguguugagggccc

SEQ ID NO: 977682 - RNA, 22 nt, Human
cuggguggaaagugcugagaau

SEQ ID NO: 977683 - RNA, 22 nt, Human
ucuuuccuguaacugcuguuca

SEQ ID NO: 977684 - RNA, 22 nt, Human
gcagguggcagaggugggaucu

SEQ ID NO: 977685 - RNA, 22 nt, Human
ggcagccaugucccagggcuuc

SEQ ID NO: 977686 - RNA, 22 nt, Human
agacauuuauugaacaccuagc

SEQ ID NO: 977687 - RNA, 22 nt, Human
ccagcagcgauagggugagugc

SEQ ID NO: 977688 - RNA, 22 nt, Human
aggcagcugugaggacuggauu

SEQ ID NO: 977689 - RNA, 22 nt, Human
uauuagguaugaacuggcaacc

SEQ ID NO: 977690 - RNA, 22 nt, Human
acugcagcaaagcccgugucuu

SEQ ID NO: 977691 - RNA, 22 nt, Human
ucugucacccagagugcagugg

SEQ ID NO: 977692 - RNA, 22 nt, Human
acccuggguucccgcagcacca

SEQ ID NO: 977693 - RNA, 22 nt, Human
cacucaggcugugucaggagga

SEQ ID NO: 977694 - RNA, 22 nt, Human
cauggacucugguuuggggagc

SEQ ID NO: 977695 - RNA, 22 nt, Human
cuccucacacccacugcaacca

SEQ ID NO: 977696 - RNA, 22 nt, Human
aaaaucugguaauuugaaugug

SEQ ID NO: 977697 - RNA, 22 nt, Human
cugcuuccaugcaauggcaguc

SEQ ID NO: 977698 - RNA, 22 nt, Human
agagccaggacugugucucacu

SEQ ID NO: 977699 - RNA, 22 nt, Human
aaguucaauggaaaagcuuuag

SEQ ID NO: 977700 - RNA, 22 nt, Human
ccuccucugggaagauucagag

SEQ ID NO: 977701 - RNA, 22 nt, Human
cagcugacgccagaguggaauu

SEQ ID NO: 977702 - RNA, 22 nt, Human
aagaacagauucagccugaacu

SEQ ID NO: 977703 - RNA, 22 nt, Human
gucaggauuugaacucaggucu

SEQ ID NO: 977704 - RNA, 22 nt, Human
uuuuaucugugacaucuggcag

SEQ ID NO: 977705 - RNA, 22 nt, Human
uauauuaaaugaccaguuuuaa

SEQ ID NO: 977706 - RNA, 22 nt, Human
uacaguuuguuacauuguuagu

SEQ ID NO: 977707 - RNA, 22 nt, Human
aagaacaguugggaggugagcc

SEQ ID NO: 977708 - RNA, 22 nt, Human
ucagagugggagaaugugccaa

SEQ ID NO: 977709 - RNA, 22 nt, Human
uagaaaauagggccuguggagc

SEQ ID NO: 977710 - RNA, 22 nt, Human
agacccugcaccucucgugggc

SEQ ID NO: 977711 - RNA, 22 nt, Human
aggcucugguuggcaaguaaag

SEQ ID NO: 977712 - RNA, 22 nt, Human
uugguuuaggaacuggcuugga

SEQ ID NO: 977713 - RNA, 22 nt, Human
gcucccacugcagcccugagcc

SEQ ID NO: 977714 - RNA, 22 nt, Human
caagagcugaggcuggagaggu

SEQ ID NO: 977715 - RNA, 22 nt, Human
gagauauguuagaaagcuauug

SEQ ID NO: 977716 - RNA, 22 nt, Human
ugugcucuggaguugccuucac

SEQ ID NO: 977717 - RNA, 22 nt, Human
cagccugcauuuguaucuguau

SEQ ID NO: 977718 - RNA, 22 nt, Human
agcugccauccuguucagcacc

SEQ ID NO: 977719 - RNA, 22 nt, Human
gacagagaggcugagcaguaca

SEQ ID NO: 977720 - RNA, 22 nt, Human
auacaacuuuacaugcaauucc

SEQ ID NO: 977721 - RNA, 22 nt, Human
cacugcaguuccccagugcgca

SEQ ID NO: 977722 - RNA, 20 nt, Human
guguuucaugugauacaaug

SEQ ID NO: 977723 - RNA, 22 nt, Human
uuccucuccucccaccagguga

SEQ ID NO: 977724 - RNA, 22 nt, Human
gguggguauaguuagggccucu

SEQ ID NO: 977725 - RNA, 22 nt, Human
cagcuccagcccaggcagcucc

SEQ ID NO: 977726 - RNA, 22 nt, Human
ucaagagaaggggaaauagacu

SEQ ID NO: 977727 - RNA, 22 nt, Human
ucccagauuguugauggcuuaa

SEQ ID NO: 977728 - RNA, 22 nt, Human
cucuggaguggguggccgggag

SEQ ID NO: 977729 - RNA, 22 nt, Human
uccuggucuacacugcauuggg

SEQ ID NO: 977730 - RNA, 22 nt, Human
uguguacacaaugauugcagag

SEQ ID NO: 977731 - RNA, 22 nt, Human
aacaaaugauuguugguuggag

SEQ ID NO: 977732 - RNA, 22 nt, Human
ucuggccaacaaaaacuaaguc

SEQ ID NO: 977733 - RNA, 22 nt, Human
cuggagccagccagggcccucu

SEQ ID NO: 977734 - RNA, 22 nt, Human
auagauuugaauuuaagacuug

SEQ ID NO: 977735 - RNA, 21 nt, Human
agcaggaggcagucacagcuc

SEQ ID NO: 977736 - RNA, 22 nt, Human
augcagcugugggcaagaaaug

SEQ ID NO: 977737 - RNA, 22 nt, Human
ugaaaugacagucuuaagcucu

SEQ ID NO: 977738 - RNA, 22 nt, Human
agagccagcaacucuagcccug

SEQ ID NO: 977739 - RNA, 22 nt, Human
aggucacccguuugacuaucca

SEQ ID NO: 977740 - RNA, 18 nt, Human
ugcucuguuuaaugauuu

SEQ ID NO: 977741 - RNA, 22 nt, Human
uaggcacuggggaggcagcaug

SEQ ID NO: 977742 - RNA, 22 nt, Human
gucuccugagccuugacugcaa

SEQ ID NO: 977743 - RNA, 22 nt, Human
gccugcugaaccucaugcaguc

SEQ ID NO: 977744 - RNA, 22 nt, Human
acagagcaauaacagggagagg

SEQ ID NO: 977745 - RNA, 22 nt, Human
cagagcuggguuugggaaaccu

SEQ ID NO: 977746 - RNA, 21 nt, Human
ggagggcagcccagacuggcu

SEQ ID NO: 977747 - RNA, 22 nt, Human
agcugagagguggcaagcugua

SEQ ID NO: 977748 - RNA, 22 nt, Human
uguuccuaaauaugaauggaga

SEQ ID NO: 977749 - RNA, 22 nt, Human
ucagagugcagggaguagcagc

SEQ ID NO: 977750 - RNA, 22 nt, Human
ggccucuggcaggcaggcccuc

SEQ ID NO: 977751 - RNA, 22 nt, Human
ggaggccaaggaggagcuugcc

SEQ ID NO: 977752 - RNA, 22 nt, Human
gaguuuaaagcauacauauuuu

SEQ ID NO: 977753 - RNA, 22 nt, Human
uggcagaaguacacaagcaugc

SEQ ID NO: 977754 - RNA, 22 nt, Human
cuggccuguccugacccagccu

SEQ ID NO: 977755 - RNA, 22 nt, Human
auuauguauuugguauaguuug

SEQ ID NO: 977756 - RNA, 22 nt, Human
uccucuggggcgugguccugga

SEQ ID NO: 977757 - RNA, 22 nt, Human
uggcagagaaccugggcuuugu

SEQ ID NO: 977758 - RNA, 22 nt, Human
cucuucuugccugaugaggcag

SEQ ID NO: 977759 - RNA, 22 nt, Human
gaaagagaaccugggccuagau

SEQ ID NO: 977760 - RNA, 22 nt, Human
ucaugaaucguggaaugauuua

SEQ ID NO: 977761 - RNA, 22 nt, Human
ccuuccuggcuguccgccugau

SEQ ID NO: 977762 - RNA, 22 nt, Human
cccuucccuucugggagaucca

SEQ ID NO: 977763 - RNA, 23 nt, Human
uugugggcagauuccauggggag

SEQ ID NO: 977764 - RNA, 22 nt, Human
agugcuguaacaacuuauuugg

SEQ ID NO: 977765 - RNA, 22 nt, Human
gaaggccaguuuugagauaggu

SEQ ID NO: 977766 - RNA, 22 nt, Human
acagggcaccugagguaggaag

SEQ ID NO: 977767 - RNA, 22 nt, Human
guuuggggucugcagagcggcg

SEQ ID NO: 977768 - RNA, 22 nt, Human
ccuguucaagggaugauugacc

SEQ ID NO: 977769 - RNA, 22 nt, Human
guacauuuuacuuuguuugaau

SEQ ID NO: 977770 - RNA, 22 nt, Human
ccagacuguggaguuccuggug

SEQ ID NO: 977771 - RNA, 22 nt, Human
gcaagcaguuguggcuucugag

SEQ ID NO: 977772 - RNA, 22 nt, Human
uucugagccucauucaugaggc

SEQ ID NO: 977773 - RNA, 22 nt, Human
aaagaucagucugaagcaacau

SEQ ID NO: 977774 - RNA, 22 nt, Human
cuggcagguuuggugucuggug

SEQ ID NO: 977775 - RNA, 22 nt, Human
aagcagaugggacuccaaggca

SEQ ID NO: 977776 - RNA, 22 nt, Human
aaacacagggauauauauucca

SEQ ID NO: 977777 - RNA, 22 nt, Human
gcugaaauucagauuccuaggc

SEQ ID NO: 977778 - RNA, 22 nt, Human
gagcucccaggccccagcaagg

SEQ ID NO: 977779 - RNA, 22 nt, Human
gcagauggugccaugucuugug

SEQ ID NO: 977780 - RNA, 22 nt, Human
uaugcacacaucgcagcaggaa

SEQ ID NO: 977781 - RNA, 19 nt, Human
agcagagcccugaagaucc

SEQ ID NO: 977782 - RNA, 22 nt, Human
ucacaggagauuaugugugcua

SEQ ID NO: 977783 - RNA, 22 nt, Human
ugacacauuaaaugcucacaaa

SEQ ID NO: 977784 - RNA, 22 nt, Human
uuauuuauggcacuguuggugg

SEQ ID NO: 977785 - RNA, 22 nt, Human
gaugcacugcaguauauacugu

SEQ ID NO: 977786 - RNA, 22 nt, Human
aguuuaugaaacacagauuuga

SEQ ID NO: 977787 - RNA, 22 nt, Human
ucagaagcaggagugugcacaa

SEQ ID NO: 977788 - RNA, 22 nt, Human
gacucugcugacuaguugacua

SEQ ID NO: 977789 - RNA, 22 nt, Human
cccagcccugaccuauuggaaa

SEQ ID NO: 977790 - RNA, 22 nt, Human
gcuggcagagacaagaagacua

SEQ ID NO: 977791 - RNA, 22 nt, Human
aauauaauuuuauuccuagagu

SEQ ID NO: 977792 - RNA, 22 nt, Human
ucccuggacagccuugccuggg

SEQ ID NO: 977793 - RNA, 22 nt, Human
aaguccaucucugccccacaca

SEQ ID NO: 977794 - RNA, 22 nt, Human
agccucucugaugugacagcua

SEQ ID NO: 977795 - RNA, 22 nt, Human
guccuggcccacuggcaggcug

SEQ ID NO: 977796 - RNA, 21 nt, Human
ccagccucagaucagggagcu

SEQ ID NO: 977797 - RNA, 22 nt, Human
uccuggccgcuggccccugaga

SEQ ID NO: 977798 - RNA, 22 nt, Human
ggcugagggccagggcuagucu

SEQ ID NO: 977799 - RNA, 22 nt, Human
uccuuccucggggacccagauc

SEQ ID NO: 977800 - RNA, 22 nt, Human
ccagggcaggagaaagacucac

SEQ ID NO: 977801 - RNA, 20 nt, Human
acaauuuccucacuauaugc

SEQ ID NO: 977802 - RNA, 22 nt, Human
uuucagaugcaauuaauuuuca

SEQ ID NO: 977803 - RNA, 22 nt, Human
ccaggcugagcaugauuggagc

SEQ ID NO: 977804 - RNA, 19 nt, Human
auggaaaaugccagacuga

SEQ ID NO: 977805 - RNA, 22 nt, Human
gaggccagaguuccccgaguca

SEQ ID NO: 977806 - RNA, 22 nt, Human
aaaugcuugcucuugauuauuu

SEQ ID NO: 977807 - RNA, 22 nt, Human
gagggagggaaaguuuaacacu

SEQ ID NO: 977808 - RNA, 23 nt, Human
aggcugcagaagaauagggucau

SEQ ID NO: 977809 - RNA, 19 nt, Human
uggcucugucgaaggcaca

SEQ ID NO: 977810 - RNA, 22 nt, Human
cuauuucugccuaaugaccugu

SEQ ID NO: 977811 - RNA, 23 nt, Human
cugucuccugggcuagguggaau

SEQ ID NO: 977812 - RNA, 19 nt, Human
auaaggcagugacuuuuuu

SEQ ID NO: 977813 - RNA, 22 nt, Human
agucuuaacuaugcaaguacua

SEQ ID NO: 977814 - RNA, 20 nt, Human
ccaauaaagcucuauaggga

SEQ ID NO: 977815 - RNA, 22 nt, Human
cucuccagaauaugccgccgug

SEQ ID NO: 977816 - RNA, 22 nt, Human
gccaggggacgcggagcgacga

SEQ ID NO: 977817 - RNA, 22 nt, Human
agcuuaggaggaugaugaacau

SEQ ID NO: 977818 - RNA, 22 nt, Human
guaagggauuugaacauagguu

SEQ ID NO: 977819 - RNA, 22 nt, Human
guggccuggaugagcuucgaca

SEQ ID NO: 977820 - RNA, 22 nt, Human
cugcuuugcauagcugccagag

SEQ ID NO: 977821 - RNA, 22 nt, Human
ugggccagcaauugcugcucag

SEQ ID NO: 977822 - RNA, 17 nt, Human
acucaggaucugggagu

SEQ ID NO: 977823 - RNA, 22 nt, Human
cuggaagggucuacuuagcaga

SEQ ID NO: 977824 - RNA, 22 nt, Human
gcaccuuuggaaugaaaaguug

SEQ ID NO: 977825 - RNA, 22 nt, Human
aggcccuggcacugccugggag

SEQ ID NO: 977826 - RNA, 22 nt, Human
acagaacuuccugcuggagugg

SEQ ID NO: 977827 - RNA, 22 nt, Human
uugagggaacaugagaaucauc

SEQ ID NO: 977828 - RNA, 22 nt, Human
aacucacuuuguggcuucugaa

SEQ ID NO: 977829 - RNA, 22 nt, Human
uccaggaguuugagacugcagu

SEQ ID NO: 977830 - RNA, 22 nt, Human
auucugucuuuuuaaaauaaua

SEQ ID NO: 977831 - RNA, 22 nt, Human
cugccagcagaggccagcgcug

SEQ ID NO: 977832 - RNA, 22 nt, Human
auuucagguaccugugggaucc

SEQ ID NO: 977833 - RNA, 19 nt, Human
acauauguggauauacaug

SEQ ID NO: 977834 - RNA, 20 nt, Human
gcugaggucauuaugccuca

SEQ ID NO: 977835 - RNA, 22 nt, Human
gcugccuggaauaacggcuggc

SEQ ID NO: 977836 - RNA, 22 nt, Human
uguguauagguugugcuaauag

SEQ ID NO: 977837 - RNA, 22 nt, Human
augcagauguuugguucauugu

SEQ ID NO: 977838 - RNA, 22 nt, Human
gggcccagcgugguuccaucug

SEQ ID NO: 977839 - RNA, 22 nt, Human
cugccuggaaugccagcuucuc

SEQ ID NO: 977840 - RNA, 21 nt, Human
agacagagugcagucuacaua

SEQ ID NO: 977841 - RNA, 20 nt, Human
uuucugugagaaacacuguu

SEQ ID NO: 977842 - RNA, 22 nt, Human
auuugcaaagucguaucuguga

SEQ ID NO: 977843 - RNA, 17 nt, Human
ucugccgacugccagcu

SEQ ID NO: 977844 - RNA, 22 nt, Human
acucaggagggaucagcuauca

SEQ ID NO: 977845 - RNA, 22 nt, Human
agggcagcagcuccuccuagcu

SEQ ID NO: 977846 - RNA, 22 nt, Human
uugauaaaaugaugaaaucacu

SEQ ID NO: 977847 - RNA, 22 nt, Human
aggcuucuaggguuggcagcgg

SEQ ID NO: 977848 - RNA, 22 nt, Human
aucaguuuggugcuuucaguga

SEQ ID NO: 977849 - RNA, 22 nt, Human
augcugugucuagcaggaacac

SEQ ID NO: 977850 - RNA, 19 nt, Human
gagguggguccccgcagcc

SEQ ID NO: 977851 - RNA, 22 nt, Human
agggcucuguccccagaggccc

SEQ ID NO: 977852 - RNA, 22 nt, Human
gauggcaggcaggugaguagag

SEQ ID NO: 977853 - RNA, 22 nt, Human
caccagcuuugcccacugccca

SEQ ID NO: 977854 - RNA, 22 nt, Human
augcuguguuuuaaauggaaau

SEQ ID NO: 977855 - RNA, 22 nt, Human
uauaugcucugggauccugaaa

SEQ ID NO: 977856 - RNA, 18 nt, Human
aaguaacagaagagcaca

SEQ ID NO: 977857 - RNA, 22 nt, Human
aagggcaggcagagaucauaua

SEQ ID NO: 977858 - RNA, 22 nt, Human
acugggccuugccauggcagcc

SEQ ID NO: 977859 - RNA, 18 nt, Human
gcugucugaggucugagg

SEQ ID NO: 977860 - RNA, 22 nt, Human
ccaggaaugaaauguagauaaa

SEQ ID NO: 977861 - RNA, 22 nt, Human
cagcaguguacaaggugucaga

SEQ ID NO: 977862 - RNA, 23 nt, Human
uuucaaauuacucugcagaugac

SEQ ID NO: 977863 - RNA, 22 nt, Human
ccucuuccacugggccccaucc

SEQ ID NO: 977864 - RNA, 22 nt, Human
ccugccugggcucacuugccag

SEQ ID NO: 977865 - RNA, 22 nt, Human
aaacagcugucauuguuuuaaa

SEQ ID NO: 977866 - RNA, 22 nt, Human
gggugggguguaucggauccua

SEQ ID NO: 977867 - RNA, 22 nt, Human
uccuggccgccgcguggggccg

SEQ ID NO: 977868 - RNA, 22 nt, Human
ucuggcucugaauucacuucug

SEQ ID NO: 977869 - RNA, 22 nt, Human
agggcugcaggcaagauauggc

SEQ ID NO: 977870 - RNA, 22 nt, Human
agugucugccaacugcaugguc

SEQ ID NO: 977871 - RNA, 22 nt, Human
ccuuagagaguacugggcugcc

SEQ ID NO: 977872 - RNA, 22 nt, Human
cuugaaguugcaaaacauuaau

SEQ ID NO: 977873 - RNA, 22 nt, Human
gccuguccuggaugcucugcaa

SEQ ID NO: 977874 - RNA, 19 nt, Human
cucuggagcagacacugga

SEQ ID NO: 977875 - RNA, 22 nt, Human
ugugcccaucccucuggagugu

SEQ ID NO: 977876 - RNA, 22 nt, Human
cacugaagcuuucauucucuug

SEQ ID NO: 977877 - RNA, 22 nt, Human
agcugcucugauaaaccuacuu

SEQ ID NO: 977878 - RNA, 22 nt, Human
uaaaagcucuucuguugaguua

SEQ ID NO: 977879 - RNA, 21 nt, Human
cccuguguuccacagcagaca

SEQ ID NO: 977880 - RNA, 22 nt, Human
aggcacugaaggaagcuugcgc

SEQ ID NO: 977881 - RNA, 22 nt, Human
uuaauacagucuccagaaguaa

SEQ ID NO: 977882 - RNA, 22 nt, Human
aucccuggacggcgccucccca

SEQ ID NO: 977883 - RNA, 22 nt, Human
ugauuucccuguagccucugaa

SEQ ID NO: 977884 - RNA, 22 nt, Human
agccugucugucuccaaagcug

SEQ ID NO: 977885 - RNA, 22 nt, Human
guggccucuguuggcuccuagg

SEQ ID NO: 977886 - RNA, 22 nt, Human
cucagaagccuucagucuuggc

SEQ ID NO: 977887 - RNA, 22 nt, Human
agggacacaugugauuauuuau

SEQ ID NO: 977888 - RNA, 22 nt, Human
aggcugcucaguagauggagcu

SEQ ID NO: 977889 - RNA, 22 nt, Human
uucuucaugcuguugcugcuug

SEQ ID NO: 977890 - RNA, 22 nt, Human
ggccucugaggacagccuuggc

SEQ ID NO: 977891 - RNA, 22 nt, Human
agagcugcaauuucauguggug

SEQ ID NO: 977892 - RNA, 20 nt, Human
gccugccucagcuagcugag

SEQ ID NO: 977893 - RNA, 22 nt, Human
ggagcagggcagugaauucugg

SEQ ID NO: 977894 - RNA, 22 nt, Human
accagagcgcucaagccuuccc

SEQ ID NO: 977895 - RNA, 22 nt, Human
gugaccaucagagaauaacaaa

SEQ ID NO: 977896 - RNA, 22 nt, Human
uuccaggaggagguacuagagg

SEQ ID NO: 977897 - RNA, 22 nt, Human
ccugucaggguuugccucagaa

SEQ ID NO: 977898 - RNA, 22 nt, Human
uuuauuaugauggacaccuucg

SEQ ID NO: 977899 - RNA, 22 nt, Human
cugcuucuaagaaccugcagcu

SEQ ID NO: 977900 - RNA, 22 nt, Human
uggcaguccccugugccuggaa

SEQ ID NO: 977901 - RNA, 22 nt, Human
ucccugcucagcucaccuggca

SEQ ID NO: 977902 - RNA, 22 nt, Human
agaggcuccuucacucuggcac

SEQ ID NO: 977903 - RNA, 22 nt, Human
aagaacugugcuccaggcucca

SEQ ID NO: 977904 - RNA, 22 nt, Human
cacccagccuucacacaggagu

SEQ ID NO: 977905 - RNA, 22 nt, Human
ugcagcauuauucacaguagcc

SEQ ID NO: 977906 - RNA, 22 nt, Human
uggccugaauuauggcagaucu

SEQ ID NO: 977907 - RNA, 23 nt, Human
aacaccaaggcucagagagauaa

SEQ ID NO: 977908 - RNA, 22 nt, Human
caucagcaggcaacacucuugg

SEQ ID NO: 977909 - RNA, 22 nt, Human
uugcauuugacaaauuauuuaa

SEQ ID NO: 977910 - RNA, 22 nt, Human
cagggccagcgcccaggcccag

SEQ ID NO: 977911 - RNA, 22 nt, Human
ucuguucaugucuuuuuaagug

SEQ ID NO: 977912 - RNA, 22 nt, Human
cuggugguucaggagaauggcu

SEQ ID NO: 977913 - RNA, 22 nt, Human
acugccugcucauaacauugcu

SEQ ID NO: 977914 - RNA, 22 nt, Human
acuaaauagccucugguaguug

SEQ ID NO: 977915 - RNA, 20 nt, Human
aggagcugaauuagaggguu

SEQ ID NO: 977916 - RNA, 21 nt, Human
cugugcuuuuuaagugugaug

SEQ ID NO: 977917 - RNA, 22 nt, Human
cuuacauugugugcaugagggg

SEQ ID NO: 977918 - RNA, 22 nt, Human
guuuuucuaggaccaugugauu

SEQ ID NO: 977919 - RNA, 22 nt, Human
ggagugggaacaaugacauggu

SEQ ID NO: 977920 - RNA, 22 nt, Human
ugacauaaaccagugagcaaaa

SEQ ID NO: 977921 - RNA, 22 nt, Human
ggauguugauugaauggccauu

SEQ ID NO: 977922 - RNA, 22 nt, Human
gcacagaagagcuuuggaauga

SEQ ID NO: 977923 - RNA, 22 nt, Human
ccagccugguucagaauuggcu

SEQ ID NO: 977924 - RNA, 20 nt, Human
aacacacugguggcaucagg

SEQ ID NO: 977925 - RNA, 22 nt, Human
auccagucaaaauuaguaaggu

SEQ ID NO: 977926 - RNA, 22 nt, Human
ugggcaaguaucggacucugag

SEQ ID NO: 977927 - RNA, 22 nt, Human
aaggcacugcuuugcugcgccc

SEQ ID NO: 977928 - RNA, 22 nt, Human
caggcagcagaggaguguggga

SEQ ID NO: 977929 - RNA, 22 nt, Human
gcugccacauuuucaggacuaa

SEQ ID NO: 977930 - RNA, 22 nt, Human
ugcccaggcuggaaugcagugg

SEQ ID NO: 977931 - RNA, 22 nt, Human
ugucccagauacuggacauaga

SEQ ID NO: 977932 - RNA, 22 nt, Human
agggagcucaguuggaagcggu

SEQ ID NO: 977933 - RNA, 22 nt, Human
ggagaagggacagacucagcuu

SEQ ID NO: 977934 - RNA, 22 nt, Human
aaccaaauggaugguaagaggg

SEQ ID NO: 977935 - RNA, 22 nt, Human
uacuuucuagcucuccccaguu

SEQ ID NO: 977936 - RNA, 22 nt, Human
acuggcaguuugagaaugcauu

SEQ ID NO: 977937 - RNA, 22 nt, Human
gagagugaaggcuucccagcaa

SEQ ID NO: 977938 - RNA, 22 nt, Human
aaaugcauaucaaagacuugaa

SEQ ID NO: 977939 - RNA, 22 nt, Human
ugauuucaaguagugacaugcu

SEQ ID NO: 977940 - RNA, 22 nt, Human
uagaacaugcucauguauaaau

SEQ ID NO: 977941 - RNA, 22 nt, Human
cccucuacagggaagcgcuuuc

SEQ ID NO: 977942 - RNA, 22 nt, Human
uccuucagaaaaccucagucuu

SEQ ID NO: 977943 - RNA, 22 nt, Human
cuacucugaauugaagugauau

SEQ ID NO: 977944 - RNA, 22 nt, Human
gagugcaguuggggugagggga

SEQ ID NO: 977945 - RNA, 22 nt, Human
ugauuucccucaucauaacaga

SEQ ID NO: 977946 - RNA, 22 nt, Human
uucaggaucaaguugccaguag

SEQ ID NO: 977947 - RNA, 23 nt, Human
ccugggcauuggcugcagcuucu

SEQ ID NO: 977948 - RNA, 22 nt, Human
ugccucccucucugccacugga

SEQ ID NO: 977949 - RNA, 22 nt, Human
ucuggccauggcaagccgagug

SEQ ID NO: 977950 - RNA, 22 nt, Human
aagcaaaggcaggagcuuguga

SEQ ID NO: 977951 - RNA, 22 nt, Human
cauuauguucaguagcuuaaaa

SEQ ID NO: 977952 - RNA, 22 nt, Human
ugcauuuguuaccuuauugcag

SEQ ID NO: 977953 - RNA, 22 nt, Human
agccuugaguucaagugcuggc

SEQ ID NO: 977954 - RNA, 22 nt, Human
cacaggcugcccgcagcuggga

SEQ ID NO: 977955 - RNA, 22 nt, Human
aaggagagguuguccguguugu

SEQ ID NO: 977956 - RNA, 22 nt, Human
ugcaagggcuuagggggcugug

SEQ ID NO: 977957 - RNA, 22 nt, Human
augaagucuagcaagcauugaa

SEQ ID NO: 977958 - RNA, 22 nt, Human
uaaaugugcacuuuacuuuuca

SEQ ID NO: 977959 - RNA, 22 nt, Human
augcaguauaaaucauuucugg

SEQ ID NO: 977960 - RNA, 22 nt, Human
cugggagcuggaugcccugccc

SEQ ID NO: 977961 - RNA, 22 nt, Human
uaucuguuguaguacagaugau

SEQ ID NO: 977962 - RNA, 22 nt, Human
augugucugugggcacacacac

SEQ ID NO: 977963 - RNA, 22 nt, Human
cuggaaauuggagaugauguuu

SEQ ID NO: 977964 - RNA, 22 nt, Human
ugggccuggaguuuguccagag

SEQ ID NO: 977965 - RNA, 22 nt, Human
agcagagcggggccuccggaag

SEQ ID NO: 977966 - RNA, 22 nt, Human
ggccccuggcaccaggcugauu

SEQ ID NO: 977967 - RNA, 22 nt, Human
uccaugagcuagggauucauca

SEQ ID NO: 977968 - RNA, 22 nt, Human
uugcagcuuagugauguuaucu

SEQ ID NO: 977969 - RNA, 22 nt, Human
ugugccauuucuauucugcagc

SEQ ID NO: 977970 - RNA, 22 nt, Human
agcugccagcaaguuucaaaca

SEQ ID NO: 977971 - RNA, 22 nt, Human
cccaggcagugugugcaugcgu

SEQ ID NO: 977972 - RNA, 22 nt, Human
gcaggaugccagggcagcagcg

SEQ ID NO: 977973 - RNA, 22 nt, Human
auuaaagaaacccagcauguga

SEQ ID NO: 977974 - RNA, 19 nt, Human
aguggcagaucuggaagua

SEQ ID NO: 977975 - RNA, 22 nt, Human
uugcuuugccaccagaagucua

SEQ ID NO: 977976 - RNA, 22 nt, Human
agggucugacuccucuggcaag

SEQ ID NO: 977977 - RNA, 22 nt, Human
cugagccuguguuucucuggca

SEQ ID NO: 977978 - RNA, 22 nt, Human
uaagaagcuucugcuaaugccu

SEQ ID NO: 977979 - RNA, 22 nt, Human
aucuggcuugacuuugcgacuu

SEQ ID NO: 977980 - RNA, 22 nt, Human
gagaggugaaggcugcccuggg

SEQ ID NO: 977981 - RNA, 22 nt, Human
agucccagccuguaggauuggg

SEQ ID NO: 977982 - RNA, 22 nt, Human
gcucccugccuacacggaccuu

SEQ ID NO: 977983 - RNA, 22 nt, Human
gaugggaggaaccugggucccu

SEQ ID NO: 977984 - RNA, 19 nt, Human
ugagaggcuuaaggcagcu

SEQ ID NO: 977985 - RNA, 22 nt, Human
cugccuugaggagguuguggga

SEQ ID NO: 977986 - RNA, 22 nt, Human
acugugcacaauucuaaguccu

SEQ ID NO: 977987 - RNA, 22 nt, Human
uuuucauuuuuguagaugcaag

SEQ ID NO: 977988 - RNA, 22 nt, Human
caaaggcaacauauacuuguuu

SEQ ID NO: 977989 - RNA, 22 nt, Human
ccaggagcuggagggugcagug

SEQ ID NO: 977990 - RNA, 22 nt, Human
cccuccccacaaagcuucacac

SEQ ID NO: 977991 - RNA, 22 nt, Human
acguuuucuagagaauaugcag

SEQ ID NO: 977992 - RNA, 19 nt, Human
ggugaccaccuggucagug

SEQ ID NO: 977993 - RNA, 22 nt, Human
auucauucugaccucaagagaa

SEQ ID NO: 977994 - RNA, 22 nt, Human
acagggccucagccagggcaga

SEQ ID NO: 977995 - RNA, 22 nt, Human
agccaggaagaaggucacacca

SEQ ID NO: 977996 - RNA, 21 nt, Human
aguguccuugaucuugccuug

SEQ ID NO: 977997 - RNA, 22 nt, Human
ccucucauagucuguauccuuu

SEQ ID NO: 977998 - RNA, 22 nt, Human
cuguggagcuuguggcaguggg

SEQ ID NO: 977999 - RNA, 22 nt, Human
aaaugcaccuugcugugagacu

SEQ ID NO: 978000 - RNA, 22 nt, Human
ugcccugugugugcaagcacug

SEQ ID NO: 978001 - RNA, 22 nt, Human
cggcuggguagaggugccgggu

SEQ ID NO: 978002 - RNA, 21 nt, Human
aagaagcaauuuauuggaagg

SEQ ID NO: 978003 - RNA, 22 nt, Human
uaguuaaaauaauggagauguu

SEQ ID NO: 978004 - RNA, 19 nt, Human
acauuuagaauguacuugc

SEQ ID NO: 978005 - RNA, 22 nt, Human
agcugccaccucugccuuuggg

SEQ ID NO: 978006 - RNA, 18 nt, Human
gaaaggagagacaguagg

SEQ ID NO: 978007 - RNA, 22 nt, Human
aagugguagacaaagauaauug

SEQ ID NO: 978008 - RNA, 22 nt, Human
gauacauuuuaucuccuaacag

SEQ ID NO: 978009 - RNA, 22 nt, Human
ccaggagagcaaaggucacucu

SEQ ID NO: 978010 - RNA, 19 nt, Human
agaggccucagcagcuggc

SEQ ID NO: 978011 - RNA, 22 nt, Human
aaggcccuaauagagcacauau

SEQ ID NO: 978012 - RNA, 22 nt, Human
ccaggagcaaagaucacuggga

SEQ ID NO: 978013 - RNA, 18 nt, Human
gagguccugcucuagccc

SEQ ID NO: 978014 - RNA, 20 nt, Human
uccaugaguuagagacuaua

SEQ ID NO: 978015 - RNA, 22 nt, Human
uccaugagagguaacuuuacaa

SEQ ID NO: 978016 - RNA, 22 nt, Human
cugccucuggccucaggcccag

SEQ ID NO: 978017 - RNA, 22 nt, Human
uuugagauggagucuugcucug

SEQ ID NO: 978018 - RNA, 22 nt, Human
gaaggaaaggucucaugccuuu

SEQ ID NO: 978019 - RNA, 22 nt, Human
ccugggagggcaagugcugaug

SEQ ID NO: 978020 - RNA, 22 nt, Human
ccaggagauaagcugaguuuau

SEQ ID NO: 978021 - RNA, 22 nt, Human
uuguuuuggaagaacuuacucu

SEQ ID NO: 978022 - RNA, 22 nt, Human
caggcugcagaggccuuucaug

SEQ ID NO: 978023 - RNA, 23 nt, Human
agaggccaacuucuugccccucc

SEQ ID NO: 978024 - RNA, 22 nt, Human
uucuucagucccacuagccaca

SEQ ID NO: 978025 - RNA, 23 nt, Human
auuuccuacuauaaaagagguaa

SEQ ID NO: 978026 - RNA, 22 nt, Human
cacaccuguaauaccagcuacu

SEQ ID NO: 978027 - RNA, 22 nt, Human
uggaaagagguagaggaucugg

SEQ ID NO: 978028 - RNA, 22 nt, Human
uuucuucacaggguauugggug

SEQ ID NO: 978029 - RNA, 22 nt, Human
auuuacagaugaugcuauuuga

SEQ ID NO: 978030 - RNA, 22 nt, Human
ccugagagcauuccacacugaa

SEQ ID NO: 978031 - RNA, 22 nt, Human
ugggauggagccugaguauagu

SEQ ID NO: 978032 - RNA, 22 nt, Human
ccacaggaccagaggagaucac

SEQ ID NO: 978033 - RNA, 22 nt, Human
gcugcuguugauuuaguccaau

SEQ ID NO: 978034 - RNA, 22 nt, Human
cagugcugggcagaggagagcg

SEQ ID NO: 978035 - RNA, 22 nt, Human
auguaacuucugugaaucugac

SEQ ID NO: 978036 - RNA, 22 nt, Human
augaugguuguccuaggugcau

SEQ ID NO: 978037 - RNA, 20 nt, Human
gccuggaggcaaugggaaga

SEQ ID NO: 978038 - RNA, 22 nt, Human
gcagagugggagcccagggcug

SEQ ID NO: 978039 - RNA, 22 nt, Human
ucugcaggacugaggccuguuu

SEQ ID NO: 978040 - RNA, 22 nt, Human
guccuggggauacagaagugaa

SEQ ID NO: 978041 - RNA, 22 nt, Human
ucagugucuugggcuugaaugc

SEQ ID NO: 978042 - RNA, 18 nt, Human
aagcugcccucaggcagg

SEQ ID NO: 978043 - RNA, 22 nt, Human
uggcuucuuagaccaguggccu

SEQ ID NO: 978044 - RNA, 22 nt, Human
cucuuaguuuaucuuugacaaa

SEQ ID NO: 978045 - RNA, 22 nt, Human
uacagauacagaucuagauaca

SEQ ID NO: 978046 - RNA, 20 nt, Human
aauguauauuuuaugccagg

SEQ ID NO: 978047 - RNA, 22 nt, Human
ucugggaacagccuggcugugu

SEQ ID NO: 978048 - RNA, 22 nt, Human
auaaagauuucuuuuucucuac

SEQ ID NO: 978049 - RNA, 22 nt, Human
agcaccugcuaugugucaggga

SEQ ID NO: 978050 - RNA, 22 nt, Human
aaagccuucaaguagauguaag

SEQ ID NO: 978051 - RNA, 22 nt, Human
uucaucaauguguuuaauaaug

SEQ ID NO: 978052 - RNA, 22 nt, Human
caaauacucuggauguguuugu

SEQ ID NO: 978053 - RNA, 22 nt, Human
ccagcccuucccaacuggccag

SEQ ID NO: 978054 - RNA, 22 nt, Human
aggaugaggcuggcaggucuug

SEQ ID NO: 978055 - RNA, 17 nt, Human
aggcugcugggccaggg

SEQ ID NO: 978056 - RNA, 22 nt, Human
gucucccacuuucuggccucuu

SEQ ID NO: 978057 - RNA, 22 nt, Human
acuggccaugaacuugggaucu

SEQ ID NO: 978058 - RNA, 22 nt, Human
agaagccauugaagcagaccuc

SEQ ID NO: 978059 - RNA, 22 nt, Human
ugaaagguuaaaaguaguauug

SEQ ID NO: 978060 - RNA, 22 nt, Human
ucugccugaaauucacauguaa

SEQ ID NO: 978061 - RNA, 22 nt, Human
aucuauuucugcuaauaacaau

SEQ ID NO: 978062 - RNA, 22 nt, Human
ugaaauauuuagagaguaaguu

SEQ ID NO: 978063 - RNA, 22 nt, Human
ggccucgcggcuucugguggcu

SEQ ID NO: 978064 - RNA, 22 nt, Human
ccacagccauuccagggaggcu

SEQ ID NO: 978065 - RNA, 22 nt, Human
gccaggagggaaaggacaauuu

SEQ ID NO: 978066 - RNA, 22 nt, Human
ugggagcucagaaagggagguc

SEQ ID NO: 978067 - RNA, 22 nt, Human
cugugucccccucagccaggug

SEQ ID NO: 978068 - RNA, 22 nt, Human
ggcuguggggggagccugcccg

SEQ ID NO: 978069 - RNA, 23 nt, Human
ccugugugcccuuaauucacagc

SEQ ID NO: 978070 - RNA, 22 nt, Human
uaucuuugcaaauaucucuaag

SEQ ID NO: 978071 - RNA, 22 nt, Human
uaaguucaguuggucgaaguag

SEQ ID NO: 978072 - RNA, 22 nt, Human
aguugcagacgcagagauguug

SEQ ID NO: 978073 - RNA, 22 nt, Human
cucuggaguucuucaagcuacu

SEQ ID NO: 978074 - RNA, 22 nt, Human
acuuguucauugaguacauaug

SEQ ID NO: 978075 - RNA, 18 nt, Human
uggagccagcucuaggau

SEQ ID NO: 978076 - RNA, 22 nt, Human
cggggcuguagcacagcugagc

SEQ ID NO: 978077 - RNA, 22 nt, Human
aaggcagcacagcaacugcuca

SEQ ID NO: 978078 - RNA, 22 nt, Human
uaaugcuuaacagcuggcuuuu

SEQ ID NO: 978079 - RNA, 22 nt, Human
ccagagagauugcuucuaaaga

SEQ ID NO: 978080 - RNA, 22 nt, Human
ccagcagagucuaggaaggagg

SEQ ID NO: 978081 - RNA, 22 nt, Human
ccaaagagcuagaauuauaggc

SEQ ID NO: 978082 - RNA, 22 nt, Human
gaggggcagagguagagaacaa

SEQ ID NO: 978083 - RNA, 22 nt, Human
gaggggcuugaggcccugaugg

SEQ ID NO: 978084 - RNA, 22 nt, Human
aguguuaagagaaaauucugcu

SEQ ID NO: 978085 - RNA, 22 nt, Human
auuuugaugcuaucuaaugaau

SEQ ID NO: 978086 - RNA, 22 nt, Human
uuuaaucaggcaaagcauaaua

SEQ ID NO: 978087 - RNA, 22 nt, Human
gcagggcuguucaggagggugg

SEQ ID NO: 978088 - RNA, 22 nt, Human
cauggccucaaaggacugcaga

SEQ ID NO: 978089 - RNA, 22 nt, Human
uauuucuggcuuugagggugau

SEQ ID NO: 978090 - RNA, 22 nt, Human
uccagcagguuggucaggugca

SEQ ID NO: 978091 - RNA, 22 nt, Human
uaaggcacacaguugcugcaug

SEQ ID NO: 978092 - RNA, 22 nt, Human
uggcucuggugcgggcuccugc

SEQ ID NO: 978093 - RNA, 22 nt, Human
cucaggaggaggaaguucauug

SEQ ID NO: 978094 - RNA, 23 nt, Human
uuacuuuugcaccaaccuaauau

SEQ ID NO: 978095 - RNA, 22 nt, Human
uggcagucuggguuggcaguua

SEQ ID NO: 978096 - RNA, 22 nt, Human
aguccaggaguugggugacauu

SEQ ID NO: 978097 - RNA, 22 nt, Human
acuaggggcucaggcccaggga

SEQ ID NO: 978098 - RNA, 22 nt, Human
ucacaagaauuuguagaugaaa

SEQ ID NO: 978099 - RNA, 23 nt, Human
cuggccuccgacacuggccaaga

SEQ ID NO: 978100 - RNA, 22 nt, Human
ggagauagacuuggugagccac

SEQ ID NO: 978101 - RNA, 22 nt, Human
cauaagaaauuuaacagaacuu

SEQ ID NO: 978102 - RNA, 22 nt, Human
agucauauguggcauuuucuaa

SEQ ID NO: 978103 - RNA, 19 nt, Human
agugucaucagcuacucag

SEQ ID NO: 978104 - RNA, 22 nt, Human
aaucuggcauuugagaguagga

SEQ ID NO: 978105 - RNA, 22 nt, Human
aaagacauuagauuaacguaca

SEQ ID NO: 978106 - RNA, 22 nt, Human
uaauuuauuucaacugccaagg

SEQ ID NO: 978107 - RNA, 22 nt, Human
agccuccacagaugcaaagggc

SEQ ID NO: 978108 - RNA, 22 nt, Human
cucuggagguugagcccagcaa

SEQ ID NO: 978109 - RNA, 19 nt, Human
uggcagaggcaguuuguac

SEQ ID NO: 978110 - RNA, 22 nt, Human
agcagagcgccugcucagaggg

SEQ ID NO: 978111 - RNA, 22 nt, Human
aggcacugacagauucuguguc

SEQ ID NO: 978112 - RNA, 22 nt, Human
uguggugagaaacugguagauu

SEQ ID NO: 978113 - RNA, 22 nt, Human
ucuggccaggggucccugaagg

SEQ ID NO: 978114 - RNA, 22 nt, Human
gaagccaagugcaaaugccuua

SEQ ID NO: 978115 - RNA, 22 nt, Human
ccaggagccacucaggcccaca

SEQ ID NO: 978116 - RNA, 22 nt, Human
aaguucaaggugauaguggcag

SEQ ID NO: 978117 - RNA, 22 nt, Human
ucuagaaaaaaacugcugugga

SEQ ID NO: 978118 - RNA, 18 nt, Human
agagaugguguagaguuu

SEQ ID NO: 978119 - RNA, 22 nt, Human
aaagaacaucggagugggcggg

SEQ ID NO: 978120 - RNA, 20 nt, Human
aggcucagcugagcucuugg

SEQ ID NO: 978121 - RNA, 22 nt, Human
uggcucagcuuacuuuugaggg

SEQ ID NO: 978122 - RNA, 22 nt, Human
ucuccugggcuugguugaaguu

SEQ ID NO: 978123 - RNA, 22 nt, Human
cccaggagacagaaacagaggu

SEQ ID NO: 978124 - RNA, 22 nt, Human
aaagcacauuacaagcucaguc

SEQ ID NO: 978125 - RNA, 22 nt, Human
uccugggcuguggccccgggca

SEQ ID NO: 978126 - RNA, 22 nt, Human
ggccaccuuccaguugccugca

SEQ ID NO: 978127 - RNA, 22 nt, Human
uugcaaaugugaauaauuacac

SEQ ID NO: 978128 - RNA, 22 nt, Human
uuucaagagggaacugaacaca

SEQ ID NO: 978129 - RNA, 22 nt, Human
uccugccugcaaucccagcacu

SEQ ID NO: 978130 - RNA, 22 nt, Human
ugaauaguccuuggaauaacug

SEQ ID NO: 978131 - RNA, 22 nt, Human
uggccugcagaggcuguggggc

SEQ ID NO: 978132 - RNA, 22 nt, Human
ccuccuggguucaagcgauucu

SEQ ID NO: 978133 - RNA, 22 nt, Human
ucagucuucccuccagugcaac

SEQ ID NO: 978134 - RNA, 22 nt, Human
uacuaaauaguuuaauuccuca

SEQ ID NO: 978135 - RNA, 22 nt, Human
cuggcucaggaaaguugcugcu

SEQ ID NO: 978136 - RNA, 22 nt, Human
aacaaauggggccuuguaugaa

SEQ ID NO: 978137 - RNA, 22 nt, Human
gcaggagacaacuguaaggaga

SEQ ID NO: 978138 - RNA, 22 nt, Human
cuccugggagucuuccuggaug

SEQ ID NO: 978139 - RNA, 22 nt, Human
ucauugaauuugguucaauaug

SEQ ID NO: 978140 - RNA, 22 nt, Human
gucaggauuaaugggaguaugc

SEQ ID NO: 978141 - RNA, 22 nt, Human
cugagggugcuauucuugccuu

SEQ ID NO: 978142 - RNA, 22 nt, Human
gaggccagaagugccucgggcu

SEQ ID NO: 978143 - RNA, 22 nt, Human
ccaagaugaucuuuacaguguu

SEQ ID NO: 978144 - RNA, 22 nt, Human
cagggcaggaauuugacauugc

SEQ ID NO: 978145 - RNA, 22 nt, Human
acaguacauaauccugagucug

SEQ ID NO: 978146 - RNA, 22 nt, Human
ugccugucuuaauaucuggaaa

SEQ ID NO: 978147 - RNA, 22 nt, Human
acugccauuggucaaaugagug

SEQ ID NO: 978148 - RNA, 22 nt, Human
uucuucaaauagcagggaguca

SEQ ID NO: 978149 - RNA, 22 nt, Human
augucuuuggcuuugacauggc

SEQ ID NO: 978150 - RNA, 22 nt, Human
ccaggggaaacagggagcacuc

SEQ ID NO: 978151 - RNA, 22 nt, Human
caaaaguaccuugugugcuuug

SEQ ID NO: 978152 - RNA, 22 nt, Human
caggaaagaaaugagaacacca

SEQ ID NO: 978153 - RNA, 22 nt, Human
uguggcugucuguucuccuagg

SEQ ID NO: 978154 - RNA, 23 nt, Human
ccuucagaagaaguaacaggggc

SEQ ID NO: 978155 - RNA, 19 nt, Human
agucccaggcccgaaagag

SEQ ID NO: 978156 - RNA, 22 nt, Human
gucaaacaaauuaacauaucca

SEQ ID NO: 978157 - RNA, 22 nt, Human
agggagugguuaagaaggugca

SEQ ID NO: 978158 - RNA, 21 nt, Human
cucucugcuuaugaauaguga

SEQ ID NO: 978159 - RNA, 22 nt, Human
ccugccaggcuuugggcuucug

SEQ ID NO: 978160 - RNA, 22 nt, Human
aggacuccauguguccuggaga

SEQ ID NO: 978161 - RNA, 22 nt, Human
ucccagcauaacaaacugcccg

SEQ ID NO: 978162 - RNA, 22 nt, Human
guggccugccgugugguauggg

SEQ ID NO: 978163 - RNA, 22 nt, Human
cagggcugagaauuuagagaca

SEQ ID NO: 978164 - RNA, 22 nt, Human
ucauuucccuccuacaaagagg

SEQ ID NO: 978165 - RNA, 22 nt, Human
uaugaaacauucauacaaauaa

SEQ ID NO: 978166 - RNA, 22 nt, Human
ggaaagagcuaaaagggugaga

SEQ ID NO: 978167 - RNA, 20 nt, Human
uccagaggccacauccagug

SEQ ID NO: 978168 - RNA, 22 nt, Human
aacagacauauuuuuaauaugc

SEQ ID NO: 978169 - RNA, 22 nt, Human
ugauuaacugucuauuaaucau

SEQ ID NO: 978170 - RNA, 22 nt, Human
cagagcugcgcuuuuuccuggu

SEQ ID NO: 978171 - RNA, 22 nt, Human
gugggggcaggcagugcuagga

SEQ ID NO: 978172 - RNA, 22 nt, Human
auagaguccaaaguaugaauau

SEQ ID NO: 978173 - RNA, 19 nt, Human
ccaguagagacagcugcag

SEQ ID NO: 978174 - RNA, 22 nt, Human
aagcagccacuggccaguuaua

SEQ ID NO: 978175 - RNA, 22 nt, Human
gccuggcugggcaccaggggag

SEQ ID NO: 978176 - RNA, 22 nt, Human
aauucaugaguagaaucuauau

SEQ ID NO: 978177 - RNA, 22 nt, Human
ggcuuucuagaucuagcucugu

SEQ ID NO: 978178 - RNA, 22 nt, Human
ggaugcaggaguugaagaagga

SEQ ID NO: 978179 - RNA, 22 nt, Human
aauuuuaagcauaugacugguu

SEQ ID NO: 978180 - RNA, 22 nt, Human
uugcagcugcaguaaauguuca

SEQ ID NO: 978181 - RNA, 22 nt, Human
gcagggacugugaucucacaga

SEQ ID NO: 978182 - RNA, 22 nt, Human
gccagggcucgcggucccucgu

SEQ ID NO: 978183 - RNA, 22 nt, Human
agaggucagauuucuccuggug

SEQ ID NO: 978184 - RNA, 22 nt, Human
ugagaaaagguugagaugauaa

SEQ ID NO: 978185 - RNA, 22 nt, Human
ggcagaagauaggacagggaau

SEQ ID NO: 978186 - RNA, 22 nt, Human
guuuacaaauauuuuaaauggu

SEQ ID NO: 978187 - RNA, 22 nt, Human
ccaggauggggagcagauagaa

SEQ ID NO: 978188 - RNA, 22 nt, Human
accaggggaugguuggcacugu

SEQ ID NO: 978189 - RNA, 22 nt, Human
ccacugucagaggggcugugcc

SEQ ID NO: 978190 - RNA, 22 nt, Human
ccucagcucuucccugugcaca

SEQ ID NO: 978191 - RNA, 22 nt, Human
acucugcuggcugcagggcagc

SEQ ID NO: 978192 - RNA, 22 nt, Human
aaugugaaaccgcacagaauaa

SEQ ID NO: 978193 - RNA, 22 nt, Human
ugaggcaggagguugagaacug

SEQ ID NO: 978194 - RNA, 22 nt, Human
ccugccaggagcuggugcugca

SEQ ID NO: 978195 - RNA, 22 nt, Human
gaauacaugauacaugaacugc

SEQ ID NO: 978196 - RNA, 21 nt, Human
gauuugcagaaacuagacagg

SEQ ID NO: 978197 - RNA, 22 nt, Human
cccucugcucaggugcauaggc

SEQ ID NO: 978198 - RNA, 22 nt, Human
gcuggcuguuggagguaccugc

SEQ ID NO: 978199 - RNA, 22 nt, Human
gucucugcucuagagucuguga

SEQ ID NO: 978200 - RNA, 22 nt, Human
aacaucuuuuuguuugcugaaa

SEQ ID NO: 978201 - RNA, 22 nt, Human
agaaaguucacugguauauuuu

SEQ ID NO: 978202 - RNA, 18 nt, Human
cugggucuccaggcugcc

SEQ ID NO: 978203 - RNA, 22 nt, Human
caggcagcccugcaccaagugu

SEQ ID NO: 978204 - RNA, 22 nt, Human
uucaggauuauacucucuuccc

SEQ ID NO: 978205 - RNA, 19 nt, Human
acccagagcccuuugcagg

SEQ ID NO: 978206 - RNA, 23 nt, Human
ucccagccucuucucuugcauac

SEQ ID NO: 978207 - RNA, 22 nt, Human
uucaggaugaaagugugcaaca

SEQ ID NO: 978208 - RNA, 18 nt, Human
cagaagcaggcagugcag

SEQ ID NO: 978209 - RNA, 22 nt, Human
auauaaagagcuuaguauagug

SEQ ID NO: 978210 - RNA, 22 nt, Human
agaauuuuugauuaucuacucg

SEQ ID NO: 978211 - RNA, 22 nt, Human
gugcauuugugcaugcacaugu

SEQ ID NO: 978212 - RNA, 21 nt, Human
aggugccaaggagaagcaggc

SEQ ID NO: 978213 - RNA, 22 nt, Human
uggccuuccuggugacucauga

SEQ ID NO: 978214 - RNA, 22 nt, Human
ucauuucucccggccaaaaacu

SEQ ID NO: 978215 - RNA, 17 nt, Human
cugagcauccgugcucu

SEQ ID NO: 978216 - RNA, 22 nt, Human
agcuguucccucacugcaguca

SEQ ID NO: 978217 - RNA, 22 nt, Human
caacauuucaaggucuuuagga

SEQ ID NO: 978218 - RNA, 22 nt, Human
cugagauggccacugggucuca

SEQ ID NO: 978219 - RNA, 22 nt, Human
ugagccuggccugcagagacca

SEQ ID NO: 978220 - RNA, 22 nt, Human
cuggcucauccagguguugcuc

SEQ ID NO: 978221 - RNA, 22 nt, Human
aggggagguggcagaaaugugc

SEQ ID NO: 978222 - RNA, 22 nt, Human
aaaguucagugccuucuauaca

SEQ ID NO: 978223 - RNA, 22 nt, Human
uucuaaagugcaaucugacaga

SEQ ID NO: 978224 - RNA, 22 nt, Human
uccuuucaccaaaaaguguugu

SEQ ID NO: 978225 - RNA, 22 nt, Human
uccagggcuuggcugggacggu

SEQ ID NO: 978226 - RNA, 21 nt, Human
gcugcugccccuagugaggcc

SEQ ID NO: 978227 - RNA, 22 nt, Human
gccuggagaccugcuccucuac

SEQ ID NO: 978228 - RNA, 22 nt, Human
cguuggagacacuugaggacuu

SEQ ID NO: 978229 - RNA, 22 nt, Human
uuuauuugucuugccauuuagu

SEQ ID NO: 978230 - RNA, 22 nt, Human
cuccuggaggauagugacuggg

SEQ ID NO: 978231 - RNA, 22 nt, Human
ggccacaacuugcuccuagccc

SEQ ID NO: 978232 - RNA, 22 nt, Human
guuguuuugcaggauccuuaca

SEQ ID NO: 978233 - RNA, 20 nt, Human
uuucugugcccaggucuguu

SEQ ID NO: 978234 - RNA, 22 nt, Human
ccagcugauucgguggugguug

SEQ ID NO: 978235 - RNA, 22 nt, Human
gcugcuggcaucuagggggugg

SEQ ID NO: 978236 - RNA, 20 nt, Human
ugcagagcuggcuggcuccu

SEQ ID NO: 978237 - RNA, 22 nt, Human
uacucagagucauugcccuucu

SEQ ID NO: 978238 - RNA, 22 nt, Human
aacaugcugccuuucuacgagu

SEQ ID NO: 978239 - RNA, 22 nt, Human
ucccaggacccaggcauucaca

SEQ ID NO: 978240 - RNA, 22 nt, Human
aguggugcugcgcgcggagcuc

SEQ ID NO: 978241 - RNA, 22 nt, Human
cacauugaaaugacccaauaau

SEQ ID NO: 978242 - RNA, 22 nt, Human
gcaggcuggaggcuguucuggg

SEQ ID NO: 978243 - RNA, 22 nt, Human
cucccuggugacucccaaagcu

SEQ ID NO: 978244 - RNA, 22 nt, Human
ugaaauguguaauguggaugcc

SEQ ID NO: 978245 - RNA, 22 nt, Human
caggccugacccugagcuucac

SEQ ID NO: 978246 - RNA, 22 nt, Human
aguggcaggaaaguggaagaga

SEQ ID NO: 978247 - RNA, 22 nt, Human
gucccucugugucccugcaguc

SEQ ID NO: 978248 - RNA, 22 nt, Human
gcguggugcugcccugcacaca

SEQ ID NO: 978249 - RNA, 22 nt, Human
gugcugcucacaucuggaggua

SEQ ID NO: 978250 - RNA, 22 nt, Human
uggagcaggaagucuauggcug

SEQ ID NO: 978251 - RNA, 22 nt, Human
acaugcauucucuaaaagcaaa

SEQ ID NO: 978252 - RNA, 22 nt, Human
augaguaagaccauaauuuuug

SEQ ID NO: 978253 - RNA, 22 nt, Human
guaagagcacugucuccugcug

SEQ ID NO: 978254 - RNA, 21 nt, Human
ucuugaaaauuguagcaguuu

SEQ ID NO: 978255 - RNA, 22 nt, Human
aggaaaaaccuguuaaugguag

SEQ ID NO: 978256 - RNA, 22 nt, Human
cagcugccuguauuguccucau

SEQ ID NO: 978257 - RNA, 22 nt, Human
gacaggguacgggcuaggcaca

SEQ ID NO: 978258 - RNA, 23 nt, Human
aggaacugaggccuagggaggua

SEQ ID NO: 978259 - RNA, 22 nt, Human
aggccucacauugggcuucaag

SEQ ID NO: 978260 - RNA, 22 nt, Human
agagcugcaggguggacccagg

SEQ ID NO: 978261 - RNA, 22 nt, Human
ccugucuggaacauggccuguu

SEQ ID NO: 978262 - RNA, 22 nt, Human
agcugcccugguaagauugaug

SEQ ID NO: 978263 - RNA, 22 nt, Human
caggauccccaggucgccgucc

SEQ ID NO: 978264 - RNA, 22 nt, Human
cauugcucaggcccagcaggaa

SEQ ID NO: 978265 - RNA, 22 nt, Human
guucuucagaggggaaagaacc

SEQ ID NO: 978266 - RNA, 22 nt, Human
agagaacacgugcaucugcaau

SEQ ID NO: 978267 - RNA, 22 nt, Human
ggcagcugggucacaccgaucu

SEQ ID NO: 978268 - RNA, 22 nt, Human
gcuguggccaacaaaccacuuu

SEQ ID NO: 978269 - RNA, 22 nt, Human
aauccaggguguggccuuucca

SEQ ID NO: 978270 - RNA, 22 nt, Human
aggcuuccgaguagcugggacu

SEQ ID NO: 978271 - RNA, 22 nt, Human
ugucuucaguaaaauacacuau

SEQ ID NO: 978272 - RNA, 20 nt, Human
ucagggcaugggacagcccc

SEQ ID NO: 978273 - RNA, 22 nt, Human
uaugcauagguaucuauacuca

SEQ ID NO: 978274 - RNA, 22 nt, Human
ggcacugaucugauuucccucc

SEQ ID NO: 978275 - RNA, 22 nt, Human
ucucagggccucccucuguuuc

SEQ ID NO: 978276 - RNA, 22 nt, Human
uaggaggguuagagggaaauau

SEQ ID NO: 978277 - RNA, 22 nt, Human
uggugcuguggaggggcagaag

SEQ ID NO: 978278 - RNA, 22 nt, Human
ggccucucuggcauggcugccc

SEQ ID NO: 978279 - RNA, 22 nt, Human
gcuguucacauuuugggccaaa

SEQ ID NO: 978280 - RNA, 22 nt, Human
uuuaggaucaaugagaaagucu

SEQ ID NO: 978281 - RNA, 22 nt, Human
gcaggggaguccacucuaugca

SEQ ID NO: 978282 - RNA, 19 nt, Human
ugucucagugucccuuccu

SEQ ID NO: 978283 - RNA, 22 nt, Human
auuucugauaaacguaagcugc

SEQ ID NO: 978284 - RNA, 22 nt, Human
uccucagcaaacacuucacucu

SEQ ID NO: 978285 - RNA, 22 nt, Human
uuucauaauagugcaguuuguu

SEQ ID NO: 978286 - RNA, 22 nt, Human
gcuggccauauauuuugcuguu

SEQ ID NO: 978287 - RNA, 22 nt, Human
caggacagagcccagacugugu

SEQ ID NO: 978288 - RNA, 22 nt, Human
agcugcccuucucuugcccuug

SEQ ID NO: 978289 - RNA, 22 nt, Human
gggaaggagguggcuugaagug

SEQ ID NO: 978290 - RNA, 22 nt, Human
agcagcauuaugauauaucuua

SEQ ID NO: 978291 - RNA, 22 nt, Human
gugcagggagcccagaaggucc

SEQ ID NO: 978292 - RNA, 22 nt, Human
uuucaaacauaucuucauuacu

SEQ ID NO: 978293 - RNA, 22 nt, Human
ccagggcaggggcuggaguuca

SEQ ID NO: 978294 - RNA, 22 nt, Human
ccugucugaggaggugcucuuu

SEQ ID NO: 978295 - RNA, 22 nt, Human
gccuggagaaaggaagguggga

SEQ ID NO: 978296 - RNA, 22 nt, Human
gucuggggaagucagggcauca

SEQ ID NO: 978297 - RNA, 22 nt, Human
uagcacaggucuuguugccauu

SEQ ID NO: 978298 - RNA, 22 nt, Human
uccuucuuucccccuagucauu

SEQ ID NO: 978299 - RNA, 22 nt, Human
ucccagcauuaaugccugucag

SEQ ID NO: 978300 - RNA, 22 nt, Human
acaggcucucagccaguuggca

SEQ ID NO: 978301 - RNA, 22 nt, Human
cucuucuugcuagacugagugc

SEQ ID NO: 978302 - RNA, 22 nt, Human
gcauuguccugcuucugagugu

SEQ ID NO: 978303 - RNA, 22 nt, Human
gggaagggagggaccucagucu

SEQ ID NO: 978304 - RNA, 22 nt, Human
auaagguaugaaaaguaaaugg

SEQ ID NO: 978305 - RNA, 22 nt, Human
augaagcugaccuugucuugcu

SEQ ID NO: 978306 - RNA, 22 nt, Human
ugcccaggaucuggcgaugcuc

SEQ ID NO: 978307 - RNA, 22 nt, Human
cccaggcugaguuagagguguc

SEQ ID NO: 978308 - RNA, 22 nt, Human
caguggccaugguggcaggggu

SEQ ID NO: 978309 - RNA, 22 nt, Human
aagacauuacuggaaucugacu

SEQ ID NO: 978310 - RNA, 22 nt, Human
agaucaaagccaugagagauuu

SEQ ID NO: 978311 - RNA, 22 nt, Human
ugcuggguuaccuaagccuaaa

SEQ ID NO: 978312 - RNA, 22 nt, Human
ugcugccuuugggaccuggccu

SEQ ID NO: 978313 - RNA, 22 nt, Human
ccugccuggcugucagcagagc

SEQ ID NO: 978314 - RNA, 22 nt, Human
caguacuuguccucagguguua

SEQ ID NO: 978315 - RNA, 21 nt, Human
uggcucuguucaauauaugga

SEQ ID NO: 978316 - RNA, 22 nt, Human
ucaaaacacuauuaccuuuaau

SEQ ID NO: 978317 - RNA, 22 nt, Human
ucugcagguguuggaaggguca

SEQ ID NO: 978318 - RNA, 22 nt, Human
uccaggagguaugaguggcccc

SEQ ID NO: 978319 - RNA, 22 nt, Human
aagcuguucucuaaguuucaug

SEQ ID NO: 978320 - RNA, 22 nt, Human
ucccagccacagguguagcccu

SEQ ID NO: 978321 - RNA, 22 nt, Human
cuucaagagaaugcagggaugu

SEQ ID NO: 978322 - RNA, 22 nt, Human
gugguaaucggauucuuaccgg

SEQ ID NO: 978323 - RNA, 22 nt, Human
cuuaaauuggaugaguuaaguu

SEQ ID NO: 978324 - RNA, 20 nt, Human
cuucaggacccauccucccc

SEQ ID NO: 978325 - RNA, 22 nt, Human
cagucccagaagagccugggag

SEQ ID NO: 978326 - RNA, 22 nt, Human
cucugggcaaagaugccucauc

SEQ ID NO: 978327 - RNA, 22 nt, Human
uguauuuugugaggaucacucu

SEQ ID NO: 978328 - RNA, 22 nt, Human
auauuccauugguuucccuucu

SEQ ID NO: 978329 - RNA, 22 nt, Human
cauguuuucuaggcuuucacaa

SEQ ID NO: 978330 - RNA, 22 nt, Human
ucugucacccgagcaggcgaga

SEQ ID NO: 978331 - RNA, 22 nt, Human
gcuaccugagcaagagcuucaa

SEQ ID NO: 978332 - RNA, 22 nt, Human
gugccuggagcuaauguguaua

SEQ ID NO: 978333 - RNA, 20 nt, Human
gucagugucuucaguaguga

SEQ ID NO: 978334 - RNA, 22 nt, Human
gcagcugcaauaggcaucaagc

SEQ ID NO: 978335 - RNA, 22 nt, Human
uauauuuaaauccagguugaaa

SEQ ID NO: 978336 - RNA, 22 nt, Human
gcagggcagcuuagucccuguc

SEQ ID NO: 978337 - RNA, 22 nt, Human
gugacagaguuuuagaucucau

SEQ ID NO: 978338 - RNA, 22 nt, Human
agcagccagagucugaacauua

SEQ ID NO: 978339 - RNA, 22 nt, Human
uuguuuuuaugaacauccagga

SEQ ID NO: 978340 - RNA, 19 nt, Human
ugcauaaauuauauacuuu

SEQ ID NO: 978341 - RNA, 22 nt, Human
ucuaagccuaggaaaugaguuu

SEQ ID NO: 978342 - RNA, 22 nt, Human
cagagacccuaggcaggugaca

SEQ ID NO: 978343 - RNA, 22 nt, Human
uuucaaagguggaagagugaau

SEQ ID NO: 978344 - RNA, 20 nt, Human
agugacagagacuguguggc

SEQ ID NO: 978345 - RNA, 22 nt, Human
gagagugagauaauuucacaua

SEQ ID NO: 978346 - RNA, 22 nt, Human
gcugccacucugagcuugcuuc

SEQ ID NO: 978347 - RNA, 22 nt, Human
aguuuuauuccaaugugcagca

SEQ ID NO: 978348 - RNA, 22 nt, Human
acugaaggaaagccuuugcaug

SEQ ID NO: 978349 - RNA, 19 nt, Human
gaggcgaggcgugcaggag

SEQ ID NO: 978350 - RNA, 18 nt, Human
cugagggcagccccuggg

SEQ ID NO: 978351 - RNA, 18 nt, Human
gccugccuagagcuugcc

SEQ ID NO: 978352 - RNA, 22 nt, Human
aaaauuauggaguaucccaaag

SEQ ID NO: 978353 - RNA, 22 nt, Human
cuaccuuucugacucuugggau

SEQ ID NO: 978354 - RNA, 20 nt, Human
ggucccugcccucugucauc

SEQ ID NO: 978355 - RNA, 22 nt, Human
ucuguucagaauuguaacacuc

SEQ ID NO: 978356 - RNA, 22 nt, Human
aagcuggagaguuaggugaaua

SEQ ID NO: 978357 - RNA, 22 nt, Human
agagagagggaaacugcuaaac

SEQ ID NO: 978358 - RNA, 22 nt, Human
uuucauuauaaaaaguuggcuu

SEQ ID NO: 978359 - RNA, 22 nt, Human
cagaguggcgacccccucagcu

SEQ ID NO: 978360 - RNA, 22 nt, Human
agaugaagauaucugcaggggc

SEQ ID NO: 978361 - RNA, 19 nt, Human
ggcuccuguggcugcagcc

SEQ ID NO: 978362 - RNA, 18 nt, Human
uccagcgugcuccagggc

SEQ ID NO: 978363 - RNA, 22 nt, Human
cucagaguccauaguuuacagu

SEQ ID NO: 978364 - RNA, 22 nt, Human
aaagcucuuuuccaaguauuga

SEQ ID NO: 978365 - RNA, 22 nt, Human
ugucccagguccuagaugacca

SEQ ID NO: 978366 - RNA, 22 nt, Human
gcugccuguguggccacucacu

SEQ ID NO: 978367 - RNA, 22 nt, Human
uuucaauguaacauuuccaggc

SEQ ID NO: 978368 - RNA, 22 nt, Human
gucauuucuguuucuucagugc

SEQ ID NO: 978369 - RNA, 18 nt, Human
aucuuuccauagcauguu

SEQ ID NO: 978370 - RNA, 22 nt, Human
cagagcugucauuugccaguga

SEQ ID NO: 978371 - RNA, 22 nt, Human
uauuccaaaaucccaaacugcc

SEQ ID NO: 978372 - RNA, 22 nt, Human
ccuugggauuucucaugccaau

SEQ ID NO: 978373 - RNA, 22 nt, Human
aaaacauucugugaacucucaa

SEQ ID NO: 978374 - RNA, 22 nt, Human
uggcaguggcucagagugcaga

SEQ ID NO: 978375 - RNA, 21 nt, Human
cagaggcagguccugggacgg

SEQ ID NO: 978376 - RNA, 22 nt, Human
cccaggucugugccagcucuga

SEQ ID NO: 978377 - RNA, 22 nt, Human
ccaaggagaaugacaccaugga

SEQ ID NO: 978378 - RNA, 22 nt, Human
uggcucaggccuacgacgccuu

SEQ ID NO: 978379 - RNA, 22 nt, Human
ggugacuggagggacccaggcc

SEQ ID NO: 978380 - RNA, 22 nt, Human
cucucugaggcaggccuguggg

SEQ ID NO: 978381 - RNA, 22 nt, Human
uggcaccagcaccuagaugggg

SEQ ID NO: 978382 - RNA, 22 nt, Human
gauuaggagggagaggcaagua

SEQ ID NO: 978383 - RNA, 22 nt, Human
acucugagcaucccaagucuua

SEQ ID NO: 978384 - RNA, 22 nt, Human
uugaaauggaagugaaaauucu

SEQ ID NO: 978385 - RNA, 22 nt, Human
caggggcugugggcggagccuc

SEQ ID NO: 978386 - RNA, 22 nt, Human
ccacacugaaccucagugucuu

SEQ ID NO: 978387 - RNA, 22 nt, Human
caaggccaagucucugugaaga

SEQ ID NO: 978388 - RNA, 21 nt, Human
acuguucauuugaugaacugg

SEQ ID NO: 978389 - RNA, 23 nt, Human
ucuggcucuaugugacagcucuc

SEQ ID NO: 978390 - RNA, 20 nt, Human
uacuugaauguugcagcagu

SEQ ID NO: 978391 - RNA, 22 nt, Human
ucaccuuagcuagaggaagaga

SEQ ID NO: 978392 - RNA, 22 nt, Human
auuuguaauuucuuaucugugu

SEQ ID NO: 978393 - RNA, 20 nt, Human
ucugucucugagcuagacuu

SEQ ID NO: 978394 - RNA, 22 nt, Human
ggagcuguaacgagccauugcu

SEQ ID NO: 978395 - RNA, 22 nt, Human
cuguucauggaaaaauaguugg

SEQ ID NO: 978396 - RNA, 22 nt, Human
uagaauauacacuacagcuuaa

SEQ ID NO: 978397 - RNA, 22 nt, Human
auugacaauguauuuguaucug

SEQ ID NO: 978398 - RNA, 21 nt, Human
acccuggguucuccauacccu

SEQ ID NO: 978399 - RNA, 22 nt, Human
uucuuaagcaccuaaaaagugg

SEQ ID NO: 978400 - RNA, 22 nt, Human
cuuuguauucaguugggcugug

SEQ ID NO: 978401 - RNA, 22 nt, Human
cacugcucgcugcagcauggcc

SEQ ID NO: 978402 - RNA, 22 nt, Human
ucaagagauugaauaauaacug

SEQ ID NO: 978403 - RNA, 22 nt, Human
accucugcaaugcaaugucaug

SEQ ID NO: 978404 - RNA, 22 nt, Human
caggggcuguuugccucaggcc

SEQ ID NO: 978405 - RNA, 22 nt, Human
ugaaaucaauugcaauguuuau

SEQ ID NO: 978406 - RNA, 22 nt, Human
accaugggucagccaccucagc

SEQ ID NO: 978407 - RNA, 22 nt, Human
ugagaguauuuuggcauuauca

SEQ ID NO: 978408 - RNA, 22 nt, Human
aaugucaaaggcuauacauuca

SEQ ID NO: 978409 - RNA, 22 nt, Human
ucugccuggguguggagcagag

SEQ ID NO: 978410 - RNA, 22 nt, Human
augggugugaaaauggucaucu

SEQ ID NO: 978411 - RNA, 22 nt, Human
aagaacauuuaugauggcauuu

SEQ ID NO: 978412 - RNA, 22 nt, Human
cccagggaagccauuucugacu

SEQ ID NO: 978413 - RNA, 22 nt, Human
caaaaguaauugugguuuuugc

SEQ ID NO: 978414 - RNA, 22 nt, Human
caaauucucaagguuuauccca

SEQ ID NO: 978415 - RNA, 22 nt, Human
agaggcugcacuugcucaugau

SEQ ID NO: 978416 - RNA, 22 nt, Human
agagcugaauuuggguggugga

SEQ ID NO: 978417 - RNA, 22 nt, Human
ucccuggcugggggcugccuug

SEQ ID NO: 978418 - RNA, 22 nt, Human
gauuucaaccuaacaguaugac

SEQ ID NO: 978419 - RNA, 22 nt, Human
agaggggaggcgaaccagaguc

SEQ ID NO: 978420 - RNA, 19 nt, Human
uggcuuccaucucucucau

SEQ ID NO: 978421 - RNA, 22 nt, Human
cacagaguggaggcuuggccug

SEQ ID NO: 978422 - RNA, 22 nt, Human
uuggccaauccuauuggguggg

SEQ ID NO: 978423 - RNA, 22 nt, Human
gcaggaguguggugggacaucc

SEQ ID NO: 978424 - RNA, 22 nt, Human
ggaaagaccugagauaggaaua

SEQ ID NO: 978425 - RNA, 22 nt, Human
ggcuucucucccccagcuccac

SEQ ID NO: 978426 - RNA, 20 nt, Human
acauguacuaaugaauacag

SEQ ID NO: 978427 - RNA, 22 nt, Human
uauauuaaagugcuuugcagug

SEQ ID NO: 978428 - RNA, 22 nt, Human
acaggcagcacuaaucucuggu

SEQ ID NO: 978429 - RNA, 22 nt, Human
agcgagggaggucugaggacag

SEQ ID NO: 978430 - RNA, 22 nt, Human
cuugaaagcacuuaguaaauua

SEQ ID NO: 978431 - RNA, 21 nt, Human
ucucuacacuuucacuaggcu

SEQ ID NO: 978432 - RNA, 22 nt, Human
caagggcucuuuugaggaaugu

SEQ ID NO: 978433 - RNA, 22 nt, Human
cuccuggacauggagcggagga

SEQ ID NO: 978434 - RNA, 22 nt, Human
uccaggagcauccaggugaagc

SEQ ID NO: 978435 - RNA, 22 nt, Human
uaagacauuugaaaugugaucc

SEQ ID NO: 978436 - RNA, 22 nt, Human
gcugccaugguccaggcuccag

SEQ ID NO: 978437 - RNA, 22 nt, Human
ucugagaguccaucuccaagcc

SEQ ID NO: 978438 - RNA, 22 nt, Human
acaggggcuccgaaggugaggg

SEQ ID NO: 978439 - RNA, 22 nt, Human
ucagaggaaaggucagauggcu

SEQ ID NO: 978440 - RNA, 22 nt, Human
ggcaugggguguauguggcacg

SEQ ID NO: 978441 - RNA, 22 nt, Human
augugucuuucaagguauagaa

SEQ ID NO: 978442 - RNA, 18 nt, Human
auggucucauacugggag

SEQ ID NO: 978443 - RNA, 20 nt, Human
gccugcagguuggaugggau

SEQ ID NO: 978444 - RNA, 22 nt, Human
uuccaaagucauguugcugaua

SEQ ID NO: 978445 - RNA, 22 nt, Human
aaggucauuuaacaauuuauga

SEQ ID NO: 978446 - RNA, 20 nt, Human
cucuccucacccgugucagg

SEQ ID NO: 978447 - RNA, 22 nt, Human
uuugaaaaaggccuuugguaug

SEQ ID NO: 978448 - RNA, 22 nt, Human
cagcuuccaucuccacugcccu

SEQ ID NO: 978449 - RNA, 22 nt, Human
aaaaguaauugaugcaaucgua

SEQ ID NO: 978450 - RNA, 18 nt, Human
ccuggaccugucuccuuu

SEQ ID NO: 978451 - RNA, 22 nt, Human
ggugggcaacauuuggccugag

SEQ ID NO: 978452 - RNA, 22 nt, Human
agaugaaaagauaagcagcaau

SEQ ID NO: 978453 - RNA, 22 nt, Human
ccacagaguuacaaaacaguca

SEQ ID NO: 978454 - RNA, 22 nt, Human
aagcagccuggcaugaugcuuu

SEQ ID NO: 978455 - RNA, 22 nt, Human
caggcagcucuaauggaaagug

SEQ ID NO: 978456 - RNA, 22 nt, Human
cucugagcugaaacaugagcau

SEQ ID NO: 978457 - RNA, 22 nt, Human
cuucuggaggacacuggcccca

SEQ ID NO: 978458 - RNA, 17 nt, Human
ccuuucucuuucaucuc

SEQ ID NO: 978459 - RNA, 22 nt, Human
caauguguuugcauauuaaaau

SEQ ID NO: 978460 - RNA, 22 nt, Human
ccaggccagcaggcacaccugc

SEQ ID NO: 978461 - RNA, 22 nt, Human
auuucccagcuuugaucaguuu

SEQ ID NO: 978462 - RNA, 22 nt, Human
acucuggcccuccugcugccag

SEQ ID NO: 978463 - RNA, 22 nt, Human
gcucugcugucuucuugcaggc

SEQ ID NO: 978464 - RNA, 22 nt, Human
caucaucaaaagugacagagaa

SEQ ID NO: 978465 - RNA, 22 nt, Human
uggcuccuaucaaggagugggu

SEQ ID NO: 978466 - RNA, 17 nt, Human
uguagcuucuccuucuc

SEQ ID NO: 978467 - RNA, 22 nt, Human
aggauguugcuauuggcagucu

SEQ ID NO: 978468 - RNA, 22 nt, Human
ugccagcccaccuuggggccuc

SEQ ID NO: 978469 - RNA, 22 nt, Human
uggagacucugcaucugugaca

SEQ ID NO: 978470 - RNA, 22 nt, Human
aagaaaugcagaaaugugcugg

SEQ ID NO: 978471 - RNA, 22 nt, Human
agccagcucccuccccugcagg

SEQ ID NO: 978472 - RNA, 22 nt, Human
uuuauuuggcauccagggagaa

SEQ ID NO: 978473 - RNA, 22 nt, Human
auacagauguugaauguuauau

SEQ ID NO: 978474 - RNA, 22 nt, Human
agcucugggccaggaacccuaa

SEQ ID NO: 978475 - RNA, 22 nt, Human
cugguacaaaaugcugauauca

SEQ ID NO: 978476 - RNA, 22 nt, Human
uauucacauguacauaugcuca

SEQ ID NO: 978477 - RNA, 22 nt, Human
uguguuauugccacugaagacc

SEQ ID NO: 978478 - RNA, 22 nt, Human
gcuccuggugcuguagagauuu

SEQ ID NO: 978479 - RNA, 22 nt, Human
gggcagcucuggcugugggaag

SEQ ID NO: 978480 - RNA, 22 nt, Human
agaaggccuaacuugggggcaa

SEQ ID NO: 978481 - RNA, 22 nt, Human
cagauccaucucucagaaagag

SEQ ID NO: 978482 - RNA, 22 nt, Human
uacuuuuugucucuuugaaugu

SEQ ID NO: 978483 - RNA, 22 nt, Human
uuggccaagauacgagcacaua

SEQ ID NO: 978484 - RNA, 22 nt, Human
acucagaaugacugaugcugug

SEQ ID NO: 978485 - RNA, 22 nt, Human
uacauguaagacaugagacucu

SEQ ID NO: 978486 - RNA, 22 nt, Human
uuaaaaugcagauucugauuca

SEQ ID NO: 978487 - RNA, 22 nt, Human
cuggcucacaggugagaugcau

SEQ ID NO: 978488 - RNA, 22 nt, Human
gcucccagacugaccagaggug

SEQ ID NO: 978489 - RNA, 22 nt, Human
cuuguaaaagguacauuaugcu

SEQ ID NO: 978490 - RNA, 22 nt, Human
cagucccaugagcccagaacau

SEQ ID NO: 978491 - RNA, 22 nt, Human
agagggcagggcgguaaguccu

SEQ ID NO: 978492 - RNA, 22 nt, Human
cuggccacugguggucauaggc

SEQ ID NO: 978493 - RNA, 19 nt, Human
ggucagcugggcuagaggc

SEQ ID NO: 978494 - RNA, 22 nt, Human
auaucaaacgaaguuauuuuaa

SEQ ID NO: 978495 - RNA, 17 nt, Human
ucaugcccaacuauuac

SEQ ID NO: 978496 - RNA, 22 nt, Human
ccaugagccaggcugaggaagc

SEQ ID NO: 978497 - RNA, 22 nt, Human
agcauuuaugacuaauguaaaa

SEQ ID NO: 978498 - RNA, 22 nt, Human
ucagagaaguaagguggggugc

SEQ ID NO: 978499 - RNA, 22 nt, Human
gugccugugcggacucagggaa

SEQ ID NO: 978500 - RNA, 22 nt, Human
ggcugcagaaguacuuccggau

SEQ ID NO: 978501 - RNA, 22 nt, Human
ucuccuggcaugugggucaucu

SEQ ID NO: 978502 - RNA, 22 nt, Human
gaguguucccacaccccaguug

SEQ ID NO: 978503 - RNA, 22 nt, Human
gaaggaagugcucauacuaguu

SEQ ID NO: 978504 - RNA, 22 nt, Human
gcuggcagaagagcugguucaa

SEQ ID NO: 978505 - RNA, 22 nt, Human
aguguccccuccaagggccugg

SEQ ID NO: 978506 - RNA, 22 nt, Human
agcugcccagcuaggaagaagg

SEQ ID NO: 978507 - RNA, 22 nt, Human
agaauaaauguuggacuuagga

SEQ ID NO: 978508 - RNA, 22 nt, Human
guacucucuugaaggccuuucu

SEQ ID NO: 978509 - RNA, 22 nt, Human
uuccaggacaagauguuucagg

SEQ ID NO: 978510 - RNA, 22 nt, Human
ucaaauaugugauagaagcuaa

SEQ ID NO: 978511 - RNA, 22 nt, Human
aaucuauucccuuucuguaaaa

SEQ ID NO: 978512 - RNA, 22 nt, Human
aauauguucaaaauagaucacu

SEQ ID NO: 978513 - RNA, 22 nt, Human
gugcucaggaagcuguuccugc

SEQ ID NO: 978514 - RNA, 22 nt, Human
guggagacuucuacuagagacc

SEQ ID NO: 978515 - RNA, 23 nt, Human
cagggcugguagggaagagcgug

SEQ ID NO: 978516 - RNA, 22 nt, Human
caguguuccaggcggcagugaa

SEQ ID NO: 978517 - RNA, 19 nt, Human
ccauggcaaugaucugaug

SEQ ID NO: 978518 - RNA, 22 nt, Human
cagggguggcugcagcagaggu

SEQ ID NO: 978519 - RNA, 22 nt, Human
gcaguccucucauuggccuccu

SEQ ID NO: 978520 - RNA, 22 nt, Human
uucauucuuauuugugaucugg

SEQ ID NO: 978521 - RNA, 23 nt, Human
cauaaaauauuaguaugguagca

SEQ ID NO: 978522 - RNA, 22 nt, Human
uugugucuuaaagauuaaaugg

SEQ ID NO: 978523 - RNA, 22 nt, Human
uuaugacauaugaguacaagua

SEQ ID NO: 978524 - RNA, 20 nt, Human
uguuaaaggacacuugcuuu

SEQ ID NO: 978525 - RNA, 22 nt, Human
ugggccugaaggagcugcgccc

SEQ ID NO: 978526 - RNA, 17 nt, Human
acagaggcaggagugga

SEQ ID NO: 978527 - RNA, 22 nt, Human
uagggcaggugaagaaaagcua

SEQ ID NO: 978528 - RNA, 22 nt, Human
cagagcagucuggagauccagc

SEQ ID NO: 978529 - RNA, 22 nt, Human
cuccaggggccagaagccuggc

SEQ ID NO: 978530 - RNA, 22 nt, Human
ccugaagaugcuguggccuggu

SEQ ID NO: 978531 - RNA, 19 nt, Human
aucugccuguuaucacaua

SEQ ID NO: 978532 - RNA, 22 nt, Human
aaugagcuagaccugcuuccuc

SEQ ID NO: 978533 - RNA, 22 nt, Human
ucagccugcgucauggugacac

SEQ ID NO: 978534 - RNA, 22 nt, Human
cuguccuaugaguacucacuag

SEQ ID NO: 978535 - RNA, 22 nt, Human
gaggccacaguccugaggcauc

SEQ ID NO: 978536 - RNA, 22 nt, Human
caaaugcuaacuucuuuccaaa

SEQ ID NO: 978537 - RNA, 22 nt, Human
agcaacagcccugagguucaug

SEQ ID NO: 978538 - RNA, 22 nt, Human
gcaaggcugagcacauuugcau

SEQ ID NO: 978539 - RNA, 18 nt, Human
cugaggccaacuacacug

SEQ ID NO: 978540 - RNA, 22 nt, Human
aggccucuucagggagcaugga

SEQ ID NO: 978541 - RNA, 22 nt, Human
cauacauugcucauucaguauc

SEQ ID NO: 978542 - RNA, 23 nt, Human
uggcucugagagguucagaugcu

SEQ ID NO: 978543 - RNA, 22 nt, Human
agggccagagucuguguagaua

SEQ ID NO: 978544 - RNA, 22 nt, Human
aaggccagccugagagcuaaca

SEQ ID NO: 978545 - RNA, 22 nt, Human
aaggcaguaggaucuuccacag

SEQ ID NO: 978546 - RNA, 22 nt, Human
ggcuauguggucauauaagaua

SEQ ID NO: 978547 - RNA, 22 nt, Human
agggggugcuacuuccagaguu

SEQ ID NO: 978548 - RNA, 22 nt, Human
acaaagugcacaagaugagaac

SEQ ID NO: 978549 - RNA, 22 nt, Human
ugcagggcccuugggguugaac

SEQ ID NO: 978550 - RNA, 22 nt, Human
ugacaguuaagguauacauuca

SEQ ID NO: 978551 - RNA, 22 nt, Human
cccaggaggcagagguuggagc

SEQ ID NO: 978552 - RNA, 22 nt, Human
ccaggagaugauguuggggauu

SEQ ID NO: 978553 - RNA, 22 nt, Human
uaugcacauucacacaaaaaug

SEQ ID NO: 978554 - RNA, 22 nt, Human
cauguuaaugaauuuuugcagu

SEQ ID NO: 978555 - RNA, 22 nt, Human
uuuggaaaguguacaaauuuga

SEQ ID NO: 978556 - RNA, 17 nt, Human
uguggccuucugagcuu

SEQ ID NO: 978557 - RNA, 22 nt, Human
ugcaauaacccaguaucuguga

SEQ ID NO: 978558 - RNA, 22 nt, Human
cccagaggugcuucagaggugc

SEQ ID NO: 978559 - RNA, 22 nt, Human
ggcagcaguggcugcuauuguc

SEQ ID NO: 978560 - RNA, 22 nt, Human
agugcuguuagguuaauauagu

SEQ ID NO: 978561 - RNA, 22 nt, Human
ugcaaacaggagaguaaguaua

SEQ ID NO: 978562 - RNA, 22 nt, Human
aaaagacauaugugggcauucu

SEQ ID NO: 978563 - RNA, 22 nt, Human
uagaaaugcaguguacuguguc

SEQ ID NO: 978564 - RNA, 22 nt, Human
caguagcagggauuauuuuagg

SEQ ID NO: 978565 - RNA, 22 nt, Human
ugugucuguguauacacggcau

SEQ ID NO: 978566 - RNA, 22 nt, Human
acuucuucuucagcugggggau

SEQ ID NO: 978567 - RNA, 22 nt, Human
caaauguguaaggaaguguuag

SEQ ID NO: 978568 - RNA, 22 nt, Human
cagccagccucucaaccaugca

SEQ ID NO: 978569 - RNA, 22 nt, Human
uugaggaguguuuagggugagg

SEQ ID NO: 978570 - RNA, 22 nt, Human
agugacugacaccuguaauccc

SEQ ID NO: 978571 - RNA, 22 nt, Human
ggcacucagagauucaggcugu

SEQ ID NO: 978572 - RNA, 22 nt, Human
ugagagugauugguucgaaugu

SEQ ID NO: 978573 - RNA, 22 nt, Human
gggcagauggggcacaggcuga

SEQ ID NO: 978574 - RNA, 22 nt, Human
uugagcacaacucuuggagagc

SEQ ID NO: 978575 - RNA, 22 nt, Human
uuucuaaaugguggcugcauug

SEQ ID NO: 978576 - RNA, 22 nt, Human
uugcauguuauuuaaucuguau

SEQ ID NO: 978577 - RNA, 22 nt, Human
caagccucagaaucuucuccau

SEQ ID NO: 978578 - RNA, 22 nt, Human
aucaguuugagugcugugucaa

SEQ ID NO: 978579 - RNA, 19 nt, Human
ucuggcuccgccucuuagu

SEQ ID NO: 978580 - RNA, 22 nt, Human
cagauggcauuuccuuucuggc

SEQ ID NO: 978581 - RNA, 22 nt, Human
cagaguucaaagccugcuggga

SEQ ID NO: 978582 - RNA, 22 nt, Human
acagacagauuuugucugaugu

SEQ ID NO: 978583 - RNA, 22 nt, Human
cagagccaggguugcaccccug

SEQ ID NO: 978584 - RNA, 22 nt, Human
aagagcugcaucuaagccauga

SEQ ID NO: 978585 - RNA, 18 nt, Human
agugugugcccuuucagg

SEQ ID NO: 978586 - RNA, 22 nt, Human
acagguggggaggcugagguuc

SEQ ID NO: 978587 - RNA, 22 nt, Human
auucaguuaaaaacuguacuuc

SEQ ID NO: 978588 - RNA, 22 nt, Human
aucaguuuaaaugggcuguugg

SEQ ID NO: 978589 - RNA, 22 nt, Human
gcaccugcaggaugagccaggg

SEQ ID NO: 978590 - RNA, 22 nt, Human
agccucucuccagcuuggcaga

SEQ ID NO: 978591 - RNA, 22 nt, Human
cugcaucacagcaggaggcaca

SEQ ID NO: 978592 - RNA, 22 nt, Human
gcccaggcuggagugcaguagc

SEQ ID NO: 978593 - RNA, 22 nt, Human
uuugcaauuugugcugcaaaug

SEQ ID NO: 978594 - RNA, 22 nt, Human
gaaggcaggcuucugauuaggu

SEQ ID NO: 978595 - RNA, 22 nt, Human
cuuugaauugccguuucaucug

SEQ ID NO: 978596 - RNA, 22 nt, Human
agggaauccaucuaucuucauu

SEQ ID NO: 978597 - RNA, 22 nt, Human
ucuggccagaaagacuugaugu

SEQ ID NO: 978598 - RNA, 22 nt, Human
gucauucuuaacaacucaguag

SEQ ID NO: 978599 - RNA, 22 nt, Human
ugcagagguuuccaggcaaguu

SEQ ID NO: 978600 - RNA, 22 nt, Human
uccaggaggcagggcugugccc

SEQ ID NO: 978601 - RNA, 23 nt, Human
aggcagcuggguagcaucuuucu

SEQ ID NO: 978602 - RNA, 22 nt, Human
ugagaauaggcauagaaccugg

SEQ ID NO: 978603 - RNA, 22 nt, Human
ucugagaguacgggcugcgcgc

SEQ ID NO: 978604 - RNA, 22 nt, Human
agucuucacucuucacuacuau

SEQ ID NO: 978605 - RNA, 22 nt, Human
cucuuuccaggguaccccaggu

SEQ ID NO: 978606 - RNA, 22 nt, Human
ugcuggguagaaguauuagucu

SEQ ID NO: 978607 - RNA, 22 nt, Human
ugaagcugugggcaguggagcc

SEQ ID NO: 978608 - RNA, 22 nt, Human
guggccaagagauaaaauugug

SEQ ID NO: 978609 - RNA, 22 nt, Human
aaguuugcauagauuaagcauu

SEQ ID NO: 978610 - RNA, 22 nt, Human
uagcauuuauggucaugugucc

SEQ ID NO: 978611 - RNA, 22 nt, Human
ugggugagugggaaaagcccag

SEQ ID NO: 978612 - RNA, 22 nt, Human
acaugaaaccugagucuaacuc

SEQ ID NO: 978613 - RNA, 22 nt, Human
agagggcauuaacucugucuug

SEQ ID NO: 978614 - RNA, 22 nt, Human
acccaggaggcaagguugcagu

SEQ ID NO: 978615 - RNA, 22 nt, Human
cuggaggcugaguugggucucc

SEQ ID NO: 978616 - RNA, 18 nt, Human
cugaggcuggcaggagcc

SEQ ID NO: 978617 - RNA, 22 nt, Human
cagguaagagacggauuggccc

SEQ ID NO: 978618 - RNA, 22 nt, Human
uuguaacagcugcuuaauagag

SEQ ID NO: 978619 - RNA, 22 nt, Human
cucaggaugcaggucacaggac

SEQ ID NO: 978620 - RNA, 22 nt, Human
ucuucucuccugcuuggcagaa

SEQ ID NO: 978621 - RNA, 22 nt, Human
cucccacuccuggcucaccaca

SEQ ID NO: 978622 - RNA, 22 nt, Human
cugggagguggagguugcauug

SEQ ID NO: 978623 - RNA, 22 nt, Human
cugggucuccggcagccucggg

SEQ ID NO: 978624 - RNA, 22 nt, Human
aggcagcauuugaauccagguc

SEQ ID NO: 978625 - RNA, 22 nt, Human
cuugaaagcacuccuuugacug

SEQ ID NO: 978626 - RNA, 19 nt, Human
ucucacaguuuccuugccu

SEQ ID NO: 978627 - RNA, 22 nt, Human
cucacugacgaggaagcugaga

SEQ ID NO: 978628 - RNA, 16 nt, Human
gucuggccuaccugcc

SEQ ID NO: 978629 - RNA, 22 nt, Human
ggccuagggaguggccaugccu

SEQ ID NO: 978630 - RNA, 22 nt, Human
gcuuccuucuaccacaucaugc

SEQ ID NO: 978631 - RNA, 22 nt, Human
cugcuuuggcagaagucagcua

SEQ ID NO: 978632 - RNA, 22 nt, Human
aagcugccuugcugaggagaaa

SEQ ID NO: 978633 - RNA, 22 nt, Human
gggaucagaaacauagcccuga

SEQ ID NO: 978634 - RNA, 22 nt, Human
ccagaggugcugggagaggucu

SEQ ID NO: 978635 - RNA, 22 nt, Human
uggucaaauuuagucucuggaa

SEQ ID NO: 978636 - RNA, 18 nt, Human
accuucauuccuuugccu

SEQ ID NO: 978637 - RNA, 22 nt, Human
gcagcaggcuuuucauaccuug

SEQ ID NO: 978638 - RNA, 22 nt, Human
gacagcagggacauguaggaag

SEQ ID NO: 978639 - RNA, 22 nt, Human
uccagggagauggcagaggcug

SEQ ID NO: 978640 - RNA, 22 nt, Human
cuaaaugacuuccagugguuau

SEQ ID NO: 978641 - RNA, 22 nt, Human
gcacugaaugccaaaguguagg

SEQ ID NO: 978642 - RNA, 22 nt, Human
uuugcauuuccagaguagcaga

SEQ ID NO: 978643 - RNA, 22 nt, Human
cuguuuauagcagagcaagccu

SEQ ID NO: 978644 - RNA, 22 nt, Human
gccuggucucuuucaugucagu

SEQ ID NO: 978645 - RNA, 22 nt, Human
uuguuucagcuguaugcuaugu

SEQ ID NO: 978646 - RNA, 22 nt, Human
uuugaacugauaaucuucuguu

SEQ ID NO: 978647 - RNA, 19 nt, Human
agucucacccaagcagucu

SEQ ID NO: 978648 - RNA, 22 nt, Human
aaaucucaggccucuauuuacu

SEQ ID NO: 978649 - RNA, 22 nt, Human
aauguucaaaagcaucagugaa

SEQ ID NO: 978650 - RNA, 21 nt, Human
gcagacugcccugcugucccc

SEQ ID NO: 978651 - RNA, 22 nt, Human
aaggcagcagugcacgacugau

SEQ ID NO: 978652 - RNA, 22 nt, Human
uuugaaagcuacuuucggguca

SEQ ID NO: 978653 - RNA, 22 nt, Human
ccagugcaggugagcaccaggu

SEQ ID NO: 978654 - RNA, 22 nt, Human
gaagcagcucagauugacugaa

SEQ ID NO: 978655 - RNA, 22 nt, Human
cugggcagccucacacaauguu

SEQ ID NO: 978656 - RNA, 22 nt, Human
ggcugcaggcagaggcugucug

SEQ ID NO: 978657 - RNA, 22 nt, Human
caggcagcugggucaccguccc

SEQ ID NO: 978658 - RNA, 22 nt, Human
ugagccagccucagaagucacg

SEQ ID NO: 978659 - RNA, 22 nt, Human
auucagcaguuccugcuucagu

SEQ ID NO: 978660 - RNA, 22 nt, Human
ucccagagguugagucacuuau

SEQ ID NO: 978661 - RNA, 23 nt, Human
uuucucauccagagagucagucc

SEQ ID NO: 978662 - RNA, 22 nt, Human
uuuuucagccaugaauuacacu

SEQ ID NO: 978663 - RNA, 22 nt, Human
cucuggccgcagcucagcucug

SEQ ID NO: 978664 - RNA, 22 nt, Human
ucaccuugaaugcagcagcgug

SEQ ID NO: 978665 - RNA, 20 nt, Human
gugugaagcccucaggagga

SEQ ID NO: 978666 - RNA, 22 nt, Human
ucucagagggaaacaugaguga

SEQ ID NO: 978667 - RNA, 20 nt, Human
gcagagcuguucugugggga

SEQ ID NO: 978668 - RNA, 22 nt, Human
cagagugagggccugcaccugc

SEQ ID NO: 978669 - RNA, 23 nt, Human
uggcagcuguguaagagaaagca

SEQ ID NO: 978670 - RNA, 22 nt, Human
aagaacauucgaacuauuuucu

SEQ ID NO: 978671 - RNA, 22 nt, Human
guggcugcuguccucucugguu

SEQ ID NO: 978672 - RNA, 22 nt, Human
gggucucucucggcuccacgcg

SEQ ID NO: 978673 - RNA, 22 nt, Human
agagauguucauucagcauguu

SEQ ID NO: 978674 - RNA, 22 nt, Human
cccugcugucaggugcugggag

SEQ ID NO: 978675 - RNA, 22 nt, Human
aaaucucaauuugaauuguagc

SEQ ID NO: 978676 - RNA, 22 nt, Human
acucugcugauagguccucaga

SEQ ID NO: 978677 - RNA, 22 nt, Human
gcauugucaaaagugguaugac

SEQ ID NO: 978678 - RNA, 22 nt, Human
gauuucaccugaucuugucauc

SEQ ID NO: 978679 - RNA, 22 nt, Human
uuuggaauguaguuuaaucauc

SEQ ID NO: 978680 - RNA, 22 nt, Human
aacucugcaaccuauguagacc

SEQ ID NO: 978681 - RNA, 22 nt, Human
gaaaggagggaaacagagcggu

SEQ ID NO: 978682 - RNA, 22 nt, Human
uuauguagugacugacuguuag

SEQ ID NO: 978683 - RNA, 22 nt, Human
acacagaguauuuagaaggggu

SEQ ID NO: 978684 - RNA, 22 nt, Human
ucacucugucccccauugagau

SEQ ID NO: 978685 - RNA, 22 nt, Human
acugucucucuagcaguucagg

SEQ ID NO: 978686 - RNA, 22 nt, Human
ugugggcucccccucacucugu

SEQ ID NO: 978687 - RNA, 18 nt, Human
cugcugugucgucugggc

SEQ ID NO: 978688 - RNA, 22 nt, Human
aagccucuggggccucaucugu

SEQ ID NO: 978689 - RNA, 22 nt, Human
gagcuguccgccccugggccga

SEQ ID NO: 978690 - RNA, 18 nt, Human
gagcacugguguugaggu

SEQ ID NO: 978691 - RNA, 22 nt, Human
agauacauauagaaaacaucaa

SEQ ID NO: 978692 - RNA, 22 nt, Human
ucaguuacuccuuuccuuaggu

SEQ ID NO: 978693 - RNA, 22 nt, Human
uggagagguuuaaacaaaaguu

SEQ ID NO: 978694 - RNA, 22 nt, Human
ucuuacauauagcaugaguaca

SEQ ID NO: 978695 - RNA, 22 nt, Human
cccaagagcuucuaggacgcug

SEQ ID NO: 978696 - RNA, 22 nt, Human
uggcagcugaauggcuggaugg

SEQ ID NO: 978697 - RNA, 15 nt, Human
ucacucuggaaggga

SEQ ID NO: 978698 - RNA, 22 nt, Human
agucauaugacccuucacaaac

SEQ ID NO: 978699 - RNA, 22 nt, Human
agcagggcuugccgcuuguccu

SEQ ID NO: 978700 - RNA, 22 nt, Human
ugaagccuuguguggccucucu

SEQ ID NO: 978701 - RNA, 19 nt, Human
acacagggcuagaguuaca

SEQ ID NO: 978702 - RNA, 22 nt, Human
uccuggccuuauccccaaacug

SEQ ID NO: 978703 - RNA, 22 nt, Human
uacaucuagccuuacaauuauu

SEQ ID NO: 978704 - RNA, 20 nt, Human
accaggagauggaggcaggg

SEQ ID NO: 978705 - RNA, 22 nt, Human
ugggcugcuucuauuggugguc

SEQ ID NO: 978706 - RNA, 15 nt, Human
aggcacugugggacc

SEQ ID NO: 978707 - RNA, 22 nt, Human
aacauuucugagaauaucaguu

SEQ ID NO: 978708 - RNA, 22 nt, Human
agacaugucaccaauucuuacu

SEQ ID NO: 978709 - RNA, 22 nt, Human
acuguauugguuuucuauugcu

SEQ ID NO: 978710 - RNA, 22 nt, Human
ggguggggcccaggaaaucuau

SEQ ID NO: 978711 - RNA, 22 nt, Human
gaaggcuugcagcucuguggca

SEQ ID NO: 978712 - RNA, 22 nt, Human
ggcagaaggccucccagcuccu

SEQ ID NO: 978713 - RNA, 22 nt, Human
accucuggccuucaggcaucau

SEQ ID NO: 978714 - RNA, 22 nt, Human
ggcugcugggaauaugccagcu

SEQ ID NO: 978715 - RNA, 22 nt, Human
gcaagcugcuuaagcucauugu

SEQ ID NO: 978716 - RNA, 22 nt, Human
ucacucugaaugguacugagga

SEQ ID NO: 978717 - RNA, 20 nt, Human
augcuuucuugugugcugcu

SEQ ID NO: 978718 - RNA, 22 nt, Human
ucagggcauucaagaggccugg

SEQ ID NO: 978719 - RNA, 22 nt, Human
uccugccuugccugggacauca

SEQ ID NO: 978720 - RNA, 22 nt, Human
ucucucuucaacccuuaacuag

SEQ ID NO: 978721 - RNA, 22 nt, Human
uggcagagucugggcuugggca

SEQ ID NO: 978722 - RNA, 20 nt, Human
uccaggcagcucagaguguc

SEQ ID NO: 978723 - RNA, 22 nt, Human
guaaaugugcuucuuuuaacuu

SEQ ID NO: 978724 - RNA, 22 nt, Human
ggccagaaaguuaagcuguggc

SEQ ID NO: 978725 - RNA, 22 nt, Human
ucccagagacagagccuccucc

SEQ ID NO: 978726 - RNA, 22 nt, Human
cugcugugcaacauugcaccua

SEQ ID NO: 978727 - RNA, 20 nt, Human
aaaaucucccagaaacuuau

SEQ ID NO: 978728 - RNA, 22 nt, Human
agcaggugacagggcuguggug

SEQ ID NO: 978729 - RNA, 21 nt, Human
ucuguucaaggaacuacggau

SEQ ID NO: 978730 - RNA, 22 nt, Human
cagccuuugugaacaucaggug

SEQ ID NO: 978731 - RNA, 22 nt, Human
ugcauuaugcuugugcuguaua

SEQ ID NO: 978732 - RNA, 22 nt, Human
uuugcauuuguuuagaaccuga

SEQ ID NO: 978733 - RNA, 22 nt, Human
uagacagauuuaaaggaaugga

SEQ ID NO: 978734 - RNA, 22 nt, Human
ggguguccugugccaagcuggg

SEQ ID NO: 978735 - RNA, 22 nt, Human
ucuuaaaaguaugccaauugga

SEQ ID NO: 978736 - RNA, 22 nt, Human
gcugagggcauguguggcgacu

SEQ ID NO: 978737 - RNA, 22 nt, Human
gcagugacagggcugcugccuu

SEQ ID NO: 978738 - RNA, 22 nt, Human
aaagcagauucugaugcaguag

SEQ ID NO: 978739 - RNA, 22 nt, Human
cugcagaguggagccucggcug

SEQ ID NO: 978740 - RNA, 22 nt, Human
ggcugugauugguggaugugaa

SEQ ID NO: 978741 - RNA, 22 nt, Human
gggagagguuacccgagcaacu

SEQ ID NO: 978742 - RNA, 22 nt, Human
agcaggguuuggggauuggcac

SEQ ID NO: 978743 - RNA, 22 nt, Human
uccucugccccagaugaaauuu

SEQ ID NO: 978744 - RNA, 22 nt, Human
cauuuucucaaugaacccucuu

SEQ ID NO: 978745 - RNA, 22 nt, Human
cugagguggaacagaggugaag

SEQ ID NO: 978746 - RNA, 22 nt, Human
cagacauauguuuuaacagauu

SEQ ID NO: 978747 - RNA, 22 nt, Human
auacuuacuuuucuucagacua

SEQ ID NO: 978748 - RNA, 22 nt, Human
ugggauaguggccaggaccccc

SEQ ID NO: 978749 - RNA, 22 nt, Human
ucugcaggccucgacaaggcca

SEQ ID NO: 978750 - RNA, 21 nt, Human
uggcugagccaggugugugga

SEQ ID NO: 978751 - RNA, 22 nt, Human
agggcccuccccgcucagggca

SEQ ID NO: 978752 - RNA, 17 nt, Human
gcccaggaaggacggcc

SEQ ID NO: 978753 - RNA, 22 nt, Human
gacucugcuacaggccgagguu

SEQ ID NO: 978754 - RNA, 22 nt, Human
aauguacacugaaagccuauca

SEQ ID NO: 978755 - RNA, 22 nt, Human
uccauuuucuugcucuagguaa

SEQ ID NO: 978756 - RNA, 22 nt, Human
auaugcauaugucaaaacuuau

SEQ ID NO: 978757 - RNA, 22 nt, Human
ccaggggcuggugcugagcugg

SEQ ID NO: 978758 - RNA, 20 nt, Human
cccuggagagaagcuccacg

SEQ ID NO: 978759 - RNA, 22 nt, Human
ugucccauggauaccaggcuau

SEQ ID NO: 978760 - RNA, 22 nt, Human
uuauuuggaaauauggcuucug

SEQ ID NO: 978761 - RNA, 22 nt, Human
ugcaggagaaaguacggagcgu

SEQ ID NO: 978762 - RNA, 20 nt, Human
aucuucuuggccagcuugcu

SEQ ID NO: 978763 - RNA, 16 nt, Human
auuguuuucaauuaga

SEQ ID NO: 978764 - RNA, 22 nt, Human
acugggaggcaaagagcaagga

SEQ ID NO: 978765 - RNA, 22 nt, Human
aggaagcccuugucauuucugu

SEQ ID NO: 978766 - RNA, 22 nt, Human
caccuggcuggaagugcuccgg

SEQ ID NO: 978767 - RNA, 22 nt, Human
agggguggagaguguugccagu

SEQ ID NO: 978768 - RNA, 22 nt, Human
agccccuuccaguucucagauc

SEQ ID NO: 978769 - RNA, 22 nt, Human
auccuugagaaaauaaaugacc

SEQ ID NO: 978770 - RNA, 22 nt, Human
uguagggaggaaggguuggaaa

SEQ ID NO: 978771 - RNA, 19 nt, Human
aggacucuggaggcaugag

SEQ ID NO: 978772 - RNA, 22 nt, Human
cugccugcguugccucgugccu

SEQ ID NO: 978773 - RNA, 22 nt, Human
gagccugagugcugccuccccu

SEQ ID NO: 978774 - RNA, 22 nt, Human
cagagacagggcagggagugug

SEQ ID NO: 978775 - RNA, 22 nt, Human
gagcccagguucugcuuccagc

SEQ ID NO: 978776 - RNA, 22 nt, Human
guaggcagguggaggagugaag

SEQ ID NO: 978777 - RNA, 22 nt, Human
auucuuuuuuaaggaauagaac

SEQ ID NO: 978778 - RNA, 22 nt, Human
ugucaucuuggucuggaauaag

SEQ ID NO: 978779 - RNA, 22 nt, Human
ucagaggagccaaaguucugag

SEQ ID NO: 978780 - RNA, 22 nt, Human
ccagucugugugccagccugcg

SEQ ID NO: 978781 - RNA, 22 nt, Human
uccucuggggucagggcacuac

SEQ ID NO: 978782 - RNA, 22 nt, Human
cucacugcccugaaguuggguu

SEQ ID NO: 978783 - RNA, 22 nt, Human
aggcugugaguuuugucucaga

SEQ ID NO: 978784 - RNA, 20 nt, Human
ggaagcagagaacuguuuuc

SEQ ID NO: 978785 - RNA, 22 nt, Human
uucauguguauggaacauuuuu

SEQ ID NO: 978786 - RNA, 22 nt, Human
aaagcucacaguaauacaaggc

SEQ ID NO: 978787 - RNA, 23 nt, Human
acuuuagauaaauuaugugcaca

SEQ ID NO: 978788 - RNA, 19 nt, Human
uuggcagcugagauccugc

SEQ ID NO: 978789 - RNA, 22 nt, Human
ucucccagaggaucccagugga

SEQ ID NO: 978790 - RNA, 22 nt, Human
uuuguuaaggaguauugcuucu

SEQ ID NO: 978791 - RNA, 22 nt, Human
gaggcagcugaagcuucaaaga

SEQ ID NO: 978792 - RNA, 22 nt, Human
ugcacacacgcggcacaucugu

SEQ ID NO: 978793 - RNA, 22 nt, Human
ugaacagauggcccagcagagg

SEQ ID NO: 978794 - RNA, 22 nt, Human
uuugggaagaggaaucucugga

SEQ ID NO: 978795 - RNA, 22 nt, Human
cugcccugccuggccagugugg

SEQ ID NO: 978796 - RNA, 23 nt, Human
ggucccaguggagaggccucacc

SEQ ID NO: 978797 - RNA, 22 nt, Human
gggcuccagcccgggaccaggu

SEQ ID NO: 978798 - RNA, 22 nt, Human
ugggcuccagcaccugugcucu

SEQ ID NO: 978799 - RNA, 22 nt, Human
ggggagaguccuuuccaguucc

SEQ ID NO: 978800 - RNA, 22 nt, Human
gcugagaguguaggauguuuac

SEQ ID NO: 978801 - RNA, 18 nt, Human
acagaggcagacauguau

SEQ ID NO: 978802 - RNA, 18 nt, Human
cagaaguccuucaaggcc

SEQ ID NO: 978803 - RNA, 22 nt, Human
cucuuuaaaguaaaauuugucu

SEQ ID NO: 978804 - RNA, 22 nt, Human
gaaaguuucuucauuaagaugu

SEQ ID NO: 978805 - RNA, 22 nt, Human
caaaugauaccuauuacuaggc

SEQ ID NO: 978806 - RNA, 22 nt, Human
uggcagcuugaaugcagucuuu

SEQ ID NO: 978807 - RNA, 22 nt, Human
cgccaggcuugguagcucaugc

SEQ ID NO: 978808 - RNA, 22 nt, Human
cugggagcaccauacuuguuuc

SEQ ID NO: 978809 - RNA, 17 nt, Human
ggccuuggggccucagu

SEQ ID NO: 978810 - RNA, 22 nt, Human
acauuuaaugauccuacuguga

SEQ ID NO: 978811 - RNA, 22 nt, Human
uacaaagucaccagcuucuugc

SEQ ID NO: 978812 - RNA, 22 nt, Human
uggcuccuaggauggugccugg

SEQ ID NO: 978813 - RNA, 22 nt, Human
auacauacauguaugcacauac

SEQ ID NO: 978814 - RNA, 22 nt, Human
acagugcuaaacacuucuugaa

SEQ ID NO: 978815 - RNA, 22 nt, Human
cucagucucuugggcugugaag

SEQ ID NO: 978816 - RNA, 17 nt, Human
cagacagauauccuggg

SEQ ID NO: 978817 - RNA, 22 nt, Human
uuaaauuuuagaaacagacucu

SEQ ID NO: 978818 - RNA, 22 nt, Human
gggcugccaagccugccugccu

SEQ ID NO: 978819 - RNA, 22 nt, Human
ggaggaggcggcagaaguuccu

SEQ ID NO: 978820 - RNA, 22 nt, Human
uuggagcccugaggaucuggau

SEQ ID NO: 978821 - RNA, 22 nt, Human
uccaugucuucaugugucuaac

SEQ ID NO: 978822 - RNA, 22 nt, Human
augaaaacggaccagagcuauu

SEQ ID NO: 978823 - RNA, 22 nt, Human
gagagcugcagccgagaggggg

SEQ ID NO: 978824 - RNA, 22 nt, Human
caggcaggugcagauuccucuu

SEQ ID NO: 978825 - RNA, 22 nt, Human
gggcuucucuuaugcuaacugg

SEQ ID NO: 978826 - RNA, 22 nt, Human
cuaauguggacucuaucaaagu

SEQ ID NO: 978827 - RNA, 22 nt, Human
uaagacacaugcguacaagaua

SEQ ID NO: 978828 - RNA, 22 nt, Human
ccaggacagugaacauguaaga

SEQ ID NO: 978829 - RNA, 23 nt, Human
uugaaggagaaagcuuucuuggu

SEQ ID NO: 978830 - RNA, 22 nt, Human
ugucaugcagguuuguuauaga

SEQ ID NO: 978831 - RNA, 22 nt, Human
cucugcagaauuugagcugcuc

SEQ ID NO: 978832 - RNA, 22 nt, Human
cugucucuguugccuguaggug

SEQ ID NO: 978833 - RNA, 22 nt, Human
gccuggagccucagcaaggagg

SEQ ID NO: 978834 - RNA, 22 nt, Human
gcauguguggaggagaugugcu

SEQ ID NO: 978835 - RNA, 22 nt, Human
uuuuccucuguuauuaguguga

SEQ ID NO: 978836 - RNA, 22 nt, Human
agugacugggcagggcagggcc

SEQ ID NO: 978837 - RNA, 22 nt, Human
ucuuguuucuguauauaaugac

SEQ ID NO: 978838 - RNA, 22 nt, Human
aaggcagccucugccagccggg

SEQ ID NO: 978839 - RNA, 22 nt, Human
auacuuuggggguuaguguaga

SEQ ID NO: 978840 - RNA, 22 nt, Human
cccugaggcaaaggcuagaguu

SEQ ID NO: 978841 - RNA, 22 nt, Human
uugggcaaaguguuucuggagc

SEQ ID NO: 978842 - RNA, 22 nt, Human
ccaggaaaauaccaagcuuuaa

SEQ ID NO: 978843 - RNA, 22 nt, Human
uucuucuuuccuauaauuaauu

SEQ ID NO: 978844 - RNA, 22 nt, Human
aagugguaggaagagagcacug

SEQ ID NO: 978845 - RNA, 22 nt, Human
aucaggaucaugcuggguggga

SEQ ID NO: 978846 - RNA, 22 nt, Human
uguggcccagaugagugugcua

SEQ ID NO: 978847 - RNA, 22 nt, Human
ugaagcagcaccauuuuagagc

SEQ ID NO: 978848 - RNA, 22 nt, Human
acauacuaugaauacauguguc

SEQ ID NO: 978849 - RNA, 22 nt, Human
caccguuugguuuggauuuaca

SEQ ID NO: 978850 - RNA, 22 nt, Human
aaggcugauuagacugauagcu

SEQ ID NO: 978851 - RNA, 22 nt, Human
ucaggcugugggcacuggccau

SEQ ID NO: 978852 - RNA, 22 nt, Human
uggccugggccugccggugcaa

SEQ ID NO: 978853 - RNA, 22 nt, Human
gcucaggaucccaggggugugc

SEQ ID NO: 978854 - RNA, 22 nt, Human
uucugagguccaugcaguacug

SEQ ID NO: 978855 - RNA, 22 nt, Human
ccugucagaugaaguaauugug

SEQ ID NO: 978856 - RNA, 22 nt, Human
ccuccugggagagcacggaggg

SEQ ID NO: 978857 - RNA, 22 nt, Human
uugucugucccagcuugugcau

SEQ ID NO: 978858 - RNA, 22 nt, Human
ccaggcccugcuccucacacca

SEQ ID NO: 978859 - RNA, 19 nt, Human
ucccgcccacugagcgugc

SEQ ID NO: 978860 - RNA, 20 nt, Human
aguuauaguaucuagccaug

SEQ ID NO: 978861 - RNA, 23 nt, Human
agggccugauggcucccgcuggc

SEQ ID NO: 978862 - RNA, 17 nt, Human
uugaacugcugagucag

SEQ ID NO: 978863 - RNA, 22 nt, Human
aucuaagauguauugagcacuu

SEQ ID NO: 978864 - RNA, 22 nt, Human
aaguuauaucaucucauugacg

SEQ ID NO: 978865 - RNA, 22 nt, Human
cagcuccugcagcugcugccgu

SEQ ID NO: 978866 - RNA, 22 nt, Human
uucagugucaauuuuuaaauau

SEQ ID NO: 978867 - RNA, 22 nt, Human
gacaucaauauucugcagggau

SEQ ID NO: 978868 - RNA, 23 nt, Human
uggacgccgacuuuggaggcgcu

SEQ ID NO: 978869 - RNA, 22 nt, Human
aacauucugguucuaaaaaccu

SEQ ID NO: 978870 - RNA, 22 nt, Human
uccaguggugguuugaagggca

SEQ ID NO: 978871 - RNA, 20 nt, Human
gcuguucacauuauuaguag

SEQ ID NO: 978872 - RNA, 22 nt, Human
aagcccagcaucccugcaccag

SEQ ID NO: 978873 - RNA, 22 nt, Human
gcuuuuucaaaugaaagcuggu

SEQ ID NO: 978874 - RNA, 22 nt, Human
ucucagagaccugaacucccug

SEQ ID NO: 978875 - RNA, 22 nt, Human
aggggccuggacauggacgcgc

SEQ ID NO: 978876 - RNA, 22 nt, Human
gcugucuggcauggcguggcug

SEQ ID NO: 978877 - RNA, 22 nt, Human
uugcagagaucagcagguuuga

SEQ ID NO: 978878 - RNA, 22 nt, Human
gaggcacuggaggaaaggagaa

SEQ ID NO: 978879 - RNA, 23 nt, Human
uggcucagggucucuuaugaagu

SEQ ID NO: 978880 - RNA, 22 nt, Human
acuuugcaaugggcagaaccca

SEQ ID NO: 978881 - RNA, 22 nt, Human
cauccaggcaccacaaccagcu

SEQ ID NO: 978882 - RNA, 22 nt, Human
gguuggaggugggaauagcuag

SEQ ID NO: 978883 - RNA, 23 nt, Human
uggcucucucagugcugcagagg

SEQ ID NO: 978884 - RNA, 22 nt, Human
uuaaauuagucaagcuucucug

SEQ ID NO: 978885 - RNA, 21 nt, Human
gacaggggaagaagcaaggag

SEQ ID NO: 978886 - RNA, 22 nt, Human
ggguaauuggggccuugcagug

SEQ ID NO: 978887 - RNA, 22 nt, Human
agugccuggaccccaugacaua

SEQ ID NO: 978888 - RNA, 22 nt, Human
guggcagcaaaauccugcauuc

SEQ ID NO: 978889 - RNA, 22 nt, Human
caguucuuuguggggaguucuc

SEQ ID NO: 978890 - RNA, 22 nt, Human
uagaaacucaggauacucuucc

SEQ ID NO: 978891 - RNA, 22 nt, Human
augucacauggucaccucuagc

SEQ ID NO: 978892 - RNA, 19 nt, Human
aaacacagauuucuuacca

SEQ ID NO: 978893 - RNA, 22 nt, Human
cugccuggguucaaguccuguu

SEQ ID NO: 978894 - RNA, 23 nt, Human
cacugcagcguggucuggcagga

SEQ ID NO: 978895 - RNA, 22 nt, Human
ggcugucucugugacugccacc

SEQ ID NO: 978896 - RNA, 22 nt, Human
cagaagaauggugucugagcuc

SEQ ID NO: 978897 - RNA, 22 nt, Human
cacuggggugggccugguagag

SEQ ID NO: 978898 - RNA, 22 nt, Human
ugucauuuucuaaucuguuguc

SEQ ID NO: 978899 - RNA, 22 nt, Human
cccaaggccucuccuuggcuug

SEQ ID NO: 978900 - RNA, 22 nt, Human
aaucaguuguccaaaguucaca

SEQ ID NO: 978901 - RNA, 22 nt, Human
uggggugggcaugcgcuguccu

SEQ ID NO: 978902 - RNA, 22 nt, Human
aagaaauauugggccuuauaaa

SEQ ID NO: 978903 - RNA, 22 nt, Human
cagcugacuucauaggaagaca

SEQ ID NO: 978904 - RNA, 22 nt, Human
auacaaguugugauaauguaaa

SEQ ID NO: 978905 - RNA, 22 nt, Human
cugccuggggaaugugaggauu

SEQ ID NO: 978906 - RNA, 22 nt, Human
gccgaagcugccgucugguccu

SEQ ID NO: 978907 - RNA, 22 nt, Human
aagagcuguaugccauaugauu

SEQ ID NO: 978908 - RNA, 22 nt, Human
aggggugauuugggacaggaca

SEQ ID NO: 978909 - RNA, 22 nt, Human
aaauuuucagagcacuagagaa

SEQ ID NO: 978910 - RNA, 22 nt, Human
uccagugcuggaccagagcacc

SEQ ID NO: 978911 - RNA, 22 nt, Human
ucucuucucuagugagcaacug

SEQ ID NO: 978912 - RNA, 22 nt, Human
aaaauacuguggaguguugaaa

SEQ ID NO: 978913 - RNA, 22 nt, Human
cccuguccuggaugggagcacu

SEQ ID NO: 978914 - RNA, 22 nt, Human
aagcugcccuguguuagaguuc

SEQ ID NO: 978915 - RNA, 22 nt, Human
cucagcagugacaagagaguau

SEQ ID NO: 978916 - RNA, 22 nt, Human
ggccuugcuuggguuauaugcc

SEQ ID NO: 978917 - RNA, 23 nt, Human
ucugggccacuugucugcacuuc

SEQ ID NO: 978918 - RNA, 22 nt, Human
agugaguggguuacagauggga

SEQ ID NO: 978919 - RNA, 22 nt, Human
gucccauaaguagugcaacuug

SEQ ID NO: 978920 - RNA, 22 nt, Human
cccucugccugcgcccuggugu

SEQ ID NO: 978921 - RNA, 22 nt, Human
gggagucugggcuagacuccuu

SEQ ID NO: 978922 - RNA, 22 nt, Human
gcaggcagagagggguuuccag

SEQ ID NO: 978923 - RNA, 22 nt, Human
uccuucagaggacggcagccag

SEQ ID NO: 978924 - RNA, 22 nt, Human
ugcauuguaggauguuuagcag

SEQ ID NO: 978925 - RNA, 22 nt, Human
uuuucauuuacauuagggaaga

SEQ ID NO: 978926 - RNA, 22 nt, Human
ugcaugcugcacacaugcguag

SEQ ID NO: 978927 - RNA, 22 nt, Human
aacauauaaacucuuaaguuca

SEQ ID NO: 978928 - RNA, 22 nt, Human
augaguugaagcuacaagaggc

SEQ ID NO: 978929 - RNA, 22 nt, Human
gcuggccaguguggugaccacc

SEQ ID NO: 978930 - RNA, 22 nt, Human
uucuucuucaagugcugcauuc

SEQ ID NO: 978931 - RNA, 22 nt, Human
aggcucugcagugcuggaggac

SEQ ID NO: 978932 - RNA, 22 nt, Human
agcucacagaaauccugcagga

SEQ ID NO: 978933 - RNA, 22 nt, Human
gugcagguguuuuggcugccag

SEQ ID NO: 978934 - RNA, 22 nt, Human
cacaauuuguuuuaucaguauu

SEQ ID NO: 978935 - RNA, 22 nt, Human
aaaggagacuucagaucuccuu

SEQ ID NO: 978936 - RNA, 22 nt, Human
uccuccuucgggacugcuugac

SEQ ID NO: 978937 - RNA, 22 nt, Human
ugggcacaggggaauggaugaa

SEQ ID NO: 978938 - RNA, 22 nt, Human
gcccucagaggacagcugacuu

SEQ ID NO: 978939 - RNA, 22 nt, Human
ugcuuccuucccguucuucucc

SEQ ID NO: 978940 - RNA, 22 nt, Human
agagcuggacgucugagcccua

SEQ ID NO: 978941 - RNA, 22 nt, Human
cuguggagugcuuggcucagug

SEQ ID NO: 978942 - RNA, 22 nt, Human
augcaucuauucccaagggcag

SEQ ID NO: 978943 - RNA, 22 nt, Human
aguauuucuaguugguucuacu

SEQ ID NO: 978944 - RNA, 22 nt, Human
cucaggauuuaaaggggcacuc

SEQ ID NO: 978945 - RNA, 22 nt, Human
gaggccugggagccuguccucc

SEQ ID NO: 978946 - RNA, 22 nt, Human
gacccaggcccaaggcugccag

SEQ ID NO: 978947 - RNA, 22 nt, Human
auggggugaccaugagcauuua

SEQ ID NO: 978948 - RNA, 22 nt, Human
cuggcucccguuguccuugaag

SEQ ID NO: 978949 - RNA, 22 nt, Human
agcauuuaggagaauuugagaa

SEQ ID NO: 978950 - RNA, 21 nt, Human
ucacaucuauguuaagcaaac

SEQ ID NO: 978951 - RNA, 22 nt, Human
gcugggcagccuggccgcugcc

SEQ ID NO: 978952 - RNA, 22 nt, Human
gagcugccaguguaugaauucu

SEQ ID NO: 978953 - RNA, 22 nt, Human
ucacauuuucauauucucugag

SEQ ID NO: 978954 - RNA, 22 nt, Human
uggcagcacaagguggcccaug

SEQ ID NO: 978955 - RNA, 22 nt, Human
augugcaacuucagcagaaagg

SEQ ID NO: 978956 - RNA, 22 nt, Human
ggaccagagcucgggcuucuca

SEQ ID NO: 978957 - RNA, 22 nt, Human
aucagcaagcauuuauugagug

SEQ ID NO: 978958 - RNA, 22 nt, Human
cuggagcucuccagagccccgu

SEQ ID NO: 978959 - RNA, 22 nt, Human
cccaggaggaggaaaaagcucg

SEQ ID NO: 978960 - RNA, 22 nt, Human
uaggaaaagucuagauugauga

SEQ ID NO: 978961 - RNA, 22 nt, Human
uggcugggagcuggaacugggc

SEQ ID NO: 978962 - RNA, 22 nt, Human
cugucaguaggcucccaucauu

SEQ ID NO: 978963 - RNA, 22 nt, Human
uaacagaauuugcuaaacuccg

SEQ ID NO: 978964 - RNA, 22 nt, Human
caauaauauccugugcuguuug

SEQ ID NO: 978965 - RNA, 22 nt, Human
aucuacaggauaguuuaauauu

SEQ ID NO: 978966 - RNA, 18 nt, Human
ggcucaggcuauccuaac

SEQ ID NO: 978967 - RNA, 22 nt, Human
guuauauauaguauuucucuga

SEQ ID NO: 978968 - RNA, 22 nt, Human
ccaggcugcuguugguguccgc

SEQ ID NO: 978969 - RNA, 22 nt, Human
uggcucagcuuuccccaucugg

SEQ ID NO: 978970 - RNA, 20 nt, Human
ugggccuguggcagaagucu

SEQ ID NO: 978971 - RNA, 22 nt, Human
acaguaaugauucugagucucu

SEQ ID NO: 978972 - RNA, 22 nt, Human
guccucugaaguugugcaaugc

SEQ ID NO: 978973 - RNA, 22 nt, Human
uguuuaauucaccaucauguuc

SEQ ID NO: 978974 - RNA, 22 nt, Human
acucaagauagggaaaguacaa

SEQ ID NO: 978975 - RNA, 19 nt, Human
ccuuccagcuccuuuucag

SEQ ID NO: 978976 - RNA, 22 nt, Human
uuguuacuaagccuuuaaauag

SEQ ID NO: 978977 - RNA, 20 nt, Human
acguggccaccaguggcuua

SEQ ID NO: 978978 - RNA, 21 nt, Human
uccuuccuugagguccuuucc

SEQ ID NO: 978979 - RNA, 22 nt, Human
aggucagcaugaguagaaggua

SEQ ID NO: 978980 - RNA, 22 nt, Human
uugacacaguuuucucauuaag

SEQ ID NO: 978981 - RNA, 22 nt, Human
aacauaaauuugaaguggcaaa

SEQ ID NO: 978982 - RNA, 22 nt, Human
uaagaacaagcuggggguucca

SEQ ID NO: 978983 - RNA, 22 nt, Human
cuuccaaagcacuuuauggacc

SEQ ID NO: 978984 - RNA, 22 nt, Human
aaaugcagauugucauucagga

SEQ ID NO: 978985 - RNA, 22 nt, Human
uuauuugcccauguuuagcaga

SEQ ID NO: 978986 - RNA, 22 nt, Human
agaagcugccuacaugaccagc

SEQ ID NO: 978987 - RNA, 22 nt, Human
uccaagggcagccauagaacuu

SEQ ID NO: 978988 - RNA, 22 nt, Human
uauagccauuuccaguggcauc

SEQ ID NO: 978989 - RNA, 22 nt, Human
caaggccaguucaccaagggca

SEQ ID NO: 978990 - RNA, 17 nt, Human
ucaggauccaggguucu

SEQ ID NO: 978991 - RNA, 20 nt, Human
cugugcuuuggaaccuggaa

SEQ ID NO: 978992 - RNA, 22 nt, Human
ugcaacauuauuaaacuaagca

SEQ ID NO: 978993 - RNA, 22 nt, Human
gagacagcagggccagggccug

SEQ ID NO: 978994 - RNA, 22 nt, Human
cagaaauguucuaaugauucag

SEQ ID NO: 978995 - RNA, 22 nt, Human
ugucccaggcugaaguacagug

SEQ ID NO: 978996 - RNA, 22 nt, Human
agggauggaagacuugaagacc

SEQ ID NO: 978997 - RNA, 22 nt, Human
agcccaugcaacaggccuagcg

SEQ ID NO: 978998 - RNA, 22 nt, Human
uagcugccauugcuccaggaag

SEQ ID NO: 978999 - RNA, 22 nt, Human
ucugcaggcuuauaggaugggu

SEQ ID NO: 979000 - RNA, 22 nt, Human
cugggcuccuaaccauccaggu

SEQ ID NO: 979001 - RNA, 22 nt, Human
augcacuaugaugagcuagucu

SEQ ID NO: 979002 - RNA, 22 nt, Human
ugacaugcuuguuuuccuugaa

SEQ ID NO: 979003 - RNA, 22 nt, Human
uguuguuuucucauggagaaua

SEQ ID NO: 979004 - RNA, 22 nt, Human
ccuggagaccagaggauacuuc

SEQ ID NO: 979005 - RNA, 22 nt, Human
acagagcuucccagccugagca

SEQ ID NO: 979006 - RNA, 22 nt, Human
caggaggccaacugugggacuu

SEQ ID NO: 979007 - RNA, 22 nt, Human
aggaggcacucacucucagggu

SEQ ID NO: 979008 - RNA, 22 nt, Human
ggcagccauggacacuggcuag

SEQ ID NO: 979009 - RNA, 22 nt, Human
ggcuggcagaagugugcuggcu

SEQ ID NO: 979010 - RNA, 22 nt, Human
ugguggcuucugaggauggcga

SEQ ID NO: 979011 - RNA, 22 nt, Human
auaacagaguugggaagugaaa

SEQ ID NO: 979012 - RNA, 20 nt, Human
ggcagcaggaguuuccucuu

SEQ ID NO: 979013 - RNA, 22 nt, Human
ccucucaucauuaucgcuuugu

SEQ ID NO: 979014 - RNA, 22 nt, Human
cagccugcccuggaagcccagc

SEQ ID NO: 979015 - RNA, 22 nt, Human
gcccaugcacuuucugugaugg

SEQ ID NO: 979016 - RNA, 22 nt, Human
cugcucuguuaauuaaacuuug

SEQ ID NO: 979017 - RNA, 22 nt, Human
aaaaaugaaacggcugguuggc

SEQ ID NO: 979018 - RNA, 22 nt, Human
guaauugacucagcucuguuca

SEQ ID NO: 979019 - RNA, 22 nt, Human
gguuugcaugugauguugggca

SEQ ID NO: 979020 - RNA, 22 nt, Human
gcacagaaguaaaauacaaguc

SEQ ID NO: 979021 - RNA, 22 nt, Human
uccaggaggugaggggaccaaa

SEQ ID NO: 979022 - RNA, 22 nt, Human
ggcugcagguugguuggcagcu

SEQ ID NO: 979023 - RNA, 22 nt, Human
ugucucugugagaucugacgau

SEQ ID NO: 979024 - RNA, 22 nt, Human
uccccagggcugcagagggugu

SEQ ID NO: 979025 - RNA, 22 nt, Human
agcagagcuauucuugugcaau

SEQ ID NO: 979026 - RNA, 22 nt, Human
cuuaaauuuucaucuacaagaa

SEQ ID NO: 979027 - RNA, 17 nt, Human
caggcuccuuccagauu

SEQ ID NO: 979028 - RNA, 22 nt, Human
ggguacuuaauauuuacggggu

SEQ ID NO: 979029 - RNA, 22 nt, Human
ugcugccacugguagucucauu

SEQ ID NO: 979030 - RNA, 22 nt, Human
cacagcauaaugaaauauacuu

SEQ ID NO: 979031 - RNA, 19 nt, Human
cuggccaggccaggggccc

SEQ ID NO: 979032 - RNA, 22 nt, Human
gccuggcaaggcccuguugacu

SEQ ID NO: 979033 - RNA, 22 nt, Human
gcccugagggguggugucugua

SEQ ID NO: 979034 - RNA, 22 nt, Human
aggccaaauagcagguuugcua

SEQ ID NO: 979035 - RNA, 22 nt, Human
gcccugugcgacucuagagguu

SEQ ID NO: 979036 - RNA, 22 nt, Human
cagggccauaucuugugcacca

SEQ ID NO: 979037 - RNA, 22 nt, Human
aagaacaguguccugggacucg

SEQ ID NO: 979038 - RNA, 22 nt, Human
gcacugaacuuuaaucauuucu

SEQ ID NO: 979039 - RNA, 22 nt, Human
uucaagguaugguagcugguca

SEQ ID NO: 979040 - RNA, 22 nt, Human
gacacuaaaguauaggguaucu

SEQ ID NO: 979041 - RNA, 22 nt, Human
gcuugaaaauucauagguauuu

SEQ ID NO: 979042 - RNA, 22 nt, Human
gcugggaguuacugucuccuuu

SEQ ID NO: 979043 - RNA, 18 nt, Human
ugagaggcagguagagga

SEQ ID NO: 979044 - RNA, 22 nt, Human
ucuucagauugcacugagcaag

SEQ ID NO: 979045 - RNA, 22 nt, Human
uguaggaguccaaucaggagac

SEQ ID NO: 979046 - RNA, 22 nt, Human
uucuucuucauuucugacgaug

SEQ ID NO: 979047 - RNA, 22 nt, Human
gcugcaggcauuuuccugggca

SEQ ID NO: 979048 - RNA, 22 nt, Human
aggcacuguucccaguuauccu

SEQ ID NO: 979049 - RNA, 22 nt, Human
uuacaagauaaccugaugcugu

SEQ ID NO: 979050 - RNA, 22 nt, Human
uuucauguuuauggaaaaugag

SEQ ID NO: 979051 - RNA, 23 nt, Human
cacuccuguuucuaagccagcau

SEQ ID NO: 979052 - RNA, 22 nt, Human
cagagcugguguuacaagucca

SEQ ID NO: 979053 - RNA, 20 nt, Human
agggccugcucugugguguc

SEQ ID NO: 979054 - RNA, 22 nt, Human
uuucacauuagauaugucauuu

SEQ ID NO: 979055 - RNA, 22 nt, Human
uccuggcccucugcaaacgcca

SEQ ID NO: 979056 - RNA, 22 nt, Human
aagggaggggauguaagccugg

SEQ ID NO: 979057 - RNA, 23 nt, Human
uucauuugucuacuucacuuguu

SEQ ID NO: 979058 - RNA, 22 nt, Human
uaggccagaggagcagcuuugg

SEQ ID NO: 979059 - RNA, 22 nt, Human
acagcuguggggacucuugccc

SEQ ID NO: 979060 - RNA, 22 nt, Human
gcagcugcagacccucagugcu

SEQ ID NO: 979061 - RNA, 22 nt, Human
uucacauuauaaucaguucugc

SEQ ID NO: 979062 - RNA, 22 nt, Human
gcaucuucacacaaagccagug

SEQ ID NO: 979063 - RNA, 22 nt, Human
uucuggagaucugccuauggga

SEQ ID NO: 979064 - RNA, 22 nt, Human
uguuaucugagcaacgucgacg

SEQ ID NO: 979065 - RNA, 22 nt, Human
cacaauguauauguauaucaaa

SEQ ID NO: 979066 - RNA, 22 nt, Human
aggccugaggaccagauaaaug

SEQ ID NO: 979067 - RNA, 22 nt, Human
cccucugcaggcuggaccugcc

SEQ ID NO: 979068 - RNA, 22 nt, Human
cacugcaguaacucuaggacug

SEQ ID NO: 979069 - RNA, 23 nt, Human
cuggcuccgaagacuccaggauc

SEQ ID NO: 979070 - RNA, 22 nt, Human
agcauggggcaaugcaugugcu

SEQ ID NO: 979071 - RNA, 22 nt, Human
cugaggagagaucacguggugu

SEQ ID NO: 979072 - RNA, 22 nt, Human
gggagggaggugaugcuuggcu

SEQ ID NO: 979073 - RNA, 21 nt, Human
gucaaacuugcaccagugccc

SEQ ID NO: 979074 - RNA, 23 nt, Human
acacaauagaguacuauucagcc

SEQ ID NO: 979075 - RNA, 22 nt, Human
ucaggagggugacaggcccugg

SEQ ID NO: 979076 - RNA, 22 nt, Human
acauucuagauauguuauauuu

SEQ ID NO: 979077 - RNA, 23 nt, Human
aaggucacagaacuuagcaagcc

SEQ ID NO: 979078 - RNA, 22 nt, Human
uucacaggauauaugugcaggg

SEQ ID NO: 979079 - RNA, 22 nt, Human
gaaaauacuucaguguucuggc

SEQ ID NO: 979080 - RNA, 22 nt, Human
uuuccucuucuggcaggcaggg

SEQ ID NO: 979081 - RNA, 22 nt, Human
auuucacucucccugccacuua

SEQ ID NO: 979082 - RNA, 22 nt, Human
uuauacauguguuuugagauga

SEQ ID NO: 979083 - RNA, 23 nt, Human
gcaggugguucgaacagaaguuu

SEQ ID NO: 979084 - RNA, 22 nt, Human
ugccgcagugcggggagggccc

SEQ ID NO: 979085 - RNA, 22 nt, Human
agaagcagacucugaggcaagg

SEQ ID NO: 979086 - RNA, 22 nt, Human
uuggaaggugagucccuggguu

SEQ ID NO: 979087 - RNA, 22 nt, Human
agggagaaaauuggaugcacaa

SEQ ID NO: 979088 - RNA, 22 nt, Human
cuuugcaauagaggcacacaug

SEQ ID NO: 979089 - RNA, 20 nt, Human
accucugcaucaauccuuug

SEQ ID NO: 979090 - RNA, 22 nt, Human
gcugccagcuuuccuuggcuga

SEQ ID NO: 979091 - RNA, 23 nt, Human
cagaggcaucggauucaacauca

SEQ ID NO: 979092 - RNA, 18 nt, Human
ucagagguacagaaaagu

SEQ ID NO: 979093 - RNA, 22 nt, Human
ucauuuccucaaauucaagguu

SEQ ID NO: 979094 - RNA, 22 nt, Human
uuucuggcagcgggacaggggu

SEQ ID NO: 979095 - RNA, 22 nt, Human
gcccaggaguuggaggcugcag

SEQ ID NO: 979096 - RNA, 22 nt, Human
gaugauuuuaugucuugucauu

SEQ ID NO: 979097 - RNA, 22 nt, Human
ccagcuggcacuguggcugccc

SEQ ID NO: 979098 - RNA, 22 nt, Human
aggagaaggaagugcaucacua

SEQ ID NO: 979099 - RNA, 22 nt, Human
gcaggcaguuauuuaguagaau

SEQ ID NO: 979100 - RNA, 22 nt, Human
caggcagcaucagucugcugua

SEQ ID NO: 979101 - RNA, 22 nt, Human
gccuaauaacuagcuguguaac

SEQ ID NO: 979102 - RNA, 22 nt, Human
uucauuccugagcccauauuua

SEQ ID NO: 979103 - RNA, 22 nt, Human
gcugauuauuacaugucugugg

SEQ ID NO: 979104 - RNA, 22 nt, Human
guacacauuaugcuucucuaaa

SEQ ID NO: 979105 - RNA, 22 nt, Human
ucugggugaugaaaugcacugu

SEQ ID NO: 979106 - RNA, 22 nt, Human
ucauggagacuuugagccuguu

SEQ ID NO: 979107 - RNA, 22 nt, Human
agcuggggcugcagagaacagg

SEQ ID NO: 979108 - RNA, 22 nt, Human
agaaagcacucugucuuuuacc

SEQ ID NO: 979109 - RNA, 22 nt, Human
agagcuggcugcugcggugcuu

SEQ ID NO: 979110 - RNA, 22 nt, Human
cccauggggacaccaugaagga

SEQ ID NO: 979111 - RNA, 23 nt, Human
aaucuggcugauguuuuuucucu

SEQ ID NO: 979112 - RNA, 22 nt, Human
acccagagcugggcuuggcaaa

SEQ ID NO: 979113 - RNA, 22 nt, Human
uucucuuugacauuauucaggu

SEQ ID NO: 979114 - RNA, 22 nt, Human
cuggccuuggaagggagcccgu

SEQ ID NO: 979115 - RNA, 22 nt, Human
gggagggauuaguucugccugg

SEQ ID NO: 979116 - RNA, 22 nt, Human
uacaguaaccagucuacuuaga

SEQ ID NO: 979117 - RNA, 22 nt, Human
acagggccaggugagaggugcu

SEQ ID NO: 979118 - RNA, 22 nt, Human
ugaaagcagugccaugauuaug

SEQ ID NO: 979119 - RNA, 22 nt, Human
auuguggugucaguuauaggca

SEQ ID NO: 979120 - RNA, 23 nt, Human
agcccagcagagaaccuaggucc

SEQ ID NO: 979121 - RNA, 22 nt, Human
gcagcuggagcaucuucucauc

SEQ ID NO: 979122 - RNA, 22 nt, Human
gcagccugaugaucuggguugu

SEQ ID NO: 979123 - RNA, 19 nt, Human
ucagaggauuuggcuauga

SEQ ID NO: 979124 - RNA, 22 nt, Human
ccugccuggagcugagugugga

SEQ ID NO: 979125 - RNA, 22 nt, Human
uuuuuauaacucuuuugugaca

SEQ ID NO: 979126 - RNA, 20 nt, Human
cauuuguuagcuuucuacug

SEQ ID NO: 979127 - RNA, 22 nt, Human
uagcaggguccaaugugaggca

SEQ ID NO: 979128 - RNA, 22 nt, Human
gggaagagaccguacccuggcc

SEQ ID NO: 979129 - RNA, 22 nt, Human
auuguacaaugccuggaacauu

SEQ ID NO: 979130 - RNA, 22 nt, Human
aaaugucuuucuucugcuacgu

SEQ ID NO: 979131 - RNA, 22 nt, Human
cugccuugaaaaugaagcuuua

SEQ ID NO: 979132 - RNA, 22 nt, Human
ugugcuucugcagagacuauuu

SEQ ID NO: 979133 - RNA, 22 nt, Human
gaggccugaaaggggaccuaug

SEQ ID NO: 979134 - RNA, 22 nt, Human
ggagugacucacagcugggaca

SEQ ID NO: 979135 - RNA, 22 nt, Human
aaaucaguucucccuuucuuca

SEQ ID NO: 979136 - RNA, 22 nt, Human
ugugugcagacagauauuacuu

SEQ ID NO: 979137 - RNA, 19 nt, Human
agcagagcagggccguggg

SEQ ID NO: 979138 - RNA, 23 nt, Human
gggcugcuccaggccaaggcugg

SEQ ID NO: 979139 - RNA, 22 nt, Human
agccaggauggucucgaucggc

SEQ ID NO: 979140 - RNA, 22 nt, Human
uggacagguuugggugccuguu

SEQ ID NO: 979141 - RNA, 22 nt, Human
uuccuauuuccaugaaacacaa

SEQ ID NO: 979142 - RNA, 22 nt, Human
auggccaagaaauugccgacug

SEQ ID NO: 979143 - RNA, 22 nt, Human
acucugacuggagugagagagg

SEQ ID NO: 979144 - RNA, 22 nt, Human
agggcccucuggcaggccaggc

SEQ ID NO: 979145 - RNA, 22 nt, Human
cagucucuugcuucauuaguug

SEQ ID NO: 979146 - RNA, 22 nt, Human
caucaaauggcaagugaaagcu

SEQ ID NO: 979147 - RNA, 22 nt, Human
uggcugugucaucauagcugug

SEQ ID NO: 979148 - RNA, 21 nt, Human
aaagaacaggcagauguucuu

SEQ ID NO: 979149 - RNA, 22 nt, Human
uaggagcuaaaauauuuuauau

SEQ ID NO: 979150 - RNA, 22 nt, Human
ccagaggcuggggaaggauaca

SEQ ID NO: 979151 - RNA, 22 nt, Human
cauugcacugcagcccgggcaa

SEQ ID NO: 979152 - RNA, 22 nt, Human
ggagacagugguagggccuaag

SEQ ID NO: 979153 - RNA, 22 nt, Human
ccaggagcuggcauguggagag

SEQ ID NO: 979154 - RNA, 22 nt, Human
ugcuggggcucugaccacucca

SEQ ID NO: 979155 - RNA, 22 nt, Human
gcaugucaugucauguaggaau

SEQ ID NO: 979156 - RNA, 22 nt, Human
gccuuccuuacaccugcucagc

SEQ ID NO: 979157 - RNA, 22 nt, Human
augggguggaguccgggcagcg

SEQ ID NO: 979158 - RNA, 22 nt, Human
agacauuuggaagauacacaua

SEQ ID NO: 979159 - RNA, 22 nt, Human
ugguccugagcaccagccugac

SEQ ID NO: 979160 - RNA, 22 nt, Human
acagagcuuaauucaggagcuu

SEQ ID NO: 979161 - RNA, 22 nt, Human
aacugcuguggccuaguacuua

SEQ ID NO: 979162 - RNA, 22 nt, Human
gcagaaggucuggcacuucagg

SEQ ID NO: 979163 - RNA, 22 nt, Human
uucucacuauguauguagauug

SEQ ID NO: 979164 - RNA, 22 nt, Human
ugcugcuccccagcacacagca

SEQ ID NO: 979165 - RNA, 22 nt, Human
aaauauagcaauuaugccuacu

SEQ ID NO: 979166 - RNA, 22 nt, Human
agggcagcacagcugugcuccu

SEQ ID NO: 979167 - RNA, 20 nt, Human
gucagaggacccuagagcga

SEQ ID NO: 979168 - RNA, 22 nt, Human
ugaguagcggcuauguguaacu

SEQ ID NO: 979169 - RNA, 22 nt, Human
agucccagaucuacaggaggga

SEQ ID NO: 979170 - RNA, 22 nt, Human
ucagcuccucagagccucaguu

SEQ ID NO: 979171 - RNA, 22 nt, Human
gagaggaguuacuauuuccgag

SEQ ID NO: 979172 - RNA, 22 nt, Human
auagaaauggcagcuggugcua

SEQ ID NO: 979173 - RNA, 22 nt, Human
agauuucaauggauauugcaag

SEQ ID NO: 979174 - RNA, 22 nt, Human
gccaggcuccaggcccuccuga

SEQ ID NO: 979175 - RNA, 22 nt, Human
gcagggaccugccacugcuguc

SEQ ID NO: 979176 - RNA, 21 nt, Human
ccuggcuucagggugcacugg

SEQ ID NO: 979177 - RNA, 22 nt, Human
cuggccucauagccaagcugug

SEQ ID NO: 979178 - RNA, 22 nt, Human
cagugcaguugguggcaggggu

SEQ ID NO: 979179 - RNA, 22 nt, Human
acaaaccagcuuaagcaagaug

SEQ ID NO: 979180 - RNA, 22 nt, Human
uaucuuuaacuugcaguauuua

SEQ ID NO: 979181 - RNA, 22 nt, Human
guggagacgggacagaagcuaa

SEQ ID NO: 979182 - RNA, 22 nt, Human
auuacacaggauuugccuuacu

SEQ ID NO: 979183 - RNA, 22 nt, Human
uaauuucaauagcuugcauaau

SEQ ID NO: 979184 - RNA, 22 nt, Human
uggcccugacagguccugggca

SEQ ID NO: 979185 - RNA, 22 nt, Human
caccugagugucaguauucuca

SEQ ID NO: 979186 - RNA, 22 nt, Human
ggcagcauuuagagcacagugu

SEQ ID NO: 979187 - RNA, 22 nt, Human
acacagggggcauucuaggagu

SEQ ID NO: 979188 - RNA, 22 nt, Human
agucucagcuacuugggaggcu

SEQ ID NO: 979189 - RNA, 21 nt, Human
gcuccuggugcugcguggcgc

SEQ ID NO: 979190 - RNA, 22 nt, Human
uucucuucuguucagugcccaa

SEQ ID NO: 979191 - RNA, 22 nt, Human
cgcugggggaacagcgagggug

SEQ ID NO: 979192 - RNA, 22 nt, Human
aaaugcacaauaaaguaaaggc

SEQ ID NO: 979193 - RNA, 22 nt, Human
ucuguagcaagugagaggcauu

SEQ ID NO: 979194 - RNA, 22 nt, Human
gccuggagggucccucucugga

SEQ ID NO: 979195 - RNA, 22 nt, Human
ggcucugcagugacuugagggg

SEQ ID NO: 979196 - RNA, 22 nt, Human
acucuuuuauaaagcaucuuga

SEQ ID NO: 979197 - RNA, 22 nt, Human
ugaaggaaagagggaacauccc

SEQ ID NO: 979198 - RNA, 22 nt, Human
ugguccaggguguaguacagag

SEQ ID NO: 979199 - RNA, 22 nt, Human
ugcauguuauuguggcaagaau

SEQ ID NO: 979200 - RNA, 22 nt, Human
gcaggguauaauacuuagguga

SEQ ID NO: 979201 - RNA, 22 nt, Human
ccugcagguugcagaggcggaa

SEQ ID NO: 979202 - RNA, 22 nt, Human
cucaggguaaugaaagacgaau

SEQ ID NO: 979203 - RNA, 22 nt, Human
ucugaggcauaaccuguucugc

SEQ ID NO: 979204 - RNA, 22 nt, Human
aaaugcagauuuugaugcagca

SEQ ID NO: 979205 - RNA, 21 nt, Human
agcuuccugcagugggagguc

SEQ ID NO: 979206 - RNA, 22 nt, Human
ucaaaugcaggucuggucuugg

SEQ ID NO: 979207 - RNA, 18 nt, Human
gcucugcccaggcugccc

SEQ ID NO: 979208 - RNA, 22 nt, Human
agcagggggccacagucacagc

SEQ ID NO: 979209 - RNA, 21 nt, Human
aaagugguaaggauuauuuug

SEQ ID NO: 979210 - RNA, 23 nt, Human
ggagugcaauggcgccaucucgg

SEQ ID NO: 979211 - RNA, 22 nt, Human
aaaugccucugcuguacacaau

SEQ ID NO: 979212 - RNA, 22 nt, Human
cugggcuguaauguggcacuga

SEQ ID NO: 979213 - RNA, 22 nt, Human
uaauuuaauccaaguguuacau

SEQ ID NO: 979214 - RNA, 22 nt, Human
agcuauguauaaauaggccacu

SEQ ID NO: 979215 - RNA, 22 nt, Human
ucuuuacaucacaauuguaugg

SEQ ID NO: 979216 - RNA, 22 nt, Human
uaauuucuagggacuaaggugc

SEQ ID NO: 979217 - RNA, 22 nt, Human
gccugagcuacuagggagucug

SEQ ID NO: 979218 - RNA, 22 nt, Human
gucccugcccuccugggacuca

SEQ ID NO: 979219 - RNA, 22 nt, Human
cccuuccucccaggcuucugug

SEQ ID NO: 979220 - RNA, 22 nt, Human
ucuggcucugacacuacuguua

SEQ ID NO: 979221 - RNA, 22 nt, Human
aucuggcugagcgaggcccaca

SEQ ID NO: 979222 - RNA, 19 nt, Human
ggcugccuggagcgagggc

SEQ ID NO: 979223 - RNA, 22 nt, Human
ggcaucuguccaucucuccagc

SEQ ID NO: 979224 - RNA, 22 nt, Human
uuucuuauauucugucauuguu

SEQ ID NO: 979225 - RNA, 20 nt, Human
uacagaaugcaauaaaaugg

SEQ ID NO: 979226 - RNA, 23 nt, Human
acauacauggagauaaagugaug

SEQ ID NO: 979227 - RNA, 22 nt, Human
cucuggagcauuucaccuacau

SEQ ID NO: 979228 - RNA, 21 nt, Human
ucagaguguguuacagcaagc

SEQ ID NO: 979229 - RNA, 22 nt, Human
ucagcaguggcucucaugcagu

SEQ ID NO: 979230 - RNA, 22 nt, Human
acagcagcuggguucccaccau

SEQ ID NO: 979231 - RNA, 22 nt, Human
auaaaaaggacagauguggucu

SEQ ID NO: 979232 - RNA, 22 nt, Human
aguggggacuuaugccagcauu

SEQ ID NO: 979233 - RNA, 18 nt, Human
aagaggaggaaacccagg

SEQ ID NO: 979234 - RNA, 22 nt, Human
cagagcugcucaugguggccag

SEQ ID NO: 979235 - RNA, 22 nt, Human
aggccagcagcaugacggcauc

SEQ ID NO: 979236 - RNA, 22 nt, Human
gugcucuguguauuaggauguc

SEQ ID NO: 979237 - RNA, 22 nt, Human
ggggugggcgugcagggacacc

SEQ ID NO: 979238 - RNA, 22 nt, Human
ccuuaaaagaacuaucucuucu

SEQ ID NO: 979239 - RNA, 22 nt, Human
uacaguaacauguuguacaagc

SEQ ID NO: 979240 - RNA, 18 nt, Human
aaugcuauuguuauaggg

SEQ ID NO: 979241 - RNA, 21 nt, Human
agggccugugcucuccagguc

SEQ ID NO: 979242 - RNA, 22 nt, Human
gucauuguguggacauggagaa

SEQ ID NO: 979243 - RNA, 22 nt, Human
gcagcugggccccagccucucc

SEQ ID NO: 979244 - RNA, 22 nt, Human
caggcagcucgaugccuuguug

SEQ ID NO: 979245 - RNA, 22 nt, Human
uuagccauuaaauuacaaggug

SEQ ID NO: 979246 - RNA, 22 nt, Human
cagccucuaagcacagccucuc

SEQ ID NO: 979247 - RNA, 22 nt, Human
ucauuuuucacacagggucacc

SEQ ID NO: 979248 - RNA, 22 nt, Human
gaccugccugagcugccucugc

SEQ ID NO: 979249 - RNA, 22 nt, Human
aggcugccaaagcuucugucuc

SEQ ID NO: 979250 - RNA, 22 nt, Human
uaauuucuaauucauuuucagu

SEQ ID NO: 979251 - RNA, 22 nt, Human
ugccugucagggggagugggaa

SEQ ID NO: 979252 - RNA, 22 nt, Human
uaaggcacccauguucauacag

SEQ ID NO: 979253 - RNA, 22 nt, Human
ccuguucacccuccaugcacag

SEQ ID NO: 979254 - RNA, 22 nt, Human
ucuccugcagucagcagucuca

SEQ ID NO: 979255 - RNA, 22 nt, Human
uagugcuuuaggccugaguguc

SEQ ID NO: 979256 - RNA, 22 nt, Human
guggcccaggcuuggcgcuggc

SEQ ID NO: 979257 - RNA, 23 nt, Human
gccagccuugcucuccugcagcc

SEQ ID NO: 979258 - RNA, 22 nt, Human
ccaggccuuucuucuuggucug

SEQ ID NO: 979259 - RNA, 22 nt, Human
gucaggauuauaauccccaugg

SEQ ID NO: 979260 - RNA, 22 nt, Human
accugccuucucaaggacauga

SEQ ID NO: 979261 - RNA, 20 nt, Human
auuaggauuuuaggucauca

SEQ ID NO: 979262 - RNA, 22 nt, Human
uuucuagucucgaucucuuaau

SEQ ID NO: 979263 - RNA, 22 nt, Human
uggcaguguauagguggcuccu

SEQ ID NO: 979264 - RNA, 22 nt, Human
gacagccaugcacuucugcugu

SEQ ID NO: 979265 - RNA, 22 nt, Human
uggggcucaccuaggcuggaag

SEQ ID NO: 979266 - RNA, 22 nt, Human
acaguaauauugaugcucguca

SEQ ID NO: 979267 - RNA, 22 nt, Human
ucugggagguacugggaggugu

SEQ ID NO: 979268 - RNA, 22 nt, Human
auauuucaugggguuccauacu

SEQ ID NO: 979269 - RNA, 22 nt, Human
gugccagcaguuauggugauuu

SEQ ID NO: 979270 - RNA, 22 nt, Human
ucaggaugagcucauaacuaug

SEQ ID NO: 979271 - RNA, 22 nt, Human
gaggggaagacuucuggacagu

SEQ ID NO: 979272 - RNA, 22 nt, Human
ugaaacagucuccagacuugga

SEQ ID NO: 979273 - RNA, 20 nt, Human
gcugucuggauuagaagccu

SEQ ID NO: 979274 - RNA, 22 nt, Human
ccaggcugccgaggaaagaaag

SEQ ID NO: 979275 - RNA, 22 nt, Human
uuaggauagucuguuagaaaag

SEQ ID NO: 979276 - RNA, 21 nt, Human
ccucuggcuugugcugugccc

SEQ ID NO: 979277 - RNA, 22 nt, Human
uccauuuuguagguaugcuaca

SEQ ID NO: 979278 - RNA, 22 nt, Human
uaaggucauggugaauaauaag

SEQ ID NO: 979279 - RNA, 22 nt, Human
acagcaggauuuggcgauguug

SEQ ID NO: 979280 - RNA, 22 nt, Human
agcugccgaugcccagcugcau

SEQ ID NO: 979281 - RNA, 22 nt, Human
aggccagcacgacagccgcagg

SEQ ID NO: 979282 - RNA, 22 nt, Human
ugcucuguaacaaauugacaug

SEQ ID NO: 979283 - RNA, 22 nt, Human
gaggcugauucggggaacagca

SEQ ID NO: 979284 - RNA, 22 nt, Human
uagggaggcuacuucuuguagg

SEQ ID NO: 979285 - RNA, 22 nt, Human
aagccagauagaagaacucauu

SEQ ID NO: 979286 - RNA, 22 nt, Human
uuauuugguugcugacuuggaa

SEQ ID NO: 979287 - RNA, 22 nt, Human
accauuuaauaaguauuuccau

SEQ ID NO: 979288 - RNA, 19 nt, Human
acaagggcaggcaagguga

SEQ ID NO: 979289 - RNA, 22 nt, Human
accacuguaucuccagcacauu

SEQ ID NO: 979290 - RNA, 22 nt, Human
uuggccaauggugauucccggc

SEQ ID NO: 979291 - RNA, 22 nt, Human
aagggcagggaguuugugucua

SEQ ID NO: 979292 - RNA, 21 nt, Human
uggaggaauaaagcacagaag

SEQ ID NO: 979293 - RNA, 22 nt, Human
ugcugcucucagccaccaggaa

SEQ ID NO: 979294 - RNA, 22 nt, Human
gaggccugguagccgagcccca

SEQ ID NO: 979295 - RNA, 22 nt, Human
ugggcagagaucuggaucaaac

SEQ ID NO: 979296 - RNA, 22 nt, Human
ggccaaaccgcaauuauuuuug

SEQ ID NO: 979297 - RNA, 22 nt, Human
agcauuuauuucuuagaaauug

SEQ ID NO: 979298 - RNA, 20 nt, Human
ucugccacuuuuucugucac

SEQ ID NO: 979299 - RNA, 22 nt, Human
uuuaagauucaguaaggcaaac

SEQ ID NO: 979300 - RNA, 22 nt, Human
gccuggaguuguggugaagcca

SEQ ID NO: 979301 - RNA, 22 nt, Human
cauaauaucuccgauuacuugc

SEQ ID NO: 979302 - RNA, 22 nt, Human
uugaaucuggguacuuguaaua

SEQ ID NO: 979303 - RNA, 22 nt, Human
uuccuggccucucucugagcag

SEQ ID NO: 979304 - RNA, 22 nt, Human
uuugacauuauccuguuacugg

SEQ ID NO: 979305 - RNA, 22 nt, Human
guuugcauaaaguggaugcagg

SEQ ID NO: 979306 - RNA, 22 nt, Human
cccaggccccagggcuugucag

SEQ ID NO: 979307 - RNA, 22 nt, Human
auaucaaagcuaguggaaauuu

SEQ ID NO: 979308 - RNA, 22 nt, Human
gcuuuauguaaguccaaaggca

SEQ ID NO: 979309 - RNA, 22 nt, Human
cuggcagguggauggggacucc

SEQ ID NO: 979310 - RNA, 22 nt, Human
uagaaaagauaacauucugugc

SEQ ID NO: 979311 - RNA, 22 nt, Human
uaaaugcuaucgcauaaaaccu

SEQ ID NO: 979312 - RNA, 22 nt, Human
uccucugcuggaagggcaagag

SEQ ID NO: 979313 - RNA, 22 nt, Human
uuuguaugugauaagacuauuc

SEQ ID NO: 979314 - RNA, 22 nt, Human
agcagggcugcagugugucuuu

SEQ ID NO: 979315 - RNA, 22 nt, Human
gaguuuaacacuuggagaaaag

SEQ ID NO: 979316 - RNA, 22 nt, Human
auauaaguuaguggucauguuu

SEQ ID NO: 979317 - RNA, 22 nt, Human
caggggcaggugugagaucauc

SEQ ID NO: 979318 - RNA, 22 nt, Human
cuggagccggcgagccccagcc

SEQ ID NO: 979319 - RNA, 22 nt, Human
auguuuaagaaagucuuccaua

SEQ ID NO: 979320 - RNA, 22 nt, Human
ucccaggguccucuucuggaau

SEQ ID NO: 979321 - RNA, 22 nt, Human
caaggccuccugggcccagaga

SEQ ID NO: 979322 - RNA, 22 nt, Human
gccacguugccacccgggugac

SEQ ID NO: 979323 - RNA, 22 nt, Human
acagaauuaucaggaaauguua

SEQ ID NO: 979324 - RNA, 22 nt, Human
gcagggaagaucuuggagcugc

SEQ ID NO: 979325 - RNA, 22 nt, Human
uuacuuuggauggucaagaaag

SEQ ID NO: 979326 - RNA, 22 nt, Human
aguggaccagaagacugaagcu

SEQ ID NO: 979327 - RNA, 22 nt, Human
aaaaaaucagaucuuugguuaa

SEQ ID NO: 979328 - RNA, 22 nt, Human
ucuugggaaauaaacagauuga

SEQ ID NO: 979329 - RNA, 22 nt, Human
ugcuguguggaugugaagaauc

SEQ ID NO: 979330 - RNA, 22 nt, Human
ccugccagggccuuggaagaaa

SEQ ID NO: 979331 - RNA, 22 nt, Human
gcacccaggcuugggcagcaac

SEQ ID NO: 979332 - RNA, 22 nt, Human
auuuucaucauggguuuaacau

SEQ ID NO: 979333 - RNA, 22 nt, Human
gaaggccacaaaaaaugucaua

SEQ ID NO: 979334 - RNA, 18 nt, Human
aggcacuggaauuaaggg

SEQ ID NO: 979335 - RNA, 21 nt, Human
acaggcucuggggaugcuggg

SEQ ID NO: 979336 - RNA, 22 nt, Human
ccaaggcuccucagcuggucuu

SEQ ID NO: 979337 - RNA, 18 nt, Human
cguuuuuccgggauugca

SEQ ID NO: 979338 - RNA, 18 nt, Human
acauuucuaggugaaagc

SEQ ID NO: 979339 - RNA, 22 nt, Human
gcuuugaagucugugucuuuug

SEQ ID NO: 979340 - RNA, 22 nt, Human
gccucugcccuccugggacugc

SEQ ID NO: 979341 - RNA, 22 nt, Human
gcagggugccgacuucagggau

SEQ ID NO: 979342 - RNA, 19 nt, Human
acuuucuccaggaccuguu

SEQ ID NO: 979343 - RNA, 22 nt, Human
uagcuuuguguaugaugucugu

SEQ ID NO: 979344 - RNA, 22 nt, Human
gcacagggccuggcacauaaga

SEQ ID NO: 979345 - RNA, 18 nt, Human
aggcacagagcauacaua

SEQ ID NO: 979346 - RNA, 22 nt, Human
uaagaacagugacagccaacau

SEQ ID NO: 979347 - RNA, 22 nt, Human
gagacagcacaggccacuggga

SEQ ID NO: 979348 - RNA, 22 nt, Human
uugaaagacuucuccugugaaa

SEQ ID NO: 979349 - RNA, 21 nt, Human
ccuggcagaagccugauaugc

SEQ ID NO: 979350 - RNA, 22 nt, Human
gaaguuuauuucaaucuauuca

SEQ ID NO: 979351 - RNA, 22 nt, Human
cuguguccucccgcugcaccca

SEQ ID NO: 979352 - RNA, 22 nt, Human
agaggcuggauugagcauagac

SEQ ID NO: 979353 - RNA, 22 nt, Human
auguaucaugcaggguccauga

SEQ ID NO: 979354 - RNA, 22 nt, Human
ggaaagagcccagcagugcuug

SEQ ID NO: 979355 - RNA, 22 nt, Human
cagcuccugaggacugcuggga

SEQ ID NO: 979356 - RNA, 22 nt, Human
cauaauauacuacauugaugaa

SEQ ID NO: 979357 - RNA, 21 nt, Human
ucugucucuccacugcccugc

SEQ ID NO: 979358 - RNA, 22 nt, Human
agagacaggguuuugccauguu

SEQ ID NO: 979359 - RNA, 19 nt, Human
ggcugccuuuccuuaccag

SEQ ID NO: 979360 - RNA, 22 nt, Human
aauauuucuccuucguuauagc

SEQ ID NO: 979361 - RNA, 22 nt, Human
caaaguuuggcucucaugacau

SEQ ID NO: 979362 - RNA, 22 nt, Human
cauguacacucauguaacuaua

SEQ ID NO: 979363 - RNA, 22 nt, Human
uguauguaaaguuuguaauaga

SEQ ID NO: 979364 - RNA, 22 nt, Human
agauuucagguuggggcagaag

SEQ ID NO: 979365 - RNA, 22 nt, Human
auacagcagugaauaagauaaa

SEQ ID NO: 979366 - RNA, 22 nt, Human
ggcugcuggaagacugaacaag

SEQ ID NO: 979367 - RNA, 22 nt, Human
aaagaaauagauggcauuuaaa

SEQ ID NO: 979368 - RNA, 22 nt, Human
gcuccuggucuggagcuucaag

SEQ ID NO: 979369 - RNA, 22 nt, Human
cugugccaguguauuccuguga

SEQ ID NO: 979370 - RNA, 22 nt, Human
gccagagcacaggcugguagua

SEQ ID NO: 979371 - RNA, 22 nt, Human
uccuugaagcuuguaucuaaua

SEQ ID NO: 979372 - RNA, 22 nt, Human
gcacuaaaccaacauguaauaa

SEQ ID NO: 979373 - RNA, 22 nt, Human
uauuucagguauggugugaaau

SEQ ID NO: 979374 - RNA, 22 nt, Human
uauacugucgcauuacacucac

SEQ ID NO: 979375 - RNA, 22 nt, Human
ccaggagaugggaaaguagcag

SEQ ID NO: 979376 - RNA, 22 nt, Human
cagcagagaccaagugauuuga

SEQ ID NO: 979377 - RNA, 22 nt, Human
gggccccuuguaucucuggcuc

SEQ ID NO: 979378 - RNA, 22 nt, Human
aacuucuggauguuucaaaugu

SEQ ID NO: 979379 - RNA, 22 nt, Human
uccagagcagguggucagaagg

SEQ ID NO: 979380 - RNA, 22 nt, Human
uaaguuuaaauguacaugaagc

SEQ ID NO: 979381 - RNA, 22 nt, Human
auggaaaggcuguggaaacuua

SEQ ID NO: 979382 - RNA, 22 nt, Human
cagcugccagcuucucuccauc

SEQ ID NO: 979383 - RNA, 20 nt, Human
cagcucugggaaagaggcca

SEQ ID NO: 979384 - RNA, 22 nt, Human
cagggcugcuggccgugcccuc

SEQ ID NO: 979385 - RNA, 22 nt, Human
agaggaugauuuuaaggacacu

SEQ ID NO: 979386 - RNA, 22 nt, Human
ucagagugaggcgucaacauga

SEQ ID NO: 979387 - RNA, 22 nt, Human
ucucagagugacaaugagaauu

SEQ ID NO: 979388 - RNA, 22 nt, Human
uuuugaaagccagguuuguaug

SEQ ID NO: 979389 - RNA, 22 nt, Human
uaaggcaccauaauauauuuaa

SEQ ID NO: 979390 - RNA, 22 nt, Human
gaguuauuggguggaaagguag

SEQ ID NO: 979391 - RNA, 22 nt, Human
ucacaggaggaaccuggccugg

SEQ ID NO: 979392 - RNA, 22 nt, Human
ucaggacagccagggugcagac

SEQ ID NO: 979393 - RNA, 22 nt, Human
caaauacuggguaaguuaauuu

SEQ ID NO: 979394 - RNA, 22 nt, Human
uuugcagugauucuugcaguga

SEQ ID NO: 979395 - RNA, 22 nt, Human
agugacaacaaguugacuagaa

SEQ ID NO: 979396 - RNA, 22 nt, Human
auuuccuauggauacaggcaga

SEQ ID NO: 979397 - RNA, 20 nt, Human
uauuucugggcaaccauuua

SEQ ID NO: 979398 - RNA, 22 nt, Human
uagcacaucuggcgcuuauagg

SEQ ID NO: 979399 - RNA, 22 nt, Human
uccuggaggcaaaugagcacau

SEQ ID NO: 979400 - RNA, 22 nt, Human
ucuggcuccacaccucacugca

SEQ ID NO: 979401 - RNA, 22 nt, Human
uggcagaguuggagguggaaga

SEQ ID NO: 979402 - RNA, 22 nt, Human
gcagauggugggggaggaguac

SEQ ID NO: 979403 - RNA, 19 nt, Human
ggcugcugguuacagaggc

SEQ ID NO: 979404 - RNA, 22 nt, Human
ccuggggagaagagcuuccccc

SEQ ID NO: 979405 - RNA, 22 nt, Human
uuucacaaguuucaggauucug

SEQ ID NO: 979406 - RNA, 19 nt, Human
agaguauugaauuugcccu

SEQ ID NO: 979407 - RNA, 20 nt, Human
cugugccuaaaccuccgggu

SEQ ID NO: 979408 - RNA, 22 nt, Human
gugggaugguagguagguaaua

SEQ ID NO: 979409 - RNA, 22 nt, Human
uuccuaauggcaaaacauguuu

SEQ ID NO: 979410 - RNA, 22 nt, Human
cccaagcagggugcagaggcau

SEQ ID NO: 979411 - RNA, 22 nt, Human
ucugccuggauuuuggaaagcu

SEQ ID NO: 979412 - RNA, 22 nt, Human
gauuucuuuaugaaguacagaa

SEQ ID NO: 979413 - RNA, 19 nt, Human
agccuggcuuugcucugcu

SEQ ID NO: 979414 - RNA, 22 nt, Human
ucuuuccuagaggcugaugagu

SEQ ID NO: 979415 - RNA, 21 nt, Human
uccaggaguucuaauaggugu

SEQ ID NO: 979416 - RNA, 22 nt, Human
ggaggaugagcuacgaggagcu

SEQ ID NO: 979417 - RNA, 22 nt, Human
gagccuggauugaagugggugg

SEQ ID NO: 979418 - RNA, 22 nt, Human
gcccaggaaauaaaagugggcu

SEQ ID NO: 979419 - RNA, 22 nt, Human
cagcucccgccaucgggaggca

SEQ ID NO: 979420 - RNA, 18 nt, Human
uucacaggaaaugucuuu

SEQ ID NO: 979421 - RNA, 22 nt, Human
guagaagugaugucauguuaua

SEQ ID NO: 979422 - RNA, 22 nt, Human
ccagggugagaaaaggcuggau

SEQ ID NO: 979423 - RNA, 22 nt, Human
guccugggcccaggggcugccu

SEQ ID NO: 979424 - RNA, 22 nt, Human
uggcacaugguaagacucagua

SEQ ID NO: 979425 - RNA, 19 nt, Human
cugggccagagcuguccuc

SEQ ID NO: 979426 - RNA, 22 nt, Human
aauauuaauagaagggguucua

SEQ ID NO: 979427 - RNA, 22 nt, Human
uagaaguuaaaggaauacagaa

SEQ ID NO: 979428 - RNA, 22 nt, Human
uaaugaauaaacuugagaguca

SEQ ID NO: 979429 - RNA, 22 nt, Human
guaucuuuccacaucuucagua

SEQ ID NO: 979430 - RNA, 22 nt, Human
gcagcauacagggagaguacuc

SEQ ID NO: 979431 - RNA, 22 nt, Human
aacccagccguguagcugccgc

SEQ ID NO: 979432 - RNA, 22 nt, Human
gaagcucucaaacucuccccuu

SEQ ID NO: 979433 - RNA, 22 nt, Human
gucuuaaaaucagaggauauag

SEQ ID NO: 979434 - RNA, 22 nt, Human
agugcuuugguauagaacuauu

SEQ ID NO: 979435 - RNA, 22 nt, Human
uccuggcccgaucccugugaag

SEQ ID NO: 979436 - RNA, 22 nt, Human
aauucauccaugaacaauucca

SEQ ID NO: 979437 - RNA, 22 nt, Human
ucuucucccaucuccaggcagg

SEQ ID NO: 979438 - RNA, 22 nt, Human
aucaagaauguucauucuucua

SEQ ID NO: 979439 - RNA, 22 nt, Human
ucagaaauguaagcugaugacu

SEQ ID NO: 979440 - RNA, 22 nt, Human
aaaguguugggaagaaagugca

SEQ ID NO: 979441 - RNA, 22 nt, Human
agggccagcacuccuggcagga

SEQ ID NO: 979442 - RNA, 22 nt, Human
ugaaacaggaaguaaacagaca

SEQ ID NO: 979443 - RNA, 22 nt, Human
cuggcucauagagcagcuccaa

SEQ ID NO: 979444 - RNA, 22 nt, Human
aggcugucaucuuugcaggcag

SEQ ID NO: 979445 - RNA, 22 nt, Human
aauguucagaggacaauauaaa

SEQ ID NO: 979446 - RNA, 22 nt, Human
agugaggcuaauaggcaauggu

SEQ ID NO: 979447 - RNA, 22 nt, Human
uugggaaggcguggaagcagaa

SEQ ID NO: 979448 - RNA, 22 nt, Human
cuugaaucuucugaguauuugc

SEQ ID NO: 979449 - RNA, 22 nt, Human
gaccauuugcuaguaaauugca

SEQ ID NO: 979450 - RNA, 22 nt, Human
gaggcaguguugaaaaggagag

SEQ ID NO: 979451 - RNA, 22 nt, Human
gcuuccugagaaacaaucugau

SEQ ID NO: 979452 - RNA, 22 nt, Human
uagcagagcagggaucagagcc

SEQ ID NO: 979453 - RNA, 22 nt, Human
agauguaguagugggucuuuua

SEQ ID NO: 979454 - RNA, 22 nt, Human
gccuucaguagugucagcugua

SEQ ID NO: 979455 - RNA, 19 nt, Human
aucuuacagagcagaguac

SEQ ID NO: 979456 - RNA, 22 nt, Human
gugccuuccccgguggucuguu

SEQ ID NO: 979457 - RNA, 22 nt, Human
uuuccauguuggugaaaugagg

SEQ ID NO: 979458 - RNA, 22 nt, Human
ggcacagggaggcccuggugug

SEQ ID NO: 979459 - RNA, 17 nt, Human
gagaguguauuggaugc

SEQ ID NO: 979460 - RNA, 22 nt, Human
cauuguuaccaucuuuuaccua

SEQ ID NO: 979461 - RNA, 22 nt, Human
cugugcuugcggguguggagcc

SEQ ID NO: 979462 - RNA, 22 nt, Human
uaugcacacauguaugcaugug

SEQ ID NO: 979463 - RNA, 17 nt, Human
uucaaugauuaaugcau

SEQ ID NO: 979464 - RNA, 22 nt, Human
gccuucugauugcuggacugac

SEQ ID NO: 979465 - RNA, 22 nt, Human
cugggcagcuaccaccacugcu

SEQ ID NO: 979466 - RNA, 22 nt, Human
accccagaggcggaggcugcag

SEQ ID NO: 979467 - RNA, 19 nt, Human
agcuggggcgguguguguu

SEQ ID NO: 979468 - RNA, 22 nt, Human
agggccugagcuggcugaccuc

SEQ ID NO: 979469 - RNA, 23 nt, Human
accaggagaaaagcuuugcggga

SEQ ID NO: 979470 - RNA, 22 nt, Human
ugagccuguggggugacaacca

SEQ ID NO: 979471 - RNA, 20 nt, Human
ggcagagcuaugucuguugc

SEQ ID NO: 979472 - RNA, 22 nt, Human
uucuccucuguuggccuucccu

SEQ ID NO: 979473 - RNA, 22 nt, Human
gcuggccucuacaggccggcca

SEQ ID NO: 979474 - RNA, 22 nt, Human
uucuguauauuguaaagacuca

SEQ ID NO: 979475 - RNA, 22 nt, Human
auaaagacaugcuuacuugccc

SEQ ID NO: 979476 - RNA, 22 nt, Human
guuugaaugcaguaugcauuuu

SEQ ID NO: 979477 - RNA, 22 nt, Human
uguguccauucaggcacugacc

SEQ ID NO: 979478 - RNA, 20 nt, Human
caagcccucuuuagccugcc

SEQ ID NO: 979479 - RNA, 22 nt, Human
ucaucuugcugccauugcuuua

SEQ ID NO: 979480 - RNA, 22 nt, Human
acacuuuguuguggcauauacg

SEQ ID NO: 979481 - RNA, 22 nt, Human
agaggugacauaggagaggcuc

SEQ ID NO: 979482 - RNA, 22 nt, Human
gcaggugguccccguggagugg

SEQ ID NO: 979483 - RNA, 23 nt, Human
aggagaagagauuuccacaugca

SEQ ID NO: 979484 - RNA, 22 nt, Human
gccuugggcacaggcagggccc

SEQ ID NO: 979485 - RNA, 22 nt, Human
ugggcacuggaagccugcugug

SEQ ID NO: 979486 - RNA, 22 nt, Human
caggcugaggcaguaggguuug

SEQ ID NO: 979487 - RNA, 22 nt, Human
cacaggugcuccucggggagcu

SEQ ID NO: 979488 - RNA, 22 nt, Human
acugcagccuuugggcucauaa

SEQ ID NO: 979489 - RNA, 22 nt, Human
aguuuauagcccagauucaugg

SEQ ID NO: 979490 - RNA, 22 nt, Human
uggcagggugggcuucagcccc

SEQ ID NO: 979491 - RNA, 22 nt, Human
gagggcuccauuccccgugccc

SEQ ID NO: 979492 - RNA, 22 nt, Human
aauauccacacugugucccugc

SEQ ID NO: 979493 - RNA, 22 nt, Human
guggagccaggaucuccgcaca

SEQ ID NO: 979494 - RNA, 19 nt, Human
aggucauugauagugcagg

SEQ ID NO: 979495 - RNA, 20 nt, Human
uucuggaggcuacaagucug

SEQ ID NO: 979496 - RNA, 22 nt, Human
uguaacaguaagccugugagcu

SEQ ID NO: 979497 - RNA, 22 nt, Human
cccauucauccucgcuuccuuc

SEQ ID NO: 979498 - RNA, 22 nt, Human
uuggcagggccaggcucucucu

SEQ ID NO: 979499 - RNA, 22 nt, Human
aacugcuggggaggccaaacuc

SEQ ID NO: 979500 - RNA, 22 nt, Human
gcagccagaagacucagaacaa

SEQ ID NO: 979501 - RNA, 21 nt, Human
caugcaggauuuaaccuagaa

SEQ ID NO: 979502 - RNA, 22 nt, Human
cagagggaaaaggggaguaaua

SEQ ID NO: 979503 - RNA, 22 nt, Human
agaaugcuccagagcugaaaga

SEQ ID NO: 979504 - RNA, 22 nt, Human
aggagagggguaggauuaauuu

SEQ ID NO: 979505 - RNA, 22 nt, Human
aggcacugugcagucccaagca

SEQ ID NO: 979506 - RNA, 22 nt, Human
gcugugcuggaaggggaccugc

SEQ ID NO: 979507 - RNA, 22 nt, Human
ugggagaagcagcagccaagug

SEQ ID NO: 979508 - RNA, 22 nt, Human
auagugguuggauaugucagag

SEQ ID NO: 979509 - RNA, 22 nt, Human
cuguucucuggcgguggcuguu

SEQ ID NO: 979510 - RNA, 22 nt, Human
agcugcugugugcucaggcagg

SEQ ID NO: 979511 - RNA, 22 nt, Human
gggcugcuuauacugaugauaa

SEQ ID NO: 979512 - RNA, 20 nt, Human
ucacauccucucccaacaug

SEQ ID NO: 979513 - RNA, 23 nt, Human
ccucagcauggcaggagcccagc

SEQ ID NO: 979514 - RNA, 22 nt, Human
ggaaaaggccacagggacacau

SEQ ID NO: 979515 - RNA, 22 nt, Human
gccaggcagauaugugagcuua

SEQ ID NO: 979516 - RNA, 22 nt, Human
cuacuucuaaguacauggugau

SEQ ID NO: 979517 - RNA, 22 nt, Human
aggucccaggcauagcuggucu

SEQ ID NO: 979518 - RNA, 22 nt, Human
uucuucaaacaaaaguggcaug

SEQ ID NO: 979519 - RNA, 23 nt, Human
agaauuguaaauagaauauaccu

SEQ ID NO: 979520 - RNA, 22 nt, Human
uccucuggauauaagccucacc

SEQ ID NO: 979521 - RNA, 22 nt, Human
cgcugccaggucaccaggggua

SEQ ID NO: 979522 - RNA, 22 nt, Human
uuccucucaacaugccugccgg

SEQ ID NO: 979523 - RNA, 22 nt, Human
caaaguuaugaaugauaagauu

SEQ ID NO: 979524 - RNA, 22 nt, Human
ugaugaaaauaugauucugagg

SEQ ID NO: 979525 - RNA, 22 nt, Human
ucaaaugcggucauggcuuuua

SEQ ID NO: 979526 - RNA, 22 nt, Human
ucucaggaaauaggauuugagu

SEQ ID NO: 979527 - RNA, 19 nt, Human
ucgagucaagacacuaggc

SEQ ID NO: 979528 - RNA, 22 nt, Human
cugucucugucuuaacucccag

SEQ ID NO: 979529 - RNA, 22 nt, Human
ugaaugaguuuggcugcuguuc

SEQ ID NO: 979530 - RNA, 22 nt, Human
uuuugaauaauucagaaacagc

SEQ ID NO: 979531 - RNA, 22 nt, Human
cagaguccuggacacagagaca

SEQ ID NO: 979532 - RNA, 22 nt, Human
ucagaacauugacauucuuauu

SEQ ID NO: 979533 - RNA, 18 nt, Human
cuuuaugugcagagcuuu

SEQ ID NO: 979534 - RNA, 20 nt, Human
agugcaagaaagcacagcug

SEQ ID NO: 979535 - RNA, 22 nt, Human
cuuaacagcaagaucuguguca

SEQ ID NO: 979536 - RNA, 22 nt, Human
uaagaacagugucugucucaca

SEQ ID NO: 979537 - RNA, 20 nt, Human
aggcagagcgcacuuuuaga

SEQ ID NO: 979538 - RNA, 22 nt, Human
uucuauaagacucauauuucuu

SEQ ID NO: 979539 - RNA, 22 nt, Human
cuucugggcauucagcugcaca

SEQ ID NO: 979540 - RNA, 22 nt, Human
acaaaugcagcauaaagugaac

SEQ ID NO: 979541 - RNA, 22 nt, Human
acagguggagugguuagcaggc

SEQ ID NO: 979542 - RNA, 22 nt, Human
gggcagcuguaucugagcuuau

SEQ ID NO: 979543 - RNA, 20 nt, Human
cugagccaacucucuucuug

SEQ ID NO: 979544 - RNA, 22 nt, Human
cuggcuuccaugcuguaguggc

SEQ ID NO: 979545 - RNA, 20 nt, Human
acugggcauaccuguccugu

SEQ ID NO: 979546 - RNA, 22 nt, Human
auuaaauuaaguggcuaauuua

SEQ ID NO: 979547 - RNA, 22 nt, Human
ugaguaauaaacugucuugcuc

SEQ ID NO: 979548 - RNA, 22 nt, Human
cccuggaggcggagcuugcagu

SEQ ID NO: 979549 - RNA, 22 nt, Human
aggucauuuccuuagaggcaga

SEQ ID NO: 979550 - RNA, 22 nt, Human
ccugcuucagggaugauggcac

SEQ ID NO: 979551 - RNA, 22 nt, Human
auggauaagucaaagaguaucc

SEQ ID NO: 979552 - RNA, 22 nt, Human
uagcugucaccagaaauggcca

SEQ ID NO: 979553 - RNA, 22 nt, Human
acaaaugcuuaguucaccaaaa

SEQ ID NO: 979554 - RNA, 20 nt, Human
ccucaggaugagggugagca

SEQ ID NO: 979555 - RNA, 22 nt, Human
aggguagggccguagggccaug

SEQ ID NO: 979556 - RNA, 22 nt, Human
agagggagcccagucauagcug

SEQ ID NO: 979557 - RNA, 22 nt, Human
ggcaggcagaggcugagacagg

SEQ ID NO: 979558 - RNA, 22 nt, Human
caggccaggcugcauuugcccc

SEQ ID NO: 979559 - RNA, 22 nt, Human
aaagcagacugauuugcaucac

SEQ ID NO: 979560 - RNA, 22 nt, Human
ggagccuguuaguugagugcuc

SEQ ID NO: 979561 - RNA, 22 nt, Human
ucuggcucuguguccccaccca

SEQ ID NO: 979562 - RNA, 23 nt, Human
uggcagcagaucuuaaagugacc

SEQ ID NO: 979563 - RNA, 22 nt, Human
cccuugcacauuugucuuuaau

SEQ ID NO: 979564 - RNA, 22 nt, Human
uaaauucugaucaaguuccuuc

SEQ ID NO: 979565 - RNA, 22 nt, Human
gaggcuggugguuaguuccauu

SEQ ID NO: 979566 - RNA, 22 nt, Human
gcucugcugaagccccuugcau

SEQ ID NO: 979567 - RNA, 22 nt, Human
uugugugguagcuucauugaac

SEQ ID NO: 979568 - RNA, 22 nt, Human
uauggcauuguuggugaugaua

SEQ ID NO: 979569 - RNA, 22 nt, Human
ugguacuuggaggcagaaaaau

SEQ ID NO: 979570 - RNA, 22 nt, Human
gcugccuuuugcuccucccacc

SEQ ID NO: 979571 - RNA, 22 nt, Human
ugaaauguaaauaggacuagaa

SEQ ID NO: 979572 - RNA, 22 nt, Human
ugagccugaguucaaggcugca

SEQ ID NO: 979573 - RNA, 19 nt, Human
gcucugagaggggcauggg

SEQ ID NO: 979574 - RNA, 22 nt, Human
ucuacagacagagcagguggga

SEQ ID NO: 979575 - RNA, 22 nt, Human
auaauuuacuaagcucuaccuu

SEQ ID NO: 979576 - RNA, 21 nt, Human
uacugagaccucacagugugc

SEQ ID NO: 979577 - RNA, 22 nt, Human
ccucccuuggccauagccagcc

SEQ ID NO: 979578 - RNA, 22 nt, Human
gggaaaggaucagugggaggcu

SEQ ID NO: 979579 - RNA, 20 nt, Human
ccucaguguccuggacuggg

SEQ ID NO: 979580 - RNA, 22 nt, Human
aguucucaagacaauuaccugu

SEQ ID NO: 979581 - RNA, 22 nt, Human
guaguucugcagugucaccuga

SEQ ID NO: 979582 - RNA, 22 nt, Human
gcaggcagaucaccugucagga

SEQ ID NO: 979583 - RNA, 22 nt, Human
uggagugaaguaaagaggacaa

SEQ ID NO: 979584 - RNA, 22 nt, Human
agugcuuuccuucuugugacau

SEQ ID NO: 979585 - RNA, 22 nt, Human
uuuccuaagguagugauaauuu

SEQ ID NO: 979586 - RNA, 22 nt, Human
ugcuuuuaagaacaaugcugcu

SEQ ID NO: 979587 - RNA, 22 nt, Human
auguggcacagcacaguaagag

SEQ ID NO: 979588 - RNA, 22 nt, Human
guguggcugauugacaugguca

SEQ ID NO: 979589 - RNA, 22 nt, Human
cagcccagccgagggccuggcu

SEQ ID NO: 979590 - RNA, 22 nt, Human
caggcagccugagggaucuggg

SEQ ID NO: 979591 - RNA, 22 nt, Human
auccaggccuugaaguaccagu

SEQ ID NO: 979592 - RNA, 22 nt, Human
ugcagaggagcuggaaggcugg

SEQ ID NO: 979593 - RNA, 22 nt, Human
ucuucagaggaagucagucuuu

SEQ ID NO: 979594 - RNA, 22 nt, Human
aaaaagguugauccagauuagg

SEQ ID NO: 979595 - RNA, 22 nt, Human
uauuuguugaguuguuaugucu

SEQ ID NO: 979596 - RNA, 22 nt, Human
acagagcugggugcccccugga

SEQ ID NO: 979597 - RNA, 22 nt, Human
agccuggaggaggaguugagca

SEQ ID NO: 979598 - RNA, 22 nt, Human
gcagcccaauggacugagacag

SEQ ID NO: 979599 - RNA, 22 nt, Human
gacccaggguggucaccugaaa

SEQ ID NO: 979600 - RNA, 22 nt, Human
ugaagguggcauaggagagaug

SEQ ID NO: 979601 - RNA, 22 nt, Human
ucccagggacucucugccuucc

SEQ ID NO: 979602 - RNA, 20 nt, Human
cagucccaauccagggccag

SEQ ID NO: 979603 - RNA, 22 nt, Human
guggauggauuuugaggaaugg

SEQ ID NO: 979604 - RNA, 22 nt, Human
uaggaugaucuuguagagagau

SEQ ID NO: 979605 - RNA, 22 nt, Human
aggccugaaguguggagugggg

SEQ ID NO: 979606 - RNA, 22 nt, Human
aguguuugagacacauuucacu

SEQ ID NO: 979607 - RNA, 22 nt, Human
uuuguuuacucauucauugaug

SEQ ID NO: 979608 - RNA, 23 nt, Human
auaaggcauaaagguacauugga

SEQ ID NO: 979609 - RNA, 22 nt, Human
ccuggagcaggagcugcagagg

SEQ ID NO: 979610 - RNA, 19 nt, Human
gaggagcuaucggagacag

SEQ ID NO: 979611 - RNA, 17 nt, Human
ucaggcugggugcagug

SEQ ID NO: 979612 - RNA, 22 nt, Human
cagcugccacaggacuuucuga

SEQ ID NO: 979613 - RNA, 23 nt, Human
uggcaccaggcauucuaggggua

SEQ ID NO: 979614 - RNA, 19 nt, Human
agggccugagcagauguug

SEQ ID NO: 979615 - RNA, 22 nt, Human
cugccugcuucugagccagagg

SEQ ID NO: 979616 - RNA, 22 nt, Human
ucugcaggaggcuggcugcagg

SEQ ID NO: 979617 - RNA, 22 nt, Human
auaguguguaaagugcagugau

SEQ ID NO: 979618 - RNA, 22 nt, Human
agagcagauggagcuggaagag

SEQ ID NO: 979619 - RNA, 22 nt, Human
guuugcauggaagacagugagu

SEQ ID NO: 979620 - RNA, 22 nt, Human
uggaaagaauuccuaugguuca

SEQ ID NO: 979621 - RNA, 22 nt, Human
ugucaccaguuccaggaaauaa

SEQ ID NO: 979622 - RNA, 21 nt, Human
ucuccaguauccuucucugag

SEQ ID NO: 979623 - RNA, 22 nt, Human
uugcugaagugaagguauguuu

SEQ ID NO: 979624 - RNA, 22 nt, Human
uuucuuaguccuagagugauuu

SEQ ID NO: 979625 - RNA, 22 nt, Human
ugcucuucggggccacugcuug

SEQ ID NO: 979626 - RNA, 22 nt, Human
cuggcucaggguggucuggguc

SEQ ID NO: 979627 - RNA, 22 nt, Human
uuccucagaaaauacuguccaa

SEQ ID NO: 979628 - RNA, 22 nt, Human
acagcuggcaggggggcaugaa

SEQ ID NO: 979629 - RNA, 18 nt, Human
ugacucacccugucagug

SEQ ID NO: 979630 - RNA, 19 nt, Human
gcuccuggaugaccugugg

SEQ ID NO: 979631 - RNA, 22 nt, Human
gagugucugaauuagagcacaa

SEQ ID NO: 979632 - RNA, 22 nt, Human
aacaguaaugugguguuggguu

SEQ ID NO: 979633 - RNA, 22 nt, Human
ccaggagagcucucguucagug

SEQ ID NO: 979634 - RNA, 22 nt, Human
gaggauggaggugugagcuaug

SEQ ID NO: 979635 - RNA, 22 nt, Human
cgcagcagccccgugguaggug

SEQ ID NO: 979636 - RNA, 22 nt, Human
agccuucaguaaauccacugug

SEQ ID NO: 979637 - RNA, 22 nt, Human
cgcugggcgccgaccugcuggc

SEQ ID NO: 979638 - RNA, 22 nt, Human
gaaaaagugaccuugguagcua

SEQ ID NO: 979639 - RNA, 22 nt, Human
auggggugagacuaggauuaaa

SEQ ID NO: 979640 - RNA, 19 nt, Human
acuggcagcuguagucugu

SEQ ID NO: 979641 - RNA, 22 nt, Human
ucucagagagcuguguuuuccu

SEQ ID NO: 979642 - RNA, 22 nt, Human
ugggaggaucgcuugagcccag

SEQ ID NO: 979643 - RNA, 22 nt, Human
gggcuggucuggcuuagucagg

SEQ ID NO: 979644 - RNA, 22 nt, Human
agcaguagugauggccccugag

SEQ ID NO: 979645 - RNA, 22 nt, Human
gccacccccaaguagguggucu

SEQ ID NO: 979646 - RNA, 20 nt, Human
agggucaguagcacagagcu

SEQ ID NO: 979647 - RNA, 22 nt, Human
uugauacagcagccugugaucc

SEQ ID NO: 979648 - RNA, 22 nt, Human
ggaggugggauuaggaccuaaa

SEQ ID NO: 979649 - RNA, 22 nt, Human
caaaugauagagccgauuauca

SEQ ID NO: 979650 - RNA, 22 nt, Human
aggcagcuggacauaacuaacc

SEQ ID NO: 979651 - RNA, 21 nt, Human
gaggcugucugcugcuggccu

SEQ ID NO: 979652 - RNA, 19 nt, Human
cuggcagccugucuguguc

SEQ ID NO: 979653 - RNA, 22 nt, Human
auuugaagucuucaugauuucu

SEQ ID NO: 979654 - RNA, 22 nt, Human
uuucauguuuucuuaaauggca

SEQ ID NO: 979655 - RNA, 22 nt, Human
ugacauaaaucuaaaggaaagg

SEQ ID NO: 979656 - RNA, 22 nt, Human
caggggcaagaaugcugucagc

SEQ ID NO: 979657 - RNA, 22 nt, Human
uccaggaguccuggguggcccc

SEQ ID NO: 979658 - RNA, 22 nt, Human
guguaaggugaaaucaacaaau

SEQ ID NO: 979659 - RNA, 22 nt, Human
auguaacaggugaagcucugag

SEQ ID NO: 979660 - RNA, 20 nt, Human
cccugcagccaugggagugg

SEQ ID NO: 979661 - RNA, 22 nt, Human
caguguggagggagagagccug

SEQ ID NO: 979662 - RNA, 22 nt, Human
ggcacugagaacaggcugacuu

SEQ ID NO: 979663 - RNA, 22 nt, Human
ucaaauacauggucaaucaacu

SEQ ID NO: 979664 - RNA, 21 nt, Human
ucacuagugccuucugucauu

SEQ ID NO: 979665 - RNA, 22 nt, Human
ccagagaccagaacauggggau

SEQ ID NO: 979666 - RNA, 22 nt, Human
agggauguaaauucuucuucuu

SEQ ID NO: 979667 - RNA, 22 nt, Human
uuagcaucugcuguaagcuuau

SEQ ID NO: 979668 - RNA, 22 nt, Human
gucucuaucauagcugaacccu

SEQ ID NO: 979669 - RNA, 22 nt, Human
ccgggccucgggacaccgggua

SEQ ID NO: 979670 - RNA, 22 nt, Human
cugaagcaaaggaucgagcuaa

SEQ ID NO: 979671 - RNA, 22 nt, Human
ugagcuggucacuccuucugaa

SEQ ID NO: 979672 - RNA, 22 nt, Human
cuggagagaccgaaagaggcug

SEQ ID NO: 979673 - RNA, 22 nt, Human
caguuucuguuuuaaauagcag

SEQ ID NO: 979674 - RNA, 17 nt, Human
acagagguuauacagac

SEQ ID NO: 979675 - RNA, 22 nt, Human
uuacauuagacccacuuucaug

SEQ ID NO: 979676 - RNA, 22 nt, Human
cagguacacucccuugugcuga

SEQ ID NO: 979677 - RNA, 22 nt, Human
accaggagacaugaccaaugag

SEQ ID NO: 979678 - RNA, 22 nt, Human
cagguggguacaucacagagac

SEQ ID NO: 979679 - RNA, 22 nt, Human
guuauacauauguguuaacaaa

SEQ ID NO: 979680 - RNA, 18 nt, Human
ucuccuggguaggggccu

SEQ ID NO: 979681 - RNA, 22 nt, Human
auuguauuagcacaauacaauu

SEQ ID NO: 979682 - RNA, 22 nt, Human
caugggagguuggcuuggcaug

SEQ ID NO: 979683 - RNA, 22 nt, Human
caggaaaaaugccaggagucag

SEQ ID NO: 979684 - RNA, 22 nt, Human
uguuuauaccuugguauaacca

SEQ ID NO: 979685 - RNA, 22 nt, Human
aaaacuaaauacgcuuugccuc

SEQ ID NO: 979686 - RNA, 22 nt, Human
gaggcugcccaacuggagugga

SEQ ID NO: 979687 - RNA, 22 nt, Human
agccucugguccucccucagcu

SEQ ID NO: 979688 - RNA, 22 nt, Human
accgaaggaaacuggaaccguu

SEQ ID NO: 979689 - RNA, 22 nt, Human
cauuuaaagguuguggguaaaa

SEQ ID NO: 979690 - RNA, 22 nt, Human
gaggcaggcacuguuaucagca

SEQ ID NO: 979691 - RNA, 22 nt, Human
ggcccacacugacagcugagcu

SEQ ID NO: 979692 - RNA, 22 nt, Human
agcccaggcagagggaugcuug

SEQ ID NO: 979693 - RNA, 22 nt, Human
gaugagggccugguggcugugc

SEQ ID NO: 979694 - RNA, 22 nt, Human
auuucucuuagcaagacauuac

SEQ ID NO: 979695 - RNA, 22 nt, Human
cagucucuaaaucaaucugaau

SEQ ID NO: 979696 - RNA, 22 nt, Human
aacuucugggcuguccaaaacu

SEQ ID NO: 979697 - RNA, 22 nt, Human
agaugcugugaggaagcuagga

SEQ ID NO: 979698 - RNA, 22 nt, Human
ggcuuugccuggaauuuccuug

SEQ ID NO: 979699 - RNA, 22 nt, Human
gcugucccgaaccccugguaau

SEQ ID NO: 979700 - RNA, 22 nt, Human
ccagcuccuucugucuguggag

SEQ ID NO: 979701 - RNA, 22 nt, Human
caauaaguaauaggcaucuaau

SEQ ID NO: 979702 - RNA, 22 nt, Human
uucauuaaguauaaaauguggu

SEQ ID NO: 979703 - RNA, 22 nt, Human
cuuccucaugugcaaugcaagc

SEQ ID NO: 979704 - RNA, 22 nt, Human
aguuugaaauguuggcaauauu

SEQ ID NO: 979705 - RNA, 22 nt, Human
aggcaguguguagcuggaagag

SEQ ID NO: 979706 - RNA, 22 nt, Human
ggcaccuggauguagcagugaa

SEQ ID NO: 979707 - RNA, 22 nt, Human
ggugcucaagagggcauccucu

SEQ ID NO: 979708 - RNA, 22 nt, Human
augcugugcuggcuaaccaugg

SEQ ID NO: 979709 - RNA, 22 nt, Human
ggcugccugaacuuuggggaaa

SEQ ID NO: 979710 - RNA, 22 nt, Human
ugccuuccuggagcugaaggcu

SEQ ID NO: 979711 - RNA, 22 nt, Human
caccuuuugugucugcguuugu

SEQ ID NO: 979712 - RNA, 19 nt, Human
aacuagaaagguuuugaga

SEQ ID NO: 979713 - RNA, 22 nt, Human
aagcugccugggaggaagggcu

SEQ ID NO: 979714 - RNA, 22 nt, Human
cauggcaggugcagauucugug

SEQ ID NO: 979715 - RNA, 22 nt, Human
uucaggaucacuaaacccucca

SEQ ID NO: 979716 - RNA, 22 nt, Human
augugucuucuaagccaagccu

SEQ ID NO: 979717 - RNA, 22 nt, Human
gccugagagucugcauuucuaa

SEQ ID NO: 979718 - RNA, 22 nt, Human
uccugagauucugcauuucuaa

SEQ ID NO: 979719 - RNA, 20 nt, Human
ugcagcugguuucacaggga

SEQ ID NO: 979720 - RNA, 22 nt, Human
ucccaggaauccguccucuaga

SEQ ID NO: 979721 - RNA, 20 nt, Human
agguggcuccugcugggggu

SEQ ID NO: 979722 - RNA, 21 nt, Human
agcagaggggacauguuugau

SEQ ID NO: 979723 - RNA, 22 nt, Human
cauaugaaauaugaguugaaca

SEQ ID NO: 979724 - RNA, 19 nt, Human
cagaguccuugaccagucc

SEQ ID NO: 979725 - RNA, 22 nt, Human
ggagggcucaauugacuccuga

SEQ ID NO: 979726 - RNA, 22 nt, Human
uucacauugugcagauuauggu

SEQ ID NO: 979727 - RNA, 22 nt, Human
uccuuguaaaggagcucuaaca

SEQ ID NO: 979728 - RNA, 22 nt, Human
cugugucuucuguuuugaaguu

SEQ ID NO: 979729 - RNA, 22 nt, Human
auguacaguggaaacuaacaaa

SEQ ID NO: 979730 - RNA, 22 nt, Human
uguucuucuagauugccuuuua

SEQ ID NO: 979731 - RNA, 22 nt, Human
gccaggcuguuuuuauuacugu

SEQ ID NO: 979732 - RNA, 22 nt, Human
auauaguuggguuucauucuac

SEQ ID NO: 979733 - RNA, 22 nt, Human
ggcagaggaagcuggaaguggg

SEQ ID NO: 979734 - RNA, 22 nt, Human
ugaaagcuguccacuaggcugu

SEQ ID NO: 979735 - RNA, 22 nt, Human
ucugccagugguuuggcccuga

SEQ ID NO: 979736 - RNA, 22 nt, Human
aagauacugaugauguaggcua

SEQ ID NO: 979737 - RNA, 22 nt, Human
uucauguaauuccauaagguaa

SEQ ID NO: 979738 - RNA, 22 nt, Human
ucaaaacaacacucagguguaa

SEQ ID NO: 979739 - RNA, 22 nt, Human
ugggugggagcacccugucugg

SEQ ID NO: 979740 - RNA, 18 nt, Human
uggcagcuagguaaagaa

SEQ ID NO: 979741 - RNA, 22 nt, Human
cagggacaauggcagagccuga

SEQ ID NO: 979742 - RNA, 22 nt, Human
cucagcccagcccaggaccagg

SEQ ID NO: 979743 - RNA, 22 nt, Human
ucucagaguuuacggggcugaa

SEQ ID NO: 979744 - RNA, 23 nt, Human
uccugaggguuucccagccuugg

SEQ ID NO: 979745 - RNA, 22 nt, Human
gugggagcuuuggcaucaggcu

SEQ ID NO: 979746 - RNA, 22 nt, Human
uuuuaucaaucauuaagacauu

SEQ ID NO: 979747 - RNA, 22 nt, Human
gcagcuucaguaggugaagaca

SEQ ID NO: 979748 - RNA, 22 nt, Human
gacccaggagagaggguugcau

SEQ ID NO: 979749 - RNA, 22 nt, Human
gucaccaggucugaugcagcca

SEQ ID NO: 979750 - RNA, 22 nt, Human
ccccggaggcggagguugcagu

SEQ ID NO: 979751 - RNA, 22 nt, Human
cccaggaggcgcagguugcggu

SEQ ID NO: 979752 - RNA, 22 nt, Human
agccuggaggccaggagacagu

SEQ ID NO: 979753 - RNA, 22 nt, Human
agcugccacugagggugcacag

SEQ ID NO: 979754 - RNA, 22 nt, Human
uguuuuaaucucccauugcucu

SEQ ID NO: 979755 - RNA, 22 nt, Human
cugcuguguuccuccugcaucu

SEQ ID NO: 979756 - RNA, 22 nt, Human
acauucaugucccacuucuagc

SEQ ID NO: 979757 - RNA, 22 nt, Human
gggugggaacaggaugccagga

SEQ ID NO: 979758 - RNA, 22 nt, Human
uucuuucucaacaugaauguuu

SEQ ID NO: 979759 - RNA, 22 nt, Human
gcugucugcugugcacugagca

SEQ ID NO: 979760 - RNA, 22 nt, Human
agcagccaguucucugugguag

SEQ ID NO: 979761 - RNA, 22 nt, Human
guaggcagggcuguggggagaa

SEQ ID NO: 979762 - RNA, 22 nt, Human
aaaugaccagaauacaggcuuc

SEQ ID NO: 979763 - RNA, 22 nt, Human
auguaugucugcauacacauac

SEQ ID NO: 979764 - RNA, 20 nt, Human
cucucuggaaggugggagcc

SEQ ID NO: 979765 - RNA, 22 nt, Human
uuucuauucuggaucuguggca

SEQ ID NO: 979766 - RNA, 22 nt, Human
gaggcuggcagaaaagcacagg

SEQ ID NO: 979767 - RNA, 22 nt, Human
ucucuucauagugacacccauc

SEQ ID NO: 979768 - RNA, 22 nt, Human
cccuugggguggagguugcagu

SEQ ID NO: 979769 - RNA, 22 nt, Human
uuuaaauguuuaaaacucguga

SEQ ID NO: 979770 - RNA, 22 nt, Human
agccacagugcaagagagaaaa

SEQ ID NO: 979771 - RNA, 22 nt, Human
gucuauauauugcuugaauaau

SEQ ID NO: 979772 - RNA, 22 nt, Human
ccaggcagagggauccccaucc

SEQ ID NO: 979773 - RNA, 22 nt, Human
cugccuuggcccuaguucaugg

SEQ ID NO: 979774 - RNA, 22 nt, Human
ccacagagacaggguccuugcu

SEQ ID NO: 979775 - RNA, 18 nt, Human
gggcacuggggacuggag

SEQ ID NO: 979776 - RNA, 18 nt, Human
ugugaacacauuuuucug

SEQ ID NO: 979777 - RNA, 22 nt, Human
aggccagcccugggcugagaga

SEQ ID NO: 979778 - RNA, 22 nt, Human
caauauucaguggaaaagccau

SEQ ID NO: 979779 - RNA, 22 nt, Human
gggagguucuguucgcacuuga

SEQ ID NO: 979780 - RNA, 22 nt, Human
cuccagggaggucugcaggacu

SEQ ID NO: 979781 - RNA, 22 nt, Human
aggagaaagacuggacagccaa

SEQ ID NO: 979782 - RNA, 22 nt, Human
agaugaaagauuuuuauagaga

SEQ ID NO: 979783 - RNA, 22 nt, Human
uuuccuucaucaucugagagcu

SEQ ID NO: 979784 - RNA, 22 nt, Human
cuucagaagccugcagccuuug

SEQ ID NO: 979785 - RNA, 22 nt, Human
cuggaagguuccucccagcucc

SEQ ID NO: 979786 - RNA, 22 nt, Human
cccauuuagauaacaguucaaa

SEQ ID NO: 979787 - RNA, 22 nt, Human
cagaggccauauuucuucacuc

SEQ ID NO: 979788 - RNA, 22 nt, Human
cugggcaguuuuacaucauugc

SEQ ID NO: 979789 - RNA, 22 nt, Human
uccaggaggacugagggggcug

SEQ ID NO: 979790 - RNA, 22 nt, Human
ccucucucuccugcacacacac

SEQ ID NO: 979791 - RNA, 22 nt, Human
acagcuggaggccccauugucc

SEQ ID NO: 979792 - RNA, 22 nt, Human
aauguggaaucauggacuuuau

SEQ ID NO: 979793 - RNA, 23 nt, Human
uggugccucagaagcagugggcu

SEQ ID NO: 979794 - RNA, 22 nt, Human
acccaggacucucuuccaguag

SEQ ID NO: 979795 - RNA, 22 nt, Human
cugugauuguuaguuccuauac

SEQ ID NO: 979796 - RNA, 22 nt, Human
uggcucagugcauucacaguaa

SEQ ID NO: 979797 - RNA, 21 nt, Human
uggcucuggguaggagagugc

SEQ ID NO: 979798 - RNA, 22 nt, Human
uggagcaggcaucuuucucucu

SEQ ID NO: 979799 - RNA, 22 nt, Human
cucuucaaaagucuaauccuua

SEQ ID NO: 979800 - RNA, 22 nt, Human
uccucaggcugccuggaagacu

SEQ ID NO: 979801 - RNA, 20 nt, Human
uuuacauuuugaaacaguga

SEQ ID NO: 979802 - RNA, 19 nt, Human
uugguggugguuuugguuc

SEQ ID NO: 979803 - RNA, 20 nt, Human
gguagcagcugcugucaucc

SEQ ID NO: 979804 - RNA, 22 nt, Human
ugugcugguacaugugaggaug

SEQ ID NO: 979805 - RNA, 22 nt, Human
gcagaagcugggcagcgaggug

SEQ ID NO: 979806 - RNA, 18 nt, Human
cagcagagacauucaaaa

SEQ ID NO: 979807 - RNA, 22 nt, Human
agcugccagcaucccggaaggg

SEQ ID NO: 979808 - RNA, 17 nt, Human
ucuuuccugccaugcuc

SEQ ID NO: 979809 - RNA, 22 nt, Human
caaggccaguuucuccuaguca

SEQ ID NO: 979810 - RNA, 22 nt, Human
augcugugucaccuuaggauuu

SEQ ID NO: 979811 - RNA, 22 nt, Human
ugaaauguuugaagaccacuga

SEQ ID NO: 979812 - RNA, 22 nt, Human
acagccagggcauugucgccga

SEQ ID NO: 979813 - RNA, 22 nt, Human
uucccaguauuaccuucaggaa

SEQ ID NO: 979814 - RNA, 22 nt, Human
uggcagaguucgcugugccuuu

SEQ ID NO: 979815 - RNA, 22 nt, Human
uccugagauaaaucucauguga

SEQ ID NO: 979816 - RNA, 22 nt, Human
gcugggcuucucaaugcugccu

SEQ ID NO: 979817 - RNA, 22 nt, Human
ucccagagauuuccucuccuuc

SEQ ID NO: 979818 - RNA, 22 nt, Human
agauuuccugcacugccuuuga

SEQ ID NO: 979819 - RNA, 22 nt, Human
caggguggaagcuguagagugg

SEQ ID NO: 979820 - RNA, 22 nt, Human
aaguguguauuguuuaugcugc

SEQ ID NO: 979821 - RNA, 20 nt, Human
cccuaggaacgcagcaggag

SEQ ID NO: 979822 - RNA, 22 nt, Human
auugaaaggcaaaguaggaagc

SEQ ID NO: 979823 - RNA, 22 nt, Human
gaaaaugugucaucccuacugu

SEQ ID NO: 979824 - RNA, 22 nt, Human
uaaaugugcacagguuagaagg

SEQ ID NO: 979825 - RNA, 22 nt, Human
ugaaaguuacaggaaaacagau

SEQ ID NO: 979826 - RNA, 22 nt, Human
uggguagaggaauugggcuacc

SEQ ID NO: 979827 - RNA, 22 nt, Human
aagucuuagcaacuaucgcuuu

SEQ ID NO: 979828 - RNA, 22 nt, Human
gauggcagucaaccaggugagg

SEQ ID NO: 979829 - RNA, 22 nt, Human
ggagccugcgggagcucccauu

SEQ ID NO: 979830 - RNA, 20 nt, Human
agcuucuucugucuaauuuu

SEQ ID NO: 979831 - RNA, 22 nt, Human
ccucccagugccuccagagcag

SEQ ID NO: 979832 - RNA, 22 nt, Human
guaagucugaguguaauucaca

SEQ ID NO: 979833 - RNA, 22 nt, Human
gcucucagguacaaagcugugu

SEQ ID NO: 979834 - RNA, 19 nt, Human
ccagagcccgccagauggg

SEQ ID NO: 979835 - RNA, 22 nt, Human
cagcauugaucccaggcugugg

SEQ ID NO: 979836 - RNA, 22 nt, Human
caagagcuacccugugccauau

SEQ ID NO: 979837 - RNA, 22 nt, Human
auuucuguugcuuauaaauuac

SEQ ID NO: 979838 - RNA, 22 nt, Human
acuuugaaggggaacauuuuaa

SEQ ID NO: 979839 - RNA, 22 nt, Human
uucagcaagaccaccauguacc

SEQ ID NO: 979840 - RNA, 22 nt, Human
aggccuggugugccggaugcag

SEQ ID NO: 979841 - RNA, 18 nt, Human
aggcccuggccucgaaca

SEQ ID NO: 979842 - RNA, 22 nt, Human
aaaguucagauuagacucaaga

SEQ ID NO: 979843 - RNA, 22 nt, Human
cuggcaggaaguuagaugguaa

SEQ ID NO: 979844 - RNA, 22 nt, Human
ccucuucugcuucaggagcacu

SEQ ID NO: 979845 - RNA, 21 nt, Human
cuguuucuugugaagugacac

SEQ ID NO: 979846 - RNA, 22 nt, Human
cacaaaaguaggaggcaggcgg

SEQ ID NO: 979847 - RNA, 20 nt, Human
aggcacuguugucuguaucc

SEQ ID NO: 979848 - RNA, 22 nt, Human
agcccagggaaccaggaagugg

SEQ ID NO: 979849 - RNA, 22 nt, Human
gagauguacaauguguauuaau

SEQ ID NO: 979850 - RNA, 22 nt, Human
ucagagagccucaggcacugcc

SEQ ID NO: 979851 - RNA, 22 nt, Human
gugcagugaaaaaagaaugucc

SEQ ID NO: 979852 - RNA, 21 nt, Human
cagaggcaggcucugugugug

SEQ ID NO: 979853 - RNA, 17 nt, Human
aggcauggucuggggug

SEQ ID NO: 979854 - RNA, 22 nt, Human
aagggcagccugacucacgguc

SEQ ID NO: 979855 - RNA, 18 nt, Human
uggagcugagugcugugc

SEQ ID NO: 979856 - RNA, 22 nt, Human
cugggaugucuauagaacacuu

SEQ ID NO: 979857 - RNA, 22 nt, Human
ggcucuggugaggguaggagau

SEQ ID NO: 979858 - RNA, 22 nt, Human
gugggacucuucuuuggcagug

SEQ ID NO: 979859 - RNA, 22 nt, Human
caaaugauacuguuuuuagucu

SEQ ID NO: 979860 - RNA, 22 nt, Human
ccauccuaucugaccuacuugu

SEQ ID NO: 979861 - RNA, 22 nt, Human
auuuuguggguucugcugaugu

SEQ ID NO: 979862 - RNA, 22 nt, Human
cccuggaggcaaagguugcagu

SEQ ID NO: 979863 - RNA, 22 nt, Human
cuguaaauaugaagaauauaug

SEQ ID NO: 979864 - RNA, 22 nt, Human
ucuucacagaugcauauacuuc

SEQ ID NO: 979865 - RNA, 22 nt, Human
cagcagcuacuuggagcagcag

SEQ ID NO: 979866 - RNA, 22 nt, Human
uuguuacaucuuauguaagugg

SEQ ID NO: 979867 - RNA, 22 nt, Human
uccauuuucaucucauguauaa

SEQ ID NO: 979868 - RNA, 22 nt, Human
caggcagcauuuacucugauga

SEQ ID NO: 979869 - RNA, 22 nt, Human
gccauuuucugucuuguuuauu

SEQ ID NO: 979870 - RNA, 22 nt, Human
auuauaggcuugagccaccgug

SEQ ID NO: 979871 - RNA, 18 nt, Human
cucugcuaaugggcagcu

SEQ ID NO: 979872 - RNA, 22 nt, Human
caggggcucugggugaugugag

SEQ ID NO: 979873 - RNA, 22 nt, Human
agccacagcaacaagugcaauu

SEQ ID NO: 979874 - RNA, 22 nt, Human
accagagcagacuacuggaggu

SEQ ID NO: 979875 - RNA, 22 nt, Human
acucucucacagcuuggcugau

SEQ ID NO: 979876 - RNA, 22 nt, Human
aucaaaaccuugacuuuuaaug

SEQ ID NO: 979877 - RNA, 22 nt, Human
gaaaugcaggcuuggauucagc

SEQ ID NO: 979878 - RNA, 22 nt, Human
ugaagccaucccucagauggcc

SEQ ID NO: 979879 - RNA, 22 nt, Human
agcuguguguuuccacugagcu

SEQ ID NO: 979880 - RNA, 22 nt, Human
ggggacugccuuccacagacac

SEQ ID NO: 979881 - RNA, 22 nt, Human
gacauucacagguaaacauucc

SEQ ID NO: 979882 - RNA, 22 nt, Human
aagcagggugucuugacccaug

SEQ ID NO: 979883 - RNA, 22 nt, Human
aggccagcgcugcuagcucccg

SEQ ID NO: 979884 - RNA, 22 nt, Human
auggggcugggauucuccucgg

SEQ ID NO: 979885 - RNA, 22 nt, Human
augcccugugguucaugugaga

SEQ ID NO: 979886 - RNA, 22 nt, Human
aggacuuagaacauuauguacu

SEQ ID NO: 979887 - RNA, 22 nt, Human
gaaauauuguacuggagauguu

SEQ ID NO: 979888 - RNA, 22 nt, Human
ugcagugguugagagcccagac

SEQ ID NO: 979889 - RNA, 22 nt, Human
aaugcacacauuugguacugaa

SEQ ID NO: 979890 - RNA, 22 nt, Human
caggcugucugaauggaggccc

SEQ ID NO: 979891 - RNA, 22 nt, Human
caaaaguucucacccagacaug

SEQ ID NO: 979892 - RNA, 22 nt, Human
uuggaugaagucuagcuuuagu

SEQ ID NO: 979893 - RNA, 22 nt, Human
gcucaagagagaugcaguucuu

SEQ ID NO: 979894 - RNA, 22 nt, Human
ucuguucagaagaggugaaagu

SEQ ID NO: 979895 - RNA, 22 nt, Human
uuugcauugcauuaaguauucu

SEQ ID NO: 979896 - RNA, 22 nt, Human
ggcugcagcggauuggggauug

SEQ ID NO: 979897 - RNA, 22 nt, Human
aaaucagagugguuggucaucc

SEQ ID NO: 979898 - RNA, 22 nt, Human
ucugaagaacugaguaaacaug

SEQ ID NO: 979899 - RNA, 22 nt, Human
agagcagguggcaacucuggga

SEQ ID NO: 979900 - RNA, 22 nt, Human
ucccagagccaagcuauggaug

SEQ ID NO: 979901 - RNA, 22 nt, Human
gcucccagggcagcgcagaaga

SEQ ID NO: 979902 - RNA, 22 nt, Human
agggaaaguaagcauuucauua

SEQ ID NO: 979903 - RNA, 22 nt, Human
ccagccuggacugggucuugug

SEQ ID NO: 979904 - RNA, 22 nt, Human
ccacagaaaguugucuagagua

SEQ ID NO: 979905 - RNA, 22 nt, Human
uugcaaaugggcaaagcagauc

SEQ ID NO: 979906 - RNA, 22 nt, Human
ugcagugguguccagguguacu

SEQ ID NO: 979907 - RNA, 22 nt, Human
aguuugaaaguauugacagaag

SEQ ID NO: 979908 - RNA, 22 nt, Human
gacagggcgcccagccuguuuc

SEQ ID NO: 979909 - RNA, 22 nt, Human
aaauaugugaucagugaauaaa

SEQ ID NO: 979910 - RNA, 22 nt, Human
cagguggcuucucccuaggcca

SEQ ID NO: 979911 - RNA, 22 nt, Human
cugcaggggccucgagcacagg

SEQ ID NO: 979912 - RNA, 22 nt, Human
uccagagccuauauguucaacu

SEQ ID NO: 979913 - RNA, 22 nt, Human
uggagcagggcaucacugugcg

SEQ ID NO: 979914 - RNA, 22 nt, Human
ucaaagcaucagucaauuuagg

SEQ ID NO: 979915 - RNA, 22 nt, Human
accauuuuggguauuuucagag

SEQ ID NO: 979916 - RNA, 22 nt, Human
augugucuaauuccaggagcac

SEQ ID NO: 979917 - RNA, 22 nt, Human
gagggcugaugcuuacuuauuu

SEQ ID NO: 979918 - RNA, 17 nt, Human
uccaggagaggcaaugg

SEQ ID NO: 979919 - RNA, 22 nt, Human
ggagagaauuccauggacaugu

SEQ ID NO: 979920 - RNA, 22 nt, Human
uaaugcacaugacugaacuauu

SEQ ID NO: 979921 - RNA, 22 nt, Human
aaagguuaguucuuagaagugc

SEQ ID NO: 979922 - RNA, 22 nt, Human
ccagaagaccccguccaccucc

SEQ ID NO: 979923 - RNA, 21 nt, Human
ggcacugagccagauggacuc

SEQ ID NO: 979924 - RNA, 22 nt, Human
cccaggcuggagugcaauggug

SEQ ID NO: 979925 - RNA, 18 nt, Human
ugucucaggcugaaacag

SEQ ID NO: 979926 - RNA, 22 nt, Human
uuccugagggacuuuugagauu

SEQ ID NO: 979927 - RNA, 22 nt, Human
uuagaaaaaggcuguggucuua

SEQ ID NO: 979928 - RNA, 22 nt, Human
augcucuggaguacgugaaauu

SEQ ID NO: 979929 - RNA, 22 nt, Human
uugaaagaagaagcugcgaugu

SEQ ID NO: 979930 - RNA, 22 nt, Human
acagccaggaauucuggagaag

SEQ ID NO: 979931 - RNA, 22 nt, Human
uggaggcauaggccugggcccu

SEQ ID NO: 979932 - RNA, 22 nt, Human
cccaggaacagcacagaacagc

SEQ ID NO: 979933 - RNA, 22 nt, Human
ccagcucuagccccauguggcu

SEQ ID NO: 979934 - RNA, 22 nt, Human
aaaaaucuaugacugcuucucc

SEQ ID NO: 979935 - RNA, 21 nt, Human
ugaaugaggaggauggcauuu

SEQ ID NO: 979936 - RNA, 22 nt, Human
acugagcugugacaaugcuuaa

SEQ ID NO: 979937 - RNA, 19 nt, Human
uuacuuggcaaagucaguc

SEQ ID NO: 979938 - RNA, 22 nt, Human
gagcacaggcuuugguggacac

SEQ ID NO: 979939 - RNA, 22 nt, Human
gaucauuugcaggaaacauuaa

SEQ ID NO: 979940 - RNA, 22 nt, Human
cagugggugaugaguccugggg

SEQ ID NO: 979941 - RNA, 19 nt, Human
uccaggagcaaagccaguu

SEQ ID NO: 979942 - RNA, 22 nt, Human
agcccuagagcuggaggucagu

SEQ ID NO: 979943 - RNA, 22 nt, Human
cugggagggguagccaauccua

SEQ ID NO: 979944 - RNA, 23 nt, Human
gagugcagaauagacaugcagug

SEQ ID NO: 979945 - RNA, 22 nt, Human
ugcauauuuuauaaagauggaa

SEQ ID NO: 979946 - RNA, 22 nt, Human
auuauuagugauguuguuacug

SEQ ID NO: 979947 - RNA, 22 nt, Human
aucucccagccacagcauucuu

SEQ ID NO: 979948 - RNA, 22 nt, Human
ucuuuccuaggugauaugcaau

SEQ ID NO: 979949 - RNA, 21 nt, Human
aaggcagaagcauggaaugag

SEQ ID NO: 979950 - RNA, 22 nt, Human
uagacacauccguggaagcuuc

SEQ ID NO: 979951 - RNA, 17 nt, Human
agcugccagggagugug

SEQ ID NO: 979952 - RNA, 22 nt, Human
ucucuuuuauguacacccugac

SEQ ID NO: 979953 - RNA, 22 nt, Human
auacauguuguaccauauguuu

SEQ ID NO: 979954 - RNA, 22 nt, Human
caggugcugcguggcggagcug

SEQ ID NO: 979955 - RNA, 22 nt, Human
agcccaggaaguugaggcuugc

SEQ ID NO: 979956 - RNA, 22 nt, Human
ggagggagcauccccuugcuga

SEQ ID NO: 979957 - RNA, 22 nt, Human
gagcagugagugaauguugccu

SEQ ID NO: 979958 - RNA, 22 nt, Human
gcaggcagagguggaggagaca

SEQ ID NO: 979959 - RNA, 22 nt, Human
uuucacauguggaaugccaggu

SEQ ID NO: 979960 - RNA, 22 nt, Human
uccagggguaccggccaggcag

SEQ ID NO: 979961 - RNA, 22 nt, Human
gcaggccuuggcaaugagccug

SEQ ID NO: 979962 - RNA, 22 nt, Human
uccuggcccggccgggccugcu

SEQ ID NO: 979963 - RNA, 22 nt, Human
ggcuuggaaaugguaaugagcu

SEQ ID NO: 979964 - RNA, 22 nt, Human
auggauaauggugauaguugca

SEQ ID NO: 979965 - RNA, 22 nt, Human
uucuuaaguauuucagagacug

SEQ ID NO: 979966 - RNA, 19 nt, Human
cagagcugcuggccucguc

SEQ ID NO: 979967 - RNA, 22 nt, Human
agaggaugguugaggaagaccu

SEQ ID NO: 979968 - RNA, 22 nt, Human
aauaauaagauacuaagggagu

SEQ ID NO: 979969 - RNA, 21 nt, Human
gugguucuagagaaacagaau

SEQ ID NO: 979970 - RNA, 23 nt, Human
augcaguauaugucaguaguuua

SEQ ID NO: 979971 - RNA, 22 nt, Human
cagccaggccuggugaccaaag

SEQ ID NO: 979972 - RNA, 22 nt, Human
aaucucuuuggcucaaggaucc

SEQ ID NO: 979973 - RNA, 22 nt, Human
auugacaauuagcccuuaggug

SEQ ID NO: 979974 - RNA, 21 nt, Human
aggcucagagaucaaacagua

SEQ ID NO: 979975 - RNA, 18 nt, Human
gaagggagcuggaaugca

SEQ ID NO: 979976 - RNA, 22 nt, Human
acuuccuguuaugugugccucu

SEQ ID NO: 979977 - RNA, 22 nt, Human
uuuucagugggcaaugauguga

SEQ ID NO: 979978 - RNA, 22 nt, Human
ccaguuuuuccagugcuuucug

SEQ ID NO: 979979 - RNA, 22 nt, Human
ugaaaugacaaagguuuuucuu

SEQ ID NO: 979980 - RNA, 22 nt, Human
ugucaaaaugacuuuacuacag

SEQ ID NO: 979981 - RNA, 19 nt, Human
ucaaugcaugaaaucagcc

SEQ ID NO: 979982 - RNA, 22 nt, Human
ggagcugggacccugucaucug

SEQ ID NO: 979983 - RNA, 22 nt, Human
auacaucuagagucauaaaaac

SEQ ID NO: 979984 - RNA, 22 nt, Human
uuucaacaccagagaccaugcg

SEQ ID NO: 979985 - RNA, 22 nt, Human
uauguacaaucagcaguucaua

SEQ ID NO: 979986 - RNA, 22 nt, Human
auguuuccauuuucuuguauca

SEQ ID NO: 979987 - RNA, 22 nt, Human
uccacauccauugcuugacuuu

SEQ ID NO: 979988 - RNA, 22 nt, Human
gaggcacugaauacuugagggu

SEQ ID NO: 979989 - RNA, 22 nt, Human
cccaggcagucuggcucuaaag

SEQ ID NO: 979990 - RNA, 22 nt, Human
aggauaguugugaagauaggcu

SEQ ID NO: 979991 - RNA, 22 nt, Human
ggcaggagaauggcgugaacuc

SEQ ID NO: 979992 - RNA, 22 nt, Human
ccucugagaccagcucugcacc

SEQ ID NO: 979993 - RNA, 18 nt, Human
gguggcaggucagaugcc

SEQ ID NO: 979994 - RNA, 22 nt, Human
uguuaugugccacacuugaggg

SEQ ID NO: 979995 - RNA, 22 nt, Human
aauuaguauugcgauucauuag

SEQ ID NO: 979996 - RNA, 23 nt, Human
aucaagauaauccagaugaccua

SEQ ID NO: 979997 - RNA, 19 nt, Human
gcauaaaaugucaaugugu

SEQ ID NO: 979998 - RNA, 22 nt, Human
cuggcuuccucaggagcagugg

SEQ ID NO: 979999 - RNA, 22 nt, Human
uagcuuuaccauagaagaguau

SEQ ID NO: 980000 - RNA, 22 nt, Human
ucucaccauggugcuugcuuau

SEQ ID NO: 980001 - RNA, 22 nt, Human
gcacugaaaauguuggauucca

SEQ ID NO: 980002 - RNA, 22 nt, Human
ucagggcaaaagggaaaccauu

SEQ ID NO: 980003 - RNA, 22 nt, Human
cauuugaauuguucugugggaa

SEQ ID NO: 980004 - RNA, 22 nt, Human
cauucuuauauuuacucauuca

SEQ ID NO: 980005 - RNA, 17 nt, Human
cauuuguugaucaguug

SEQ ID NO: 980006 - RNA, 22 nt, Human
cucugcaggggaggcaugcacu

SEQ ID NO: 980007 - RNA, 22 nt, Human
cuugaucuacauagugaaaccc

SEQ ID NO: 980008 - RNA, 22 nt, Human
gccugucugcagggcugucauu

SEQ ID NO: 980009 - RNA, 22 nt, Human
ccaccaggacagcccugagggg

SEQ ID NO: 980010 - RNA, 22 nt, Human
ugagcacaaguuugcaugugug

SEQ ID NO: 980011 - RNA, 21 nt, Human
uuucuucacuuugccccaugu

SEQ ID NO: 980012 - RNA, 22 nt, Human
ggugccaggcuguagucagggu

SEQ ID NO: 980013 - RNA, 22 nt, Human
guuuuccuucucagccauugcc

SEQ ID NO: 980014 - RNA, 22 nt, Human
ggcugccagugagugcagaccg

SEQ ID NO: 980015 - RNA, 22 nt, Human
caggaggaaaugugacccugcu

SEQ ID NO: 980016 - RNA, 22 nt, Human
aaggcacuuuuccugagaugau

SEQ ID NO: 980017 - RNA, 22 nt, Human
uuucuucagagagagcuuuccc

SEQ ID NO: 980018 - RNA, 22 nt, Human
auuaggacacauacauguacag

SEQ ID NO: 980019 - RNA, 22 nt, Human
uccacuuuagcaaugauugaau

SEQ ID NO: 980020 - RNA, 22 nt, Human
augaaagaugauuuaaaguacu

SEQ ID NO: 980021 - RNA, 21 nt, Human
cucuugugucagagccagagg

SEQ ID NO: 980022 - RNA, 22 nt, Human
ucuuuaaucauaaccaagaugg

SEQ ID NO: 980023 - RNA, 22 nt, Human
cuucucagcaugguuacuguga

SEQ ID NO: 980024 - RNA, 22 nt, Human
gggcuuauggagggcuuuguac

SEQ ID NO: 980025 - RNA, 22 nt, Human
acauuuacagugcuagacaauc

SEQ ID NO: 980026 - RNA, 22 nt, Human
caugggcucuucuggacugcac

SEQ ID NO: 980027 - RNA, 22 nt, Human
aaagucauuggaauauuaauga

SEQ ID NO: 980028 - RNA, 22 nt, Human
ccugucugcaugaucccugcca

SEQ ID NO: 980029 - RNA, 22 nt, Human
aagcuuucagagcagaauguga

SEQ ID NO: 980030 - RNA, 22 nt, Human
guacauuuugagguuaaaacaa

SEQ ID NO: 980031 - RNA, 22 nt, Human
cugcuggccuagcccauccucu

SEQ ID NO: 980032 - RNA, 22 nt, Human
ccugugggagggagcggcugga

SEQ ID NO: 980033 - RNA, 22 nt, Human
gagcugaguuaccuccagauca

SEQ ID NO: 980034 - RNA, 21 nt, Human
ucaggggcuguguuuuccauc

SEQ ID NO: 980035 - RNA, 22 nt, Human
guggcuucuggcugggccucag

SEQ ID NO: 980036 - RNA, 22 nt, Human
ccuggguggcagagguugcagu

SEQ ID NO: 980037 - RNA, 22 nt, Human
uggggugguaauacaccguucu

SEQ ID NO: 980038 - RNA, 23 nt, Human
ucagagagcuguugagagcugcc

SEQ ID NO: 980039 - RNA, 22 nt, Human
ucuucucaguuucucuaggaug

SEQ ID NO: 980040 - RNA, 22 nt, Human
gaaaucugcccagugcacuggu

SEQ ID NO: 980041 - RNA, 22 nt, Human
aguauucuggaauucuauguga

SEQ ID NO: 980042 - RNA, 22 nt, Human
agcugcccuguggggaggguug

SEQ ID NO: 980043 - RNA, 22 nt, Human
agagcuguggauaguccuggau

SEQ ID NO: 980044 - RNA, 22 nt, Human
uucauacaguggcugcacucca

SEQ ID NO: 980045 - RNA, 22 nt, Human
uggagggcucuuucaccuggua

SEQ ID NO: 980046 - RNA, 22 nt, Human
cagcaguguggaagcugagggg

SEQ ID NO: 980047 - RNA, 22 nt, Human
aggguggcaccuggaagggaug

SEQ ID NO: 980048 - RNA, 21 nt, Human
uggcugccuacaugcugcagg

SEQ ID NO: 980049 - RNA, 22 nt, Human
ugccucagagugggcuugcuau

SEQ ID NO: 980050 - RNA, 22 nt, Human
gacauuucaaucucauuauggg

SEQ ID NO: 980051 - RNA, 22 nt, Human
augucccagcugagagacaacu

SEQ ID NO: 980052 - RNA, 22 nt, Human
gaggcagcuuggggcugugggu

SEQ ID NO: 980053 - RNA, 23 nt, Human
agggcugaugccauugcagcucu

SEQ ID NO: 980054 - RNA, 22 nt, Human
aauauugagaaccagcauguuu

SEQ ID NO: 980055 - RNA, 22 nt, Human
acagguggcauaggcaguuuga

SEQ ID NO: 980056 - RNA, 22 nt, Human
ugacagaacagguugggagcaa

SEQ ID NO: 980057 - RNA, 22 nt, Human
uuuaugagcaccuuggcccaga

SEQ ID NO: 980058 - RNA, 19 nt, Human
ggcucucccuugagagagc

SEQ ID NO: 980059 - RNA, 22 nt, Human
ugcuauacggagcaucuucagg

SEQ ID NO: 980060 - RNA, 22 nt, Human
gcagcuggcucagagagguggg

SEQ ID NO: 980061 - RNA, 22 nt, Human
gucccagaaacauauugcuggu

SEQ ID NO: 980062 - RNA, 22 nt, Human
uuaaaaccaucagcuguaagau

SEQ ID NO: 980063 - RNA, 22 nt, Human
uuccagaauuuuguucugcuug

SEQ ID NO: 980064 - RNA, 22 nt, Human
uaguuuuuucaacaaauggugc

SEQ ID NO: 980065 - RNA, 22 nt, Human
caggccuggggcuggcuuccag

SEQ ID NO: 980066 - RNA, 22 nt, Human
gcagaggcuccauuuuacagau

SEQ ID NO: 980067 - RNA, 22 nt, Human
ggcagcucaccucugguccagg

SEQ ID NO: 980068 - RNA, 22 nt, Human
caccagcuacagacuacugugu

SEQ ID NO: 980069 - RNA, 22 nt, Human
ucagaggguggcugggagcauc

SEQ ID NO: 980070 - RNA, 22 nt, Human
uggacagguugaguaggaggag

SEQ ID NO: 980071 - RNA, 22 nt, Human
uccugccuagcaggugaccuau

SEQ ID NO: 980072 - RNA, 22 nt, Human
gagucacaaagccuuucuuauu

SEQ ID NO: 980073 - RNA, 22 nt, Human
agcccucauggaacagcuccua

SEQ ID NO: 980074 - RNA, 22 nt, Human
aauguugaggauaucagaaaau

SEQ ID NO: 980075 - RNA, 17 nt, Human
gcugcagcgguaggcag

SEQ ID NO: 980076 - RNA, 22 nt, Human
uucuuguauauaaaaaucauuu

SEQ ID NO: 980077 - RNA, 22 nt, Human
caggagugcagguggugaggca

SEQ ID NO: 980078 - RNA, 22 nt, Human
cccaggaagaaauucugauuug

SEQ ID NO: 980079 - RNA, 22 nt, Human
agcacagguacggagaugcuac

SEQ ID NO: 980080 - RNA, 22 nt, Human
uauuucagggagaauaaauuug

SEQ ID NO: 980081 - RNA, 22 nt, Human
gcagacagggcuacagagguac

SEQ ID NO: 980082 - RNA, 22 nt, Human
acccaggagccgugagagguua

SEQ ID NO: 980083 - RNA, 22 nt, Human
gcuggcaggagccuuucccuuu

SEQ ID NO: 980084 - RNA, 22 nt, Human
guggccugccagcagauggcgc

SEQ ID NO: 980085 - RNA, 22 nt, Human
ccaggccuguguuguguggagg

SEQ ID NO: 980086 - RNA, 22 nt, Human
acugccuugucucuugccuguu

SEQ ID NO: 980087 - RNA, 22 nt, Human
ggagccagugcccucuggugga

SEQ ID NO: 980088 - RNA, 22 nt, Human
ccuguucauuuuuugacucugc

SEQ ID NO: 980089 - RNA, 22 nt, Human
gagagcuguuuaucuucuucaa

SEQ ID NO: 980090 - RNA, 22 nt, Human
cucuggaguuagugaucugggc

SEQ ID NO: 980091 - RNA, 20 nt, Human
ccugucuggagacaaagaga

SEQ ID NO: 980092 - RNA, 22 nt, Human
gaguaagagcuggcuuuggugu

SEQ ID NO: 980093 - RNA, 23 nt, Human
accaggaguugucucaggaaaca

SEQ ID NO: 980094 - RNA, 22 nt, Human
uccaguggguugcugagggagg

SEQ ID NO: 980095 - RNA, 22 nt, Human
cagcagcugggaaggaggcuga

SEQ ID NO: 980096 - RNA, 23 nt, Human
agacccagagacuggcucugcuc

SEQ ID NO: 980097 - RNA, 22 nt, Human
uaaaugcagauuccugagccua

SEQ ID NO: 980098 - RNA, 22 nt, Human
gagcaggcucugccuguguguc

SEQ ID NO: 980099 - RNA, 22 nt, Human
aaaguguaaggaauuuaaguaa

SEQ ID NO: 980100 - RNA, 22 nt, Human
gcucugcugagauaucugggag

SEQ ID NO: 980101 - RNA, 22 nt, Human
acucacuuuccauucaagcacc

SEQ ID NO: 980102 - RNA, 22 nt, Human
acauugcugcauucuccuuccc

SEQ ID NO: 980103 - RNA, 21 nt, Human
aaggagccuaggaggcucagg

SEQ ID NO: 980104 - RNA, 22 nt, Human
gcugucacaagcaucuggggca

SEQ ID NO: 980105 - RNA, 22 nt, Human
cuguguuugaugagaagccacc

SEQ ID NO: 980106 - RNA, 22 nt, Human
acagggcauuuccucuaugugu

SEQ ID NO: 980107 - RNA, 22 nt, Human
cugcuguggugucaagcaucuc

SEQ ID NO: 980108 - RNA, 22 nt, Human
ccaaagucagugcucagucguc

SEQ ID NO: 980109 - RNA, 20 nt, Human
uagauuucauacuucucuuu

SEQ ID NO: 980110 - RNA, 22 nt, Human
gccuggagcucggcugagggcg

SEQ ID NO: 980111 - RNA, 22 nt, Human
uuaaaaugaauauugauuagca

SEQ ID NO: 980112 - RNA, 22 nt, Human
gagcugggcacacgccacuuga

SEQ ID NO: 980113 - RNA, 22 nt, Human
cugagauggaguuucgcucuuc

SEQ ID NO: 980114 - RNA, 22 nt, Human
acauuucuuuucaucucuauau

SEQ ID NO: 980115 - RNA, 22 nt, Human
gcugccugccuaguuccacagu

SEQ ID NO: 980116 - RNA, 19 nt, Human
cugucaggggcuggauguu

SEQ ID NO: 980117 - RNA, 21 nt, Human
ugcugaugucagagaagcaag

SEQ ID NO: 980118 - RNA, 22 nt, Human
gguucacacuuucaugauuuca

SEQ ID NO: 980119 - RNA, 22 nt, Human
cauuacauuucaaaauguuucc

SEQ ID NO: 980120 - RNA, 22 nt, Human
ucuugggaaauguuugcgagcu

SEQ ID NO: 980121 - RNA, 22 nt, Human
agucuucucauuucacaugcuu

SEQ ID NO: 980122 - RNA, 22 nt, Human
aggcuguggugcugaaggaggg

SEQ ID NO: 980123 - RNA, 22 nt, Human
gaggacaggagacucacuguuu

SEQ ID NO: 980124 - RNA, 22 nt, Human
auauuucuccaaauguuuucaa

SEQ ID NO: 980125 - RNA, 19 nt, Human
ccuguucaugacucugucc

SEQ ID NO: 980126 - RNA, 19 nt, Human
cauuuuaagcauccccagu

SEQ ID NO: 980127 - RNA, 22 nt, Human
caagaaaugggauuugacugcc

SEQ ID NO: 980128 - RNA, 22 nt, Human
cugcuccacaccuccauuuccu

SEQ ID NO: 980129 - RNA, 22 nt, Human
ccaggccugauugggaaucuug

SEQ ID NO: 980130 - RNA, 22 nt, Human
cucagggacguuagaggacagg

SEQ ID NO: 980131 - RNA, 22 nt, Human
ggccagaggugguacauagcuu

SEQ ID NO: 980132 - RNA, 22 nt, Human
guggccucugugcuccugccua

SEQ ID NO: 980133 - RNA, 17 nt, Human
cacccuggcuagucuga

SEQ ID NO: 980134 - RNA, 17 nt, Human
aggcaggcagagcggga

SEQ ID NO: 980135 - RNA, 22 nt, Human
uagaaacaucagcuaaccaaaa

SEQ ID NO: 980136 - RNA, 22 nt, Human
agccagcagggcuuagaggaca

SEQ ID NO: 980137 - RNA, 22 nt, Human
ugccugcugcuaagcucuuugu

SEQ ID NO: 980138 - RNA, 22 nt, Human
gcuuuccuggcccugucccugc

SEQ ID NO: 980139 - RNA, 22 nt, Human
gaagaacaccugcugcccagug

SEQ ID NO: 980140 - RNA, 22 nt, Human
cuccaggccagggaaguggaca

SEQ ID NO: 980141 - RNA, 22 nt, Human
gcaaggagacuguagggccaag

SEQ ID NO: 980142 - RNA, 22 nt, Human
gcaaaugaguuguaacauaaaa

SEQ ID NO: 980143 - RNA, 22 nt, Human
aaaucacuguuauugaucuuaa

SEQ ID NO: 980144 - RNA, 22 nt, Human
gcugccugggcaggaggcgcug

SEQ ID NO: 980145 - RNA, 22 nt, Human
aggcagagagcaguggccgucu

SEQ ID NO: 980146 - RNA, 22 nt, Human
uuuauuuaaagucguguguuaa

SEQ ID NO: 980147 - RNA, 22 nt, Human
gagcccucucuguaggcaagua

SEQ ID NO: 980148 - RNA, 22 nt, Human
cacuggugacuucugagcugga

SEQ ID NO: 980149 - RNA, 22 nt, Human
ugacccugcuucuuggugcagg

SEQ ID NO: 980150 - RNA, 22 nt, Human
uucagagaugacaccugguguu

SEQ ID NO: 980151 - RNA, 22 nt, Human
uucaagaucuggguuuucagcu

SEQ ID NO: 980152 - RNA, 22 nt, Human
gcuggcucuucaguggagauag

SEQ ID NO: 980153 - RNA, 23 nt, Human
aggcuuccuaucuuagagcuggg

SEQ ID NO: 980154 - RNA, 22 nt, Human
uggcaccaggcgggguggcugu

SEQ ID NO: 980155 - RNA, 17 nt, Human
cucugcagugcauggcu

SEQ ID NO: 980156 - RNA, 22 nt, Human
aauuucuaauugaaucucucuu

SEQ ID NO: 980157 - RNA, 22 nt, Human
aucaggauucaguaucuccagc

SEQ ID NO: 980158 - RNA, 22 nt, Human
gcagauggcugagccugcagau

SEQ ID NO: 980159 - RNA, 22 nt, Human
ggagcugcacgcucugaagccu

SEQ ID NO: 980160 - RNA, 22 nt, Human
aucuggcuauugacauguuaua

SEQ ID NO: 980161 - RNA, 20 nt, Human
ucuccuggucugguccgugc

SEQ ID NO: 980162 - RNA, 22 nt, Human
gagacacacacaggagguggca

SEQ ID NO: 980163 - RNA, 22 nt, Human
cugcucugcagcuuggacuccc

SEQ ID NO: 980164 - RNA, 22 nt, Human
uggggacacagagguucguugg

SEQ ID NO: 980165 - RNA, 22 nt, Human
ccaggaagcugucugauaugaa

SEQ ID NO: 980166 - RNA, 22 nt, Human
aaagcccauguggaaguacagg

SEQ ID NO: 980167 - RNA, 22 nt, Human
gacucagugauuugacaugccu

SEQ ID NO: 980168 - RNA, 22 nt, Human
agucagugaaaacuagaauguu

SEQ ID NO: 980169 - RNA, 22 nt, Human
cugccugugccaaugcuccuuu

SEQ ID NO: 980170 - RNA, 22 nt, Human
gccagcagguggagagaucaag

SEQ ID NO: 980171 - RNA, 22 nt, Human
gcagccacagaggagggaugca

SEQ ID NO: 980172 - RNA, 22 nt, Human
gggccuccggggugagcugugg

SEQ ID NO: 980173 - RNA, 22 nt, Human
uguacaguauauuucaaagcca

SEQ ID NO: 980174 - RNA, 22 nt, Human
gagugagggcagcaggggcugc

SEQ ID NO: 980175 - RNA, 22 nt, Human
uaaaucagccuuugcuauuuua

SEQ ID NO: 980176 - RNA, 22 nt, Human
ucuguggcacgauugcacugca

SEQ ID NO: 980177 - RNA, 22 nt, Human
uguauguguauguacauaugca

SEQ ID NO: 980178 - RNA, 22 nt, Human
aagggcagcuuaaauugguagc

SEQ ID NO: 980179 - RNA, 22 nt, Human
gaggaaccaaucugugauauuc

SEQ ID NO: 980180 - RNA, 22 nt, Human
aagggaggaggauuuauuguac

SEQ ID NO: 980181 - RNA, 22 nt, Human
ccccuuccuuccucagacagcc

SEQ ID NO: 980182 - RNA, 22 nt, Human
uucuuaggacuaguauagcaug

SEQ ID NO: 980183 - RNA, 22 nt, Human
gcuguggucugugagcuccaaa

SEQ ID NO: 980184 - RNA, 22 nt, Human
uucauugucucuguuugccuuc

SEQ ID NO: 980185 - RNA, 22 nt, Human
ccaaaguccauaguuuacuuua

SEQ ID NO: 980186 - RNA, 22 nt, Human
ucccagagacaucauuucuccg

SEQ ID NO: 980187 - RNA, 22 nt, Human
ucagacuucaguuuuuaguugu

SEQ ID NO: 980188 - RNA, 22 nt, Human
uccaggccaauguagcaggccc

SEQ ID NO: 980189 - RNA, 22 nt, Human
aacuucaaaugugacuuugcau

SEQ ID NO: 980190 - RNA, 22 nt, Human
ggacuggacucucaggcucaca

SEQ ID NO: 980191 - RNA, 22 nt, Human
aaagcucuuauagcagagugug

SEQ ID NO: 980192 - RNA, 21 nt, Human
gcagccagccgagaccaugcc

SEQ ID NO: 980193 - RNA, 22 nt, Human
ucuuccagcaaugugaaaucac

SEQ ID NO: 980194 - RNA, 17 nt, Human
cccugccaccaggaagc

SEQ ID NO: 980195 - RNA, 22 nt, Human
uaaccuuuggugaaauauuaac

SEQ ID NO: 980196 - RNA, 22 nt, Human
uccuugaaaagaaugucuccau

SEQ ID NO: 980197 - RNA, 22 nt, Human
ccauaagguugaaaacuguaca

SEQ ID NO: 980198 - RNA, 23 nt, Human
ugcagcugccucuggcgggccgg

SEQ ID NO: 980199 - RNA, 23 nt, Human
ugcagccacucaggagcucagug

SEQ ID NO: 980200 - RNA, 23 nt, Human
aucaaaguggaaaucaauuaucu

SEQ ID NO: 980201 - RNA, 22 nt, Human
uuucuauuuuaaaggcauaugg

SEQ ID NO: 980202 - RNA, 22 nt, Human
uggcuuccaaaggaaugggccu

SEQ ID NO: 980203 - RNA, 22 nt, Human
agggaugguggagguugcaagu

SEQ ID NO: 980204 - RNA, 21 nt, Human
aggcugcuggcucaggguccu

SEQ ID NO: 980205 - RNA, 20 nt, Human
ucucaggguucagcaaagua

SEQ ID NO: 980206 - RNA, 22 nt, Human
aacagcuuugcuucuggagaca

SEQ ID NO: 980207 - RNA, 22 nt, Human
ucagggcagaauccaaagaauu

SEQ ID NO: 980208 - RNA, 22 nt, Human
ggcagucagugugguucauaaa

SEQ ID NO: 980209 - RNA, 22 nt, Human
uccaggagaaggccauccagcg

SEQ ID NO: 980210 - RNA, 22 nt, Human
ucugcugcacaaauucaucucu

SEQ ID NO: 980211 - RNA, 19 nt, Human
ggcuggcaagugacagugu

SEQ ID NO: 980212 - RNA, 22 nt, Human
ugggcagacuaaggucaaagcu

SEQ ID NO: 980213 - RNA, 17 nt, Human
cagcucugcaucuuccu

SEQ ID NO: 980214 - RNA, 22 nt, Human
ccuggcaguggugaagaagagg

SEQ ID NO: 980215 - RNA, 22 nt, Human
aggcaggcacacuuccuccagg

SEQ ID NO: 980216 - RNA, 22 nt, Human
gcugugagggucuagugaggug

SEQ ID NO: 980217 - RNA, 22 nt, Human
aaggcagcagaggaaaggugcu

SEQ ID NO: 980218 - RNA, 22 nt, Human
acuggagcccguggaggcgcag

SEQ ID NO: 980219 - RNA, 22 nt, Human
aaacuccugggcucaagcaguu

SEQ ID NO: 980220 - RNA, 22 nt, Human
gggggcuggaauauccaucaac

SEQ ID NO: 980221 - RNA, 18 nt, Human
acagaaauagcugugccu

SEQ ID NO: 980222 - RNA, 22 nt, Human
ugagccugcugucgcuggaccc

SEQ ID NO: 980223 - RNA, 21 nt, Human
uggccaaacuggagcauuuga

SEQ ID NO: 980224 - RNA, 22 nt, Human
uaaauguguaaaccuccauuac

SEQ ID NO: 980225 - RNA, 22 nt, Human
cccagccuggugcacugugggg

SEQ ID NO: 980226 - RNA, 17 nt, Human
gcuguaguuugauaaga

SEQ ID NO: 980227 - RNA, 22 nt, Human
cagaagaaaguggggagacaag

SEQ ID NO: 980228 - RNA, 22 nt, Human
ggcagcuguggacgucgucauu

SEQ ID NO: 980229 - RNA, 22 nt, Human
aaggaagacacagaugaaguga

SEQ ID NO: 980230 - RNA, 22 nt, Human
agugaaaugauucugagcaaga

SEQ ID NO: 980231 - RNA, 22 nt, Human
ccugguguugugaaguagccgu

SEQ ID NO: 980232 - RNA, 22 nt, Human
uuauuuggguuugaguguggca

SEQ ID NO: 980233 - RNA, 20 nt, Human
ugcagcugcaggaggguggg

SEQ ID NO: 980234 - RNA, 22 nt, Human
ugccuggcaaugccagaagcca

SEQ ID NO: 980235 - RNA, 22 nt, Human
aagacuuucucccaaauccuca

SEQ ID NO: 980236 - RNA, 22 nt, Human
aagggcaggagaagacggauau

SEQ ID NO: 980237 - RNA, 22 nt, Human
ugcagaagacacaagguaacgu

SEQ ID NO: 980238 - RNA, 18 nt, Human
ccagguggugacagagau

SEQ ID NO: 980239 - RNA, 22 nt, Human
uuggcagugaugcagcuuguuc

SEQ ID NO: 980240 - RNA, 22 nt, Human
ucuggcucuguguccucaccca

SEQ ID NO: 980241 - RNA, 22 nt, Human
uggcagggugccaguugcgagu

SEQ ID NO: 980242 - RNA, 22 nt, Human
uugaaaguccuucuugaguuac

SEQ ID NO: 980243 - RNA, 22 nt, Human
uacauguaauuuucauaguaag

SEQ ID NO: 980244 - RNA, 22 nt, Human
aacauuuaugguagucauugca

SEQ ID NO: 980245 - RNA, 22 nt, Human
auuaggauuugguauggucaua

SEQ ID NO: 980246 - RNA, 22 nt, Human
caggccugugaguugaggcccc

SEQ ID NO: 980247 - RNA, 22 nt, Human
gcugucugcugggucgcucagg

SEQ ID NO: 980248 - RNA, 20 nt, Human
aggcucagagcaguaguaca

SEQ ID NO: 980249 - RNA, 22 nt, Human
uucucugaucuugcuagacuga

SEQ ID NO: 980250 - RNA, 19 nt, Human
accaggcuuauggucagug

SEQ ID NO: 980251 - RNA, 22 nt, Human
cuuccugcauugugccagaguu

SEQ ID NO: 980252 - RNA, 22 nt, Human
aacagaauugcugcugccaaug

SEQ ID NO: 980253 - RNA, 21 nt, Human
ucagcagcuuuugcagucccu

SEQ ID NO: 980254 - RNA, 22 nt, Human
gcuugggauaugcugauguaaa

SEQ ID NO: 980255 - RNA, 22 nt, Human
acaauacaggcuucuggacuua

SEQ ID NO: 980256 - RNA, 22 nt, Human
ggggcuguuuuuggaauggcug

SEQ ID NO: 980257 - RNA, 22 nt, Human
agggcugguauguccaugaaag

SEQ ID NO: 980258 - RNA, 22 nt, Human
ucauugaagugacugaaagauu

SEQ ID NO: 980259 - RNA, 19 nt, Human
cagaccuguccagccugug

SEQ ID NO: 980260 - RNA, 22 nt, Human
gagcuuugcuggaagccugggg

SEQ ID NO: 980261 - RNA, 23 nt, Human
uugugucuacuuccuaucuaggg

SEQ ID NO: 980262 - RNA, 22 nt, Human
ggcagcuccucucagcaaaaga

SEQ ID NO: 980263 - RNA, 22 nt, Human
cccaggaggccaagguugcagu

SEQ ID NO: 980264 - RNA, 22 nt, Human
gcuggccauagaagccaaagag

SEQ ID NO: 980265 - RNA, 22 nt, Human
ucuccuggcccugucgccaucu

SEQ ID NO: 980266 - RNA, 22 nt, Human
uugcaauagccuuauuuccaaa

SEQ ID NO: 980267 - RNA, 22 nt, Human
cagaggcagaggucaucucugg

SEQ ID NO: 980268 - RNA, 22 nt, Human
ggacuucuaagugccagacacu

SEQ ID NO: 980269 - RNA, 22 nt, Human
aucuacaggauuuuacagaguu

SEQ ID NO: 980270 - RNA, 22 nt, Human
uugaacuguaagcaugucugcc

SEQ ID NO: 980271 - RNA, 22 nt, Human
cugggagcaagucaggaaaggu

SEQ ID NO: 980272 - RNA, 21 nt, Human
aggucagcccagcucuggaag

SEQ ID NO: 980273 - RNA, 22 nt, Human
uuagugucuucuucauccucug

SEQ ID NO: 980274 - RNA, 22 nt, Human
uaaauguguuagucaugguuuu

SEQ ID NO: 980275 - RNA, 21 nt, Human
cauauuaaaucggugccuuua

SEQ ID NO: 980276 - RNA, 22 nt, Human
auguuauuaaaguacagauucu

SEQ ID NO: 980277 - RNA, 22 nt, Human
uggcugaacuaaugugcuguuu

SEQ ID NO: 980278 - RNA, 22 nt, Human
uggcagcagacaaaaggccauu

SEQ ID NO: 980279 - RNA, 22 nt, Human
gacagggcauggugcagaguuc

SEQ ID NO: 980280 - RNA, 22 nt, Human
gcugaagggagugcugagucug

SEQ ID NO: 980281 - RNA, 22 nt, Human
aggcccaguuauccuacuuguu

SEQ ID NO: 980282 - RNA, 23 nt, Human
ccugucugugcuggguggacaca

SEQ ID NO: 980283 - RNA, 20 nt, Human
uaagaacaagacuaggaagc

SEQ ID NO: 980284 - RNA, 22 nt, Human
aguuauauaacuaucuagaugc

SEQ ID NO: 980285 - RNA, 22 nt, Human
uuugcaaagugacuauuauaug

SEQ ID NO: 980286 - RNA, 22 nt, Human
cuucacaaauggccuagaguuc

SEQ ID NO: 980287 - RNA, 19 nt, Human
guggccagggcaggggcug

SEQ ID NO: 980288 - RNA, 22 nt, Human
uggagaggaaagugcaguuuug

SEQ ID NO: 980289 - RNA, 20 nt, Human
uugcaaauaucuauugauug

SEQ ID NO: 980290 - RNA, 22 nt, Human
cagaggcacaagaaagcaaggc

SEQ ID NO: 980291 - RNA, 22 nt, Human
cagaggcuguguaggcagacug

SEQ ID NO: 980292 - RNA, 22 nt, Human
agggauggaagcucgucugcaa

SEQ ID NO: 980293 - RNA, 22 nt, Human
uggcagcauuuuuuccagaaca

SEQ ID NO: 980294 - RNA, 22 nt, Human
ucacaggguaucugggauggau

SEQ ID NO: 980295 - RNA, 21 nt, Human
aaauacagaaacuuguuuuca

SEQ ID NO: 980296 - RNA, 22 nt, Human
uuccuggcugaacugaacuccu

SEQ ID NO: 980297 - RNA, 22 nt, Human
ucaugcuuauugcauauuugga

SEQ ID NO: 980298 - RNA, 22 nt, Human
uaaacauggauucugaucacag

SEQ ID NO: 980299 - RNA, 22 nt, Human
gaggcacugagagugggggaug

SEQ ID NO: 980300 - RNA, 22 nt, Human
auacaucucauguaagagauaa

SEQ ID NO: 980301 - RNA, 22 nt, Human
uggcugaaucugcagcaggaag

SEQ ID NO: 980302 - RNA, 22 nt, Human
gucuuguuugggauguggaugg

SEQ ID NO: 980303 - RNA, 22 nt, Human
aaugaacacagcccucuacuuu

SEQ ID NO: 980304 - RNA, 22 nt, Human
gucccagggaugcagacaugag

SEQ ID NO: 980305 - RNA, 22 nt, Human
aguacauuuauuaaugguaaaa

SEQ ID NO: 980306 - RNA, 22 nt, Human
cggcagcaaaggaagccagguc

SEQ ID NO: 980307 - RNA, 22 nt, Human
gcucccagaaccaaggcugggg

SEQ ID NO: 980308 - RNA, 22 nt, Human
ucuggccacuugcuucacacug

SEQ ID NO: 980309 - RNA, 23 nt, Human
ggcugagacuacaggcgcuugcc

SEQ ID NO: 980310 - RNA, 22 nt, Human
cacugcuuuaaggcugaguaac

SEQ ID NO: 980311 - RNA, 22 nt, Human
acaagaauuuacauguagugga

SEQ ID NO: 980312 - RNA, 22 nt, Human
aaugccuuggagagccuagagg

SEQ ID NO: 980313 - RNA, 22 nt, Human
gcagggacaucuuugucuagua

SEQ ID NO: 980314 - RNA, 22 nt, Human
cucucccagucaggcucaggau

SEQ ID NO: 980315 - RNA, 22 nt, Human
ucagggacauuuagacacugau

SEQ ID NO: 980316 - RNA, 22 nt, Human
cugccucucagccugaccgcca

SEQ ID NO: 980317 - RNA, 22 nt, Human
aagggcagagggaaucccacau

SEQ ID NO: 980318 - RNA, 22 nt, Human
ugcuugaggggaauaaaaagaa

SEQ ID NO: 980319 - RNA, 22 nt, Human
accuuauuuugaaauagauugu

SEQ ID NO: 980320 - RNA, 22 nt, Human
augugacaauauuuggucuuau

SEQ ID NO: 980321 - RNA, 22 nt, Human
caggguggcccuguggucucau

SEQ ID NO: 980322 - RNA, 22 nt, Human
ucaaaugcacguagagaaaaua

SEQ ID NO: 980323 - RNA, 22 nt, Human
agucucugcaugaugcagcaca

SEQ ID NO: 980324 - RNA, 22 nt, Human
aggcagauuuaggagaaaagaa

SEQ ID NO: 980325 - RNA, 22 nt, Human
gcccagcacauugcugaggacc

SEQ ID NO: 980326 - RNA, 22 nt, Human
agcagccagaaagggcagucga

SEQ ID NO: 980327 - RNA, 19 nt, Human
guugaaaguaggugagggu

SEQ ID NO: 980328 - RNA, 21 nt, Human
cagcuccacuaaagcagcugu

SEQ ID NO: 980329 - RNA, 22 nt, Human
guucuucaaagugacaacuaaa

SEQ ID NO: 980330 - RNA, 21 nt, Human
uaaaugugagcagggcugggc

SEQ ID NO: 980331 - RNA, 22 nt, Human
ugccuguguugauuacuuuguc

SEQ ID NO: 980332 - RNA, 22 nt, Human
ggccaugguuggggaagacaug

SEQ ID NO: 980333 - RNA, 22 nt, Human
uggccuggggaccugugagacc

SEQ ID NO: 980334 - RNA, 22 nt, Human
uccaucagauucccuccugaga

SEQ ID NO: 980335 - RNA, 22 nt, Human
ccccuuccaggaagcagaaucg

SEQ ID NO: 980336 - RNA, 22 nt, Human
gucacuguuuccuauuauauuu

SEQ ID NO: 980337 - RNA, 21 nt, Human
cugcuuuacuucagaggaucu

SEQ ID NO: 980338 - RNA, 22 nt, Human
ggcuucaccgcgggguugcagg

SEQ ID NO: 980339 - RNA, 20 nt, Human
gacaucauguacacauugcc

SEQ ID NO: 980340 - RNA, 22 nt, Human
ugcacacaaaugugaacgugcc

SEQ ID NO: 980341 - RNA, 22 nt, Human
guguacaugagaaaucaacuuu

SEQ ID NO: 980342 - RNA, 22 nt, Human
aaguugaaugcguacgugacau

SEQ ID NO: 980343 - RNA, 22 nt, Human
uagaaauguuagauguauugag

SEQ ID NO: 980344 - RNA, 22 nt, Human
uuauuuacaacucuucucuucc

SEQ ID NO: 980345 - RNA, 21 nt, Human
cucaggaucuuauauauuagu

SEQ ID NO: 980346 - RNA, 22 nt, Human
ugacagaaugugacucucagau

SEQ ID NO: 980347 - RNA, 22 nt, Human
auucuucacaaauauauagaag

SEQ ID NO: 980348 - RNA, 22 nt, Human
uuucauggcuaggacuagagug

SEQ ID NO: 980349 - RNA, 22 nt, Human
ugaagacacauacaagggaaug

SEQ ID NO: 980350 - RNA, 22 nt, Human
agaugcugucacacacacuguu

SEQ ID NO: 980351 - RNA, 22 nt, Human
ccucaggggcuuuucguuguug

SEQ ID NO: 980352 - RNA, 23 nt, Human
uugucugugcuuuuccaguugcu

SEQ ID NO: 980353 - RNA, 22 nt, Human
ggcugccuggaccuccucuuuc

SEQ ID NO: 980354 - RNA, 22 nt, Human
cugcuguguugccagugucacc

SEQ ID NO: 980355 - RNA, 22 nt, Human
cacugaaggcuaggauuagaug

SEQ ID NO: 980356 - RNA, 22 nt, Human
cuggccugugggcugucuccgg

SEQ ID NO: 980357 - RNA, 22 nt, Human
gcucugucaacagcuagcugug

SEQ ID NO: 980358 - RNA, 22 nt, Human
guuauguaucuugauugggugg

SEQ ID NO: 980359 - RNA, 22 nt, Human
cuccuggaccagggcuauuggg

SEQ ID NO: 980360 - RNA, 22 nt, Human
cacugcaggucugagauggggg

SEQ ID NO: 980361 - RNA, 22 nt, Influenza B virus
agauuagguaguugucugauuu

SEQ ID NO: 980362 - RNA, 22 nt, Human
aaacccaucugucugucugcag

SEQ ID NO: 980363 - RNA, 22 nt, Human
uuugcaaaaugucuuguguuag

SEQ ID NO: 980364 - RNA, 22 nt, Human
aaagucauugcuguuaucaaug

SEQ ID NO: 980365 - RNA, 23 nt, Human
ugauuaggucuacucuuggcucc

SEQ ID NO: 980366 - RNA, 22 nt, Human
uauucacauguacauaugcuca

SEQ ID NO: 980367 - RNA, 22 nt, Human
acucugcuaaauguguaggcuc

SEQ ID NO: 980368 - RNA, 22 nt, Human
auucacaauuagaaguagauaa

SEQ ID NO: 980369 - RNA, 22 nt, Human
ugcucccagggacucuggcugg

SEQ ID NO: 980370 - RNA, 22 nt, Human
uaacauuccucaaaguuuucag

SEQ ID NO: 980371 - RNA, 22 nt, Human
uauauuaacuugugauccugga

SEQ ID NO: 980372 - RNA, 22 nt, Human
acucuuuuauaaagcaucuuga

SEQ ID NO: 980373 - RNA, 22 nt, Human
uacucugccccagccaauaaug

SEQ ID NO: 980374 - RNA, 22 nt, Human
cugcacaguuugauuucuugcu

SEQ ID NO: 980375 - RNA, 19 nt, Human
gucaucuuuuaauaaugug

SEQ ID NO: 980376 - RNA, 22 nt, Human
guuaggauauggugaaauggag

SEQ ID NO: 980377 - RNA, 22 nt, Human
gcuccuggcucuggccaaggga

SEQ ID NO: 980378 - RNA, 22 nt, Human
guucacaagcuggguuucugca

SEQ ID NO: 980379 - RNA, 22 nt, Human
agcuauguuauagcauguauca

SEQ ID NO: 980380 - RNA, 22 nt, Human
ccuccugggacucauuagcacc

SEQ ID NO: 980381 - RNA, 22 nt, Human
aauucacaaaaccagauugcuu

SEQ ID NO: 980382 - RNA, 22 nt, Human
acucugcaauguggcaagaaca

SEQ ID NO: 980383 - RNA, 22 nt, Human
acauuuaaauaccuauguuucu

SEQ ID NO: 980384 - RNA, 22 nt, Human
cuguuuaucuaggaguugcagg

SEQ ID NO: 980385 - RNA, 22 nt, Human
uugacaaugcacugugcuaagu

SEQ ID NO: 980386 - RNA, 22 nt, Human
ccuccugguccagcaucucuuu

SEQ ID NO: 980387 - RNA, 22 nt, Human
auuuauuaugggauuuggcuca

SEQ ID NO: 980388 - RNA, 22 nt, Human
uauuagcgcuuacugaguugcc

SEQ ID NO: 980389 - RNA, 18 nt, Human
uugauaaacaauuucauu

SEQ ID NO: 980390 - RNA, 22 nt, Human
uuucuauucuggaucuguggca

SEQ ID NO: 980391 - RNA, 22 nt, Human
ucuggccagugaaaugcagaau

SEQ ID NO: 980392 - RNA, 22 nt, Human
gcuccuggguguggcugccccu

SEQ ID NO: 980393 - RNA, 22 nt, Human
ggauuugggcuugcagcagagc

SEQ ID NO: 980394 - RNA, 21 nt, Human
cauauuaaaucggugccuuua

SEQ ID NO: 980395 - RNA, 22 nt, Human
guggccaaaucaugucaaaggc

SEQ ID NO: 980396 - RNA, 22 nt, Human
gcuggccaguguggugaccacc

SEQ ID NO: 980397 - RNA, 18 nt, Human
gaaaggagagacaguagg

SEQ ID NO: 980398 - RNA, 22 nt, Human
auuagagaaugugcugacauug

SEQ ID NO: 980399 - RNA, 22 nt, Human
aaacaaguuuagaauaaugaau

SEQ ID NO: 980400 - RNA, 22 nt, Human
aagucuguagaaaaacaguuua

SEQ ID NO: 980401 - RNA, 22 nt, Human
ugcaaaugaguugcagaucagg

SEQ ID NO: 980402 - RNA, 22 nt, Human
aggauuuguuuauaggucuuaa

SEQ ID NO: 980403 - RNA, 22 nt, Human
guuugaaugcaguaugcauuuu

SEQ ID NO: 980404 - RNA, 22 nt, Human
acacauuauagagaguauaaua

SEQ ID NO: 980405 - RNA, 22 nt, Human
aauucacaaaaguuagauccau

SEQ ID NO: 980406 - RNA, 22 nt, Human
auaaauaucacuguugucccuc

SEQ ID NO: 980407 - RNA, 22 nt, Human
ccuccuggguucaagcgauucu

SEQ ID NO: 980408 - RNA, 18 nt, Human
auguauguacauauuuau

SEQ ID NO: 980409 - RNA, 22 nt, Human
cccauggcuuaggagggagugu

SEQ ID NO: 980410 - RNA, 22 nt, Human
agccauuggcugccuggugcgu

SEQ ID NO: 980411 - RNA, 22 nt, Human
gagccaagaucgcaccacugca

SEQ ID NO: 980412 - RNA, 22 nt, Human
gaggaaagcugguuuaaaguau

SEQ ID NO: 980413 - RNA, 22 nt, Human
ucuggccaggggucccugaagg

SEQ ID NO: 980414 - RNA, 23 nt, Human
uuauugaggguguagauuggugu

SEQ ID NO: 980415 - RNA, 22 nt, Human
ugcaccuuguugcuuuuacgaa

SEQ ID NO: 980416 - RNA, 22 nt, Human
uggccauagcucagcuccuuca

SEQ ID NO: 980417 - RNA, 22 nt, Human
cuggccuaaaauugcuucugca

SEQ ID NO: 980418 - RNA, 22 nt, Human
aacucugcaaccuauguagacc

SEQ ID NO: 980419 - RNA, 22 nt, Human
aggauuuugacuuauucaggga

SEQ ID NO: 980420 - RNA, 22 nt, Human
ucugagccacagauguccuguu

SEQ ID NO: 980421 - RNA, 22 nt, Human
uuaauguggaaagcucuugagu

SEQ ID NO: 980422 - RNA, 22 nt, Human
cuucacaaaauauuucauuaua

SEQ ID NO: 980423 - RNA, 22 nt, Human
uuuuauauugagugagaguucc

SEQ ID NO: 980424 - RNA, 22 nt, Human
cagacaggaauucuggcguggu

SEQ ID NO: 980425 - RNA, 22 nt, Human
uugaaaugcagauuccaaucca

SEQ ID NO: 980426 - RNA, 22 nt, Human
uuaaaaugcagauucugauuca

SEQ ID NO: 980427 - RNA, 21 nt, Human
ccuggccaaucugauaggguu

SEQ ID NO: 980428 - RNA, 22 nt, Human
uacaucuagccuuacaauuauu

SEQ ID NO: 980429 - RNA, 22 nt, Human
gucaucuuccuaguguuaacua

SEQ ID NO: 980430 - RNA, 22 nt, Human
cuguuuaucccuuuggucagca

SEQ ID NO: 980431 - RNA, 22 nt, Human
ggaagugaggaaauauuuuguu

SEQ ID NO: 980432 - RNA, 22 nt, Human
aaagcuauuuuauugcagcucu

SEQ ID NO: 980433 - RNA, 22 nt, Human
uggcacauagcagguacucagu

SEQ ID NO: 980434 - RNA, 22 nt, Human
gcuccuggcuucacugacauca

SEQ ID NO: 980435 - RNA, 22 nt, Human
ccacucugauuucaagggagau

SEQ ID NO: 980436 - RNA, 22 nt, Human
caauagaaaacucaauacuuaa

SEQ ID NO: 980437 - RNA, 22 nt, Human
ggcaagcauaaccuguacagcc

SEQ ID NO: 980438 - RNA, 22 nt, Human
acaccuuucagguccagacagu

SEQ ID NO: 980439 - RNA, 22 nt, Human
aauuaggaauaaaugaguacuu

SEQ ID NO: 980440 - RNA, 22 nt, Human
gcuggccauggggagugaggag

SEQ ID NO: 980441 - RNA, 22 nt, Human
gccaugaggaacuguaagacaa

SEQ ID NO: 980442 - RNA, 22 nt, Human
aacuccagggcauugucuccug

SEQ ID NO: 980443 - RNA, 22 nt, Human
agaggaaguaaucaggaccugc

SEQ ID NO: 980444 - RNA, 22 nt, Human
uaacccaaaggcaaugucucga

SEQ ID NO: 980445 - RNA, 22 nt, Human
auauuaggcaaggagauuauuu

SEQ ID NO: 980446 - RNA, 22 nt, Human
aaacaccagcacuguuuacaaa

SEQ ID NO: 980447 - RNA, 21 nt, Human
ucuccuggguccaacccaugc

SEQ ID NO: 980448 - RNA, 22 nt, Human
aaacccugcccuucccaagaug

SEQ ID NO: 980449 - RNA, 22 nt, Human
aauguacaaaagucagccaacu

SEQ ID NO: 980450 - RNA, 22 nt, Human
gcuggccauggccugcgccauc

SEQ ID NO: 980451 - RNA, 22 nt, Human
ucucugcugagaagggcuggca

SEQ ID NO: 980452 - RNA, 22 nt, Human
acacuuuuguguauauccaguu

SEQ ID NO: 980453 - RNA, 22 nt, Human
caacccaaaagcguuuccauuu

SEQ ID NO: 980454 - RNA, 19 nt, Human
uauucaggaugauggcaca

SEQ ID NO: 980455 - RNA, 21 nt, Human
acucugcugcgggcuuggccu

SEQ ID NO: 980456 - RNA, 22 nt, Human
gaguuauuagucaaauagggaa

SEQ ID NO: 980457 - RNA, 22 nt, Human
aacauuucugagaauaucaguu

SEQ ID NO: 980458 - RNA, 22 nt, Human
augauguuauuuucagaaacau

SEQ ID NO: 980459 - RNA, 22 nt, Human
uauucacauuaauaagucuuca

SEQ ID NO: 980460 - RNA, 22 nt, Human
ccuggccagccagggcuggggu

SEQ ID NO: 980461 - RNA, 22 nt, Human
aguguacacuaaaugaauacaa

SEQ ID NO: 980462 - RNA, 22 nt, Human
aaagaacaauguggaaucuccu

SEQ ID NO: 980463 - RNA, 22 nt, Human
guuuaauaauguugaauuacua

SEQ ID NO: 980464 - RNA, 22 nt, Human
ccucugcucccuggugucugag

SEQ ID NO: 980465 - RNA, 22 nt, Human
aaguuuguguaguuuagcaucc

SEQ ID NO: 980466 - RNA, 22 nt, Human
uauuggcagcaugagcuccugg

SEQ ID NO: 980467 - RNA, 22 nt, Human
caugucuuggcuuaggcacaga

SEQ ID NO: 980468 - RNA, 18 nt, Human
ucuuggcagcaucuggca

SEQ ID NO: 980469 - RNA, 22 nt, Human
acagcauugcuccaucucaaga

SEQ ID NO: 980470 - RNA, 23 nt, Human
uucuuauuuacuuuggaaucucc

SEQ ID NO: 980471 - RNA, 22 nt, Human
uuucaacaggaugauaauaggc

SEQ ID NO: 980472 - RNA, 22 nt, Human
ggcagacaccuuuaugucuaau

SEQ ID NO: 980473 - RNA, 22 nt, Human
cccaaacaguuccugugguacu

SEQ ID NO: 980474 - RNA, 21 nt, Human
ccucugcucgggcaugcguuu

SEQ ID NO: 980475 - RNA, 22 nt, Human
aaagguaacaguuauaaccagg

SEQ ID NO: 980476 - RNA, 22 nt, Human
auguuuaaaggagucagagacu

SEQ ID NO: 980477 - RNA, 22 nt, Human
uauauuaaagugcuuugcagug

SEQ ID NO: 980478 - RNA, 22 nt, Human
cuggcacaugcucccugagugg

SEQ ID NO: 980479 - RNA, 22 nt, Human
ucuggccaauguugugaucaca

SEQ ID NO: 980480 - RNA, 22 nt, Human
uuaaaugaugcauaucauuuag

SEQ ID NO: 980481 - RNA, 22 nt, Human
acuggccaggcacagcuguggg

SEQ ID NO: 980482 - RNA, 22 nt, Human
ucuggccagcaugagaccuggu

SEQ ID NO: 980483 - RNA, 22 nt, Human
gucaucuugcuguuuuagaucu

SEQ ID NO: 980484 - RNA, 22 nt, Human
guacauuucauuuaaaugaugu

SEQ ID NO: 980485 - RNA, 22 nt, Human
ucaaauaaggagucaugaccau

SEQ ID NO: 980486 - RNA, 22 nt, Human
ucauugaauuugguucaauaug

SEQ ID NO: 980487 - RNA, 20 nt, Human
aauauaauucucugaauuua

SEQ ID NO: 980488 - RNA, 22 nt, Human
ccuccuggcuuuucccauugaa

SEQ ID NO: 980489 - RNA, 22 nt, Human
uuuauguaauuucauaggugug

SEQ ID NO: 980490 - RNA, 22 nt, Human
gauguuucaugcuagcaugugu

SEQ ID NO: 980491 - RNA, 22 nt, Human
auaugaaaguaagcaugugugu

SEQ ID NO: 980492 - RNA, 20 nt, Human
ccuuuauuauuuguaugaug

SEQ ID NO: 980493 - RNA, 22 nt, Human
aacagacauauuuuuaauaugc

SEQ ID NO: 980494 - RNA, 22 nt, Human
accuguuuuccuaucuagauug

SEQ ID NO: 980495 - RNA, 22 nt, Human
uaugcacaauaugaucuauuug

SEQ ID NO: 980496 - RNA, 22 nt, Human
ucucuggccgagagucccuggg

SEQ ID NO: 980497 - RNA, 22 nt, Human
ccuccugggccuugcucuguga

SEQ ID NO: 980498 - RNA, 23 nt, Human
ucuccuggcugcacuguggccac

SEQ ID NO: 980499 - RNA, 22 nt, Human
uccaagggaaacugcacuucua

SEQ ID NO: 980500 - RNA, 22 nt, Human
gcucugcugacagcugggacag

SEQ ID NO: 980501 - RNA, 22 nt, Human
acaggacuguggaaggaucucu

SEQ ID NO: 980502 - RNA, 22 nt, Human
gaaaaagugaccuugguagcua

SEQ ID NO: 980503 - RNA, 22 nt, Human
uucuuaggacuaguauagcaug

SEQ ID NO: 980504 - RNA, 20 nt, Human
cugagccaacucucuucuug

SEQ ID NO: 980505 - RNA, 22 nt, Human
cuggccaauauagggaaaucuu

SEQ ID NO: 980506 - RNA, 22 nt, Human
acuccuggguuccggagauucu

SEQ ID NO: 980507 - RNA, 22 nt, Human
agacaggcagaggcugcagagg

SEQ ID NO: 980508 - RNA, 20 nt, Human
aaaaacaguaaugcugaaga

SEQ ID NO: 980509 - RNA, 22 nt, Human
uuaaaacagcgugaaucuggca

SEQ ID NO: 980510 - RNA, 22 nt, Human
cuugaaaugacaggagcacauc

SEQ ID NO: 980511 - RNA, 20 nt, Human
uugaggagauauugaauacu

SEQ ID NO: 980512 - RNA, 17 nt, Human
ugaagaugcauggcagc

SEQ ID NO: 980513 - RNA, 22 nt, Human
auuaggaagaggaugucagcau

SEQ ID NO: 980514 - RNA, 22 nt, Human
gagggcuccucacauucucuau

SEQ ID NO: 980515 - RNA, 22 nt, Human
uuccuggccccaccccuggaga

SEQ ID NO: 980516 - RNA, 22 nt, Human
cacacuuuuggcauguuugguu

SEQ ID NO: 980517 - RNA, 22 nt, Human
uaacuccacaccccucuuggug

SEQ ID NO: 980518 - RNA, 22 nt, Human
gcaaaacagucgaugccuccca

SEQ ID NO: 980519 - RNA, 22 nt, Human
ucuguaaauccugcucagcaac

SEQ ID NO: 980520 - RNA, 22 nt, Human
cauagaaaagaguagguaaugu

SEQ ID NO: 980521 - RNA, 22 nt, Human
auguuauaguuauaaaaugagg

SEQ ID NO: 980522 - RNA, 22 nt, Human
augaaaaguucgaucuagaagg

SEQ ID NO: 980523 - RNA, 22 nt, Human
uuccuugaaugagucauggaaa

SEQ ID NO: 980524 - RNA, 20 nt, Human
ucugccacuuuuucugucac

SEQ ID NO: 980525 - RNA, 22 nt, Human
agacaugagaaacccaccagag

SEQ ID NO: 980526 - RNA, 22 nt, Human
uccuggccuuauccccaaacug

SEQ ID NO: 980527 - RNA, 22 nt, Human
aagauauuuuagaacauucacu

SEQ ID NO: 980528 - RNA, 22 nt, Human
guaauguguuuugaaaaacagu

SEQ ID NO: 980529 - RNA, 22 nt, Human
ucuucaaacugaaaauuuagaa

SEQ ID NO: 980530 - RNA, 22 nt, Human
gcaccuuucuauauucaguggc

SEQ ID NO: 980531 - RNA, 22 nt, Human
gcagggaagggaaacagagacc

SEQ ID NO: 980532 - RNA, 22 nt, Human
gaaauauucuugucuuguuuuc

SEQ ID NO: 980533 - RNA, 19 nt, Human
ugaggccaaggucacagau

SEQ ID NO: 980534 - RNA, 22 nt, Human
aagauguaucuuuccuuuaauu

SEQ ID NO: 980535 - RNA, 22 nt, Human
uuuuaacuuaaaauacauagau

SEQ ID NO: 980536 - RNA, 22 nt, Human
aucaggauccaccuugagccug

SEQ ID NO: 980537 - RNA, 22 nt, Human
uuuauuauguacaggcacuaua

SEQ ID NO: 980538 - RNA, 22 nt, Human
aucauaaaccacuuuguaaucu

SEQ ID NO: 980539 - RNA, 22 nt, Human
cuccugggagucuuccuggaug

SEQ ID NO: 980540 - RNA, 22 nt, Human
uucagcaacauuuguugagugc

SEQ ID NO: 980541 - RNA, 22 nt, Human
acuccuggaaaagaacgcaggg

SEQ ID NO: 980542 - RNA, 23 nt, Human
acagaaaguucugcuggacagag

SEQ ID NO: 980543 - RNA, 22 nt, Human
gcucugcucuaacauuccugac

SEQ ID NO: 980544 - RNA, 22 nt, Human
acuccagguuuuuucacugaag

SEQ ID NO: 980545 - RNA, 22 nt, Human
gaguuauuugguuugcaugcag

SEQ ID NO: 980546 - RNA, 22 nt, Human
guggccaacucaauguuuuuca

SEQ ID NO: 980547 - RNA, 22 nt, Human
ucucugcucaggcaccagcccu

SEQ ID NO: 980548 - RNA, 22 nt, Human
cuuuuacugugaaaagaaacug

SEQ ID NO: 980549 - RNA, 22 nt, Human
uaaccuuuguucaauguaagau

SEQ ID NO: 980550 - RNA, 22 nt, Human
ucugaagccaccucugcuuguc

SEQ ID NO: 980551 - RNA, 21 nt, Human
acugccugucuccauagucua

SEQ ID NO: 980552 - RNA, 22 nt, Human
ugcauuccauguguuuccugag

SEQ ID NO: 980553 - RNA, 22 nt, Human
aguuuaauauccuucaacuuuc

SEQ ID NO: 980554 - RNA, 22 nt, Human
cauuccuuaacguggggagucu

SEQ ID NO: 980555 - RNA, 22 nt, Human
aaauauuauugcuuaaggggag

SEQ ID NO: 980556 - RNA, 19 nt, Human
gcucugcuacuauuaccac

SEQ ID NO: 980557 - RNA, 22 nt, Human
cacucugcugaaaucgccuugu

SEQ ID NO: 980558 - RNA, 22 nt, Human
uggagccagagcgcagccuggg

SEQ ID NO: 980559 - RNA, 22 nt, Human
augucacauggccuguacuuug

SEQ ID NO: 980560 - RNA, 22 nt, Human
ucugugccucaucugguucagg

SEQ ID NO: 980561 - RNA, 22 nt, Human
ccuggccaggcucucagcacug

SEQ ID NO: 980562 - RNA, 22 nt, Human
aagcaugugcuggggcuuuuug

SEQ ID NO: 980563 - RNA, 22 nt, Human
aagggcugagcacagugagcca

SEQ ID NO: 980564 - RNA, 22 nt, Human
uccugugccuccaccugcuccg

SEQ ID NO: 980565 - RNA, 22 nt, Human
ccuccuggugacaaggcaaagc

SEQ ID NO: 980566 - RNA, 23 nt, Human
cagaaaguuugagaagauacauc

SEQ ID NO: 980567 - RNA, 22 nt, Human
uuccuggccucucucugagcag

SEQ ID NO: 980568 - RNA, 22 nt, Human
ucugaaaucuguaagcacuagc

SEQ ID NO: 980569 - RNA, 21 nt, Human
ucugagagcaacugcccuuua

SEQ ID NO: 980570 - RNA, 22 nt, Human
gcuccugggcucuaccuugcua

SEQ ID NO: 980571 - RNA, 22 nt, Human
agacaggaugcauacucuuggu

SEQ ID NO: 980572 - RNA, 22 nt, Human
cauguguagugaaauaagcagu

SEQ ID NO: 980573 - RNA, 18 nt, Human
augugcaauuuuguauuu

SEQ ID NO: 980574 - RNA, 21 nt, Human
uguaaguuucaucugaauugg

SEQ ID NO: 980575 - RNA, 21 nt, Human
ugacauaauccauaguacaaa

SEQ ID NO: 980576 - RNA, 22 nt, Human
uccaagggaaugugggcaaugc

SEQ ID NO: 980577 - RNA, 22 nt, Human
aacauaaauuugaaguggcaaa

SEQ ID NO: 980578 - RNA, 22 nt, Human
uaugcacaacaugcagguuugu

SEQ ID NO: 980579 - RNA, 22 nt, Human
uuagauaacaguagaauaucaa

SEQ ID NO: 980580 - RNA, 22 nt, Human
ucaaauaaugccauucaucauc

SEQ ID NO: 980581 - RNA, 22 nt, Human
uacaucuauacugaucuacauu

SEQ ID NO: 980582 - RNA, 22 nt, Human
gacaucaauauucugcagggau

SEQ ID NO: 980583 - RNA, 22 nt, Human
cuacucugaauugaagugauau

SEQ ID NO: 980584 - RNA, 22 nt, Human
uucugagcugcaacacuaacau

SEQ ID NO: 980585 - RNA, 22 nt, Human
auggccaagagucgauuugggg

SEQ ID NO: 980586 - RNA, 22 nt, Human
gcacucugccaggucuccugau

SEQ ID NO: 980587 - RNA, 22 nt, Human
uggucaaaaaggccuagacaca

SEQ ID NO: 980588 - RNA, 22 nt, Human
uuuaguagaugcagcauuauuu

SEQ ID NO: 980589 - RNA, 22 nt, Human
uuuauuaaaacuguuggcucug

SEQ ID NO: 980590 - RNA, 22 nt, Human
ugucaucuucaucauaaguaaa

SEQ ID NO: 980591 - RNA, 22 nt, Human
ucuuuauuuuaugcuugugcaa

SEQ ID NO: 980592 - RNA, 22 nt, Human
agcagacauaucucaugucaca

SEQ ID NO: 980593 - RNA, 22 nt, Human
ugaggccagucucaucacaggc

SEQ ID NO: 980594 - RNA, 20 nt, Human
ccuggccaaugagauaggaa

SEQ ID NO: 980595 - RNA, 22 nt, Human
gacagagaggcugagcaguaca

SEQ ID NO: 980596 - RNA, 22 nt, Human
aggauauuugcuuaagauagcu

SEQ ID NO: 980597 - RNA, 22 nt, Human
gcuccuggcaggcagugugugu

SEQ ID NO: 980598 - RNA, 22 nt, Human
ucugagcccucuuuugcagccc

SEQ ID NO: 980599 - RNA, 22 nt, Human
aggucacccguuugacuaucca

SEQ ID NO: 980600 - RNA, 22 nt, Human
aauccuggaauacaagagugaa

SEQ ID NO: 980601 - RNA, 22 nt, Human
aaccuuuugcaagugccuugac

SEQ ID NO: 980602 - RNA, 20 nt, Human
ucucugcuguccacauuugc

SEQ ID NO: 980603 - RNA, 22 nt, Human
uugcaaaugaccauugccacau

SEQ ID NO: 980604 - RNA, 22 nt, Human
augugcuaaacucaacaaaucu

SEQ ID NO: 980605 - RNA, 22 nt, Human
acuaaauagccucugguaguug

SEQ ID NO: 980606 - RNA, 22 nt, Human
acagacauuuucuguauugccu

SEQ ID NO: 980607 - RNA, 22 nt, Human
cuggcacacaaguauuuccuuu

SEQ ID NO: 980608 - RNA, 22 nt, Human
caguuuaaaugagugacugcag

SEQ ID NO: 980609 - RNA, 22 nt, Human
aauguucaguagaauaggaaug

SEQ ID NO: 980610 - RNA, 22 nt, Human
uaccuauagguacaauuacaag

SEQ ID NO: 980611 - RNA, 22 nt, Human
auucuuuucccaacugcuuuaa

SEQ ID NO: 980612 - RNA, 19 nt, Human
auaaauaaaaagugggaga

SEQ ID NO: 980613 - RNA, 21 nt, Human
auguaggaguuauuggaacag

SEQ ID NO: 980614 - RNA, 22 nt, Human
ucugagccuauuucaaauuccu

SEQ ID NO: 980615 - RNA, 22 nt, Human
caaaaguaaucguggcuuuugc

SEQ ID NO: 980616 - RNA, 22 nt, Human
cagccuuuuaggacuauuugug

SEQ ID NO: 980617 - RNA, 22 nt, Human
guucacaagaguuacagacaga

SEQ ID NO: 980618 - RNA, 22 nt, Human
uaaaacugaauacauacugagg

SEQ ID NO: 980619 - RNA, 22 nt, Human
augcacuacuagaugcaaaagu

SEQ ID NO: 980620 - RNA, 22 nt, Human
agcuuguagaaggccacgagca

SEQ ID NO: 980621 - RNA, 22 nt, Human
aacauuucuucugaaacugagu

SEQ ID NO: 980622 - RNA, 22 nt, Human
uggcaacaugucgaagugcugu

SEQ ID NO: 980623 - RNA, 22 nt, Human
uguguuaacacugcaugauaau

SEQ ID NO: 980624 - RNA, 20 nt, Human
ucuccuggugacaguaccca

SEQ ID NO: 980625 - RNA, 17 nt, Human
uucugagccacuuccuu

SEQ ID NO: 980626 - RNA, 22 nt, Human
uggcacauagaaaaggaucaau

SEQ ID NO: 980627 - RNA, 17 nt, Human
agcugaaauugcugaag

SEQ ID NO: 980628 - RNA, 22 nt, Human
ccugugccagcugggcccugcc

SEQ ID NO: 980629 - RNA, 22 nt, Human
aucaggaucugcaucauaagaa

SEQ ID NO: 980630 - RNA, 22 nt, Human
aggccaaagugcuccuuuuaga

SEQ ID NO: 980631 - RNA, 22 nt, Human
aggccaaagcaagacccuguaa

SEQ ID NO: 980632 - RNA, 22 nt, Human
uggcaccagcaccuagaugggg

SEQ ID NO: 980633 - RNA, 22 nt, Human
acaaacagcuaacauauguuaa

SEQ ID NO: 980634 - RNA, 22 nt, Human
aaaguuugcaauuuauguuaau

SEQ ID NO: 980635 - RNA, 22 nt, Human
cauauuaaggucuguaaggggu

SEQ ID NO: 980636 - RNA, 22 nt, Human
uugcuucauuuuaaauaaagac

SEQ ID NO: 980637 - RNA, 22 nt, Human
guccaaauaaguugcaaaauag

SEQ ID NO: 980638 - RNA, 22 nt, Human
uauuagguaugaacuggcaacc

SEQ ID NO: 980639 - RNA, 22 nt, Human
uguuuauuacaguucuuggaau

SEQ ID NO: 980640 - RNA, 22 nt, Human
aaacauucucagcccugcuugc

SEQ ID NO: 980641 - RNA, 22 nt, Human
uaagucaugauucuguguuacu

SEQ ID NO: 980642 - RNA, 22 nt, Human
aauguggaaucauggacuuuau

SEQ ID NO: 980643 - RNA, 22 nt, Human
auauaaagagcuuaguauagug

SEQ ID NO: 980644 - RNA, 22 nt, Human
uccugagcugccgcaucagcag

SEQ ID NO: 980645 - RNA, 22 nt, Human
auuuauuaugggauuuggcaca

SEQ ID NO: 980646 - RNA, 22 nt, Human
uacaaagagguaauugcauaua

SEQ ID NO: 980647 - RNA, 22 nt, Human
auagaauagcauagaaaauuga

SEQ ID NO: 980648 - RNA, 22 nt, Human
ucuuuuauccuacauuuagcuc

SEQ ID NO: 980649 - RNA, 22 nt, Human
uagggauggaaacuaggaaucu

SEQ ID NO: 980650 - RNA, 22 nt, Human
cugggccaagaaguuguguaug

SEQ ID NO: 980651 - RNA, 21 nt, Human
gggaaugagauucuuggagau

SEQ ID NO: 980652 - RNA, 22 nt, Human
ccuguuuagugaggugaggagu

SEQ ID NO: 980653 - RNA, 22 nt, Human
guauuaggaaauaugaagaaag

SEQ ID NO: 980654 - RNA, 22 nt, Human
cuuuagugguauuuuagcaagu

SEQ ID NO: 980655 - RNA, 19 nt, Human
uggaagaggaagggaaaua

SEQ ID NO: 980656 - RNA, 22 nt, Human
cauaacauccuugcuacuuuga

SEQ ID NO: 980657 - RNA, 22 nt, Human
gcaggagagucugugccagguu

SEQ ID NO: 980658 - RNA, 22 nt, Human
gcucugcugcuuacuagauggu

SEQ ID NO: 980659 - RNA, 22 nt, Human
aaauaacuuaugaucgucuggc

SEQ ID NO: 980660 - RNA, 22 nt, Human
guaaauaacugguaauuggggu

SEQ ID NO: 980661 - RNA, 22 nt, Human
ucucugcucugugccucaguuu

SEQ ID NO: 980662 - RNA, 22 nt, Human
uggaagagguggaaguggcuuc

SEQ ID NO: 980663 - RNA, 22 nt, Human
augaaauguuggucccaaucgc

SEQ ID NO: 980664 - RNA, 22 nt, Human
aaagucauuguaauauaugcua

SEQ ID NO: 980665 - RNA, 22 nt, Human
auaaaaccaaagcagcaguguu

SEQ ID NO: 980666 - RNA, 22 nt, Human
uucaaacaguguagaauauaug

SEQ ID NO: 980667 - RNA, 20 nt, Human
aggauuugagaaggcgucuu

SEQ ID NO: 980668 - RNA, 22 nt, Human
uacuaggaagcagcugcauugg

SEQ ID NO: 980669 - RNA, 22 nt, Human
uaaugaugugugcaaacugaau

SEQ ID NO: 980670 - RNA, 22 nt, Human
uggcagacuuuagggucuacau

SEQ ID NO: 980671 - RNA, 19 nt, Human
cauuaggauuagagacaag

SEQ ID NO: 980672 - RNA, 22 nt, Human
cagccuuugggucagaagauuc

SEQ ID NO: 980673 - RNA, 22 nt, Human
gaaauauugggacucagagcuu

SEQ ID NO: 980674 - RNA, 22 nt, Human
gucaucuuaucauuguugcugu

SEQ ID NO: 980675 - RNA, 18 nt, Human
auggucucauacugggag

SEQ ID NO: 980676 - RNA, 17 nt, Human
ccacucaguaauuucuc

SEQ ID NO: 980677 - RNA, 22 nt, Human
acuugaaaggaagcucuaaaac

SEQ ID NO: 980678 - RNA, 22 nt, Human
uaauaggagccaggucacauag

SEQ ID NO: 980679 - RNA, 22 nt, Human
uugcaaaugggcaaagcagauc

SEQ ID NO: 980680 - RNA, 22 nt, Human
aaccuucacuugcuucauuuga

SEQ ID NO: 980681 - RNA, 22 nt, Human
cugcucacgccaccguucauca

SEQ ID NO: 980682 - RNA, 22 nt, Human
uccuggcccgaucccugugaag

SEQ ID NO: 980683 - RNA, 22 nt, Human
aaacacuagcaggaagcacuga

SEQ ID NO: 980684 - RNA, 22 nt, Human
aaaguuuggauuagcaguuaga

SEQ ID NO: 980685 - RNA, 22 nt, Human
aaugauguauuaguacaacaca

SEQ ID NO: 980686 - RNA, 23 nt, Human
uuccuggcagguacaacuuuuac

SEQ ID NO: 980687 - RNA, 22 nt, Human
uuaaaaugcagauuaugacuca

SEQ ID NO: 980688 - RNA, 22 nt, Human
ugagccaaacuucuccuugguc

SEQ ID NO: 980689 - RNA, 22 nt, Human
gaggaaggucccaucagaauuu

SEQ ID NO: 980690 - RNA, 22 nt, Human
uuugcaauuugugcugcaaaug

SEQ ID NO: 980691 - RNA, 20 nt, Human
ucuccuggucugguccgugc

SEQ ID NO: 980692 - RNA, 22 nt, Human
uggcaccaggcgggguggcugu

SEQ ID NO: 980693 - RNA, 22 nt, Human
gaagccuugaacugcaaacccc

SEQ ID NO: 980694 - RNA, 23 nt, Human
uacuuaggaauggggacggcaag

SEQ ID NO: 980695 - RNA, 22 nt, Human
cacucugcagcugaagggcugg

SEQ ID NO: 980696 - RNA, 22 nt, Human
ucuccuggagcaggaagguggg

SEQ ID NO: 980697 - RNA, 23 nt, Human
gacaccuuugccagaucaagaug

SEQ ID NO: 980698 - RNA, 22 nt, Human
aguuucuuuagauagaaaguuc

SEQ ID NO: 980699 - RNA, 22 nt, Human
ccucugcugcuguugagcaccg

SEQ ID NO: 980700 - RNA, 22 nt, Human
uuggccaaggaaguagcaacgg

SEQ ID NO: 980701 - RNA, 22 nt, Human
uuaggauaugaaacaguauaag

SEQ ID NO: 980702 - RNA, 22 nt, Human
aguugcagacgcagagauguug

SEQ ID NO: 980703 - RNA, 21 nt, Human
ugcuggaaaaagugguucuag

SEQ ID NO: 980704 - RNA, 22 nt, Human
uucaucaauguguuuaauaaug

SEQ ID NO: 980705 - RNA, 22 nt, Human
aaaugaguuuccucaauguccu

SEQ ID NO: 980706 - RNA, 22 nt, Human
cauuucauaguugucacaauaa

SEQ ID NO: 980707 - RNA, 22 nt, Human
acuucuggauagagucagcuuu

SEQ ID NO: 980708 - RNA, 22 nt, Human
aauguacaauaagacaaagagg

SEQ ID NO: 980709 - RNA, 22 nt, Human
aauuucaaguggcaucuuugau

SEQ ID NO: 980710 - RNA, 22 nt, Human
agacauuuggaagauacacaua

SEQ ID NO: 980711 - RNA, 22 nt, Human
uuaguaggagagcuuguucauu

SEQ ID NO: 980712 - RNA, 22 nt, Human
cagacauauguuuuaacagauu

SEQ ID NO: 980713 - RNA, 22 nt, Human
augaaauaucuugaagaaauuc

SEQ ID NO: 980714 - RNA, 22 nt, Human
acucugcucuuauaguguuaua

SEQ ID NO: 980715 - RNA, 22 nt, Human
ucugccacuagugguuaccuua

SEQ ID NO: 980716 - RNA, 22 nt, Human
cuuuauuagauguagacuuucu

SEQ ID NO: 980717 - RNA, 22 nt, Human
aaacugccuccugggcaacuaa

SEQ ID NO: 980718 - RNA, 22 nt, Human
gcucugcuaauauuguaguacc

SEQ ID NO: 980719 - RNA, 22 nt, Human
cagcugcaguucaaugcuugcu

SEQ ID NO: 980720 - RNA, 22 nt, Human
uuucacaaugcaauccuacuuc

SEQ ID NO: 980721 - RNA, 22 nt, Human
agaaauguggaggaacagggcu

SEQ ID NO: 980722 - RNA, 22 nt, Human
guauuagguuggugcaaaauug

SEQ ID NO: 980723 - RNA, 22 nt, Human
uauauuaaaugaccaguuuuaa

SEQ ID NO: 980724 - RNA, 22 nt, Human
agaaaugaagcaggaguuauua

SEQ ID NO: 980725 - RNA, 22 nt, Human
cuuaauaaaugguagcuguuau

SEQ ID NO: 980726 - RNA, 22 nt, Human
aggccaaauagcagguuugcua

SEQ ID NO: 980727 - RNA, 17 nt, Human
cuccuggccaccccucu

SEQ ID NO: 980728 - RNA, 22 nt, Human
uauguagguaaacacagacaua

SEQ ID NO: 980729 - RNA, 22 nt, Human
cagagacauuaagugccaugau

SEQ ID NO: 980730 - RNA, 22 nt, Human
cuccuuggccguuaaugucaca

SEQ ID NO: 980731 - RNA, 23 nt, Human
cacuccuguuucuaagccagcau

SEQ ID NO: 980732 - RNA, 22 nt, Human
gcucugcuugcaucaugacugc

SEQ ID NO: 980733 - RNA, 22 nt, Human
uagaaacagcauauauuagccc

SEQ ID NO: 980734 - RNA, 22 nt, Human
aaaguaaccuaguaauaguguc

SEQ ID NO: 980735 - RNA, 22 nt, Human
guucacaaauaugcacuuacga

SEQ ID NO: 980736 - RNA, 22 nt, Human
guggccaaacaccaguuuagga

SEQ ID NO: 980737 - RNA, 22 nt, Human
cugaaaugguugccuggagaau

SEQ ID NO: 980738 - RNA, 22 nt, Human
gauuucuuuagguguaauagug

SEQ ID NO: 980739 - RNA, 22 nt, Human
gacuccuggcuuucccucuuag

SEQ ID NO: 980740 - RNA, 20 nt, Human
acugggcauaccuguccugu

SEQ ID NO: 980741 - RNA, 22 nt, Human
aggauuugaaccugcauccagu

SEQ ID NO: 980742 - RNA, 22 nt, Human
ucuuguuacaguuuauuacaug

SEQ ID NO: 980743 - RNA, 22 nt, Human
uuucuuaguccuagagugauuu

SEQ ID NO: 980744 - RNA, 22 nt, Human
agacagugcaagaagagcaggc

SEQ ID NO: 980745 - RNA, 22 nt, Human
uucugagguccaugcaguacug

SEQ ID NO: 980746 - RNA, 22 nt, Human
gacucugcuaggaaaaucucag

SEQ ID NO: 980747 - RNA, 22 nt, Human
uuaaaaugaauauugauuagca

SEQ ID NO: 980748 - RNA, 22 nt, Human
acagcauucaauaaauaauaac

SEQ ID NO: 980749 - RNA, 22 nt, Human
auaaacaucuguuucucuucug

SEQ ID NO: 980750 - RNA, 22 nt, Human
uugaauaauuaauuacacucag

SEQ ID NO: 980751 - RNA, 22 nt, Human
aauaauguacauacauauuucg

SEQ ID NO: 980752 - RNA, 22 nt, Human
auggccaaggggccuaggcagg

SEQ ID NO: 980753 - RNA, 22 nt, Human
cagcuuugcccuuugcccaauc

SEQ ID NO: 980754 - RNA, 22 nt, Human
cugggccagcaacugcaaugga

SEQ ID NO: 980755 - RNA, 22 nt, Human
ucuggccacuaauaggucucac

SEQ ID NO: 980756 - RNA, 22 nt, Human
uauucacagguucuggggauca

SEQ ID NO: 980757 - RNA, 22 nt, Human
uuggccaagggcucuuuaggcu

SEQ ID NO: 980758 - RNA, 22 nt, Human
ugcaacauuauuaaacuaagca

SEQ ID NO: 980759 - RNA, 22 nt, Human
aaauauguaaccaaggugaagu

SEQ ID NO: 980760 - RNA, 22 nt, Human
ucacucuggaguccgcuaccag

SEQ ID NO: 980761 - RNA, 22 nt, Human
ugaaaaacuuuaauccauaaag

SEQ ID NO: 980762 - RNA, 22 nt, Human
ugaauauguuccucacaaguuc

SEQ ID NO: 980763 - RNA, 22 nt, Human
gagaggggcgcgcagcucgcga

SEQ ID NO: 980764 - RNA, 22 nt, Human
uguguauagcaguuuccagucu

SEQ ID NO: 980765 - RNA, 22 nt, Human
uccuggccagaggacaaagcug

SEQ ID NO: 980766 - RNA, 22 nt, Human
cacuccuguuccacuaaaugag

SEQ ID NO: 980767 - RNA, 22 nt, Human
guuuuauuuccaugagagaccg

SEQ ID NO: 980768 - RNA, 22 nt, Human
augugcaacuucagcagaaagg

SEQ ID NO: 980769 - RNA, 22 nt, Human
aguuggcauuuuauuuaaguau

SEQ ID NO: 980770 - RNA, 22 nt, Human
gagagcuguuuaucuucuucaa

SEQ ID NO: 980771 - RNA, 22 nt, Human
ugaaggugucuuugugaacauc

SEQ ID NO: 980772 - RNA, 22 nt, Human
aauauccagguagaugucuucu

SEQ ID NO: 980773 - RNA, 22 nt, Human
aacuucuggauguuucaaaugu

SEQ ID NO: 980774 - RNA, 22 nt, Human
acauaaauagauuauugggagg

SEQ ID NO: 980775 - RNA, 22 nt, Human
auuaggauuugguauggucaua

SEQ ID NO: 980776 - RNA, 22 nt, Human
gcuggccacauugugccguccu

SEQ ID NO: 980777 - RNA, 22 nt, Human
uuguuacuaagccuuuaaauag

SEQ ID NO: 980778 - RNA, 22 nt, Human
agauaaauuccuaagauuucag

SEQ ID NO: 980779 - RNA, 23 nt, Human
aacuccugaaucgugagccaucu

SEQ ID NO: 980780 - RNA, 22 nt, Human
uucaggauggcggauguugggg

SEQ ID NO: 980781 - RNA, 22 nt, Human
ugcauguuauuguggcaagaau

SEQ ID NO: 980782 - RNA, 22 nt, Human
uuggcagcccagcuuacuagca

SEQ ID NO: 980783 - RNA, 22 nt, Human
augguacaauguguuuguuagg

SEQ ID NO: 980784 - RNA, 22 nt, Human
ucacucugcaggaaggagcagc

SEQ ID NO: 980785 - RNA, 22 nt, Human
uucuuagaugauuaaugauggg

SEQ ID NO: 980786 - RNA, 22 nt, Human
aauagaauuuguacuguguuuu

SEQ ID NO: 980787 - RNA, 19 nt, Human
agucucacccaagcagucu

SEQ ID NO: 980788 - RNA, 18 nt, Human
aggccaaacuuguaagca

SEQ ID NO: 980789 - RNA, 22 nt, Human
guggccaaggugcagagcagcu

SEQ ID NO: 980790 - RNA, 22 nt, Human
ucugagccagccaccuccuuca

SEQ ID NO: 980791 - RNA, 22 nt, Human
acucugcucuuuggacaaugcc

SEQ ID NO: 980792 - RNA, 22 nt, Human
gcuggccaaaguguaccuggag

SEQ ID NO: 980793 - RNA, 22 nt, Human
cagcuccugaggacugcuggga

SEQ ID NO: 980794 - RNA, 22 nt, Human
cuccugaguaguagcauuguca

SEQ ID NO: 980795 - RNA, 22 nt, Human
acucugcuauugcagugcaaaa

SEQ ID NO: 980796 - RNA, 22 nt, Human
ucugagaggcaucugcacuucu

SEQ ID NO: 980797 - RNA, 22 nt, Human
uuggccaaauaaucuugcagau

SEQ ID NO: 980798 - RNA, 22 nt, Human
uccuggcccucugcaaacgcca

SEQ ID NO: 980799 - RNA, 22 nt, Human
cagucucagaggugggaguggg

SEQ ID NO: 980800 - RNA, 22 nt, Human
uuaaguaagaccuuaugucuug

SEQ ID NO: 980801 - RNA, 22 nt, Human
gaguuauugaguauagaaugua

SEQ ID NO: 980802 - RNA, 22 nt, Human
ucugugccuccguaacacacca

SEQ ID NO: 980803 - RNA, 22 nt, Human
gaaaaugugucaucccuacugu

SEQ ID NO: 980804 - RNA, 22 nt, Human
aaaugauggaaaugaggcugaa

SEQ ID NO: 980805 - RNA, 22 nt, Human
aauaagauugacacaaguaccu

SEQ ID NO: 980806 - RNA, 22 nt, Human
aaugauguauguauaaggcagg

SEQ ID NO: 980807 - RNA, 22 nt, Human
ucacucuguguuucccugggac

SEQ ID NO: 980808 - RNA, 22 nt, Human
uagcacaggucuuguugccauu

SEQ ID NO: 980809 - RNA, 22 nt, Human
aauuaggaaauucagccauuuu

SEQ ID NO: 980810 - RNA, 22 nt, Human
ugucuuaauaugugcauucugu

SEQ ID NO: 980811 - RNA, 22 nt, Human
cagcuuuguccugcaaaccuga

SEQ ID NO: 980812 - RNA, 21 nt, Human
acuggccaccacuggcagggg

SEQ ID NO: 980813 - RNA, 22 nt, Human
auuuggauucuuauuuagcacu

SEQ ID NO: 980814 - RNA, 22 nt, Human
uuaauuuuuauguauagugugu

SEQ ID NO: 980815 - RNA, 22 nt, Human
cugagccagcgggcucacuuuu

SEQ ID NO: 980816 - RNA, 22 nt, Human
cuccuggcacugucuugaccca

SEQ ID NO: 980817 - RNA, 22 nt, Human
uccaagggcaacaauggaacac

SEQ ID NO: 980818 - RNA, 22 nt, Human
cagucauuggcuaaagcucccu

SEQ ID NO: 980819 - RNA, 20 nt, Human
cugggccauccuuuuacaau

SEQ ID NO: 980820 - RNA, 21 nt, Human
auucugaguugucagucuuca

SEQ ID NO: 980821 - RNA, 22 nt, Human
auucacaaagucacccuuacac

SEQ ID NO: 980822 - RNA, 22 nt, Human
uggcagacacugucgaagccua

SEQ ID NO: 980823 - RNA, 22 nt, Human
auuacacacucaaguccuguua

SEQ ID NO: 980824 - RNA, 23 nt, Human
ccagucucuuuccaaaaucacau

SEQ ID NO: 980825 - RNA, 22 nt, Human
uccugggcaaaaguaucuguga

SEQ ID NO: 980826 - RNA, 22 nt, Human
uuugauaacagugaauaucaug

SEQ ID NO: 980827 - RNA, 23 nt, Human
uuuuaauuuggacauaagaagau

SEQ ID NO: 980828 - RNA, 22 nt, Human
uucagcaagaauuuacugagcu

SEQ ID NO: 980829 - RNA, 22 nt, Human
uagcuuuguguaugaugucugu

SEQ ID NO: 980830 - RNA, 22 nt, Human
cagaggaguucaguacacagcc

SEQ ID NO: 980831 - RNA, 22 nt, Human
cuuuuauuuugaauuaagggcu

SEQ ID NO: 980832 - RNA, 22 nt, Human
uucaugcuuuuaccgcuguuaa

SEQ ID NO: 980833 - RNA, 22 nt, Human
aauucacaggagguauuugucc

SEQ ID NO: 980834 - RNA, 20 nt, Human
aacacacugguggcaucagg

SEQ ID NO: 980835 - RNA, 22 nt, Human
cuuuguauucaguugggcugug

SEQ ID NO: 980836 - RNA, 22 nt, Human
ggucugaguggggccugagauu

SEQ ID NO: 980837 - RNA, 22 nt, Human
cuuuuuaucucuuaaugauguu

SEQ ID NO: 980838 - RNA, 21 nt, Human
ccacucugaguguugaacaga

SEQ ID NO: 980839 - RNA, 22 nt, Human
ccuggccauagggcccaggaaa

SEQ ID NO: 980840 - RNA, 22 nt, Human
gaguuuaaaacgcuuguauuua

SEQ ID NO: 980841 - RNA, 22 nt, Human
ugcugaaagucccaaaucucau

SEQ ID NO: 980842 - RNA, 22 nt, Human
uggccaaauuugguguaacuug

SEQ ID NO: 980843 - RNA, 22 nt, Human
uuaggcauauggcacaugauag

SEQ ID NO: 980844 - RNA, 22 nt, Human
agacagguaaauagagaugcug

SEQ ID NO: 980845 - RNA, 22 nt, Human
aagacagagacucugcaacagg

SEQ ID NO: 980846 - RNA, 22 nt, Human
aaaaagcuuaaaugagcaguuc

SEQ ID NO: 980847 - RNA, 22 nt, Human
acucugcuguuuacucucuaua

SEQ ID NO: 980848 - RNA, 22 nt, Human
uagaauguaaauuccaagggca

SEQ ID NO: 980849 - RNA, 22 nt, Human
gcucugcugaagccccuugcau

SEQ ID NO: 980850 - RNA, 22 nt, Human
gacucugcugacuaguugacua

SEQ ID NO: 980851 - RNA, 22 nt, Human
auagucaaccuuguaauuagcc

SEQ ID NO: 980852 - RNA, 22 nt, Human
uaaaugauaauaaugcuagugu

SEQ ID NO: 980853 - RNA, 22 nt, Human
ugaggccagcuucagcagugga

SEQ ID NO: 980854 - RNA, 22 nt, Human
ucacucugggccagcgcaggua

SEQ ID NO: 980855 - RNA, 22 nt, Human
guuaggauguggggacuuuggg

SEQ ID NO: 980856 - RNA, 22 nt, Human
uaaaagacccucuagaguccca

SEQ ID NO: 980857 - RNA, 22 nt, Human
ucugccaccuucauccuccacu

SEQ ID NO: 980858 - RNA, 22 nt, Human
aguuucaauucuuuucacaaag

SEQ ID NO: 980859 - RNA, 22 nt, Human
aaaaguaauugaugcaaucgua

SEQ ID NO: 980860 - RNA, 22 nt, Human
aucugaagcuaucugcacuuca

SEQ ID NO: 980861 - RNA, 22 nt, Human
uuccuggcaugaaaaauaucac

SEQ ID NO: 980862 - RNA, 22 nt, Human
aaacaugagcacuugcuucaua

SEQ ID NO: 980863 - RNA, 18 nt, Human
cugaggccaacuacacug

SEQ ID NO: 980864 - RNA, 23 nt, Human
ccagucucacguauacaggauuu

SEQ ID NO: 980865 - RNA, 17 nt, Human
ucuccuggcucuaucag

SEQ ID NO: 980866 - RNA, 22 nt, Human
guucacaaaauucuggccagug

SEQ ID NO: 980867 - RNA, 22 nt, Human
auuagagaaauguugccaagau

SEQ ID NO: 980868 - RNA, 22 nt, Human
cuucacaaagcucucuuuaugu

SEQ ID NO: 980869 - RNA, 21 nt, Human
gacucugcaccaaauuaagcc

SEQ ID NO: 980870 - RNA, 22 nt, Human
uuccuggcaccaccacuucuag

SEQ ID NO: 980871 - RNA, 22 nt, Human
guggccaaaaggaagaagguua

SEQ ID NO: 980872 - RNA, 22 nt, Human
ucugccaccaccuacacuagua

SEQ ID NO: 980873 - RNA, 22 nt, Human
ucagggaacuacuucucccuau

SEQ ID NO: 980874 - RNA, 22 nt, Human
acaaaguaggucaucaaagcuc

SEQ ID NO: 980875 - RNA, 22 nt, Human
gcuggccauagaagccaaagag

SEQ ID NO: 980876 - RNA, 22 nt, Human
aaauuagucauguuguauuacu

SEQ ID NO: 980877 - RNA, 22 nt, Human
auucacaacaaaaggauaugag

SEQ ID NO: 980878 - RNA, 22 nt, Human
guuauuagaagugaaggauugu

SEQ ID NO: 980879 - RNA, 22 nt, Human
uggacaaaugauuucuaccuuu

SEQ ID NO: 980880 - RNA, 22 nt, Human
cuccuggcccugagcucccagg

SEQ ID NO: 980881 - RNA, 22 nt, Human
guggccaauaggagcagcuauc

SEQ ID NO: 980882 - RNA, 22 nt, Human
uuaaaagagcagcccagcauau

SEQ ID NO: 980883 - RNA, 22 nt, Human
uguuggcaucucugagagaguu

SEQ ID NO: 980884 - RNA, 22 nt, Human
uggcacaugguaagacucagua

SEQ ID NO: 980885 - RNA, 22 nt, Human
uaguuaggguucugcagagaca

SEQ ID NO: 980886 - RNA, 22 nt, Human
cugugccaguguauuccuguga

SEQ ID NO: 980887 - RNA, 22 nt, Human
agaaaugacacacaugagacau

SEQ ID NO: 980888 - RNA, 22 nt, Human
acucugcuugggccauaucugg

SEQ ID NO: 980889 - RNA, 17 nt, Human
cuccuggcagccucagg

SEQ ID NO: 980890 - RNA, 22 nt, Human
ugcaugcugcacacaugcguag

SEQ ID NO: 980891 - RNA, 22 nt, Human
cugguccauucucucccugaag

SEQ ID NO: 980892 - RNA, 22 nt, Human
uggcagcagggccccuggagga

SEQ ID NO: 980893 - RNA, 22 nt, Human
aacacauauuuauauaugcaca

SEQ ID NO: 980894 - RNA, 22 nt, Human
aaauaguaaagugguagccauc

SEQ ID NO: 980895 - RNA, 22 nt, Human
uuuacugugcauuagaaucacc

SEQ ID NO: 980896 - RNA, 22 nt, Human
gcaccuuuuucuaggagaaugu

SEQ ID NO: 980897 - RNA, 22 nt, Human
uguuuaauugggccaacagcgg

SEQ ID NO: 980898 - RNA, 22 nt, Human
ugagaauaggcauagaaccugg

SEQ ID NO: 980899 - RNA, 22 nt, Human
uguagaaagaauauguuucaua

SEQ ID NO: 980900 - RNA, 22 nt, Human
auggccaagaaauugccgacug

SEQ ID NO: 980901 - RNA, 19 nt, Human
uuuaggauaaagucuggac

SEQ ID NO: 980902 - RNA, 22 nt, Human
caucuuuuggccuauucugagg

SEQ ID NO: 980903 - RNA, 22 nt, Human
gaguuuaaauaacacauuucca

SEQ ID NO: 980904 - RNA, 22 nt, Human
ggucagccuuggauuugguagc

SEQ ID NO: 980905 - RNA, 22 nt, Human
ugcugagaaucacagguuauaa

SEQ ID NO: 980906 - RNA, 17 nt, Human
auuagguuuugucauga

SEQ ID NO: 980907 - RNA, 22 nt, Human
ucuccuggucaccucagaaguc

SEQ ID NO: 980908 - RNA, 22 nt, Human
aaugugcaggcucaaaccuugu

SEQ ID NO: 980909 - RNA, 22 nt, Human
uugagggaacaugagaaucauc

SEQ ID NO: 980910 - RNA, 22 nt, Human
uauaaagaaguguaaacaggaa

SEQ ID NO: 980911 - RNA, 22 nt, Human
guacacauugucuguuuacuuc

SEQ ID NO: 980912 - RNA, 22 nt, Human
uauuggaugauucacuuggcag

SEQ ID NO: 980913 - RNA, 22 nt, Human
cauccugguuaccccauaguca

SEQ ID NO: 980914 - RNA, 22 nt, Human
ugaaacacuuucaauuacauau

SEQ ID NO: 980915 - RNA, 22 nt, Human
aauuaggagaaaacuguugucu

SEQ ID NO: 980916 - RNA, 22 nt, Human
ggauuuggaagaccgggucaca

SEQ ID NO: 980917 - RNA, 22 nt, Human
uauuuaauaaaacuauggcaug

SEQ ID NO: 980918 - RNA, 22 nt, Human
auuauuaggugcucucugacaa

SEQ ID NO: 980919 - RNA, 22 nt, Human
cauaagaaauuuaacagaacuu

SEQ ID NO: 980920 - RNA, 22 nt, Human
augaaagaugauuuaaaguacu

SEQ ID NO: 980921 - RNA, 22 nt, Human
ugucaucuuuuuaaagaagaga

SEQ ID NO: 980922 - RNA, 22 nt, Human
uauuagguaaaggacuugcagg

SEQ ID NO: 980923 - RNA, 19 nt, Human
acugccugaggcucacagg

SEQ ID NO: 980924 - RNA, 22 nt, Human
agccuugaacacugacugaagg

SEQ ID NO: 980925 - RNA, 22 nt, Human
caccuuguggcccagucagguu

SEQ ID NO: 980926 - RNA, 22 nt, Human
caaaaguaauugugguuuuugc

SEQ ID NO: 980927 - RNA, 22 nt, Human
agcacucuucugugauaguugu

SEQ ID NO: 980928 - RNA, 22 nt, Human
uaggauuuggcuuuagucaggu

SEQ ID NO: 980929 - RNA, 22 nt, Human
uuugaauaucacaaacuuucaa

SEQ ID NO: 980930 - RNA, 22 nt, Human
cagcaggguagguuguaucagu

SEQ ID NO: 980931 - RNA, 22 nt, Human
guauuagguuggugcaaaagua

SEQ ID NO: 980932 - RNA, 22 nt, Human
aaacagaaauuuccucaugcuc

SEQ ID NO: 980933 - RNA, 22 nt, Human
uaacuccaucucugugucugcu

SEQ ID NO: 980934 - RNA, 22 nt, Human
accucugcaacccuggaauggg

SEQ ID NO: 980935 - RNA, 22 nt, Human
acacucuguaaugucacacucc

SEQ ID NO: 980936 - RNA, 22 nt, Human
cauucacauucuucuuacuguu

SEQ ID NO: 980937 - RNA, 22 nt, Human
ugaaagcacaaguucuaacagg

SEQ ID NO: 980938 - RNA, 22 nt, Human
gcuccuggugcaaaguuucuuc

SEQ ID NO: 980939 - RNA, 22 nt, Human
auguuuaagaaagucuuccaua

SEQ ID NO: 980940 - RNA, 22 nt, Human
uauuggucuuggaagguuuugu

SEQ ID NO: 980941 - RNA, 22 nt, Human
ucuggccaacccucaaguugua

SEQ ID NO: 980942 - RNA, 22 nt, Human
cuggccaauccauuaauuuguu

SEQ ID NO: 980943 - RNA, 22 nt, Human
uugaaauauggauugaccuuga

SEQ ID NO: 980944 - RNA, 22 nt, Human
gcuggccagggcugcucgcgga

SEQ ID NO: 980945 - RNA, 22 nt, Human
cagggucuuauaaggccaauuu

SEQ ID NO: 980946 - RNA, 22 nt, Human
uuccuguuucauagaaaacuga

SEQ ID NO: 980947 - RNA, 22 nt, Human
guucacaauggcuuuaccuaag

SEQ ID NO: 980948 - RNA, 19 nt, Human
gcuccugggccucacucau

SEQ ID NO: 980949 - RNA, 22 nt, Human
aaauaugaaugauaagaguuau

SEQ ID NO: 980950 - RNA, 22 nt, Human
uggccaagaaugauaugugaag

SEQ ID NO: 980951 - RNA, 22 nt, Human
uucagcaaugacagccuauaua

SEQ ID NO: 980952 - RNA, 22 nt, Human
uuggccaauuccagaggaucau

SEQ ID NO: 980953 - RNA, 22 nt, Human
uagagcugggcagugcucugag

SEQ ID NO: 980954 - RNA, 22 nt, Human
aagaugcagcaaacuacuuuuu

SEQ ID NO: 980955 - RNA, 22 nt, Human
uccuggccuagcucacccugga

SEQ ID NO: 980956 - RNA, 22 nt, Human
uuauuaugguauuucuuugcag

SEQ ID NO: 980957 - RNA, 22 nt, Human
cucuugaaaauuggaacacaga

SEQ ID NO: 980958 - RNA, 22 nt, Human
aacuccugaggaaauggucuca

SEQ ID NO: 980959 - RNA, 22 nt, Human
acacucugugaggcauguaaug

SEQ ID NO: 980960 - RNA, 22 nt, Human
cugaaaugacgguuuggggcaa

SEQ ID NO: 980961 - RNA, 22 nt, Human
guauguauguauauguuuaaga

SEQ ID NO: 980962 - RNA, 22 nt, Human
aaagucauuggaauauuaauga

SEQ ID NO: 980963 - RNA, 22 nt, Human
uuuauauuucccaggauuggcc

SEQ ID NO: 980964 - RNA, 22 nt, Human
uggcaaacuggaggaagcccug

SEQ ID NO: 980965 - RNA, 22 nt, Human
agucauguguucaucuuucauu

SEQ ID NO: 980966 - RNA, 22 nt, Human
ucuccuggcaugugggucaucu

SEQ ID NO: 980967 - RNA, 22 nt, Human
cacucugccugauguuacaugg

SEQ ID NO: 980968 - RNA, 22 nt, Human
cuggccaagcacuggggucaaa

SEQ ID NO: 980969 - RNA, 20 nt, Human
auuaggauuuuaggucauca

SEQ ID NO: 980970 - RNA, 22 nt, Human
aaauauaguaaaugcauaguuc

SEQ ID NO: 980971 - RNA, 22 nt, Human
ccuccuggaaaaauucccuggc

SEQ ID NO: 980972 - RNA, 22 nt, Human
uaaguuaucggaguguguuuca

SEQ ID NO: 980973 - RNA, 22 nt, Human
cugggccaucuccuuugugugg

SEQ ID NO: 980974 - RNA, 22 nt, Human
acauaaugaaaugcagaaauca

SEQ ID NO: 980975 - RNA, 22 nt, Human
auuuggcaaauaauuugagggu

SEQ ID NO: 980976 - RNA, 22 nt, Human
acucugcuuaauuaaaaccagg

SEQ ID NO: 980977 - RNA, 22 nt, Human
aaacacaucauucaugucguca

SEQ ID NO: 980978 - RNA, 22 nt, Human
ucauaaaaugcuccugauauug

SEQ ID NO: 980979 - RNA, 22 nt, Human
ucuccugguacccuuccuagca

SEQ ID NO: 980980 - RNA, 22 nt, Human
ucuggccauggcaagccgagug

SEQ ID NO: 980981 - RNA, 22 nt, Human
ccuaggcccauuaauuccccuu

SEQ ID NO: 980982 - RNA, 22 nt, Human
auggccaacugaaaugaaagau

SEQ ID NO: 980983 - RNA, 22 nt, Human
augauugaaaaugacauugcca

SEQ ID NO: 980984 - RNA, 18 nt, Human
uagaauauaggucauucu

SEQ ID NO: 980985 - RNA, 22 nt, Human
cuuuauauccagauguuuggug

SEQ ID NO: 980986 - RNA, 22 nt, Human
gaguuuaaagcauacauauuuu

SEQ ID NO: 980987 - RNA, 19 nt, Human
ucucugcuucucuuggcau

SEQ ID NO: 980988 - RNA, 22 nt, Human
cuggccaguugccuuccugggu

SEQ ID NO: 980989 - RNA, 22 nt, Human
gcucugcugauccgcagccauc

SEQ ID NO: 980990 - RNA, 22 nt, Human
cuccacagcucaggcucagagu

SEQ ID NO: 980991 - RNA, 22 nt, Human
ccuccugggagagcacggaggg

SEQ ID NO: 980992 - RNA, 22 nt, Human
ucuggccagaaagacuugaugu

SEQ ID NO: 980993 - RNA, 22 nt, Human
acauaaaguacugagagacucu

SEQ ID NO: 980994 - RNA, 22 nt, Human
ccuggccaggcuccaaguacug

SEQ ID NO: 980995 - RNA, 22 nt, Human
cauucacaucuuguuccaucac

SEQ ID NO: 980996 - RNA, 22 nt, Human
aaagaauacccugggucauaaa

SEQ ID NO: 980997 - RNA, 22 nt, Human
acauuaaugaggugaugacaca

SEQ ID NO: 980998 - RNA, 22 nt, Human
gcuccuggcauccugcuuuuaa

SEQ ID NO: 980999 - RNA, 22 nt, Human
auguuuaaucggcugccuuucc

SEQ ID NO: 981000 - RNA, 22 nt, Human
aaugccuuggagagccuagagg

SEQ ID NO: 981001 - RNA, 22 nt, Human
guggccaagaaaauagaugcau

SEQ ID NO: 981002 - RNA, 22 nt, Human
gucugucucccugugacugaga

SEQ ID NO: 981003 - RNA, 22 nt, Human
ugcugaaauuagaacauugagg

SEQ ID NO: 981004 - RNA, 22 nt, Human
acucucugguauuggcaaguuu

SEQ ID NO: 981005 - RNA, 22 nt, Human
uagcuuuguuagaaugucuuca

SEQ ID NO: 981006 - RNA, 22 nt, Human
uuucaacauauaccauaaugcc

SEQ ID NO: 981007 - RNA, 22 nt, Human
cuggccaaugccuggggaauag

SEQ ID NO: 981008 - RNA, 22 nt, Human
uucagcaacucaaaccuauuag

SEQ ID NO: 981009 - RNA, 22 nt, Human
uacuccugcugauccugccagc

SEQ ID NO: 981010 - RNA, 18 nt, Human
ugcagcaagugcuaaaua

SEQ ID NO: 981011 - RNA, 22 nt, Human
auucacaaaaugauauagauac

SEQ ID NO: 981012 - RNA, 22 nt, Human
uauauuaaccauaggguucuag

SEQ ID NO: 981013 - RNA, 22 nt, Human
uugcauguagaauacucaacuu

SEQ ID NO: 981014 - RNA, 22 nt, Human
guggccaauuuccaucuguaag

SEQ ID NO: 981015 - RNA, 22 nt, Human
uuucacaagacagcuacuguug

SEQ ID NO: 981016 - RNA, 22 nt, Human
uaaagacaugguguaggugaac

SEQ ID NO: 981017 - RNA, 22 nt, Human
ucuccuggccuuuagguuaagg

SEQ ID NO: 981018 - RNA, 22 nt, Human
ucuuuuaaaagcccugcugucu

SEQ ID NO: 981019 - RNA, 22 nt, Human
ccacucugauuggucaccucug

SEQ ID NO: 981020 - RNA, 22 nt, Human
ucacaaaucauuuuaucugugu

SEQ ID NO: 981021 - RNA, 22 nt, Human
ugcuuccuauccacacaaugcc

SEQ ID NO: 981022 - RNA, 22 nt, Human
agacagugauguaagcaggagu

SEQ ID NO: 981023 - RNA, 22 nt, Human
acuuugaaggggaacauuuuaa

SEQ ID NO: 981024 - RNA, 22 nt, Human
uugaaauacugcauuguucagu

SEQ ID NO: 981025 - RNA, 22 nt, Human
auguuuuacccuuugcacaaac

SEQ ID NO: 981026 - RNA, 22 nt, Human
agcuauguauuuguguguuaaa

SEQ ID NO: 981027 - RNA, 22 nt, Human
cacaugugugcugaggacugug

SEQ ID NO: 981028 - RNA, 20 nt, Human
acauggaaggucaaacuauc

SEQ ID NO: 981029 - RNA, 22 nt, Human
caucuuuaacaauuuacaaugu

SEQ ID NO: 981030 - RNA, 22 nt, Human
ucuuuuuauauugacaaaaggu

SEQ ID NO: 981031 - RNA, 22 nt, Human
aaguaugugauacauguuaauu

SEQ ID NO: 981032 - RNA, 18 nt, Human
augcuuugcuuacguuau

SEQ ID NO: 981033 - RNA, 22 nt, Human
cuucugaggcagcuauucaguu

SEQ ID NO: 981034 - RNA, 20 nt, Human
uaacauaguccagagaacga

SEQ ID NO: 981035 - RNA, 22 nt, Human
guucacaagaugugguggggag

SEQ ID NO: 981036 - RNA, 22 nt, Human
ccuggccacccagccuuggcca

SEQ ID NO: 981037 - RNA, 22 nt, Human
aaauaguuacuucugcugucuu

SEQ ID NO: 981038 - RNA, 22 nt, Human
aacucugccagguuucaggagc

SEQ ID NO: 981039 - RNA, 22 nt, Human
guugaaauccuaacccccuagu

SEQ ID NO: 981040 - RNA, 22 nt, Human
ucagggaaauuuccauguguuu

SEQ ID NO: 981041 - RNA, 22 nt, Human
ggucugaguggugcugacucag

SEQ ID NO: 981042 - RNA, 22 nt, Human
cagcuccucacgagucuugaaa

SEQ ID NO: 981043 - RNA, 22 nt, Human
acacauuaugagcaguugucuu

SEQ ID NO: 981044 - RNA, 22 nt, Human
aggauuuuagauaagacagcaa

SEQ ID NO: 981045 - RNA, 22 nt, Human
cuuagaaaugcagauucucagg

SEQ ID NO: 981046 - RNA, 22 nt, Human
ucugcuguccuuuauauagauu

SEQ ID NO: 981047 - RNA, 22 nt, Human
aaacuccugggcucaagcaguu

SEQ ID NO: 981048 - RNA, 22 nt, Human
uuugauucuguaaaauaacagg

SEQ ID NO: 981049 - RNA, 22 nt, Human
ccuccugguugcaaugaaaugg

SEQ ID NO: 981050 - RNA, 22 nt, Human
cuauuuaugugcuauuuuguau

SEQ ID NO: 981051 - RNA, 22 nt, Human
acucugcuaucuuagcaaaagg

SEQ ID NO: 981052 - RNA, 22 nt, Human
gacauacagcauggucuaugaa

SEQ ID NO: 981053 - RNA, 17 nt, Human
uagaauauggugggcug

SEQ ID NO: 981054 - RNA, 22 nt, Human
aaauaguuguuuggaucaauaa

SEQ ID NO: 981055 - RNA, 22 nt, Human
uagaaacaucagcuaaccaaaa

SEQ ID NO: 981056 - RNA, 22 nt, Human
ugucccaguuggguauugaauu

SEQ ID NO: 981057 - RNA, 22 nt, Human
ugcccaaaccucuccuagcucu

SEQ ID NO: 981058 - RNA, 22 nt, Human
auggccaaaucuaaacuguugg

SEQ ID NO: 981059 - RNA, 22 nt, Human
ucuuaaaaguaugccaauugga

SEQ ID NO: 981060 - RNA, 22 nt, Human
augucacauggucaccucuagc

SEQ ID NO: 981061 - RNA, 16 nt, Human
gcucugcugaggccca

SEQ ID NO: 981062 - RNA, 22 nt, Human
uuggccaagacucauguccuau

SEQ ID NO: 981063 - RNA, 22 nt, Human
ccuguuuacaucaucaaggacu

SEQ ID NO: 981064 - RNA, 22 nt, Human
cuccugggcucauaucauucag

SEQ ID NO: 981065 - RNA, 22 nt, Human
uugcuucagagggagacacuuu

SEQ ID NO: 981066 - RNA, 22 nt, Human
uaguuuaaaaguuagggaugau

SEQ ID NO: 981067 - RNA, 22 nt, Human
uuguacacaauucuuaacauac

SEQ ID NO: 981068 - RNA, 22 nt, Human
ucuuuaaucauaaccaagaugg

SEQ ID NO: 981069 - RNA, 22 nt, Human
uuggcagagaguaugcugaaga

SEQ ID NO: 981070 - RNA, 22 nt, Human
aacauguugcuuuaauaauauu

SEQ ID NO: 981071 - RNA, 22 nt, Human
ccacucugauuuuggcuccacu

SEQ ID NO: 981072 - RNA, 22 nt, Human
cuucaaacccagauuaaaugca

SEQ ID NO: 981073 - RNA, 22 nt, Human
aauaugaauuauuguuacaagu

SEQ ID NO: 981074 - RNA, 22 nt, Human
gaauuacauuguuagccuuccu

SEQ ID NO: 981075 - RNA, 22 nt, Human
ugaagucuauuaacugauuucu

SEQ ID NO: 981076 - RNA, 22 nt, Human
gcuggccauucucuuugagaug

SEQ ID NO: 981077 - RNA, 22 nt, Human
cuccuggaccagggcuauuggg

SEQ ID NO: 981078 - RNA, 22 nt, Human
ucuggccaguagauguggguug

SEQ ID NO: 981079 - RNA, 22 nt, Human
ccacucugcugugcuccaugau

SEQ ID NO: 981080 - RNA, 22 nt, Human
accuacccuuagaucacaaggg

SEQ ID NO: 981081 - RNA, 21 nt, Human
ugcauuccuccauccaacagg

SEQ ID NO: 981082 - RNA, 22 nt, Human
gcccucugcacagcucugagca

SEQ ID NO: 981083 - RNA, 22 nt, Human
acauccugaagucagucauuug

SEQ ID NO: 981084 - RNA, 22 nt, Human
aauaggcaguuggauaugcaag

SEQ ID NO: 981085 - RNA, 22 nt, Human
aaacuacuaugggaauguacuu

SEQ ID NO: 981086 - RNA, 22 nt, Human
uccugagcuucaaaacacuuug

SEQ ID NO: 981087 - RNA, 22 nt, Human
ucauugaagugacugaaagauu

SEQ ID NO: 981088 - RNA, 22 nt, Human
aucaggaucagggcuagcagag

SEQ ID NO: 981089 - RNA, 20 nt, Human
uuggcagcaguuccaaguga

SEQ ID NO: 981090 - RNA, 22 nt, Human
uggcagcacuagguacugagcu

SEQ ID NO: 981091 - RNA, 22 nt, Human
aaguuuaagguggaaguggugg

SEQ ID NO: 981092 - RNA, 22 nt, Human
aacauuucauuggaagcuaugu

SEQ ID NO: 981093 - RNA, 18 nt, Human
uacaucuauauaguguuu

SEQ ID NO: 981094 - RNA, 22 nt, Human
uuuaggaucaaugagaaagucu

SEQ ID NO: 981095 - RNA, 20 nt, Human
caguuuaacuuugagcaguu

SEQ ID NO: 981096 - RNA, 22 nt, Human
ucacucuguguuugaacucaag

SEQ ID NO: 981097 - RNA, 22 nt, Human
uucaaaacaaucuguuugcauu

SEQ ID NO: 981098 - RNA, 22 nt, Human
ucagggaaugaugcacacaguu

SEQ ID NO: 981099 - RNA, 21 nt, Human
cuggccgaccccucugugcuc

SEQ ID NO: 981100 - RNA, 22 nt, Human
aggauguugcuauuggcagucu

SEQ ID NO: 981101 - RNA, 22 nt, Human
uuuauuagugcuuguaucacug

SEQ ID NO: 981102 - RNA, 22 nt, Human
cuucacaaucaccuuuucggaa

SEQ ID NO: 981103 - RNA, 22 nt, Human
augcuuccaaggcuaagacaag

SEQ ID NO: 981104 - RNA, 22 nt, Human
uaggauaggauggagacagaau

SEQ ID NO: 981105 - RNA, 20 nt, Human
guauuaggagguaaauguaa

SEQ ID NO: 981106 - RNA, 22 nt, Human
uaaaaguauacuuucaaaggag

SEQ ID NO: 981107 - RNA, 22 nt, Human
uauuagugaaagaauuaguuug

SEQ ID NO: 981108 - RNA, 21 nt, Human
cucuuuauauaguaaagauau

SEQ ID NO: 981109 - RNA, 22 nt, Human
acuccugggugcugaccagcgu

SEQ ID NO: 981110 - RNA, 22 nt, Human
cuuauaguaugauguugagaau

SEQ ID NO: 981111 - RNA, 22 nt, Human
auuauuagugauguuguuacug

SEQ ID NO: 981112 - RNA, 22 nt, Human
aaauguuagguuguacugaguc

SEQ ID NO: 981113 - RNA, 22 nt, Human
cuggcccagagcucuggccuuu

SEQ ID NO: 981114 - RNA, 22 nt, Human
agacauuuauugaacaccuagc

SEQ ID NO: 981115 - RNA, 22 nt, Human
uuuaggauaacuccaguuuucc

SEQ ID NO: 981116 - RNA, 22 nt, Human
uuugaaauguaucaguauaggu

SEQ ID NO: 981117 - RNA, 22 nt, Human
cuccugggcucaagugauccuc

SEQ ID NO: 981118 - RNA, 23 nt, Human
guuguaauggauaaugcaaauug

SEQ ID NO: 981119 - RNA, 22 nt, Human
guuaggauuauauaucccauga

SEQ ID NO: 981120 - RNA, 22 nt, Human
uagaauaugugguaggaucugg

SEQ ID NO: 981121 - RNA, 22 nt, Human
guggccaagaggggacuggaua

SEQ ID NO: 981122 - RNA, 22 nt, Human
ccugguccuuacgucauugcuu

SEQ ID NO: 981123 - RNA, 22 nt, Human
gaugcaaagcauuuuugugugu

SEQ ID NO: 981124 - RNA, 20 nt, Human
aggcucugcauuucugagug

SEQ ID NO: 981125 - RNA, 22 nt, Human
cugagccauccauaccagcuua

SEQ ID NO: 981126 - RNA, 22 nt, Human
cacagcuaggaggaaagcagag

SEQ ID NO: 981127 - RNA, 22 nt, Human
uuuaguagugacagauucuggg

SEQ ID NO: 981128 - RNA, 22 nt, Human
aggccaaauugaucaucuuuag

SEQ ID NO: 981129 - RNA, 22 nt, Human
gcuguuaggugcccugaccuug

SEQ ID NO: 981130 - RNA, 22 nt, Human
uuauuuaaaauguagguuggga

SEQ ID NO: 981131 - RNA, 22 nt, Human
uggaagagaaaggaguggaucu

SEQ ID NO: 981132 - RNA, 22 nt, Human
accuuauuaaaaugaugaugua

SEQ ID NO: 981133 - RNA, 20 nt, Human
ccagucucuaucagaaauaa

SEQ ID NO: 981134 - RNA, 22 nt, Human
cagcuccugggccaucuccuag

SEQ ID NO: 981135 - RNA, 22 nt, Human
uuauuaggaacucaggauuuuu

SEQ ID NO: 981136 - RNA, 22 nt, Human
augcugagugagugaaacccag

SEQ ID NO: 981137 - RNA, 22 nt, Human
uauuagguuggugcaacaguaa

SEQ ID NO: 981138 - RNA, 18 nt, Human
uccuggccacacuaccuu

SEQ ID NO: 981139 - RNA, 22 nt, Human
aacuccagugucagcugcaaug

SEQ ID NO: 981140 - RNA, 17 nt, Human
uuccacaauaguuuguc

SEQ ID NO: 981141 - RNA, 22 nt, Human
gaaauauuacaguggaggggau

SEQ ID NO: 981142 - RNA, 20 nt, Human
uccagggcaacuagagugug

SEQ ID NO: 981143 - RNA, 22 nt, Human
uauuagagaaaagauggaugug

SEQ ID NO: 981144 - RNA, 22 nt, Human
auauuagguuggugcaaaagua

SEQ ID NO: 981145 - RNA, 22 nt, Human
uggccacacccaccuagaggag

SEQ ID NO: 981146 - RNA, 22 nt, Human
uuuuaugauugagcuggcuaca

SEQ ID NO: 981147 - RNA, 22 nt, Human
gagccaggggucagcuccgagg

SEQ ID NO: 981148 - RNA, 22 nt, Human
auuaggcaauucugggcaucuc

SEQ ID NO: 981149 - RNA, 22 nt, Human
ucugccacuuuugcuuacuggg

SEQ ID NO: 981150 - RNA, 21 nt, Human
gggucugaauaucuggugcug

SEQ ID NO: 981151 - RNA, 22 nt, Human
acuccuggggcugccaucacag

SEQ ID NO: 981152 - RNA, 22 nt, Human
cuggccauguugccucugagac

SEQ ID NO: 981153 - RNA, 22 nt, Human
ugauaauauuuugaaucauaag

SEQ ID NO: 981154 - RNA, 22 nt, Human
cuuaggauuuaauuucagacuc

SEQ ID NO: 981155 - RNA, 22 nt, Human
gcuccuggagagauugagaaag

SEQ ID NO: 981156 - RNA, 22 nt, Human
gcagcauauuguacuggccugc

SEQ ID NO: 981157 - RNA, 22 nt, Human
aggcucugcagugcuggaggac

SEQ ID NO: 981158 - RNA, 22 nt, Human
auauuagggucucuaaauucua

SEQ ID NO: 981159 - RNA, 22 nt, Human
acagggaaguucugcaacagga

SEQ ID NO: 981160 - RNA, 22 nt, Human
gucucuaucauagcugaacccu

SEQ ID NO: 981161 - RNA, 22 nt, Human
acgcuuuuacuauuuugagcuc

SEQ ID NO: 981162 - RNA, 22 nt, Human
agagacugcgugucagcgcugg

SEQ ID NO: 981163 - RNA, 22 nt, Human
uaacuccagagaauccauccau

SEQ ID NO: 981164 - RNA, 22 nt, Human
augauugguggucagcaguaug

SEQ ID NO: 981165 - RNA, 22 nt, Human
aaauguggguaaugggacugga

SEQ ID NO: 981166 - RNA, 22 nt, Human
ucugcuguugccaugaguaaua

SEQ ID NO: 981167 - RNA, 22 nt, Human
uucaccuugaauaugucuuaaa

SEQ ID NO: 981168 - RNA, 22 nt, Human
ggaugcacgaaggcgccucgga

SEQ ID NO: 981169 - RNA, 22 nt, Human
uuggccaaacagaguucaacag

SEQ ID NO: 981170 - RNA, 19 nt, Human
ucauaaaaaugguaaccca

SEQ ID NO: 981171 - RNA, 22 nt, Human
gaucuuggggggaucaccaugg

SEQ ID NO: 981172 - RNA, 22 nt, Human
ucauugaauauggggccauaca

SEQ ID NO: 981173 - RNA, 22 nt, Human
aggcucugugcagccugcaucu

SEQ ID NO: 981174 - RNA, 22 nt, Human
uuuaugagcaccuuggcccaga

SEQ ID NO: 981175 - RNA, 22 nt, Human
uuauguagcagaaagauguuug

SEQ ID NO: 981176 - RNA, 22 nt, Human
guggccaaggcagagaaagagc

SEQ ID NO: 981177 - RNA, 22 nt, Human
uccuggucuacacugcauuggg

SEQ ID NO: 981178 - RNA, 22 nt, Human
uuaauguguguacaggauuuug

SEQ ID NO: 981179 - RNA, 18 nt, Human
uuaaggauaagcagacua

SEQ ID NO: 981180 - RNA, 22 nt, Human
auuuacagaagcauguaauagc

SEQ ID NO: 981181 - RNA, 17 nt, Human
auguuaauuucacauuu

SEQ ID NO: 981182 - RNA, 22 nt, Human
cugcugagaaaagacugaggga

SEQ ID NO: 981183 - RNA, 22 nt, Human
uaagaacaguagaacaguaggu

SEQ ID NO: 981184 - RNA, 22 nt, Human
ucuccuggaagaauaccacacu

SEQ ID NO: 981185 - RNA, 20 nt, Human
uccuggccuucucgggcagu

SEQ ID NO: 981186 - RNA, 22 nt, Human
uaagccugguucauaauuugcu

SEQ ID NO: 981187 - RNA, 22 nt, Human
acacagaguauuuagaaggggu

SEQ ID NO: 981188 - RNA, 22 nt, Human
auacagcagugaauaagauaaa

SEQ ID NO: 981189 - RNA, 22 nt, Human
acugccugcucauaacauugcu

SEQ ID NO: 981190 - RNA, 22 nt, Human
aggauguuaucugugcaggugg

SEQ ID NO: 981191 - RNA, 22 nt, Human
cugagggugcuauucuugccuu

SEQ ID NO: 981192 - RNA, 22 nt, Human
uuggcacagagcugcagccugg

SEQ ID NO: 981193 - RNA, 22 nt, Human
aggauuucugugccuggaaaau

SEQ ID NO: 981194 - RNA, 22 nt, Human
gcuggccauauauuuugcuguu

SEQ ID NO: 981195 - RNA, 22 nt, Human
accuuguuaaaaugaggauucu

SEQ ID NO: 981196 - RNA, 22 nt, Human
gaaauguguuguucauuucuaa

SEQ ID NO: 981197 - RNA, 22 nt, Human
acacuuuuagcuaugaguuaau

SEQ ID NO: 981198 - RNA, 22 nt, Human
aauuaggaaaugagaguauuug

SEQ ID NO: 981199 - RNA, 22 nt, Human
acagacauucagcuaagucuau

SEQ ID NO: 981200 - RNA, 22 nt, Human
cuucaugcugauauccucgaug

SEQ ID NO: 981201 - RNA, 22 nt, Human
guuuauuaacugucaagugauu

SEQ ID NO: 981202 - RNA, 17 nt, Human
acacagggagagggagc

SEQ ID NO: 981203 - RNA, 22 nt, Human
cucuggccugcagauccaugcu

SEQ ID NO: 981204 - RNA, 22 nt, Human
gcaauaaauaacauggaagaca

SEQ ID NO: 981205 - RNA, 22 nt, Human
cuucacaaauggccuagaguuc

SEQ ID NO: 981206 - RNA, 22 nt, Human
uaagucauaagucaugauguua

SEQ ID NO: 981207 - RNA, 22 nt, Human
ugugaaauucuugaaaugcaca

SEQ ID NO: 981208 - RNA, 22 nt, Human
ccuccuggcccugggccuggaa

SEQ ID NO: 981209 - RNA, 22 nt, Human
auucacaaauaacaggugcaga

SEQ ID NO: 981210 - RNA, 22 nt, Human
uagaaaugauuuugaugcuuca

SEQ ID NO: 981211 - RNA, 21 nt, Human
uggcagacaggaggagcucac

SEQ ID NO: 981212 - RNA, 22 nt, Human
guugaaaugagggauuaaucag

SEQ ID NO: 981213 - RNA, 22 nt, Human
cuggucaaggagagucucugca

SEQ ID NO: 981214 - RNA, 22 nt, Human
uaacccaauaauugguggccuu

SEQ ID NO: 981215 - RNA, 22 nt, Human
agggucuguggaugcaucuggg

SEQ ID NO: 981216 - RNA, 22 nt, Human
cauauaaauacaacauguguua

SEQ ID NO: 981217 - RNA, 22 nt, Human
aaauaguuagcccugcauauau

SEQ ID NO: 981218 - RNA, 22 nt, Human
cacuggcccauuccugucuggc

SEQ ID NO: 981219 - RNA, 20 nt, Human
uguuccaagcuaaugaauga

SEQ ID NO: 981220 - RNA, 22 nt, Human
ccugggccugaaaacauuucuc

SEQ ID NO: 981221 - RNA, 22 nt, Human
ugcauguggaccccuggugccu

SEQ ID NO: 981222 - RNA, 22 nt, Human
uauucacauucucaggccuggu

SEQ ID NO: 981223 - RNA, 16 nt, Human
auucacaaggcaucgg

SEQ ID NO: 981224 - RNA, 22 nt, Human
uaaccuuucaggcauguagguu

SEQ ID NO: 981225 - RNA, 22 nt, Human
aagaacauucgaacuauuuucu

SEQ ID NO: 981226 - RNA, 22 nt, Human
uuaauaggcuucuaacauagcu

SEQ ID NO: 981227 - RNA, 22 nt, Human
aucaggauggguuuggcuuagg

SEQ ID NO: 981228 - RNA, 19 nt, Human
uccaccuuucuucauuugg

SEQ ID NO: 981229 - RNA, 22 nt, Human
ucuguaaaacuucuuuguaaau

SEQ ID NO: 981230 - RNA, 22 nt, Human
auuaggaaauguguugcaagca

SEQ ID NO: 981231 - RNA, 22 nt, Human
auagaguccaaaguaugaauau

SEQ ID NO: 981232 - RNA, 22 nt, Human
ccuguuuaucuaucuagagaug

SEQ ID NO: 981233 - RNA, 22 nt, Human
cugaccaucauggugaaacccc

SEQ ID NO: 981234 - RNA, 22 nt, Human
uguaggauguaaggcaggcauc

SEQ ID NO: 981235 - RNA, 22 nt, Human
cuugaucuacauagugaaaccc

SEQ ID NO: 981236 - RNA, 22 nt, Human
auuauuagacuuauaugguagu

SEQ ID NO: 981237 - RNA, 22 nt, Human
uuggccaaggaccuuuuuggag

SEQ ID NO: 981238 - RNA, 22 nt, Human
ucacucugggcccuacugggcu

SEQ ID NO: 981239 - RNA, 19 nt, Human
uggucuaaaugugugcccc

SEQ ID NO: 981240 - RNA, 21 nt, Human
uggccaaaaccauauuauuaa

SEQ ID NO: 981241 - RNA, 21 nt, Human
auuuggcaaaggcgaugcaca

SEQ ID NO: 981242 - RNA, 22 nt, Human
uuauuuggaaauauggcuucug

SEQ ID NO: 981243 - RNA, 22 nt, Human
guuuaaguuucagaagcuaaga

SEQ ID NO: 981244 - RNA, 22 nt, Human
uuggccaagggaucgagguugg

SEQ ID NO: 981245 - RNA, 20 nt, Human
ugagccaaacgaugaagagc

SEQ ID NO: 981246 - RNA, 16 nt, Human
aggccaaaaaggggca

SEQ ID NO: 981247 - RNA, 22 nt, Human
ugaaacaggaaguaaacagaca

SEQ ID NO: 981248 - RNA, 22 nt, Human
gcucugcuguguuuguucagca

SEQ ID NO: 981249 - RNA, 22 nt, Human
ucuccuggccgggcuguccccu

SEQ ID NO: 981250 - RNA, 22 nt, Human
ucacuaagugccgaguuuaguu

SEQ ID NO: 981251 - RNA, 22 nt, Human
uuucacaaguuucaggauucug

SEQ ID NO: 981252 - RNA, 22 nt, Human
uggucaacaggcagggaugaaa

SEQ ID NO: 981253 - RNA, 22 nt, Human
ccuggccagcagccccuuccuc

SEQ ID NO: 981254 - RNA, 22 nt, Human
ugcugagguuucgucugcuugc

SEQ ID NO: 981255 - RNA, 22 nt, Human
guauuagggccaaaggcaggaa

SEQ ID NO: 981256 - RNA, 22 nt, Human
auagaauaaggcacagauucuu

SEQ ID NO: 981257 - RNA, 22 nt, Human
uaguuauuauuguuacuaucag

SEQ ID NO: 981258 - RNA, 22 nt, Human
guaauaaugguccccaaacacu

SEQ ID NO: 981259 - RNA, 23 nt, Human
cuccuggaggguccggcccugcc

SEQ ID NO: 981260 - RNA, 22 nt, Human
uucagcaagugucucuacuguc

SEQ ID NO: 981261 - RNA, 22 nt, Human
uuuaucagagauauguguggac

SEQ ID NO: 981262 - RNA, 22 nt, Human
cugggccagaccuuguggucuu

SEQ ID NO: 981263 - RNA, 22 nt, Human
cuuuguaucuaaauaucuugaa

SEQ ID NO: 981264 - RNA, 18 nt, Human
accuucauuccuuugccu

SEQ ID NO: 981265 - RNA, 22 nt, Human
uguguuaaguauuugauacacu

SEQ ID NO: 981266 - RNA, 22 nt, Human
aacauuucagcaaauaagaaca

SEQ ID NO: 981267 - RNA, 22 nt, Human
uaaauaaguucuucauuguuug

SEQ ID NO: 981268 - RNA, 22 nt, Human
cugagccaugagccugcgccca

SEQ ID NO: 981269 - RNA, 22 nt, Human
aguaacucauguaaaccucaca

SEQ ID NO: 981270 - RNA, 22 nt, Human
cugcuaaaccucucugagagcu

SEQ ID NO: 981271 - RNA, 22 nt, Human
uuauuagguuuacauaaagguu

SEQ ID NO: 981272 - RNA, 22 nt, Human
uaacugauauugaaaaacauca

SEQ ID NO: 981273 - RNA, 20 nt, Human
guauuagguguuccucuuuc

SEQ ID NO: 981274 - RNA, 22 nt, Human
uuuuuuauaucaacugaagucu

SEQ ID NO: 981275 - RNA, 22 nt, Human
ucucugcuugguguaugugagu

SEQ ID NO: 981276 - RNA, 22 nt, Human
augcugagcagagcugacaugc

SEQ ID NO: 981277 - RNA, 22 nt, Human
cauuaaauuccuuguucucaaa

SEQ ID NO: 981278 - RNA, 23 nt, Human
uccugaggguuucccagccuugg

SEQ ID NO: 981279 - RNA, 22 nt, Human
acuggccagaacuaagucacau

SEQ ID NO: 981280 - RNA, 22 nt, Human
acaaaaagggagaugagguaga

SEQ ID NO: 981281 - RNA, 22 nt, Human
aacauucaccucuaccuccuuc

SEQ ID NO: 981282 - RNA, 22 nt, Human
guuaauaaagguauagaaucag

SEQ ID NO: 981283 - RNA, 20 nt, Human
guguuucaugugauacaaug

SEQ ID NO: 981284 - RNA, 22 nt, Human
acucugcucuguauuucacugu

SEQ ID NO: 981285 - RNA, 22 nt, Human
gcuuccuaaaugcacagggcag

SEQ ID NO: 981286 - RNA, 22 nt, Human
uccuggccucacaguccugggu

SEQ ID NO: 981287 - RNA, 22 nt, Human
aagucaaaccuugcucacagga

SEQ ID NO: 981288 - RNA, 22 nt, Human
aacugcauuuaacaaauacucu

SEQ ID NO: 981289 - RNA, 22 nt, Human
aaaacaguuauaaacagaguca

SEQ ID NO: 981290 - RNA, 22 nt, Human
gagaaggaguagcugaccuggg

SEQ ID NO: 981291 - RNA, 22 nt, Human
gacagguggggaaacuaaggua

SEQ ID NO: 981292 - RNA, 22 nt, Human
uggcagcagaacaugaaaccca

SEQ ID NO: 981293 - RNA, 23 nt, Human
uggcuaaaggcucuaguccugcu

SEQ ID NO: 981294 - RNA, 22 nt, Human
uggcagcaccagcaguguccuu

SEQ ID NO: 981295 - RNA, 22 nt, Human
uucaaaacagcuagauauugga

SEQ ID NO: 981296 - RNA, 22 nt, Human
ccuccuggggugaaggauggga

SEQ ID NO: 981297 - RNA, 22 nt, Human
ccuggaccaaacacuggccugg

SEQ ID NO: 981298 - RNA, 22 nt, Human
aaagucauacauggugcuuacu

SEQ ID NO: 981299 - RNA, 22 nt, Human
uuggccaaaaaagucauuagaa

SEQ ID NO: 981300 - RNA, 22 nt, Human
ugaccaaaaaauucccugugag

SEQ ID NO: 981301 - RNA, 22 nt, Human
agacaggagagggaacugccgg

SEQ ID NO: 981302 - RNA, 22 nt, Human
ugucuuaagaaauugcauuugu

SEQ ID NO: 981303 - RNA, 22 nt, Human
aacaguaucuuuuaucagaaau

SEQ ID NO: 981304 - RNA, 22 nt, Human
ccuggccacagggcucugcauu

SEQ ID NO: 981305 - RNA, 22 nt, Human
ucugaagccuuuguacaggccu

SEQ ID NO: 981306 - RNA, 22 nt, Human
uagggauguaaacauaguaauu

SEQ ID NO: 981307 - RNA, 22 nt, Human
gcuccuggauguucaagucggc

SEQ ID NO: 981308 - RNA, 19 nt, Human
uccucagugacaaccucag

SEQ ID NO: 981309 - RNA, 22 nt, Human
uauuuauucauucagcaagcau

SEQ ID NO: 981310 - RNA, 22 nt, Human
aauaugucugcuaauuguuucu

SEQ ID NO: 981311 - RNA, 22 nt, Human
auaaaaaggacagauguggucu

SEQ ID NO: 981312 - RNA, 22 nt, Human
uguuccuguguggaaaagggcc

SEQ ID NO: 981313 - RNA, 22 nt, Human
gacuccugggccucugagaggc

SEQ ID NO: 981314 - RNA, 22 nt, Human
ccuucuuaaacaucauuuuggc

SEQ ID NO: 981315 - RNA, 18 nt, Human
uuuaugagcugugggacc

SEQ ID NO: 981316 - RNA, 22 nt, Human
uuauuagggugguuuauguucu

SEQ ID NO: 981317 - RNA, 22 nt, Human
gaauauuaguaucaguuauacc

SEQ ID NO: 981318 - RNA, 22 nt, Human
acaccuuuuauucgccaggcac

SEQ ID NO: 981319 - RNA, 22 nt, Human
acucugcuuauugcugcaggca

SEQ ID NO: 981320 - RNA, 22 nt, Human
guuauaaaaugcacaguuguuu

SEQ ID NO: 981321 - RNA, 22 nt, Human
acuccugguuuguguccuggcu

SEQ ID NO: 981322 - RNA, 22 nt, Human
caaaaguaauuaugguuuuugc

SEQ ID NO: 981323 - RNA, 22 nt, Human
ucacucugacuuggccuccaac

SEQ ID NO: 981324 - RNA, 22 nt, Human
uacucugccacuaggaguucug

SEQ ID NO: 981325 - RNA, 22 nt, Human
auauugaacccuacagacugua

SEQ ID NO: 981326 - RNA, 18 nt, Human
acuaugcugaauaaaugg

SEQ ID NO: 981327 - RNA, 22 nt, Human
uaggauaugugaaaucauauua

SEQ ID NO: 981328 - RNA, 22 nt, Human
aacuaaaucuggcauuuagagc

SEQ ID NO: 981329 - RNA, 22 nt, Human
agccuugaguucaagugcuggc

SEQ ID NO: 981330 - RNA, 22 nt, Human
uuauguagugacugacuguuag

SEQ ID NO: 981331 - RNA, 22 nt, Human
ucuccuggguaaaaggguugau

SEQ ID NO: 981332 - RNA, 22 nt, Human
gggccaaggggagcuggaaggg

SEQ ID NO: 981333 - RNA, 22 nt, Human
aggcauguauaugugcacaugu

SEQ ID NO: 981334 - RNA, 22 nt, Human
agccaugugucuuuauucuguu

SEQ ID NO: 981335 - RNA, 22 nt, Human
ugaaagcagugccaugauuaug

SEQ ID NO: 981336 - RNA, 22 nt, Human
gcucugcuggagggaaagagaa

SEQ ID NO: 981337 - RNA, 22 nt, Human
aaugaaauguagcuuauccaua

SEQ ID NO: 981338 - RNA, 22 nt, Human
cauuuaaagguuguggguaaaa

SEQ ID NO: 981339 - RNA, 22 nt, Human
uuuuauuaucuuugaaugggac

SEQ ID NO: 981340 - RNA, 22 nt, Human
acauacaucaaguaucacaaga

SEQ ID NO: 981341 - RNA, 22 nt, Human
aauguacacugaaagccuauca

SEQ ID NO: 981342 - RNA, 20 nt, Human
uuaggcauuuggauuggcuu

SEQ ID NO: 981343 - RNA, 22 nt, Human
ugaaagcacugauucucaacuc

SEQ ID NO: 981344 - RNA, 22 nt, Human
caaaaguaauugcaguuuuugc

SEQ ID NO: 981345 - RNA, 22 nt, Human
guucacaauuuuuacugauugg

SEQ ID NO: 981346 - RNA, 22 nt, Human
uuaggcauuggaaggucagcuu

SEQ ID NO: 981347 - RNA, 22 nt, Human
gcucugcugagauaucugggag

SEQ ID NO: 981348 - RNA, 22 nt, Human
uaaaauguuugcaagagaccag

SEQ ID NO: 981349 - RNA, 22 nt, Human
aacaaaccuucccuauacgucu

SEQ ID NO: 981350 - RNA, 22 nt, Human
acauuuuuuagagucccacauu

SEQ ID NO: 981351 - RNA, 22 nt, Human
auucacaaguugauggauauuu

SEQ ID NO: 981352 - RNA, 22 nt, Human
uuuauuguuguuagucauaagu

SEQ ID NO: 981353 - RNA, 22 nt, Human
ugguccaagugagguggccucu

SEQ ID NO: 981354 - RNA, 19 nt, Human
acuuccugcccgcuccuuu

SEQ ID NO: 981355 - RNA, 22 nt, Human
cugggccauggaagucucugcc

SEQ ID NO: 981356 - RNA, 22 nt, Human
ucacucugucccccauugagau

SEQ ID NO: 981357 - RNA, 23 nt, Human
ucaaacauauugugagacacagg

SEQ ID NO: 981358 - RNA, 22 nt, Human
gcagggaaggggcaugcuggag

SEQ ID NO: 981359 - RNA, 22 nt, Human
agcauaaguugguacagccacu

SEQ ID NO: 981360 - RNA, 20 nt, Human
ucacucugaugcuagggugg

SEQ ID NO: 981361 - RNA, 22 nt, Human
aaacacagggauauauauucca

SEQ ID NO: 981362 - RNA, 19 nt, Human
uuucacaaagagagcguga

SEQ ID NO: 981363 - RNA, 22 nt, Human
aacuaacagucauuaaaagaac

SEQ ID NO: 981364 - RNA, 22 nt, Human
cuguuacacggaccuucaaauc

SEQ ID NO: 981365 - RNA, 22 nt, Human
ccuuuuauacucagugauauca

SEQ ID NO: 981366 - RNA, 23 nt, Human
uggccacagggugcuccauugua

SEQ ID NO: 981367 - RNA, 22 nt, Human
cagccuuuuccauguauuguug

SEQ ID NO: 981368 - RNA, 22 nt, Human
uuauuuagucuagaugaauuuu

SEQ ID NO: 981369 - RNA, 22 nt, Human
auuauuaggacuacugggguug

SEQ ID NO: 981370 - RNA, 22 nt, Human
auuagcauauuaaauagucauu

SEQ ID NO: 981371 - RNA, 22 nt, Human
gagcacugauuuauuuuugucu

SEQ ID NO: 981372 - RNA, 22 nt, Human
auaaugugauauuucauuuaca

SEQ ID NO: 981373 - RNA, 21 nt, Human
uucugagcacucaucacuguc

SEQ ID NO: 981374 - RNA, 22 nt, Human
acugucuucaaaugaauauauu

SEQ ID NO: 981375 - RNA, 22 nt, Human
ugaaauguaaauaggacuagaa

SEQ ID NO: 981376 - RNA, 22 nt, Human
cguggccagccauuuccuggaa

SEQ ID NO: 981377 - RNA, 22 nt, Human
uacaccuuaaucauaugugucu

SEQ ID NO: 981378 - RNA, 22 nt, Human
uuacuggcugggccugagggcu

SEQ ID NO: 981379 - RNA, 22 nt, Human
acuccuggguugcaguccucaa

SEQ ID NO: 981380 - RNA, 22 nt, Human
gacuccugccuccucuguuugc

SEQ ID NO: 981381 - RNA, 22 nt, Human
cggccaaauugcagagagaagc

SEQ ID NO: 981382 - RNA, 22 nt, Human
aggagacaucuaacuguagguu

SEQ ID NO: 981383 - RNA, 22 nt, Human
auuaggauuuuguccaaguagc

SEQ ID NO: 981384 - RNA, 22 nt, Human
uaccuucaccagcgaauguuug

SEQ ID NO: 981385 - RNA, 22 nt, Human
gcuuagaaguuccuauaaaaug

SEQ ID NO: 981386 - RNA, 22 nt, Human
acaccuuugugaagugaugaug

SEQ ID NO: 981387 - RNA, 22 nt, Human
gagaggugaauguggaugccac

SEQ ID NO: 981388 - RNA, 22 nt, Human
uagaacaugugaaaauauagcc

SEQ ID NO: 981389 - RNA, 22 nt, Human
uuauuaggaaaaggucagaugu

SEQ ID NO: 981390 - RNA, 22 nt, Human
uuuaauugauucacagucugua

SEQ ID NO: 981391 - RNA, 22 nt, Human
ccucugcucugguccaugugcu

SEQ ID NO: 981392 - RNA, 21 nt, Human
ucuuggccuaaguucacugaa

SEQ ID NO: 981393 - RNA, 22 nt, Human
uaauaaaugaaagugcuggcau

SEQ ID NO: 981394 - RNA, 22 nt, Human
uauucacaaaaugagguccuca

SEQ ID NO: 981395 - RNA, 22 nt, Human
uuuuaguuguaguuggugagga

SEQ ID NO: 981396 - RNA, 22 nt, Human
ucacucugccuccauauuacua

SEQ ID NO: 981397 - RNA, 22 nt, Human
auaaugugaagauaaugcaaga

SEQ ID NO: 981398 - RNA, 19 nt, Human
gcuggccacgccccaguug

SEQ ID NO: 981399 - RNA, 22 nt, Human
ucauguuuggaguuugcucacu

SEQ ID NO: 981400 - RNA, 22 nt, Human
auggccaagaaguauuccugac

SEQ ID NO: 981401 - RNA, 22 nt, Human
guuauauaagacaaaucagagu

SEQ ID NO: 981402 - RNA, 18 nt, Human
acaguaaagaaaggaauu

SEQ ID NO: 981403 - RNA, 22 nt, Human
ccuccugggcuccugucugcac

SEQ ID NO: 981404 - RNA, 22 nt, Human
aaaagucugcucucauuucaga

SEQ ID NO: 981405 - RNA, 16 nt, Human
gcuccugggcccucga

SEQ ID NO: 981406 - RNA, 22 nt, Human
cucugcugggauguaaagucuu

SEQ ID NO: 981407 - RNA, 22 nt, Human
cagccuuuaagcuuggauaggu

SEQ ID NO: 981408 - RNA, 22 nt, Human
gaaacacaugcagcuccauaga

SEQ ID NO: 981409 - RNA, 22 nt, Human
aagccuugcagcauuaggcucu

SEQ ID NO: 981410 - RNA, 22 nt, Human
uuuauuauccaguguugucaug

SEQ ID NO: 981411 - RNA, 22 nt, Human
gaaauauuguacuggagauguu

SEQ ID NO: 981412 - RNA, 22 nt, Human
uggccacaguguccagcagcag

SEQ ID NO: 981413 - RNA, 22 nt, Human
acagaccucuagauuacauuug

SEQ ID NO: 981414 - RNA, 21 nt, Human
uccuggcccacucuaucccca

SEQ ID NO: 981415 - RNA, 22 nt, Human
uccugggcuuaagugauccucc

SEQ ID NO: 981416 - RNA, 22 nt, Human
ucuggccaacaaaaacuaaguc

SEQ ID NO: 981417 - RNA, 22 nt, Human
auucacaaaugcugccccauuc

SEQ ID NO: 981418 - RNA, 22 nt, Human
ugcaugugcccacucuggcuua

SEQ ID NO: 981419 - RNA, 22 nt, Human
uugcaaauauguucuccuauuc

SEQ ID NO: 981420 - RNA, 22 nt, Human
augugagguaucuaggucuucg

SEQ ID NO: 981421 - RNA, 22 nt, Human
uccuggccgccgcguggggccg

SEQ ID NO: 981422 - RNA, 20 nt, Human
ucacagaaacaaauagagaa

SEQ ID NO: 981423 - RNA, 22 nt, Human
agggucugcauuccaacuuggg

SEQ ID NO: 981424 - RNA, 22 nt, Human
guauuaggugguggaauuguag

SEQ ID NO: 981425 - RNA, 22 nt, Human
aagaguaugcaugcauguuugu

SEQ ID NO: 981426 - RNA, 22 nt, Human
uucugagcuacauaguacuggg

SEQ ID NO: 981427 - RNA, 20 nt, Human
uauuaggaaggaggaaggaa

SEQ ID NO: 981428 - RNA, 22 nt, Human
cuccuggaagcccgcccugcug

SEQ ID NO: 981429 - RNA, 22 nt, Human
cuccugggaauuuaguugugag

SEQ ID NO: 981430 - RNA, 22 nt, Human
agagucuuuugucaguaauguu

SEQ ID NO: 981431 - RNA, 22 nt, Human
auucggaucauguguauguguu

SEQ ID NO: 981432 - RNA, 22 nt, Human
acuccaggguuuugcaccugga

SEQ ID NO: 981433 - RNA, 22 nt, Human
uuuauguaguuacggacuauca

SEQ ID NO: 981434 - RNA, 22 nt, Human
auauauaagcugaugagccaca

SEQ ID NO: 981435 - RNA, 22 nt, Human
aauucacagaaccauggugcuc

SEQ ID NO: 981436 - RNA, 22 nt, Human
ccuccugggacaggcuggcaca

SEQ ID NO: 981437 - RNA, 22 nt, Human
uuauuagagauauuugguuagg

SEQ ID NO: 981438 - RNA, 22 nt, Human
ucaaauacauggucaaucaacu

SEQ ID NO: 981439 - RNA, 22 nt, Human
uaugcauuuuauagugcaaagc

SEQ ID NO: 981440 - RNA, 22 nt, Human
cagacagggaccucgcuccaga

SEQ ID NO: 981441 - RNA, 22 nt, Human
agaauaugaggaaacugugaau

SEQ ID NO: 981442 - RNA, 22 nt, Human
auuauaaagaacaugugugugg

SEQ ID NO: 981443 - RNA, 22 nt, Human
cuucuuaucaaguggcaaaucu

SEQ ID NO: 981444 - RNA, 17 nt, Human
cagcucugcaucuuccu

SEQ ID NO: 981445 - RNA, 22 nt, Human
caaaaguaauugugguuuucac

SEQ ID NO: 981446 - RNA, 22 nt, Human
ucugacauuuugagaaugacau

SEQ ID NO: 981447 - RNA, 22 nt, Human
aagaauaaauuaagauacuuag

SEQ ID NO: 981448 - RNA, 22 nt, Human
cugccacuagcuuucacaucuu

SEQ ID NO: 981449 - RNA, 22 nt, Human
caccuuuugugucugcguuugu

SEQ ID NO: 981450 - RNA, 22 nt, Human
cugggccaguuaugucucaucu

SEQ ID NO: 981451 - RNA, 22 nt, Human
uuccuggcugaacugaacuccu

SEQ ID NO: 981452 - RNA, 22 nt, Human
auuagggaaggauuuggccuga

SEQ ID NO: 981453 - RNA, 22 nt, Human
ucuuugcacacaucccuucccg

SEQ ID NO: 981454 - RNA, 22 nt, Human
ccuggccaaucuagggcuguua

SEQ ID NO: 981455 - RNA, 22 nt, Human
uagaacaugcucauguauaaau

SEQ ID NO: 981456 - RNA, 22 nt, Human
gaaauauuucucuugagccccu

SEQ ID NO: 981457 - RNA, 22 nt, Human
gcuggccaggaagagucucaga

SEQ ID NO: 981458 - RNA, 22 nt, Human
gagggaaggacccauuuuaagu

SEQ ID NO: 981459 - RNA, 21 nt, Human
acacauuaugagcauagacuc

SEQ ID NO: 981460 - RNA, 22 nt, Human
ugucuuaauuuggaugauguuu

SEQ ID NO: 981461 - RNA, 22 nt, Human
ccuggccacucagguguggggc

SEQ ID NO: 981462 - RNA, 17 nt, Human
auucuuugaugucucug

SEQ ID NO: 981463 - RNA, 22 nt, Human
uccaaagaagucacaaacgaag

SEQ ID NO: 981464 - RNA, 22 nt, Human
aacacauaggcagagcaugaca

SEQ ID NO: 981465 - RNA, 22 nt, Human
aaauaugugaucagugaauaaa

SEQ ID NO: 981466 - RNA, 17 nt, Human
acuccuggucugaaggg

SEQ ID NO: 981467 - RNA, 22 nt, Human
cuguaaaacugcuuaaguaugc

SEQ ID NO: 981468 - RNA, 22 nt, Human
guacacucccccugugaaguug

SEQ ID NO: 981469 - RNA, 22 nt, Human
caccguuugguuuggauuuaca

SEQ ID NO: 981470 - RNA, 22 nt, Human
gcaccuuuggaaugaaaaguug

SEQ ID NO: 981471 - RNA, 22 nt, Human
uggucaaaaacucucaguggac

SEQ ID NO: 981472 - RNA, 22 nt, Human
aauaauguugacgauagucuua

SEQ ID NO: 981473 - RNA, 22 nt, Human
cugagccuguguuucucuggca

SEQ ID NO: 981474 - RNA, 22 nt, Human
ucacucugguccauccgagagc

SEQ ID NO: 981475 - RNA, 22 nt, Human
gcuccuggccagcacagggccc

SEQ ID NO: 981476 - RNA, 22 nt, Human
ucuggccaggauggcaagacca

SEQ ID NO: 981477 - RNA, 22 nt, Human
uuaaaagaauccuguuauccuc

SEQ ID NO: 981478 - RNA, 22 nt, Human
gaaucauagaacauuaauagaa

SEQ ID NO: 981479 - RNA, 22 nt, Human
uugaaugaccaugaugcaaggg

SEQ ID NO: 981480 - RNA, 22 nt, Human
auauuaggaguuaaauguauua

SEQ ID NO: 981481 - RNA, 22 nt, Human
auauauaaccuggauaaggcuu

SEQ ID NO: 981482 - RNA, 18 nt, Human
gcuccuggagucugacuc

SEQ ID NO: 981483 - RNA, 22 nt, Human
guucacaagcugauugucuuuc

SEQ ID NO: 981484 - RNA, 22 nt, Human
uuauuagguuauucucuguacu

SEQ ID NO: 981485 - RNA, 22 nt, Human
aaaaauguuaucuacuguccga

SEQ ID NO: 981486 - RNA, 19 nt, Human
uuucuuaggccuuuggccu

SEQ ID NO: 981487 - RNA, 22 nt, Human
aacugcuggggaggccaaacuc

SEQ ID NO: 981488 - RNA, 23 nt, Human
auagucauguaaaauauuugaag

SEQ ID NO: 981489 - RNA, 22 nt, Human
cagcuguggcugccacugcucc

SEQ ID NO: 981490 - RNA, 22 nt, Human
uuucacaaaugucuuuaacuug

SEQ ID NO: 981491 - RNA, 22 nt, Human
ccuuuuauaaaguuguauugaa

SEQ ID NO: 981492 - RNA, 22 nt, Human
aaaaaguauuggccaugguuga

SEQ ID NO: 981493 - RNA, 22 nt, Human
acauucuuaacaguuaaaaacu

SEQ ID NO: 981494 - RNA, 22 nt, Human
aaauauuagggagaacagggac

SEQ ID NO: 981495 - RNA, 22 nt, Human
uaaaguguccuagcuaggaggc

SEQ ID NO: 981496 - RNA, 20 nt, Human
acuccugguaacuuuuguga

SEQ ID NO: 981497 - RNA, 22 nt, Human
uuggccaagugguuaaucucca

SEQ ID NO: 981498 - RNA, 22 nt, Human
gccauaaauugcuggucaaaau

SEQ ID NO: 981499 - RNA, 22 nt, Human
aauaauuagugggacagagaac

SEQ ID NO: 981500 - RNA, 22 nt, Human
cacaguuucuauaggucagaau

SEQ ID NO: 981501 - RNA, 22 nt, Human
gucauggaggauugugaguggu

SEQ ID NO: 981502 - RNA, 22 nt, Human
uaggaugaaaauccagcuuaua

SEQ ID NO: 981503 - RNA, 22 nt, Human
ccuuuuaugaacuugagcaggu

SEQ ID NO: 981504 - RNA, 22 nt, Human
cucugcuaagcaugaacaauua

SEQ ID NO: 981505 - RNA, 22 nt, Human
caccucuuugauuugaggcaag

SEQ ID NO: 981506 - RNA, 22 nt, Human
uuggcacacaguaagcccuaag

SEQ ID NO: 981507 - RNA, 22 nt, Human
aaaaaugugaccacaggguguu

SEQ ID NO: 981508 - RNA, 22 nt, Human
acauuucuuucuauucaguagc

SEQ ID NO: 981509 - RNA, 22 nt, Human
auuacaaaagaagggagaaggu

SEQ ID NO: 981510 - RNA, 22 nt, Human
auuaggauguuccuaugcacau

SEQ ID NO: 981511 - RNA, 22 nt, Human
uauccaaacauauagucucucu

SEQ ID NO: 981512 - RNA, 22 nt, Human
uuuaauguucaucucaaaggau

SEQ ID NO: 981513 - RNA, 22 nt, Human
uuguuuaaaauguagcaagaaa

SEQ ID NO: 981514 - RNA, 22 nt, Human
aauaauaagauacuaagggagu

SEQ ID NO: 981515 - RNA, 23 nt, Human
agggcacugaagcuggaauuggg

SEQ ID NO: 981516 - RNA, 22 nt, Human
ccagacaggaacacacaucucc

SEQ ID NO: 981517 - RNA, 22 nt, Human
ccuccuggauggauuuggugga

SEQ ID NO: 981518 - RNA, 22 nt, Human
aggaucuugcuguagaggauag

SEQ ID NO: 981519 - RNA, 21 nt, Human
acagacagggccagugucccc

SEQ ID NO: 981520 - RNA, 22 nt, Human
gaacccaaccucacuuggggua

SEQ ID NO: 981521 - RNA, 22 nt, Human
uggcucaagugauccuccugcc

SEQ ID NO: 981522 - RNA, 22 nt, Human
aucauuuaaaacaagucucuau

SEQ ID NO: 981523 - RNA, 23 nt, Human
uuucaacaaugcuuagagaaaac

SEQ ID NO: 981524 - RNA, 18 nt, Human
aacuucaacuacaaugga

SEQ ID NO: 981525 - RNA, 22 nt, Human
aacuccuguucuaugacaagag

SEQ ID NO: 981526 - RNA, 22 nt, Human
cuggccaagcuucucuaagcag

SEQ ID NO: 981527 - RNA, 22 nt, Human
uuucuggcagcgggacaggggu

SEQ ID NO: 981528 - RNA, 22 nt, Human
uaaaagacauauaacuguagga

SEQ ID NO: 981529 - RNA, 18 nt, Human
ucuccuggguaggggccu

SEQ ID NO: 981530 - RNA, 22 nt, Human
uauugaaauccauuacguucuu

SEQ ID NO: 981531 - RNA, 22 nt, Human
cuauuaggcuuccauuucaugc

SEQ ID NO: 981532 - RNA, 22 nt, Human
cauugguagaguuuguuuuaua

SEQ ID NO: 981533 - RNA, 22 nt, Human
ugacauaaaccagugagcaaaa

SEQ ID NO: 981534 - RNA, 22 nt, Human
cugugccaucugcacucucguc

SEQ ID NO: 981535 - RNA, 22 nt, Human
aauucacauauacauuauuccu

SEQ ID NO: 981536 - RNA, 22 nt, Human
agcaugcgcuugaucagcucca

SEQ ID NO: 981537 - RNA, 22 nt, Human
ucucugcuaagauugugucuag

SEQ ID NO: 981538 - RNA, 22 nt, Human
gcuagaaaucgacuucagaauu

SEQ ID NO: 981539 - RNA, 22 nt, Human
acuggccaggcagcaguagcuu

SEQ ID NO: 981540 - RNA, 22 nt, Human
acagucauuagauacaaugucu

SEQ ID NO: 981541 - RNA, 22 nt, Human
gaccuuuuuacuguguacgcug

SEQ ID NO: 981542 - RNA, 22 nt, Human
gaauuacaaagugagacaagcu

SEQ ID NO: 981543 - RNA, 22 nt, Human
uuuuaucugugacaucuggcag

SEQ ID NO: 981544 - RNA, 22 nt, Human
aaguuuguuguacauguuagua

SEQ ID NO: 981545 - RNA, 19 nt, Human
uggcagcauugguaccuug

SEQ ID NO: 981546 - RNA, 22 nt, Human
aaagcuauuugugaguuauaga

SEQ ID NO: 981547 - RNA, 22 nt, Human
auuauuagauucuuaauuguaa

SEQ ID NO: 981548 - RNA, 22 nt, Human
gauauagguucauaguguuaca

SEQ ID NO: 981549 - RNA, 22 nt, Human
uccuggccuugcuccugaugcc

SEQ ID NO: 981550 - RNA, 22 nt, Human
uaguuuaauggucaacuaauga

SEQ ID NO: 981551 - RNA, 22 nt, Human
aaauauaauuucugccucaaua

SEQ ID NO: 981552 - RNA, 22 nt, Human
acacauuauaggcaaucaaaag

SEQ ID NO: 981553 - RNA, 22 nt, Human
cuuccugggcaauguucugcuu

SEQ ID NO: 981554 - RNA, 22 nt, Human
auuaggauguguauauuguguu

SEQ ID NO: 981555 - RNA, 22 nt, Human
ccuggccagaggcgugccugug

SEQ ID NO: 981556 - RNA, 22 nt, Human
auucacaauagcagcuugcaug

SEQ ID NO: 981557 - RNA, 21 nt, Human
cauuucaugauuauagaaaug

SEQ ID NO: 981558 - RNA, 22 nt, Human
auccauggaggacaagagcaau

SEQ ID NO: 981559 - RNA, 20 nt, Human
cacguuuuuccacuagcaaa

SEQ ID NO: 981560 - RNA, 22 nt, Human
uggcagcagacaaaaggccauu

SEQ ID NO: 981561 - RNA, 22 nt, Human
auauaauaguuucauaaaggcu

SEQ ID NO: 981562 - RNA, 22 nt, Human
aauaagaauuuacuugucaaga

SEQ ID NO: 981563 - RNA, 22 nt, Human
acacuucuauucccugcacaaa

SEQ ID NO: 981564 - RNA, 22 nt, Human
cugagccagcuggcaugugcua

SEQ ID NO: 981565 - RNA, 22 nt, Human
uaagauaauaaguaugucuaug

SEQ ID NO: 981566 - RNA, 22 nt, Human
acacuugauaggucaaaucagu

SEQ ID NO: 981567 - RNA, 22 nt, Human
uuggccaagucacugguuaaug

SEQ ID NO: 981568 - RNA, 22 nt, Human
ggccaaaugaaggcaaugggac

SEQ ID NO: 981569 - RNA, 22 nt, Human
aaaaguauuuauggcuauguaa

SEQ ID NO: 981570 - RNA, 22 nt, Human
auagauguucaaucagauauuu

SEQ ID NO: 981571 - RNA, 22 nt, Human
uagaaaugugauaauagcuuaa

SEQ ID NO: 981572 - RNA, 22 nt, Human
uuauuuggguuugaguguggca

SEQ ID NO: 981573 - RNA, 22 nt, Human
aaguaugcuaauuaacuagcac

SEQ ID NO: 981574 - RNA, 22 nt, Human
cagcuuuuuagaaucuagggca

SEQ ID NO: 981575 - RNA, 22 nt, Human
uuuauuagauuaucaaagaggu

SEQ ID NO: 981576 - RNA, 22 nt, Human
aauaaaauggucaguuuucuca

SEQ ID NO: 981577 - RNA, 16 nt, Human
gucuggccuaccugcc

SEQ ID NO: 981578 - RNA, 22 nt, Human
acagggaacaggaauauacaaa

SEQ ID NO: 981579 - RNA, 22 nt, Human
guucacaaaguacuguaugcau

SEQ ID NO: 981580 - RNA, 22 nt, Human
auauuaggugcucaauacaugc

SEQ ID NO: 981581 - RNA, 19 nt, Human
acauuuaaauucagaucuc

SEQ ID NO: 981582 - RNA, 20 nt, Human
aaaauauguauaacucuucu

SEQ ID NO: 981583 - RNA, 19 nt, Human
agcagcuggagguggagug

SEQ ID NO: 981584 - RNA, 21 nt, Human
uggccaaacuggagcauuuga

SEQ ID NO: 981585 - RNA, 22 nt, Human
cuauuagguaugcagccuauuu

SEQ ID NO: 981586 - RNA, 18 nt, Human
uuaauguggcuuacuaug

SEQ ID NO: 981587 - RNA, 22 nt, Human
cuggccaacaucuggggcacau

SEQ ID NO: 981588 - RNA, 22 nt, Human
acucugcuggcugcagggcagc

SEQ ID NO: 981589 - RNA, 22 nt, Human
gcucugcucuugacuuaccagg

SEQ ID NO: 981590 - RNA, 22 nt, Human
gagggcuccauuccccgugccc

SEQ ID NO: 981591 - RNA, 22 nt, Human
aaagacauggaacuagagaugg

SEQ ID NO: 981592 - RNA, 22 nt, Human
uuggccaacagcgacagggcca

SEQ ID NO: 981593 - RNA, 15 nt, Human
ucacucuggaaggga

SEQ ID NO: 981594 - RNA, 22 nt, Human
aagcuaugggggaguuucaacc

SEQ ID NO: 981595 - RNA, 22 nt, Human
cugagccaccggcagggacauc

SEQ ID NO: 981596 - RNA, 21 nt, Human
uuugaauagaaauagugcuua

SEQ ID NO: 981597 - RNA, 22 nt, Human
uuuuaucugcuucauuaguuga

SEQ ID NO: 981598 - RNA, 22 nt, Human
uccuggccgcuggccccugaga

SEQ ID NO: 981599 - RNA, 22 nt, Human
uuauuugguugcugacuuggaa

SEQ ID NO: 981600 - RNA, 22 nt, Human
acuuccugcaaucguccacucc

SEQ ID NO: 981601 - RNA, 22 nt, Human
gcacucugugaucugcagagcc

SEQ ID NO: 981602 - RNA, 22 nt, Human
ugacauaaaucuaaaggaaagg

SEQ ID NO: 981603 - RNA, 23 nt, Human
uccaagggcuacaaacacagacc

SEQ ID NO: 981604 - RNA, 19 nt, Human
ucaaaacacaaaugguuga

SEQ ID NO: 981605 - RNA, 22 nt, Human
acucugcuuccacuuuugcuaa

SEQ ID NO: 981606 - RNA, 22 nt, Human
ucuuggccagguguggugccuc

SEQ ID NO: 981607 - RNA, 20 nt, Human
ugaaauaaggaguuguccuu

SEQ ID NO: 981608 - RNA, 21 nt, Human
cuccugggcuaagauauagug

SEQ ID NO: 981609 - RNA, 19 nt, Human
uccugggcugcgucuugcc

SEQ ID NO: 981610 - RNA, 22 nt, Human
uucaaucauuuuuacauagucc

SEQ ID NO: 981611 - RNA, 20 nt, Human
uuggcagcagcucagccacc

SEQ ID NO: 981612 - RNA, 22 nt, Human
aacugccuggccaggcugcaac

SEQ ID NO: 981613 - RNA, 22 nt, Human
ucacuaaguuacauuuaguauu

SEQ ID NO: 981614 - RNA, 22 nt, Human
acauaacaaucauaggacauag

SEQ ID NO: 981615 - RNA, 22 nt, Human
uuucacaaguaaaguccuaagu

SEQ ID NO: 981616 - RNA, 22 nt, Human
aaaagagugacugauaaguaua

SEQ ID NO: 981617 - RNA, 22 nt, Human
cacucugcaggccaaaccaaag

SEQ ID NO: 981618 - RNA, 22 nt, Human
cuauuagguuggugcaaaagua

SEQ ID NO: 981619 - RNA, 22 nt, Human
acagggaauggagggaucagua

SEQ ID NO: 981620 - RNA, 22 nt, Human
ucugagccguauggcuuggcua

SEQ ID NO: 981621 - RNA, 22 nt, Human
uauuaugagguauuuggacuuu

SEQ ID NO: 981622 - RNA, 22 nt, Human
aauauuaauagaagggguucua

SEQ ID NO: 981623 - RNA, 22 nt, Human
ggcagcaucacuugucuccagc

SEQ ID NO: 981624 - RNA, 22 nt, Human
ccugggcaucucaugcaccugc

SEQ ID NO: 981625 - RNA, 22 nt, Human
cagcuuugucugauuccucuuu

SEQ ID NO: 981626 - RNA, 22 nt, Human
uuggcaucaguguaggaccugu

SEQ ID NO: 981627 - RNA, 22 nt, Human
cauuuuauccucugggaagcua

SEQ ID NO: 981628 - RNA, 22 nt, Human
uaggaucucaccauagaaggaa

SEQ ID NO: 981629 - RNA, 22 nt, Human
uuuacuguuuacagcuaaugca

SEQ ID NO: 981630 - RNA, 22 nt, Human
gggucugaggaguaccauuguc

SEQ ID NO: 981631 - RNA, 22 nt, Human
augugaggaagaaagagguaag

SEQ ID NO: 981632 - RNA, 22 nt, Human
acuccuggguucuaaauuugaa

SEQ ID NO: 981633 - RNA, 22 nt, Human
uagaauaaguugaugauauaug

SEQ ID NO: 981634 - RNA, 22 nt, Human
gaaaaguaaacacuagggguca

SEQ ID NO: 981635 - RNA, 22 nt, Human
caaaaguaauggcgguuuuuac

SEQ ID NO: 981636 - RNA, 22 nt, Human
aaaguauuuuugacaggcauua

SEQ ID NO: 981637 - RNA, 22 nt, Human
auguggcacagcacaguaagag

SEQ ID NO: 981638 - RNA, 22 nt, Human
uuuauagggacaguucuuggag

SEQ ID NO: 981639 - RNA, 22 nt, Human
uggcacaaaucuagucccuggu

SEQ ID NO: 981640 - RNA, 22 nt, Human
cugcugucauagccaucccucc

SEQ ID NO: 981641 - RNA, 22 nt, Human
ccuuuucuaaucuuaagaaugu

SEQ ID NO: 981642 - RNA, 22 nt, Human
gaaaaguacacagcccaaacau

SEQ ID NO: 981643 - RNA, 22 nt, Human
uaaagaacacagggaauagcac

SEQ ID NO: 981644 - RNA, 22 nt, Human
cugccuggcuaaacucaagucg

SEQ ID NO: 981645 - RNA, 22 nt, Human
gcuggccagugucccagggauc

SEQ ID NO: 981646 - RNA, 20 nt, Human
uccugagccuccaccauguc

SEQ ID NO: 981647 - RNA, 21 nt, Human
cggccaaauuccuccuaggga

SEQ ID NO: 981648 - RNA, 22 nt, Human
aacuucugggcuguccaaaacu

SEQ ID NO: 981649 - RNA, 22 nt, Human
uaaaaguaggaaugaaacgcau

SEQ ID NO: 981650 - RNA, 22 nt, Human
cacucugcgcugggcgccagcg

SEQ ID NO: 981651 - RNA, 22 nt, Human
aacacugcugcuggguucugug

SEQ ID NO: 981652 - RNA, 22 nt, Human
auuaggacagagaugucaagag

SEQ ID NO: 981653 - RNA, 20 nt, Human
ucaccuuuguugguauucau

SEQ ID NO: 981654 - RNA, 22 nt, Human
cucucugcaaguuuugaaauag

SEQ ID NO: 981655 - RNA, 20 nt, Human
uuucacaaugaacaugucuc

SEQ ID NO: 981656 - RNA, 23 nt, Human
gcucugcucuguuucauagacag

SEQ ID NO: 981657 - RNA, 18 nt, Human
gcuccugguuggaaagaa

SEQ ID NO: 981658 - RNA, 22 nt, Human
cugagccagggccacacaugga

SEQ ID NO: 981659 - RNA, 20 nt, Human
caaguguagaaacuaauaag

SEQ ID NO: 981660 - RNA, 22 nt, Human
uggcagcacuugaacuugagcc

SEQ ID NO: 981661 - RNA, 22 nt, Human
gcuccuggcuccaggcagccaa

SEQ ID NO: 981662 - RNA, 22 nt, Human
gcagacaucaagcacaggccca

SEQ ID NO: 981663 - RNA, 22 nt, Human
gcagacauuuugaaucuaggcu

SEQ ID NO: 981664 - RNA, 22 nt, Human
cuucacaauucuaacagggcaa

SEQ ID NO: 981665 - RNA, 22 nt, Human
aaauauagcaauuaugccuacu

SEQ ID NO: 981666 - RNA, 22 nt, Human
aaugauguuuuuaaagaacaua

SEQ ID NO: 981667 - RNA, 22 nt, Human
uguguuaauuccacaaacauuc

SEQ ID NO: 981668 - RNA, 22 nt, Human
ucuuguuaaagugaagauacug

SEQ ID NO: 981669 - RNA, 20 nt, Human
aggccaaacccagcgcgccc

SEQ ID NO: 981670 - RNA, 22 nt, Human
aaacacauuuuaggaaaaucua

SEQ ID NO: 981671 - RNA, 22 nt, Human
uccugucuaaagaccugcaggc

SEQ ID NO: 981672 - RNA, 22 nt, Human
acacucugcucugagcuucagg

SEQ ID NO: 981673 - RNA, 23 nt, Human
uggccaagauaaucucaguuuuc

SEQ ID NO: 981674 - RNA, 22 nt, Human
ugcuugaggggaauaaaaagaa

SEQ ID NO: 981675 - RNA, 22 nt, Human
guuuuauuggaacacagccaug

SEQ ID NO: 981676 - RNA, 22 nt, Human
caacuccuccccagcaugccaa

SEQ ID NO: 981677 - RNA, 17 nt, Human
ucugaagccagucugcu

SEQ ID NO: 981678 - RNA, 22 nt, Human
uaaccuuuggugaaauauuaac

SEQ ID NO: 981679 - RNA, 22 nt, Human
uccuggccuugcgucuugggag

SEQ ID NO: 981680 - RNA, 22 nt, Human
ucuccugggaggacaaggaagg

SEQ ID NO: 981681 - RNA, 22 nt, Human
uucaggaugaaagugugcaaca

SEQ ID NO: 981682 - RNA, 22 nt, Human
guaaaauagaauaacguggcua

SEQ ID NO: 981683 - RNA, 23 nt, Human
uuggcagcgggucaggcuguggg

SEQ ID NO: 981684 - RNA, 22 nt, Human
aaagacauugaagaaggacuua

SEQ ID NO: 981685 - RNA, 22 nt, Human
uacaaaaaauugauacugacga

SEQ ID NO: 981686 - RNA, 22 nt, Human
ucacucugauagauaagcuaac

SEQ ID NO: 981687 - RNA, 22 nt, Human
ucacaagaauuuguagaugaaa

SEQ ID NO: 981688 - RNA, 22 nt, Human
aaaaugagauacaguuugaaag

SEQ ID NO: 981689 - RNA, 22 nt, Human
ucuccuggcauuugguugagua

SEQ ID NO: 981690 - RNA, 22 nt, Human
cagggucuuggcgccaucaccc

SEQ ID NO: 981691 - RNA, 22 nt, Human
gucugagcgcuggagcuugugu

SEQ ID NO: 981692 - RNA, 21 nt, Human
gacaggacuagaccagagcuc

SEQ ID NO: 981693 - RNA, 22 nt, Human
aaacaccaagagcuagcuauua

SEQ ID NO: 981694 - RNA, 22 nt, Human
acuggccaggcgaaccacacug

SEQ ID NO: 981695 - RNA, 22 nt, Human
ucacucuguuagaggaaagugc

SEQ ID NO: 981696 - RNA, 22 nt, Human
uuucauuauaaaaaguuggcuu

SEQ ID NO: 981697 - RNA, 22 nt, Human
uccuaggcaguuggugcuccau

SEQ ID NO: 981698 - RNA, 22 nt, Human
agaauaaacugcuuuagggcag

SEQ ID NO: 981699 - RNA, 17 nt, Human
acucugcugaaguagaa

SEQ ID NO: 981700 - RNA, 22 nt, Human
cuguuuauggagguaaggcauc

SEQ ID NO: 981701 - RNA, 22 nt, Human
ucuaagccuaggaaaugaguuu

SEQ ID NO: 981702 - RNA, 22 nt, Human
cuuucacacacauacauuugga

SEQ ID NO: 981703 - RNA, 22 nt, Human
uggcaacauggacaggucugcc

SEQ ID NO: 981704 - RNA, 22 nt, Human
uguuuaguaggaguuuaauacu

SEQ ID NO: 981705 - RNA, 22 nt, Human
cuggcccaggaagacguguccc

SEQ ID NO: 981706 - RNA, 22 nt, Human
uuucacaacguuguggugagag

SEQ ID NO: 981707 - RNA, 22 nt, Human
caacaaguggguacuuuacagg

SEQ ID NO: 981708 - RNA, 22 nt, Human
cacuaaguaagcuccucuacaa

SEQ ID NO: 981709 - RNA, 21 nt, Human
uucagcaagcacucuggacac

SEQ ID NO: 981710 - RNA, 22 nt, Human
ucugugccaccucuccaguguc

SEQ ID NO: 981711 - RNA, 23 nt, Human
agucuuaauacagcucuuuucua

SEQ ID NO: 981712 - RNA, 22 nt, Human
gggcauguagugugcauagaga

SEQ ID NO: 981713 - RNA, 22 nt, Human
ucuccuggaagugauuccccug

SEQ ID NO: 981714 - RNA, 23 nt, Human
uucaaaacuggaaaaucagaugc

SEQ ID NO: 981715 - RNA, 22 nt, Human
caaggugcagcguugucaagcu

SEQ ID NO: 981716 - RNA, 22 nt, Human
aaucaguauugguauagaauga

SEQ ID NO: 981717 - RNA, 23 nt, Human
uuucacaaugagcauuacagaau

SEQ ID NO: 981718 - RNA, 22 nt, Human
gaacccaaaccuggaccucccu

SEQ ID NO: 981719 - RNA, 22 nt, Human
accuucaaugaaaauaauaguc

SEQ ID NO: 981720 - RNA, 21 nt, Human
uccuggccagggcacuaggca

SEQ ID NO: 981721 - RNA, 22 nt, Human
uccuggccucgcuguccaccuu

SEQ ID NO: 981722 - RNA, 22 nt, Human
augcaaaugaacauguugcuag

SEQ ID NO: 981723 - RNA, 22 nt, Human
uuguuauaaagacuaaauaugu

SEQ ID NO: 981724 - RNA, 22 nt, Human
auuaggcagggcaugguggcuc

SEQ ID NO: 981725 - RNA, 22 nt, Human
acaguuauucuuuaugcaacca

SEQ ID NO: 981726 - RNA, 22 nt, Human
uugcaaauuccaauccaauauu

SEQ ID NO: 981727 - RNA, 22 nt, Human
agcuauguaacagugccaugga

SEQ ID NO: 981728 - RNA, 22 nt, Human
auuggcaaggcugcggugucug

SEQ ID NO: 981729 - RNA, 22 nt, Human
ugucaucuuggucuggaauaag

SEQ ID NO: 981730 - RNA, 22 nt, Human
ucuccuggauagauacuaucca

SEQ ID NO: 981731 - RNA, 22 nt, Human
ggccacaagugguccugagucc

SEQ ID NO: 981732 - RNA, 19 nt, Human
auuagcaugcuugaggaug

SEQ ID NO: 981733 - RNA, 22 nt, Human
uucuuauucuugaaauguggga

SEQ ID NO: 981734 - RNA, 22 nt, Human
caauaagugcuuuuguuuagca

SEQ ID NO: 981735 - RNA, 22 nt, Human
uuggccaauuuagaacguguug

SEQ ID NO: 981736 - RNA, 22 nt, Human
auggccaaagccacagcagagg

SEQ ID NO: 981737 - RNA, 22 nt, Human
acucugcugauagguccucaga

SEQ ID NO: 981738 - RNA, 20 nt, Human
cauuggacuuggcuucaugg

SEQ ID NO: 981739 - RNA, 22 nt, Human
aauucacaugcaugucugugca

SEQ ID NO: 981740 - RNA, 21 nt, Human
ugaaacacucuuuccaugaga

SEQ ID NO: 981741 - RNA, 22 nt, Human
ucuccugguuuguuaaauaauu

SEQ ID NO: 981742 - RNA, 22 nt, Human
acucugcucaaaguccugaggc

SEQ ID NO: 981743 - RNA, 22 nt, Human
gcuccuggugcuguagagauuu

SEQ ID NO: 981744 - RNA, 22 nt, Human
uuuuauucuaaguaugauggga

SEQ ID NO: 981745 - RNA, 22 nt, Human
uuguuaguuuauauaauguagu

SEQ ID NO: 981746 - RNA, 22 nt, Human
uuucacaacacaaucucguuaa

SEQ ID NO: 981747 - RNA, 23 nt, Human
gcuguuagauuuaauaagcauuu

SEQ ID NO: 981748 - RNA, 23 nt, Human
ccuccugggcacaggccugaugg

SEQ ID NO: 981749 - RNA, 22 nt, Human
caaaaagcuuagguaacaagcc

SEQ ID NO: 981750 - RNA, 22 nt, Human
cuucuuaaagauuacacaauga

SEQ ID NO: 981751 - RNA, 22 nt, Human
uauauuaacacccacuugccuc

SEQ ID NO: 981752 - RNA, 22 nt, Human
caaaaguaccuugugugcuuug

SEQ ID NO: 981753 - RNA, 22 nt, Human
agagugauccuaauugauuugg

SEQ ID NO: 981754 - RNA, 22 nt, Human
gauuuggccuuucgcaugguau

SEQ ID NO: 981755 - RNA, 22 nt, Human
guuuauuagaguuuucugucug

SEQ ID NO: 981756 - RNA, 22 nt, Human
gcuggccagcccucuuccucca

SEQ ID NO: 981757 - RNA, 22 nt, Human
auucugagacaauugccgucag

SEQ ID NO: 981758 - RNA, 22 nt, Human
uucagcaagaccaccauguacc

SEQ ID NO: 981759 - RNA, 22 nt, Human
uggaagagacacuuacauucag

SEQ ID NO: 981760 - RNA, 22 nt, Human
ucaauaaaauuguuuuccuauc

SEQ ID NO: 981761 - RNA, 22 nt, Human
cacuaugcuuacaugcuuauau

SEQ ID NO: 981762 - RNA, 23 nt, Human
auauuagggagauuagcccucua

SEQ ID NO: 981763 - RNA, 22 nt, Human
ccuccuggaggcucuagggaaa

SEQ ID NO: 981764 - RNA, 22 nt, Human
ucaaugaaagagcaugcauuuu

SEQ ID NO: 981765 - RNA, 22 nt, Human
uuggccaaggucacugggugag

SEQ ID NO: 981766 - RNA, 20 nt, Human
auguaaaauuauaaggcuga

SEQ ID NO: 981767 - RNA, 22 nt, Human
auaauaaaccaggaugggucug

SEQ ID NO: 981768 - RNA, 21 nt, Human
uuauugagacauuuguggaaa

SEQ ID NO: 981769 - RNA, 22 nt, Human
cacucugagccaaaacuaauuc

SEQ ID NO: 981770 - RNA, 22 nt, Human
uuuauuuggcaucucugccaag

SEQ ID NO: 981771 - RNA, 22 nt, Human
caaauauuccagguacaucccu

SEQ ID NO: 981772 - RNA, 22 nt, Human
uuuuacuuaauucuuggucaug

SEQ ID NO: 981773 - RNA, 19 nt, Human
ucucacaguuuccuugccu

SEQ ID NO: 981774 - RNA, 22 nt, Human
uuggccaaagcucaccagugcu

SEQ ID NO: 981775 - RNA, 22 nt, Human
aaagacauuagauuaacguaca

SEQ ID NO: 981776 - RNA, 22 nt, Human
ucuccuggauggaccuucucuu

SEQ ID NO: 981777 - RNA, 22 nt, Human
augcacuacuuggcuuuacuga

SEQ ID NO: 981778 - RNA, 22 nt, Human
uggccacauccuuuccuuguca

SEQ ID NO: 981779 - RNA, 22 nt, Human
cuccuggcuucugaaaucgugg

SEQ ID NO: 981780 - RNA, 22 nt, Human
ggcaacauucuccagauccuuu

SEQ ID NO: 981781 - RNA, 22 nt, Human
guuuauuauacaacaaaagcua

SEQ ID NO: 981782 - RNA, 22 nt, Human
auucaucaacugauagccauag

SEQ ID NO: 981783 - RNA, 22 nt, Human
uggcgcaacucauucauggugu

SEQ ID NO: 981784 - RNA, 22 nt, Human
caaguuaucagaaggcacuuuu

SEQ ID NO: 981785 - RNA, 20 nt, Human
agacaggagcccccauucag

SEQ ID NO: 981786 - RNA, 22 nt, Human
caaaaguaauguaugcucaucg

SEQ ID NO: 981787 - RNA, 22 nt, Human
uagaauauacacuacagcuuaa

SEQ ID NO: 981788 - RNA, 22 nt, Human
cucccuggugacucccaaagcu

SEQ ID NO: 981789 - RNA, 22 nt, Human
cuuuugauaguugcugagcagg

SEQ ID NO: 981790 - RNA, 22 nt, Human
accaaacaaaauugugcacugu

SEQ ID NO: 981791 - RNA, 22 nt, Human
uaaguauguuagaaaaucaagu

SEQ ID NO: 981792 - RNA, 22 nt, Human
ugucaucucacugauauagaug

SEQ ID NO: 981793 - RNA, 22 nt, Human
gaaaaguauguuuauuuugacu

SEQ ID NO: 981794 - RNA, 22 nt, Human
uuaaaugaacgagauaugcaac

SEQ ID NO: 981795 - RNA, 22 nt, Human
uccaaggguucaugugcauuca

SEQ ID NO: 981796 - RNA, 22 nt, Human
cacugucuuuugugaagacaau

SEQ ID NO: 981797 - RNA, 22 nt, Human
uauuuaaaaagaggccagcugg

SEQ ID NO: 981798 - RNA, 22 nt, Human
uuggccaauggugauucccggc

SEQ ID NO: 981799 - RNA, 22 nt, Human
ggcagcauuuagagcacagugu

SEQ ID NO: 981800 - RNA, 21 nt, Human
uggcagacuagaguauagaug

SEQ ID NO: 981801 - RNA, 22 nt, Human
uuggcagcauccaagucucggg

SEQ ID NO: 981802 - RNA, 22 nt, Human
gcucugcucccucaaaugacau

SEQ ID NO: 981803 - RNA, 22 nt, Human
uauugaggauugaggaaagcac

SEQ ID NO: 981804 - RNA, 22 nt, Human
aauguuauuacacuugugaaau

SEQ ID NO: 981805 - RNA, 22 nt, Human
uuucacaaacugaggagacaau

SEQ ID NO: 981806 - RNA, 18 nt, Human
gcuccuggaccaggucac

SEQ ID NO: 981807 - RNA, 22 nt, Human
cagagagggcggcccuggcuuc

SEQ ID NO: 981808 - RNA, 22 nt, Human
aaauacagcagacuccuguugu

SEQ ID NO: 981809 - RNA, 22 nt, Human
augaggauuaacuguugucaua

SEQ ID NO: 981810 - RNA, 22 nt, Human
aaagcacauuacaagcucaguc

SEQ ID NO: 981811 - RNA, 22 nt, Human
uggccaaaguagaaaauaauag

SEQ ID NO: 981812 - RNA, 18 nt, Human
aggauauuaagaguacag

SEQ ID NO: 981813 - RNA, 22 nt, Human
uuucaacagcucucaaaugauc

SEQ ID NO: 981814 - RNA, 22 nt, Human
aguauacauauauuagccuucg

SEQ ID NO: 981815 - RNA, 22 nt, Human
aguuauagaaccagguccucac

SEQ ID NO: 981816 - RNA, 22 nt, Human
ucuuggccccaccugugccagc

SEQ ID NO: 981817 - RNA, 22 nt, Human
caauaaguaauaggcaucuaau

SEQ ID NO: 981818 - RNA, 22 nt, Human
uuggccaaaggaaagacuacug

SEQ ID NO: 981819 - RNA, 22 nt, Human
acucugacuggagugagagagg

SEQ ID NO: 981820 - RNA, 22 nt, Human
aaauacaguguguguucuuuga

SEQ ID NO: 981821 - RNA, 22 nt, Human
caacccaagguuaguuggucuu

SEQ ID NO: 981822 - RNA, 22 nt, Human
cuaauguggacucuaucaaagu

SEQ ID NO: 981823 - RNA, 22 nt, Human
cuggcacaaugucacuuuugcu

SEQ ID NO: 981824 - RNA, 22 nt, Human
uccugggcuuuguuucucuccu

SEQ ID NO: 981825 - RNA, 22 nt, Human
uccaagggcaugcugaaauaag

SEQ ID NO: 981826 - RNA, 22 nt, Human
gaaaugugggucaugacccauu

SEQ ID NO: 981827 - RNA, 22 nt, Human
uuggccaaccagaacggagguc

SEQ ID NO: 981828 - RNA, 22 nt, Human
auguuguagcauaugaaauaua

SEQ ID NO: 981829 - RNA, 22 nt, Human
uacagccucacauuuacuuaca

SEQ ID NO: 981830 - RNA, 22 nt, Human
ucugcaggaggcuggcugcagg

SEQ ID NO: 981831 - RNA, 22 nt, Human
uucugagccucauucaugaggc

SEQ ID NO: 981832 - RNA, 22 nt, Human
ucacucugcugcccgagggcug

SEQ ID NO: 981833 - RNA, 22 nt, Human
gucuggccuuuuuagcuugugg

SEQ ID NO: 981834 - RNA, 22 nt, Human
augcaaaagacuauuuguugcu

SEQ ID NO: 981835 - RNA, 22 nt, Human
aacucacuuuguggcuucugaa

SEQ ID NO: 981836 - RNA, 22 nt, Human
uguuggcauuagaggguuauug

SEQ ID NO: 981837 - RNA, 22 nt, Human
uaacuaacuaguguucaaaaua

SEQ ID NO: 981838 - RNA, 22 nt, Human
auaaagacaugcuuacuugccc

SEQ ID NO: 981839 - RNA, 22 nt, Human
uccaagggaauuuaaaguugcu

SEQ ID NO: 981840 - RNA, 22 nt, Human
auaauguguucaucuuacaauu

SEQ ID NO: 981841 - RNA, 23 nt, Human
cuucuggcucuauaucagaauuc

SEQ ID NO: 981842 - RNA, 22 nt, Human
caaaaguaauugcgguuuuugc

SEQ ID NO: 981843 - RNA, 22 nt, Human
uugcaaauuauuuuagucccuu

SEQ ID NO: 981844 - RNA, 22 nt, Human
ucuucaaaaaauauccaucagu

SEQ ID NO: 981845 - RNA, 22 nt, Human
caaaacauucagagagcucacu

SEQ ID NO: 981846 - RNA, 22 nt, Human
cuaaauaaucccucuggucuua

SEQ ID NO: 981847 - RNA, 22 nt, Human
augauguuaccaguacuuagag

SEQ ID NO: 981848 - RNA, 22 nt, Human
uuucaagagggaacugaacaca

SEQ ID NO: 981849 - RNA, 20 nt, Human
auggccaaccugcuuaugac

SEQ ID NO: 981850 - RNA, 22 nt, Human
uaggaugagggguggccaagua

SEQ ID NO: 981851 - RNA, 22 nt, Human
agaguucagcuacugcaaaugu

SEQ ID NO: 981852 - RNA, 22 nt, Human
ucacucuguggcccaggcagug

SEQ ID NO: 981853 - RNA, 22 nt, Human
uggagggaacaaaggaguccca

SEQ ID NO: 981854 - RNA, 22 nt, Human
gggaggaggaauguuuugugua

SEQ ID NO: 981855 - RNA, 19 nt, Human
uuggcagcugagauccugc

SEQ ID NO: 981856 - RNA, 22 nt, Human
gucuagagugcuuccuagucau

SEQ ID NO: 981857 - RNA, 22 nt, Human
auucacaaugauacauaagcga

SEQ ID NO: 981858 - RNA, 22 nt, Human
cuggcucaauuuguacugcugu

SEQ ID NO: 981859 - RNA, 22 nt, Human
aaguuguauauaccgcuuuaag

SEQ ID NO: 981860 - RNA, 22 nt, Human
caacuccuggcuguuaggcaca

SEQ ID NO: 981861 - RNA, 22 nt, Human
aacacaaagaagcugcaggauc

SEQ ID NO: 981862 - RNA, 22 nt, Human
uggcaagccugagauccgggag

SEQ ID NO: 981863 - RNA, 22 nt, Human
cugcccaaauccuucuuccucu

SEQ ID NO: 981864 - RNA, 19 nt, Human
aauaauguucaugagauug

SEQ ID NO: 981865 - RNA, 22 nt, Human
uagaaaugauugguugagcucu

SEQ ID NO: 981866 - RNA, 22 nt, Human
cuaggccacuugcucucaugga

SEQ ID NO: 981867 - RNA, 22 nt, Human
auuagguugugcuuuguggaca

SEQ ID NO: 981868 - RNA, 22 nt, Human
cauguguaugcauucauacaua

SEQ ID NO: 981869 - RNA, 22 nt, Human
auuaaggaauguaggcaagaag

SEQ ID NO: 981870 - RNA, 22 nt, Human
uauuauuauaguuauugggaag

SEQ ID NO: 981871 - RNA, 22 nt, Human
auggccaagcuuacucuguugu

SEQ ID NO: 981872 - RNA, 22 nt, Human
uauauuaaacccucucuguagg

SEQ ID NO: 981873 - RNA, 22 nt, Human
acuccuggggauccauuccuuu

SEQ ID NO: 981874 - RNA, 22 nt, Human
uuccuggcgccacggagccggu

SEQ ID NO: 981875 - RNA, 22 nt, Human
uaccuuuugcuuauuaugacac

SEQ ID NO: 981876 - RNA, 22 nt, Human
uguuuauuuucaggauggauug

SEQ ID NO: 981877 - RNA, 20 nt, Human
uacuuaggcuuguuuuggcc

SEQ ID NO: 981878 - RNA, 20 nt, Human
ucugccacugcacucugccc

SEQ ID NO: 981879 - RNA, 22 nt, Human
aaaagagucuuaggcagucaua

SEQ ID NO: 981880 - RNA, 22 nt, Human
acuccuggugcugaugaagaga

SEQ ID NO: 981881 - RNA, 20 nt, Human
uuggcagcuucaggguacua

SEQ ID NO: 981882 - RNA, 22 nt, Human
ucuauuuacagaaagcagaauu

SEQ ID NO: 981883 - RNA, 22 nt, Human
uagaauaugauuaauuuucuua

SEQ ID NO: 981884 - RNA, 22 nt, Human
uuuaggaucucucuuguuacau

SEQ ID NO: 981885 - RNA, 22 nt, Human
aacaaguaaguuuauauauauu

SEQ ID NO: 981886 - RNA, 22 nt, Human
uccuggcccaaucugcccauga

SEQ ID NO: 981887 - RNA, 22 nt, Human
aacacuuucuuccuugcucagg

SEQ ID NO: 981888 - RNA, 22 nt, Human
uuucacaaagcauagcacuuua

SEQ ID NO: 981889 - RNA, 21 nt, Human
ucacucugauuaggugucucu

SEQ ID NO: 981890 - RNA, 22 nt, Human
acaaaaaccguggauucagcau

SEQ ID NO: 981891 - RNA, 22 nt, Human
uuuuaauucaaagugaauagug

SEQ ID NO: 981892 - RNA, 19 nt, Human
ccuggccagacuucugccc

SEQ ID NO: 981893 - RNA, 22 nt, Human
ucuccugguauguaugcaccug

SEQ ID NO: 981894 - RNA, 22 nt, Human
accuguuuguguccauuaguga

SEQ ID NO: 981895 - RNA, 22 nt, Human
ucauaaaaauagacucuaaagu

SEQ ID NO: 981896 - RNA, 22 nt, Human
aauuaaauugguuuagagagga

SEQ ID NO: 981897 - RNA, 22 nt, Human
aacaugucuggguauucacaag

SEQ ID NO: 981898 - RNA, 22 nt, Human
acuggccaggagcuggaaauac

SEQ ID NO: 981899 - RNA, 22 nt, Human
uaaagcacgucuauuuaaugau

SEQ ID NO: 981900 - RNA, 22 nt, Human
aggccaaagcucaccugcagcu

SEQ ID NO: 981901 - RNA, 22 nt, Human
uaugucacauuguaacagugug

SEQ ID NO: 981902 - RNA, 21 nt, Human
agggaaagaaaaugagcuaau

SEQ ID NO: 981903 - RNA, 22 nt, Human
auggccaagaucacagacuuca

SEQ ID NO: 981904 - RNA, 22 nt, Human
cagagcagucuggagauccagc

SEQ ID NO: 981905 - RNA, 21 nt, Human
gauguuggaggcuggggucug

SEQ ID NO: 981906 - RNA, 22 nt, Human
gugauaaagacgugucauaauu

SEQ ID NO: 981907 - RNA, 22 nt, Human
aggccaaauguguauaaaacau

SEQ ID NO: 981908 - RNA, 22 nt, Human
gggaagauaguguugagggccc

SEQ ID NO: 981909 - RNA, 22 nt, Human
ucuccugggcuugguugaaguu

SEQ ID NO: 981910 - RNA, 22 nt, Human
ugaaugugaugcuaaacauaug

SEQ ID NO: 981911 - RNA, 22 nt, Human
ucagggaacaauguuauggcuu

SEQ ID NO: 981912 - RNA, 21 nt, Human
caugcaggauuuaaccuagaa

SEQ ID NO: 981913 - RNA, 22 nt, Human
cucucuggcacuucauugcugu

SEQ ID NO: 981914 - RNA, 22 nt, Human
uauuuaauuugcucauugugau

SEQ ID NO: 981915 - RNA, 21 nt, Human
uuuauuuauauaggacacaug

SEQ ID NO: 981916 - RNA, 22 nt, Human
acaggccugagauuuugcauuu

SEQ ID NO: 981917 - RNA, 22 nt, Human
aaccaaauggaugguaagaggg

SEQ ID NO: 981918 - RNA, 22 nt, Human
uggcagcaauuagcuagagcug

SEQ ID NO: 981919 - RNA, 22 nt, Human
agaauaaauguuggacuuagga

SEQ ID NO: 981920 - RNA, 20 nt, Human
uguccuaauagacaagcaga

SEQ ID NO: 981921 - RNA, 22 nt, Human
auguuuaaauuuauagacagug

SEQ ID NO: 981922 - RNA, 22 nt, Human
auauuaaugagcaaguaaguga

SEQ ID NO: 981923 - RNA, 22 nt, Human
acuaaauaguuuugacagaaca

SEQ ID NO: 981924 - RNA, 22 nt, Human
uaucuuugaugccagauguuac

SEQ ID NO: 981925 - RNA, 22 nt, Human
uuuauuaauguagcauccaugg

SEQ ID NO: 981926 - RNA, 22 nt, Human
cuccuggaggauagugacuggg

SEQ ID NO: 981927 - RNA, 22 nt, Human
cucuugaagggcaucugaguua

SEQ ID NO: 981928 - RNA, 22 nt, Human
uaggcaauauuagacuuugucu

SEQ ID NO: 981929 - RNA, 22 nt, Human
uuauguaggauaaugaauugcc

SEQ ID NO: 981930 - RNA, 22 nt, Human
gcacagcucgagcucaggaggg

SEQ ID NO: 981931 - RNA, 22 nt, Human
gcucugcuggaaguucucugga

SEQ ID NO: 981932 - RNA, 22 nt, Human
auuauggacguuaauuuuggaa

SEQ ID NO: 981933 - RNA, 22 nt, Human
aagucauucuauuucucuaugu

SEQ ID NO: 981934 - RNA, 22 nt, Human
gcucugcuuucuggggggaucc

SEQ ID NO: 981935 - RNA, 22 nt, Human
cggccaagccggggccccgaag

SEQ ID NO: 981936 - RNA, 22 nt, Human
auucugagaaaugcauugucag

SEQ ID NO: 981937 - RNA, 22 nt, Human
ugagccaaugauuugaauagag

SEQ ID NO: 981938 - RNA, 22 nt, Human
uacaguauggaaaauguauagu

SEQ ID NO: 981939 - RNA, 22 nt, Human
caugcaggcacccagagcccac

SEQ ID NO: 981940 - RNA, 22 nt, Human
cuggccacugguggucauaggc

SEQ ID NO: 981941 - RNA, 22 nt, Human
ugacauaaguugguagaaagga

SEQ ID NO: 981942 - RNA, 22 nt, Human
cuccuggcucgcccccagcuga

SEQ ID NO: 981943 - RNA, 22 nt, Human
auucacauguugaagcccuaac

SEQ ID NO: 981944 - RNA, 22 nt, Human
aucuuucaaucaggaaaaaucu

SEQ ID NO: 981945 - RNA, 22 nt, Human
uuggccaaauacacaccuuuug

SEQ ID NO: 981946 - RNA, 22 nt, Human
uugaaaaguuuugaaacacucu

SEQ ID NO: 981947 - RNA, 22 nt, Human
aaaccaaacauuugcgguggug

SEQ ID NO: 981948 - RNA, 22 nt, Human
acacauaagaaacuacaaagag

SEQ ID NO: 981949 - RNA, 22 nt, Human
guuccaaacaagucauaaagua

SEQ ID NO: 981950 - RNA, 22 nt, Human
uccuggccaaguuacucucugc

SEQ ID NO: 981951 - RNA, 22 nt, Human
ccuggccagcuaauugcccauc

SEQ ID NO: 981952 - RNA, 22 nt, Human
auggcaagcaagcugaagagau

SEQ ID NO: 981953 - RNA, 22 nt, Human
agcacauucuugccuuaaccuc

SEQ ID NO: 981954 - RNA, 22 nt, Human
aaauuauuuucagaauggagaa

SEQ ID NO: 981955 - RNA, 22 nt, Human
uuagugauaggaagccagauug

SEQ ID NO: 981956 - RNA, 22 nt, Human
aaacuccugcauacucagaagc

SEQ ID NO: 981957 - RNA, 22 nt, Human
aggauguucgggucacauagcc

SEQ ID NO: 981958 - RNA, 22 nt, Human
ggccaaaccgcaauuauuuuug

SEQ ID NO: 981959 - RNA, 22 nt, Human
ccuccugguaauuagcgaaagg

SEQ ID NO: 981960 - RNA, 22 nt, Human
uauauuaguggaaugauaugaa

SEQ ID NO: 981961 - RNA, 22 nt, Human
ucagcaggcaggaggcaugcca

SEQ ID NO: 981962 - RNA, 22 nt, Human
uucagauaaacuacaaauaauu

SEQ ID NO: 981963 - RNA, 22 nt, Human
cagccuuugugaacaucaggug

SEQ ID NO: 981964 - RNA, 22 nt, Human
cuuugaauuccaguacaauaac

SEQ ID NO: 981965 - RNA, 22 nt, Human
acauuccugaggaaauacauuc

SEQ ID NO: 981966 - RNA, 22 nt, Human
uggcagcauuaauuauucaggu

SEQ ID NO: 981967 - RNA, 17 nt, Human
uuaagguggaucagcac

SEQ ID NO: 981968 - RNA, 18 nt, Human
ucagggaaucuuggccuu

SEQ ID NO: 981969 - RNA, 22 nt, Human
acucugcuugcccaauggaaac

SEQ ID NO: 981970 - RNA, 22 nt, Human
aaaacuccugaaauuguuuccc

SEQ ID NO: 981971 - RNA, 22 nt, Human
agcuagaauguuccuuuucauu

SEQ ID NO: 981972 - RNA, 21 nt, Human
ucacauuucucauggguaaau

SEQ ID NO: 981973 - RNA, 22 nt, Human
uugaggaguguuuagggugagg

SEQ ID NO: 981974 - RNA, 22 nt, Human
auagacauuuugcauucaagca

SEQ ID NO: 981975 - RNA, 22 nt, Human
cuuaggaugaguuuuugcguuu

SEQ ID NO: 981976 - RNA, 22 nt, Human
aaaugugcuucuuacucucaau

SEQ ID NO: 981977 - RNA, 22 nt, Human
uagaaacagagagauaugcccc

SEQ ID NO: 981978 - RNA, 21 nt, Human
uggaccaaaguaauuugccuu

SEQ ID NO: 981979 - RNA, 22 nt, Human
guauuaggagguggagccuuug

SEQ ID NO: 981980 - RNA, 21 nt, Human
uuuauuaacaacuguggacgu

SEQ ID NO: 981981 - RNA, 22 nt, Human
cauagaaacugagacaaggauu

SEQ ID NO: 981982 - RNA, 22 nt, Human
ccaaaaaguacauuuaggugug

SEQ ID NO: 981983 - RNA, 22 nt, Human
cuggcucaccuccgcuccagca

SEQ ID NO: 981984 - RNA, 22 nt, Human
acaugaaaccugagucuaacuc

SEQ ID NO: 981985 - RNA, 20 nt, Human
ccuccuggucaggugugcag

SEQ ID NO: 981986 - RNA, 22 nt, Human
aauucacagcauuugcccaucu

SEQ ID NO: 981987 - RNA, 22 nt, Human
uaaaacuagugguugggacuaa

SEQ ID NO: 981988 - RNA, 22 nt, Human
aaucauaauucaaauaagcuua

SEQ ID NO: 981989 - RNA, 22 nt, Human
uccuggccaggaugaccuaaca

SEQ ID NO: 981990 - RNA, 22 nt, Human
acuggccaugggauuuauauuu

SEQ ID NO: 981991 - RNA, 19 nt, Human
cauuccuuugucugccaaa

SEQ ID NO: 981992 - RNA, 22 nt, Human
aaacucaaauuaaacuagcuua

SEQ ID NO: 981993 - RNA, 22 nt, Human
auuuggcacacuggguucucgu

SEQ ID NO: 981994 - RNA, 22 nt, Human
auggccaagcauauacagauug

SEQ ID NO: 981995 - RNA, 23 nt, Human
uauuagggccaggacuggcaaau

SEQ ID NO: 981996 - RNA, 22 nt, Human
aagucauuaucucuucuaaucu

SEQ ID NO: 981997 - RNA, 22 nt, Human
guuauuaguaagacucgcacau

SEQ ID NO: 981998 - RNA, 22 nt, Human
gcuccuggcucucugagggcug

SEQ ID NO: 981999 - RNA, 18 nt, Human
aaguaugccuauguuauu

SEQ ID NO: 982000 - RNA, 22 nt, Human
uuucauuauucaugcuaguuau

SEQ ID NO: 982001 - RNA, 22 nt, Human
uggcacaugguaagugcuuaac

SEQ ID NO: 982002 - RNA, 22 nt, Human
uuucacaaacucagggugugug

SEQ ID NO: 982003 - RNA, 22 nt, Human
aagucauugguagcuugauagg

SEQ ID NO: 982004 - RNA, 22 nt, Human
ugaaauguguaauguggaugcc

SEQ ID NO: 982005 - RNA, 21 nt, Human
ccugggccaaauucccuggac

SEQ ID NO: 982006 - RNA, 22 nt, Human
cuggccaacuugcuuguuggca

SEQ ID NO: 982007 - RNA, 22 nt, Human
aguaugaagaugaugaaaaaua

SEQ ID NO: 982008 - RNA, 22 nt, Human
uggcaacaccuggaagacaugg

SEQ ID NO: 982009 - RNA, 22 nt, Human
cagacaggguccuguccgucac

SEQ ID NO: 982010 - RNA, 22 nt, Human
auucacaaguucuagggauuag

SEQ ID NO: 982011 - RNA, 22 nt, Human
ccuggccagggucugggcugcu

SEQ ID NO: 982012 - RNA, 22 nt, Human
caauaagccagguguuuguguu

SEQ ID NO: 982013 - RNA, 22 nt, Human
cauguuaaugaauuuuugcagu

SEQ ID NO: 982014 - RNA, 22 nt, Human
uggccacaugcgucugugaggc

SEQ ID NO: 982015 - RNA, 22 nt, Human
caugcaggcccgccugaauggg

SEQ ID NO: 982016 - RNA, 22 nt, Human
accuuauuuugaaauagauugu

SEQ ID NO: 982017 - RNA, 22 nt, Human
cucuuuaaaguaaaauuugucu

SEQ ID NO: 982018 - RNA, 22 nt, Human
uuuucauuguuccucgagcauu

SEQ ID NO: 982019 - RNA, 22 nt, Human
uaaaaugacuuccuccaacauc

SEQ ID NO: 982020 - RNA, 20 nt, Human
uuggccaaaucuuagucaug

SEQ ID NO: 982021 - RNA, 22 nt, Human
acuccugguucccaguugagau

SEQ ID NO: 982022 - RNA, 22 nt, Human
auuaggaaacugaaugucagaa

SEQ ID NO: 982023 - RNA, 22 nt, Human
ccuggccauuugaacuucagac

SEQ ID NO: 982024 - RNA, 22 nt, Human
uauccaaaguuucucagaaacu

SEQ ID NO: 982025 - RNA, 22 nt, Human
ucucuggcagggauaucuggcu

SEQ ID NO: 982026 - RNA, 22 nt, Human
uguuggcagauugucuaggguu

SEQ ID NO: 982027 - RNA, 22 nt, Human
uagcacugaaucacaugcugcu

SEQ ID NO: 982028 - RNA, 23 nt, Human
ucugggccacuugucugcacuuc

SEQ ID NO: 982029 - RNA, 22 nt, Human
ggccaaaugaaaucugagcaau

SEQ ID NO: 982030 - RNA, 22 nt, Human
aaugugcagaugaauaaacaaa

SEQ ID NO: 982031 - RNA, 22 nt, Human
ucauugaaugcucugcagguug

SEQ ID NO: 982032 - RNA, 22 nt, Human
ucacucuggccucugcagcagu

SEQ ID NO: 982033 - RNA, 22 nt, Human
cugagccaguagucagggacaa

SEQ ID NO: 982034 - RNA, 22 nt, Human
acucugcucccuaagccaugau

SEQ ID NO: 982035 - RNA, 21 nt, Human
uuucacaaaaguaugugacaa

SEQ ID NO: 982036 - RNA, 22 nt, Human
uggcaucauagccaaggugcuu

SEQ ID NO: 982037 - RNA, 22 nt, Human
gucuggccugccagcucuggug

SEQ ID NO: 982038 - RNA, 22 nt, Human
aaagauaugucuccaaagagau

SEQ ID NO: 982039 - RNA, 22 nt, Human
aauaguaaaagauacagcuaau

SEQ ID NO: 982040 - RNA, 22 nt, Human
aguuuaaaucauguuuuguaac

SEQ ID NO: 982041 - RNA, 22 nt, Human
gcuccugggcccugggcuaacu

SEQ ID NO: 982042 - RNA, 19 nt, Human
agucugcauuucuagcaag

SEQ ID NO: 982043 - RNA, 22 nt, Human
uuagagaugucccaaaaugaag

SEQ ID NO: 982044 - RNA, 22 nt, Human
ucacucugaaugguacugagga

SEQ ID NO: 982045 - RNA, 22 nt, Human
uuuaggaugcucuauucugacu

SEQ ID NO: 982046 - RNA, 19 nt, Human
ucuaagccucaauguuuuc

SEQ ID NO: 982047 - RNA, 22 nt, Human
uggucuaaauauggcucuaaau

SEQ ID NO: 982048 - RNA, 23 nt, Human
acucagcuuugggagaugacuca

SEQ ID NO: 982049 - RNA, 22 nt, Human
aucaggauguuuggcugucaua

SEQ ID NO: 982050 - RNA, 22 nt, Human
cgcaccacugaauuccagccug

SEQ ID NO: 982051 - RNA, 22 nt, Human
agggaagugaaugacagauauc

SEQ ID NO: 982052 - RNA, 22 nt, Human
acuaacauguuaaucaaaagaa

SEQ ID NO: 982053 - RNA, 22 nt, Human
augguacaaaauguauaaaguc

SEQ ID NO: 982054 - RNA, 22 nt, Human
caaguaaagaaucacauuucuu

SEQ ID NO: 982055 - RNA, 22 nt, Human
aagugccaucauagcauggcug

SEQ ID NO: 982056 - RNA, 22 nt, Human
ccugagccuggcucaugcacuc

SEQ ID NO: 982057 - RNA, 22 nt, Human
cucucuggaccucaacuauuuu

SEQ ID NO: 982058 - RNA, 22 nt, Human
aauaaaaugaacugguagaguu

SEQ ID NO: 982059 - RNA, 22 nt, Human
auuagguaagauaaagcagagg

SEQ ID NO: 982060 - RNA, 22 nt, Human
aaaagguaguugccaaauaagg

SEQ ID NO: 982061 - RNA, 22 nt, Human
aauaauguuaugucauucuucu

SEQ ID NO: 982062 - RNA, 22 nt, Human
augauguugauaaauuacuuua

SEQ ID NO: 982063 - RNA, 22 nt, Human
aggauaguugugaagauaggcu

SEQ ID NO: 982064 - RNA, 22 nt, Human
ucacucuguuuuacucacuguu

SEQ ID NO: 982065 - RNA, 22 nt, Human
acauucaaggccuucugacaca

SEQ ID NO: 982066 - RNA, 22 nt, Human
uuuuuauaugaaggauagugcg

SEQ ID NO: 982067 - RNA, 22 nt, Human
cuuauuagugucugucugaguu

SEQ ID NO: 982068 - RNA, 22 nt, Human
uagaauaugugguguauacuuu

SEQ ID NO: 982069 - RNA, 22 nt, Human
uccuguuaguguuagacuuccc

SEQ ID NO: 982070 - RNA, 22 nt, Human
gucaucuuugcccugugcagga

SEQ ID NO: 982071 - RNA, 22 nt, Human
cugagggucaacuugauuguau

SEQ ID NO: 982072 - RNA, 22 nt, Human
aggaagaauguuuacauaucaa

SEQ ID NO: 982073 - RNA, 22 nt, Human
uccaagggcagcagccauagcc

SEQ ID NO: 982074 - RNA, 22 nt, Human
cugggccacaagccugugugau

SEQ ID NO: 982075 - RNA, 19 nt, Human
caugcugaccugcuguggu

SEQ ID NO: 982076 - RNA, 22 nt, Human
cuaccuuucugacucuugggau

SEQ ID NO: 982077 - RNA, 22 nt, Human
uagggauggcagcauguagcuu

SEQ ID NO: 982078 - RNA, 19 nt, Human
cugggccagagcuguccuc

SEQ ID NO: 982079 - RNA, 22 nt, Human
cgagcaugaugacggcuguggc

SEQ ID NO: 982080 - RNA, 22 nt, Human
accuguuuggaggagguguuag

SEQ ID NO: 982081 - RNA, 22 nt, Human
auuagguuagugugcaagagaa

SEQ ID NO: 982082 - RNA, 22 nt, Human
gauuaggagggagaggcaagua

SEQ ID NO: 982083 - RNA, 22 nt, Human
uuauucaggcucucuuuggcua

SEQ ID NO: 982084 - RNA, 22 nt, Human
caaaaguagugaaguuguacau

SEQ ID NO: 982085 - RNA, 22 nt, Human
gugcaagguacauccuugaugu

SEQ ID NO: 982086 - RNA, 22 nt, Human
aaguuuguucagggcuuacauu

SEQ ID NO: 982087 - RNA, 22 nt, Human
ucuuguuaucaggaaaacagua

SEQ ID NO: 982088 - RNA, 22 nt, Human
accuuuuuguucuguucucagc

SEQ ID NO: 982089 - RNA, 22 nt, Human
gaguuauuuugagcagaugguu

SEQ ID NO: 982090 - RNA, 22 nt, Human
uuagugauuacuacauagauga

SEQ ID NO: 982091 - RNA, 22 nt, Human
uuccuggcauagagagggcaca

SEQ ID NO: 982092 - RNA, 23 nt, Human
aacugagauaauguauguaaagc

SEQ ID NO: 982093 - RNA, 22 nt, Human
cagcugugaauugucuuaucua

SEQ ID NO: 982094 - RNA, 22 nt, Human
cucuggccuggggccugcuccc

SEQ ID NO: 982095 - RNA, 23 nt, Human
ggccacaaauagucuccccuggc

SEQ ID NO: 982096 - RNA, 22 nt, Human
aaagcagcagcaccugcauuuc

SEQ ID NO: 982097 - RNA, 22 nt, Human
uuaaagagucuacugcacaucc

SEQ ID NO: 982098 - RNA, 22 nt, Human
cucugcuuuuuaaaaggagucc

SEQ ID NO: 982099 - RNA, 22 nt, Human
ccuggccagcgccggcugcucg

SEQ ID NO: 982100 - RNA, 22 nt, Human
agggaagaugucucaucuuagg

SEQ ID NO: 982101 - RNA, 22 nt, Human
agcugaaagugcuuugaggacu

SEQ ID NO: 982102 - RNA, 22 nt, Human
cugggccagggaggugucugua

SEQ ID NO: 982103 - RNA, 22 nt, Human
caaauaguaugagcaaugauuc

SEQ ID NO: 982104 - RNA, 22 nt, Human
aaccaggugacucauggugagc

SEQ ID NO: 982105 - RNA, 22 nt, Human
uaugucuugcauuuuucaaacu

SEQ ID NO: 982106 - RNA, 22 nt, Human
uuuaauuaggaaaugggcaggg

SEQ ID NO: 982107 - RNA, 22 nt, Human
acucugcugucugauggcagga

SEQ ID NO: 982108 - RNA, 21 nt, Human
auuuggauauugcuggcaaau

SEQ ID NO: 982109 - RNA, 22 nt, Human
ucuccuggcucuaaaaggcugu

SEQ ID NO: 982110 - RNA, 22 nt, Human
cuccuggcucugccacuuacua

SEQ ID NO: 982111 - RNA, 22 nt, Human
cugccuggguucaaguccuguu

SEQ ID NO: 982112 - RNA, 22 nt, Human
uuggcagcagggaguuggccgc

SEQ ID NO: 982113 - RNA, 22 nt, Human
aaaauaacuucuacuauuugca

SEQ ID NO: 982114 - RNA, 22 nt, Human
uggcagcagcuaacuuaggcag

SEQ ID NO: 982115 - RNA, 21 nt, Human
agacaguaacucuucuacucc

SEQ ID NO: 982116 - RNA, 22 nt, Human
acacauuuaaaaaggaacauau

SEQ ID NO: 982117 - RNA, 22 nt, Human
aaagauguuuuauaaguuaugg

SEQ ID NO: 982118 - RNA, 22 nt, Human
uguuuaaucuauaaaauggaga

SEQ ID NO: 982119 - RNA, 22 nt, Human
ucuccugggugcuuuaucagaa

SEQ ID NO: 982120 - RNA, 22 nt, Human
aacaauaauugcgguucucuau

SEQ ID NO: 982121 - RNA, 22 nt, Human
cucauacauaugccauuccugc

SEQ ID NO: 982122 - RNA, 22 nt, Human
uaaaaaguagugagaauggcgc

SEQ ID NO: 982123 - RNA, 22 nt, Human
cuaagccacucaaaucuugugg

SEQ ID NO: 982124 - RNA, 22 nt, Human
gcacucuguuucuccugucagc

SEQ ID NO: 982125 - RNA, 22 nt, Human
aggccaaagcacagagcuggaa

SEQ ID NO: 982126 - RNA, 22 nt, Human
ucuggcaaaggcaaccacaguu

SEQ ID NO: 982127 - RNA, 22 nt, Human
acuuugaaacuaaaauucauua

SEQ ID NO: 982128 - RNA, 22 nt, Human
acagcaugucuaguuaaauacu

SEQ ID NO: 982129 - RNA, 22 nt, Human
ugcucuucggggccacugcuug

SEQ ID NO: 982130 - RNA, 22 nt, Human
cagggucugaaacugaucacag

SEQ ID NO: 982131 - RNA, 22 nt, Human
agugaacaaagguagugagcau

SEQ ID NO: 982132 - RNA, 22 nt, Human
acucugcuaaauguaaguuggu

SEQ ID NO: 982133 - RNA, 22 nt, Human
gucaucuucgcagagugauuuu

SEQ ID NO: 982134 - RNA, 21 nt, Human
gcuccuggugcugcguggcgc

SEQ ID NO: 982135 - RNA, 22 nt, Human
uaggaugaucuuguagagagau

SEQ ID NO: 982136 - RNA, 19 nt, Human
gcuccuggaugaccugugg

SEQ ID NO: 982137 - RNA, 22 nt, Human
uacucugcucauuggagugugu

SEQ ID NO: 982138 - RNA, 22 nt, Human
uacucugcaggauggacuaugg

SEQ ID NO: 982139 - RNA, 22 nt, Human
aacucugcuuauaguuugucca

SEQ ID NO: 982140 - RNA, 22 nt, Human
cuccugcgguacuacugugcuu

SEQ ID NO: 982141 - RNA, 22 nt, Human
agucuuaacuaugcaaguacua

SEQ ID NO: 982142 - RNA, 22 nt, Human
accuuuuccagcuucuagaggc

SEQ ID NO: 982143 - RNA, 22 nt, Human
uugagggucuggaucugcugcu

SEQ ID NO: 982144 - RNA, 22 nt, Human
uucaggauucuuucagacuggg

SEQ ID NO: 982145 - RNA, 22 nt, Human
gacucugcuacaggccgagguu

SEQ ID NO: 982146 - RNA, 19 nt, Human
ugcuagaaauucugugacu

SEQ ID NO: 982147 - RNA, 22 nt, Human
uccuggccuccguucucugcau

SEQ ID NO: 982148 - RNA, 18 nt, Human
uuucacaaccuccagagg

SEQ ID NO: 982149 - RNA, 22 nt, Human
auuuauuaccucggaguuucug

SEQ ID NO: 982150 - RNA, 22 nt, Human
uuuaguagaaauauuugggccu

SEQ ID NO: 982151 - RNA, 22 nt, Human
uccuggcccggccgggccugcu

SEQ ID NO: 982152 - RNA, 22 nt, Human
ucacaaagggagggauagcugg

SEQ ID NO: 982153 - RNA, 19 nt, Human
cugggccagaaucagcuca

SEQ ID NO: 982154 - RNA, 22 nt, Human
aaugauggucauggcaacuuuu

SEQ ID NO: 982155 - RNA, 22 nt, Human
auauuaauuauuuacacaugag

SEQ ID NO: 982156 - RNA, 19 nt, Human
cugaggcccauguaccaug

SEQ ID NO: 982157 - RNA, 22 nt, Human
uagaaacacagagagacccaug

SEQ ID NO: 982158 - RNA, 22 nt, Human
uauagcaagcaggacagucuca

SEQ ID NO: 982159 - RNA, 22 nt, Human
acuccaggcaucugcuucugcu

SEQ ID NO: 982160 - RNA, 22 nt, Human
gcagcauacagggagaguacuc

SEQ ID NO: 982161 - RNA, 23 nt, Human
ugucuggcucauggugggucuca

SEQ ID NO: 982162 - RNA, 22 nt, Human
caaauaguuuuucauguauuau

SEQ ID NO: 982163 - RNA, 22 nt, Human
ccuccuggccugugcagagccc

SEQ ID NO: 982164 - RNA, 22 nt, Human
cugaagccaugugcucacuggu

SEQ ID NO: 982165 - RNA, 22 nt, Human
cacccacauggaaauucacagu

SEQ ID NO: 982166 - RNA, 22 nt, Human
cuucacaacgacaucugguuag

SEQ ID NO: 982167 - RNA, 22 nt, Human
acaaaaagcuccauuacugucc

SEQ ID NO: 982168 - RNA, 19 nt, Human
ccucugcuccaguuuccuu

SEQ ID NO: 982169 - RNA, 22 nt, Human
cagcucugaggaacacuccuuu

SEQ ID NO: 982170 - RNA, 22 nt, Human
ucuugcuaaagaccaacacauu

SEQ ID NO: 982171 - RNA, 22 nt, Human
uucagcaauuuuuuaagcuaau

SEQ ID NO: 982172 - RNA, 22 nt, Human
uauuaggguaaauuugacaugc

SEQ ID NO: 982173 - RNA, 22 nt, Human
uuuauauagagauuugugcaug

SEQ ID NO: 982174 - RNA, 21 nt, Human
gucaaacuugcaccagugccc

SEQ ID NO: 982175 - RNA, 22 nt, Human
agcuccugcucuuugucccuaa

SEQ ID NO: 982176 - RNA, 22 nt, Human
uuaguuaggaaacaaaguuguu

SEQ ID NO: 982177 - RNA, 22 nt, Human
acuuccugaauggggcuaauua

SEQ ID NO: 982178 - RNA, 22 nt, Human
ccuccuggagcauuggugagga

SEQ ID NO: 982179 - RNA, 22 nt, Human
uaaauacuuuuacuccacugau

SEQ ID NO: 982180 - RNA, 22 nt, Human
ucugcaagauggucuuagaggu

SEQ ID NO: 982181 - RNA, 19 nt, Human
auagaaaggguuaaagaca

SEQ ID NO: 982182 - RNA, 22 nt, Human
agaauaaaucaaauguccugag

SEQ ID NO: 982183 - RNA, 22 nt, Human
uggcagcacaagguggcccaug

SEQ ID NO: 982184 - RNA, 22 nt, Human
aaagacagagcuguaggggaaa

SEQ ID NO: 982185 - RNA, 22 nt, Human
ccaaaaagcucagagauauguu

SEQ ID NO: 982186 - RNA, 22 nt, Human
guauuaggaggaacacaggccu

SEQ ID NO: 982187 - RNA, 22 nt, Human
uuuuaugugcuggacuggcagu

SEQ ID NO: 982188 - RNA, 22 nt, Human
agagggcugcugcacagugcuc

SEQ ID NO: 982189 - RNA, 22 nt, Human
cuucugagcagaccuccugggg

SEQ ID NO: 982190 - RNA, 22 nt, Human
aggccaaaccggauggaaaagg

SEQ ID NO: 982191 - RNA, 22 nt, Human
ggucugaaaauggugaccacca

SEQ ID NO: 982192 - RNA, 22 nt, Human
ccuggccaguuuccaggcccug

SEQ ID NO: 982193 - RNA, 22 nt, Human
uggucaaauuuagucucuggaa

SEQ ID NO: 982194 - RNA, 22 nt, Human
aggagacauaacuaugaugaga

SEQ ID NO: 982195 - RNA, 21 nt, Human
cucucugcuuaugaauaguga

SEQ ID NO: 982196 - RNA, 22 nt, Human
uguuuaauucaccaucauguuc

SEQ ID NO: 982197 - RNA, 22 nt, Human
caccuugugauccucuugccuu

SEQ ID NO: 982198 - RNA, 22 nt, Human
auggccaagaauauuucucaac

SEQ ID NO: 982199 - RNA, 22 nt, Human
aaguaugcaaaucgucuuagaa

SEQ ID NO: 982200 - RNA, 18 nt, Human
ucauuagggauugcaaag

SEQ ID NO: 982201 - RNA, 22 nt, Human
aacauuucagcaccugauuccu

SEQ ID NO: 982202 - RNA, 22 nt, Human
ucugagccaccugccagugcug

SEQ ID NO: 982203 - RNA, 22 nt, Human
cuuauuagaguuguguucuguu

SEQ ID NO: 982204 - RNA, 22 nt, Human
cugggcaauaugcugggccugg

SEQ ID NO: 982205 - RNA, 22 nt, Human
guguugacucuuggacuucaag

SEQ ID NO: 982206 - RNA, 22 nt, Human
cuuauuagaaagaaaagacaug

SEQ ID NO: 982207 - RNA, 20 nt, Human
uccuggccucccuggggcuc

SEQ ID NO: 982208 - RNA, 22 nt, Human
uccuggcccacuaugccagcau

SEQ ID NO: 982209 - RNA, 22 nt, Human
guugaaauuugugauaauuuag

SEQ ID NO: 982210 - RNA, 22 nt, Human
ugaauaagaauuauuauaauga

SEQ ID NO: 982211 - RNA, 22 nt, Human
uauucacaggcuggagugaugu

SEQ ID NO: 982212 - RNA, 22 nt, Human
aaaauauuuuagggccaggaga

SEQ ID NO: 982213 - RNA, 22 nt, Human
ggccaaaucuguaaggcaagau

SEQ ID NO: 982214 - RNA, 22 nt, Human
aauacugccugugagguaacuc

SEQ ID NO: 982215 - RNA, 22 nt, Human
uugccacugaaccagucuugca

SEQ ID NO: 982216 - RNA, 22 nt, Human
aauagaauguaaucuaauacau

SEQ ID NO: 982217 - RNA, 22 nt, Human
uuuauaaguacuuugucugcuu

SEQ ID NO: 982218 - RNA, 22 nt, Human
uuuucauuguuacuaugagcua

SEQ ID NO: 982219 - RNA, 22 nt, Human
augcccaaugucacaauuuuug

SEQ ID NO: 982220 - RNA, 22 nt, Human
ugcugaaacaauaacauacugg

SEQ ID NO: 982221 - RNA, 22 nt, Human
agucugcuuccuggagaacuca

SEQ ID NO: 982222 - RNA, 22 nt, Human
aacucuggagcacgcccuggcc

SEQ ID NO: 982223 - RNA, 22 nt, Human
acaguguuuuaugagaauuguu

SEQ ID NO: 982224 - RNA, 20 nt, Human
augcaaacccugcuuugugg

SEQ ID NO: 982225 - RNA, 18 nt, Human
ugucaucuguuuaaaacc

SEQ ID NO: 982226 - RNA, 22 nt, Human
ugucaucugauauuacuuauag

SEQ ID NO: 982227 - RNA, 22 nt, Human
ucaaaacacuauuaccuuuaau

SEQ ID NO: 982228 - RNA, 22 nt, Human
acauuuaaauaugccuuauauu

SEQ ID NO: 982229 - RNA, 22 nt, Human
uccugggcgguuaugugaucug

SEQ ID NO: 982230 - RNA, 22 nt, Human
uuucacaauuuuaaggagcaaa

SEQ ID NO: 982231 - RNA, 22 nt, Human
aaaucagucccucuuggaauuu

SEQ ID NO: 982232 - RNA, 22 nt, Human
ucuccuggcucaccaggcugga

SEQ ID NO: 982233 - RNA, 22 nt, Human
aaaucaguaaauguucauuaac

SEQ ID NO: 982234 - RNA, 22 nt, Human
ucaaaaaguugaagaguugggg

SEQ ID NO: 982235 - RNA, 20 nt, Human
uauauaggaaauauuguguu

SEQ ID NO: 982236 - RNA, 22 nt, Human
uaaccaaagggccuaaggaaug

SEQ ID NO: 982237 - RNA, 22 nt, Human
gcucugcugucuucuugcaggc

SEQ ID NO: 982238 - RNA, 22 nt, Human
gcuggccaggugcuuugguucu

SEQ ID NO: 982239 - RNA, 22 nt, Human
cuccugugggucaccaauaggc

SEQ ID NO: 982240 - RNA, 21 nt, Human
gugguucuagagaaacagaau

SEQ ID NO: 982241 - RNA, 22 nt, Human
uuuaggauauuaauguucagag

SEQ ID NO: 982242 - RNA, 22 nt, Human
ucacucugagaggucacuggaa

SEQ ID NO: 982243 - RNA, 22 nt, Human
aaauaaguaguuuaguguugug

SEQ ID NO: 982244 - RNA, 22 nt, Human
uuuuauuaguggcuagaugggg

SEQ ID NO: 982245 - RNA, 22 nt, Human
auuccaaagccugaauaaugga

SEQ ID NO: 982246 - RNA, 22 nt, Human
ugcugaaaacucaaccauugug

SEQ ID NO: 982247 - RNA, 22 nt, Human
ucugagccaauuucugugucca

SEQ ID NO: 982248 - RNA, 22 nt, Human
uuuuaauugcaauuaugguccc

SEQ ID NO: 982249 - RNA, 22 nt, Human
cagucauuuuauuugaaaauua

SEQ ID NO: 982250 - RNA, 22 nt, Human
ucuggccacccgaggccccugc

SEQ ID NO: 982251 - RNA, 22 nt, Human
uuuuauauggcacauugguugg

SEQ ID NO: 982252 - RNA, 22 nt, Human
gauuaggacauggauguauguu

SEQ ID NO: 982253 - RNA, 22 nt, Human
cagcugacgccagaguggaauu

SEQ ID NO: 982254 - RNA, 22 nt, Human
aaauauguauggaguucaugaa

SEQ ID NO: 982255 - RNA, 22 nt, Human
augcccugaggaaugucacgcu

SEQ ID NO: 982256 - RNA, 22 nt, Human
gcuccuggucuggagcuucaag

SEQ ID NO: 982257 - RNA, 22 nt, Human
aaaagcuagucaaugauguauu

SEQ ID NO: 982258 - RNA, 22 nt, Human
cuguuuauagcagagcaagccu

SEQ ID NO: 982259 - RNA, 22 nt, Human
aacucugcagugacuuauaaag

SEQ ID NO: 982260 - RNA, 22 nt, Human
auuaggacacauacauguacag

SEQ ID NO: 982261 - RNA, 22 nt, Human
guggccaagagauaaaauugug

SEQ ID NO: 982262 - RNA, 22 nt, Human
gcucugcugggugggcaguuau

SEQ ID NO: 982263 - RNA, 22 nt, Human
cugggccaaaagaaguguucuu

SEQ ID NO: 982264 - RNA, 22 nt, Human
uucaacuagauuuauacaauuc

SEQ ID NO: 982265 - RNA, 22 nt, Human
ccuccuggaggcucuaagggag

SEQ ID NO: 982266 - RNA, 22 nt, Human
auggccaagcaugccuguggcc

SEQ ID NO: 982267 - RNA, 22 nt, Human
ugcaccuuguccauuuuuggcc

SEQ ID NO: 982268 - RNA, 22 nt, Human
uaccucacugggccucaguuuu

SEQ ID NO: 982269 - RNA, 22 nt, Human
acauagaaccuggcacauagua

SEQ ID NO: 982270 - RNA, 22 nt, Human
cuccuggcuuucccagaccagg

SEQ ID NO: 982271 - RNA, 22 nt, Human
ugcaccuucauuuuaggcagcu

SEQ ID NO: 982272 - RNA, 22 nt, Human
aaauaguucagcuuguaaaccc

SEQ ID NO: 982273 - RNA, 22 nt, Human
accuuuuauguaaauauauguu

SEQ ID NO: 982274 - RNA, 22 nt, Human
accuauuuaugcaauuaugaaa

SEQ ID NO: 982275 - RNA, 22 nt, Human
uuuuauugucaaugaagacaga

SEQ ID NO: 982276 - RNA, 22 nt, Human
uuuauaagaagcaaugucugag

SEQ ID NO: 982277 - RNA, 22 nt, Human
aaaaguaauugcaauuuuguag

SEQ ID NO: 982278 - RNA, 22 nt, Human
gcuggccacacugcugauggag

SEQ ID NO: 982279 - RNA, 22 nt, Human
guggccaagggacucuaaggca

SEQ ID NO: 982280 - RNA, 22 nt, Human
gucugucuguuguugagaagca

SEQ ID NO: 982281 - RNA, 22 nt, Human
uaaauaugcauguauccuuauc

SEQ ID NO: 982282 - RNA, 22 nt, Human
acuggccagguucaaaauacag

SEQ ID NO: 982283 - RNA, 22 nt, Human
auucacaaagaagggaaguaca

SEQ ID NO: 982284 - RNA, 22 nt, Human
cucaugucuucacccauucuaa

SEQ ID NO: 982285 - RNA, 22 nt, Human
ggccacaacuugcuccuagccc

SEQ ID NO: 982286 - RNA, 22 nt, Human
cuauuagguaugugguugcuau

SEQ ID NO: 982287 - RNA, 22 nt, Human
uuaauaaacaggugcagcugaa

SEQ ID NO: 982288 - RNA, 22 nt, Human
cugugccaggcccagcugacuu

SEQ ID NO: 982289 - RNA, 22 nt, Human
aacugcuguggccuaguacuua

SEQ ID NO: 982290 - RNA, 22 nt, Human
uaaaguauauuuuuucucaaua

SEQ ID NO: 982291 - RNA, 22 nt, Human
uccaagggcuuuggcgugaagu

SEQ ID NO: 982292 - RNA, 22 nt, Human
uuguauucauugcuuacccaau

SEQ ID NO: 982293 - RNA, 18 nt, Human
uguuaggaagggcacaca

SEQ ID NO: 982294 - RNA, 22 nt, Human
gacauaaaauucaauaauuugu

SEQ ID NO: 982295 - RNA, 22 nt, Human
uaggaugacacagcaaguauag

SEQ ID NO: 982296 - RNA, 19 nt, Human
aggucuaaucauaagacaa

SEQ ID NO: 982297 - RNA, 22 nt, Human
uccuggcccuguggccugcagu

SEQ ID NO: 982298 - RNA, 22 nt, Human
agcuccugaaaauccagacugg

SEQ ID NO: 982299 - RNA, 22 nt, Human
aucuacaggauaguuuaauauu

SEQ ID NO: 982300 - RNA, 22 nt, Human
uuuuaauacugcuauuguagga

SEQ ID NO: 982301 - RNA, 22 nt, Human
aguguacaguuuguaguacuac

SEQ ID NO: 982302 - RNA, 22 nt, Human
aaaguuugagugauuugacaca

SEQ ID NO: 982303 - RNA, 22 nt, Human
cugccuugguuucuagcagggc

SEQ ID NO: 982304 - RNA, 21 nt, Human
aaaaagcuggggcaugcaugc

SEQ ID NO: 982305 - RNA, 22 nt, Human
ccuggccaggcauggagucaca

SEQ ID NO: 982306 - RNA, 22 nt, Human
uccaagggcucauggacacuuu

SEQ ID NO: 982307 - RNA, 22 nt, Human
auagucacucuguuagguguuu

SEQ ID NO: 982308 - RNA, 22 nt, Human
agacucugcuaagaauauaauu

SEQ ID NO: 982309 - RNA, 17 nt, Human
aaauaugaccucaaagu

SEQ ID NO: 982310 - RNA, 22 nt, Human
uugcaguugucuuuccuaauuu

SEQ ID NO: 982311 - RNA, 22 nt, Human
uggaagaggcccaugacugccu

SEQ ID NO: 982312 - RNA, 22 nt, Human
uuaggaaucaccugcagaucuu

SEQ ID NO: 982313 - RNA, 20 nt, Human
ggccgaaauaauaguggcuu

SEQ ID NO: 982314 - RNA, 22 nt, Human
aaacugcugguugcuggccagc

SEQ ID NO: 982315 - RNA, 22 nt, Human
auacauacauguacacauaaau

SEQ ID NO: 982316 - RNA, 22 nt, Human
ucaucuaagagucuuacauuua

SEQ ID NO: 982317 - RNA, 22 nt, Human
augcaaaaguaacugugauuuu

SEQ ID NO: 982318 - RNA, 22 nt, Human
guuccaguaugauuccacccau

SEQ ID NO: 982319 - RNA, 22 nt, Human
aaagauuaaaucaaauugguca

SEQ ID NO: 982320 - RNA, 18 nt, Human
uggcagcaggaagccauu

SEQ ID NO: 982321 - RNA, 22 nt, Human
aaauaaguuaaacuagaaugau

SEQ ID NO: 982322 - RNA, 22 nt, Human
auuggucaggacuggcaugugg

SEQ ID NO: 982323 - RNA, 22 nt, Human
cuggccuagcucucugcuugaa

SEQ ID NO: 982324 - RNA, 22 nt, Human
aauucacauguugaaguccuaa

SEQ ID NO: 982325 - RNA, 23 nt, Human
agacaguggccgagagguacuag

SEQ ID NO: 982326 - RNA, 22 nt, Human
ggaagugaggaauuagguuuau

SEQ ID NO: 982327 - RNA, 22 nt, Human
aaaacagacagccaguguagag

SEQ ID NO: 982328 - RNA, 22 nt, Human
uccuugacugugaggaacuagc

SEQ ID NO: 982329 - RNA, 22 nt, Human
uuucuauuuuaaaggcauaugg

SEQ ID NO: 982330 - RNA, 22 nt, Human
acaccuuugccccaagucauag

SEQ ID NO: 982331 - RNA, 22 nt, Human
augcacuaugaugagcuagucu

SEQ ID NO: 982332 - RNA, 20 nt, Human
auucacaaagccaguguugc

SEQ ID NO: 982333 - RNA, 22 nt, Human
aaaugaugcucacagauuagug

SEQ ID NO: 982334 - RNA, 22 nt, Human
uuauuagagugcuuugagaaag

SEQ ID NO: 982335 - RNA, 22 nt, Human
uuaggauagucuguuagaaaag

SEQ ID NO: 982336 - RNA, 21 nt, Human
auuguuaucauugugcugugu

SEQ ID NO: 982337 - RNA, 22 nt, Human
uuggcagauuugucaguaagcu

SEQ ID NO: 982338 - RNA, 22 nt, Human
aauaagaaagagucagcuucag

SEQ ID NO: 982339 - RNA, 22 nt, Human
acucuggcccuccugcugccag

SEQ ID NO: 982340 - RNA, 22 nt, Human
uggcagcagacaucugaggucu

SEQ ID NO: 982341 - RNA, 22 nt, Human
ccuccuggugggcgcuucuggc

SEQ ID NO: 982342 - RNA, 22 nt, Human
auguuuuauauuuugcagcagu

SEQ ID NO: 982343 - RNA, 20 nt, Human
ccaauaaagcucuauaggga

SEQ ID NO: 982344 - RNA, 22 nt, Human
ucuuggcaauuugaucucaguu

SEQ ID NO: 982345 - RNA, 22 nt, Human
uagaguguuguaauugaaaagg

SEQ ID NO: 982346 - RNA, 22 nt, Human
acauuucagcgugcaugacaug

SEQ ID NO: 982347 - RNA, 22 nt, Human
aagaacauuuaugauggcauuu

SEQ ID NO: 982348 - RNA, 23 nt, Human
cuucacaaucaaaaucaguucug

SEQ ID NO: 982349 - RNA, 22 nt, Human
ucagggaaucagacucugcagc

SEQ ID NO: 982350 - RNA, 22 nt, Human
uaggauaugguagaaaucauuc

SEQ ID NO: 982351 - RNA, 22 nt, Human
aaacagucaugguugcuguuca

SEQ ID NO: 982352 - RNA, 22 nt, Human
uuauugagcacauaguaugugg

SEQ ID NO: 982353 - RNA, 18 nt, Human
gcacucugacugcagagc

SEQ ID NO: 982354 - RNA, 22 nt, Human
agggaaugcuccguauaaaucu

SEQ ID NO: 982355 - RNA, 22 nt, Human
ccugagccucuugcacgcucag

SEQ ID NO: 982356 - RNA, 22 nt, Human
uuuuaguuguacugucaacagu

SEQ ID NO: 982357 - RNA, 17 nt, Human
cagacaggcugucaccc

SEQ ID NO: 982358 - RNA, 22 nt, Human
ucugagccaaaauaaacagcau

SEQ ID NO: 982359 - RNA, 22 nt, Human
ccuuuucaacuaagauucugca

SEQ ID NO: 982360 - RNA, 22 nt, Human
gacacuaaaguauaggguaucu

SEQ ID NO: 982361 - RNA, 22 nt, Human
auucacaacugauccuugcuca

SEQ ID NO: 982362 - RNA, 22 nt, Human
gcugauguuuaguugauguuac

SEQ ID NO: 982363 - RNA, 22 nt, Human
cuguuuauuacacuggauagca

SEQ ID NO: 982364 - RNA, 22 nt, Human
gcugaaauucagauuccuaggc

SEQ ID NO: 982365 - RNA, 22 nt, Human
aaguuugugucagagcuguuac

SEQ ID NO: 982366 - RNA, 22 nt, Human
uacucugcaaguugaagguggc

SEQ ID NO: 982367 - RNA, 22 nt, Human
uuggccaagauacgagcacaua

SEQ ID NO: 982368 - RNA, 22 nt, Human
ugaagggggagauauaugugug

SEQ ID NO: 982369 - RNA, 22 nt, Human
auguggcauucuuggucauuuc

SEQ ID NO: 982370 - RNA, 22 nt, Human
uuucacaaucaaauggugaaau

SEQ ID NO: 982371 - RNA, 22 nt, Human
cucaaauauguggucagaaagc

SEQ ID NO: 982372 - RNA, 22 nt, Human
ucaaaacaaucauuggaugugc

SEQ ID NO: 982373 - RNA, 22 nt, Human
ggucuaaaaugagucuuccuag

SEQ ID NO: 982374 - RNA, 22 nt, Human
aauucacaauguguagucaugc

SEQ ID NO: 982375 - RNA, 22 nt, Human
uuaauaaaguaugaauuggaaa

SEQ ID NO: 982376 - RNA, 22 nt, Human
auucugaguccaugggggcagg

SEQ ID NO: 982377 - RNA, 22 nt, Human
uaggauguagcuaugucaucau

SEQ ID NO: 982378 - RNA, 22 nt, Human
auuuggcauaggcagaggccca

SEQ ID NO: 982379 - RNA, 22 nt, Human
gaguuuaacacuuggagaaaag

SEQ ID NO: 982380 - RNA, 22 nt, Human
auuuauuaagcaucugcuaugu

SEQ ID NO: 982381 - RNA, 22 nt, Human
ucuugaaggggggcaguguuga

SEQ ID NO: 982382 - RNA, 22 nt, Human
uuggccaacauggugaaacccc

SEQ ID NO: 982383 - RNA, 22 nt, Human
gcucugcuguggaauccucucc

SEQ ID NO: 982384 - RNA, 22 nt, Human
uagauaaauuagaaaguuuacu

SEQ ID NO: 982385 - RNA, 22 nt, Human
acuggccaugaacuugggaucu

SEQ ID NO: 982386 - RNA, 22 nt, Human
agcuauguauaaauaggccacu

SEQ ID NO: 982387 - RNA, 20 nt, Human
ucuguaaagacuccagaagc

SEQ ID NO: 982388 - RNA, 22 nt, Human
caaguaugagaaagcuauuacc

SEQ ID NO: 982389 - RNA, 22 nt, Human
uuauuaguguugauauuaggau

SEQ ID NO: 982390 - RNA, 22 nt, Human
ucuggccacuugcuucacacug

SEQ ID NO: 982391 - RNA, 22 nt, Human
ccugggcaggccggacgcuggg

SEQ ID NO: 982392 - RNA, 22 nt, Human
cagacaggcaggugcugcuuug

SEQ ID NO: 982393 - RNA, 22 nt, Human
caacugagcaguagcgucugga

SEQ ID NO: 982394 - RNA, 22 nt, Human
uggucaaaagaaagcucagaac

SEQ ID NO: 982395 - RNA, 22 nt, Human
agacauaagugcuaugacauug

SEQ ID NO: 982396 - RNA, 22 nt, Human
uucuuaagcaccuaaaaagugg

SEQ ID NO: 982397 - RNA, 22 nt, Human
auagugcaguggacugaguuaa

SEQ ID NO: 982398 - RNA, 22 nt, Human
cuggcgcaacagaaaaucugga

SEQ ID NO: 982399 - RNA, 21 nt, Human
uuuuauugaugaauggccacu

SEQ ID NO: 982400 - RNA, 22 nt, Human
uaaaaaguugaaaggacuuauc

SEQ ID NO: 982401 - RNA, 22 nt, Human
gagacagugguugcagaagcuc

SEQ ID NO: 982402 - RNA, 22 nt, Human
auaaaagaaguuuugguacuug

SEQ ID NO: 982403 - RNA, 19 nt, Human
cuuauuagagugagagcuu

SEQ ID NO: 982404 - RNA, 21 nt, Human
aacauuucaggauccaaauug

SEQ ID NO: 982405 - RNA, 21 nt, Human
auguaggguuugccuucucua

SEQ ID NO: 982406 - RNA, 22 nt, Human
gggaggagggugcuggcuaaac

SEQ ID NO: 982407 - RNA, 22 nt, Human
aaauaggagcuuaagcacuucu

SEQ ID NO: 982408 - RNA, 22 nt, Human
aggucaccauggcaugcuccac

SEQ ID NO: 982409 - RNA, 22 nt, Human
acuaugcucauuguuaauauuu

SEQ ID NO: 982410 - RNA, 22 nt, Human
uaugcacacauguaugcaugug

SEQ ID NO: 982411 - RNA, 22 nt, Human
uuggccaauccuauuggguggg

SEQ ID NO: 982412 - RNA, 21 nt, Human
aaguuuguucuuguauagucu

SEQ ID NO: 982413 - RNA, 22 nt, Human
ucuccuggcccugucgccaucu

SEQ ID NO: 982414 - RNA, 22 nt, Human
agcuuuguauuugagcauacga

SEQ ID NO: 982415 - RNA, 22 nt, Human
auuacacaggauuugccuuacu

SEQ ID NO: 982416 - RNA, 22 nt, Human
acuccugggugcauuucugauu

SEQ ID NO: 982417 - RNA, 22 nt, Human
uggcacauaguaggugcucaau

SEQ ID NO: 982418 - RNA, 22 nt, Human
uauuggauagcuugugcagaau

SEQ ID NO: 982419 - RNA, 22 nt, Human
auggccaaauaacagcuugcau

SEQ ID NO: 982420 - RNA, 21 nt, Human
uuccuggcggcagaaacguga

SEQ ID NO: 982421 - RNA, 22 nt, Human
cugcauucauaucagauagaag

SEQ ID NO: 982422 - RNA, 22 nt, Human
caguuuaaccuauccauuaugu

SEQ ID NO: 982423 - RNA, 22 nt, Human
uugauaaaaugaugaaaucacu

SEQ ID NO: 982424 - RNA, 22 nt, Human
ggucugaguagagggcuggcga

SEQ ID NO: 982425 - RNA, 22 nt, Human
gcauugaguccacucugucuuu

SEQ ID NO: 982426 - RNA, 22 nt, Human
uaaaccuugguagcaucuugcu

SEQ ID NO: 982427 - RNA, 22 nt, Human
acauucuaacauuguacagaua

SEQ ID NO: 982428 - RNA, 22 nt, Human
uuucacaacugcuuauuugaga

SEQ ID NO: 982429 - RNA, 22 nt, Human
uuucaaauaccauaaaccuaau

SEQ ID NO: 982430 - RNA, 22 nt, Human
cagggaauccauggucauaagg

SEQ ID NO: 982431 - RNA, 22 nt, Human
ggccaaauuuggccaugagcau

SEQ ID NO: 982432 - RNA, 22 nt, Human
auaaaacuuauuagaauugugu

SEQ ID NO: 982433 - RNA, 22 nt, Human
agaaguauaaagaauguuuaug

SEQ ID NO: 982434 - RNA, 16 nt, Human
ucucugcuucauaggu

SEQ ID NO: 982435 - RNA, 22 nt, Human
auuaaauacugcaggcuaagca

SEQ ID NO: 982436 - RNA, 22 nt, Human
auucuuuuuuaaggaauagaac

SEQ ID NO: 982437 - RNA, 22 nt, Human
auuuauuauugugguuacuucu

SEQ ID NO: 982438 - RNA, 22 nt, Human
guuuauuauucaacuucauguu

SEQ ID NO: 982439 - RNA, 22 nt, Human
caggaggcuccuagggcucugu

SEQ ID NO: 982440 - RNA, 22 nt, Human
guccucugggcagcugccccac

SEQ ID NO: 982441 - RNA, 22 nt, Human
caaaacauucagagagcucacu

SEQ ID NO: 982442 - RNA, 22 nt, Human
auccccagaaaauaggugccua

SEQ ID NO: 982443 - RNA, 22 nt, Human
ccaaggaggccccaggucagcu

SEQ ID NO: 982444 - RNA, 22 nt, Human
ucccagcagggccgaccagccu

SEQ ID NO: 982445 - RNA, 22 nt, Human
uaguccagccuuggguguagcc

SEQ ID NO: 982446 - RNA, 22 nt, Human
ucucacugggucacagcagagg

SEQ ID NO: 982447 - RNA, 18 nt, Human
uguacaguuaugagcauu

SEQ ID NO: 982448 - RNA, 22 nt, Human
gcuuccuggagggagagagcug

SEQ ID NO: 982449 - RNA, 22 nt, Human
ucucagggcagcaaggaagcau

SEQ ID NO: 982450 - RNA, 22 nt, Human
gccugcagaggugcugcuagcu

SEQ ID NO: 982451 - RNA, 22 nt, Human
auuguaaguagaaauguuaugg

SEQ ID NO: 982452 - RNA, 22 nt, Human
ccuccugggccuugcucuguga

SEQ ID NO: 982453 - RNA, 22 nt, Human
uuuucauuguuccucgagcauu

SEQ ID NO: 982454 - RNA, 22 nt, Human
agcagaaccacagcacuguuga

SEQ ID NO: 982455 - RNA, 22 nt, Human
gaggucagucagaccaggguuu

SEQ ID NO: 982456 - RNA, 22 nt, Human
uagccucucuccuccacaaccu

SEQ ID NO: 982457 - RNA, 22 nt, Human
aauaauuuugagagccuggaaa

SEQ ID NO: 982458 - RNA, 22 nt, Human
gcagguggcagaggugggaucu

SEQ ID NO: 982459 - RNA, 22 nt, Human
agccaggaauuggacaacacau

SEQ ID NO: 982460 - RNA, 22 nt, Human
gaagagcuuagacagaaucaaa

SEQ ID NO: 982461 - RNA, 22 nt, Human
acacagccgugaaucugcuucu

SEQ ID NO: 982462 - RNA, 22 nt, Human
aacaugucuggguauucacaag

SEQ ID NO: 982463 - RNA, 22 nt, Human
cagggagcuggcuggcgugagu

SEQ ID NO: 982464 - RNA, 21 nt, Human
cuugaaagguagagucuacag

SEQ ID NO: 982465 - RNA, 22 nt, Human
ccucucuguguggccucuccau

SEQ ID NO: 982466 - RNA, 22 nt, Human
cagagcugugauaaauagauau

SEQ ID NO: 982467 - RNA, 22 nt, Human
uuggccuuaaccucucugugcc

SEQ ID NO: 982468 - RNA, 22 nt, Human
ggucuaaaaugagucuuccuag

SEQ ID NO: 982469 - RNA, 22 nt, Human
uuccucuccucacaugagucac

SEQ ID NO: 982470 - RNA, 22 nt, Human
agauuuccaucuuuuucaugug

SEQ ID NO: 982471 - RNA, 22 nt, Human
ccugggcaggccggacgcuggg

SEQ ID NO: 982472 - RNA, 22 nt, Human
aguggggaagagcaugggcccu

SEQ ID NO: 982473 - RNA, 22 nt, Human
cagcuggaugggagaccauguu

SEQ ID NO: 982474 - RNA, 23 nt, Human
ugcucugggaggcccuggagagc

SEQ ID NO: 982475 - RNA, 22 nt, Human
gcaggagugacauggaugugga

SEQ ID NO: 982476 - RNA, 22 nt, Human
gaaaucugaaucuucuguuggu

SEQ ID NO: 982477 - RNA, 22 nt, Human
cugggcugcaguuccugguccu

SEQ ID NO: 982478 - RNA, 22 nt, Human
auacaucuaugccuuucugaca

SEQ ID NO: 982479 - RNA, 22 nt, Human
auaaaagaaguuuugguacuug

SEQ ID NO: 982480 - RNA, 22 nt, Human
cugcagccuaggugcagcuggg

SEQ ID NO: 982481 - RNA, 22 nt, Human
cucagcagagaccagggaggaa

SEQ ID NO: 982482 - RNA, 22 nt, Human
uggacucagaaguguucuuuua

SEQ ID NO: 982483 - RNA, 22 nt, Human
gcaggagcugcucuccugacga

SEQ ID NO: 982484 - RNA, 22 nt, Human
ggcugaguugagaggauuacuu

SEQ ID NO: 982485 - RNA, 22 nt, Human
cucuggagcauuucaccuacau

SEQ ID NO: 982486 - RNA, 22 nt, Human
ugagcccagagcccuuguaggg

SEQ ID NO: 982487 - RNA, 22 nt, Human
uuucaaugacacaaaagagaaa

SEQ ID NO: 982488 - RNA, 22 nt, Human
gucaucuuccuaguguuaacua

SEQ ID NO: 982489 - RNA, 22 nt, Human
ggcuggcuggcugguagacaag

SEQ ID NO: 982490 - RNA, 22 nt, Human
ucuguuccaguagaaaggugca

SEQ ID NO: 982491 - RNA, 22 nt, Human
ucuguaucacccguucccagaa

SEQ ID NO: 982492 - RNA, 22 nt, Human
cacugcuuucacaguuuguucc

SEQ ID NO: 982493 - RNA, 22 nt, Human
ggccucuggcaggcaggcccuc

SEQ ID NO: 982494 - RNA, 22 nt, Human
uggagcaagcuggagagaacau

SEQ ID NO: 982495 - RNA, 19 nt, Human
uacuuuuucaggacagagu

SEQ ID NO: 982496 - RNA, 22 nt, Human
acagcauugcuccaucucaaga

SEQ ID NO: 982497 - RNA, 22 nt, Human
ggcagcugagcauggcuaccuu

SEQ ID NO: 982498 - RNA, 22 nt, Human
uggcagaaguucacuaguagcu

SEQ ID NO: 982499 - RNA, 22 nt, Human
aaaaugugaucuacaaaugcaa

SEQ ID NO: 982500 - RNA, 20 nt, Human
ucagagucaucaaagauggu

SEQ ID NO: 982501 - RNA, 22 nt, Human
uccucuggggcgugguccugga

SEQ ID NO: 982502 - RNA, 22 nt, Human
cagacagaccugcaagggcaca

SEQ ID NO: 982503 - RNA, 22 nt, Human
acuggccaggcagcaguagcuu

SEQ ID NO: 982504 - RNA, 22 nt, Human
ccagguggcuucugcccgaugu

SEQ ID NO: 982505 - RNA, 22 nt, Human
uguaugcaccauuguauuaccu

SEQ ID NO: 982506 - RNA, 22 nt, Human
ugccaaggguaugggcaagaua

SEQ ID NO: 982507 - RNA, 22 nt, Human
uagcuuuaccauagaagaguau

SEQ ID NO: 982508 - RNA, 22 nt, Human
agccaugcaccuuacucuugcu

SEQ ID NO: 982509 - RNA, 22 nt, Human
aaugcacagcguuccaugcuug

SEQ ID NO: 982510 - RNA, 22 nt, Human
ggcacugaaccaggacacaagc

SEQ ID NO: 982511 - RNA, 22 nt, Human
uauuuccugcauggugauguaa

SEQ ID NO: 982512 - RNA, 22 nt, Human
ugucuuccucuuggcuugagcu

SEQ ID NO: 982513 - RNA, 22 nt, Human
ugaacagauggcccagcagagg

SEQ ID NO: 982514 - RNA, 22 nt, Human
aaguuucauguggagguagacu

SEQ ID NO: 982515 - RNA, 22 nt, Human
uggcccuguggaggucagugag

SEQ ID NO: 982516 - RNA, 22 nt, Human
agcagggcuucugugccugugc

SEQ ID NO: 982517 - RNA, 22 nt, Human
caguaugucuacuggacaaagu

SEQ ID NO: 982518 - RNA, 22 nt, Human
gcaggaugccagggcagcagcg

SEQ ID NO: 982519 - RNA, 18 nt, Human
cugaggccaacuacacug

SEQ ID NO: 982520 - RNA, 22 nt, Human
acaggcagggaccuuggcuaag

SEQ ID NO: 982521 - RNA, 22 nt, Human
ugggugcuucgucagcucugag

SEQ ID NO: 982522 - RNA, 17 nt, Human
gcugccaccuuuggagc

SEQ ID NO: 982523 - RNA, 22 nt, Human
ccucagggaggccucuguggcu

SEQ ID NO: 982524 - RNA, 22 nt, Human
aaacaaguguaaacuagucugu

SEQ ID NO: 982525 - RNA, 22 nt, Human
uggcacaugguaagugcuuaac

SEQ ID NO: 982526 - RNA, 21 nt, Human
uuuauuuauauaggacacaug

SEQ ID NO: 982527 - RNA, 22 nt, Human
auugaaagcacaaagaacaagu

SEQ ID NO: 982528 - RNA, 22 nt, Human
aggagcagaccguaguccugca

SEQ ID NO: 982529 - RNA, 22 nt, Human
ugccugggagugaccaagacuc

SEQ ID NO: 982530 - RNA, 22 nt, Human
ggagcagagcucuucaucugca

SEQ ID NO: 982531 - RNA, 22 nt, Human
ggcacagggagccgcaguugca

SEQ ID NO: 982532 - RNA, 22 nt, Human
aucaguuuguauaugaaacacu

SEQ ID NO: 982533 - RNA, 22 nt, Human
aaauaggagcuuaagcacuucu

SEQ ID NO: 982534 - RNA, 22 nt, Human
aaguucaaguaguguuacaugg

SEQ ID NO: 982535 - RNA, 17 nt, Human
cuccuggcagccucagg

SEQ ID NO: 982536 - RNA, 19 nt, Human
gcauuucucuuuacagcca

SEQ ID NO: 982537 - RNA, 22 nt, Human
uacagaaaaacuggcauugaag

SEQ ID NO: 982538 - RNA, 22 nt, Human
ccaggacuucgaggcuacagug

SEQ ID NO: 982539 - RNA, 22 nt, Human
caaauguguaaggaaguguuag

SEQ ID NO: 982540 - RNA, 21 nt, Human
cucaggauggcggccuggugg

SEQ ID NO: 982541 - RNA, 22 nt, Human
cagccagggagggcaaaugaga

SEQ ID NO: 982542 - RNA, 22 nt, Human
ccugggcucuauccugacccag

SEQ ID NO: 982543 - RNA, 22 nt, Human
acagacagauuuugucugaugu

SEQ ID NO: 982544 - RNA, 22 nt, Human
ccagcugauucgguggugguug

SEQ ID NO: 982545 - RNA, 22 nt, Human
gggacagcuguagugcuuggcu

SEQ ID NO: 982546 - RNA, 22 nt, Human
gccugccuuuuggaggcacauu

SEQ ID NO: 982547 - RNA, 22 nt, Human
ugaaggaaugaguauacuguuu

SEQ ID NO: 982548 - RNA, 22 nt, Human
ucugucacucuagagauggcag

SEQ ID NO: 982549 - RNA, 22 nt, Human
uucagcagucguccaggaaaag

SEQ ID NO: 982550 - RNA, 22 nt, Human
ucauugcaguugaguuguguua

SEQ ID NO: 982551 - RNA, 22 nt, Human
cagaggaggccaccgcauaggc

SEQ ID NO: 982552 - RNA, 22 nt, Human
uuuuauucuaaguaugauggga

SEQ ID NO: 982553 - RNA, 20 nt, Human
gugugaagcccucaggagga

SEQ ID NO: 982554 - RNA, 22 nt, Human
uaugaagaaguucugugaaaug

SEQ ID NO: 982555 - RNA, 22 nt, Human
uugacaagaaucguugccuugg

SEQ ID NO: 982556 - RNA, 22 nt, Human
agagaaaagaguucaggcuuug

SEQ ID NO: 982557 - RNA, 22 nt, Human
cauugacaguucuuuaaguugc

SEQ ID NO: 982558 - RNA, 22 nt, Human
aaggagagguuguccguguugu

SEQ ID NO: 982559 - RNA, 22 nt, Human
uggcucugagacacaggcucuc

SEQ ID NO: 982560 - RNA, 22 nt, Human
gagggacagcuaaagagaaauu

SEQ ID NO: 982561 - RNA, 22 nt, Human
cagcauugaucccaggcugugg

SEQ ID NO: 982562 - RNA, 22 nt, Human
gccucugggcucugccccuggc

SEQ ID NO: 982563 - RNA, 22 nt, Human
ccuggcucuguccucgcgcaaa

SEQ ID NO: 982564 - RNA, 22 nt, Human
cuggccaguuguccuggcuugg

SEQ ID NO: 982565 - RNA, 19 nt, Human
acacagggaucagaggguu

SEQ ID NO: 982566 - RNA, 21 nt, Human
acaguucaugauaacuccauc

SEQ ID NO: 982567 - RNA, 20 nt, Human
gaaaugugaccucuucugug

SEQ ID NO: 982568 - RNA, 23 nt, Human
uggcuucugccccauucucucca

SEQ ID NO: 982569 - RNA, 22 nt, Human
ugacacagauuagagacauacc

SEQ ID NO: 982570 - RNA, 22 nt, Human
cugggagguggagguugcauug

SEQ ID NO: 982571 - RNA, 22 nt, Human
uagucaaaccucagaauacccc

SEQ ID NO: 982572 - RNA, 22 nt, Human
ggcucugcugguaagaugccuc

SEQ ID NO: 982573 - RNA, 22 nt, Human
acaugcuuucuagguccuucug

SEQ ID NO: 982574 - RNA, 22 nt, Human
ucuguaaauccugcucagcaac

SEQ ID NO: 982575 - RNA, 20 nt, Human
accucugcaucaauccuuug

SEQ ID NO: 982576 - RNA, 22 nt, Human
cccacucccugcacgccugccg

SEQ ID NO: 982577 - RNA, 22 nt, Human
uaagaacauuuucggaaagaua

SEQ ID NO: 982578 - RNA, 22 nt, Human
cugggagcggcugucacugguu

SEQ ID NO: 982579 - RNA, 22 nt, Human
ccugcucugguuuagucagucu

SEQ ID NO: 982580 - RNA, 22 nt, Human
ucagcugccucucccuggaaga

SEQ ID NO: 982581 - RNA, 22 nt, Human
gcagagccgugaauggauuuca

SEQ ID NO: 982582 - RNA, 22 nt, Human
cuaaaugcccuacaaugacugg

SEQ ID NO: 982583 - RNA, 19 nt, Human
acaggcagaauugggugug

SEQ ID NO: 982584 - RNA, 22 nt, Human
uggggccugagguggagcugca

SEQ ID NO: 982585 - RNA, 22 nt, Human
gcuguuaggugcccugaccuug

SEQ ID NO: 982586 - RNA, 22 nt, Human
cugccugcuucugagccagagg

SEQ ID NO: 982587 - RNA, 22 nt, Human
auaaaaccaaagcagcaguguu

SEQ ID NO: 982588 - RNA, 19 nt, Human
uccuucagucagaucuggg

SEQ ID NO: 982589 - RNA, 22 nt, Human
gcagcauacagggagaguacuc

SEQ ID NO: 982590 - RNA, 22 nt, Human
ucuggcucaucucuccagguaa

SEQ ID NO: 982591 - RNA, 22 nt, Human
cccaggcagucuggcucuaaag

SEQ ID NO: 982592 - RNA, 22 nt, Human
caggacagguguucuagaucag

SEQ ID NO: 982593 - RNA, 22 nt, Human
ugccagggcugcuacuggcuga

SEQ ID NO: 982594 - RNA, 22 nt, Human
uagggcuauucugaguaauaau

SEQ ID NO: 982595 - RNA, 22 nt, Human
augagcuucccagacaggaugg

SEQ ID NO: 982596 - RNA, 22 nt, Human
cuuccucugcggcgccgggcgc

SEQ ID NO: 982597 - RNA, 22 nt, Human
uuuauagggacaguucuuggag

SEQ ID NO: 982598 - RNA, 22 nt, Human
caggcugccgugaagcaggccu

SEQ ID NO: 982599 - RNA, 22 nt, Human
caggccagguggcaggcaaaac

SEQ ID NO: 982600 - RNA, 22 nt, Human
aaaucaguuggaacacaagcag

SEQ ID NO: 982601 - RNA, 20 nt, Human
ugcagggcucugcuucucuc

SEQ ID NO: 982602 - RNA, 22 nt, Human
gguugccggggcaggacuggaa

SEQ ID NO: 982603 - RNA, 22 nt, Human
uaccucacugggccucaguuuu

SEQ ID NO: 982604 - RNA, 20 nt, Human
uccaagggcagcagaaucag

SEQ ID NO: 982605 - RNA, 22 nt, Human
uugcauuguugcaaugaaguau

SEQ ID NO: 982606 - RNA, 17 nt, Human
uccuucagggccucaca

SEQ ID NO: 982607 - RNA, 22 nt, Human
augcccgauaccuaguuaacuc

SEQ ID NO: 982608 - RNA, 22 nt, Human
uguggcugucuguucuccuagg

SEQ ID NO: 982609 - RNA, 22 nt, Human
ugaaggcauugaugaaggaauc

SEQ ID NO: 982610 - RNA, 22 nt, Human
cccagcagccagaaugaggagc

SEQ ID NO: 982611 - RNA, 22 nt, Human
agaaauguuuauggcugccuau

SEQ ID NO: 982612 - RNA, 23 nt, Human
ugaugggaaggaacgacuaccac

SEQ ID NO: 982613 - RNA, 23 nt, Human
ucuccuggcugcacuguggccac

SEQ ID NO: 982614 - RNA, 22 nt, Human
caaugugucaggaaaagggcca

SEQ ID NO: 982615 - RNA, 22 nt, Human
ucccagggacucucugccuucc

SEQ ID NO: 982616 - RNA, 22 nt, Human
aaggcagcagugcacgacugau

SEQ ID NO: 982617 - RNA, 22 nt, Human
uaaagguaguuuuaaaggugcu

SEQ ID NO: 982618 - RNA, 22 nt, Human
ugaagcagagaauuugacaguc

SEQ ID NO: 982619 - RNA, 22 nt, Human
agccugagagccaagcugugca

SEQ ID NO: 982620 - RNA, 22 nt, Human
auaauguguucaucuuacaauu

SEQ ID NO: 982621 - RNA, 22 nt, Human
gucccugcccuccugggacuca

SEQ ID NO: 982622 - RNA, 22 nt, Human
agaaaugggccuugggacacaa

SEQ ID NO: 982623 - RNA, 22 nt, Human
caagagcuggguggcaagcuag

SEQ ID NO: 982624 - RNA, 22 nt, Human
aaacuuuaagacaguccucaag

SEQ ID NO: 982625 - RNA, 22 nt, Human
ugggccagcaauugcugcucag

SEQ ID NO: 982626 - RNA, 22 nt, Human
ccugccaggacauugcuugaag

SEQ ID NO: 982627 - RNA, 22 nt, Human
agccacagcaacaagugcaauu

SEQ ID NO: 982628 - RNA, 22 nt, Human
gcagcuggcucagagagguggg

SEQ ID NO: 982629 - RNA, 22 nt, Human
guauucuugguuaucaaaauac

SEQ ID NO: 982630 - RNA, 22 nt, Human
aagguacaaaguauuauuuaaa

SEQ ID NO: 982631 - RNA, 22 nt, Human
aggcuccaugcaaaggcuguuu

SEQ ID NO: 982632 - RNA, 22 nt, Human
acauagcuuaaaugagaagaua

SEQ ID NO: 982633 - RNA, 22 nt, Human
gcagggacaccuuugugaagcu

SEQ ID NO: 982634 - RNA, 22 nt, Human
ggcuccuguccuccuggagcuc

SEQ ID NO: 982635 - RNA, 22 nt, Human
ucaggggcuugaggugcauguc

SEQ ID NO: 982636 - RNA, 22 nt, Human
uggucaggcugcucugcggcgu

SEQ ID NO: 982637 - RNA, 22 nt, Human
cccuggcaaaacacucucuuga

SEQ ID NO: 982638 - RNA, 22 nt, Human
uugggcugaaguagagggcaga

SEQ ID NO: 982639 - RNA, 22 nt, Human
auggccaagaaauugccgacug

SEQ ID NO: 982640 - RNA, 18 nt, Human
cguuuuuccgggauugca

SEQ ID NO: 982641 - RNA, 20 nt, Human
uguugauuggugucaucuca

SEQ ID NO: 982642 - RNA, 22 nt, Human
uggccgggccgggcgccuccac

SEQ ID NO: 982643 - RNA, 22 nt, Human
ggccaaaugaaggcaaugggac

SEQ ID NO: 982644 - RNA, 22 nt, Human
ugucccagacacaguaugcgcu

SEQ ID NO: 982645 - RNA, 22 nt, Human
gucagcagugucagcucugggg

SEQ ID NO: 982646 - RNA, 22 nt, Human
aaacagaaggguagguaaacau

SEQ ID NO: 982647 - RNA, 22 nt, Human
gcuggccugaccagccacaggc

SEQ ID NO: 982648 - RNA, 20 nt, Human
ccagcugagccaaggggaga

SEQ ID NO: 982649 - RNA, 22 nt, Human
uccuucagggggccgccugcac

SEQ ID NO: 982650 - RNA, 22 nt, Human
ccuccuggcccugggccuggaa

SEQ ID NO: 982651 - RNA, 22 nt, Human
aagcugccugggaggaagggcu

SEQ ID NO: 982652 - RNA, 22 nt, Human
agcuaggaaauugaggcugaga

SEQ ID NO: 982653 - RNA, 20 nt, Human
ccuggcuuugcaucugugau

SEQ ID NO: 982654 - RNA, 22 nt, Human
uggcagaggcucugugauguug

SEQ ID NO: 982655 - RNA, 22 nt, Human
gcacagggccuggcacauaaga

SEQ ID NO: 982656 - RNA, 22 nt, Human
ugggcacuauggcucugugcac

SEQ ID NO: 982657 - RNA, 22 nt, Human
aaaacaguuauaaacagaguca

SEQ ID NO: 982658 - RNA, 22 nt, Human
ccaggcugcucacaagcugccc

SEQ ID NO: 982659 - RNA, 22 nt, Human
ucucucagggggaaggcugaag

SEQ ID NO: 982660 - RNA, 22 nt, Human
gugcauugcgaugcagacgacc

SEQ ID NO: 982661 - RNA, 19 nt, Human
uagcugccuguuaccucca

SEQ ID NO: 982662 - RNA, 22 nt, Human
cugggcagcuaccaccacugcu

SEQ ID NO: 982663 - RNA, 22 nt, Human
ugcaguggaaucuggagagcag

SEQ ID NO: 982664 - RNA, 22 nt, Human
cuuccuguugucacagucugcg

SEQ ID NO: 982665 - RNA, 22 nt, Human
ucugcagaaguggcugggccac

SEQ ID NO: 982666 - RNA, 22 nt, Human
cugggcuacguguugacagcau

SEQ ID NO: 982667 - RNA, 22 nt, Human
ucuggagcgaggucccugucug

SEQ ID NO: 982668 - RNA, 22 nt, Human
ugucucugccagcuagcagaau

SEQ ID NO: 982669 - RNA, 22 nt, Human
ggcugcuggggacgugggagag

SEQ ID NO: 982670 - RNA, 22 nt, Human
acacauuaugagcaguugucuu

SEQ ID NO: 982671 - RNA, 22 nt, Human
aauucacauauacauuauuccu

SEQ ID NO: 982672 - RNA, 22 nt, Human
aguguacacuaaaugaauacaa

SEQ ID NO: 982673 - RNA, 22 nt, Human
agggcagaaaccaccuugaugg

SEQ ID NO: 982674 - RNA, 19 nt, Human
cagaguccuugaccagucc

SEQ ID NO: 982675 - RNA, 22 nt, Human
ugaaaucuucacuaagucucuu

SEQ ID NO: 982676 - RNA, 22 nt, Human
gggcaugguggcaggcaccugu

SEQ ID NO: 982677 - RNA, 22 nt, Human
acugucuuccaggucuggaggu

SEQ ID NO: 982678 - RNA, 21 nt, Human
ccacaggggcuccccugucag

SEQ ID NO: 982679 - RNA, 19 nt, Human
gcuggggccugaccagaca

SEQ ID NO: 982680 - RNA, 22 nt, Human
cccagcccagcguucgaggggu

SEQ ID NO: 982681 - RNA, 22 nt, Human
gcucccagggcagcgcagaaga

SEQ ID NO: 982682 - RNA, 22 nt, Human
ugccuggcaaugccagaagcca

SEQ ID NO: 982683 - RNA, 22 nt, Human
gggaguggauuauguggaccca

SEQ ID NO: 982684 - RNA, 22 nt, Human
ucacuugccuagcccaguucag

SEQ ID NO: 982685 - RNA, 22 nt, Human
cacccacccacugcucauuggc

SEQ ID NO: 982686 - RNA, 23 nt, Human
ugcagccacucaggagcucagug

SEQ ID NO: 982687 - RNA, 22 nt, Human
uaaagcaggccacauaugugau

SEQ ID NO: 982688 - RNA, 22 nt, Human
agggcagcagcggcccaggccu

SEQ ID NO: 982689 - RNA, 22 nt, Human
ugggacacccucacgccugcac

SEQ ID NO: 982690 - RNA, 22 nt, Human
ccucacagggccaggccccuca

SEQ ID NO: 982691 - RNA, 22 nt, Human
aagaaauguagagccuaguaaa

SEQ ID NO: 982692 - RNA, 22 nt, Human
aggguggcaguuacuggagcaa

SEQ ID NO: 982693 - RNA, 22 nt, Human
cacaggaggaggccagagcgua

SEQ ID NO: 982694 - RNA, 22 nt, Human
uuaaacagguuuuugaauggcc

SEQ ID NO: 982695 - RNA, 22 nt, Human
gagaggucaucucccaucagca

SEQ ID NO: 982696 - RNA, 22 nt, Human
uuggcagagaguaugcugaaga

SEQ ID NO: 982697 - RNA, 22 nt, Human
ucacagaauagcacuguaagcg

SEQ ID NO: 982698 - RNA, 22 nt, Human
gggccuggggugacguaccccu

SEQ ID NO: 982699 - RNA, 22 nt, Human
ccaaggcuucccagagaugcuc

SEQ ID NO: 982700 - RNA, 20 nt, Human
gcucccagccugcagucccc

SEQ ID NO: 982701 - RNA, 22 nt, Human
gaggcagcaugguaccuuggag

SEQ ID NO: 982702 - RNA, 22 nt, Human
aggagacaucuaacuguagguu

SEQ ID NO: 982703 - RNA, 22 nt, Human
gugaggugguacaauauuaacu

SEQ ID NO: 982704 - RNA, 22 nt, Human
gccccucccagucaggagcacu

SEQ ID NO: 982705 - RNA, 22 nt, Human
aaagcccauguggaaguacagg

SEQ ID NO: 982706 - RNA, 22 nt, Human
uggccuggaagagaggucgagg

SEQ ID NO: 982707 - RNA, 22 nt, Human
uucucuucaucucaguaaaugu

SEQ ID NO: 982708 - RNA, 22 nt, Human
acugccuugucucuugccuguu

SEQ ID NO: 982709 - RNA, 22 nt, Human
gugagcaggauuucauggugua

SEQ ID NO: 982710 - RNA, 22 nt, Human
gcugccucaggcaccuccuggc

SEQ ID NO: 982711 - RNA, 22 nt, Human
cagcuuggcuuccgcuuuacug

SEQ ID NO: 982712 - RNA, 22 nt, Human
aggagucagauaugggaaaguu

SEQ ID NO: 982713 - RNA, 22 nt, Human
uuauuagagauauuugguuagg

SEQ ID NO: 982714 - RNA, 22 nt, Human
gcccagcagaucucagugucuc

SEQ ID NO: 982715 - RNA, 22 nt, Human
ggagacagugguagggccuaag

SEQ ID NO: 982716 - RNA, 22 nt, Human
agccccaguccgcugcgggcgg

SEQ ID NO: 982717 - RNA, 22 nt, Human
cagggccuccuaaggcaucuaa

SEQ ID NO: 982718 - RNA, 22 nt, Human
gcagccccaggagacgcccagg

SEQ ID NO: 982719 - RNA, 22 nt, Human
uugcaaauauguucuccuauuc

SEQ ID NO: 982720 - RNA, 22 nt, Human
gaguuauucuagguccuuugua

SEQ ID NO: 982721 - RNA, 22 nt, Human
uuaacagagugccuggcaugua

SEQ ID NO: 982722 - RNA, 22 nt, Human
cugcucuggucucuucauguuu

SEQ ID NO: 982723 - RNA, 22 nt, Human
cuucuugcaauuuucaucuuau

SEQ ID NO: 982724 - RNA, 22 nt, Human
cagagcuguuacuauucaugaa

SEQ ID NO: 982725 - RNA, 22 nt, Human
gccuggcugagguggggaggca

SEQ ID NO: 982726 - RNA, 22 nt, Human
augugaaagagguguucagugg

SEQ ID NO: 982727 - RNA, 23 nt, Human
ugcagagggacugaagccagcuu

SEQ ID NO: 982728 - RNA, 22 nt, Human
agucccagaucuacaggaggga

SEQ ID NO: 982729 - RNA, 22 nt, Human
cccucagcuccacccucagcag

SEQ ID NO: 982730 - RNA, 21 nt, Human
gacaggggaagaagcaaggag

SEQ ID NO: 982731 - RNA, 22 nt, Human
cugcuuugaaaauaaacuuguc

SEQ ID NO: 982732 - RNA, 22 nt, Human
ggugugccuggggcuuagcugc

SEQ ID NO: 982733 - RNA, 20 nt, Human
cacaggccuugugagcagac

SEQ ID NO: 982734 - RNA, 22 nt, Human
cacagcagaaaguguaggagga

SEQ ID NO: 982735 - RNA, 22 nt, Human
gcuggggaggcagcagagaaca

SEQ ID NO: 982736 - RNA, 22 nt, Human
cagcugcccugccuugcccuua

SEQ ID NO: 982737 - RNA, 22 nt, Human
cugcucuggcuguguacuucag

SEQ ID NO: 982738 - RNA, 22 nt, Human
uaggacaggugaggggcugugg

SEQ ID NO: 982739 - RNA, 22 nt, Human
caugagauaauuuuucuccagu

SEQ ID NO: 982740 - RNA, 22 nt, Human
cugguuuagcuguaagguuccc

SEQ ID NO: 982741 - RNA, 22 nt, Human
ggagccuugggcgcucucccau

SEQ ID NO: 982742 - RNA, 22 nt, Human
accuuucauuaaagucuguagu

SEQ ID NO: 982743 - RNA, 22 nt, Human
gagaaacuuggaguuauucugg

SEQ ID NO: 982744 - RNA, 22 nt, Human
uagaaagugaagguuaauuaau

SEQ ID NO: 982745 - RNA, 22 nt, Human
cagggacaauggcagagccuga

SEQ ID NO: 982746 - RNA, 22 nt, Human
acucacauuucaucaggccaag

SEQ ID NO: 982747 - RNA, 19 nt, Human
uggcuuccaucucucucau

SEQ ID NO: 982748 - RNA, 22 nt, Human
ccuggagcccaaggcagugaga

SEQ ID NO: 982749 - RNA, 19 nt, Human
gaguuauugccagggcaug

SEQ ID NO: 982750 - RNA, 20 nt, Human
caaguguagaaacuaauaag

SEQ ID NO: 982751 - RNA, 22 nt, Human
ugagcuggucacuccuucugaa

SEQ ID NO: 982752 - RNA, 22 nt, Human
uuugcauugcauacaaggaacu

SEQ ID NO: 982753 - RNA, 22 nt, Human
cagcugugaauugucuuaucua

SEQ ID NO: 982754 - RNA, 19 nt, Human
agcagcuggagguggagug

SEQ ID NO: 982755 - RNA, 22 nt, Human
ggccuugguaaagggaugcaug

SEQ ID NO: 982756 - RNA, 21 nt, Human
ccugcagcaccagaaggagau

SEQ ID NO: 982757 - RNA, 22 nt, Human
ggucccagguugacagggagac

SEQ ID NO: 982758 - RNA, 22 nt, Human
ggagauagacuuggugagccac

SEQ ID NO: 982759 - RNA, 22 nt, Human
gucucagauaacauguauucua

SEQ ID NO: 982760 - RNA, 19 nt, Human
gcucugugaugcugagggg

SEQ ID NO: 982761 - RNA, 22 nt, Human
cugccagcacugccuccugagg

SEQ ID NO: 982762 - RNA, 22 nt, Human
agccagugcaacagcagugaag

SEQ ID NO: 982763 - RNA, 22 nt, Human
cccagggucccugcucucugug

SEQ ID NO: 982764 - RNA, 22 nt, Human
gucccagaggcuuuggccacag

SEQ ID NO: 982765 - RNA, 22 nt, Human
uagggcagccacccaggcugcu

SEQ ID NO: 982766 - RNA, 20 nt, Human
cccugcagccaugggagugg

SEQ ID NO: 982767 - RNA, 22 nt, Human
uggcucagaugcucuuccagug

SEQ ID NO: 982768 - RNA, 22 nt, Human
gggauggggucaacauguaccu

SEQ ID NO: 982769 - RNA, 19 nt, Human
gcucagagggcccugugcu

SEQ ID NO: 982770 - RNA, 22 nt, Human
agcuuuauuugucauucacggc

SEQ ID NO: 982771 - RNA, 22 nt, Human
cagacacaccaggcccauucug

SEQ ID NO: 982772 - RNA, 20 nt, Human
caccacagaauuggggacag

SEQ ID NO: 982773 - RNA, 22 nt, Human
ccuggaaguuggagguugcagu

SEQ ID NO: 982774 - RNA, 22 nt, Human
ccaggacucaguggggaaaggg

SEQ ID NO: 982775 - RNA, 21 nt, Human
cagcaaaucauugggcagacu

SEQ ID NO: 982776 - RNA, 22 nt, Human
ccaccaggacagcccugagggg

SEQ ID NO: 982777 - RNA, 22 nt, Human
ugggcucucuggcaggaaggcu

SEQ ID NO: 982778 - RNA, 18 nt, Human
gggcacuggggacuggag

SEQ ID NO: 982779 - RNA, 22 nt, Human
gucaucuucgcagagugauuuu

SEQ ID NO: 982780 - RNA, 22 nt, Human
cuggcagcgugagcagcaucca

SEQ ID NO: 982781 - RNA, 19 nt, Human
auacacauacguaaacuga

SEQ ID NO: 982782 - RNA, 19 nt, Human
agaggccucagcagcuggc

SEQ ID NO: 982783 - RNA, 22 nt, Human
augaagucuagcaagcauugaa

SEQ ID NO: 982784 - RNA, 22 nt, Human
cuguaauucacuagggucagcg

SEQ ID NO: 982785 - RNA, 22 nt, Human
gcagggcaaugaucccgagagg

SEQ ID NO: 982786 - RNA, 22 nt, Human
uagaacagaguuccagugauca

SEQ ID NO: 982787 - RNA, 22 nt, Human
caagaaaugggauuugacugcc

SEQ ID NO: 982788 - RNA, 20 nt, Human
uggcccuguuuucuccaggc

SEQ ID NO: 982789 - RNA, 22 nt, Human
cagcuggcccuuugguagccuu

SEQ ID NO: 982790 - RNA, 22 nt, Human
aggggcugggacagagccaagc

SEQ ID NO: 982791 - RNA, 19 nt, Human
cagagccucagagcuagaa

SEQ ID NO: 982792 - RNA, 22 nt, Human
uuugcauuuguuuagaaccuga

SEQ ID NO: 982793 - RNA, 17 nt, Human
cccugccaccaggaagc

SEQ ID NO: 982794 - RNA, 22 nt, Human
ucagagaaaugaaguagggauu

SEQ ID NO: 982795 - RNA, 22 nt, Human
ccaggccugcaucugcugcgca

SEQ ID NO: 982796 - RNA, 22 nt, Human
gcugcucuccauggccgugagu

SEQ ID NO: 982797 - RNA, 22 nt, Human
agggacaguuacaucaucagac

SEQ ID NO: 982798 - RNA, 20 nt, Human
ucacucugaugcuagggugg

SEQ ID NO: 982799 - RNA, 18 nt, Human
ucuggcucaggacugaac

SEQ ID NO: 982800 - RNA, 22 nt, Human
uauguacaaucagcaguucaua

SEQ ID NO: 982801 - RNA, 22 nt, Human
ucuuugcagaauuuaacuuugc

SEQ ID NO: 982802 - RNA, 22 nt, Human
aggccaaguagcuagcauugaa

SEQ ID NO: 982803 - RNA, 22 nt, Human
uauccaaacauauagucucucu

SEQ ID NO: 982804 - RNA, 22 nt, Human
uucagagcaucucuaaagccag

SEQ ID NO: 982805 - RNA, 21 nt, Human
aggagggcacaaggccaggaa

SEQ ID NO: 982806 - RNA, 22 nt, Human
uucagcaacauuuguugagugc

SEQ ID NO: 982807 - RNA, 22 nt, Human
uucagugugugauaccugcugu

SEQ ID NO: 982808 - RNA, 22 nt, Human
ugcagccaccaccucugcugaa

SEQ ID NO: 982809 - RNA, 22 nt, Human
uucauguaauuccauaagguaa

SEQ ID NO: 982810 - RNA, 22 nt, Human
ccggggacuuaaagugaaggaa

SEQ ID NO: 982811 - RNA, 22 nt, Human
ccaggcagagugcuccagaaag

SEQ ID NO: 982812 - RNA, 22 nt, Human
cagggugccuguccucagcaaa

SEQ ID NO: 982813 - RNA, 22 nt, Human
uccuggcccacuaugccagcau

SEQ ID NO: 982814 - RNA, 20 nt, Human
ccugucuggagacaaagaga

SEQ ID NO: 982815 - RNA, 22 nt, Human
cacugcaggucugagauggggg

SEQ ID NO: 982816 - RNA, 22 nt, Human
gcagccaccucccauggcgggg

SEQ ID NO: 982817 - RNA, 22 nt, Human
ggagcagacauaaccuuacaga

SEQ ID NO: 982818 - RNA, 22 nt, Human
gauuauauaauggaagcucuug

SEQ ID NO: 982819 - RNA, 22 nt, Human
gugagcagaacagguggcuucu

SEQ ID NO: 982820 - RNA, 22 nt, Human
cagagagaggccacugcuauua

SEQ ID NO: 982821 - RNA, 22 nt, Human
agguggggaaaccagcgauccc

SEQ ID NO: 982822 - RNA, 22 nt, Human
aaugauguauuaguacaacaca

SEQ ID NO: 982823 - RNA, 22 nt, Human
cugggcugucccaaccccaucc

SEQ ID NO: 982824 - RNA, 22 nt, Human
uggguggcacuucuggggucca

SEQ ID NO: 982825 - RNA, 22 nt, Human
cuaucuuucgauucuagcuuaa

SEQ ID NO: 982826 - RNA, 22 nt, Human
agcugccacaugcccaagggca

SEQ ID NO: 982827 - RNA, 22 nt, Human
ugcacagagagaugagacacgu

SEQ ID NO: 982828 - RNA, 22 nt, Human
ugcuuuauuuauaaaauagcaa

SEQ ID NO: 982829 - RNA, 22 nt, Human
ugcacagcgggugucugucagg

SEQ ID NO: 982830 - RNA, 19 nt, Human
gucacauuugucucccagg

SEQ ID NO: 982831 - RNA, 22 nt, Human
ucugggggcgaccagggacugc

SEQ ID NO: 982832 - RNA, 22 nt, Human
agaacagaggccuuauguuuca

SEQ ID NO: 982833 - RNA, 22 nt, Human
uauugaguuacagaaaauacuu

SEQ ID NO: 982834 - RNA, 22 nt, Human
gcacagggaggcuggccuggcc

SEQ ID NO: 982835 - RNA, 22 nt, Human
cagcuccugggccaucuccuag

SEQ ID NO: 982836 - RNA, 22 nt, Human
aaaguggucaccuucucauuuc

SEQ ID NO: 982837 - RNA, 20 nt, Human
uuguuucugcuauuuucuaa

SEQ ID NO: 982838 - RNA, 22 nt, Human
accaaacaaaauugugcacugu

SEQ ID NO: 982839 - RNA, 22 nt, Human
gugcccaggcccaaggcaccac

SEQ ID NO: 982840 - RNA, 22 nt, Human
uggucucugacucugaagaccc

SEQ ID NO: 982841 - RNA, 22 nt, Human
gggagcugguuccugcccucca

SEQ ID NO: 982842 - RNA, 22 nt, Human
cuggccagcauuuuugcuuuag

SEQ ID NO: 982843 - RNA, 22 nt, Human
gggagagaugcugauugccaau

SEQ ID NO: 982844 - RNA, 22 nt, Human
gcugucuuccuugcuccaaggg

SEQ ID NO: 982845 - RNA, 22 nt, Human
gagacugauggggcucccagaa

SEQ ID NO: 982846 - RNA, 22 nt, Human
aaugugcaggcucaaaccuugu

SEQ ID NO: 982847 - RNA, 22 nt, Human
uuuuuccuagugcuuucuggua

SEQ ID NO: 982848 - RNA, 22 nt, Human
aggucauuccuugucuucuugc

SEQ ID NO: 982849 - RNA, 20 nt, Human
cccuggccuguuucaugccc

SEQ ID NO: 982850 - RNA, 22 nt, Human
uguacuuccccaaugacagcac

SEQ ID NO: 982851 - RNA, 22 nt, Human
ucccagcagagccagcaagccg

SEQ ID NO: 982852 - RNA, 22 nt, Human
agacauuuggaagauacacaua

SEQ ID NO: 982853 - RNA, 22 nt, Human
gaugcagggcuggcaggagcuu

SEQ ID NO: 982854 - RNA, 22 nt, Human
ccucuugccaaucagcuacaga

SEQ ID NO: 982855 - RNA, 22 nt, Human
uugaagcacaaugucuuuuauc

SEQ ID NO: 982856 - RNA, 22 nt, Human
ggagcugaugacgucaccaugg

SEQ ID NO: 982857 - RNA, 22 nt, Human
aaaaacugcaauuacuuuuguc

SEQ ID NO: 982858 - RNA, 22 nt, Human
aggcacugauucucagaguuac

SEQ ID NO: 982859 - RNA, 19 nt, Human
uugguggugguuuugguuc

SEQ ID NO: 982860 - RNA, 22 nt, Human
gccagcucagaugcaggaagga

SEQ ID NO: 982861 - RNA, 22 nt, Human
gaaaugugugacaaguuucaau

SEQ ID NO: 982862 - RNA, 22 nt, Human
ccugccugcaccuucucugggg

SEQ ID NO: 982863 - RNA, 22 nt, Human
gguggggccugcuccagcggcc

SEQ ID NO: 982864 - RNA, 19 nt, Human
ucugaggguccagaugcau

SEQ ID NO: 982865 - RNA, 22 nt, Human
acucugcuaucuuagcaaaagg

SEQ ID NO: 982866 - RNA, 22 nt, Human
gcagcuuuuuggaugucaguua

SEQ ID NO: 982867 - RNA, 18 nt, Human
agagcagcggcaucacac

SEQ ID NO: 982868 - RNA, 22 nt, Human
cagucccacuagugccaauacc

SEQ ID NO: 982869 - RNA, 20 nt, Human
cuccagggaacagacuggag

SEQ ID NO: 982870 - RNA, 23 nt, Human
uugauacagaagaaucaguuugu

SEQ ID NO: 982871 - RNA, 22 nt, Human
cccagcccccgagugucuggaa

SEQ ID NO: 982872 - RNA, 22 nt, Human
ggcugucucugugacugccacc

SEQ ID NO: 982873 - RNA, 22 nt, Human
ugcugugcuggcggcagaggcc

SEQ ID NO: 982874 - RNA, 22 nt, Human
ugcuggaggggccugaccagga

SEQ ID NO: 982875 - RNA, 22 nt, Human
caggccuggguucaaaucccuu

SEQ ID NO: 982876 - RNA, 22 nt, Human
auauguguacgugcaguauaua

SEQ ID NO: 982877 - RNA, 22 nt, Human
ggcaacauucuccagauccuuu

SEQ ID NO: 982878 - RNA, 22 nt, Human
gcaggaaagguugagacuuugc

SEQ ID NO: 982879 - RNA, 23 nt, Human
gcugagguacauuuacaggaaga

SEQ ID NO: 982880 - RNA, 22 nt, Human
gacucugcugacuaguugacua

SEQ ID NO: 982881 - RNA, 22 nt, Human
uggccuggaaccuggcagggac

SEQ ID NO: 982882 - RNA, 22 nt, Human
uagaaaugauuuugaugcuuca

SEQ ID NO: 982883 - RNA, 22 nt, Human
caggggaagaugccaagggaga

SEQ ID NO: 982884 - RNA, 23 nt, Human
auuuccuacuauaaaagagguaa

SEQ ID NO: 982885 - RNA, 22 nt, Human
cuggugggaggcaagguggaag

SEQ ID NO: 982886 - RNA, 22 nt, Human
ucccaggguccucuucuggaau

SEQ ID NO: 982887 - RNA, 22 nt, Human
cuacauuuguucuauagcuuuu

SEQ ID NO: 982888 - RNA, 22 nt, Human
caggcacuggggaugcugggau

SEQ ID NO: 982889 - RNA, 22 nt, Human
agagcagguggcaacucuggga

SEQ ID NO: 982890 - RNA, 22 nt, Human
uuucuucucacccaggacagag

SEQ ID NO: 982891 - RNA, 22 nt, Human
agaggcaggagguugacuugag

SEQ ID NO: 982892 - RNA, 22 nt, Human
ccaggccuuucuucuuggucug

SEQ ID NO: 982893 - RNA, 17 nt, Human
uguuccauuugaccacc

SEQ ID NO: 982894 - RNA, 22 nt, Human
uguacaguauauuucaaagcca

SEQ ID NO: 982895 - RNA, 22 nt, Human
aggagccaagcagaacuaagga

SEQ ID NO: 982896 - RNA, 22 nt, Human
uacauuugcuuugauuuucagc

SEQ ID NO: 982897 - RNA, 22 nt, Human
ugagccagauaagggcucacgc

SEQ ID NO: 982898 - RNA, 22 nt, Human
guccucugcuucaugcccugau

SEQ ID NO: 982899 - RNA, 22 nt, Human
cugggaggugcagcaaaaauca

SEQ ID NO: 982900 - RNA, 22 nt, Human
ccagcugguguuccuuaggacc

SEQ ID NO: 982901 - RNA, 22 nt, Human
acagggaaguucugcaacagga

SEQ ID NO: 982902 - RNA, 22 nt, Human
ccucugcagcagagagccagag

SEQ ID NO: 982903 - RNA, 22 nt, Human
acagggcagagggcaguuggua

SEQ ID NO: 982904 - RNA, 20 nt, Human
agggucaguagcacagagcu

SEQ ID NO: 982905 - RNA, 22 nt, Human
uaagcauucaaugcuuagcacu

SEQ ID NO: 982906 - RNA, 22 nt, Human
gcuggagccauuggcuuggccu

SEQ ID NO: 982907 - RNA, 22 nt, Human
uggccaaauuugguguaacuug

SEQ ID NO: 982908 - RNA, 22 nt, Human
uggcugaaucugcagcaggaag

SEQ ID NO: 982909 - RNA, 22 nt, Human
ggaagggcaaaagagaugaacu

SEQ ID NO: 982910 - RNA, 22 nt, Human
auguguccacaggugugagaga

SEQ ID NO: 982911 - RNA, 22 nt, Human
ccuggcuggcaagaucgugaag

SEQ ID NO: 982912 - RNA, 22 nt, Human
cagagccaaaugcugugguuau

SEQ ID NO: 982913 - RNA, 22 nt, Human
uaugucuugcauuuuucaaacu

SEQ ID NO: 982914 - RNA, 22 nt, Human
ggcucaagcagucugccugccu

SEQ ID NO: 982915 - RNA, 22 nt, Human
agggugcauguuugcaagagug

SEQ ID NO: 982916 - RNA, 22 nt, Human
uagaaacucaggauacucuucc

SEQ ID NO: 982917 - RNA, 22 nt, Human
uggggacauagccagucuggcu

SEQ ID NO: 982918 - RNA, 22 nt, Human
ggcugcaggcaggguauccacu

SEQ ID NO: 982919 - RNA, 22 nt, Human
agaggugacauaggagaggcuc

SEQ ID NO: 982920 - RNA, 22 nt, Human
ggcucuggagacauguggagag

SEQ ID NO: 982921 - RNA, 22 nt, Human
gagcccuccauggagccaggca

SEQ ID NO: 982922 - RNA, 22 nt, Human
uccagggaugccagccauguug

SEQ ID NO: 982923 - RNA, 22 nt, Human
uugcaaauuauuuuagucccuu

SEQ ID NO: 982924 - RNA, 23 nt, Human
agucuuaauacagcucuuuucua

SEQ ID NO: 982925 - RNA, 22 nt, Human
uccugggcaaaaguaucuguga

SEQ ID NO: 982926 - RNA, 22 nt, Human
guggccaaaaggaagaagguua

SEQ ID NO: 982927 - RNA, 22 nt, Human
gugauaaagacgugucauaauu

SEQ ID NO: 982928 - RNA, 22 nt, Human
uuuuauugucaaugaagacaga

SEQ ID NO: 982929 - RNA, 22 nt, Human
gcaggaguuaggcgucguggau

SEQ ID NO: 982930 - RNA, 22 nt, Human
gcagagccugacgggauuuuuc

SEQ ID NO: 982931 - RNA, 22 nt, Human
ugccagcacaaguuaagagauc

SEQ ID NO: 982932 - RNA, 21 nt, Human
uuacuuuugcagcaaccuaau

SEQ ID NO: 982933 - RNA, 22 nt, Human
cugucuguucagauucauuacu

SEQ ID NO: 982934 - RNA, 22 nt, Human
aaaagguaguugccaaauaagg

SEQ ID NO: 982935 - RNA, 22 nt, Human
agccacgucccugucaggguca

SEQ ID NO: 982936 - RNA, 22 nt, Human
ggccauggaccccgagcugacc

SEQ ID NO: 982937 - RNA, 22 nt, Human
cuggugccuccucccugugcuu

SEQ ID NO: 982938 - RNA, 22 nt, Human
uuuuaugugcuggacuggcagu

SEQ ID NO: 982939 - RNA, 22 nt, Human
acuggccagaacuaagucacau

SEQ ID NO: 982940 - RNA, 22 nt, Human
acagcuggaggccccauugucc

SEQ ID NO: 982941 - RNA, 22 nt, Human
cauugcacuucugcuuuuccuc

SEQ ID NO: 982942 - RNA, 22 nt, Human
gggaagggagggaccucagucu

SEQ ID NO: 982943 - RNA, 22 nt, Human
cagaguguggcaucuuccaacu

SEQ ID NO: 982944 - RNA, 22 nt, Human
uggcacugggaugcuacuguua

SEQ ID NO: 982945 - RNA, 22 nt, Human
cugggcaauaugcugggccugg

SEQ ID NO: 982946 - RNA, 22 nt, Human
uuucauuauaaaaaguuggcuu

SEQ ID NO: 982947 - RNA, 22 nt, Human
gcucuguguugucagaggcacc

SEQ ID NO: 982948 - RNA, 22 nt, Human
uaaaauguuugcaagagaccag

SEQ ID NO: 982949 - RNA, 23 nt, Human
uguaaaaugggguaguguuacca

SEQ ID NO: 982950 - RNA, 22 nt, Human
ggugacugguuuaucuggcagu

SEQ ID NO: 982951 - RNA, 22 nt, Human
aucuaagaguuaacaucaagaa

SEQ ID NO: 982952 - RNA, 22 nt, Human
acagagcuuaggaugacuccca

SEQ ID NO: 982953 - RNA, 22 nt, Human
ucuuggagaauggcagagaagc

SEQ ID NO: 982954 - RNA, 21 nt, Human
ugauuuccaucuuaaaauaaa

SEQ ID NO: 982955 - RNA, 23 nt, Human
ugcugguguuuuugggaccaggg

SEQ ID NO: 982956 - RNA, 22 nt, Human
ucugucacaauuugcuuacucu

SEQ ID NO: 982957 - RNA, 22 nt, Human
uguuacacagcagaauagcaag

SEQ ID NO: 982958 - RNA, 22 nt, Human
auguuuauguugggcuauauuu

SEQ ID NO: 982959 - RNA, 22 nt, Human
agccucuguagaaagcagugug

SEQ ID NO: 982960 - RNA, 22 nt, Human
gcugggagcaaagccaugcaua

SEQ ID NO: 982961 - RNA, 22 nt, Human
ugcaagaggaauucuagaagca

SEQ ID NO: 982962 - RNA, 22 nt, Human
guuauuaguaagacucgcacau

SEQ ID NO: 982963 - RNA, 22 nt, Human
ugugccagccucuggcuguguc

SEQ ID NO: 982964 - RNA, 18 nt, Human
gcagcugcaguuguagcu

SEQ ID NO: 982965 - RNA, 22 nt, Human
caaaggcaacauauacuuguuu

SEQ ID NO: 982966 - RNA, 22 nt, Human
auuaaaagcuucccaagaguua

SEQ ID NO: 982967 - RNA, 22 nt, Human
uguggccagcagguggcugugu

SEQ ID NO: 982968 - RNA, 22 nt, Human
gcucccagacugaccagaggug

SEQ ID NO: 982969 - RNA, 22 nt, Human
cuggcucacaggugagaugcau

SEQ ID NO: 982970 - RNA, 22 nt, Human
guggccucugugcuccugccua

SEQ ID NO: 982971 - RNA, 22 nt, Human
aggccagagaggggaccagccu

SEQ ID NO: 982972 - RNA, 22 nt, Human
aaaagucugcucucauuucaga

SEQ ID NO: 982973 - RNA, 22 nt, Human
caggcuugggagcagagccacu

SEQ ID NO: 982974 - RNA, 20 nt, Human
uaugaagauaugugaacagc

SEQ ID NO: 982975 - RNA, 22 nt, Human
uggcuggggccacaguuuuccu

SEQ ID NO: 982976 - RNA, 22 nt, Human
ugcucucucaggccuggcccac

SEQ ID NO: 982977 - RNA, 22 nt, Human
uccugccucuugccuucuucac

SEQ ID NO: 982978 - RNA, 22 nt, Human
ggcuggucacaccacugcaggg

SEQ ID NO: 982979 - RNA, 22 nt, Human
aacaaguaaguuuauauauauu

SEQ ID NO: 982980 - RNA, 22 nt, Human
ggcuucagugacuggugcccuc

SEQ ID NO: 982981 - RNA, 22 nt, Human
guguuuccaguucagaaagcaa

SEQ ID NO: 982982 - RNA, 21 nt, Human
agcugagcccagaagacuggu

SEQ ID NO: 982983 - RNA, 22 nt, Human
auccaaaccuggacaugagugg

SEQ ID NO: 982984 - RNA, 22 nt, Human
uccauaagcagguucuuccuga

SEQ ID NO: 982985 - RNA, 22 nt, Human
cggcagcaaaggaagccagguc

SEQ ID NO: 982986 - RNA, 22 nt, Human
aggcccugcuuuccagagcuca

SEQ ID NO: 982987 - RNA, 19 nt, Human
guaagggcuaauggacuau

SEQ ID NO: 982988 - RNA, 22 nt, Human
auucagcauaaucaguagcuug

SEQ ID NO: 982989 - RNA, 22 nt, Human
uccuucagucuucugagccaua

SEQ ID NO: 982990 - RNA, 20 nt, Human
caagcccucuuuagccugcc

SEQ ID NO: 982991 - RNA, 22 nt, Human
guguccacggcugagaaugauu

SEQ ID NO: 982992 - RNA, 22 nt, Human
cugggacuuuacccuguggccc

SEQ ID NO: 982993 - RNA, 22 nt, Human
ugcuggggagugauugaccauc

SEQ ID NO: 982994 - RNA, 22 nt, Human
uccugcaggccuguucccagua

SEQ ID NO: 982995 - RNA, 22 nt, Human
gggcugugggacccggcacuuu

SEQ ID NO: 982996 - RNA, 22 nt, Human
ugucuuaauaugugcauucugu

SEQ ID NO: 982997 - RNA, 22 nt, Human
cgggcuggcugcagcugcugga

SEQ ID NO: 982998 - RNA, 22 nt, Human
ccugccaggagcuggugcugca

SEQ ID NO: 982999 - RNA, 23 nt, Human
cuggccuccgacacuggccaaga

SEQ ID NO: 983000 - RNA, 22 nt, Human
uccagcagaaaagagguaggga

SEQ ID NO: 983001 - RNA, 22 nt, Human
ggaaaguggugguggaaagagg

SEQ ID NO: 983002 - RNA, 22 nt, Human
ucccagagcaguacuccaggag

SEQ ID NO: 983003 - RNA, 22 nt, Human
augaugugugcugaucaagcuu

SEQ ID NO: 983004 - RNA, 22 nt, Human
cccaagaucuuucgugcacuaa

SEQ ID NO: 983005 - RNA, 22 nt, Human
uauucacagcugccgcacucag

SEQ ID NO: 983006 - RNA, 22 nt, Human
cuccagggaugagacagaguag

SEQ ID NO: 983007 - RNA, 22 nt, Human
agcagcugaucaaagcacuuau

SEQ ID NO: 983008 - RNA, 22 nt, Human
uagagcuggaaaacugcaggua

SEQ ID NO: 983009 - RNA, 22 nt, Human
ggcugcugggaauaugccagcu

SEQ ID NO: 983010 - RNA, 22 nt, Human
ggccugcucugcagccucuaca

SEQ ID NO: 983011 - RNA, 22 nt, Human
aagaugcagcuuccacuuuugc

SEQ ID NO: 983012 - RNA, 20 nt, Human
ccagucucuaucagaaauaa

SEQ ID NO: 983013 - RNA, 22 nt, Human
acauuucugcaucucagagcua

SEQ ID NO: 983014 - RNA, 22 nt, Human
ugaaagcagugccaugauuaug

SEQ ID NO: 983015 - RNA, 22 nt, Human
uuaggauagucuguuagaaaag

SEQ ID NO: 983016 - RNA, 22 nt, Human
gcagaugguggggcaggaaaau

SEQ ID NO: 983017 - RNA, 22 nt, Human
gaagagcuaaaggcacaggcuu

SEQ ID NO: 983018 - RNA, 22 nt, Human
gcaggagcagucaggggcagcu

SEQ ID NO: 983019 - RNA, 22 nt, Human
augcaagauguauagaagacuu

SEQ ID NO: 983020 - RNA, 22 nt, Human
ggugccaggcucccagcucagg

SEQ ID NO: 983021 - RNA, 23 nt, Human
ugcuguccaacagacuggccaug

SEQ ID NO: 983022 - RNA, 21 nt, Human
cagagcuguccaaacccugac

SEQ ID NO: 983023 - RNA, 22 nt, Human
cccaguccuaaagcagacgcca

SEQ ID NO: 983024 - RNA, 22 nt, Human
agcagggggccacagucacagc

SEQ ID NO: 983025 - RNA, 22 nt, Human
gaaugugucacccugucccaug

SEQ ID NO: 983026 - RNA, 22 nt, Human
ucaugacaacuauauuauucca

SEQ ID NO: 983027 - RNA, 22 nt, Human
gggcugugcugaguaggaggug

SEQ ID NO: 983028 - RNA, 22 nt, Human
cuuuguaucuaaauaucuugaa

SEQ ID NO: 983029 - RNA, 22 nt, Human
auauucacugagcauaaagcca

SEQ ID NO: 983030 - RNA, 22 nt, Human
gugcauuucucauacacuaaau

SEQ ID NO: 983031 - RNA, 22 nt, Human
guugaguggguuaggaugcuga

SEQ ID NO: 983032 - RNA, 23 nt, Human
uagagcagggaaaucugucagag

SEQ ID NO: 983033 - RNA, 22 nt, Human
cagcccagcagucuuagccugc

SEQ ID NO: 983034 - RNA, 22 nt, Human
cucccuggugacucccaaagcu

SEQ ID NO: 983035 - RNA, 22 nt, Human
cacaguuucuauaggucagaau

SEQ ID NO: 983036 - RNA, 22 nt, Human
uagcugccuagacagcuauagc

SEQ ID NO: 983037 - RNA, 22 nt, Human
uucaaaacagcuagauauugga

SEQ ID NO: 983038 - RNA, 22 nt, Human
ucaguuuuuaaaugauauaauu

SEQ ID NO: 983039 - RNA, 22 nt, Human
ggccccugcggacugccuagag

SEQ ID NO: 983040 - RNA, 22 nt, Human
ucauuacagagauauaaucuac

SEQ ID NO: 983041 - RNA, 22 nt, Human
ucugccugccagucugguccuc

SEQ ID NO: 983042 - RNA, 21 nt, Human
gggucugaauaucuggugcug

SEQ ID NO: 983043 - RNA, 22 nt, Human
ggucccaggaagugcggcggcg

SEQ ID NO: 983044 - RNA, 22 nt, Human
gucccugcaucaccacgggacu

SEQ ID NO: 983045 - RNA, 22 nt, Human
cucugggcaccaaagagcagcu

SEQ ID NO: 983046 - RNA, 22 nt, Human
aaaugucuuuaucucauguaac

SEQ ID NO: 983047 - RNA, 18 nt, Human
uucaccagugugaugggu

SEQ ID NO: 983048 - RNA, 18 nt, Human
agaaggagcuaugggcag

SEQ ID NO: 983049 - RNA, 22 nt, Human
acagaguauuggaaaggcagug

SEQ ID NO: 983050 - RNA, 22 nt, Human
ucaagagacaggacguguuuca

SEQ ID NO: 983051 - RNA, 22 nt, Human
cucuguagaaacagggcagaag

SEQ ID NO: 983052 - RNA, 20 nt, Human
acauguacuaaugaauacag

SEQ ID NO: 983053 - RNA, 22 nt, Human
ugucauuuaguccucugugugu

SEQ ID NO: 983054 - RNA, 22 nt, Human
gcugccugauuuacauagugaa

SEQ ID NO: 983055 - RNA, 22 nt, Human
cagagaaacucagauagcugau

SEQ ID NO: 983056 - RNA, 22 nt, Human
cagugccucuuaagugucaccc

SEQ ID NO: 983057 - RNA, 22 nt, Human
uagaaaucagcaggcauaugua

SEQ ID NO: 983058 - RNA, 22 nt, Human
gaguuauugaguauagaaugua

SEQ ID NO: 983059 - RNA, 22 nt, Human
gccuccugaaaggaagagcucc

SEQ ID NO: 983060 - RNA, 22 nt, Human
gggcuggggcucaauaauuugu

SEQ ID NO: 983061 - RNA, 22 nt, Human
agcaggcuccuuccuucucugg

SEQ ID NO: 983062 - RNA, 16 nt, Human
gccuggaguggcaggg

SEQ ID NO: 983063 - RNA, 22 nt, Human
gucauuguguggacauggagaa

SEQ ID NO: 983064 - RNA, 22 nt, Human
ccagugcacagccaggcaggug

SEQ ID NO: 983065 - RNA, 22 nt, Human
cugcccuguggcucugagucau

SEQ ID NO: 983066 - RNA, 22 nt, Human
uuccucucaacaugccugccgg

SEQ ID NO: 983067 - RNA, 22 nt, Human
agcuggguggagggcccacggu

SEQ ID NO: 983068 - RNA, 22 nt, Human
caggggcuguggcacauggugu

SEQ ID NO: 983069 - RNA, 22 nt, Human
ggcucugcgcgguaaagugacu

SEQ ID NO: 983070 - RNA, 23 nt, Human
ucuccagugucucuucauugagu

SEQ ID NO: 983071 - RNA, 18 nt, Human
cagcugccagcucaugga

SEQ ID NO: 983072 - RNA, 22 nt, Human
gccaggcagcugggagggugcc

SEQ ID NO: 983073 - RNA, 19 nt, Human
ggcucagggcgcugccgcc

SEQ ID NO: 983074 - RNA, 22 nt, Human
ucaggcaggcagagggcaaaug

SEQ ID NO: 983075 - RNA, 21 nt, Human
gacaggacuagaccagagcuc

SEQ ID NO: 983076 - RNA, 22 nt, Human
uaggggugaggccaggcaucag

SEQ ID NO: 983077 - RNA, 22 nt, Human
ggcagcaucacuugucuccagc

SEQ ID NO: 983078 - RNA, 21 nt, Human
cggccaaauuccuccuaggga

SEQ ID NO: 983079 - RNA, 22 nt, Human
uucuggaggccccuuccuucuc

SEQ ID NO: 983080 - RNA, 22 nt, Human
acugggccggugcagaguaguu

SEQ ID NO: 983081 - RNA, 22 nt, Human
aguuauucauuuauucuguaca

SEQ ID NO: 983082 - RNA, 22 nt, Human
caaaguuuaaaguagauuucag

SEQ ID NO: 983083 - RNA, 22 nt, Human
cagaacauucacucauaugugg

SEQ ID NO: 983084 - RNA, 22 nt, Human
uacaucuauacugaucuacauu

SEQ ID NO: 983085 - RNA, 19 nt, Human
gagcacagcggcauuuggu

SEQ ID NO: 983086 - RNA, 22 nt, Human
gcucagaggcacgaccucuugg

SEQ ID NO: 983087 - RNA, 22 nt, Human
auaguacacauccuacaauguu

SEQ ID NO: 983088 - RNA, 22 nt, Human
auauuaaugagcaaguaaguga

SEQ ID NO: 983089 - RNA, 22 nt, Human
gggugacauuucccaaugagcc

SEQ ID NO: 983090 - RNA, 22 nt, Human
gcaggagagccagcaggcuucc

SEQ ID NO: 983091 - RNA, 22 nt, Human
ucccaggauguuggcggcaggu

SEQ ID NO: 983092 - RNA, 22 nt, Human
auguuuaaaggagucagagacu

SEQ ID NO: 983093 - RNA, 22 nt, Human
agcugccagcaucccggaaggg

SEQ ID NO: 983094 - RNA, 22 nt, Human
uguuuuauuucuccaagaggga

SEQ ID NO: 983095 - RNA, 22 nt, Human
ucauugaauuucacagcuuuau

SEQ ID NO: 983096 - RNA, 22 nt, Human
augggagugacagggccacugg

SEQ ID NO: 983097 - RNA, 22 nt, Human
gugcaugugucuuuauaguagc

SEQ ID NO: 983098 - RNA, 22 nt, Human
aaugagcugcugcuguuccacc

SEQ ID NO: 983099 - RNA, 22 nt, Human
aagccagguguuuaggccagcg

SEQ ID NO: 983100 - RNA, 22 nt, Human
gugacagaguuuuagaucucau

SEQ ID NO: 983101 - RNA, 22 nt, Human
cugaagccaugugcucacuggu

SEQ ID NO: 983102 - RNA, 22 nt, Human
ggccagaaaguuaagcuguggc

SEQ ID NO: 983103 - RNA, 22 nt, Human
ucacuuaaaaauucuaguuaug

SEQ ID NO: 983104 - RNA, 22 nt, Human
cucucuggcacuucauugcugu

SEQ ID NO: 983105 - RNA, 19 nt, Human
cagcugcaccgugaccauc

SEQ ID NO: 983106 - RNA, 22 nt, Human
uuccuggcauagagagggcaca

SEQ ID NO: 983107 - RNA, 22 nt, Human
cugagcugggaguagagacucu

SEQ ID NO: 983108 - RNA, 22 nt, Human
cuggagaggcugggaacagguu

SEQ ID NO: 983109 - RNA, 22 nt, Human
aguacagaccugucucuuccug

SEQ ID NO: 983110 - RNA, 22 nt, Human
cacagggcaccaguuggccauc

SEQ ID NO: 983111 - RNA, 22 nt, Human
gcucagagcacucagacucagc

SEQ ID NO: 983112 - RNA, 22 nt, Human
cugagccaugagccugcgccca

SEQ ID NO: 983113 - RNA, 22 nt, Human
agggccagcacuccuggcagga

SEQ ID NO: 983114 - RNA, 22 nt, Human
ccuuucucuggcagcaggacag

SEQ ID NO: 983115 - RNA, 22 nt, Human
caaaugcauagaaagaugaaac

SEQ ID NO: 983116 - RNA, 22 nt, Human
cacagggcagguacucucagag

SEQ ID NO: 983117 - RNA, 19 nt, Human
gcuggccacgccccaguug

SEQ ID NO: 983118 - RNA, 21 nt, Human
uccucugcagugagguggccu

SEQ ID NO: 983119 - RNA, 22 nt, Human
guguguccucaguaguggcaug

SEQ ID NO: 983120 - RNA, 22 nt, Human
cuggguggcuguccagccagcc

SEQ ID NO: 983121 - RNA, 22 nt, Human
acuggccaugggauuuauauuu

SEQ ID NO: 983122 - RNA, 22 nt, Human
uuggccaaaggaaagacuacug

SEQ ID NO: 983123 - RNA, 22 nt, Human
gcagggugccgacuucagggau

SEQ ID NO: 983124 - RNA, 22 nt, Human
uagcugugagcacccaggcugu

SEQ ID NO: 983125 - RNA, 23 nt, Human
uugcuucugugcaauucaguacu

SEQ ID NO: 983126 - RNA, 22 nt, Human
cugcugucauagccaucccucc

SEQ ID NO: 983127 - RNA, 21 nt, Human
ugaaaguuggagucaaaugua

SEQ ID NO: 983128 - RNA, 23 nt, Human
aggcccugccugucccucuuuuu

SEQ ID NO: 983129 - RNA, 22 nt, Human
gcaggguaggugacagguaguc

SEQ ID NO: 983130 - RNA, 22 nt, Human
ucagaagcaggagugugcacaa

SEQ ID NO: 983131 - RNA, 22 nt, Human
aaggucauuuuuuccucuguug

SEQ ID NO: 983132 - RNA, 22 nt, Human
acccagcucuuugauggucuug

SEQ ID NO: 983133 - RNA, 19 nt, Human
ggccaggcugacugugguc

SEQ ID NO: 983134 - RNA, 21 nt, Human
auguaggguuugccuucucua

SEQ ID NO: 983135 - RNA, 22 nt, Human
cagggguguuuuuggccaggag

SEQ ID NO: 983136 - RNA, 22 nt, Human
uggcccugacacgugguacugg

SEQ ID NO: 983137 - RNA, 22 nt, Human
ucuccaagcagggcugcaaggc

SEQ ID NO: 983138 - RNA, 22 nt, Human
cucugagagcggucuguggcuu

SEQ ID NO: 983139 - RNA, 22 nt, Human
uauuucuuguuauucucguuga

SEQ ID NO: 983140 - RNA, 17 nt, Human
uauguaguacuuauaaa

SEQ ID NO: 983141 - RNA, 22 nt, Human
ggcuggaaaagacaaagcuauu

SEQ ID NO: 983142 - RNA, 22 nt, Human
accuuaaaacugacacauggag

SEQ ID NO: 983143 - RNA, 22 nt, Human
cagaggcucuuccucacugccc

SEQ ID NO: 983144 - RNA, 22 nt, Human
uuuuccuacugauaaacaguua

SEQ ID NO: 983145 - RNA, 22 nt, Human
gccucugcaugcucagcaccca

SEQ ID NO: 983146 - RNA, 22 nt, Human
ccuggaugauccaugucaugga

SEQ ID NO: 983147 - RNA, 22 nt, Human
uuggcagauuugucaguaagcu

SEQ ID NO: 983148 - RNA, 22 nt, Human
acacagggcggaaagcaugaga

SEQ ID NO: 983149 - RNA, 22 nt, Human
ugaggcuggcaaggcugguauu

SEQ ID NO: 983150 - RNA, 22 nt, Human
uaggaugaucuuguagagagau

SEQ ID NO: 983151 - RNA, 19 nt, Human
uagaaugcccacuuaaaaa

SEQ ID NO: 983152 - RNA, 22 nt, Human
cuggguggcagagccugcagug

SEQ ID NO: 983153 - RNA, 22 nt, Human
cagccccucacagagcuguccu

SEQ ID NO: 983154 - RNA, 22 nt, Human
cccaucaggaacccaggagccc

SEQ ID NO: 983155 - RNA, 22 nt, Human
aaaguguugauaugugacaucc

SEQ ID NO: 983156 - RNA, 22 nt, Human
uuccucagagggcgcuggggaa

SEQ ID NO: 983157 - RNA, 22 nt, Human
ucacagaaauaagauaguuauu

SEQ ID NO: 983158 - RNA, 20 nt, Human
aggaagccaaaggcugucuu

SEQ ID NO: 983159 - RNA, 22 nt, Human
gauggcagguaguggucucauc

SEQ ID NO: 983160 - RNA, 21 nt, Human
gcucccuggcugugugaccug

SEQ ID NO: 983161 - RNA, 22 nt, Human
aaaaagcuuaaaugagcaguuc

SEQ ID NO: 983162 - RNA, 22 nt, Human
ccagagccugcugagccccauu

SEQ ID NO: 983163 - RNA, 19 nt, Human
gcacugaagaguuggucac

SEQ ID NO: 983164 - RNA, 22 nt, Human
uggaagcaucacuucuugccug

SEQ ID NO: 983165 - RNA, 22 nt, Human
gccuggagacagcagaggcggc

SEQ ID NO: 983166 - RNA, 22 nt, Human
ugccagggugucaggagagcua

SEQ ID NO: 983167 - RNA, 22 nt, Human
cuggacuuuggcccaucugcca

SEQ ID NO: 983168 - RNA, 20 nt, Human
cuuggccuacuuagcuuugu

SEQ ID NO: 983169 - RNA, 22 nt, Human
aagcucugcucagcagacuagg

SEQ ID NO: 983170 - RNA, 22 nt, Human
gagcagugagugaauguugccu

SEQ ID NO: 983171 - RNA, 22 nt, Human
cuucaagaagacagcagagcau

SEQ ID NO: 983172 - RNA, 22 nt, Human
aacaugaagguaggaugguuuu

SEQ ID NO: 983173 - RNA, 22 nt, Human
acagaaauuagcagugaguuua

SEQ ID NO: 983174 - RNA, 19 nt, Human
ucuaacagaagugucgucc

SEQ ID NO: 983175 - RNA, 22 nt, Human
guuauugcaguauagaggucua

SEQ ID NO: 983176 - RNA, 22 nt, Human
auuguaucuugucauuaugcau

SEQ ID NO: 983177 - RNA, 22 nt, Human
cagggagggacaauugucaccu

SEQ ID NO: 983178 - RNA, 22 nt, Human
aaucaguauugguauagaauga

SEQ ID NO: 983179 - RNA, 22 nt, Human
gaggggcugcccuggugucagg

SEQ ID NO: 983180 - RNA, 22 nt, Human
gcauuuaaauuugaacuucaga

SEQ ID NO: 983181 - RNA, 19 nt, Human
gcccugcaggagguggggc

SEQ ID NO: 983182 - RNA, 22 nt, Human
cccuggagguggagguugcagg

SEQ ID NO: 983183 - RNA, 22 nt, Human
acaaaguuugugguauuccaag

SEQ ID NO: 983184 - RNA, 22 nt, Human
guggcugcuacagagcuggagg

SEQ ID NO: 983185 - RNA, 22 nt, Human
ugaagcaggaucguuugcuuca

SEQ ID NO: 983186 - RNA, 22 nt, Human
cucaguuucuucauauuguagg

SEQ ID NO: 983187 - RNA, 22 nt, Human
ugugacagaucuuuaaauaaug

SEQ ID NO: 983188 - RNA, 23 nt, Human
ugcucccaggugacgcugcuguu

SEQ ID NO: 983189 - RNA, 22 nt, Human
cccuggaagguucucuggcuca

SEQ ID NO: 983190 - RNA, 22 nt, Human
agccagcagggcuuagaggaca

SEQ ID NO: 983191 - RNA, 22 nt, Human
ccagcccuugagauggaaggga

SEQ ID NO: 983192 - RNA, 22 nt, Human
gaaacacaugcagcuccauaga

SEQ ID NO: 983193 - RNA, 17 nt, Human
ugccagccugucccagg

SEQ ID NO: 983194 - RNA, 22 nt, Human
uuuaucuuuggaucuucagaaa

SEQ ID NO: 983195 - RNA, 22 nt, Human
uuucacauacaguguauaguag

SEQ ID NO: 983196 - RNA, 22 nt, Human
agcugcugcgccucacccuggc

SEQ ID NO: 983197 - RNA, 22 nt, Human
cugaaggagaaggccacuguuc

SEQ ID NO: 983198 - RNA, 22 nt, Human
ggcauguuucaucacaucaaga

SEQ ID NO: 983199 - RNA, 21 nt, Human
uuuuuucuugcgugaggccug

SEQ ID NO: 983200 - RNA, 22 nt, Human
gagcaacaguuuaugguuuuuc

SEQ ID NO: 983201 - RNA, 22 nt, Human
aucaggauggguuuggcuuagg

SEQ ID NO: 983202 - RNA, 22 nt, Human
ucacagggauggaauagaaaua

SEQ ID NO: 983203 - RNA, 22 nt, Human
aaugugguuaacccauuuaaga

SEQ ID NO: 983204 - RNA, 22 nt, Human
aagggcuggcccugggaagagu

SEQ ID NO: 983205 - RNA, 22 nt, Human
cugcagaguggagccucggcug

SEQ ID NO: 983206 - RNA, 22 nt, Human
uaggauuuggcuuuagucaggu

SEQ ID NO: 983207 - RNA, 22 nt, Human
cucugcuuuuuaaaaggagucc

SEQ ID NO: 983208 - RNA, 22 nt, Human
uagaggugacacugagaccaua

SEQ ID NO: 983209 - RNA, 22 nt, Human
uuugcauuaucucacuuauaua

SEQ ID NO: 983210 - RNA, 20 nt, Human
guggccuguccuguuguggg

SEQ ID NO: 983211 - RNA, 22 nt, Human
auaaggcaucucucaguuagca

SEQ ID NO: 983212 - RNA, 22 nt, Human
uucucauucugacucaguguag

SEQ ID NO: 983213 - RNA, 22 nt, Human
ccuggccucagacagagggugg

SEQ ID NO: 983214 - RNA, 22 nt, Human
cuggacagaaaaggccacugga

SEQ ID NO: 983215 - RNA, 22 nt, Human
gggcagauggggcacaggcuga

SEQ ID NO: 983216 - RNA, 22 nt, Human
acagccugagaguggagcuggc

SEQ ID NO: 983217 - RNA, 22 nt, Human
aaucaguuguccaaaguucaca

SEQ ID NO: 983218 - RNA, 22 nt, Human
gucacacuagggccaaguggag

SEQ ID NO: 983219 - RNA, 22 nt, Human
ggcagcuggggcagugcccugu

SEQ ID NO: 983220 - RNA, 22 nt, Human
ccugggcuggaguacagcagug

SEQ ID NO: 983221 - RNA, 22 nt, Human
agcagacaacccagaugaccca

SEQ ID NO: 983222 - RNA, 22 nt, Human
gagggcaggggucuugcacggu

SEQ ID NO: 983223 - RNA, 22 nt, Human
cuggcucaauaaauauuagcug

SEQ ID NO: 983224 - RNA, 22 nt, Human
auguguaaaaagugcuuaauau

SEQ ID NO: 983225 - RNA, 22 nt, Human
ugcacacacaugaaguagcaug

SEQ ID NO: 983226 - RNA, 22 nt, Human
agccuguccagaggacagggcu

SEQ ID NO: 983227 - RNA, 22 nt, Human
acuuggagagcauugcugggga

SEQ ID NO: 983228 - RNA, 22 nt, Human
gcagcugaagcugcaguuccag

SEQ ID NO: 983229 - RNA, 22 nt, Human
cuggagcuccagggucuccucu

SEQ ID NO: 983230 - RNA, 20 nt, Human
ugcagcuucaccugugucau

SEQ ID NO: 983231 - RNA, 22 nt, Human
gaaaaagugaccuugguagcua

SEQ ID NO: 983232 - RNA, 22 nt, Human
ggcugcagaaguacuuccggau

SEQ ID NO: 983233 - RNA, 17 nt, Human
gucugggcuuuagagac

SEQ ID NO: 983234 - RNA, 22 nt, Human
ccagggcagugggagaaggugc

SEQ ID NO: 983235 - RNA, 22 nt, Human
agccacagcgaaccucucuucc

SEQ ID NO: 983236 - RNA, 22 nt, Human
ccugggcuuucaaaaccagccu

SEQ ID NO: 983237 - RNA, 22 nt, Human
gccugggaacucugaucuccug

SEQ ID NO: 983238 - RNA, 22 nt, Human
cacguuuuaugacagaagaagc

SEQ ID NO: 983239 - RNA, 22 nt, Human
gcacagggcugccaggcggcuu

SEQ ID NO: 983240 - RNA, 22 nt, Human
uccucaggaucuaggagugcuu

SEQ ID NO: 983241 - RNA, 22 nt, Human
cuggccaacuugcuuguuggca

SEQ ID NO: 983242 - RNA, 22 nt, Human
acagcacaaucugagucccaga

SEQ ID NO: 983243 - RNA, 22 nt, Human
gcacccagaauaaggacaggac

SEQ ID NO: 983244 - RNA, 22 nt, Human
auugaaaggcaaaguaggaagc

SEQ ID NO: 983245 - RNA, 22 nt, Human
cacacaugucucuccaugcucu

SEQ ID NO: 983246 - RNA, 22 nt, Human
ucuucuccagugcuucugcaca

SEQ ID NO: 983247 - RNA, 22 nt, Human
acguuuucagccuuaauguaga

SEQ ID NO: 983248 - RNA, 23 nt, Human
gccuggccaccccagggcugcuu

SEQ ID NO: 983249 - RNA, 21 nt, Human
agugaaauugcaucagaggga

SEQ ID NO: 983250 - RNA, 22 nt, Human
uucugggacaucuggacaguuu

SEQ ID NO: 983251 - RNA, 22 nt, Human
ugccacagaggugaagcccacu

SEQ ID NO: 983252 - RNA, 22 nt, Human
ugguaaagaaggcuagaucuga

SEQ ID NO: 983253 - RNA, 21 nt, Human
agggccugugcucuccagguc

SEQ ID NO: 983254 - RNA, 22 nt, Human
gaaaggucuuccggucuuccag

SEQ ID NO: 983255 - RNA, 22 nt, Human
aaaauaucagcaaagggugaca

SEQ ID NO: 983256 - RNA, 22 nt, Human
ccuggccagcagccccuuccuc

SEQ ID NO: 983257 - RNA, 22 nt, Human
gauuuauuggucuuucauuggu

SEQ ID NO: 983258 - RNA, 20 nt, Human
ccugccuguguuugugauga

SEQ ID NO: 983259 - RNA, 18 nt, Human
auuuugaacaaugcugua

SEQ ID NO: 983260 - RNA, 20 nt, Human
cagaaggucuaagcuuuaga

SEQ ID NO: 983261 - RNA, 22 nt, Human
gcagacuguaucaaugucagua

SEQ ID NO: 983262 - RNA, 22 nt, Human
cagggccagcgcccaggcccag

SEQ ID NO: 983263 - RNA, 20 nt, Human
ggucccugcccucugucauc

SEQ ID NO: 983264 - RNA, 22 nt, Human
caugcuuuaccaaagcagugau

SEQ ID NO: 983265 - RNA, 22 nt, Human
caggaaagagcugccaggcagg

SEQ ID NO: 983266 - RNA, 22 nt, Human
acugcagccuagggaccacagu

SEQ ID NO: 983267 - RNA, 21 nt, Human
gggaaugagauucuuggagau

SEQ ID NO: 983268 - RNA, 22 nt, Human
ggaccagagaagugagcaccug

SEQ ID NO: 983269 - RNA, 22 nt, Human
agaagaaacugucggggauauu

SEQ ID NO: 983270 - RNA, 20 nt, Human
uuccagagaucugcauuuua

SEQ ID NO: 983271 - RNA, 20 nt, Human
uaagaacaagacuaggaagc

SEQ ID NO: 983272 - RNA, 22 nt, Human
ucaagcaggguagcaagcuggu

SEQ ID NO: 983273 - RNA, 23 nt, Human
ucagcugcuuccuccugccugcc

SEQ ID NO: 983274 - RNA, 22 nt, Human
cugccucuugacagaucguggc

SEQ ID NO: 983275 - RNA, 22 nt, Human
ugcugcacaauuggaaaguauc

SEQ ID NO: 983276 - RNA, 18 nt, Human
ccuggaccugucuccuuu

SEQ ID NO: 983277 - RNA, 22 nt, Human
ccucuccaguuuuaacgugacc

SEQ ID NO: 983278 - RNA, 20 nt, Human
uuaggcauuuggauuggcuu

SEQ ID NO: 983279 - RNA, 22 nt, Human
ccaggcugccgaggaaagaaag

SEQ ID NO: 983280 - RNA, 22 nt, Human
gugccugguuuggggaguguuc

SEQ ID NO: 983281 - RNA, 22 nt, Human
aggggugauuugggacaggaca

SEQ ID NO: 983282 - RNA, 22 nt, Human
gccugcagauauauaggauggu

SEQ ID NO: 983283 - RNA, 22 nt, Human
gaguggggcccacugcugggug

SEQ ID NO: 983284 - RNA, 22 nt, Human
ugugccuggcauucugggcuuc

SEQ ID NO: 983285 - RNA, 22 nt, Human
augcucuggaguacgugaaauu

SEQ ID NO: 983286 - RNA, 22 nt, Human
uaacccaauaauugguggccuu

SEQ ID NO: 983287 - RNA, 22 nt, Human
gugcagugagcagugcagcacc

SEQ ID NO: 983288 - RNA, 22 nt, Human
agugggcagugcgcucggaugc

SEQ ID NO: 983289 - RNA, 22 nt, Human
cacuggggugggccugguagag

SEQ ID NO: 983290 - RNA, 22 nt, Human
ucaggagaaucagggcuguccu

SEQ ID NO: 983291 - RNA, 22 nt, Human
ggucccugaagaggccuggggu

SEQ ID NO: 983292 - RNA, 22 nt, Human
ucacaucuuauuagaguaucuc

SEQ ID NO: 983293 - RNA, 21 nt, Human
gcacagggacagaucaucaca

SEQ ID NO: 983294 - RNA, 22 nt, Human
agucccagugagaugagccacg

SEQ ID NO: 983295 - RNA, 22 nt, Human
uggcucuggggacaguaagucc

SEQ ID NO: 983296 - RNA, 22 nt, Human
cuucacaaagcucucuuuaugu

SEQ ID NO: 983297 - RNA, 22 nt, Human
cagcagcuacuuggagcagcag

SEQ ID NO: 983298 - RNA, 22 nt, Human
aguguuccugcucucaggaagc

SEQ ID NO: 983299 - RNA, 22 nt, Human
gcagugguggagcuuacauauc

SEQ ID NO: 983300 - RNA, 22 nt, Human
uauguacacauacacuuguaau

SEQ ID NO: 983301 - RNA, 22 nt, Human
aauucacaggagguauuugucc

SEQ ID NO: 983302 - RNA, 22 nt, Human
uuuauauuucccaggauuggcc

SEQ ID NO: 983303 - RNA, 22 nt, Human
gugccugggcaugagcuuguug

SEQ ID NO: 983304 - RNA, 22 nt, Human
agcauaaguugguacagccacu

SEQ ID NO: 983305 - RNA, 19 nt, Human
uggcugggcgugccuccgu

SEQ ID NO: 983306 - RNA, 22 nt, Human
gcaggcagucaucuuucauauu

SEQ ID NO: 983307 - RNA, 22 nt, Human
ccuggugccacuagagaauguc

SEQ ID NO: 983308 - RNA, 22 nt, Human
acuccuggaaaagaacgcaggg

SEQ ID NO: 983309 - RNA, 18 nt, Human
cugagggcagccccuggg

SEQ ID NO: 983310 - RNA, 22 nt, Human
cugggaggcccacguugggaag

SEQ ID NO: 983311 - RNA, 21 nt, Human
agcagagugcuuugacuuugu

SEQ ID NO: 983312 - RNA, 22 nt, Human
gagguagccacagauagagacu

SEQ ID NO: 983313 - RNA, 22 nt, Human
ccagcagagucuaggaaggagg

SEQ ID NO: 983314 - RNA, 22 nt, Human
uaaaagacauauaacuguagga

SEQ ID NO: 983315 - RNA, 22 nt, Human
gagccagcgccuugccucuggg

SEQ ID NO: 983316 - RNA, 22 nt, Human
agaauaaauguuggacuuagga

SEQ ID NO: 983317 - RNA, 20 nt, Human
uccugagccuccaccauguc

SEQ ID NO: 983318 - RNA, 22 nt, Human
aggugagugugacugcaagaga

SEQ ID NO: 983319 - RNA, 22 nt, Human
ucugggagguaaccaugcugau

SEQ ID NO: 983320 - RNA, 22 nt, Human
gcugagggcauguguggcgacu

SEQ ID NO: 983321 - RNA, 22 nt, Human
guggcucucgccagccugcggg

SEQ ID NO: 983322 - RNA, 22 nt, Human
uugaaaggugcugugugcugau

SEQ ID NO: 983323 - RNA, 22 nt, Human
uccaagggcagccauagaacuu

SEQ ID NO: 983324 - RNA, 22 nt, Human
ccuucucuacuccugaugcaug

SEQ ID NO: 983325 - RNA, 22 nt, Human
ccuggagcaaaaaucuaaggag

SEQ ID NO: 983326 - RNA, 22 nt, Human
agccacagcauguguguaugua

SEQ ID NO: 983327 - RNA, 22 nt, Human
uuugcauuacuugacuuuaguu

SEQ ID NO: 983328 - RNA, 22 nt, Human
ccagcacugcucucagacugag

SEQ ID NO: 983329 - RNA, 22 nt, Human
ugcaggugcguuuucaagccuc

SEQ ID NO: 983330 - RNA, 22 nt, Human
ccuucuuaaacaucauuuuggc

SEQ ID NO: 983331 - RNA, 22 nt, Human
cuggggccacaacggcgcacgc

SEQ ID NO: 983332 - RNA, 22 nt, Human
uuaauguguguacaggauuuug

SEQ ID NO: 983333 - RNA, 22 nt, Human
caggaacacaaguucagggaug

SEQ ID NO: 983334 - RNA, 22 nt, Human
agcagaacugaugagacuugag

SEQ ID NO: 983335 - RNA, 22 nt, Human
guauuuauaggggaaugagagu

SEQ ID NO: 983336 - RNA, 22 nt, Human
uucaaugagcccggggccauag

SEQ ID NO: 983337 - RNA, 19 nt, Human
ccuuugaaucaggacacuu

SEQ ID NO: 983338 - RNA, 22 nt, Human
ugaaaguuacaggaaaacagau

SEQ ID NO: 983339 - RNA, 22 nt, Human
gugcuuccaucuagagggucac

SEQ ID NO: 983340 - RNA, 22 nt, Human
ccugccaggcuuugggcuucug

SEQ ID NO: 983341 - RNA, 22 nt, Human
ucuucaaaaaauauccaucagu

SEQ ID NO: 983342 - RNA, 22 nt, Human
ugcuggcccaguauggacugca

SEQ ID NO: 983343 - RNA, 22 nt, Human
aguuacuugagacguuuaugaa

SEQ ID NO: 983344 - RNA, 22 nt, Human
uggggguguccuggugcacaca

SEQ ID NO: 983345 - RNA, 22 nt, Human
gcuccuggcucucugagggcug

SEQ ID NO: 983346 - RNA, 22 nt, Human
ucagggcauacucuucaagguc

SEQ ID NO: 983347 - RNA, 22 nt, Human
gagggcugaagauuguggcccc

SEQ ID NO: 983348 - RNA, 22 nt, Human
ugcucagggacaauggagaggg

SEQ ID NO: 983349 - RNA, 22 nt, Human
auagaacagaaacagaugcaca

SEQ ID NO: 983350 - RNA, 17 nt, Human
aucuggcugcuucuaga

SEQ ID NO: 983351 - RNA, 20 nt, Human
ccuccaggcacacccaugug

SEQ ID NO: 983352 - RNA, 22 nt, Human
ugauuuuuagcuauucugaaga

SEQ ID NO: 983353 - RNA, 22 nt, Human
cucaccacagagccuguccagc

SEQ ID NO: 983354 - RNA, 22 nt, Human
uggagaugaauauguguaccug

SEQ ID NO: 983355 - RNA, 22 nt, Human
aaguuugugucagagcuguuac

SEQ ID NO: 983356 - RNA, 22 nt, Human
auuuggcaaauaauuugagggu

SEQ ID NO: 983357 - RNA, 22 nt, Human
cccagacugcagagcgggcaga

SEQ ID NO: 983358 - RNA, 22 nt, Human
ucacagacaauuguuuuggugu

SEQ ID NO: 983359 - RNA, 22 nt, Human
gcagggaaggggcaugcuggag

SEQ ID NO: 983360 - RNA, 22 nt, Human
ggcugggcugcugggucagagc

SEQ ID NO: 983361 - RNA, 22 nt, Human
ugcccaggaucuggcgaugcuc

SEQ ID NO: 983362 - RNA, 22 nt, Human
ccagggcaggagaaagacucac

SEQ ID NO: 983363 - RNA, 22 nt, Human
ggccaccuuccaguugccugca

SEQ ID NO: 983364 - RNA, 22 nt, Human
aaauaaguaguuuaguguugug

SEQ ID NO: 983365 - RNA, 22 nt, Human
uuacaaagaguguucuuuucca

SEQ ID NO: 983366 - RNA, 22 nt, Human
ucaaaguagggguaagccaggc

SEQ ID NO: 983367 - RNA, 22 nt, Human
auguuuuacccuuugcacaaac

SEQ ID NO: 983368 - RNA, 22 nt, Human
uccugccuuagagcaaggaaaa

SEQ ID NO: 983369 - RNA, 21 nt, Human
ugcaugcuauguuuuuauuuc

SEQ ID NO: 983370 - RNA, 22 nt, Human
gcuggaccaggugugcacaggc

SEQ ID NO: 983371 - RNA, 22 nt, Human
uuguaacaggcacucugugcca

SEQ ID NO: 983372 - RNA, 23 nt, Human
auucuucauuaucuucuagaaaa

SEQ ID NO: 983373 - RNA, 22 nt, Human
gaggccuggaauuccagccugg

SEQ ID NO: 983374 - RNA, 22 nt, Human
gaagccaagugcaaaugccuua

SEQ ID NO: 983375 - RNA, 22 nt, Human
ggccuggcauggggacuaaggg

SEQ ID NO: 983376 - RNA, 22 nt, Human
caaggcaggcaguucacuugag

SEQ ID NO: 983377 - RNA, 22 nt, Human
agccccaguaagggagggccug

SEQ ID NO: 983378 - RNA, 22 nt, Human
agucucugcaugaugcagcaca

SEQ ID NO: 983379 - RNA, 22 nt, Human
uaugcacaccuggguccuuguc

SEQ ID NO: 983380 - RNA, 22 nt, Human
ugggcuggcugaacuucaaccu

SEQ ID NO: 983381 - RNA, 22 nt, Human
ccagaagucaggaaugagucuu

SEQ ID NO: 983382 - RNA, 22 nt, Human
agccuucaguaaauccacugug

SEQ ID NO: 983383 - RNA, 22 nt, Human
ucugggcucugucagcaccucu

SEQ ID NO: 983384 - RNA, 22 nt, Human
augacagaaggccucccugaca

SEQ ID NO: 983385 - RNA, 22 nt, Human
ucucccacgguacaggauaaac

SEQ ID NO: 983386 - RNA, 22 nt, Human
acugcagcaaagcccgugucuu

SEQ ID NO: 983387 - RNA, 22 nt, Human
uggccuggcucacagugagauu

SEQ ID NO: 983388 - RNA, 22 nt, Human
ggccagaggccauccuccugcu

SEQ ID NO: 983389 - RNA, 22 nt, Human
uuucauguuuucuuaaauggca

SEQ ID NO: 983390 - RNA, 22 nt, Human
augguguagcaugugauaugac

SEQ ID NO: 983391 - RNA, 22 nt, Human
acuuguguaacacagaaagaac

SEQ ID NO: 983392 - RNA, 22 nt, Human
cauauaaauacaacauguguua

SEQ ID NO: 983393 - RNA, 22 nt, Human
aagucacacuagacaacugagg

SEQ ID NO: 983394 - RNA, 22 nt, Human
uggggcuggcuauugucucccu

SEQ ID NO: 983395 - RNA, 22 nt, Human
uggcugggccgggccuugugcc

SEQ ID NO: 983396 - RNA, 22 nt, Human
guggccuggaugagcuucgaca

SEQ ID NO: 983397 - RNA, 22 nt, Human
auuucauugaaguuaauucuuc

SEQ ID NO: 983398 - RNA, 22 nt, Human
cagcccuuuccuucucagcuuu

SEQ ID NO: 983399 - RNA, 20 nt, Human
ucugccacugcacucugccc

SEQ ID NO: 983400 - RNA, 22 nt, Human
ugggaugggaucucgcuguguc

SEQ ID NO: 983401 - RNA, 22 nt, Human
agcuggguguguaucagauaaa

SEQ ID NO: 983402 - RNA, 22 nt, Human
cagcccuggccccagguggucu

SEQ ID NO: 983403 - RNA, 22 nt, Human
gccuggcccagggcucuuguug

SEQ ID NO: 983404 - RNA, 22 nt, Human
ucagcagauggguuguguuggc

SEQ ID NO: 983405 - RNA, 22 nt, Human
ugccuggguccaggccaagccu

SEQ ID NO: 983406 - RNA, 22 nt, Human
gugcucaggaagcuguuccugc

SEQ ID NO: 983407 - RNA, 22 nt, Human
gaaaaugugccuuuggguauug

SEQ ID NO: 983408 - RNA, 22 nt, Human
auucacaaguugauggauauuu

SEQ ID NO: 983409 - RNA, 23 nt, Human
uggauaaagcugugcugcauagg

SEQ ID NO: 983410 - RNA, 22 nt, Human
cugugcuggagaugggccagag

SEQ ID NO: 983411 - RNA, 22 nt, Human
uccauggguagcccugguugag

SEQ ID NO: 983412 - RNA, 22 nt, Human
uggagcaggugggaugucguga

SEQ ID NO: 983413 - RNA, 22 nt, Human
gagcaggcucugccuguguguc

SEQ ID NO: 983414 - RNA, 22 nt, Human
gggcaguggguggcugcagccu

SEQ ID NO: 983415 - RNA, 22 nt, Human
ucauccuuuugcaugggaaggc

SEQ ID NO: 983416 - RNA, 22 nt, Human
cagagcugguguuacaagucca

SEQ ID NO: 983417 - RNA, 22 nt, Human
ucaaaguccuugcuuuuucugu

SEQ ID NO: 983418 - RNA, 22 nt, Human
cagggguggcugcagcagaggu

SEQ ID NO: 983419 - RNA, 22 nt, Human
ggucacaggggagaagagugau

SEQ ID NO: 983420 - RNA, 22 nt, Human
ugcagggccuucuagaccaugg

SEQ ID NO: 983421 - RNA, 22 nt, Human
cccauuuagauaacaguucaaa

SEQ ID NO: 983422 - RNA, 22 nt, Human
ucagggaaucagacucugcagc

SEQ ID NO: 983423 - RNA, 22 nt, Human
ugcugccucagcuuccugggcu

SEQ ID NO: 983424 - RNA, 22 nt, Human
ggagcagagcugggcuuggcug

SEQ ID NO: 983425 - RNA, 22 nt, Human
agcugcccuucucuugcccuug

SEQ ID NO: 983426 - RNA, 22 nt, Human
gccugucugcagggcugucauu

SEQ ID NO: 983427 - RNA, 22 nt, Human
aagggacuuugucagcuuucca

SEQ ID NO: 983428 - RNA, 22 nt, Human
cacauuuaaagguugaagcuga

SEQ ID NO: 983429 - RNA, 22 nt, Human
agccuggacagcuacggagaac

SEQ ID NO: 983430 - RNA, 18 nt, Human
caguuuuuauaucuggca

SEQ ID NO: 983431 - RNA, 22 nt, Human
ucucagaggcccgacguucucc

SEQ ID NO: 983432 - RNA, 22 nt, Human
gccuccugguugcuucuccaac

SEQ ID NO: 983433 - RNA, 22 nt, Human
ucuggcucaaaauacguacucu

SEQ ID NO: 983434 - RNA, 22 nt, Human
aacaaauguguuuuguaauuaa

SEQ ID NO: 983435 - RNA, 22 nt, Human
cuuucucugugugguaaagggc

SEQ ID NO: 983436 - RNA, 22 nt, Human
ccagcugcugugcagggaggcu

SEQ ID NO: 983437 - RNA, 22 nt, Human
gagggauggugugagaggcuca

SEQ ID NO: 983438 - RNA, 22 nt, Human
ucuggccauggcaagccgagug

SEQ ID NO: 983439 - RNA, 22 nt, Human
caggcacucauucagagaggug

SEQ ID NO: 983440 - RNA, 22 nt, Human
aaggacuccaauucuuucaucu

SEQ ID NO: 983441 - RNA, 22 nt, Human
gccuuggcugaugugcgaauga

SEQ ID NO: 983442 - RNA, 22 nt, Human
gcauucaucuuccuccaugcag

SEQ ID NO: 983443 - RNA, 22 nt, Human
gacccugccaugagugacaggg

SEQ ID NO: 983444 - RNA, 22 nt, Human
ggcugccuucccugagccccgg

SEQ ID NO: 983445 - RNA, 22 nt, Human
uccucuucugcccaucagaggc

SEQ ID NO: 983446 - RNA, 22 nt, Human
ugaaauguuugaagaccacuga

SEQ ID NO: 983447 - RNA, 22 nt, Human
uuuccucuaaacgcauuugcuu

SEQ ID NO: 983448 - RNA, 22 nt, Human
ugcauccuuaaccagcaucacu

SEQ ID NO: 983449 - RNA, 22 nt, Human
uggcucuggugcgggcuccugc

SEQ ID NO: 983450 - RNA, 22 nt, Human
gcugccucuguagcuuuggacc

SEQ ID NO: 983451 - RNA, 22 nt, Human
gugccuggcaugcgccggugcu

SEQ ID NO: 983452 - RNA, 22 nt, Human
aucuggcuugacuuugcgacuu

SEQ ID NO: 983453 - RNA, 21 nt, Human
ucugucucuccacugcccugc

SEQ ID NO: 983454 - RNA, 22 nt, Human
aggucccaggcauagcuggucu

SEQ ID NO: 983455 - RNA, 22 nt, Human
uguguccauucaggcacugacc

SEQ ID NO: 983456 - RNA, 22 nt, Human
aaggccaggacaccaggggacu

SEQ ID NO: 983457 - RNA, 22 nt, Human
agagcagccugugaugaugcac

SEQ ID NO: 983458 - RNA, 20 nt, Human
aauauaauucucugaauuua

SEQ ID NO: 983459 - RNA, 22 nt, Human
cagcccucagguccucagcagc

SEQ ID NO: 983460 - RNA, 22 nt, Human
augagacuaccuguaauguggc

SEQ ID NO: 983461 - RNA, 22 nt, Human
uguacaugugucuguauaucuu

SEQ ID NO: 983462 - RNA, 22 nt, Human
agaauuguugggguaauaaaag

SEQ ID NO: 983463 - RNA, 22 nt, Human
ugcucuggggagcuccucugcg

SEQ ID NO: 983464 - RNA, 22 nt, Human
ucugaggcccugcaggcagugu

SEQ ID NO: 983465 - RNA, 20 nt, Human
cugggcagguguuugaucuc

SEQ ID NO: 983466 - RNA, 22 nt, Human
ggaggccaucuggcuggaggcu

SEQ ID NO: 983467 - RNA, 22 nt, Human
agcugcucuuugaaggacacuu

SEQ ID NO: 983468 - RNA, 22 nt, Human
guggauggauugaggcaguggg

SEQ ID NO: 983469 - RNA, 21 nt, Human
ucccacucuaaauggacugaa

SEQ ID NO: 983470 - RNA, 19 nt, Human
aggcagcacccaguccuug

SEQ ID NO: 983471 - RNA, 22 nt, Human
agugaaauccuggucaacaggu

SEQ ID NO: 983472 - RNA, 22 nt, Human
uguggcuguguccaccugcugc

SEQ ID NO: 983473 - RNA, 19 nt, Human
uauucaggaugauggcaca

SEQ ID NO: 983474 - RNA, 22 nt, Human
uugugcauuucucugagugugu

SEQ ID NO: 983475 - RNA, 21 nt, Human
gcugagagguugggaaguuca

SEQ ID NO: 983476 - RNA, 22 nt, Human
gccugccuggagcuugagguga

SEQ ID NO: 983477 - RNA, 22 nt, Human
uuggccaaacagaguucaacag

SEQ ID NO: 983478 - RNA, 21 nt, Human
uuuauuaacaacuguggacgu

SEQ ID NO: 983479 - RNA, 22 nt, Human
aaauauagcaauuaugccuacu

SEQ ID NO: 983480 - RNA, 22 nt, Human
agagacaggguuuugccauguu

SEQ ID NO: 983481 - RNA, 22 nt, Human
cauacauuuugcauauuuacca

SEQ ID NO: 983482 - RNA, 22 nt, Human
cacucugcgcugggcgccagcg

SEQ ID NO: 983483 - RNA, 22 nt, Human
gggcuggcgggaaaggcaauuc

SEQ ID NO: 983484 - RNA, 22 nt, Human
cagcucugugcaggccugggga

SEQ ID NO: 983485 - RNA, 22 nt, Human
gcagagcugggucuguauccaa

SEQ ID NO: 983486 - RNA, 22 nt, Human
ggaggccaaggugggcggauca

SEQ ID NO: 983487 - RNA, 22 nt, Human
aagagcuggaagugaagauaac

SEQ ID NO: 983488 - RNA, 22 nt, Human
ggacagagcccugguggccuaa

SEQ ID NO: 983489 - RNA, 22 nt, Human
ccagggcugagcugugaccaug

SEQ ID NO: 983490 - RNA, 22 nt, Human
gaaggagagagacaucgucccu

SEQ ID NO: 983491 - RNA, 22 nt, Human
augcaguacagauaauucuaca

SEQ ID NO: 983492 - RNA, 22 nt, Human
ggggauggaauguaguagugau

SEQ ID NO: 983493 - RNA, 22 nt, Human
uaugcauaugaccccaagcuug

SEQ ID NO: 983494 - RNA, 23 nt, Human
cccuggagcuagucugagcagag

SEQ ID NO: 983495 - RNA, 22 nt, Human
uacauaguuccauuuacaggaa

SEQ ID NO: 983496 - RNA, 22 nt, Human
uuuauaaguacuuugucugcuu

SEQ ID NO: 983497 - RNA, 22 nt, Human
cugggcucagcccaugcugucc

SEQ ID NO: 983498 - RNA, 22 nt, Human
cacauugaaaugacccaauaau

SEQ ID NO: 983499 - RNA, 22 nt, Human
cagaaauguuuauauguggugu

SEQ ID NO: 983500 - RNA, 22 nt, Human
uggcucucagcucccagcagcc

SEQ ID NO: 983501 - RNA, 22 nt, Human
acagcuggaggucugugagcac

SEQ ID NO: 983502 - RNA, 18 nt, Human
cagaugagaugcaaucuc

SEQ ID NO: 983503 - RNA, 22 nt, Human
gaaggcuggcuuucugagagca

SEQ ID NO: 983504 - RNA, 22 nt, Human
aagccaggggcugcuuaggaga

SEQ ID NO: 983505 - RNA, 22 nt, Human
uggaggaugccuggggaggccu

SEQ ID NO: 983506 - RNA, 22 nt, Human
aucuggcucacuuagucuagga

SEQ ID NO: 983507 - RNA, 22 nt, Human
gagaaguuucugguuugcauag

SEQ ID NO: 983508 - RNA, 22 nt, Human
cagggccacccucugcugggug

SEQ ID NO: 983509 - RNA, 18 nt, Human
acauuucuaugcuucugg

SEQ ID NO: 983510 - RNA, 23 nt, Human
ucacacagcuggucagguacaga

SEQ ID NO: 983511 - RNA, 22 nt, Human
ucuguccucuuugaagcugcuc

SEQ ID NO: 983512 - RNA, 22 nt, Human
guauuagggccaaaggcaggaa

SEQ ID NO: 983513 - RNA, 22 nt, Human
cugaggagagaucacguggugu

SEQ ID NO: 983514 - RNA, 22 nt, Human
cugggccugguagggcuugaaa

SEQ ID NO: 983515 - RNA, 22 nt, Human
ggccucucauguccugggcuuc

SEQ ID NO: 983516 - RNA, 22 nt, Human
ggcaggaggaagaguuagcacc

SEQ ID NO: 983517 - RNA, 22 nt, Human
cagaggcuguguaggcagacug

SEQ ID NO: 983518 - RNA, 22 nt, Human
uucuuucacucaagaaggaucu

SEQ ID NO: 983519 - RNA, 22 nt, Human
caggcagcugaggacuuugcua

SEQ ID NO: 983520 - RNA, 22 nt, Human
gcucugcuuucuggggggaucc

SEQ ID NO: 983521 - RNA, 22 nt, Human
uggguggcggccugguucugag

SEQ ID NO: 983522 - RNA, 22 nt, Human
caggugccgggaaugcagcaau

SEQ ID NO: 983523 - RNA, 22 nt, Human
cucugugccucaguuuucuucu

SEQ ID NO: 983524 - RNA, 22 nt, Human
ucagggcaggacaguguaggcc

SEQ ID NO: 983525 - RNA, 22 nt, Human
aaagguaguacuucuagaaggg

SEQ ID NO: 983526 - RNA, 20 nt, Human
aucagcaacugccacucagu

SEQ ID NO: 983527 - RNA, 22 nt, Human
ugccucugggugaccaaggagc

SEQ ID NO: 983528 - RNA, 22 nt, Human
ccaggccuagccccugagggua

SEQ ID NO: 983529 - RNA, 22 nt, Human
agagcugcccacacagcagauu

SEQ ID NO: 983530 - RNA, 23 nt, Human
ggcucugugcugggccugcagga

SEQ ID NO: 983531 - RNA, 18 nt, Human
uccagagcuacuguggug

SEQ ID NO: 983532 - RNA, 22 nt, Human
aaaggucaagcuggacucaggu

SEQ ID NO: 983533 - RNA, 22 nt, Human
acauuucuccuacuuguuauuu

SEQ ID NO: 983534 - RNA, 22 nt, Human
uccucagggcggccuccgucuu

SEQ ID NO: 983535 - RNA, 19 nt, Human
agcagagcagggccguggg

SEQ ID NO: 983536 - RNA, 22 nt, Human
agcucuccacacauaggacuag

SEQ ID NO: 983537 - RNA, 22 nt, Human
ugccugucuuaauaucuggaaa

SEQ ID NO: 983538 - RNA, 22 nt, Human
agcuggugcugaagcucuugag

SEQ ID NO: 983539 - RNA, 22 nt, Human
ggaaggaggaugcucuggccuu

SEQ ID NO: 983540 - RNA, 19 nt, Human
aggucauugauagugcagg

SEQ ID NO: 983541 - RNA, 22 nt, Human
cacacuagucuauccauuagcu

SEQ ID NO: 983542 - RNA, 22 nt, Human
cagccagggucaggcagcuucu

SEQ ID NO: 983543 - RNA, 21 nt, Human
uccuuccuugagguccuuucc

SEQ ID NO: 983544 - RNA, 22 nt, Human
aaggcugccucugccagaggag

SEQ ID NO: 983545 - RNA, 22 nt, Human
gccaggcugcuccagggaggcc

SEQ ID NO: 983546 - RNA, 22 nt, Human
cuccacagcucaggcucagagu

SEQ ID NO: 983547 - RNA, 22 nt, Human
uuaugcuaagugcaacaagcca

SEQ ID NO: 983548 - RNA, 22 nt, Human
uuuaggaucucucuuguuacau

SEQ ID NO: 983549 - RNA, 22 nt, Human
augaagcuaaacccugcagcca

SEQ ID NO: 983550 - RNA, 22 nt, Human
aaauaugugaucagugaauaaa

SEQ ID NO: 983551 - RNA, 22 nt, Human
aagggaaaucauauggugcagu

SEQ ID NO: 983552 - RNA, 22 nt, Human
uggcucagcuuuccccaucugg

SEQ ID NO: 983553 - RNA, 22 nt, Human
cagcagggcccccgggugcgcc

SEQ ID NO: 983554 - RNA, 22 nt, Human
cugaaggauuagagagcacuua

SEQ ID NO: 983555 - RNA, 22 nt, Human
ccuggcaguuuugcccaggauu

SEQ ID NO: 983556 - RNA, 22 nt, Human
ugggcagagucguggggaauag

SEQ ID NO: 983557 - RNA, 22 nt, Human
ucagcaauccucccacaggugg

SEQ ID NO: 983558 - RNA, 22 nt, Human
uggcugggagcuggaacugggc

SEQ ID NO: 983559 - RNA, 22 nt, Human
ucugagaggcagaccuuccuaa

SEQ ID NO: 983560 - RNA, 22 nt, Human
aacuucuugguccugagcuguu

SEQ ID NO: 983561 - RNA, 22 nt, Human
cugaggugcuauggaggauacg

SEQ ID NO: 983562 - RNA, 23 nt, Human
gcagacagagcagacuaagacaa

SEQ ID NO: 983563 - RNA, 22 nt, Human
cuccagggagcuguggagguuu

SEQ ID NO: 983564 - RNA, 22 nt, Human
cagagcugagaauguugaugcu

SEQ ID NO: 983565 - RNA, 22 nt, Human
gugggaugcaguggugaguggc

SEQ ID NO: 983566 - RNA, 18 nt, Human
acaaauguagugucuuaa

SEQ ID NO: 983567 - RNA, 22 nt, Human
auaaauaucacuguugucccuc

SEQ ID NO: 983568 - RNA, 22 nt, Human
uagaauaugugguaggaucugg

SEQ ID NO: 983569 - RNA, 22 nt, Human
ggcucugcagugacuugagggg

SEQ ID NO: 983570 - RNA, 22 nt, Human
ccugccugucaucgccugcgcc

SEQ ID NO: 983571 - RNA, 22 nt, Human
gagucccaugaugauagccaca

SEQ ID NO: 983572 - RNA, 23 nt, Human
uccuccuuuugcuugugcuuccc

SEQ ID NO: 983573 - RNA, 22 nt, Human
cacaggagcuguggggcagugu

SEQ ID NO: 983574 - RNA, 22 nt, Human
gcucuguguccacagcuggaaa

SEQ ID NO: 983575 - RNA, 22 nt, Human
augucacauggucaccucuagc

SEQ ID NO: 983576 - RNA, 22 nt, Human
cuccuuccugccccagugauaa

SEQ ID NO: 983577 - RNA, 22 nt, Human
uaggcagcugcaaacuucgguc

SEQ ID NO: 983578 - RNA, 22 nt, Human
aauucuagcauugugaaaauau

SEQ ID NO: 983579 - RNA, 22 nt, Human
ucagagugguagccuauuuucu

SEQ ID NO: 983580 - RNA, 22 nt, Human
aguaaacauaauuuaccuguag

SEQ ID NO: 983581 - RNA, 22 nt, Human
aaaguaaccuaguaauaguguc

SEQ ID NO: 983582 - RNA, 22 nt, Human
guguuccauguuugagguaguu

SEQ ID NO: 983583 - RNA, 22 nt, Human
cacccagccuucacacaggagu

SEQ ID NO: 983584 - RNA, 22 nt, Human
cuggccuggcagggagggcaug

SEQ ID NO: 983585 - RNA, 23 nt, Human
ucaugcccaggcuccagauguca

SEQ ID NO: 983586 - RNA, 22 nt, Human
ugcauuguugaugaguugaaua

SEQ ID NO: 983587 - RNA, 22 nt, Human
gcagcugaauguccauugcugc

SEQ ID NO: 983588 - RNA, 22 nt, Human
uccagggguaccggccaggcag

SEQ ID NO: 983589 - RNA, 17 nt, Human
ugcauuguaggcuagcc

SEQ ID NO: 983590 - RNA, 22 nt, Human
uggcucaguaaucgagucuccu

SEQ ID NO: 983591 - RNA, 22 nt, Human
auaucacaaacaagucuguacu

SEQ ID NO: 983592 - RNA, 22 nt, Human
ugggcagaaggaagagccaccu

SEQ ID NO: 983593 - RNA, 22 nt, Human
aaaaugugcaguuuuuaagcug

SEQ ID NO: 983594 - RNA, 22 nt, Human
ugcacacaaguuggagaaugaa

SEQ ID NO: 983595 - RNA, 20 nt, Human
aggcacuguugucuguaucc

SEQ ID NO: 983596 - RNA, 22 nt, Human
gccaagagaaugugagagaaau

SEQ ID NO: 983597 - RNA, 22 nt, Human
ucccccacucuaaaggagccuu

SEQ ID NO: 983598 - RNA, 22 nt, Human
gggcugcuuccuggggaaugcu

SEQ ID NO: 983599 - RNA, 22 nt, Human
aacaaauggaacacaaaucuuu

SEQ ID NO: 983600 - RNA, 22 nt, Human
auuugucuagugguauucacgu

SEQ ID NO: 983601 - RNA, 22 nt, Human
ggaggccaguccuggccgggcu

SEQ ID NO: 983602 - RNA, 22 nt, Human
ccucccaccauuuagagagagc

SEQ ID NO: 983603 - RNA, 22 nt, Human
cagaauuuuucgaauguacugu

SEQ ID NO: 983604 - RNA, 22 nt, Human
uggagccaugccuggccuuucc

SEQ ID NO: 983605 - RNA, 22 nt, Human
agccacagcuccuugguggaga

SEQ ID NO: 983606 - RNA, 22 nt, Human
uucccaguauuaccuucaggaa

SEQ ID NO: 983607 - RNA, 22 nt, Human
aucauaaaccacuuuguaaucu

SEQ ID NO: 983608 - RNA, 22 nt, Human
ccaggccauucccagaguugcu

SEQ ID NO: 983609 - RNA, 22 nt, Human
caaauccagaucccagucguag

SEQ ID NO: 983610 - RNA, 22 nt, Human
uuacuuuguucucaagauaugu

SEQ ID NO: 983611 - RNA, 19 nt, Human
ccugugugggguagagauc

SEQ ID NO: 983612 - RNA, 22 nt, Human
uguacauugucacucaucaagu

SEQ ID NO: 983613 - RNA, 21 nt, Human
cugagggccgcagcugggcuc

SEQ ID NO: 983614 - RNA, 22 nt, Human
uggagcaggcaucuuucucucu

SEQ ID NO: 983615 - RNA, 22 nt, Human
agauuucccucuuguauuugca

SEQ ID NO: 983616 - RNA, 22 nt, Human
ucugaagccuuuguacaggccu

SEQ ID NO: 983617 - RNA, 22 nt, Human
cugcugcugcuaucuacccagg

SEQ ID NO: 983618 - RNA, 22 nt, Human
auggacaggaacucccuuggca

SEQ ID NO: 983619 - RNA, 22 nt, Human
cucaggaugucggugacuauug

SEQ ID NO: 983620 - RNA, 22 nt, Human
uagcagcuuccagagagggcag

SEQ ID NO: 983621 - RNA, 22 nt, Human
agcagggcucuguggagggugg

SEQ ID NO: 983622 - RNA, 22 nt, Human
agaauguagucuuggagauuua

SEQ ID NO: 983623 - RNA, 22 nt, Human
ugaggggagaagcagcagccug

SEQ ID NO: 983624 - RNA, 19 nt, Human
aggacucuggaggcaugag

SEQ ID NO: 983625 - RNA, 22 nt, Human
acucugcugauagguccucaga

SEQ ID NO: 983626 - RNA, 22 nt, Human
ccugucaguugcugucagggau

SEQ ID NO: 983627 - RNA, 22 nt, Human
ccugucagaugaaguaauugug

SEQ ID NO: 983628 - RNA, 22 nt, Human
uggguagagacacagucugggg

SEQ ID NO: 983629 - RNA, 22 nt, Human
agaagccauguuuaguaggaug

SEQ ID NO: 983630 - RNA, 22 nt, Human
uggcugucagcugccuggugcg

SEQ ID NO: 983631 - RNA, 22 nt, Human
aaggcagcaccgccuccugaaa

SEQ ID NO: 983632 - RNA, 19 nt, Human
gcuccuggaugaccugugg

SEQ ID NO: 983633 - RNA, 22 nt, Human
uggcucaggugugagcugaaga

SEQ ID NO: 983634 - RNA, 22 nt, Human
gggagggauuaguucugccugg

SEQ ID NO: 983635 - RNA, 22 nt, Human
gggacuggaguagaggccggug

SEQ ID NO: 983636 - RNA, 22 nt, Human
uuccucagaaaauacuguccaa

SEQ ID NO: 983637 - RNA, 19 nt, Human
agucccaggcccgaaagag

SEQ ID NO: 983638 - RNA, 20 nt, Human
uuggcagcaguuccaaguga

SEQ ID NO: 983639 - RNA, 22 nt, Human
cauggcaggugcagauucugug

SEQ ID NO: 983640 - RNA, 22 nt, Human
gccuggaguacuccuugaagug

SEQ ID NO: 983641 - RNA, 22 nt, Human
ugcagcuucuuguccugugauu

SEQ ID NO: 983642 - RNA, 22 nt, Human
gugauugcccagcaccauuguu

SEQ ID NO: 983643 - RNA, 22 nt, Human
uccuuccuggggucucugcugc

SEQ ID NO: 983644 - RNA, 22 nt, Human
cauguaaaacacucagaacagu

SEQ ID NO: 983645 - RNA, 22 nt, Human
gagccagccgcaagagcuguga

SEQ ID NO: 983646 - RNA, 22 nt, Human
uggucuaaauauggcucuaaau

SEQ ID NO: 983647 - RNA, 23 nt, Human
acugagccagggccugggucagc

SEQ ID NO: 983648 - RNA, 22 nt, Human
cugggaggcggagguuguagug

SEQ ID NO: 983649 - RNA, 22 nt, Human
uugaaaggguuaaagugguaaa

SEQ ID NO: 983650 - RNA, 22 nt, Human
auggccaagcaugccuguggcc

SEQ ID NO: 983651 - RNA, 22 nt, Human
uuaauaggcuucuaacauagcu

SEQ ID NO: 983652 - RNA, 22 nt, Human
cuucucucugcauaggcauggg

SEQ ID NO: 983653 - RNA, 22 nt, Human
uaugcacauauaaccugcacug

SEQ ID NO: 983654 - RNA, 22 nt, Human
ggagugacucucggggccacua

SEQ ID NO: 983655 - RNA, 23 nt, Human
uccagcagccaagaaggguagaa

SEQ ID NO: 983656 - RNA, 22 nt, Human
ggagugggaacaaugacauggu

SEQ ID NO: 983657 - RNA, 22 nt, Human
uaagaacauaaauucauacggg

SEQ ID NO: 983658 - RNA, 22 nt, Human
uguuuauuacaguucuuggaau

SEQ ID NO: 983659 - RNA, 22 nt, Human
agcaccaucagaugcaauaucu

SEQ ID NO: 983660 - RNA, 22 nt, Human
agcagcagauccaaaaaaugug

SEQ ID NO: 983661 - RNA, 22 nt, Human
aaacuccugcauacucagaagc

SEQ ID NO: 983662 - RNA, 22 nt, Human
gccuucaggaaaucaguccuug

SEQ ID NO: 983663 - RNA, 22 nt, Human
gauguuucaugcuagcaugugu

SEQ ID NO: 983664 - RNA, 19 nt, Human
ggaagagaggaaaggugga

SEQ ID NO: 983665 - RNA, 22 nt, Human
ugaggcagcuuuuucugugugu

SEQ ID NO: 983666 - RNA, 22 nt, Human
aggcugcuggcaggcguggacg

SEQ ID NO: 983667 - RNA, 19 nt, Human
auagucuuuccaauuauac

SEQ ID NO: 983668 - RNA, 22 nt, Human
gcugcccucccagggcaagcuu

SEQ ID NO: 983669 - RNA, 22 nt, Human
cagggagaagucuggucagucc

SEQ ID NO: 983670 - RNA, 21 nt, Human
aacauuucaggauccaaauug

SEQ ID NO: 983671 - RNA, 22 nt, Human
ucuggcucuauaacuccuagcu

SEQ ID NO: 983672 - RNA, 22 nt, Human
uggcugaauaauauucuguugu

SEQ ID NO: 983673 - RNA, 22 nt, Human
aaaugcacugaacacauguugu

SEQ ID NO: 983674 - RNA, 22 nt, Human
ucacucuggccucugcagcagu

SEQ ID NO: 983675 - RNA, 22 nt, Human
ccugcaggggagagacuucuag

SEQ ID NO: 983676 - RNA, 22 nt, Human
cuguggugagcaacugacugaa

SEQ ID NO: 983677 - RNA, 22 nt, Human
cuuagaaaucgaacucagguua

SEQ ID NO: 983678 - RNA, 22 nt, Human
augcuguagaucuuagccucua

SEQ ID NO: 983679 - RNA, 21 nt, Human
uuucacaaaaguaugugacaa

SEQ ID NO: 983680 - RNA, 22 nt, Human
gucuugaucuccugaccuugug

SEQ ID NO: 983681 - RNA, 22 nt, Human
aggaaaugcugaugcuccugga

SEQ ID NO: 983682 - RNA, 22 nt, Human
uggcugccuagugucugagcag

SEQ ID NO: 983683 - RNA, 22 nt, Human
ugggcagauguccucugaagug

SEQ ID NO: 983684 - RNA, 22 nt, Human
uuggccaacagcgacagggcca

SEQ ID NO: 983685 - RNA, 22 nt, Human
ggaggccaaagugugggcggcu

SEQ ID NO: 983686 - RNA, 21 nt, Human
ucagcagcaucugccuagagu

SEQ ID NO: 983687 - RNA, 18 nt, Human
gggcccuggcguccgccc

SEQ ID NO: 983688 - RNA, 22 nt, Human
uucauucccuuauauuagcauu

SEQ ID NO: 983689 - RNA, 22 nt, Human
gggaagauaguguugagggccc

SEQ ID NO: 983690 - RNA, 22 nt, Human
acagaguacauucagagacuau

SEQ ID NO: 983691 - RNA, 22 nt, Human
agcugcucucacuggacgccug

SEQ ID NO: 983692 - RNA, 22 nt, Human
gccugagagucugcauuucuaa

SEQ ID NO: 983693 - RNA, 22 nt, Human
uccugagauucugcauuucuaa

SEQ ID NO: 983694 - RNA, 22 nt, Human
ccucagcucuucccugugcaca

SEQ ID NO: 983695 - RNA, 22 nt, Human
aggccuagaggaauggccaggg

SEQ ID NO: 983696 - RNA, 22 nt, Human
gagcugccaagauuacaaucag

SEQ ID NO: 983697 - RNA, 22 nt, Human
ccuggcagcuccuccccggcgg

SEQ ID NO: 983698 - RNA, 22 nt, Human
ugggagcaagcuggugcuggag

SEQ ID NO: 983699 - RNA, 22 nt, Human
gcucccugccuacacggaccuu

SEQ ID NO: 983700 - RNA, 22 nt, Human
uggccuggccacauccagcagg

SEQ ID NO: 983701 - RNA, 22 nt, Human
ugggcacaaacaucugccuguu

SEQ ID NO: 983702 - RNA, 22 nt, Human
uccagggaucuuuagagucuuu

SEQ ID NO: 983703 - RNA, 22 nt, Human
agucucagcuacuugggaggcu

SEQ ID NO: 983704 - RNA, 22 nt, Human
cagagccauccaggugccuguu

SEQ ID NO: 983705 - RNA, 22 nt, Human
aacaauaauugcgguucucuau

SEQ ID NO: 983706 - RNA, 22 nt, Human
gaaauauucuugucuuguuuuc

SEQ ID NO: 983707 - RNA, 22 nt, Human
cagagccucagaauccugugga

SEQ ID NO: 983708 - RNA, 18 nt, Human
uuuaugagcugugggacc

SEQ ID NO: 983709 - RNA, 22 nt, Human
gcagcagcccagggcucucaga

SEQ ID NO: 983710 - RNA, 22 nt, Human
ugcaggccggcccuaggccuca

SEQ ID NO: 983711 - RNA, 22 nt, Human
ccucuggcuguaccacuggcac

SEQ ID NO: 983712 - RNA, 22 nt, Human
cuggagggugagccucaucucu

SEQ ID NO: 983713 - RNA, 23 nt, Human
guuguaauggauaaugcaaauug

SEQ ID NO: 983714 - RNA, 22 nt, Human
ugcagaaguauuccaggcccca

SEQ ID NO: 983715 - RNA, 22 nt, Human
cagcaauaaugucuacaaaucu

SEQ ID NO: 983716 - RNA, 22 nt, Human
uaagaacaagcuggggguucca

SEQ ID NO: 983717 - RNA, 22 nt, Human
aggauuugaaccugcauccagu

SEQ ID NO: 983718 - RNA, 20 nt, Human
ucacaucuggcagcugauga

SEQ ID NO: 983719 - RNA, 22 nt, Human
guggccugccgugugguauggg

SEQ ID NO: 983720 - RNA, 22 nt, Human
gugcauuugacgaauacucacu

SEQ ID NO: 983721 - RNA, 22 nt, Human
caugcuuucuguccaaauguua

SEQ ID NO: 983722 - RNA, 22 nt, Human
aucaggauccaccuugagccug

SEQ ID NO: 983723 - RNA, 22 nt, Human
caaggaaaacagaugaucaaca

SEQ ID NO: 983724 - RNA, 22 nt, Human
aaguugaaugcguacgugacau

SEQ ID NO: 983725 - RNA, 20 nt, Human
uucuggaggcuacaagucug

SEQ ID NO: 983726 - RNA, 22 nt, Human
gaggccugguagccgagcccca

SEQ ID NO: 983727 - RNA, 22 nt, Human
agucccaguucgguucuuccuc

SEQ ID NO: 983728 - RNA, 20 nt, Human
cugccaugauugauagagug

SEQ ID NO: 983729 - RNA, 22 nt, Human
ccucagggucugaggagaccgu

SEQ ID NO: 983730 - RNA, 22 nt, Human
ugucccagggaaggcccagcac

SEQ ID NO: 983731 - RNA, 22 nt, Human
uucuucaaaauccagcaugauu

SEQ ID NO: 983732 - RNA, 22 nt, Human
ccacagcugaccgcaggugagc

SEQ ID NO: 983733 - RNA, 22 nt, Human
ccagccuggguguuagaagaca

SEQ ID NO: 983734 - RNA, 22 nt, Human
uuccaaagaaauugaccaagac

SEQ ID NO: 983735 - RNA, 21 nt, Human
aggugcagagccagggaccag

SEQ ID NO: 983736 - RNA, 22 nt, Human
ccucugaggucauggacuuggc

SEQ ID NO: 983737 - RNA, 22 nt, Human
ugcaccccauuuuacauuuaca

SEQ ID NO: 983738 - RNA, 22 nt, Human
cagagcugcacauucuaugaug

SEQ ID NO: 983739 - RNA, 22 nt, Human
gaggaccacagaugagccugca

SEQ ID NO: 983740 - RNA, 22 nt, Human
ccugggaggcggagguugcagg

SEQ ID NO: 983741 - RNA, 22 nt, Human
auucacaaagucacccuuacac

SEQ ID NO: 983742 - RNA, 22 nt, Human
caggggcuguuugccucaggcc

SEQ ID NO: 983743 - RNA, 22 nt, Human
guggcaggucccauuggagcag

SEQ ID NO: 983744 - RNA, 22 nt, Human
uuggccaaaaaagucauuagaa

SEQ ID NO: 983745 - RNA, 22 nt, Human
uggcucaguuucugcccagcug

SEQ ID NO: 983746 - RNA, 22 nt, Human
aggguagggcccggagacagac

SEQ ID NO: 983747 - RNA, 22 nt, Human
uugacagcuauuuugcuuugau

SEQ ID NO: 983748 - RNA, 22 nt, Human
ucccagaggcaguugguaacuu

SEQ ID NO: 983749 - RNA, 22 nt, Human
caugaagcauguuuugucauga

SEQ ID NO: 983750 - RNA, 22 nt, Human
ucuggagcuggcagggcccugg

SEQ ID NO: 983751 - RNA, 22 nt, Human
uucuuucagaacacaagugauu

SEQ ID NO: 983752 - RNA, 22 nt, Human
aaguuguauauaccgcuuuaag

SEQ ID NO: 983753 - RNA, 22 nt, Human
ucaggaaagaagaugcucagug

SEQ ID NO: 983754 - RNA, 22 nt, Human
aagauuuccauuucuagcucau

SEQ ID NO: 983755 - RNA, 22 nt, Human
gugcugucaauugcuuucagua

SEQ ID NO: 983756 - RNA, 22 nt, Human
uguaugcagggcuuguaugcag

SEQ ID NO: 983757 - RNA, 22 nt, Human
gcuguauuccugcacuguauag

SEQ ID NO: 983758 - RNA, 22 nt, Human
agcugagcuaguaguuccagug

SEQ ID NO: 983759 - RNA, 22 nt, Human
uugaaggacaucuuguuucuag

SEQ ID NO: 983760 - RNA, 18 nt, Human
ucugucuguacaaguauc

SEQ ID NO: 983761 - RNA, 22 nt, Human
ugcugcucaaugagaugccauc

SEQ ID NO: 983762 - RNA, 22 nt, Human
cugccugcugccuguggagggu

SEQ ID NO: 983763 - RNA, 22 nt, Human
cagcugccccgcuggcugacca

SEQ ID NO: 983764 - RNA, 22 nt, Human
ggcccugggcagaggagugggc

SEQ ID NO: 983765 - RNA, 22 nt, Human
gggcaugagagggcagcuggca

SEQ ID NO: 983766 - RNA, 22 nt, Human
ccucuggcaacuucacagccca

SEQ ID NO: 983767 - RNA, 22 nt, Human
ugcucuggaguggcuugugcac

SEQ ID NO: 983768 - RNA, 22 nt, Human
agccaagcaccacuggcacucg

SEQ ID NO: 983769 - RNA, 22 nt, Human
acacagggucuagaguuaggcc

SEQ ID NO: 983770 - RNA, 22 nt, Human
gccuaggaguacagaaugguuu

SEQ ID NO: 983771 - RNA, 22 nt, Human
cugccgaguacagccauagaaa

SEQ ID NO: 983772 - RNA, 19 nt, Human
ugcucaggccaaggagccc

SEQ ID NO: 983773 - RNA, 22 nt, Human
gggaggugauggcaagcagcgg

SEQ ID NO: 983774 - RNA, 22 nt, Human
gguaacaguauguagaguaaga

SEQ ID NO: 983775 - RNA, 22 nt, Human
ucugcucuaguugcuuccugcc

SEQ ID NO: 983776 - RNA, 20 nt, Human
uccaagcccuccuuccauuc

SEQ ID NO: 983777 - RNA, 22 nt, Human
aagaacauuuuguagaaugaca

SEQ ID NO: 983778 - RNA, 22 nt, Human
gcagagcucuguucuuaucucc

SEQ ID NO: 983779 - RNA, 22 nt, Human
cugcagggcccgccugagcccu

SEQ ID NO: 983780 - RNA, 18 nt, Human
guccugagcucugcugua

SEQ ID NO: 983781 - RNA, 22 nt, Human
ugcagucuuccagcugcacaaa

SEQ ID NO: 983782 - RNA, 22 nt, Human
ugagcccagagaucugagcuau

SEQ ID NO: 983783 - RNA, 22 nt, Human
cuuuuuccagcuucaggguggg

SEQ ID NO: 983784 - RNA, 22 nt, Human
ccagcagcgauagggugagugc

SEQ ID NO: 983785 - RNA, 22 nt, Human
ugggccuguugggguugaguua

SEQ ID NO: 983786 - RNA, 22 nt, Human
aggccucacauugggcuucaag

SEQ ID NO: 983787 - RNA, 22 nt, Human
uccacugcagcuucugauggaa

SEQ ID NO: 983788 - RNA, 22 nt, Human
aaaaaugcugugguagcugugu

SEQ ID NO: 983789 - RNA, 22 nt, Human
ugauuucauaguauauacauga

SEQ ID NO: 983790 - RNA, 19 nt, Human
ggcugccuggagcgagggc

SEQ ID NO: 983791 - RNA, 21 nt, Human
ugcagcugacacugguaugcc

SEQ ID NO: 983792 - RNA, 22 nt, Human
ucagaggucccuagcaggagug

SEQ ID NO: 983793 - RNA, 22 nt, Human
ccauaaggagccagacauucca

SEQ ID NO: 983794 - RNA, 22 nt, Human
cagcauggggaucacuguaggc

SEQ ID NO: 983795 - RNA, 22 nt, Human
ggcagcucugcuccacaugagu

SEQ ID NO: 983796 - RNA, 22 nt, Human
cccuggccagcucaugucugag

SEQ ID NO: 983797 - RNA, 22 nt, Human
aaggcugauuagacugauagcu

SEQ ID NO: 983798 - RNA, 22 nt, Human
ucacaugcucaccuaagccaca

SEQ ID NO: 983799 - RNA, 22 nt, Human
caggcaggugcagauuccucuu

SEQ ID NO: 983800 - RNA, 22 nt, Human
uacuccugcugauccugccagc

SEQ ID NO: 983801 - RNA, 22 nt, Human
ugcugaaauuagaacauugagg

SEQ ID NO: 983802 - RNA, 22 nt, Human
gcagagccaggcuggggcaggu

SEQ ID NO: 983803 - RNA, 16 nt, Human
gggagggaguuggugg

SEQ ID NO: 983804 - RNA, 22 nt, Human
ugucccucauugacgcugugcc

SEQ ID NO: 983805 - RNA, 21 nt, Human
ucuguacaucauugagucccc

SEQ ID NO: 983806 - RNA, 22 nt, Human
aauaugugagguauguucagug

SEQ ID NO: 983807 - RNA, 22 nt, Human
uaugcacacaucgcagcaggaa

SEQ ID NO: 983808 - RNA, 22 nt, Human
auuggcaaggcugcggugucug

SEQ ID NO: 983809 - RNA, 22 nt, Human
uuaacagacauauauauuugua

SEQ ID NO: 983810 - RNA, 22 nt, Human
gagguucacaggcuaucacagu

SEQ ID NO: 983811 - RNA, 22 nt, Human
caguaugagaguugaaucaagg

SEQ ID NO: 983812 - RNA, 22 nt, Human
caggagugaguuggggucuaca

SEQ ID NO: 983813 - RNA, 22 nt, Human
uuugcauuguuucaaaagugaa

SEQ ID NO: 983814 - RNA, 21 nt, Human
aaggaaaagcuuggucucuga

SEQ ID NO: 983815 - RNA, 22 nt, Human
uccagucauuuccauuguuccc

SEQ ID NO: 983816 - RNA, 16 nt, Human
agcagccagcacugga

SEQ ID NO: 983817 - RNA, 22 nt, Human
gcugaagagagaugcguccagc

SEQ ID NO: 983818 - RNA, 23 nt, Human
agucaguguaaguuuggaaugca

SEQ ID NO: 983819 - RNA, 22 nt, Human
ggcaguagccagggacuggcag

SEQ ID NO: 983820 - RNA, 20 nt, Human
gucucaaguaucucacaguc

SEQ ID NO: 983821 - RNA, 20 nt, Human
cucuccuugccgacuuggca

SEQ ID NO: 983822 - RNA, 22 nt, Human
gcacagaacagagaaauagcca

SEQ ID NO: 983823 - RNA, 22 nt, Human
uagugcacacgcauguagcagu

SEQ ID NO: 983824 - RNA, 20 nt, Human
gguagcagcugcugucaucc

SEQ ID NO: 983825 - RNA, 22 nt, Human
gucaucuuaucauuguugcugu

SEQ ID NO: 983826 - RNA, 22 nt, Human
ccugggugucaugggcagcugg

SEQ ID NO: 983827 - RNA, 21 nt, Human
ugcagagauaucugaagcaga

SEQ ID NO: 983828 - RNA, 22 nt, Human
aggccugggucucgugccuacc

SEQ ID NO: 983829 - RNA, 17 nt, Human
gcagcagagagacccuc

SEQ ID NO: 983830 - RNA, 22 nt, Human
cacugaaggaaggacuacugca

SEQ ID NO: 983831 - RNA, 22 nt, Human
ccugucuguaucgguucagagu

SEQ ID NO: 983832 - RNA, 22 nt, Human
gccuucugaucgcuggacugac

SEQ ID NO: 983833 - RNA, 22 nt, Human
gccuccuggauuuuagugccau

SEQ ID NO: 983834 - RNA, 22 nt, Human
ggcaaggccuugcccagcauuc

SEQ ID NO: 983835 - RNA, 22 nt, Human
gcucccagggaccgcagggcag

SEQ ID NO: 983836 - RNA, 22 nt, Human
gagaggcugaaaucacaggagc

SEQ ID NO: 983837 - RNA, 22 nt, Human
caggguuucaccauguuagcag

SEQ ID NO: 983838 - RNA, 19 nt, Human
cugcucaggucagucuguc

SEQ ID NO: 983839 - RNA, 22 nt, Human
gugugcaugcauagacaccaca

SEQ ID NO: 983840 - RNA, 22 nt, Human
uggaaggagcuaaggaccuggg

SEQ ID NO: 983841 - RNA, 22 nt, Human
ucucagggccucccucuguuuc

SEQ ID NO: 983842 - RNA, 22 nt, Human
uuucacaauuuuaaggagcaaa

SEQ ID NO: 983843 - RNA, 22 nt, Human
ugggccacaagccaugggacca

SEQ ID NO: 983844 - RNA, 22 nt, Human
cccaagcagggugcagaggcau

SEQ ID NO: 983845 - RNA, 23 nt, Human
cccagcgcugagcccugcaggca

SEQ ID NO: 983846 - RNA, 22 nt, Human
uucucuuauucuggauaugcag

SEQ ID NO: 983847 - RNA, 22 nt, Human
caggugcugcguggcggagcug

SEQ ID NO: 983848 - RNA, 22 nt, Human
uguggccuugcagccuggaggu

SEQ ID NO: 983849 - RNA, 21 nt, Human
ugggcagauggcaguguggcu

SEQ ID NO: 983850 - RNA, 22 nt, Human
caaggagauaaaauguugagcu

SEQ ID NO: 983851 - RNA, 22 nt, Human
aguguugucaaacggcucagca

SEQ ID NO: 983852 - RNA, 21 nt, Human
cagagcagcguucugcugugg

SEQ ID NO: 983853 - RNA, 22 nt, Human
acaagagauuaucuacagauga

SEQ ID NO: 983854 - RNA, 22 nt, Human
auggccaacugaaaugaaagau

SEQ ID NO: 983855 - RNA, 22 nt, Human
gggcagagguucaacuucaaca

SEQ ID NO: 983856 - RNA, 22 nt, Human
gggcuaggcuuggccagcacug

SEQ ID NO: 983857 - RNA, 22 nt, Human
auaugugugccauuucagcagu

SEQ ID NO: 983858 - RNA, 22 nt, Human
uuccuggccucucucugagcag

SEQ ID NO: 983859 - RNA, 22 nt, Human
ugccaggcccagcuccagagcu

SEQ ID NO: 983860 - RNA, 22 nt, Human
cugaagccacgauagcuuccua

SEQ ID NO: 983861 - RNA, 22 nt, Human
uggccuggcccugaggcccugu

SEQ ID NO: 983862 - RNA, 18 nt, Human
uggagcaggaagccuggc

SEQ ID NO: 983863 - RNA, 21 nt, Human
cucuuuauauaguaaagauau

SEQ ID NO: 983864 - RNA, 22 nt, Human
ugagccuggagucguggagggg

SEQ ID NO: 983865 - RNA, 22 nt, Human
aagaauguggguggauaugaug

SEQ ID NO: 983866 - RNA, 22 nt, Human
cacaaugcguacauauaucaaa

SEQ ID NO: 983867 - RNA, 22 nt, Human
aaaguuuccugcuaagugcuau

SEQ ID NO: 983868 - RNA, 22 nt, Human
aggaggccgauuucagaggucg

SEQ ID NO: 983869 - RNA, 19 nt, Human
aggcucugagcuccuggag

SEQ ID NO: 983870 - RNA, 22 nt, Human
ccugggagagccaucuguggcc

SEQ ID NO: 983871 - RNA, 22 nt, Human
agcuggagaucaugcugauacu

SEQ ID NO: 983872 - RNA, 18 nt, Human
cccacggugcuguagggc

SEQ ID NO: 983873 - RNA, 22 nt, Human
uccugucagugaggcagaugaa

SEQ ID NO: 983874 - RNA, 17 nt, Human
gccucugcuugugucau

SEQ ID NO: 983875 - RNA, 22 nt, Human
ugaaugugaugcuaaacauaug

SEQ ID NO: 983876 - RNA, 22 nt, Human
uaaguaaauuuauaaugugauu

SEQ ID NO: 983877 - RNA, 22 nt, Human
gcaccugggacccagaggcacc

SEQ ID NO: 983878 - RNA, 22 nt, Human
gcugugcuauaucucugagugu

SEQ ID NO: 983879 - RNA, 22 nt, Human
ccugucugcagauaucucaggu

SEQ ID NO: 983880 - RNA, 22 nt, Human
ugaggcagaaauuccuguuuuc

SEQ ID NO: 983881 - RNA, 22 nt, Human
uggugcugacaguucugagugc

SEQ ID NO: 983882 - RNA, 22 nt, Human
acacauuauaggcaaucaaaag

SEQ ID NO: 983883 - RNA, 21 nt, Human
ucuuugcaucaguuguuuucu

SEQ ID NO: 983884 - RNA, 22 nt, Human
uggagccauaacccuuucguac

SEQ ID NO: 983885 - RNA, 22 nt, Human
agucccaggcagccgagccggu

SEQ ID NO: 983886 - RNA, 22 nt, Human
aggcagagagcaguggccgucu

SEQ ID NO: 983887 - RNA, 22 nt, Human
aaaugucuguuagucauaucau

SEQ ID NO: 983888 - RNA, 22 nt, Human
cagaaauggagcccaggaaucu

SEQ ID NO: 983889 - RNA, 22 nt, Human
ugcugcacucaccaacagauaa

SEQ ID NO: 983890 - RNA, 22 nt, Human
gccagagccacuuuugggugau

SEQ ID NO: 983891 - RNA, 22 nt, Human
gcaggccuccccugcuggagcu

SEQ ID NO: 983892 - RNA, 22 nt, Human
acacagggcugcgccugacccc

SEQ ID NO: 983893 - RNA, 20 nt, Human
agggcagagggauuacaggc

SEQ ID NO: 983894 - RNA, 22 nt, Human
uaaaucaguuucucuuauuggu

SEQ ID NO: 983895 - RNA, 22 nt, Human
cuucucuucccagggacacagg

SEQ ID NO: 983896 - RNA, 22 nt, Human
ggagggagucagcugauuagaa

SEQ ID NO: 983897 - RNA, 22 nt, Human
gggcagaggggcgcuucccucu

SEQ ID NO: 983898 - RNA, 22 nt, Human
caggcugcggucggcucugguc

SEQ ID NO: 983899 - RNA, 22 nt, Human
uauagaaguaagcauugugaug

SEQ ID NO: 983900 - RNA, 22 nt, Human
gagccugaaauacaggucacug

SEQ ID NO: 983901 - RNA, 22 nt, Human
ugggccugaguuugggaacugg

SEQ ID NO: 983902 - RNA, 22 nt, Human
cugaaggaagcagguggccugu

SEQ ID NO: 983903 - RNA, 22 nt, Human
ccagcagcccacaggcgucccu

SEQ ID NO: 983904 - RNA, 22 nt, Human
uacauggguagguuaagucaua

SEQ ID NO: 983905 - RNA, 20 nt, Human
gcagagcuguucugugggga

SEQ ID NO: 983906 - RNA, 22 nt, Human
aggcugcaggucugggucaugu

SEQ ID NO: 983907 - RNA, 22 nt, Human
cccugccuugggguccacaccg

SEQ ID NO: 983908 - RNA, 22 nt, Human
auucacaaagaagggaaguaca

SEQ ID NO: 983909 - RNA, 22 nt, Human
acugaaggaaacuuuuguguuu

SEQ ID NO: 983910 - RNA, 20 nt, Human
uguacacaguacuuuacaau

SEQ ID NO: 983911 - RNA, 18 nt, Human
uggagcugagugcugugc

SEQ ID NO: 983912 - RNA, 22 nt, Human
agcagcaugaugacagagucuc

SEQ ID NO: 983913 - RNA, 22 nt, Human
ggcacugagaggcucuuccuaa

SEQ ID NO: 983914 - RNA, 22 nt, Human
caggcacugugcaagggucucg

SEQ ID NO: 983915 - RNA, 22 nt, Human
ccaggcccugcuccucacacca

SEQ ID NO: 983916 - RNA, 22 nt, Human
acaggcagcacuaaucucuggu

SEQ ID NO: 983917 - RNA, 22 nt, Human
uggucucuucuuccaagauggc

SEQ ID NO: 983918 - RNA, 22 nt, Human
gguggccucugcaggccucgac

SEQ ID NO: 983919 - RNA, 22 nt, Human
ggggcugguggugguuucucca

SEQ ID NO: 983920 - RNA, 22 nt, Human
cccaggucuaugccagcucuga

SEQ ID NO: 983921 - RNA, 22 nt, Human
aggggccucgcaggaccgcucc

SEQ ID NO: 983922 - RNA, 22 nt, Human
agguacagaugaaagucuaguu

SEQ ID NO: 983923 - RNA, 22 nt, Human
gcaggcaggcuuccuugaacug

SEQ ID NO: 983924 - RNA, 22 nt, Human
cugcucuguucccccaucaucu

SEQ ID NO: 983925 - RNA, 22 nt, Human
agccucucugaugugacagcua

SEQ ID NO: 983926 - RNA, 22 nt, Human
acucugggccccagguggagcu

SEQ ID NO: 983927 - RNA, 22 nt, Human
agaggucauaucucagaagaga

SEQ ID NO: 983928 - RNA, 22 nt, Human
caguggcgugaucucugcucac

SEQ ID NO: 983929 - RNA, 22 nt, Human
acugugugcccugacgccaggg

SEQ ID NO: 983930 - RNA, 22 nt, Human
agcugcaggcccaugcucaguc

SEQ ID NO: 983931 - RNA, 22 nt, Human
gggcuggcucugucuagaaagg

SEQ ID NO: 983932 - RNA, 22 nt, Human
gaugcaaagcauuuuugugugu

SEQ ID NO: 983933 - RNA, 23 nt, Human
cauuucugggagauuuauaaaau

SEQ ID NO: 983934 - RNA, 22 nt, Human
ugccugcugcuaagcucuuugu

SEQ ID NO: 983935 - RNA, 22 nt, Human
acuccuggugcugaugaagaga

SEQ ID NO: 983936 - RNA, 17 nt, Human
ucagagggaugagcagg

SEQ ID NO: 983937 - RNA, 22 nt, Human
uugaggagcacuagucagguau

SEQ ID NO: 983938 - RNA, 22 nt, Human
uuuauuagugcuuguaucacug

SEQ ID NO: 983939 - RNA, 21 nt, Human
agagagaaggccauauggucc

SEQ ID NO: 983940 - RNA, 22 nt, Human
aggagaguaccauugggccgca

SEQ ID NO: 983941 - RNA, 22 nt, Human
ccagcugcgggcaucgagaguu

SEQ ID NO: 983942 - RNA, 22 nt, Human
agguagagcuccaguagaaaau

SEQ ID NO: 983943 - RNA, 22 nt, Human
ggagagcugguagcuggcucca

SEQ ID NO: 983944 - RNA, 22 nt, Human
ugcagcucugaacagucaugaa

SEQ ID NO: 983945 - RNA, 22 nt, Human
ggccucgcggcuucugguggcu

SEQ ID NO: 983946 - RNA, 22 nt, Human
ccacagggcacagacaggaagc

SEQ ID NO: 983947 - RNA, 22 nt, Human
gguucacauauugagaguauuc

SEQ ID NO: 983948 - RNA, 22 nt, Human
agagggcugcugcacagugcuc

SEQ ID NO: 983949 - RNA, 22 nt, Human
gggucugaggaguaccauuguc

SEQ ID NO: 983950 - RNA, 22 nt, Human
gcagggugugucucauacaguu

SEQ ID NO: 983951 - RNA, 23 nt, Human
auaauaacgucugucuugucucu

SEQ ID NO: 983952 - RNA, 22 nt, Human
ccagccucacuggcaucaccua

SEQ ID NO: 983953 - RNA, 22 nt, Human
cagggugcagugucgcugcuag

SEQ ID NO: 983954 - RNA, 23 nt, Human
cagggcugggcuugguguuaggc

SEQ ID NO: 983955 - RNA, 23 nt, Human
cucugcaggagagugggcagggc

SEQ ID NO: 983956 - RNA, 22 nt, Human
accugccucagugcagcuggau

SEQ ID NO: 983957 - RNA, 22 nt, Human
ucucagggcgcagugaggcagu

SEQ ID NO: 983958 - RNA, 22 nt, Human
ugggcacuguagcuggugcugg

SEQ ID NO: 983959 - RNA, 22 nt, Human
acccugggucauauacagugug

SEQ ID NO: 983960 - RNA, 22 nt, Human
cugcccugugaggguccuuggg

SEQ ID NO: 983961 - RNA, 21 nt, Human
uauacaugugugcauacgugu

SEQ ID NO: 983962 - RNA, 22 nt, Human
gagguuagaggucagugcaguc

SEQ ID NO: 983963 - RNA, 22 nt, Human
gaugcagaaaguagacaccauc

SEQ ID NO: 983964 - RNA, 22 nt, Human
gggcagaggcucuggcccaucc

SEQ ID NO: 983965 - RNA, 22 nt, Human
gacauaaaauucaauaauuugu

SEQ ID NO: 983966 - RNA, 22 nt, Human
guuccauaucacagcagacgaa

SEQ ID NO: 983967 - RNA, 22 nt, Human
agccucugacugucagcaaggu

SEQ ID NO: 983968 - RNA, 22 nt, Human
cucauacauaugccauuccugc

SEQ ID NO: 983969 - RNA, 22 nt, Human
uaaauaaguucuucauuguuug

SEQ ID NO: 983970 - RNA, 22 nt, Human
uguguacaagaguguuuacugu

SEQ ID NO: 983971 - RNA, 22 nt, Human
uccuucagggcugaccacaggc

SEQ ID NO: 983972 - RNA, 22 nt, Human
aggcucagauucacauuugguu

SEQ ID NO: 983973 - RNA, 22 nt, Human
ggagcauguggggugagcaggg

SEQ ID NO: 983974 - RNA, 22 nt, Human
gcaagcaagcagguagagcuga

SEQ ID NO: 983975 - RNA, 22 nt, Human
ggcagcucaccucugguccagg

SEQ ID NO: 983976 - RNA, 22 nt, Human
augugcaacuucagcagaaagg

SEQ ID NO: 983977 - RNA, 22 nt, Human
uaccuugggcuauuaucuuuga

SEQ ID NO: 983978 - RNA, 22 nt, Human
cccagcagaaucugaugagggc

SEQ ID NO: 983979 - RNA, 22 nt, Human
ggcugggcaggucugcacaggg

SEQ ID NO: 983980 - RNA, 23 nt, Human
ccucccaccuauuucacuuucuu

SEQ ID NO: 983981 - RNA, 22 nt, Human
uggcucugugcuucuaguaucu

SEQ ID NO: 983982 - RNA, 23 nt, Human
ucagagaaguuguaggcugggga

SEQ ID NO: 983983 - RNA, 21 nt, Human
aaagaacaggcagauguucuu

SEQ ID NO: 983984 - RNA, 22 nt, Human
uagaacaugcucauguauaaau

SEQ ID NO: 983985 - RNA, 22 nt, Human
ccucagccuuggccccaggcag

SEQ ID NO: 983986 - RNA, 22 nt, Human
aagggcagggaguuugugucua

SEQ ID NO: 983987 - RNA, 22 nt, Human
ggcugccugaggcugaggcccg

SEQ ID NO: 983988 - RNA, 22 nt, Human
agagccuggucugagauaggac

SEQ ID NO: 983989 - RNA, 22 nt, Human
caggugggccaugaaaaaugac

SEQ ID NO: 983990 - RNA, 22 nt, Human
cccagccugucuuucccaauga

SEQ ID NO: 983991 - RNA, 22 nt, Human
ugggccacuugaaaguggaugu

SEQ ID NO: 983992 - RNA, 22 nt, Human
agcugggaugauaaccucaguc

SEQ ID NO: 983993 - RNA, 22 nt, Human
cuuugcaauagaggcacacaug

SEQ ID NO: 983994 - RNA, 22 nt, Human
ggggugggcgugcagggacacc

SEQ ID NO: 983995 - RNA, 22 nt, Human
ucuaggagcaugaagggaaggc

SEQ ID NO: 983996 - RNA, 22 nt, Human
acagcuguggccacuugcaucc

SEQ ID NO: 983997 - RNA, 19 nt, Human
ggccccucucacaggaguu

SEQ ID NO: 983998 - RNA, 22 nt, Human
ccuggccauuugaacuucagac

SEQ ID NO: 983999 - RNA, 22 nt, Human
caagacaagaucuaagcaugcu

SEQ ID NO: 984000 - RNA, 22 nt, Human
gaaauauuguacuggagauguu

SEQ ID NO: 984001 - RNA, 22 nt, Human
ggccugcugcuaugacuuccug

SEQ ID NO: 984002 - RNA, 22 nt, Human
acagggccucagcugauucugg

SEQ ID NO: 984003 - RNA, 22 nt, Human
ucccuggggauguuggccugcc

SEQ ID NO: 984004 - RNA, 22 nt, Human
ugagcccagucugucugacaug

SEQ ID NO: 984005 - RNA, 22 nt, Human
gucagaggggcagcugccaggc

SEQ ID NO: 984006 - RNA, 22 nt, Human
cagggagaucuuggcuccuggu

SEQ ID NO: 984007 - RNA, 22 nt, Human
ggcagcugaccuagcaccaucc

SEQ ID NO: 984008 - RNA, 22 nt, Human
cuggucaaggagagucucugca

SEQ ID NO: 984009 - RNA, 22 nt, Human
ucaguuuucauuucaugagcag

SEQ ID NO: 984010 - RNA, 22 nt, Human
auucauucugaccucaagagaa

SEQ ID NO: 984011 - RNA, 22 nt, Human
ucaaaugcuguauuguaguaau

SEQ ID NO: 984012 - RNA, 22 nt, Human
cauuaaauuccuuguucucaaa

SEQ ID NO: 984013 - RNA, 22 nt, Human
uguguacauaucuauccuagau

SEQ ID NO: 984014 - RNA, 22 nt, Human
agcacagaguugcagagagcgu

SEQ ID NO: 984015 - RNA, 22 nt, Human
aaaggucagcugccaucguucu

SEQ ID NO: 984016 - RNA, 22 nt, Human
cagaggugcauacaggucauua

SEQ ID NO: 984017 - RNA, 22 nt, Human
uggcagacacugucgaagccua

SEQ ID NO: 984018 - RNA, 22 nt, Human
auuuaugacuggugaauagaac

SEQ ID NO: 984019 - RNA, 22 nt, Human
cuaggccacuugcucucaugga

SEQ ID NO: 984020 - RNA, 22 nt, Human
ucucaggaauagaguggcagca

SEQ ID NO: 984021 - RNA, 22 nt, Human
gaguuuaaaacgcuuguauuua

SEQ ID NO: 984022 - RNA, 22 nt, Human
cugggcaggagggcucuaugga

SEQ ID NO: 984023 - RNA, 22 nt, Human
cugggcugagccugggcugugu

SEQ ID NO: 984024 - RNA, 22 nt, Human
ggccugccucacagucagcacc

SEQ ID NO: 984025 - RNA, 22 nt, Human
uccuggccgcuggccccugaga

SEQ ID NO: 984026 - RNA, 22 nt, Human
uaacauuccucaaaguuuucag

SEQ ID NO: 984027 - RNA, 22 nt, Human
ccuggccucuccgaguaaccug

SEQ ID NO: 984028 - RNA, 22 nt, Human
accccaagacaguagaagagaa

SEQ ID NO: 984029 - RNA, 22 nt, Human
aagggaggggauguaagccugg

SEQ ID NO: 984030 - RNA, 22 nt, Human
uaagacaauucuucagucacaa

SEQ ID NO: 984031 - RNA, 22 nt, Human
ccaccagcagugugcaaggauu

SEQ ID NO: 984032 - RNA, 20 nt, Human
ucugcucagcccucaguggc

SEQ ID NO: 984033 - RNA, 22 nt, Human
auuaggauguuccuaugcacau

SEQ ID NO: 984034 - RNA, 22 nt, Human
aguguuccuugcuuucccagag

SEQ ID NO: 984035 - RNA, 22 nt, Human
gcuguucccauguggggcucag

SEQ ID NO: 984036 - RNA, 22 nt, Human
aggucacauggauaaugaucag

SEQ ID NO: 984037 - RNA, 22 nt, Human
aguuucaauucuuuucacaaag

SEQ ID NO: 984038 - RNA, 22 nt, Human
acagggccucagccagggcaga

SEQ ID NO: 984039 - RNA, 22 nt, Human
cagccugacaccagcuuugggc

SEQ ID NO: 984040 - RNA, 22 nt, Human
aauuaggaauaaaugaguacuu

SEQ ID NO: 984041 - RNA, 22 nt, Human
uccucugccaaagggaguugcc

SEQ ID NO: 984042 - RNA, 22 nt, Human
gauggguggucucagacuugcc

SEQ ID NO: 984043 - RNA, 22 nt, Human
uccucaggucaaagcaggagaa

SEQ ID NO: 984044 - RNA, 22 nt, Human
aaggagcuuguucgccuuccuc

SEQ ID NO: 984045 - RNA, 22 nt, Human
uaugugcaguuugcucuuaaca

SEQ ID NO: 984046 - RNA, 18 nt, Human
gcagagugcgucucugug

SEQ ID NO: 984047 - RNA, 22 nt, Human
aagcugcagacccccugucuca

SEQ ID NO: 984048 - RNA, 22 nt, Human
aaaaguuuaagacucauucuag

SEQ ID NO: 984049 - RNA, 22 nt, Human
ucugucugcaccuaagcacagu

SEQ ID NO: 984050 - RNA, 22 nt, Human
aggaggcccuagagcucuagag

SEQ ID NO: 984051 - RNA, 22 nt, Human
uauguuaaauguuugauguuua

SEQ ID NO: 984052 - RNA, 22 nt, Human
ugucucagggcagcagcagggg

SEQ ID NO: 984053 - RNA, 22 nt, Human
uggccaaaguagaaaauaauag

SEQ ID NO: 984054 - RNA, 22 nt, Human
aaaguuugaaugauauauuagu

SEQ ID NO: 984055 - RNA, 22 nt, Human
uuccuauuuccaugaaacacaa

SEQ ID NO: 984056 - RNA, 22 nt, Human
gccuggcaggccugggccagca

SEQ ID NO: 984057 - RNA, 22 nt, Human
uagagcauuuagaggggcagga

SEQ ID NO: 984058 - RNA, 23 nt, Human
cuugcagggcuggaggcuuagaa

SEQ ID NO: 984059 - RNA, 22 nt, Human
cguuggagacacuugaggacuu

SEQ ID NO: 984060 - RNA, 22 nt, Human
ugggcaggauaauaucucaugu

SEQ ID NO: 984061 - RNA, 22 nt, Human
acuccugggugcugaccagcgu

SEQ ID NO: 984062 - RNA, 21 nt, Human
agacagagugcagucuacaua

SEQ ID NO: 984063 - RNA, 22 nt, Human
cucccagagaccaagcugagaa

SEQ ID NO: 984064 - RNA, 22 nt, Human
aucuggcuccuacacuugaaga

SEQ ID NO: 984065 - RNA, 22 nt, Human
aaucagucauuagcucugaccu

SEQ ID NO: 984066 - RNA, 20 nt, Human
ggcugcugugggcagagagg

SEQ ID NO: 984067 - RNA, 23 nt, Human
uggcucagggucucuuaugaagu

SEQ ID NO: 984068 - RNA, 22 nt, Human
gcugauuauuacaugucugugg

SEQ ID NO: 984069 - RNA, 22 nt, Human
uaaguucagaguucucauuugu

SEQ ID NO: 984070 - RNA, 22 nt, Human
cuggcaggaaguuagaugguaa

SEQ ID NO: 984071 - RNA, 22 nt, Human
ccuggcagaauauuaaagugca

SEQ ID NO: 984072 - RNA, 22 nt, Human
acagaccaaaaaaggauauugg

SEQ ID NO: 984073 - RNA, 18 nt, Human
gcugucugaggucugagg

SEQ ID NO: 984074 - RNA, 21 nt, Human
gcaggggauagaaauggucug

SEQ ID NO: 984075 - RNA, 22 nt, Human
gcaggauggugcccuuucugcc

SEQ ID NO: 984076 - RNA, 22 nt, Human
gcugccacucugagcuugcuuc

SEQ ID NO: 984077 - RNA, 17 nt, Human
uuuucucucuuggauuc

SEQ ID NO: 984078 - RNA, 22 nt, Human
ggccccaggaccuccacggucc

SEQ ID NO: 984079 - RNA, 22 nt, Human
ugcugccuccaacuccugggcu

SEQ ID NO: 984080 - RNA, 22 nt, Human
guuugcauauuugcacaggaau

SEQ ID NO: 984081 - RNA, 17 nt, Human
gccuuccuuccuccaca

SEQ ID NO: 984082 - RNA, 22 nt, Human
uaauuuauuucaacugccaagg

SEQ ID NO: 984083 - RNA, 19 nt, Human
ccagucccauacaggagau

SEQ ID NO: 984084 - RNA, 22 nt, Human
gccuccuggccuuugcuccuca

SEQ ID NO: 984085 - RNA, 22 nt, Human
cuggccuucagacucggacuga

SEQ ID NO: 984086 - RNA, 22 nt, Human
aaaugcaggaaauuaugcuuuu

SEQ ID NO: 984087 - RNA, 22 nt, Human
ugcucacugaacucuugcuguc

SEQ ID NO: 984088 - RNA, 22 nt, Human
ccuuuggguucaaucucggucu

SEQ ID NO: 984089 - RNA, 22 nt, Human
agaggcugaaugaugucaucau

SEQ ID NO: 984090 - RNA, 22 nt, Human
ggcugugcgggcagccguggga

SEQ ID NO: 984091 - RNA, 22 nt, Human
uagaguguuguaauugaaaagg

SEQ ID NO: 984092 - RNA, 22 nt, Human
gagaaagauguaggcugggagg

SEQ ID NO: 984093 - RNA, 22 nt, Human
cacagccugcugcacucaagaa

SEQ ID NO: 984094 - RNA, 23 nt, Human
aggcacugaaugugucagugagu

SEQ ID NO: 984095 - RNA, 22 nt, Human
gcagggucuugagaggcagcca

SEQ ID NO: 984096 - RNA, 21 nt, Human
uggaccaaaguaauuugccuu

SEQ ID NO: 984097 - RNA, 22 nt, Human
cacaggcuccggccuugcagcc

SEQ ID NO: 984098 - RNA, 22 nt, Human
ggcugcagagcugggugggccu

SEQ ID NO: 984099 - RNA, 22 nt, Human
caggaaagguagucacaaugua

SEQ ID NO: 984100 - RNA, 22 nt, Human
uauuucugucagccagauaugg

SEQ ID NO: 984101 - RNA, 22 nt, Human
cagccaggagccucugcaacua

SEQ ID NO: 984102 - RNA, 23 nt, Human
agaagcagcuucuggaguaucgg

SEQ ID NO: 984103 - RNA, 22 nt, Human
ugaagaugucagcagggguggu

SEQ ID NO: 984104 - RNA, 22 nt, Human
cucuggaguggguggccgggag

SEQ ID NO: 984105 - RNA, 17 nt, Human
acagggcagaaacagcu

SEQ ID NO: 984106 - RNA, 22 nt, Human
acagccuguguaccagcuggga

SEQ ID NO: 984107 - RNA, 22 nt, Human
cagagcucagagcagggcacuc

SEQ ID NO: 984108 - RNA, 22 nt, Human
ggcaguggaggacccugugucu

SEQ ID NO: 984109 - RNA, 22 nt, Human
aagcagggugucuugacccaug

SEQ ID NO: 984110 - RNA, 22 nt, Human
agaagcugacagaugcagcagg

SEQ ID NO: 984111 - RNA, 22 nt, Human
caggcagcguccugcuuccugu

SEQ ID NO: 984112 - RNA, 22 nt, Human
gaccugccugagcugccucugc

SEQ ID NO: 984113 - RNA, 22 nt, Human
guggccuggauagacuccaucu

SEQ ID NO: 984114 - RNA, 22 nt, Human
ucuuuccuagaggcugaugagu

SEQ ID NO: 984115 - RNA, 22 nt, Human
gggauggacuuggggacuccag

SEQ ID NO: 984116 - RNA, 22 nt, Human
acugaaggaagcgggcaggggu

SEQ ID NO: 984117 - RNA, 21 nt, Human
guguuuccuguuuauggcuug

SEQ ID NO: 984118 - RNA, 22 nt, Human
agagaauuuuaaaagccuugaa

SEQ ID NO: 984119 - RNA, 22 nt, Human
aaggaggaauuucagggugaau

SEQ ID NO: 984120 - RNA, 22 nt, Human
uucauucaucucuaaaaugccu

SEQ ID NO: 984121 - RNA, 20 nt, Human
aaaguguaagcauauaauua

SEQ ID NO: 984122 - RNA, 22 nt, Human
ugcauauuauguguaucugucu

SEQ ID NO: 984123 - RNA, 22 nt, Human
cugaggcuggggaagggaagug

SEQ ID NO: 984124 - RNA, 22 nt, Human
aagaugauguuguguuuucacu

SEQ ID NO: 984125 - RNA, 22 nt, Human
gggugggaucuguggagccuca

SEQ ID NO: 984126 - RNA, 21 nt, Human
aagccucaagcagaagacaga

SEQ ID NO: 984127 - RNA, 21 nt, Human
uaaagaagaugaaugugauca

SEQ ID NO: 984128 - RNA, 22 nt, Human
augccagucaaagaagaugaca

SEQ ID NO: 984129 - RNA, 20 nt, Human
ugcuugucaugcacucaggc

SEQ ID NO: 984130 - RNA, 22 nt, Human
aguaacaagugccaacguuaga

SEQ ID NO: 984131 - RNA, 22 nt, Human
accuuauuuugaaauagauugu

SEQ ID NO: 984132 - RNA, 19 nt, Human
gggcuccuugggccucucu

SEQ ID NO: 984133 - RNA, 22 nt, Human
gcaaugauauugaagugaugaa

SEQ ID NO: 984134 - RNA, 20 nt, Human
ucuguaaagacuccagaagc

SEQ ID NO: 984135 - RNA, 21 nt, Human
uggcugcuggcccucucucca

SEQ ID NO: 984136 - RNA, 22 nt, Human
uuuaggauaacuccaguuuucc

SEQ ID NO: 984137 - RNA, 22 nt, Human
gcaaggcugcugccacccaucu

SEQ ID NO: 984138 - RNA, 21 nt, Human
uggcucugagccucauggcug

SEQ ID NO: 984139 - RNA, 22 nt, Human
gcucucuggguggugggcaaca

SEQ ID NO: 984140 - RNA, 22 nt, Human
acccagagcugggcuuggcaaa

SEQ ID NO: 984141 - RNA, 22 nt, Human
ccugugucagccccugccucca

SEQ ID NO: 984142 - RNA, 22 nt, Human
ucugggcuugguuagggcuguu

SEQ ID NO: 984143 - RNA, 22 nt, Human
gcucagagcuugaaguuccacu

SEQ ID NO: 984144 - RNA, 20 nt, Human
agcaggaaugaugcuuucau

SEQ ID NO: 984145 - RNA, 22 nt, Human
auucagcaguuccugcuucagu

SEQ ID NO: 984146 - RNA, 22 nt, Human
uagcuuuguguaugaugucugu

SEQ ID NO: 984147 - RNA, 22 nt, Human
gagaaggaguagcugaccuggg

SEQ ID NO: 984148 - RNA, 22 nt, Human
auugacaauguauuuguaucug

SEQ ID NO: 984149 - RNA, 22 nt, Human
agcuuuauucaugauuucaggg

SEQ ID NO: 984150 - RNA, 22 nt, Human
aggcacugugcuucuuauaugu

SEQ ID NO: 984151 - RNA, 22 nt, Human
ucuuugcaacucccauuuccau

SEQ ID NO: 984152 - RNA, 22 nt, Human
acagccaggagccaugggcagg

SEQ ID NO: 984153 - RNA, 22 nt, Human
ccagccugaaaugccucauccu

SEQ ID NO: 984154 - RNA, 22 nt, Human
guuauguacuuuuuaaaucuug

SEQ ID NO: 984155 - RNA, 22 nt, Human
uagaaacauauaggauggcagg

SEQ ID NO: 984156 - RNA, 22 nt, Human
uuggccuucccuaccugggcca

SEQ ID NO: 984157 - RNA, 22 nt, Human
ccucccacuucuugcugagguc

SEQ ID NO: 984158 - RNA, 22 nt, Human
cuggcagccaagugggauacuc

SEQ ID NO: 984159 - RNA, 22 nt, Human
augcacaagaggcuagaaaaga

SEQ ID NO: 984160 - RNA, 22 nt, Human
agugucauuuuguccaucuucu

SEQ ID NO: 984161 - RNA, 22 nt, Human
agcugcucuugggugacuucaa

SEQ ID NO: 984162 - RNA, 22 nt, Human
ucucagggugaggaaagaauuu

SEQ ID NO: 984163 - RNA, 22 nt, Human
ugggcuccagcaccugugcucu

SEQ ID NO: 984164 - RNA, 22 nt, Human
aggacuuagaacauuauguacu

SEQ ID NO: 984165 - RNA, 22 nt, Human
ucuugaaggggggcaguguuga

SEQ ID NO: 984166 - RNA, 22 nt, Human
cugggguggugcaggccucaug

SEQ ID NO: 984167 - RNA, 22 nt, Human
uagccggguguugugucaugca

SEQ ID NO: 984168 - RNA, 22 nt, Human
ucaauuaugccauugcaauauu

SEQ ID NO: 984169 - RNA, 18 nt, Human
aggccugggaagcugagg

SEQ ID NO: 984170 - RNA, 19 nt, Human
aacuagaaagguuuugaga

SEQ ID NO: 984171 - RNA, 22 nt, Human
ugagccuggguggucgaggcug

SEQ ID NO: 984172 - RNA, 22 nt, Human
aggcugggcaccguuuugaucc

SEQ ID NO: 984173 - RNA, 22 nt, Human
ggcuggcauccagggaaaucca

SEQ ID NO: 984174 - RNA, 22 nt, Human
cuggccaauccauuaauuuguu

SEQ ID NO: 984175 - RNA, 22 nt, Human
agagccugugggagaugcagcu

SEQ ID NO: 984176 - RNA, 22 nt, Human
cagaaagaccugggcucaagag

SEQ ID NO: 984177 - RNA, 22 nt, Human
cuguggcuuucucugccuccuu

SEQ ID NO: 984178 - RNA, 22 nt, Human
ccuggcagcgugccgagcugcg

SEQ ID NO: 984179 - RNA, 22 nt, Human
ucucaggccccugaguuucucu

SEQ ID NO: 984180 - RNA, 22 nt, Human
gagagugaaggcuucccagcaa

SEQ ID NO: 984181 - RNA, 22 nt, Human
uaagauaugguaggaaguuugg

SEQ ID NO: 984182 - RNA, 19 nt, Human
ggcugucucggcccagcca

SEQ ID NO: 984183 - RNA, 20 nt, Human
ucucaggccccaguuuucuu

SEQ ID NO: 984184 - RNA, 22 nt, Human
agcugcugagccaggcugaugu

SEQ ID NO: 984185 - RNA, 22 nt, Human
gcucugcugagauaucugggag

SEQ ID NO: 984186 - RNA, 22 nt, Human
gcuggagauaguaggauccaua

SEQ ID NO: 984187 - RNA, 22 nt, Human
uuccauaaaggugauaguauac

SEQ ID NO: 984188 - RNA, 22 nt, Human
gaggcagaggaagguggucucu

SEQ ID NO: 984189 - RNA, 22 nt, Human
cuuggcagauccaaaaaugaca

SEQ ID NO: 984190 - RNA, 22 nt, Human
agcucccagucuccucuccaug

SEQ ID NO: 984191 - RNA, 22 nt, Human
ccucugccugcacaucauccug

SEQ ID NO: 984192 - RNA, 22 nt, Human
aaagagcuucauuuccauuuau

SEQ ID NO: 984193 - RNA, 22 nt, Human
uccugagcuucaaaacacuuug

SEQ ID NO: 984194 - RNA, 22 nt, Human
cggggcugcgcucuuccugccg

SEQ ID NO: 984195 - RNA, 22 nt, Human
cucaggaugcaggucacaggac

SEQ ID NO: 984196 - RNA, 22 nt, Human
gccuggagacaaggacaaaggg

SEQ ID NO: 984197 - RNA, 22 nt, Human
auguccuuugcuucucuggucc

SEQ ID NO: 984198 - RNA, 22 nt, Human
guucacaaauaugcacuuacga

SEQ ID NO: 984199 - RNA, 22 nt, Human
ucuuggccagguguggugccuc

SEQ ID NO: 984200 - RNA, 23 nt, Human
gggauauggaccuuggaggaguc

SEQ ID NO: 984201 - RNA, 22 nt, Human
acagaagagcacauuuaguaug

SEQ ID NO: 984202 - RNA, 22 nt, Human
uggagcuggaauuucugggccu

SEQ ID NO: 984203 - RNA, 22 nt, Human
gccuaauaacuagcuguguaac

SEQ ID NO: 984204 - RNA, 22 nt, Human
gacagguggggaaacuaaggua

SEQ ID NO: 984205 - RNA, 21 nt, Human
ucucugggcccuccugugggg

SEQ ID NO: 984206 - RNA, 22 nt, Human
guaauugacucagcucuguuca

SEQ ID NO: 984207 - RNA, 22 nt, Human
ucugagccaaaauaaacagcau

SEQ ID NO: 984208 - RNA, 22 nt, Human
ccuuuuucaauauagaauugca

SEQ ID NO: 984209 - RNA, 22 nt, Human
uggggcugucccgguuuggcga

SEQ ID NO: 984210 - RNA, 22 nt, Human
ccccagccagcaggaccucuga

SEQ ID NO: 984211 - RNA, 22 nt, Human
uagcugccagaccauucuuacu

SEQ ID NO: 984212 - RNA, 22 nt, Human
cucagggcuugaguguccagga

SEQ ID NO: 984213 - RNA, 22 nt, Human
ucuuuacaguccucugucaauc

SEQ ID NO: 984214 - RNA, 21 nt, Human
auucugaguugucagucuuca

SEQ ID NO: 984215 - RNA, 22 nt, Human
acuuugaaggggaacauuuuaa

SEQ ID NO: 984216 - RNA, 22 nt, Human
agggccagggaagcuguauuuu

SEQ ID NO: 984217 - RNA, 22 nt, Human
aguugaaauuagaguccuggcu

SEQ ID NO: 984218 - RNA, 22 nt, Human
gagcagcuagauaaagcccuuc

SEQ ID NO: 984219 - RNA, 22 nt, Human
agagacaggguuuugucguguu

SEQ ID NO: 984220 - RNA, 22 nt, Human
agugaaaugacugaaucagaua

SEQ ID NO: 984221 - RNA, 22 nt, Human
uguggcugcucaggugcagacc

SEQ ID NO: 984222 - RNA, 22 nt, Human
gcuuuauguaaguccaaaggca

SEQ ID NO: 984223 - RNA, 22 nt, Human
ugcagaggagcuggaaggcugg

SEQ ID NO: 984224 - RNA, 22 nt, Human
ggagacaguauggcuuguagcu

SEQ ID NO: 984225 - RNA, 22 nt, Human
aggcacugaaggaagcuugcgc

SEQ ID NO: 984226 - RNA, 22 nt, Human
agagcugaggauccagcugagc

SEQ ID NO: 984227 - RNA, 22 nt, Human
ucugagccagccaccuccuuca

SEQ ID NO: 984228 - RNA, 22 nt, Human
cagggccugagggcugcucugc

SEQ ID NO: 984229 - RNA, 21 nt, Human
uuugaauagaaauagugcuua

SEQ ID NO: 984230 - RNA, 22 nt, Human
agggcugcuauguugauucaga

SEQ ID NO: 984231 - RNA, 22 nt, Human
cucaggagaugacagaagguau

SEQ ID NO: 984232 - RNA, 22 nt, Human
augaaauaucuugaagaaauuc

SEQ ID NO: 984233 - RNA, 22 nt, Human
ggccucugggguccugagccca

SEQ ID NO: 984234 - RNA, 22 nt, Human
ucaagagagugcugcuuggggu

SEQ ID NO: 984235 - RNA, 22 nt, Human
cucaggauccaucuccugcccu

SEQ ID NO: 984236 - RNA, 22 nt, Human
cuauuagguaugcagccuauuu

SEQ ID NO: 984237 - RNA, 22 nt, Human
uuucuguauuuaaaagaucugg

SEQ ID NO: 984238 - RNA, 22 nt, Human
gaaaucugcccagugcacuggu

SEQ ID NO: 984239 - RNA, 22 nt, Human
uaaaguguccuagcuaggaggc

SEQ ID NO: 984240 - RNA, 22 nt, Human
gauuuccucacuaacauccauc

SEQ ID NO: 984241 - RNA, 22 nt, Human
cugggccaguuaugucucaucu

SEQ ID NO: 984242 - RNA, 22 nt, Human
gaaaaaugcuccaaaucugugg

SEQ ID NO: 984243 - RNA, 22 nt, Human
gcucugugggugaguagaaucu

SEQ ID NO: 984244 - RNA, 22 nt, Human
agccagcaugaagacagaggcc

SEQ ID NO: 984245 - RNA, 22 nt, Human
ggaggcucugcuccguguguuc

SEQ ID NO: 984246 - RNA, 22 nt, Human
ccccagcucagugcagggacau

SEQ ID NO: 984247 - RNA, 22 nt, Human
uuuuaacuuaaaauacauagau

SEQ ID NO: 984248 - RNA, 22 nt, Human
uauauuaaccauaggguucuag

SEQ ID NO: 984249 - RNA, 22 nt, Human
ggggcggggcucugagaagcau

SEQ ID NO: 984250 - RNA, 22 nt, Human
uuuaucuuuaggacuuugcaga

SEQ ID NO: 984251 - RNA, 22 nt, Human
agacagcauggagcugauaaca

SEQ ID NO: 984252 - RNA, 22 nt, Human
ucuggcuccacuuucuucauuu

SEQ ID NO: 984253 - RNA, 18 nt, Human
agagaugguguagaguuu

SEQ ID NO: 984254 - RNA, 22 nt, Human
cacugugucaguuugguuagac

SEQ ID NO: 984255 - RNA, 22 nt, Human
cugugccaucugcacucucguc

SEQ ID NO: 984256 - RNA, 22 nt, Human
ucaggggaaaucucucagcgaa

SEQ ID NO: 984257 - RNA, 22 nt, Human
uugcauuguaggauguuagaag

SEQ ID NO: 984258 - RNA, 22 nt, Human
ugcagugccucggcagugcagc

SEQ ID NO: 984259 - RNA, 22 nt, Human
cugcccugagucaugccagaug

SEQ ID NO: 984260 - RNA, 22 nt, Human
uauuuugacuauuaaaccaaca

SEQ ID NO: 984261 - RNA, 22 nt, Human
ucuuccucuagaucugaggccc

SEQ ID NO: 984262 - RNA, 17 nt, Human
uggagcugcguguguuc

SEQ ID NO: 984263 - RNA, 22 nt, Human
gccaggcuggugcaaggauauu

SEQ ID NO: 984264 - RNA, 22 nt, Human
cagcucuguaaauuccuucauc

SEQ ID NO: 984265 - RNA, 22 nt, Human
ugacuuccugcacucaggugau

SEQ ID NO: 984266 - RNA, 22 nt, Human
ccaggcugugguuuagauagag

SEQ ID NO: 984267 - RNA, 22 nt, Human
gcacugcagccucagauggugg

SEQ ID NO: 984268 - RNA, 22 nt, Human
auauuagguuggugcaaaagua

SEQ ID NO: 984269 - RNA, 20 nt, Human
ucauccaggacaggaguggc

SEQ ID NO: 984270 - RNA, 22 nt, Human
accacugggcgggcagccugcu

SEQ ID NO: 984271 - RNA, 22 nt, Human
ggccagggccuggggacugucc

SEQ ID NO: 984272 - RNA, 22 nt, Human
ccaggcagccaagugugugugu

SEQ ID NO: 984273 - RNA, 22 nt, Human
auguaucaugcaggguccauga

SEQ ID NO: 984274 - RNA, 22 nt, Human
acauuucucuuagaguuggacu

SEQ ID NO: 984275 - RNA, 22 nt, Human
cauccugguuaccccauaguca

SEQ ID NO: 984276 - RNA, 22 nt, Human
aggcccuggcacugccugggag

SEQ ID NO: 984277 - RNA, 22 nt, Human
acacagggcaaugcuuugaccu

SEQ ID NO: 984278 - RNA, 22 nt, Human
augcagcaguuuacaaagcaau

SEQ ID NO: 984279 - RNA, 22 nt, Human
aaggucauugguucugaauucu

SEQ ID NO: 984280 - RNA, 22 nt, Human
ggccaaauuuggccaugagcau

SEQ ID NO: 984281 - RNA, 22 nt, Human
ggagccagagggaugcaguuga

SEQ ID NO: 984282 - RNA, 21 nt, Human
agcaggaggcagucacagcuc

SEQ ID NO: 984283 - RNA, 22 nt, Human
cuggagcuggcuuccuuccacu

SEQ ID NO: 984284 - RNA, 22 nt, Human
gcugggaggaucucucccuguc

SEQ ID NO: 984285 - RNA, 22 nt, Human
gcugguccacucccuggaggcu

SEQ ID NO: 984286 - RNA, 22 nt, Human
cuuugcauacaauuuuuagaaa

SEQ ID NO: 984287 - RNA, 22 nt, Human
uccugccuguuuaccuguacuu

SEQ ID NO: 984288 - RNA, 22 nt, Human
acucugcuguuuacucucuaua

SEQ ID NO: 984289 - RNA, 23 nt, Human
gggggcugguugacucucugcag

SEQ ID NO: 984290 - RNA, 22 nt, Human
uacucugcaggauggacuaugg

SEQ ID NO: 984291 - RNA, 22 nt, Human
acacauuuaaaaaggaacauau

SEQ ID NO: 984292 - RNA, 22 nt, Human
caugcacuuaccugaaauucaa

SEQ ID NO: 984293 - RNA, 22 nt, Human
aauagguagccagauauauaaa

SEQ ID NO: 984294 - RNA, 22 nt, Human
agcugccaccucugccuuuggg

SEQ ID NO: 984295 - RNA, 22 nt, Human
ccuggcucucugcagauccugg

SEQ ID NO: 984296 - RNA, 22 nt, Human
cuggccacaugugugcugagca

SEQ ID NO: 984297 - RNA, 22 nt, Human
gccugaggaaugcuccugacuu

SEQ ID NO: 984298 - RNA, 22 nt, Human
auuuauuaugggauuuggcaca

SEQ ID NO: 984299 - RNA, 22 nt, Human
augcaguauaaaucauuucugg

SEQ ID NO: 984300 - RNA, 18 nt, Human
uuaauguggcuuacuaug

SEQ ID NO: 984301 - RNA, 22 nt, Human
cauuacauuucaaaauguuucc

SEQ ID NO: 984302 - RNA, 22 nt, Human
cuguguccucccgcugcaccca

SEQ ID NO: 984303 - RNA, 22 nt, Human
aggcucugcagaccccagcugu

SEQ ID NO: 984304 - RNA, 22 nt, Human
cacucugacuggcccugcagga

SEQ ID NO: 984305 - RNA, 22 nt, Human
aggucauuccagccauuccccu

SEQ ID NO: 984306 - RNA, 18 nt, Human
ugucucaggcugaaacag

SEQ ID NO: 984307 - RNA, 22 nt, Human
ggcagggagagcaugcugauaa

SEQ ID NO: 984308 - RNA, 22 nt, Human
uccuucagcuacucaguuucca

SEQ ID NO: 984309 - RNA, 22 nt, Human
acaaaguuaacaguuggauagu

SEQ ID NO: 984310 - RNA, 22 nt, Human
gaguuguucaacgugugugaaa

SEQ ID NO: 984311 - RNA, 22 nt, Human
agaugcuucaguguuuaauuua

SEQ ID NO: 984312 - RNA, 22 nt, Human
acacugcucacuucuucccuug

SEQ ID NO: 984313 - RNA, 22 nt, Human
augaaaaguucgaucuagaagg

SEQ ID NO: 984314 - RNA, 21 nt, Human
uaaauaauaaguugcugagau

SEQ ID NO: 984315 - RNA, 22 nt, Human
uugaagcaaauucugugcagua

SEQ ID NO: 984316 - RNA, 22 nt, Human
auaaagacaugcuuacuugccc

SEQ ID NO: 984317 - RNA, 22 nt, Human
acauuuguaugcguuuuuacug

SEQ ID NO: 984318 - RNA, 22 nt, Human
caaagugcuaggauuacaggcc

SEQ ID NO: 984319 - RNA, 22 nt, Human
uccugggcuuaagugauccucc

SEQ ID NO: 984320 - RNA, 22 nt, Human
gcagccacuaguuuuccuguuu

SEQ ID NO: 984321 - RNA, 22 nt, Human
cauguguaugcauucauacaua

SEQ ID NO: 984322 - RNA, 22 nt, Human
acauaaugaaaugcagaaauca

SEQ ID NO: 984323 - RNA, 20 nt, Human
agcuggagaagggcccuucc

SEQ ID NO: 984324 - RNA, 22 nt, Human
uuugacagacauuuacuacauu

SEQ ID NO: 984325 - RNA, 23 nt, Human
agcuggaggcugucuacucccaa

SEQ ID NO: 984326 - RNA, 22 nt, Human
aagaugcagcaaacuacuuuuu

SEQ ID NO: 984327 - RNA, 22 nt, Human
ucuggcucuguguccccaccca

SEQ ID NO: 984328 - RNA, 22 nt, Human
gggcacugaaugccaagcuagg

SEQ ID NO: 984329 - RNA, 22 nt, Human
cacaggagguuaggaagugguc

SEQ ID NO: 984330 - RNA, 21 nt, Human
uccuggcccacucuaucccca

SEQ ID NO: 984331 - RNA, 22 nt, Human
uucaagaugcacaguggcauuc

SEQ ID NO: 984332 - RNA, 22 nt, Human
cagcuuugucugauuccucuuu

SEQ ID NO: 984333 - RNA, 22 nt, Human
ucagggcaccaaaaaagaugcc

SEQ ID NO: 984334 - RNA, 22 nt, Human
ccaaaguccacaguuuacauua

SEQ ID NO: 984335 - RNA, 22 nt, Human
caugcacaacauacucaagagg

SEQ ID NO: 984336 - RNA, 22 nt, Human
aucagcaaucucguguauuagg

SEQ ID NO: 984337 - RNA, 22 nt, Human
ugcagugguugagagcccagac

SEQ ID NO: 984338 - RNA, 22 nt, Human
ugucucaggggcauugaaauaa

SEQ ID NO: 984339 - RNA, 22 nt, Human
gcuggagcugaguucccugggc

SEQ ID NO: 984340 - RNA, 22 nt, Human
gcuccuggcuucacugacauca

SEQ ID NO: 984341 - RNA, 22 nt, Human
uggcagagaacacacaugauuc

SEQ ID NO: 984342 - RNA, 22 nt, Human
ccagggcagccaacccagaugc

SEQ ID NO: 984343 - RNA, 22 nt, Human
ggcuggcacugaggagagcucu

SEQ ID NO: 984344 - RNA, 22 nt, Human
cuuggcugucuauaggaaagag

SEQ ID NO: 984345 - RNA, 22 nt, Human
gcuccuggcaggcagugugugu

SEQ ID NO: 984346 - RNA, 22 nt, Human
gaaugcacuuccaacaucuauu

SEQ ID NO: 984347 - RNA, 22 nt, Human
agaggccagguccagaguuugu

SEQ ID NO: 984348 - RNA, 20 nt, Human
cagagccaagagcagcaucu

SEQ ID NO: 984349 - RNA, 22 nt, Human
cagguaggauggaagggcucaa

SEQ ID NO: 984350 - RNA, 22 nt, Human
gacuccuggcuuucccucuuag

SEQ ID NO: 984351 - RNA, 22 nt, Human
cagcagcuucuguugaucagaa

SEQ ID NO: 984352 - RNA, 22 nt, Human
aggacccagaggcagaggacgu

SEQ ID NO: 984353 - RNA, 19 nt, Human
augucccaccgccccugag

SEQ ID NO: 984354 - RNA, 22 nt, Human
ggccuuggugcucuguguugca

SEQ ID NO: 984355 - RNA, 22 nt, Human
cagaaauucccauuucagauuc

SEQ ID NO: 984356 - RNA, 22 nt, Human
auuaggaagaggaugucagcau

SEQ ID NO: 984357 - RNA, 22 nt, Human
uucaugcuuuuaccgcuguuaa

SEQ ID NO: 984358 - RNA, 22 nt, Human
ggcucccugccuguccucaguc

SEQ ID NO: 984359 - RNA, 22 nt, Human
acagagcaugcucaguguguga

SEQ ID NO: 984360 - RNA, 22 nt, Human
ucauugaaugcucugcagguug

SEQ ID NO: 984361 - RNA, 22 nt, Human
guggccaagaaaauagaugcau

SEQ ID NO: 984362 - RNA, 20 nt, Human
ggcugccuccuuccuuuccu

SEQ ID NO: 984363 - RNA, 22 nt, Human
ucaggcugaggucaucugcauc

SEQ ID NO: 984364 - RNA, 22 nt, Human
ugugaggagaggcccagcuccc

SEQ ID NO: 984365 - RNA, 22 nt, Human
uuuaagaugguauuuuauaaag

SEQ ID NO: 984366 - RNA, 22 nt, Human
gagggcugcaaugagacagaga

SEQ ID NO: 984367 - RNA, 22 nt, Human
agggcagagcugucuaaauggc

SEQ ID NO: 984368 - RNA, 22 nt, Human
ucugcagcgugcaggcuggugc

SEQ ID NO: 984369 - RNA, 22 nt, Human
ggccugagcagacagcaugaug

SEQ ID NO: 984370 - RNA, 23 nt, Human
uggcucuguggaucccucaggag

SEQ ID NO: 984371 - RNA, 22 nt, Human
ggucucagcuggaguccuuggu

SEQ ID NO: 984372 - RNA, 21 nt, Human
cucaggaucuuauauauuagu

SEQ ID NO: 984373 - RNA, 22 nt, Human
ucugccuggguguggagcagag

SEQ ID NO: 984374 - RNA, 22 nt, Human
ucagaggaccuuacugagaacc

SEQ ID NO: 984375 - RNA, 22 nt, Human
uuaaacagucccagaggcugac

SEQ ID NO: 984376 - RNA, 21 nt, Human
aucuuuauuacgcagagaaga

SEQ ID NO: 984377 - RNA, 19 nt, Human
uggcagggagaguuugaag

SEQ ID NO: 984378 - RNA, 22 nt, Human
cacagggcaggccccaggccuc

SEQ ID NO: 984379 - RNA, 22 nt, Human
cagguggaucucuaaggacuga

SEQ ID NO: 984380 - RNA, 22 nt, Human
gaggccugcagcguggucccug

SEQ ID NO: 984381 - RNA, 22 nt, Human
gcuccugucuuggggcacuggc

SEQ ID NO: 984382 - RNA, 22 nt, Human
cuggacagaaagggcugcugug

SEQ ID NO: 984383 - RNA, 22 nt, Human
caguguuccaggcggcagugaa

SEQ ID NO: 984384 - RNA, 22 nt, Human
ugagugccugaacauagaguag

SEQ ID NO: 984385 - RNA, 22 nt, Human
gagugguaggcaguguuaggaa

SEQ ID NO: 984386 - RNA, 22 nt, Human
uuauuauaaugagggauaaaaa

SEQ ID NO: 984387 - RNA, 22 nt, Human
aauacugccugugagguaacuc

SEQ ID NO: 984388 - RNA, 22 nt, Human
ccccaccugugcgucugccgca

SEQ ID NO: 984389 - RNA, 22 nt, Human
aucauguuccagaaacagugau

SEQ ID NO: 984390 - RNA, 22 nt, Human
gguggccuuucaguggaucagg

SEQ ID NO: 984391 - RNA, 22 nt, Human
uauauuaaaugaccaguuuuaa

SEQ ID NO: 984392 - RNA, 22 nt, Human
uugauacagcagccugugaucc

SEQ ID NO: 984393 - RNA, 22 nt, Human
aaugcacagcuaaagugguucc

SEQ ID NO: 984394 - RNA, 22 nt, Human
cacugagaggucucauuuccaa

SEQ ID NO: 984395 - RNA, 22 nt, Human
uagaucugauacaauucaucug

SEQ ID NO: 984396 - RNA, 22 nt, Human
auggauaauggugauaguugca

SEQ ID NO: 984397 - RNA, 22 nt, Human
ugcccugucuaagcugucagua

SEQ ID NO: 984398 - RNA, 22 nt, Human
auaaaaaggacagauguggucu

SEQ ID NO: 984399 - RNA, 22 nt, Human
uggcucagcugucacagccugg

SEQ ID NO: 984400 - RNA, 18 nt, Human
uggagcagguaggcauga

SEQ ID NO: 984401 - RNA, 22 nt, Human
uuacaguaugaucaacuuuuca

SEQ ID NO: 984402 - RNA, 22 nt, Human
ggcucaggaccugggauugcca

SEQ ID NO: 984403 - RNA, 22 nt, Human
uaaaugugcacagguuagaagg

SEQ ID NO: 984404 - RNA, 20 nt, Human
cucugcagcaaggccugggu

SEQ ID NO: 984405 - RNA, 22 nt, Human
aggccuguuggcgugggcucua

SEQ ID NO: 984406 - RNA, 22 nt, Human
gcucuccaaacccuguggcuuu

SEQ ID NO: 984407 - RNA, 22 nt, Human
ucccagccggugccuggguccc

SEQ ID NO: 984408 - RNA, 22 nt, Human
aaagcaguauauugguaguugu

SEQ ID NO: 984409 - RNA, 22 nt, Human
auucuaggcuugaaacaugaag

SEQ ID NO: 984410 - RNA, 22 nt, Human
cagcagugaugugugaggguuc

SEQ ID NO: 984411 - RNA, 22 nt, Human
gaaggaagugcucauacuaguu

SEQ ID NO: 984412 - RNA, 22 nt, Human
caguuaaaggcccaauaucugg

SEQ ID NO: 984413 - RNA, 22 nt, Human
cuucaagagaaugcagggaugu

SEQ ID NO: 984414 - RNA, 22 nt, Human
cucuggagugcagccugguggc

SEQ ID NO: 984415 - RNA, 22 nt, Human
uccagccaagccuugguagcug

SEQ ID NO: 984416 - RNA, 22 nt, Human
acaggagugaaucuggcacuua

SEQ ID NO: 984417 - RNA, 20 nt, Human
uccugcaguuccuaggaggg

SEQ ID NO: 984418 - RNA, 22 nt, Human
agaagccauucccuguaggcuc

SEQ ID NO: 984419 - RNA, 20 nt, Human
agauggugaaggccagggag

SEQ ID NO: 984420 - RNA, 22 nt, Human
cagguggguacaucacagagac

SEQ ID NO: 984421 - RNA, 22 nt, Human
auauacuuggagacuaucauug

SEQ ID NO: 984422 - RNA, 22 nt, Human
agaggccaguggcugugcuguc

SEQ ID NO: 984423 - RNA, 22 nt, Human
ggcaugggguguauguggcacg

SEQ ID NO: 984424 - RNA, 21 nt, Human
ggagucauuagucauuuccuu

SEQ ID NO: 984425 - RNA, 22 nt, Human
cagccugcauuuguaucuguau

SEQ ID NO: 984426 - RNA, 22 nt, Human
acacaggagauauguaauggcu

SEQ ID NO: 984427 - RNA, 22 nt, Human
agaucucaccucuguguauuau

SEQ ID NO: 984428 - RNA, 22 nt, Human
aaguucaagucugcaucuuuuu

SEQ ID NO: 984429 - RNA, 22 nt, Human
ugccugaggagucagggcaggu

SEQ ID NO: 984430 - RNA, 22 nt, Human
cuggcugguuacuauuucuggu

SEQ ID NO: 984431 - RNA, 22 nt, Human
ccauaagguuuggggccaugca

SEQ ID NO: 984432 - RNA, 22 nt, Human
auccaggguguggagagagcuc

SEQ ID NO: 984433 - RNA, 19 nt, Human
uuucacaaagagagcguga

SEQ ID NO: 984434 - RNA, 22 nt, Human
uaaagguaacaugaacugcuuu

SEQ ID NO: 984435 - RNA, 22 nt, Human
ggccucagugggccgcugcagg

SEQ ID NO: 984436 - RNA, 22 nt, Human
ucugucuccucugaggugccag

SEQ ID NO: 984437 - RNA, 22 nt, Human
gcaagauguuaacauagggaga

SEQ ID NO: 984438 - RNA, 22 nt, Human
ucuccuggccuuuagguuaagg

SEQ ID NO: 984439 - RNA, 22 nt, Human
ucaaaugcugccuuugugugcc

SEQ ID NO: 984440 - RNA, 22 nt, Human
uuaaaacagcgugaaucuggca

SEQ ID NO: 984441 - RNA, 22 nt, Human
gagagcugugguuugaccaggc

SEQ ID NO: 984442 - RNA, 22 nt, Human
gaggugagaagggggucagaug

SEQ ID NO: 984443 - RNA, 22 nt, Human
aggcagcagccacaaggccuga

SEQ ID NO: 984444 - RNA, 19 nt, Human
cuggcagccugucuguguc

SEQ ID NO: 984445 - RNA, 22 nt, Human
gccagagcugagacacgagucc

SEQ ID NO: 984446 - RNA, 22 nt, Human
ucucagggaccaugaugaugac

SEQ ID NO: 984447 - RNA, 22 nt, Human
uggcucuggauuaaucuaggaa

SEQ ID NO: 984448 - RNA, 22 nt, Human
uuccaggaauucagcucucagu

SEQ ID NO: 984449 - RNA, 22 nt, Human
aggagccaguuccaccccagga

SEQ ID NO: 984450 - RNA, 22 nt, Human
ccagugcaggugagcaccaggu

SEQ ID NO: 984451 - RNA, 22 nt, Human
agccaggaaugcaugcucugcu

SEQ ID NO: 984452 - RNA, 22 nt, Human
aaaguuugcaauuuauguuaau

SEQ ID NO: 984453 - RNA, 22 nt, Human
caggaaauaucuccuggcagag

SEQ ID NO: 984454 - RNA, 22 nt, Human
uucuuaaagaggcaaaacacag

SEQ ID NO: 984455 - RNA, 22 nt, Human
uaaggcacgcauaagagggggc

SEQ ID NO: 984456 - RNA, 22 nt, Human
ccagggcaaaugagaucauagc

SEQ ID NO: 984457 - RNA, 22 nt, Human
aggccugggcaagaaggggcgu

SEQ ID NO: 984458 - RNA, 22 nt, Human
uggagcugggguuugaaucugg

SEQ ID NO: 984459 - RNA, 22 nt, Human
aagagcuggagcugcuacagga

SEQ ID NO: 984460 - RNA, 22 nt, Human
uugugaaacauucauggauuug

SEQ ID NO: 984461 - RNA, 17 nt, Human
ggccuuggggccucagu

SEQ ID NO: 984462 - RNA, 22 nt, Human
augauggugggagaugacccag

SEQ ID NO: 984463 - RNA, 22 nt, Human
auagaaauggcagcuggugcua

SEQ ID NO: 984464 - RNA, 22 nt, Human
gagggcuccucacauucucuau

SEQ ID NO: 984465 - RNA, 22 nt, Human
uguccugggaaugggaugcagu

SEQ ID NO: 984466 - RNA, 22 nt, Human
cuggugucugcucccucacagc

SEQ ID NO: 984467 - RNA, 22 nt, Human
gucccuggucuaccguggcuuc

SEQ ID NO: 984468 - RNA, 22 nt, Human
ggagagugggagcaacuguugc

SEQ ID NO: 984469 - RNA, 22 nt, Human
agauuucagaugcucggcaguu

SEQ ID NO: 984470 - RNA, 22 nt, Human
auaauaaaccaggaugggucug

SEQ ID NO: 984471 - RNA, 22 nt, Human
uuugcagcaaggagagagcauu

SEQ ID NO: 984472 - RNA, 22 nt, Human
aagcugccauagaacgagaggu

SEQ ID NO: 984473 - RNA, 22 nt, Human
ucuuugcaggagcccuuugaac

SEQ ID NO: 984474 - RNA, 20 nt, Human
ccuuuauuauuuguaugaug

SEQ ID NO: 984475 - RNA, 22 nt, Human
augggugugaaaauggucaucu

SEQ ID NO: 984476 - RNA, 22 nt, Human
gucccagaugucuggaacuccc

SEQ ID NO: 984477 - RNA, 22 nt, Human
cccagagccucauucuguuggg

SEQ ID NO: 984478 - RNA, 22 nt, Human
accaucagucacauguagagaa

SEQ ID NO: 984479 - RNA, 19 nt, Human
ugucccagacuccgugucu

SEQ ID NO: 984480 - RNA, 22 nt, Human
gggcagcucucacagcagccaa

SEQ ID NO: 984481 - RNA, 22 nt, Human
uguacaaugccgagacuaacuc

SEQ ID NO: 984482 - RNA, 23 nt, Human
cccuggccuuggggcacaggcug

SEQ ID NO: 984483 - RNA, 22 nt, Human
ugagccuggggccugggcagcg

SEQ ID NO: 984484 - RNA, 22 nt, Human
cugcccagaaucacucacucga

SEQ ID NO: 984485 - RNA, 21 nt, Human
aggaaguggccagauugggaa

SEQ ID NO: 984486 - RNA, 22 nt, Human
aaugaugguauugaugagcuaa

SEQ ID NO: 984487 - RNA, 22 nt, Human
ugcugcucuguaaagugaugag

SEQ ID NO: 984488 - RNA, 21 nt, Human
aggucccagguuugggcagca

SEQ ID NO: 984489 - RNA, 22 nt, Human
uauugacaauuugugaaacuau

SEQ ID NO: 984490 - RNA, 22 nt, Human
cccagcuugcccaggacugagg

SEQ ID NO: 984491 - RNA, 19 nt, Human
gaaggagagcugaguuagg

SEQ ID NO: 984492 - RNA, 22 nt, Human
gggccucucccuucucacgcau

SEQ ID NO: 984493 - RNA, 22 nt, Human
guggcuucuggcugggccucag

SEQ ID NO: 984494 - RNA, 22 nt, Human
acauacuaugaauacauguguc

SEQ ID NO: 984495 - RNA, 23 nt, Human
acagagguccaaacaguauaagc

SEQ ID NO: 984496 - RNA, 22 nt, Human
gccacaugcaauugcagcacgu

SEQ ID NO: 984497 - RNA, 22 nt, Human
cugcuuuguguggucccuccag

SEQ ID NO: 984498 - RNA, 22 nt, Human
ccauggaguuccucuggucuau

SEQ ID NO: 984499 - RNA, 22 nt, Human
aagaagagaaaugugcugcugg

SEQ ID NO: 984500 - RNA, 23 nt, Human
ggccuguguuuugucugaaguac

SEQ ID NO: 984501 - RNA, 21 nt, Human
ucccagagugcuugggacugc

SEQ ID NO: 984502 - RNA, 22 nt, Human
ccuguuuacaucaucaaggacu

SEQ ID NO: 984503 - RNA, 22 nt, Human
gcucaggaucagccaccucuuu

SEQ ID NO: 984504 - RNA, 22 nt, Human
uggcaggguuggccaccuuacc

SEQ ID NO: 984505 - RNA, 22 nt, Human
acuguguccucauguggcagaa

SEQ ID NO: 984506 - RNA, 22 nt, Human
ucccagcccagauuugugugac

SEQ ID NO: 984507 - RNA, 22 nt, Human
ugugccuucucaguccugcuca

SEQ ID NO: 984508 - RNA, 22 nt, Human
uggaugcuguaggacacgcucu

SEQ ID NO: 984509 - RNA, 22 nt, Human
agucccagcuacucaagaggcu

SEQ ID NO: 984510 - RNA, 22 nt, Human
ucuccuggauggaccuucucuu

SEQ ID NO: 984511 - RNA, 22 nt, Human
ccagaccacccuggccaugcac

SEQ ID NO: 984512 - RNA, 22 nt, Human
caggccugacccugagcuucac

SEQ ID NO: 984513 - RNA, 22 nt, Human
gagcccuggcagucugggaugg

SEQ ID NO: 984514 - RNA, 22 nt, Human
ucuugccucuuccccuuuccau

SEQ ID NO: 984515 - RNA, 22 nt, Human
agcugccagggacugggcaugg

SEQ ID NO: 984516 - RNA, 22 nt, Human
cccaggucugugccagcucuga

SEQ ID NO: 984517 - RNA, 22 nt, Human
ugcagaaggaggaggaaaucca

SEQ ID NO: 984518 - RNA, 22 nt, Human
ccugccugaaggucagccaccc

SEQ ID NO: 984519 - RNA, 17 nt, Human
cucuccuuccucugagg

SEQ ID NO: 984520 - RNA, 21 nt, Human
agggaaagaaaaugagcuaau

SEQ ID NO: 984521 - RNA, 20 nt, Human
ccuaggcaugcugagucucc

SEQ ID NO: 984522 - RNA, 22 nt, Human
uaaacauggauucugaucacag

SEQ ID NO: 984523 - RNA, 22 nt, Human
aggccugaggaccuucuggagg

SEQ ID NO: 984524 - RNA, 22 nt, Human
ugcucugggcaacagccucccu

SEQ ID NO: 984525 - RNA, 22 nt, Human
ccuggcugcauuuugcuggaug

SEQ ID NO: 984526 - RNA, 22 nt, Human
ucagccagguaauguggagaug

SEQ ID NO: 984527 - RNA, 22 nt, Human
caguuuaaccuauccauuaugu

SEQ ID NO: 984528 - RNA, 22 nt, Human
gcagcguggggacaggagcuca

SEQ ID NO: 984529 - RNA, 22 nt, Human
gagagaagaauguuccgaggcc

SEQ ID NO: 984530 - RNA, 22 nt, Human
ccuggccucagccuagggcuga

SEQ ID NO: 984531 - RNA, 22 nt, Human
caggcagcgcucguggccuggc

SEQ ID NO: 984532 - RNA, 22 nt, Human
ccucagagguuuucauucugua

SEQ ID NO: 984533 - RNA, 22 nt, Human
accucugccaagaugugcuccc

SEQ ID NO: 984534 - RNA, 22 nt, Human
acucugcugucugauggcagga

SEQ ID NO: 984535 - RNA, 22 nt, Human
auggauaagucaaagaguaucc

SEQ ID NO: 984536 - RNA, 22 nt, Human
gcuggccugcaaagcccggcug

SEQ ID NO: 984537 - RNA, 22 nt, Human
uggagcaggccggaaguggcuu

SEQ ID NO: 984538 - RNA, 22 nt, Human
ugcucuccggcuuccguggccu

SEQ ID NO: 984539 - RNA, 22 nt, Human
uccuuuccaugcuucuagaggc

SEQ ID NO: 984540 - RNA, 22 nt, Human
uggcuggcgccgggcuagccac

SEQ ID NO: 984541 - RNA, 22 nt, Human
guccucuggugaaagcauuccc

SEQ ID NO: 984542 - RNA, 22 nt, Human
cuccucugucuggcccugagcc

SEQ ID NO: 984543 - RNA, 22 nt, Human
ccagcugggauuaagggaaaau

SEQ ID NO: 984544 - RNA, 22 nt, Human
ggugcagaggagccagcugggg

SEQ ID NO: 984545 - RNA, 22 nt, Human
ucugaaaguaucuggaucuuuu

SEQ ID NO: 984546 - RNA, 22 nt, Human
gcuccuggguguggcugccccu

SEQ ID NO: 984547 - RNA, 17 nt, Human
cccagagaugcugccuu

SEQ ID NO: 984548 - RNA, 22 nt, Human
auagacauuuugcauucaagca

SEQ ID NO: 984549 - RNA, 22 nt, Human
cugccucaugcugccugcagcc

SEQ ID NO: 984550 - RNA, 22 nt, Human
gagaggugaauguggaugccac

SEQ ID NO: 984551 - RNA, 22 nt, Human
agcucagcuuccucuccaugcu

SEQ ID NO: 984552 - RNA, 22 nt, Human
gcagcuggggaggucgugggga

SEQ ID NO: 984553 - RNA, 22 nt, Human
gagcugccuguugcauagcaac

SEQ ID NO: 984554 - RNA, 22 nt, Human
ugugcuucaucacuucucaguu

SEQ ID NO: 984555 - RNA, 22 nt, Human
ggagaaggugcuggucacugug

SEQ ID NO: 984556 - RNA, 22 nt, Human
cugggccagggaggugucugua

SEQ ID NO: 984557 - RNA, 18 nt, Human
ugggcugccuggccucug

SEQ ID NO: 984558 - RNA, 21 nt, Human
ucagggcagugggagguuccu

SEQ ID NO: 984559 - RNA, 22 nt, Human
gcucaaggcaggcagacaugag

SEQ ID NO: 984560 - RNA, 22 nt, Human
ucaagagaagugcuccacagua

SEQ ID NO: 984561 - RNA, 22 nt, Human
aagaauuauugcaauacuagau

SEQ ID NO: 984562 - RNA, 22 nt, Human
cccugcagccggccagcucauu

SEQ ID NO: 984563 - RNA, 22 nt, Human
ugaguagcggcuauguguaacu

SEQ ID NO: 984564 - RNA, 22 nt, Human
caguguccucagccagcagcua

SEQ ID NO: 984565 - RNA, 22 nt, Human
gagcucugacugcugggugaca

SEQ ID NO: 984566 - RNA, 18 nt, Human
cccucuccugcuaguggg

SEQ ID NO: 984567 - RNA, 22 nt, Human
gcacccagccagcaucucagag

SEQ ID NO: 984568 - RNA, 22 nt, Human
cccuguccuuggcugugaggcu

SEQ ID NO: 984569 - RNA, 22 nt, Human
cuucugugcuucacaguugcca

SEQ ID NO: 984570 - RNA, 23 nt, Human
aaagacugcugagaauuuuagga

SEQ ID NO: 984571 - RNA, 22 nt, Human
aucuuucagagcuccaucaggg

SEQ ID NO: 984572 - RNA, 22 nt, Human
acacaggaagucagcacugaug

SEQ ID NO: 984573 - RNA, 19 nt, Human
augauggucccauucaccu

SEQ ID NO: 984574 - RNA, 22 nt, Human
cugccuuccaaccccagacucc

SEQ ID NO: 984575 - RNA, 22 nt, Human
ucugguaaccuuuaucccuccu

SEQ ID NO: 984576 - RNA, 22 nt, Human
cuguccuugcuggccagguaug

SEQ ID NO: 984577 - RNA, 22 nt, Human
cagcaguguacaaggugucaga

SEQ ID NO: 984578 - RNA, 22 nt, Human
auaugcacacucugcccacaga

SEQ ID NO: 984579 - RNA, 22 nt, Human
uacauacacaaauauacuguuu

SEQ ID NO: 984580 - RNA, 22 nt, Human
agaguggggaagguguugagaa

SEQ ID NO: 984581 - RNA, 22 nt, Human
accagcucagaagccagaaaga

SEQ ID NO: 984582 - RNA, 22 nt, Human
ccucugcugcuguugagcaccg

SEQ ID NO: 984583 - RNA, 22 nt, Human
uugacaauugggagauauaaag

SEQ ID NO: 984584 - RNA, 22 nt, Human
aguguguguuugggcgguuuau

SEQ ID NO: 984585 - RNA, 22 nt, Human
agcucccauuaucuucugaaac

SEQ ID NO: 984586 - RNA, 22 nt, Human
augugcaugcacuuacaugugu

SEQ ID NO: 984587 - RNA, 22 nt, Human
aaagcucacaguaauacaaggc

SEQ ID NO: 984588 - RNA, 22 nt, Human
uguguuuuacaaauucucuuaa

SEQ ID NO: 984589 - RNA, 22 nt, Human
agauggggcagaauggagccau

SEQ ID NO: 984590 - RNA, 22 nt, Human
guaagggauuugaacauagguu

SEQ ID NO: 984591 - RNA, 22 nt, Human
agccuggauccauguggcuacc

SEQ ID NO: 984592 - RNA, 22 nt, Human
gcacugaaugccaaaguguagg

SEQ ID NO: 984593 - RNA, 22 nt, Human
uccugagauaaaucucauguga

SEQ ID NO: 984594 - RNA, 22 nt, Human
uuugaaaauuuaagugcuacac

SEQ ID NO: 984595 - RNA, 22 nt, Human
auguuacauaguccuuauuugu

SEQ ID NO: 984596 - RNA, 17 nt, Human
gaaagguccuagaaauc

SEQ ID NO: 984597 - RNA, 22 nt, Human
ccucaugguacuuacuguagcu

SEQ ID NO: 984598 - RNA, 22 nt, Human
ccugccagucacuaugucaccu

SEQ ID NO: 984599 - RNA, 22 nt, Human
caagugucuauaucagugcuug

SEQ ID NO: 984600 - RNA, 22 nt, Human
agagccugcuguguaagucaca

SEQ ID NO: 984601 - RNA, 22 nt, Human
ucuccuggcucaccaggcugga

SEQ ID NO: 984602 - RNA, 22 nt, Human
acaggcuuacaggcugcaagua

SEQ ID NO: 984603 - RNA, 22 nt, Human
gccaggggacgcggagcgacga

SEQ ID NO: 984604 - RNA, 22 nt, Human
uauguacaugauuucauuugcu

SEQ ID NO: 984605 - RNA, 22 nt, Human
uggcagcagggccccuggagga

SEQ ID NO: 984606 - RNA, 22 nt, Human
cugagccuuauucaccagcccu

SEQ ID NO: 984607 - RNA, 22 nt, Human
cucucugcaaguuuugaaauag

SEQ ID NO: 984608 - RNA, 22 nt, Human
cuuccucccggcccaugcucug

SEQ ID NO: 984609 - RNA, 22 nt, Human
ccaggaggcggaagguacagug

SEQ ID NO: 984610 - RNA, 22 nt, Human
ggagcuggcuacagagaacucc

SEQ ID NO: 984611 - RNA, 19 nt, Human
gcuguauuaaagauacaug

SEQ ID NO: 984612 - RNA, 22 nt, Human
cuguacaucucugaggacagua

SEQ ID NO: 984613 - RNA, 20 nt, Human
augcaaacccugcuuugugg

SEQ ID NO: 984614 - RNA, 22 nt, Human
aguuuauguagaauuggcaaua

SEQ ID NO: 984615 - RNA, 22 nt, Human
aggcuuccucgugccuuagaua

SEQ ID NO: 984616 - RNA, 18 nt, Human
agugugugcccuuucagg

SEQ ID NO: 984617 - RNA, 22 nt, Human
gagauauguuagaaagcuauug

SEQ ID NO: 984618 - RNA, 22 nt, Human
ucagagaaguaagguggggugc

SEQ ID NO: 984619 - RNA, 22 nt, Human
cugccuugaaaaugaagcuuua

SEQ ID NO: 984620 - RNA, 22 nt, Human
gcaggggaguccacucuaugca

SEQ ID NO: 984621 - RNA, 22 nt, Human
ugucucuggcccaugagcagag

SEQ ID NO: 984622 - RNA, 22 nt, Human
aaugauguuuuuaaagaacaua

SEQ ID NO: 984623 - RNA, 22 nt, Human
uucuuuccaaccagauauuggu

SEQ ID NO: 984624 - RNA, 22 nt, Human
ugcucccaaacgaccuacugug

SEQ ID NO: 984625 - RNA, 19 nt, Human
ggaggccuggguauuugcc

SEQ ID NO: 984626 - RNA, 22 nt, Human
ggcuuucuagaucuagcucugu

SEQ ID NO: 984627 - RNA, 22 nt, Human
ccagagcaauucucacagaacu

SEQ ID NO: 984628 - RNA, 22 nt, Human
augcaguacauacaaacacuga

SEQ ID NO: 984629 - RNA, 22 nt, Human
ucaaaguaaaaguauagaguuu

SEQ ID NO: 984630 - RNA, 22 nt, Human
uggcucaagugauccuccugcc

SEQ ID NO: 984631 - RNA, 22 nt, Human
aacauuucuucugaaacugagu

SEQ ID NO: 984632 - RNA, 21 nt, Human
gcucucugcaugguggcucag

SEQ ID NO: 984633 - RNA, 22 nt, Human
cagacaugauguaagcagaggc

SEQ ID NO: 984634 - RNA, 18 nt, Human
gggcuguguucaugccca

SEQ ID NO: 984635 - RNA, 22 nt, Human
uaagacaugguugaucuagugu

SEQ ID NO: 984636 - RNA, 22 nt, Human
gcugucagaaggugaaggguaa

SEQ ID NO: 984637 - RNA, 22 nt, Human
aaacacagggauauauauucca

SEQ ID NO: 984638 - RNA, 22 nt, Human
aacagaaaucauuuagggcucu

SEQ ID NO: 984639 - RNA, 22 nt, Human
uccuucagcuuauuucuuagga

SEQ ID NO: 984640 - RNA, 22 nt, Human
aagaggucauaccagauaaggg

SEQ ID NO: 984641 - RNA, 22 nt, Human
ucugccugagggagcugaggaa

SEQ ID NO: 984642 - RNA, 23 nt, Human
aaguucaagucacagccugucuu

SEQ ID NO: 984643 - RNA, 22 nt, Human
cuggugugauugagcccaggug

SEQ ID NO: 984644 - RNA, 22 nt, Human
aggcagggucuugcuauguugc

SEQ ID NO: 984645 - RNA, 23 nt, Human
uggugccucagaagcagugggcu

SEQ ID NO: 984646 - RNA, 22 nt, Human
ggcuucccaaggagccaggaug

SEQ ID NO: 984647 - RNA, 22 nt, Human
ugagccuggcggaagcagcgug

SEQ ID NO: 984648 - RNA, 22 nt, Human
aaguucaagcucugccuaaaau

SEQ ID NO: 984649 - RNA, 22 nt, Human
ccagggagccuggugugucagc

SEQ ID NO: 984650 - RNA, 22 nt, Human
cauggccucaaaggacugcaga

SEQ ID NO: 984651 - RNA, 22 nt, Human
cugaggaguuuggguuguucaa

SEQ ID NO: 984652 - RNA, 22 nt, Human
agccuccacagaugcaaagggc

SEQ ID NO: 984653 - RNA, 22 nt, Human
agaagugccauacuguggucca

SEQ ID NO: 984654 - RNA, 22 nt, Human
ugaagcagaggggucuugagcu

SEQ ID NO: 984655 - RNA, 22 nt, Human
ugggguggauagaaagugaugu

SEQ ID NO: 984656 - RNA, 22 nt, Human
accagcuguguccuggcugcag

SEQ ID NO: 984657 - RNA, 22 nt, Human
agcagugggugacagagcugag

SEQ ID NO: 984658 - RNA, 22 nt, Human
ccuccaggauaagucagggccu

SEQ ID NO: 984659 - RNA, 22 nt, Human
uucuuuccacagaggggaugau

SEQ ID NO: 984660 - RNA, 22 nt, Human
ccauggcauuuuaugugucuua

SEQ ID NO: 984661 - RNA, 22 nt, Human
uuuauuccaugugucuaugacc

SEQ ID NO: 984662 - RNA, 23 nt, Human
ccucagcauggcaggagcccagc

SEQ ID NO: 984663 - RNA, 22 nt, Human
uaagaaauuuaguuauagaaug

SEQ ID NO: 984664 - RNA, 22 nt, Human
cacagaggcaaccuucuggggu

SEQ ID NO: 984665 - RNA, 22 nt, Human
agggccuggugaccuggguccu

SEQ ID NO: 984666 - RNA, 22 nt, Human
uggccugccucccggcuucuuu

SEQ ID NO: 984667 - RNA, 22 nt, Human
caagagcucagaaacccuugcu

SEQ ID NO: 984668 - RNA, 22 nt, Human
ucccagcauaacaaacugcccg

SEQ ID NO: 984669 - RNA, 22 nt, Human
aaguucaaggcucuagaguucc

SEQ ID NO: 984670 - RNA, 22 nt, Human
auuuaaauuuucugauggagag

SEQ ID NO: 984671 - RNA, 22 nt, Human
ccagcaccuugaucuuggaguu

SEQ ID NO: 984672 - RNA, 22 nt, Human
agcaggaguuugaugcuuuuau

SEQ ID NO: 984673 - RNA, 22 nt, Human
uggcaacaugucgaagugcugu

SEQ ID NO: 984674 - RNA, 22 nt, Human
aaaugcacaaaguaaguguaau

SEQ ID NO: 984675 - RNA, 22 nt, Human
ccaaaguccauaguuuacauaa

SEQ ID NO: 984676 - RNA, 22 nt, Human
ugggccacggggguggagagcu

SEQ ID NO: 984677 - RNA, 22 nt, Human
gcugguuaggugagggugcgcc

SEQ ID NO: 984678 - RNA, 22 nt, Human
gaauuguacgcuuuacauaggu

SEQ ID NO: 984679 - RNA, 22 nt, Human
agcagcugucccuuaacaucag

SEQ ID NO: 984680 - RNA, 22 nt, Human
cugcccugaccugccucagagu

SEQ ID NO: 984681 - RNA, 22 nt, Human
cuggggcugcggacgggagccc

SEQ ID NO: 984682 - RNA, 22 nt, Human
cagccacguagcccuuggccgu

SEQ ID NO: 984683 - RNA, 19 nt, Human
gcaggguguugacuguccc

SEQ ID NO: 984684 - RNA, 22 nt, Human
cuucuuuacuuucuagaaauaa

SEQ ID NO: 984685 - RNA, 22 nt, Human
ccuggccagggucugggcugcu

SEQ ID NO: 984686 - RNA, 22 nt, Human
uacacuuuuuacuacagauucu

SEQ ID NO: 984687 - RNA, 22 nt, Human
aucuggcugagcgaggcccaca

SEQ ID NO: 984688 - RNA, 20 nt, Human
agcccuguuuccuggagaga

SEQ ID NO: 984689 - RNA, 22 nt, Human
gggugaggagcugccagucaug

SEQ ID NO: 984690 - RNA, 22 nt, Human
aaguaaaagcuuuaccaugcgc

SEQ ID NO: 984691 - RNA, 22 nt, Human
guauuaggugguggaauuguag

SEQ ID NO: 984692 - RNA, 22 nt, Human
uugcuucagagggagacacuuu

SEQ ID NO: 984693 - RNA, 22 nt, Human
uggguagagcaggcuggggcuu

SEQ ID NO: 984694 - RNA, 22 nt, Human
uacaugcaugucacagaaugaa

SEQ ID NO: 984695 - RNA, 22 nt, Human
ugccuaggaaaccucaugcuuc

SEQ ID NO: 984696 - RNA, 22 nt, Human
gcagcugaaagggaucucuaca

SEQ ID NO: 984697 - RNA, 22 nt, Human
cuccaggggccagaagccuggc

SEQ ID NO: 984698 - RNA, 22 nt, Human
gugucccaaagauuagaaauca

SEQ ID NO: 984699 - RNA, 22 nt, Human
gcagugggcaacaagagcugga

SEQ ID NO: 984700 - RNA, 22 nt, Human
cagguggagcugacugagggca

SEQ ID NO: 984701 - RNA, 22 nt, Human
uuuagaaauugcagagugggug

SEQ ID NO: 984702 - RNA, 21 nt, Human
ccuucucuugcuucagcuuca

SEQ ID NO: 984703 - RNA, 22 nt, Human
aaaguucagauuagacucaaga

SEQ ID NO: 984704 - RNA, 22 nt, Human
ccuguggcucucuuuggagguc

SEQ ID NO: 984705 - RNA, 20 nt, Human
gugggcagcaggcauacugg

SEQ ID NO: 984706 - RNA, 22 nt, Human
gggaguggguuuggccuaggcc

SEQ ID NO: 984707 - RNA, 22 nt, Human
ggccuugggaggagggucagaa

SEQ ID NO: 984708 - RNA, 22 nt, Human
cccagaggugcuucagaggugc

SEQ ID NO: 984709 - RNA, 18 nt, Human
ccagcaugccagaggcug

SEQ ID NO: 984710 - RNA, 22 nt, Human
agcugcugcggaaagaugccac

SEQ ID NO: 984711 - RNA, 22 nt, Human
acauguguauagccuguauaga

SEQ ID NO: 984712 - RNA, 22 nt, Human
ucucaagagggaggcaaucaug

SEQ ID NO: 984713 - RNA, 22 nt, Human
aauguguagcauuuaaugcagu

SEQ ID NO: 984714 - RNA, 17 nt, Human
uggcucugaggcugaau

SEQ ID NO: 984715 - RNA, 22 nt, Human
ugggcagacugagcccuguccc

SEQ ID NO: 984716 - RNA, 22 nt, Human
gccuucagcccugacuggccag

SEQ ID NO: 984717 - RNA, 22 nt, Human
gcccugugccagucacgcugug

SEQ ID NO: 984718 - RNA, 22 nt, Human
uccauuggucucugugcccagg

SEQ ID NO: 984719 - RNA, 22 nt, Human
aggcacugagaggcuguguugc

SEQ ID NO: 984720 - RNA, 22 nt, Human
cagugguggaaugaggaauugu

SEQ ID NO: 984721 - RNA, 22 nt, Human
cuggagccacuuuuuauccuuu

SEQ ID NO: 984722 - RNA, 22 nt, Human
agagccagcaagugaauaguga

SEQ ID NO: 984723 - RNA, 22 nt, Human
uggcucugucacugugagcuau

SEQ ID NO: 984724 - RNA, 22 nt, Human
aucacaaaggcugcuucaugau

SEQ ID NO: 984725 - RNA, 22 nt, Human
gcccuuccaacccagagggcaa

SEQ ID NO: 984726 - RNA, 22 nt, Human
ccugguguugugaaguagccgu

SEQ ID NO: 984727 - RNA, 22 nt, Human
ucucuggaagcgcagaucuguu

SEQ ID NO: 984728 - RNA, 22 nt, Human
aagaggaagucuccauggagag

SEQ ID NO: 984729 - RNA, 22 nt, Human
cagucccagaagagccugggag

SEQ ID NO: 984730 - RNA, 20 nt, Human
ucagugauuaucucugagug

SEQ ID NO: 984731 - RNA, 22 nt, Human
gggcugggauugcuugcuguga

SEQ ID NO: 984732 - RNA, 23 nt, Human
cagagcuggcucagagcugccug

SEQ ID NO: 984733 - RNA, 22 nt, Human
agagaggcgaguuaccugugcu

SEQ ID NO: 984734 - RNA, 22 nt, Human
guguuuccuaguuuaaugaaug

SEQ ID NO: 984735 - RNA, 22 nt, Human
aggccuggccuuuauguucaag

SEQ ID NO: 984736 - RNA, 22 nt, Human
ugcaagcacucaaugcaaacag

SEQ ID NO: 984737 - RNA, 22 nt, Human
uaaauguauaggcacuaaaccu

SEQ ID NO: 984738 - RNA, 23 nt, Human
ugcucugugaauaguuggugacu

SEQ ID NO: 984739 - RNA, 22 nt, Human
cagcucucuaaggucuugcuuu

SEQ ID NO: 984740 - RNA, 22 nt, Human
guggccucuguuggcuccuagg

SEQ ID NO: 984741 - RNA, 22 nt, Human
auugaauagaugcauuauacua

SEQ ID NO: 984742 - RNA, 20 nt, Human
ucagggcaugggacagcccc

SEQ ID NO: 984743 - RNA, 22 nt, Human
cucagcagugacaagagaguau

SEQ ID NO: 984744 - RNA, 22 nt, Human
ccugcuggccaguggagggcug

SEQ ID NO: 984745 - RNA, 22 nt, Human
acauuucugagcagggagcugu

SEQ ID NO: 984746 - RNA, 22 nt, Human
cagggccaagccccuuuggcug

SEQ ID NO: 984747 - RNA, 22 nt, Human
auagucuuagaucagauaaagu

SEQ ID NO: 984748 - RNA, 22 nt, Human
uuucacaaguuucaggauucug

SEQ ID NO: 984749 - RNA, 21 nt, Human
uuugcauuuuacaugugggga

SEQ ID NO: 984750 - RNA, 22 nt, Human
gcuguccugggaacaggcacua

SEQ ID NO: 984751 - RNA, 22 nt, Human
ugaaauauuuagagaguaaguu

SEQ ID NO: 984752 - RNA, 22 nt, Human
agcagcucacaggauuccugaa

SEQ ID NO: 984753 - RNA, 22 nt, Human
agcagcauguugggaugugaaa

SEQ ID NO: 984754 - RNA, 22 nt, Human
agcugccugggcuuguacaccu

SEQ ID NO: 984755 - RNA, 22 nt, Human
gcuggccugcugggcaccaccg

SEQ ID NO: 984756 - RNA, 22 nt, Human
ucccagggacugggcuaggcuu

SEQ ID NO: 984757 - RNA, 22 nt, Human
aaaaucaguacacuuuauuuug

SEQ ID NO: 984758 - RNA, 22 nt, Human
ugggcucugcaucagugcccau

SEQ ID NO: 984759 - RNA, 22 nt, Human
agggagacacaugaggaaguca

SEQ ID NO: 984760 - RNA, 22 nt, Human
ccaggccagcaggcacaccugc

SEQ ID NO: 984761 - RNA, 22 nt, Human
ugaagcaggguggccagauugu

SEQ ID NO: 984762 - RNA, 22 nt, Human
cagggccaugaggcacaggguc

SEQ ID NO: 984763 - RNA, 22 nt, Human
guucauuuuacuguaaauagca

SEQ ID NO: 984764 - RNA, 22 nt, Human
cucagagucccuucccucgugg

SEQ ID NO: 984765 - RNA, 22 nt, Human
uacauguaggugacauuuuaau

SEQ ID NO: 984766 - RNA, 22 nt, Human
gaggaagcagggcuuggcugag

SEQ ID NO: 984767 - RNA, 22 nt, Human
cuucacaacgacaucugguuag

SEQ ID NO: 984768 - RNA, 22 nt, Human
aaggcaggaugggaaaagauuu

SEQ ID NO: 984769 - RNA, 22 nt, Human
aggauauuugcuuaagauagcu

SEQ ID NO: 984770 - RNA, 22 nt, Human
cugccuggccugaucuccacgc

SEQ ID NO: 984771 - RNA, 22 nt, Human
cgcuggccauagccuccugugu

SEQ ID NO: 984772 - RNA, 22 nt, Human
gcugcagcaagcccuccagggg

SEQ ID NO: 984773 - RNA, 22 nt, Human
uccagccacucagcagggauug

SEQ ID NO: 984774 - RNA, 22 nt, Human
gcuccuggcuccaggcagccaa

SEQ ID NO: 984775 - RNA, 22 nt, Human
aucugacaaccuauugacuuga

SEQ ID NO: 984776 - RNA, 22 nt, Human
ugggggugugccagggaccucc

SEQ ID NO: 984777 - RNA, 22 nt, Human
acugcuuuuagaaaucuauaga

SEQ ID NO: 984778 - RNA, 22 nt, Human
auucacagggacaaugggagag

SEQ ID NO: 984779 - RNA, 20 nt, Human
agcugaggcaccugagguua

SEQ ID NO: 984780 - RNA, 22 nt, Human
ccuggagcacucucccuggcug

SEQ ID NO: 984781 - RNA, 22 nt, Human
caucacuguccucagcauucca

SEQ ID NO: 984782 - RNA, 22 nt, Human
aggcugccuguuccaaucuccu

SEQ ID NO: 984783 - RNA, 22 nt, Human
ggugggcaggucacucugccuc

SEQ ID NO: 984784 - RNA, 22 nt, Human
cagaguguaucuguguaagcau

SEQ ID NO: 984785 - RNA, 23 nt, Human
ugggaguguugggaucucugcuc

SEQ ID NO: 984786 - RNA, 22 nt, Human
gauuucaauccagcuuucuucu

SEQ ID NO: 984787 - RNA, 22 nt, Human
ugauuuccacagucaggggugc

SEQ ID NO: 984788 - RNA, 20 nt, Human
auauguguacguguauacau

SEQ ID NO: 984789 - RNA, 22 nt, Human
caagggcucuuuugaggaaugu

SEQ ID NO: 984790 - RNA, 22 nt, Human
auuguaauuuuagagaaagugg

SEQ ID NO: 984791 - RNA, 22 nt, Human
gaggaguguauuccacaccacu

SEQ ID NO: 984792 - RNA, 22 nt, Human
ggcagagcuuguuccuucuguu

SEQ ID NO: 984793 - RNA, 22 nt, Human
ucaggggcugugcauuucccag

SEQ ID NO: 984794 - RNA, 22 nt, Human
cuggggcccaucgagggcugag

SEQ ID NO: 984795 - RNA, 21 nt, Human
accaggcuugugggagggagc

SEQ ID NO: 984796 - RNA, 22 nt, Human
gcucaagggaugggagugggug

SEQ ID NO: 984797 - RNA, 22 nt, Human
acucugaggcaggucagggcag

SEQ ID NO: 984798 - RNA, 22 nt, Human
ugcucuguugugcaugugggau

SEQ ID NO: 984799 - RNA, 22 nt, Human
gggucuggacggcugcaggaag

SEQ ID NO: 984800 - RNA, 22 nt, Human
acuucucuucauagguggcaau

SEQ ID NO: 984801 - RNA, 22 nt, Human
uagaaagcuugggguguuuaaa

SEQ ID NO: 984802 - RNA, 22 nt, Human
agcuuguagaaggccacgagca

SEQ ID NO: 984803 - RNA, 22 nt, Human
agaaaaggcuugaagagguuuu

SEQ ID NO: 984804 - RNA, 22 nt, Human
auuucuuccucugucaguaacu

SEQ ID NO: 984805 - RNA, 23 nt, Human
uuacaguaggaguuggaaaacca

SEQ ID NO: 984806 - RNA, 22 nt, Human
aggcagagcuggguuuugaaau

SEQ ID NO: 984807 - RNA, 22 nt, Human
gcccugagacugagcauggguu

SEQ ID NO: 984808 - RNA, 22 nt, Human
cucugcuuggaacuggacagaa

SEQ ID NO: 984809 - RNA, 22 nt, Human
ccuuccuggagcccaugcagau

SEQ ID NO: 984810 - RNA, 21 nt, Human
ugcaggcaggcagagaugcug

SEQ ID NO: 984811 - RNA, 22 nt, Human
ugggcagaguugugaugaacug

SEQ ID NO: 984812 - RNA, 22 nt, Human
aaagauuaaaucaaauugguca

SEQ ID NO: 984813 - RNA, 22 nt, Human
gcugccugauguccagcaggac

SEQ ID NO: 984814 - RNA, 22 nt, Human
uuaaacagagucugaaauguaa

SEQ ID NO: 984815 - RNA, 22 nt, Human
aacaaaugauuguugguuggag

SEQ ID NO: 984816 - RNA, 22 nt, Human
ggcagaggaaggaugaauucac

SEQ ID NO: 984817 - RNA, 21 nt, Human
gcaggaugcaucuuggugucu

SEQ ID NO: 984818 - RNA, 22 nt, Human
cugagggcaugaacauuccaua

SEQ ID NO: 984819 - RNA, 22 nt, Human
aggagagucuugagucacuggu

SEQ ID NO: 984820 - RNA, 22 nt, Human
uccuugaagcaacgugcagaca

SEQ ID NO: 984821 - RNA, 22 nt, Human
ucugaggcauaaccuguucugc

SEQ ID NO: 984822 - RNA, 22 nt, Human
cugucaguaggcucccaucauu

SEQ ID NO: 984823 - RNA, 22 nt, Human
cuagaaauauuuuacagucaag

SEQ ID NO: 984824 - RNA, 22 nt, Human
uggggaggacgggcgccuuccu

SEQ ID NO: 984825 - RNA, 22 nt, Human
ugucagggcaugcgguccagcc

SEQ ID NO: 984826 - RNA, 22 nt, Human
uaacuaacuaguguucaaaaua

SEQ ID NO: 984827 - RNA, 22 nt, Human
uuuuaguuguaguuggugagga

SEQ ID NO: 984828 - RNA, 22 nt, Human
guuauguaugagggaaugauua

SEQ ID NO: 984829 - RNA, 22 nt, Human
uuuuauauggcacauugguugg

SEQ ID NO: 984830 - RNA, 22 nt, Human
cuggccuguccugacccagccu

SEQ ID NO: 984831 - RNA, 22 nt, Human
ccugucugagccagggugggca

SEQ ID NO: 984832 - RNA, 22 nt, Human
uagcugucaccagaaauggcca

SEQ ID NO: 984833 - RNA, 22 nt, Human
cuguagcagugugcucuuuuuc

SEQ ID NO: 984834 - RNA, 22 nt, Human
uggggcugaggagccucacucu

SEQ ID NO: 984835 - RNA, 22 nt, Human
cugaaggacacgugaggagcca

SEQ ID NO: 984836 - RNA, 20 nt, Human
gagccugggaagucuaaggu

SEQ ID NO: 984837 - RNA, 22 nt, Human
guggcucuccauugacauggaa

SEQ ID NO: 984838 - RNA, 22 nt, Human
ugaagcaaacgcuucuguuccu

SEQ ID NO: 984839 - RNA, 22 nt, Human
ccucagaguaggucucagcugu

SEQ ID NO: 984840 - RNA, 22 nt, Human
guuagaaacacauucuuauuga

SEQ ID NO: 984841 - RNA, 22 nt, Human
gcaugggcaagaggacuggggg

SEQ ID NO: 984842 - RNA, 22 nt, Human
uacaaaugaccauagccacuua

SEQ ID NO: 984843 - RNA, 22 nt, Human
auccaguucucagugcuuacag

SEQ ID NO: 984844 - RNA, 22 nt, Human
ugcagcugcuugauucaucuug

SEQ ID NO: 984845 - RNA, 22 nt, Human
ugaaggaaaugacggcagaaga

SEQ ID NO: 984846 - RNA, 22 nt, Human
ggcaggugcucugugggccugg

SEQ ID NO: 984847 - RNA, 22 nt, Human
cuguucucuggcgguggcuguu

SEQ ID NO: 984848 - RNA, 22 nt, Human
ccaaggagcugcaggcacuugu

SEQ ID NO: 984849 - RNA, 19 nt, Human
uuggcagcugagauccugc

SEQ ID NO: 984850 - RNA, 22 nt, Human
acaaagcuagagaagagaauug

SEQ ID NO: 984851 - RNA, 22 nt, Human
aguuucauauuaccaugucacc

SEQ ID NO: 984852 - RNA, 22 nt, Human
uuauuuucagcuaggaaagcca

SEQ ID NO: 984853 - RNA, 22 nt, Human
ccacagggcucuaggcgcuucc

SEQ ID NO: 984854 - RNA, 22 nt, Human
acauucuaacauuguacagaua

SEQ ID NO: 984855 - RNA, 22 nt, Human
caucuuuaacaauuuacaaugu

SEQ ID NO: 984856 - RNA, 22 nt, Human
ggggcacacuuuugguagauau

SEQ ID NO: 984857 - RNA, 22 nt, Human
caccagggcucugagcucugaa

SEQ ID NO: 984858 - RNA, 22 nt, Human
auauucuuccaaaacaucauuu

SEQ ID NO: 984859 - RNA, 22 nt, Human
ucagggcagaauccaaagaauu

SEQ ID NO: 984860 - RNA, 21 nt, Human
cugcuuuacuucagaggaucu

SEQ ID NO: 984861 - RNA, 18 nt, Human
gggaucaggcugccuagg

SEQ ID NO: 984862 - RNA, 18 nt, Human
caggagcaggaguugaac

SEQ ID NO: 984863 - RNA, 22 nt, Human
aguguuucuggcaaaugaaagu

SEQ ID NO: 984864 - RNA, 22 nt, Human
ugacagggcuagaggcaaugca

SEQ ID NO: 984865 - RNA, 22 nt, Human
acauuucuuccacaugcugcug

SEQ ID NO: 984866 - RNA, 22 nt, Human
ccaggagucuggaugagguguc

SEQ ID NO: 984867 - RNA, 22 nt, Human
aguguuccacacaucuggggaa

SEQ ID NO: 984868 - RNA, 22 nt, Human
ucugagggugggagaaggagcu

SEQ ID NO: 984869 - RNA, 22 nt, Human
uggccugacugucaggcuguau

SEQ ID NO: 984870 - RNA, 19 nt, Human
uguggccaugguucagcug

SEQ ID NO: 984871 - RNA, 20 nt, Human
gggugagauguaggagaggg

SEQ ID NO: 984872 - RNA, 22 nt, Human
cacagcuuccauuagaaugaga

SEQ ID NO: 984873 - RNA, 22 nt, Human
aggcagcuggcagcacccaggg

SEQ ID NO: 984874 - RNA, 22 nt, Human
ugugccaggcacuugcccaggc

SEQ ID NO: 984875 - RNA, 22 nt, Human
gggcacugugcuaggugcugag

SEQ ID NO: 984876 - RNA, 22 nt, Human
uuaggaaucaccugcagaucuu

SEQ ID NO: 984877 - RNA, 22 nt, Human
ugcaagggcuuagggggcugug

SEQ ID NO: 984878 - RNA, 22 nt, Human
ugcagugguguccagguguacu

SEQ ID NO: 984879 - RNA, 21 nt, Human
guggcccugguguggcugcac

SEQ ID NO: 984880 - RNA, 21 nt, Human
agagaagggacucuuccaguc

SEQ ID NO: 984881 - RNA, 22 nt, Human
auuaggacagagaugucaagag

SEQ ID NO: 984882 - RNA, 22 nt, Human
guaaaauagaauaacguggcua

SEQ ID NO: 984883 - RNA, 22 nt, Human
uggaccugcuggaugggcaggu

SEQ ID NO: 984884 - RNA, 22 nt, Human
acagauauaaacuauaguagug

SEQ ID NO: 984885 - RNA, 20 nt, Human
ugagccaaacgaugaagagc

SEQ ID NO: 984886 - RNA, 22 nt, Human
gugaggugggcuggccagagac

SEQ ID NO: 984887 - RNA, 22 nt, Human
gccuggagaauuaaaaggaagg

SEQ ID NO: 984888 - RNA, 22 nt, Human
aagauucuacaguagguacauu

SEQ ID NO: 984889 - RNA, 22 nt, Human
cccagccuggugcacugugggg

SEQ ID NO: 984890 - RNA, 22 nt, Human
gccaggcaaauuaaggaaugca

SEQ ID NO: 984891 - RNA, 22 nt, Human
ggccuuggugccauggccaguu

SEQ ID NO: 984892 - RNA, 22 nt, Human
uugcauugaaaauauauuuuaa

SEQ ID NO: 984893 - RNA, 22 nt, Human
gccggggcuggggagagacaug

SEQ ID NO: 984894 - RNA, 22 nt, Human
accaguccgcggagcuccgggg

SEQ ID NO: 984895 - RNA, 22 nt, Human
acccugagucagacagccugac

SEQ ID NO: 984896 - RNA, 22 nt, Human
caauaugcaagcuauuaaguau

SEQ ID NO: 984897 - RNA, 22 nt, Human
gaggcaggcacuguuaucagca

SEQ ID NO: 984898 - RNA, 22 nt, Human
aagcccagcaucccugcaccag

SEQ ID NO: 984899 - RNA, 22 nt, Human
uuauuuggguuugaguguggca

SEQ ID NO: 984900 - RNA, 22 nt, Human
agcagccaaccuuacauucauc

SEQ ID NO: 984901 - RNA, 22 nt, Human
ugcuagaauaccuaccuggagg

SEQ ID NO: 984902 - RNA, 20 nt, Human
gaggccucagccucagcucc

SEQ ID NO: 984903 - RNA, 22 nt, Human
gcucaggacccaggugugaccu

SEQ ID NO: 984904 - RNA, 22 nt, Human
gaaaugugaccuacuuccuugu

SEQ ID NO: 984905 - RNA, 17 nt, Human
guuugcaugguguuaac

SEQ ID NO: 984906 - RNA, 22 nt, Human
gcagcacauauaaacaaagaga

SEQ ID NO: 984907 - RNA, 19 nt, Human
auaaggcaauuggauuugg

SEQ ID NO: 984908 - RNA, 20 nt, Human
uacuugaauguugcagcagu

SEQ ID NO: 984909 - RNA, 22 nt, Human
uucugaggcacuggcucuccca

SEQ ID NO: 984910 - RNA, 22 nt, Human
uugcacagaugagggugaugcu

SEQ ID NO: 984911 - RNA, 22 nt, Human
ucagggaaugaugcacacaguu

SEQ ID NO: 984912 - RNA, 22 nt, Human
ugagccagaggaggcugugugg

SEQ ID NO: 984913 - RNA, 22 nt, Human
ccucuguccuggggaguggagc

SEQ ID NO: 984914 - RNA, 22 nt, Human
ucagcugccccaguggccccag

SEQ ID NO: 984915 - RNA, 22 nt, Human
uuauuaugguauuucuuugcag

SEQ ID NO: 984916 - RNA, 23 nt, Human
cccagcuuucccacugccgagag

SEQ ID NO: 984917 - RNA, 20 nt, Human
ccagucccugagcaccaggg

SEQ ID NO: 984918 - RNA, 22 nt, Human
ggccucugcaacuggcuguggc

SEQ ID NO: 984919 - RNA, 22 nt, Human
gacccaggguuucugcacaggg

SEQ ID NO: 984920 - RNA, 22 nt, Human
ugugccagaaaauaugcugagg

SEQ ID NO: 984921 - RNA, 22 nt, Human
cuggccugaggccgccuucaga

SEQ ID NO: 984922 - RNA, 22 nt, Human
aaaugcauaucaaagacuugaa

SEQ ID NO: 984923 - RNA, 22 nt, Human
cuccugaguaguagcauuguca

SEQ ID NO: 984924 - RNA, 22 nt, Human
gccucugcaggugcgguuaucc

SEQ ID NO: 984925 - RNA, 19 nt, Human
ccucugcgcuguccugcuc

SEQ ID NO: 984926 - RNA, 22 nt, Human
aaaguguagagacuuuggaacc

SEQ ID NO: 984927 - RNA, 22 nt, Human
ccuggcaguggugaagaagagg

SEQ ID NO: 984928 - RNA, 22 nt, Human
cuguacaucccgagagccagua

SEQ ID NO: 984929 - RNA, 22 nt, Human
ugauuuccacgugcacccaggu

SEQ ID NO: 984930 - RNA, 22 nt, Human
cuguuuauaaauagaggggagu

SEQ ID NO: 984931 - RNA, 22 nt, Human
cugccucugcgucccacagagu

SEQ ID NO: 984932 - RNA, 21 nt, Human
aacugcuggucuuuucugucu

SEQ ID NO: 984933 - RNA, 22 nt, Human
gaggaaaagagacagguuauug

SEQ ID NO: 984934 - RNA, 20 nt, Human
cacagcuugccuuuuaugac

SEQ ID NO: 984935 - RNA, 22 nt, Human
guaagcaucugucucuucugca

SEQ ID NO: 984936 - RNA, 22 nt, Human
uuccugaugcacacagucauuu

SEQ ID NO: 984937 - RNA, 22 nt, Human
ggcaguggugggaggcucgcuc

SEQ ID NO: 984938 - RNA, 22 nt, Human
ucuggcucucaacaaauauuua

SEQ ID NO: 984939 - RNA, 22 nt, Human
uugauaaaaugauaucuucuuu

SEQ ID NO: 984940 - RNA, 22 nt, Human
gggaggaggaauguuuugugua

SEQ ID NO: 984941 - RNA, 22 nt, Human
uuccuguaguugugcaauguac

SEQ ID NO: 984942 - RNA, 22 nt, Human
uuaugggagcaauuggggaggu

SEQ ID NO: 984943 - RNA, 22 nt, Human
ucccacucccaggcaggccucu

SEQ ID NO: 984944 - RNA, 22 nt, Human
uucuuuaaaauagugagaaaga

SEQ ID NO: 984945 - RNA, 22 nt, Human
gagcagaugugugccaggaugc

SEQ ID NO: 984946 - RNA, 18 nt, Human
gaagggagcuggaaugca

SEQ ID NO: 984947 - RNA, 22 nt, Human
uggcaagccugagauccgggag

SEQ ID NO: 984948 - RNA, 22 nt, Human
ggggcuguuuuuggaauggcug

SEQ ID NO: 984949 - RNA, 22 nt, Human
cugccagcucaaagcgcagcua

SEQ ID NO: 984950 - RNA, 22 nt, Human
aaaugaugcucacagauuagug

SEQ ID NO: 984951 - RNA, 22 nt, Human
agugaaaugauaguguaaauac

SEQ ID NO: 984952 - RNA, 22 nt, Human
ggcagcuccucaaaaaauuaaa

SEQ ID NO: 984953 - RNA, 22 nt, Human
auuauauugaguauaaccagag

SEQ ID NO: 984954 - RNA, 22 nt, Human
gcugggagcaaguacucaucuu

SEQ ID NO: 984955 - RNA, 22 nt, Human
gggagcugagggaccucugugg

SEQ ID NO: 984956 - RNA, 21 nt, Human
acagcagggcuggcaugacag

SEQ ID NO: 984957 - RNA, 19 nt, Human
ugaagcaggcagagaagau

SEQ ID NO: 984958 - RNA, 22 nt, Human
uuaugacauaugaguacaagua

SEQ ID NO: 984959 - RNA, 22 nt, Human
gcaagcaguuguggcuucugag

SEQ ID NO: 984960 - RNA, 19 nt, Human
ggcucucuuaaagcuguuu

SEQ ID NO: 984961 - RNA, 22 nt, Human
cuguccccgcgaguccagagcu

SEQ ID NO: 984962 - RNA, 22 nt, Human
uuauacauguguuuugagauga

SEQ ID NO: 984963 - RNA, 22 nt, Human
cagcuugggucaggugccugcu

SEQ ID NO: 984964 - RNA, 22 nt, Human
uuucaagcauaacugggaagag

SEQ ID NO: 984965 - RNA, 22 nt, Human
gcuggccucuggagaagggcuu

SEQ ID NO: 984966 - RNA, 19 nt, Human
gcaugcuugguggcuucug

SEQ ID NO: 984967 - RNA, 22 nt, Human
ggccucucucccuggcuugcag

SEQ ID NO: 984968 - RNA, 18 nt, Human
ucauuagggauugcaaag

SEQ ID NO: 984969 - RNA, 22 nt, Human
ugggcugcuuccucagcugaga

SEQ ID NO: 984970 - RNA, 22 nt, Human
gcucaagagagaugcaguucuu

SEQ ID NO: 984971 - RNA, 20 nt, Human
cagcaguggaugagaguuuu

SEQ ID NO: 984972 - RNA, 19 nt, Human
caagugaagccugggaugg

SEQ ID NO: 984973 - RNA, 22 nt, Human
gccaggcacaguucuaggugcu

SEQ ID NO: 984974 - RNA, 22 nt, Human
agauacauagcugugagcacac

SEQ ID NO: 984975 - RNA, 22 nt, Human
cugcccugacugaccuuuugaa

SEQ ID NO: 984976 - RNA, 22 nt, Human
gucauugcaguggcaaaucaca

SEQ ID NO: 984977 - RNA, 20 nt, Human
uaugaguauuacuuucagga

SEQ ID NO: 984978 - RNA, 22 nt, Human
cccaggagagaggccaguuggc

SEQ ID NO: 984979 - RNA, 22 nt, Human
cagccagguucaaguccuuaua

SEQ ID NO: 984980 - RNA, 22 nt, Human
agcaccugcuuaaugugcagug

SEQ ID NO: 984981 - RNA, 22 nt, Human
cccagccucagcuuuacuucca

SEQ ID NO: 984982 - RNA, 22 nt, Human
uuaauaaacaggugcagcugaa

SEQ ID NO: 984983 - RNA, 22 nt, Human
ucacaugcuacugagccagacc

SEQ ID NO: 984984 - RNA, 22 nt, Human
agaauuuuugauuaucuacucg

SEQ ID NO: 984985 - RNA, 22 nt, Human
ccaaaugcuccacugacuuugg

SEQ ID NO: 984986 - RNA, 22 nt, Human
uuugcaaauaccaugaaacuug

SEQ ID NO: 984987 - RNA, 22 nt, Human
cuuccugcaggacagccaucug

SEQ ID NO: 984988 - RNA, 22 nt, Human
aaauacaguguguguucuuuga

SEQ ID NO: 984989 - RNA, 22 nt, Human
auauuaauuauuuacacaugag

SEQ ID NO: 984990 - RNA, 22 nt, Human
ucugugccucaucugguucagg

SEQ ID NO: 984991 - RNA, 22 nt, Human
cacagaauuaagggagaaauau

SEQ ID NO: 984992 - RNA, 22 nt, Human
ugcucugucaagaaaagaugcc

SEQ ID NO: 984993 - RNA, 22 nt, Human
uaaaauguagcuucuaggcugg

SEQ ID NO: 984994 - RNA, 22 nt, Human
uucucuggaacugaaacaagau

SEQ ID NO: 984995 - RNA, 19 nt, Human
accucugcagagauguuua

SEQ ID NO: 984996 - RNA, 22 nt, Human
uggcucagccauucguguugcc

SEQ ID NO: 984997 - RNA, 23 nt, Human
cacaccaggagccgucugggcca

SEQ ID NO: 984998 - RNA, 22 nt, Human
cacagcuucugagugaggauuu

SEQ ID NO: 984999 - RNA, 22 nt, Human
agcuuuaugggagcuuagauaa

SEQ ID NO: 985000 - RNA, 22 nt, Human
ucugggagacguguguugucag

SEQ ID NO: 985001 - RNA, 22 nt, Human
caggguggcacucagcgcaucu

SEQ ID NO: 985002 - RNA, 22 nt, Human
uuugugaagggaacagaagugu

SEQ ID NO: 985003 - RNA, 22 nt, Human
uaaauaugcauguauccuuauc

SEQ ID NO: 985004 - RNA, 22 nt, Human
gcagugguccaguucacaccca

SEQ ID NO: 985005 - RNA, 22 nt, Human
ggccugcuuuccgagccugcag

SEQ ID NO: 985006 - RNA, 22 nt, Human
uuauuagggugguuuauguucu

SEQ ID NO: 985007 - RNA, 22 nt, Human
guuaggauuauauaucccauga

SEQ ID NO: 985008 - RNA, 22 nt, Human
uguuccauaaguggugcuuugu

SEQ ID NO: 985009 - RNA, 22 nt, Human
uguauauucugccuaaaagcuu

SEQ ID NO: 985010 - RNA, 22 nt, Human
agcauggggcaaugcaugugcu

SEQ ID NO: 985011 - RNA, 22 nt, Human
uagggauggaaacuaggaaucu

SEQ ID NO: 985012 - RNA, 22 nt, Human
cuauugaauagcccaaaucauu

SEQ ID NO: 985013 - RNA, 22 nt, Human
agcagagccaggucucucugua

SEQ ID NO: 985014 - RNA, 22 nt, Human
cacugucuuuugugaagacaau

SEQ ID NO: 985015 - RNA, 22 nt, Human
caccugagugucaguauucuca

SEQ ID NO: 985016 - RNA, 22 nt, Human
gaggcucagagggagcaugguc

SEQ ID NO: 985017 - RNA, 22 nt, Human
agggaggauaguagucaguuua

SEQ ID NO: 985018 - RNA, 22 nt, Human
ugccucugugggccuuccuggc

SEQ ID NO: 985019 - RNA, 22 nt, Human
gaggcugcaggcaaugcugccc

SEQ ID NO: 985020 - RNA, 22 nt, Human
cauggcaggaggcugcuggcag

SEQ ID NO: 985021 - RNA, 22 nt, Human
ggcaggagggcggacaaugacc

SEQ ID NO: 985022 - RNA, 22 nt, Human
ugccagaagauucucuaucaga

SEQ ID NO: 985023 - RNA, 22 nt, Human
acaaaugccauauauaaauucu

SEQ ID NO: 985024 - RNA, 22 nt, Human
ggagcuggucagccuugagcau

SEQ ID NO: 985025 - RNA, 22 nt, Human
ggccagggggcuucagacucca

SEQ ID NO: 985026 - RNA, 22 nt, Human
ucagggacugcagagggaagcu

SEQ ID NO: 985027 - RNA, 22 nt, Human
gacucugcuacaggccgagguu

SEQ ID NO: 985028 - RNA, 20 nt, Human
ucacagaaacaaauagagaa

SEQ ID NO: 985029 - RNA, 22 nt, Human
uuuuccucugcagagcaguuag

SEQ ID NO: 985030 - RNA, 22 nt, Human
ucagaagcugguguccuuugaa

SEQ ID NO: 985031 - RNA, 22 nt, Human
acuggccaggcacagcuguggg

SEQ ID NO: 985032 - RNA, 22 nt, Human
gagccuggagcuggaacgaagc

SEQ ID NO: 985033 - RNA, 22 nt, Human
caagagcucccagaccugggca

SEQ ID NO: 985034 - RNA, 22 nt, Human
ucacuggggccuuuggucagga

SEQ ID NO: 985035 - RNA, 22 nt, Human
gagggguguggagccaucaguu

SEQ ID NO: 985036 - RNA, 22 nt, Human
aggcucaggcaggaauggcgga

SEQ ID NO: 985037 - RNA, 22 nt, Human
cuucacaaaauauuucauuaua

SEQ ID NO: 985038 - RNA, 22 nt, Human
gcugccuccugaaagcgcucug

SEQ ID NO: 985039 - RNA, 22 nt, Human
aucuacaggauaguuuaauauu

SEQ ID NO: 985040 - RNA, 22 nt, Human
auucggaucauguguauguguu

SEQ ID NO: 985041 - RNA, 22 nt, Human
gcuuuguguagaaggaggaugg

SEQ ID NO: 985042 - RNA, 22 nt, Human
uauuagguaugaacuggcaacc

SEQ ID NO: 985043 - RNA, 22 nt, Human
aggccaaaccggauggaaaagg

SEQ ID NO: 985044 - RNA, 22 nt, Human
ccagggucucugcugccugaga

SEQ ID NO: 985045 - RNA, 22 nt, Human
aaucuggcauguaagcuuagag

SEQ ID NO: 985046 - RNA, 22 nt, Human
ugcugccaccccucaccagagc

SEQ ID NO: 985047 - RNA, 22 nt, Human
agugaguggguuacagauggga

SEQ ID NO: 985048 - RNA, 22 nt, Human
accugagaaugggggcaugugu

SEQ ID NO: 985049 - RNA, 22 nt, Human
gaaugugugacucuauugagca

SEQ ID NO: 985050 - RNA, 23 nt, Human
uccaagggcuacaaacacagacc

SEQ ID NO: 985051 - RNA, 20 nt, Human
cguaaggcaagugcugcauc

SEQ ID NO: 985052 - RNA, 22 nt, Human
gcugucucggggcuuucuccug

SEQ ID NO: 985053 - RNA, 22 nt, Human
cugggcugcaggaguggggcaa

SEQ ID NO: 985054 - RNA, 22 nt, Human
cccuccagagcuugaccugcug

SEQ ID NO: 985055 - RNA, 22 nt, Human
ugcuggccaacaaggcuccaag

SEQ ID NO: 985056 - RNA, 22 nt, Human
gaaaguuucuucauuaagaugu

SEQ ID NO: 985057 - RNA, 22 nt, Human
ugugcaguuucuauguugucca

SEQ ID NO: 985058 - RNA, 22 nt, Human
aaaugucuaucuggcauauucc

SEQ ID NO: 985059 - RNA, 22 nt, Human
gaggcugguaggaaaggaaaca

SEQ ID NO: 985060 - RNA, 22 nt, Human
caggagcucuuaaggaugugau

SEQ ID NO: 985061 - RNA, 22 nt, Human
aacucacuuuguggcuucugaa

SEQ ID NO: 985062 - RNA, 20 nt, Human
agugucuggugcagggccuc

SEQ ID NO: 985063 - RNA, 21 nt, Human
uuacuuuugcaccaaccuaau

SEQ ID NO: 985064 - RNA, 22 nt, Human
acagagcacugcccugugccgc

SEQ ID NO: 985065 - RNA, 22 nt, Human
acauuucuggaguuucucaaca

SEQ ID NO: 985066 - RNA, 22 nt, Human
gaggaaugucagcacaggccuc

SEQ ID NO: 985067 - RNA, 22 nt, Human
ucacuaaguuacauuuaguauu

SEQ ID NO: 985068 - RNA, 22 nt, Human
uccuggauucugcccugaaggc

SEQ ID NO: 985069 - RNA, 22 nt, Human
gccaugccugugucuccaggcc

SEQ ID NO: 985070 - RNA, 22 nt, Human
uggccuggcugcccugucugga

SEQ ID NO: 985071 - RNA, 22 nt, Human
cugggcacagcguugggcucuu

SEQ ID NO: 985072 - RNA, 22 nt, Human
aaagaacaaaugauauaugguu

SEQ ID NO: 985073 - RNA, 22 nt, Human
uggcugcugagaaggcagcugu

SEQ ID NO: 985074 - RNA, 22 nt, Human
agggcugguauguccaugaaag

SEQ ID NO: 985075 - RNA, 21 nt, Human
acagccugucaucucaugguc

SEQ ID NO: 985076 - RNA, 22 nt, Human
accugccucuaagcagcaggug

SEQ ID NO: 985077 - RNA, 22 nt, Human
aaagguuugcauggaauuuacc

SEQ ID NO: 985078 - RNA, 22 nt, Human
gaacagcccuguuaagucuguu

SEQ ID NO: 985079 - RNA, 22 nt, Human
ugauuuccugugcgcccuuagg

SEQ ID NO: 985080 - RNA, 23 nt, Human
ucuggcucuaugugacagcucuc

SEQ ID NO: 985081 - RNA, 22 nt, Human
uuguacacaauucuuaacauac

SEQ ID NO: 985082 - RNA, 22 nt, Human
ugucuuaagaaauugcauuugu

SEQ ID NO: 985083 - RNA, 19 nt, Human
agucucacccaagcagucu

SEQ ID NO: 985084 - RNA, 22 nt, Human
cuguguccugcgucaagccaau

SEQ ID NO: 985085 - RNA, 22 nt, Human
cucaggaugaaagucaugguga

SEQ ID NO: 985086 - RNA, 20 nt, Human
aagcaauauagugcaaaugu

SEQ ID NO: 985087 - RNA, 22 nt, Human
uggagcugauacagcuggcuuu

SEQ ID NO: 985088 - RNA, 22 nt, Human
augcaaaagacuauuuguugcu

SEQ ID NO: 985089 - RNA, 22 nt, Human
ucaguuuugaaaacauugaaug

SEQ ID NO: 985090 - RNA, 22 nt, Human
agggcugcuccuccuucaggcc

SEQ ID NO: 985091 - RNA, 22 nt, Human
cauugcacuccagcuugggcaa

SEQ ID NO: 985092 - RNA, 22 nt, Human
ugaaggaaugagggaguggguc

SEQ ID NO: 985093 - RNA, 22 nt, Human
augcugcacaagccacauguag

SEQ ID NO: 985094 - RNA, 22 nt, Human
auuacacacucaaguccuguua

SEQ ID NO: 985095 - RNA, 22 nt, Human
gugcgccagcucaaggggaggc

SEQ ID NO: 985096 - RNA, 22 nt, Human
cugccuggucucaggcaugggg

SEQ ID NO: 985097 - RNA, 22 nt, Human
ucagagccaaucauggugcauu

SEQ ID NO: 985098 - RNA, 22 nt, Human
ggagcuguugcgcaugcgcucg

SEQ ID NO: 985099 - RNA, 22 nt, Human
ccaagggcucugacuugccugc

SEQ ID NO: 985100 - RNA, 22 nt, Human
cucccugguguccccuccagga

SEQ ID NO: 985101 - RNA, 22 nt, Human
ugauuuccaauaaggagaaugu

SEQ ID NO: 985102 - RNA, 22 nt, Human
cugagccauccauaccagcuua

SEQ ID NO: 985103 - RNA, 22 nt, Human
agcugagcacauucaaacaggu

SEQ ID NO: 985104 - RNA, 22 nt, Human
aagcagaaaaacugagcuccaa

SEQ ID NO: 985105 - RNA, 22 nt, Human
acuuugugcccaacagaaagaa

SEQ ID NO: 985106 - RNA, 22 nt, Human
agaaguaggcagggcuguauca

SEQ ID NO: 985107 - RNA, 22 nt, Human
cugaggucuagacaccccaggg

SEQ ID NO: 985108 - RNA, 22 nt, Human
ucucaggaagauuagggcuaag

SEQ ID NO: 985109 - RNA, 22 nt, Human
ucuucuuccucauuuauacaua

SEQ ID NO: 985110 - RNA, 22 nt, Human
agcagggccucuggcacugguc

SEQ ID NO: 985111 - RNA, 22 nt, Human
aggcagcagggccacuggcuga

SEQ ID NO: 985112 - RNA, 22 nt, Human
aaaacuccugaaauuguuuccc

SEQ ID NO: 985113 - RNA, 22 nt, Human
gagagcuguccggcugagcagc

SEQ ID NO: 985114 - RNA, 22 nt, Human
ccuuggcccuagccucaggcaa

SEQ ID NO: 985115 - RNA, 22 nt, Human
cugaaaugacgguuuggggcaa

SEQ ID NO: 985116 - RNA, 22 nt, Human
gccugccugcugucaucugccu

SEQ ID NO: 985117 - RNA, 22 nt, Human
ugcuucaggaagaaacgccagg

SEQ ID NO: 985118 - RNA, 22 nt, Human
gagcucagcccaaagagcagug

SEQ ID NO: 985119 - RNA, 20 nt, Human
ccuggcugcauucaggacgg

SEQ ID NO: 985120 - RNA, 22 nt, Human
ccugccugacagagaagguuca

SEQ ID NO: 985121 - RNA, 22 nt, Human
gccagcugguaggcaccuagcc

SEQ ID NO: 985122 - RNA, 22 nt, Human
uccaagggcucauggacacuuu

SEQ ID NO: 985123 - RNA, 22 nt, Human
cuuauguauauuuggaacguac

SEQ ID NO: 985124 - RNA, 22 nt, Human
caguuucucucaauaagcaucg

SEQ ID NO: 985125 - RNA, 21 nt, Human
ugcccacagcaaaugcagagg

SEQ ID NO: 985126 - RNA, 22 nt, Human
uucccaggcugugcuaccagag

SEQ ID NO: 985127 - RNA, 22 nt, Human
agagggaucacccuguuucugg

SEQ ID NO: 985128 - RNA, 22 nt, Human
cugccagcagaggccagcgcug

SEQ ID NO: 985129 - RNA, 22 nt, Human
gguagcagggcugugagucaga

SEQ ID NO: 985130 - RNA, 23 nt, Human
cccuguagcccaggacaggcuuu

SEQ ID NO: 985131 - RNA, 22 nt, Human
cuggaagguucuuugugugccu

SEQ ID NO: 985132 - RNA, 22 nt, Human
cagggcagagccaggauuucaa

SEQ ID NO: 985133 - RNA, 22 nt, Human
uugccacugaaccagucuugca

SEQ ID NO: 985134 - RNA, 22 nt, Human
acccuuucuuacucacacgcuc

SEQ ID NO: 985135 - RNA, 22 nt, Human
agucccagcucugccacuuacu

SEQ ID NO: 985136 - RNA, 22 nt, Human
cagcaauaagccagguuagaca

SEQ ID NO: 985137 - RNA, 21 nt, Human
uccauuguuuucccaggguuu

SEQ ID NO: 985138 - RNA, 22 nt, Human
aggcugcuuccuuacguggcug

SEQ ID NO: 985139 - RNA, 21 nt, Human
aagcaggacauaugaugcccu

SEQ ID NO: 985140 - RNA, 23 nt, Human
aaucuggcugauguuuuuucucu

SEQ ID NO: 985141 - RNA, 18 nt, Human
ugggauggagaguaacug

SEQ ID NO: 985142 - RNA, 22 nt, Human
cagaagcauuccagcaaauagu

SEQ ID NO: 985143 - RNA, 22 nt, Human
gcugagcugaggcagggcuggg

SEQ ID NO: 985144 - RNA, 22 nt, Human
aggccaaagcucaccugcagcu

SEQ ID NO: 985145 - RNA, 22 nt, Human
acuccuggguugcaguccucaa

SEQ ID NO: 985146 - RNA, 22 nt, Human
ccuugcaggggaacaggcagug

SEQ ID NO: 985147 - RNA, 22 nt, Human
cagggacugagauccagacugu

SEQ ID NO: 985148 - RNA, 17 nt, Human
gcuuccucaugcaguuc

SEQ ID NO: 985149 - RNA, 22 nt, Human
uccuuuuuauaguuagagaaac

SEQ ID NO: 985150 - RNA, 22 nt, Human
gggcagugguuacacagcugag

SEQ ID NO: 985151 - RNA, 21 nt, Human
guuugcaugaacaagucagcc

SEQ ID NO: 985152 - RNA, 23 nt, Human
uuucuguuggguauauauccaag

SEQ ID NO: 985153 - RNA, 22 nt, Human
ugcaccuuguccauuuuuggcc

SEQ ID NO: 985154 - RNA, 22 nt, Human
cagcugaauucuucagacucca

SEQ ID NO: 985155 - RNA, 22 nt, Human
cagggucugaaacugaucacag

SEQ ID NO: 985156 - RNA, 22 nt, Human
uggccacacccaccuagaggag

SEQ ID NO: 985157 - RNA, 22 nt, Human
uggacaggugagugacucaggg

SEQ ID NO: 985158 - RNA, 22 nt, Human
ccauaagguugaaaacuguaca

SEQ ID NO: 985159 - RNA, 22 nt, Human
aagcugccaccagcccagggca

SEQ ID NO: 985160 - RNA, 22 nt, Human
ucagggcauccauugccuguug

SEQ ID NO: 985161 - RNA, 22 nt, Human
gcaucuuucuguccauucagca

SEQ ID NO: 985162 - RNA, 22 nt, Human
uggcuucugggacuugugagca

SEQ ID NO: 985163 - RNA, 22 nt, Human
auaguauuuaauaguuagcuca

SEQ ID NO: 985164 - RNA, 22 nt, Human
ugcaccauuaauuuaugugaga

SEQ ID NO: 985165 - RNA, 22 nt, Human
uugaagauggaucgccacucuc

SEQ ID NO: 985166 - RNA, 22 nt, Human
cucagggacguuagaggacagg

SEQ ID NO: 985167 - RNA, 22 nt, Human
gaaaucugaacaacagcuguca

SEQ ID NO: 985168 - RNA, 22 nt, Human
guguggcuaccucagaggagca

SEQ ID NO: 985169 - RNA, 23 nt, Human
uugugggcagauuccauggggag

SEQ ID NO: 985170 - RNA, 22 nt, Human
gccugagagacccauggggcaa

SEQ ID NO: 985171 - RNA, 22 nt, Human
ugggcucugaagucagucugcu

SEQ ID NO: 985172 - RNA, 22 nt, Human
ccacugaaggucaacauagagc

SEQ ID NO: 985173 - RNA, 22 nt, Human
aagaaauuaaggaaugcaacga

SEQ ID NO: 985174 - RNA, 22 nt, Human
cagcugccagcuucucuccauc

SEQ ID NO: 985175 - RNA, 22 nt, Human
gacaggaggcagagcucaggug

SEQ ID NO: 985176 - RNA, 22 nt, Human
uugugugguagcuucauugaac

SEQ ID NO: 985177 - RNA, 21 nt, Human
ggugggcacaggagagcagag

SEQ ID NO: 985178 - RNA, 22 nt, Human
aauaagaaagagucagcuucag

SEQ ID NO: 985179 - RNA, 22 nt, Human
acagcagcauaaacugacuaag

SEQ ID NO: 985180 - RNA, 23 nt, Human
aucaagauaauccagaugaccua

SEQ ID NO: 985181 - RNA, 22 nt, Human
ucuccugguacccuuccuagca

SEQ ID NO: 985182 - RNA, 22 nt, Human
uucuccgcuaaguucucugcag

SEQ ID NO: 985183 - RNA, 22 nt, Human
uugaagcagcucaggaggcuua

SEQ ID NO: 985184 - RNA, 22 nt, Human
ccaggacuuuaaguccagcacu

SEQ ID NO: 985185 - RNA, 22 nt, Human
agagcucaagacgcucacagua

SEQ ID NO: 985186 - RNA, 22 nt, Human
caggcacuguguuaggcacugu

SEQ ID NO: 985187 - RNA, 22 nt, Human
agaauaaaucaaauguccugag

SEQ ID NO: 985188 - RNA, 18 nt, Human
uugagggaggggcagagu

SEQ ID NO: 985189 - RNA, 22 nt, Human
aagacagaccacgugacagggc

SEQ ID NO: 985190 - RNA, 22 nt, Human
ugugcucuggaguugccuucac

SEQ ID NO: 985191 - RNA, 22 nt, Human
uuuaguagaaauauuugggccu

SEQ ID NO: 985192 - RNA, 22 nt, Human
agugcugucccgacaacugagg

SEQ ID NO: 985193 - RNA, 22 nt, Human
aauucacauguugaaguccuaa

SEQ ID NO: 985194 - RNA, 22 nt, Human
acaaagucaaauugcagccgcc

SEQ ID NO: 985195 - RNA, 22 nt, Human
gcaaaugcucuccuuggucagg

SEQ ID NO: 985196 - RNA, 22 nt, Human
acucugcucccuaagccaugau

SEQ ID NO: 985197 - RNA, 22 nt, Human
acuacuuugggccauuuguuua

SEQ ID NO: 985198 - RNA, 22 nt, Human
acuugauuuugaaccuuucuac

SEQ ID NO: 985199 - RNA, 22 nt, Human
gacucagugauuugacaugccu

SEQ ID NO: 985200 - RNA, 22 nt, Human
ccucccacauugaggacaugcu

SEQ ID NO: 985201 - RNA, 22 nt, Human
agaaaacauuacauaggugugu

SEQ ID NO: 985202 - RNA, 22 nt, Human
cacugcuuaguugguaaaugug

SEQ ID NO: 985203 - RNA, 22 nt, Human
augcacagacccaaaggccauc

SEQ ID NO: 985204 - RNA, 22 nt, Human
ugggaggcagguaggugaugau

SEQ ID NO: 985205 - RNA, 22 nt, Human
gcucugagccgggggccugucc

SEQ ID NO: 985206 - RNA, 22 nt, Human
ugguacuuggaggcagaaaaau

SEQ ID NO: 985207 - RNA, 22 nt, Human
ucuggccaguagauguggguug

SEQ ID NO: 985208 - RNA, 22 nt, Human
uauuucuuucagguauguguug

SEQ ID NO: 985209 - RNA, 22 nt, Human
cuggccaauauagggaaaucuu

SEQ ID NO: 985210 - RNA, 20 nt, Human
cugcucugcuuugcaggugg

SEQ ID NO: 985211 - RNA, 22 nt, Human
uguacaauagcuauuaucucca

SEQ ID NO: 985212 - RNA, 22 nt, Human
gaggcugcggggaggagccugc

SEQ ID NO: 985213 - RNA, 22 nt, Human
aaauacagcagacuccuguugu

SEQ ID NO: 985214 - RNA, 22 nt, Human
cugucccucaucaccucugggu

SEQ ID NO: 985215 - RNA, 22 nt, Human
ugucaccagcugcuccucagga

SEQ ID NO: 985216 - RNA, 22 nt, Human
agucucugcaugccugcugugc

SEQ ID NO: 985217 - RNA, 22 nt, Human
acagggcagaaauguugcaucu

SEQ ID NO: 985218 - RNA, 22 nt, Human
uuagaaauacaagugagguuga

SEQ ID NO: 985219 - RNA, 22 nt, Human
cccagcuccgagcuccgagccg

SEQ ID NO: 985220 - RNA, 22 nt, Human
cuucccacuaguaucacagagc

SEQ ID NO: 985221 - RNA, 22 nt, Human
gcugcagcagaaguucucagag

SEQ ID NO: 985222 - RNA, 22 nt, Human
gcugucacauuuggagcacugg

SEQ ID NO: 985223 - RNA, 22 nt, Human
uucuggagcuaaaguccacucu

SEQ ID NO: 985224 - RNA, 22 nt, Human
guguacauauugagucugcuga

SEQ ID NO: 985225 - RNA, 22 nt, Human
uccuggccgccgcguggggccg

SEQ ID NO: 985226 - RNA, 22 nt, Human
cagagcugggcauggugaaagg

SEQ ID NO: 985227 - RNA, 20 nt, Human
cuguccccgaggucaccagg

SEQ ID NO: 985228 - RNA, 21 nt, Human
acuggccaccacuggcagggg

SEQ ID NO: 985229 - RNA, 22 nt, Human
uccugucugucuuuggucccuu

SEQ ID NO: 985230 - RNA, 22 nt, Human
uggcucagccagcccuaggaac

SEQ ID NO: 985231 - RNA, 22 nt, Human
agagaugaaaaguggagacugg

SEQ ID NO: 985232 - RNA, 22 nt, Human
uggcugcucaagggaggaggcu

SEQ ID NO: 985233 - RNA, 22 nt, Human
caggggcucuaaugcaugauca

SEQ ID NO: 985234 - RNA, 22 nt, Human
ggcugccucuggaagcuggaga

SEQ ID NO: 985235 - RNA, 22 nt, Human
cauugguagaguuuguuuuaua

SEQ ID NO: 985236 - RNA, 22 nt, Human
agagccugucugccuuucuacc

SEQ ID NO: 985237 - RNA, 22 nt, Human
agugaaauggaugcugcuacug

SEQ ID NO: 985238 - RNA, 21 nt, Human
cgggcuggccgggcccucacc

SEQ ID NO: 985239 - RNA, 22 nt, Human
ccucagggccaucucugucccu

SEQ ID NO: 985240 - RNA, 17 nt, Human
auuuccucagggcugag

SEQ ID NO: 985241 - RNA, 22 nt, Human
uaugcauauagaugcacacaca

SEQ ID NO: 985242 - RNA, 22 nt, Human
gugugcagaagacacaagacau

SEQ ID NO: 985243 - RNA, 22 nt, Human
uggccuggggaagaccaugggc

SEQ ID NO: 985244 - RNA, 22 nt, Human
aagagguaaccauagcaaccac

SEQ ID NO: 985245 - RNA, 22 nt, Human
uauuggucuuggaagguuuugu

SEQ ID NO: 985246 - RNA, 22 nt, Human
uggcacaaaucuagucccuggu

SEQ ID NO: 985247 - RNA, 22 nt, Human
ggggcagauggaacagagcaca

SEQ ID NO: 985248 - RNA, 22 nt, Human
gaagcccagggcguggccgggc

SEQ ID NO: 985249 - RNA, 22 nt, Human
cugucaucacaguugagcagcc

SEQ ID NO: 985250 - RNA, 22 nt, Human
gagauuggauuuaauggccaaa

SEQ ID NO: 985251 - RNA, 22 nt, Human
ccugggagguggagguugcagc

SEQ ID NO: 985252 - RNA, 21 nt, Human
cugugcuucuuccuaagccag

SEQ ID NO: 985253 - RNA, 22 nt, Human
augggggccugaacaggcaaaa

SEQ ID NO: 985254 - RNA, 22 nt, Human
cagaaguaagauuacugugaga

SEQ ID NO: 985255 - RNA, 22 nt, Human
gcuuuuucaaaugaaagcuggu

SEQ ID NO: 985256 - RNA, 22 nt, Human
gucaugccagcggagcucggga

SEQ ID NO: 985257 - RNA, 19 nt, Human
acuuucuccaggaccuguu

SEQ ID NO: 985258 - RNA, 22 nt, Human
agcaggugacccaagcaggcug

SEQ ID NO: 985259 - RNA, 21 nt, Human
uccuucaguucugcacuuucu

SEQ ID NO: 985260 - RNA, 22 nt, Human
ucucagagaaaugugucaccau

SEQ ID NO: 985261 - RNA, 22 nt, Human
gcacugcagguggguggagagg

SEQ ID NO: 985262 - RNA, 21 nt, Human
cuggccgaccccucugugcuc

SEQ ID NO: 985263 - RNA, 19 nt, Human
aggucuaaucauaagacaa

SEQ ID NO: 985264 - RNA, 22 nt, Human
uggaggcaucagagugcuuggc

SEQ ID NO: 985265 - RNA, 22 nt, Human
cuggccucauagccaagcugug

SEQ ID NO: 985266 - RNA, 22 nt, Human
uuugcauugccucugacuuaug

SEQ ID NO: 985267 - RNA, 22 nt, Human
aaauuguugaucuacaguaagg

SEQ ID NO: 985268 - RNA, 22 nt, Human
ccugccugcggcccgcggggag

SEQ ID NO: 985269 - RNA, 20 nt, Human
uagauuucauacuucucuuu

SEQ ID NO: 985270 - RNA, 22 nt, Human
ucagcaguguaguuuaucauuc

SEQ ID NO: 985271 - RNA, 22 nt, Human
gcucuguacgcaggaugagggg

SEQ ID NO: 985272 - RNA, 22 nt, Human
ggggcagagaauaaaaaccuaa

SEQ ID NO: 985273 - RNA, 22 nt, Human
caccuggcuggaagugcuccgg

SEQ ID NO: 985274 - RNA, 22 nt, Human
auuuauuaccucggaguuucug

SEQ ID NO: 985275 - RNA, 22 nt, Human
uggauaaacucacuguaaguug

SEQ ID NO: 985276 - RNA, 22 nt, Human
ugucuagggagcugcucaggcu

SEQ ID NO: 985277 - RNA, 22 nt, Human
uggcucagucuggguugacuga

SEQ ID NO: 985278 - RNA, 21 nt, Human
ggagucagggucuggcugggg

SEQ ID NO: 985279 - RNA, 22 nt, Human
gacagcaggagaucaugauaga

SEQ ID NO: 985280 - RNA, 22 nt, Human
ggagccuguggccgucacgacu

SEQ ID NO: 985281 - RNA, 21 nt, Human
cagaggccucaugcucugugc

SEQ ID NO: 985282 - RNA, 22 nt, Human
gagcaggcuugcagagaagggg

SEQ ID NO: 985283 - RNA, 22 nt, Human
gcagggcacagacagugccaag

SEQ ID NO: 985284 - RNA, 22 nt, Human
auuuuuccaugauacuuaucug

SEQ ID NO: 985285 - RNA, 22 nt, Human
uaaaucccuacaucuguguuuu

SEQ ID NO: 985286 - RNA, 22 nt, Human
ucucauguauugcccuggugug

SEQ ID NO: 985287 - RNA, 22 nt, Human
auuuugaaaccaaguuauuucc

SEQ ID NO: 985288 - RNA, 21 nt, Human
agagcugggacuugccugaga

SEQ ID NO: 985289 - RNA, 22 nt, Human
caaguuaucagaaggcacuuuu

SEQ ID NO: 985290 - RNA, 22 nt, Human
gagccagguuugaaucucaguc

SEQ ID NO: 985291 - RNA, 22 nt, Human
gacaugcaacaauuuggcauuu

SEQ ID NO: 985292 - RNA, 22 nt, Human
cagagcaguccuugucaaucag

SEQ ID NO: 985293 - RNA, 22 nt, Human
uuagauaacaguagaauaucaa

SEQ ID NO: 985294 - RNA, 20 nt, Human
uggagcuguaaucuugucug

SEQ ID NO: 985295 - RNA, 22 nt, Human
agggcuggaggguacuaguuua

SEQ ID NO: 985296 - RNA, 22 nt, Human
cuccugcgguacuacugugcuu

SEQ ID NO: 985297 - RNA, 18 nt, Human
uacaugcauaaaugaagc

SEQ ID NO: 985298 - RNA, 22 nt, Human
acagauugaucuugagaauuau

SEQ ID NO: 985299 - RNA, 22 nt, Human
cugagauggaguuucgcucuuc

SEQ ID NO: 985300 - RNA, 19 nt, Human
ucucagagcccuagaggcc

SEQ ID NO: 985301 - RNA, 20 nt, Human
cacguuuuuccacuagcaaa

SEQ ID NO: 985302 - RNA, 22 nt, Human
augauugaaaaugacauugcca

SEQ ID NO: 985303 - RNA, 21 nt, Human
uccagggaacuucucaggaau

SEQ ID NO: 985304 - RNA, 22 nt, Human
auucaguucuaaggucagugcc

SEQ ID NO: 985305 - RNA, 22 nt, Human
auucaagagcccauguuuccug

SEQ ID NO: 985306 - RNA, 18 nt, Human
gguggccuugacuucucu

SEQ ID NO: 985307 - RNA, 23 nt, Human
uggcaccaggcauucuaggggua

SEQ ID NO: 985308 - RNA, 22 nt, Human
aucugguuuggggauccuugug

SEQ ID NO: 985309 - RNA, 22 nt, Human
cuggcagcaguuaugaaacaau

SEQ ID NO: 985310 - RNA, 22 nt, Human
auuuuuccaauuaggauaaaga

SEQ ID NO: 985311 - RNA, 22 nt, Human
cuggagccaugucuugacugcu

SEQ ID NO: 985312 - RNA, 22 nt, Human
caaugugugcuuacaggccagu

SEQ ID NO: 985313 - RNA, 22 nt, Human
uggcagagaaccugggcuuugu

SEQ ID NO: 985314 - RNA, 22 nt, Human
uggaagcacuuggguuuuguug

SEQ ID NO: 985315 - RNA, 22 nt, Human
ccuuucucuuggauaccgauug

SEQ ID NO: 985316 - RNA, 22 nt, Human
aacaaauguguggcaguguggg

SEQ ID NO: 985317 - RNA, 22 nt, Human
cagccuuuuaggacuauuugug

SEQ ID NO: 985318 - RNA, 19 nt, Human
acuuugcaugugugucuaa

SEQ ID NO: 985319 - RNA, 22 nt, Human
ccuggccagcgccggcugcucg

SEQ ID NO: 985320 - RNA, 22 nt, Human
ugcucuucggggccacugcuug

SEQ ID NO: 985321 - RNA, 22 nt, Human
ugggcugcggauaggccucgga

SEQ ID NO: 985322 - RNA, 22 nt, Human
uuucuggcagcgggacaggggu

SEQ ID NO: 985323 - RNA, 22 nt, Human
aaagucauguaaugauaugauu

SEQ ID NO: 985324 - RNA, 22 nt, Human
gcagacauuuugaaucuaggcu

SEQ ID NO: 985325 - RNA, 22 nt, Human
auggacaggcugagcuuccuca

SEQ ID NO: 985326 - RNA, 22 nt, Human
aauguuguuuuucugcaugucu

SEQ ID NO: 985327 - RNA, 19 nt, Human
acacagggcuagaguuaca

SEQ ID NO: 985328 - RNA, 22 nt, Human
acucagaguuugcguuccauac

SEQ ID NO: 985329 - RNA, 22 nt, Human
uaacagaauccuguuauugcca

SEQ ID NO: 985330 - RNA, 22 nt, Human
uccucucagugugguuguggga

SEQ ID NO: 985331 - RNA, 19 nt, Human
cucuggccucuggaugcug

SEQ ID NO: 985332 - RNA, 22 nt, Human
cagggccuccccggcagucuuu

SEQ ID NO: 985333 - RNA, 22 nt, Human
uuuccauauucugcgucugcca

SEQ ID NO: 985334 - RNA, 22 nt, Human
cccaggaggcagagcuugcagu

SEQ ID NO: 985335 - RNA, 22 nt, Human
uuuguaaauagcaguacucaug

SEQ ID NO: 985336 - RNA, 22 nt, Human
gcugaagcccacguggcuugua

SEQ ID NO: 985337 - RNA, 20 nt, Human
ccugaggguuuguguucuuu

SEQ ID NO: 985338 - RNA, 22 nt, Human
auaauuuacaacugcuuuuaau

SEQ ID NO: 985339 - RNA, 22 nt, Human
gagccuggauugucaccgacuu

SEQ ID NO: 985340 - RNA, 22 nt, Human
uacucugccacuaggaguucug

SEQ ID NO: 985341 - RNA, 22 nt, Human
uggccugguuguugcugccguu

SEQ ID NO: 985342 - RNA, 22 nt, Human
accucugcucaagaccccuccg

SEQ ID NO: 985343 - RNA, 22 nt, Human
ugcagcucauugguguccuggu

SEQ ID NO: 985344 - RNA, 22 nt, Human
ucucagagggaaacaugaguga

SEQ ID NO: 985345 - RNA, 22 nt, Human
uugcuuuguggugguucuucca

SEQ ID NO: 985346 - RNA, 22 nt, Human
cuacauuuuucaccgagccucu

SEQ ID NO: 985347 - RNA, 22 nt, Human
uucauuacugcgguagucacac

SEQ ID NO: 985348 - RNA, 22 nt, Human
caggauccccaggucgccgucc

SEQ ID NO: 985349 - RNA, 22 nt, Human
gcagcagaggcccuacucuuug

SEQ ID NO: 985350 - RNA, 22 nt, Human
uauuagguaaaggacuugcagg

SEQ ID NO: 985351 - RNA, 22 nt, Human
gccucucucuacccaguaugau

SEQ ID NO: 985352 - RNA, 22 nt, Human
gaaaccucuuagccucucuuug

SEQ ID NO: 985353 - RNA, 22 nt, Human
aagaacagguucuagaaccauu

SEQ ID NO: 985354 - RNA, 22 nt, Human
uaguccauuuucacacugcuga

SEQ ID NO: 985355 - RNA, 22 nt, Human
cagggacagccuugggguggcg

SEQ ID NO: 985356 - RNA, 22 nt, Human
ugggccuguggcuuggcucuag

SEQ ID NO: 985357 - RNA, 22 nt, Human
gcagcugccccgacugugaguc

SEQ ID NO: 985358 - RNA, 22 nt, Human
gggagggaucugcuaggcaaug

SEQ ID NO: 985359 - RNA, 23 nt, Human
gugagcagcccacuaggaaugcc

SEQ ID NO: 985360 - RNA, 22 nt, Human
caggggcuuuuccucuauaagg

SEQ ID NO: 985361 - RNA, 21 nt, Human
ccugccaggaaacugaguguc

SEQ ID NO: 985362 - RNA, 22 nt, Human
gcuggccaguguggugaccacc

SEQ ID NO: 985363 - RNA, 22 nt, Human
ucauugaagugacugaaagauu

SEQ ID NO: 985364 - RNA, 22 nt, Human
cugugccaggcccagcugacuu

SEQ ID NO: 985365 - RNA, 22 nt, Human
auaaggcagucacuggaauguu

SEQ ID NO: 985366 - RNA, 22 nt, Human
ucaguaacuuacuuauucaccu

SEQ ID NO: 985367 - RNA, 22 nt, Human
gaggacagcuuagggcuuccug

SEQ ID NO: 985368 - RNA, 22 nt, Human
gugggggcaggcagugcuagga

SEQ ID NO: 985369 - RNA, 22 nt, Human
caucagcaggcaacacucuugg

SEQ ID NO: 985370 - RNA, 22 nt, Human
ucuggcucugacacuacuguua

SEQ ID NO: 985371 - RNA, 19 nt, Human
ucccagagucuagagguug

SEQ ID NO: 985372 - RNA, 22 nt, Human
gggccuggugcuucugacuccu

SEQ ID NO: 985373 - RNA, 22 nt, Human
auggccaagcauauacagauug

SEQ ID NO: 985374 - RNA, 22 nt, Human
caguacuugggaaugcugggga

SEQ ID NO: 985375 - RNA, 22 nt, Human
cagcccugagaaggaggaucuc

SEQ ID NO: 985376 - RNA, 22 nt, Human
uccuuugacuucuugcagucca

SEQ ID NO: 985377 - RNA, 22 nt, Human
gcuggccucuacaggccggcca

SEQ ID NO: 985378 - RNA, 20 nt, Human
uugcauuggaugugcaggug

SEQ ID NO: 985379 - RNA, 22 nt, Human
caaauaguuuuucauguauuau

SEQ ID NO: 985380 - RNA, 22 nt, Human
ggacaggguaaguacuagugug

SEQ ID NO: 985381 - RNA, 22 nt, Human
aaguucuacuguggguaaaaug

SEQ ID NO: 985382 - RNA, 22 nt, Human
uuguuucagcuguaugcuaugu

SEQ ID NO: 985383 - RNA, 22 nt, Human
gccucugcugcaagccugguug

SEQ ID NO: 985384 - RNA, 22 nt, Human
ucagagugaccuuacauggucu

SEQ ID NO: 985385 - RNA, 22 nt, Human
ggcaggguggcccuccagugag

SEQ ID NO: 985386 - RNA, 22 nt, Human
uuaaaaugaauauugauuagca

SEQ ID NO: 985387 - RNA, 22 nt, Human
ugcuuaauauugugauguaaua

SEQ ID NO: 985388 - RNA, 22 nt, Human
gaggagcuggcagcgucuccgc

SEQ ID NO: 985389 - RNA, 22 nt, Human
aaauuagucauguuguauuacu

SEQ ID NO: 985390 - RNA, 22 nt, Human
ucugucugcgcuugcccuggug

SEQ ID NO: 985391 - RNA, 22 nt, Human
uuggcagcccagcuuacuagca

SEQ ID NO: 985392 - RNA, 22 nt, Human
aguguccccuacagaggcauuc

SEQ ID NO: 985393 - RNA, 22 nt, Human
cuggccaagcacuggggucaaa

SEQ ID NO: 985394 - RNA, 22 nt, Human
ugucaucucacugauauagaug

SEQ ID NO: 985395 - RNA, 22 nt, Human
uuauuuagucuagaugaauuuu

SEQ ID NO: 985396 - RNA, 22 nt, Human
cuguccuaugaguacucacuag

SEQ ID NO: 985397 - RNA, 21 nt, Human
cagugcucaaucugacagugg

SEQ ID NO: 985398 - RNA, 22 nt, Human
cccucccaagcacucugacaua

SEQ ID NO: 985399 - RNA, 22 nt, Human
ccaagggcugcugaggugucca

SEQ ID NO: 985400 - RNA, 22 nt, Human
auucccaucgucaacuucacug

SEQ ID NO: 985401 - RNA, 22 nt, Human
caggccaggcugcauuugcccc

SEQ ID NO: 985402 - RNA, 22 nt, Human
gggcguggauggucagugcagg

SEQ ID NO: 985403 - RNA, 22 nt, Human
acuccugggugcauuucugauu

SEQ ID NO: 985404 - RNA, 22 nt, Human
ucccagagguugagucacuuau

SEQ ID NO: 985405 - RNA, 22 nt, Human
aacuaaaucuggcauuuagagc

SEQ ID NO: 985406 - RNA, 22 nt, Human
gaagccccaaacccucgccauc

SEQ ID NO: 985407 - RNA, 22 nt, Human
uguaggauguaaggcaggcauc

SEQ ID NO: 985408 - RNA, 22 nt, Human
agcugcccccagggcugugcuu

SEQ ID NO: 985409 - RNA, 22 nt, Human
agcugcaggccucuccugggga

SEQ ID NO: 985410 - RNA, 22 nt, Human
uuuuccucuguauuugaaaugc

SEQ ID NO: 985411 - RNA, 22 nt, Human
auuuggcauaggcagaggccca

SEQ ID NO: 985412 - RNA, 22 nt, Human
gccucugcaccaguacugugcc

SEQ ID NO: 985413 - RNA, 22 nt, Human
uuugacagauccuuaacucagc

SEQ ID NO: 985414 - RNA, 22 nt, Human
aggggugugcauccuggaggau

SEQ ID NO: 985415 - RNA, 22 nt, Human
ucacuuagauggggaucaucac

SEQ ID NO: 985416 - RNA, 22 nt, Human
gcucaggagcucuugguggcgc

SEQ ID NO: 985417 - RNA, 22 nt, Human
ccugacucuggccaggccagcu

SEQ ID NO: 985418 - RNA, 22 nt, Human
gggcucucaugaguguguggua

SEQ ID NO: 985419 - RNA, 19 nt, Human
ccugucugucuucagcuag

SEQ ID NO: 985420 - RNA, 22 nt, Human
acagaauuaaugaaaauuacaa

SEQ ID NO: 985421 - RNA, 22 nt, Human
ucucugcuugguguaugugagu

SEQ ID NO: 985422 - RNA, 22 nt, Human
gcugccuucaguucugauucau

SEQ ID NO: 985423 - RNA, 21 nt, Human
agaggccuuacaggauagacc

SEQ ID NO: 985424 - RNA, 22 nt, Human
agcagggcagugaucagaaagg

SEQ ID NO: 985425 - RNA, 22 nt, Human
ccuggccaaucuagggcuguua

SEQ ID NO: 985426 - RNA, 22 nt, Human
gaagcagcuggugagauggagc

SEQ ID NO: 985427 - RNA, 22 nt, Human
gccugggugaauuugauccuaa

SEQ ID NO: 985428 - RNA, 22 nt, Human
agcucccagaguccucugccca

SEQ ID NO: 985429 - RNA, 22 nt, Human
uggccagguugggcuuugcagc

SEQ ID NO: 985430 - RNA, 22 nt, Human
gagccuggauugaagugggugg

SEQ ID NO: 985431 - RNA, 22 nt, Human
acagaaggcggggacaaggcgg

SEQ ID NO: 985432 - RNA, 22 nt, Human
ggaggcugcugccucacguggg

SEQ ID NO: 985433 - RNA, 22 nt, Human
aauaugaauuauuguuacaagu

SEQ ID NO: 985434 - RNA, 22 nt, Human
ccuggcagguggcgcccucggc

SEQ ID NO: 985435 - RNA, 22 nt, Human
acucugccuuucagcagaugaa

SEQ ID NO: 985436 - RNA, 18 nt, Human
cagaagcaggcagugcag

SEQ ID NO: 985437 - RNA, 22 nt, Human
uauuucugggaguucagaaauu

SEQ ID NO: 985438 - RNA, 19 nt, Human
aggcugcaagguggugggc

SEQ ID NO: 985439 - RNA, 22 nt, Human
ucucugggugauggcagggcac

SEQ ID NO: 985440 - RNA, 21 nt, Human
ucuuggccuaaguucacugaa

SEQ ID NO: 985441 - RNA, 18 nt, Human
agggucagugucacuggc

SEQ ID NO: 985442 - RNA, 22 nt, Human
gugccagcucuccccacaucug

SEQ ID NO: 985443 - RNA, 22 nt, Human
ggcagugaaaaaguauguuucc

SEQ ID NO: 985444 - RNA, 20 nt, Human
acaaaugcauucugugacau

SEQ ID NO: 985445 - RNA, 22 nt, Human
ggagauuuauagcacacuucag

SEQ ID NO: 985446 - RNA, 22 nt, Human
aggugccagaugcacagcugaa

SEQ ID NO: 985447 - RNA, 22 nt, Human
aggcaucugaguuugcaagcuu

SEQ ID NO: 985448 - RNA, 22 nt, Human
uuagucaauagugaauauagag

SEQ ID NO: 985449 - RNA, 22 nt, Human
gagcuggugaucagcuggagga

SEQ ID NO: 985450 - RNA, 22 nt, Human
cagacauauguuuuaacagauu

SEQ ID NO: 985451 - RNA, 22 nt, Human
uaugcacacauuagcacagggu

SEQ ID NO: 985452 - RNA, 22 nt, Human
acauacaucaaguaucacaaga

SEQ ID NO: 985453 - RNA, 23 nt, Human
cuguggcugaguccuguuggagu

SEQ ID NO: 985454 - RNA, 22 nt, Human
uagcagggguagauagagugug

SEQ ID NO: 985455 - RNA, 22 nt, Human
agcagcugguaggaguggccac

SEQ ID NO: 985456 - RNA, 22 nt, Human
ggcccacacugacagcugagcu

SEQ ID NO: 985457 - RNA, 22 nt, Human
cagcccagcagggucuggcccu

SEQ ID NO: 985458 - RNA, 23 nt, Human
cuuuccuuucuuugacacccagc

SEQ ID NO: 985459 - RNA, 22 nt, Human
uccuugacugugaggaacuagc

SEQ ID NO: 985460 - RNA, 22 nt, Human
cagagcaggcccacugcccucc

SEQ ID NO: 985461 - RNA, 20 nt, Human
auguagaugaaagcaaaggc

SEQ ID NO: 985462 - RNA, 22 nt, Human
augaaauguuggucccaaucgc

SEQ ID NO: 985463 - RNA, 19 nt, Human
accaggcuuauggucagug

SEQ ID NO: 985464 - RNA, 22 nt, Human
caccuuuugugucugcguuugu

SEQ ID NO: 985465 - RNA, 22 nt, Human
gcugcagcagcugcaggguugu

SEQ ID NO: 985466 - RNA, 22 nt, Human
uguuaacaucuuggacucguga

SEQ ID NO: 985467 - RNA, 22 nt, Human
augagcugugggauuccagagg

SEQ ID NO: 985468 - RNA, 23 nt, Human
acagcaagaggaccagaugugag

SEQ ID NO: 985469 - RNA, 22 nt, Human
acauuucuuuucaucucuauau

SEQ ID NO: 985470 - RNA, 22 nt, Human
cugggaggcagucucucuagaa

SEQ ID NO: 985471 - RNA, 22 nt, Human
auucugagacaauugccgucag

SEQ ID NO: 985472 - RNA, 22 nt, Human
cuggaagaggaagccagcugga

SEQ ID NO: 985473 - RNA, 22 nt, Human
uauaagaaacaaggcaaauuuu

SEQ ID NO: 985474 - RNA, 22 nt, Human
cagcaguggccaucuguguggu

SEQ ID NO: 985475 - RNA, 21 nt, Human
uuagcaaagcaaacacaugcu

SEQ ID NO: 985476 - RNA, 19 nt, Human
cugaggugcaguaagaggc

SEQ ID NO: 985477 - RNA, 22 nt, Human
ccuggccacucagguguggggc

SEQ ID NO: 985478 - RNA, 22 nt, Human
cuggccaagcuucucuaagcag

SEQ ID NO: 985479 - RNA, 22 nt, Human
ucuccugguuuguuaaauaauu

SEQ ID NO: 985480 - RNA, 22 nt, Human
cauugcacuuuggguccaggac

SEQ ID NO: 985481 - RNA, 22 nt, Human
ucaguuuugauuccugguucuc

SEQ ID NO: 985482 - RNA, 22 nt, Human
ugguuuauuucucugaaagguu

SEQ ID NO: 985483 - RNA, 21 nt, Human
ugcagcagaguaagcagggga

SEQ ID NO: 985484 - RNA, 22 nt, Human
augggaguuuucucugaugcuc

SEQ ID NO: 985485 - RNA, 22 nt, Human
ugcaugcauaaauguacacaca

SEQ ID NO: 985486 - RNA, 22 nt, Human
cuuagaaauuguuacucauuca

SEQ ID NO: 985487 - RNA, 22 nt, Human
ugcccaaguguuuggcugaguc

SEQ ID NO: 985488 - RNA, 23 nt, Human
aggaacugaggccuagggaggua

SEQ ID NO: 985489 - RNA, 22 nt, Human
ucuuucagccacuuaccugucu

SEQ ID NO: 985490 - RNA, 21 nt, Human
agggagcuauuuauaguaagc

SEQ ID NO: 985491 - RNA, 22 nt, Human
ugcucuggguccugggccuccu

SEQ ID NO: 985492 - RNA, 22 nt, Human
uggcuggacagugggcagugga

SEQ ID NO: 985493 - RNA, 22 nt, Human
ugauggcuaucccuggaagggc

SEQ ID NO: 985494 - RNA, 22 nt, Human
uccucaggcggugaggaggggc

SEQ ID NO: 985495 - RNA, 22 nt, Human
uggcagcugauuagauggugcc

SEQ ID NO: 985496 - RNA, 22 nt, Human
acagaaauauucguggugcuug

SEQ ID NO: 985497 - RNA, 21 nt, Human
ugaggcuguuguaccagggag

SEQ ID NO: 985498 - RNA, 22 nt, Human
ugcagcauuauucacaguagcc

SEQ ID NO: 985499 - RNA, 22 nt, Human
agccuggagcuugaguuaugag

SEQ ID NO: 985500 - RNA, 16 nt, Human
gggcugggggauucug

SEQ ID NO: 985501 - RNA, 22 nt, Human
cugcagugaaaucaggaagcaa

SEQ ID NO: 985502 - RNA, 22 nt, Human
uucagagaugacaccugguguu

SEQ ID NO: 985503 - RNA, 22 nt, Human
ugagcuucaaaauaugugaauc

SEQ ID NO: 985504 - RNA, 22 nt, Human
aagucacagcuaaauagcuaag

SEQ ID NO: 985505 - RNA, 22 nt, Human
cucuggagguggagguugcagu

SEQ ID NO: 985506 - RNA, 22 nt, Human
uggucaaauuuagucucuggaa

SEQ ID NO: 985507 - RNA, 22 nt, Human
aaagaacagauguguggugcau

SEQ ID NO: 985508 - RNA, 22 nt, Human
aucaguuuggaacauucaggcc

SEQ ID NO: 985509 - RNA, 22 nt, Human
cagucccaguuugagacucugg

SEQ ID NO: 985510 - RNA, 22 nt, Human
caggcccugggcaggaucagcc

SEQ ID NO: 985511 - RNA, 22 nt, Human
cagugggcugugauggauucac

SEQ ID NO: 985512 - RNA, 22 nt, Human
uggcucuguuuuaugaguacca

SEQ ID NO: 985513 - RNA, 22 nt, Human
agugcacagcgugauguauugg

SEQ ID NO: 985514 - RNA, 22 nt, Human
gcugggagcccuggucugcucc

SEQ ID NO: 985515 - RNA, 21 nt, Human
uucagcaagcacucuggacac

SEQ ID NO: 985516 - RNA, 22 nt, Human
ucagccucucugaguccagacc

SEQ ID NO: 985517 - RNA, 22 nt, Human
gcagagccccauugcuggcggg

SEQ ID NO: 985518 - RNA, 22 nt, Human
auguacacaugcaugcaugugc

SEQ ID NO: 985519 - RNA, 22 nt, Human
ccucugaguccucccugguugc

SEQ ID NO: 985520 - RNA, 22 nt, Human
uagaaacaucagcuaaccaaaa

SEQ ID NO: 985521 - RNA, 22 nt, Human
cugcucucuguuccccuggauc

SEQ ID NO: 985522 - RNA, 20 nt, Human
agugcaagaaagcacagcug

SEQ ID NO: 985523 - RNA, 22 nt, Human
agguacaguagacagacaguua

SEQ ID NO: 985524 - RNA, 22 nt, Human
cugagauggccacugggucuca

SEQ ID NO: 985525 - RNA, 22 nt, Human
agggucugacaaugugacuuag

SEQ ID NO: 985526 - RNA, 22 nt, Human
aaguucaagaucaagguuccag

SEQ ID NO: 985527 - RNA, 22 nt, Human
gcagauggacuguaugaccuga

SEQ ID NO: 985528 - RNA, 22 nt, Human
gcagccagaagacucagaacaa

SEQ ID NO: 985529 - RNA, 22 nt, Human
ccugagccugaguggugcaggg

SEQ ID NO: 985530 - RNA, 22 nt, Human
ccagggcugcugugggacucca

SEQ ID NO: 985531 - RNA, 22 nt, Human
cuccugggagucuuccuggaug

SEQ ID NO: 985532 - RNA, 22 nt, Human
agcaguggcuggauggugugcu

SEQ ID NO: 985533 - RNA, 22 nt, Human
uggcugaaggaagauucuucua

SEQ ID NO: 985534 - RNA, 22 nt, Human
ccucugggugggaggccgggcg

SEQ ID NO: 985535 - RNA, 22 nt, Human
cuggcucccguuguccuugaag

SEQ ID NO: 985536 - RNA, 22 nt, Human
guuguauagagggcaugaaucu

SEQ ID NO: 985537 - RNA, 22 nt, Human
ggcugcucuucuuggcgaccuc

SEQ ID NO: 985538 - RNA, 22 nt, Human
uggagccugagucagcggaggc

SEQ ID NO: 985539 - RNA, 22 nt, Human
uagcacauaacuuagaauaguu

SEQ ID NO: 985540 - RNA, 22 nt, Human
ggcagcauuuagagcacagugu

SEQ ID NO: 985541 - RNA, 22 nt, Human
uauaacacucagaaagaaucau

SEQ ID NO: 985542 - RNA, 22 nt, Human
cccugccucugaagcugcucag

SEQ ID NO: 985543 - RNA, 22 nt, Human
gaagcagcaaguauaggacagg

SEQ ID NO: 985544 - RNA, 22 nt, Human
ucaaaugcggucauggcuuuua

SEQ ID NO: 985545 - RNA, 22 nt, Human
guacaaaguggaccugauagua

SEQ ID NO: 985546 - RNA, 22 nt, Human
acuuccugcaaucguccacucc

SEQ ID NO: 985547 - RNA, 22 nt, Human
aggcuucccagcugagcucagc

SEQ ID NO: 985548 - RNA, 20 nt, Human
ucucaggguucagcaaagua

SEQ ID NO: 985549 - RNA, 19 nt, Human
cuggugcuugagugaguca

SEQ ID NO: 985550 - RNA, 22 nt, Human
ucaggggcccuucccucagcag

SEQ ID NO: 985551 - RNA, 22 nt, Human
auuuacagaugaugcuauuuga

SEQ ID NO: 985552 - RNA, 22 nt, Human
uggcucuguuuguuaacuagac

SEQ ID NO: 985553 - RNA, 22 nt, Human
uaagauaauaaguaugucuaug

SEQ ID NO: 985554 - RNA, 22 nt, Human
cagcccuguccagcagagggug

SEQ ID NO: 985555 - RNA, 22 nt, Human
cagcugccaugacauguccugc

SEQ ID NO: 985556 - RNA, 22 nt, Human
uaacagaagaaaacauauugga

SEQ ID NO: 985557 - RNA, 22 nt, Human
guuugaaaaaagcaguauguaa

SEQ ID NO: 985558 - RNA, 22 nt, Human
gggaggucagggugccugcugg

SEQ ID NO: 985559 - RNA, 22 nt, Human
gcucccugcagcugagaguucc

SEQ ID NO: 985560 - RNA, 22 nt, Human
caguauuuauggcuugaguauu

SEQ ID NO: 985561 - RNA, 19 nt, Human
ugaagcaauaccauuuuug

SEQ ID NO: 985562 - RNA, 22 nt, Human
uugcauguagaauacucaacuu

SEQ ID NO: 985563 - RNA, 22 nt, Human
uaaccuuuguucaauguaagau

SEQ ID NO: 985564 - RNA, 22 nt, Human
gaaaguuuauagguuauauaau

SEQ ID NO: 985565 - RNA, 22 nt, Human
agggcagagagaugaaugggau

SEQ ID NO: 985566 - RNA, 22 nt, Human
cacagcugccauggcugcacuu

SEQ ID NO: 985567 - RNA, 22 nt, Human
ccagcagcagcguccaaggaga

SEQ ID NO: 985568 - RNA, 22 nt, Human
uccuggcccuguggccugcagu

SEQ ID NO: 985569 - RNA, 22 nt, Human
ugaggaugacgauggcaauggc

SEQ ID NO: 985570 - RNA, 22 nt, Human
guuuauuauacaacaaaagcua

SEQ ID NO: 985571 - RNA, 22 nt, Human
aaaugcacagaaaggaugugga

SEQ ID NO: 985572 - RNA, 22 nt, Human
ggaggcccagagaggugaagug

SEQ ID NO: 985573 - RNA, 22 nt, Human
cagcugccccauaaaucacagu

SEQ ID NO: 985574 - RNA, 22 nt, Human
augggcugugagguccggcagg

SEQ ID NO: 985575 - RNA, 22 nt, Human
ccugggagugugccaucucugu

SEQ ID NO: 985576 - RNA, 22 nt, Human
cagugcagaacacauggaaaau

SEQ ID NO: 985577 - RNA, 22 nt, Human
cugaggcugcccagggccaggu

SEQ ID NO: 985578 - RNA, 22 nt, Human
ccagcagcucccucaggguccg

SEQ ID NO: 985579 - RNA, 22 nt, Human
gccccagcucugccacaacuag

SEQ ID NO: 985580 - RNA, 22 nt, Human
gcaaggcuuugugaauuuuaaa

SEQ ID NO: 985581 - RNA, 22 nt, Human
agccaggggauucaucagggac

SEQ ID NO: 985582 - RNA, 22 nt, Human
gcagaggcuccauuuuacagau

SEQ ID NO: 985583 - RNA, 22 nt, Human
ucaaguguaguggugucagguc

SEQ ID NO: 985584 - RNA, 22 nt, Human
uggcacugaccccaggccugug

SEQ ID NO: 985585 - RNA, 22 nt, Human
ccugggcauaaaucacuccaag

SEQ ID NO: 985586 - RNA, 22 nt, Human
cagaggcugggaccucaggcau

SEQ ID NO: 985587 - RNA, 22 nt, Human
ucaccacugaacagaccuuugg

SEQ ID NO: 985588 - RNA, 22 nt, Human
ugcagcagcagggaggaggcuc

SEQ ID NO: 985589 - RNA, 19 nt, Human
cagaguacaccagauagga

SEQ ID NO: 985590 - RNA, 22 nt, Human
aaguuuguuguacauguuagua

SEQ ID NO: 985591 - RNA, 22 nt, Human
uugcauugaaugcacauuuuua

SEQ ID NO: 985592 - RNA, 22 nt, Human
agcuggccuuagugagcaccug

SEQ ID NO: 985593 - RNA, 22 nt, Human
agcuggccuccgggugccuggg

SEQ ID NO: 985594 - RNA, 20 nt, Human
ccuccuggucaggugugcag

SEQ ID NO: 985595 - RNA, 22 nt, Human
uuuuuaagcuccuuugauguca

SEQ ID NO: 985596 - RNA, 22 nt, Human
caggugcccagcuccugcugug

SEQ ID NO: 985597 - RNA, 22 nt, Human
ugugaaagauacuaggcagagg

SEQ ID NO: 985598 - RNA, 22 nt, Human
aggcccuguuaugagccacugu

SEQ ID NO: 985599 - RNA, 22 nt, Human
ccacagggugucaucagcuuga

SEQ ID NO: 985600 - RNA, 22 nt, Human
aaggccauuauucugauauauu

SEQ ID NO: 985601 - RNA, 22 nt, Human
ucagagucauugcaaguagaag

SEQ ID NO: 985602 - RNA, 19 nt, Human
ucagaggauuuggcuauga

SEQ ID NO: 985603 - RNA, 22 nt, Human
ggggcagaguagcuggggugug

SEQ ID NO: 985604 - RNA, 22 nt, Human
gagaagccgagucagcugagcc

SEQ ID NO: 985605 - RNA, 22 nt, Human
uggcucagaguucaucuuuuag

SEQ ID NO: 985606 - RNA, 22 nt, Human
ucuuuccuuagaauaauucuuu

SEQ ID NO: 985607 - RNA, 23 nt, Human
uacuuaggaauggggacggcaag

SEQ ID NO: 985608 - RNA, 22 nt, Human
caauaaguaauaggcaucuaau

SEQ ID NO: 985609 - RNA, 22 nt, Human
uacaaaguuugggguccucaaa

SEQ ID NO: 985610 - RNA, 22 nt, Human
guguacaugagaaaucaacuuu

SEQ ID NO: 985611 - RNA, 22 nt, Human
gaggagguuccggguggagaag

SEQ ID NO: 985612 - RNA, 22 nt, Human
uggcagaguucgcuccuauuca

SEQ ID NO: 985613 - RNA, 22 nt, Human
uggaaagaugaagauguuuaag

SEQ ID NO: 985614 - RNA, 22 nt, Human
gccuggaggggccaggguggua

SEQ ID NO: 985615 - RNA, 22 nt, Human
agagccaggaucuguuuugggg

SEQ ID NO: 985616 - RNA, 22 nt, Human
cugagcugggacucaguagcaa

SEQ ID NO: 985617 - RNA, 22 nt, Human
uccucagacacccugcuggcuu

SEQ ID NO: 985618 - RNA, 22 nt, Human
ucugccagaaguucugagagua

SEQ ID NO: 985619 - RNA, 22 nt, Human
gaagagcuauguccagggagca

SEQ ID NO: 985620 - RNA, 22 nt, Human
acauuucuuccuaauuaucccu

SEQ ID NO: 985621 - RNA, 22 nt, Human
auaguggugagcugcauuuaug

SEQ ID NO: 985622 - RNA, 18 nt, Human
acaggccucaguccugca

SEQ ID NO: 985623 - RNA, 22 nt, Human
ucacacguccuugcuacuccuc

SEQ ID NO: 985624 - RNA, 22 nt, Human
ucaguuuuuaagaguuaugcga

SEQ ID NO: 985625 - RNA, 22 nt, Human
gccuucugauugcuggacugac

SEQ ID NO: 985626 - RNA, 22 nt, Human
agcaggagagcagugcgugguc

SEQ ID NO: 985627 - RNA, 22 nt, Human
guaucuuuugguggaaaaauaa

SEQ ID NO: 985628 - RNA, 23 nt, Human
uccuucagagccucccuccaagc

SEQ ID NO: 985629 - RNA, 22 nt, Human
cauguuuucuaggcuuucacaa

SEQ ID NO: 985630 - RNA, 22 nt, Human
uuauuuauuguguaccuacugu

SEQ ID NO: 985631 - RNA, 22 nt, Human
aaauuuaagaagugugugcgug

SEQ ID NO: 985632 - RNA, 22 nt, Human
aaugccuuggagagccuagagg

SEQ ID NO: 985633 - RNA, 22 nt, Human
acagugaaugcccaagaaaagu

SEQ ID NO: 985634 - RNA, 22 nt, Human
ucaccagucuuucuuaccauug

SEQ ID NO: 985635 - RNA, 22 nt, Human
uccagccuuucuacucacugag

SEQ ID NO: 985636 - RNA, 22 nt, Human
gagccuggggacccuccugagu

SEQ ID NO: 985637 - RNA, 22 nt, Human
uccuggaggcaaaugagcacau

SEQ ID NO: 985638 - RNA, 22 nt, Human
ggccaaaccgcaauuauuuuug

SEQ ID NO: 985639 - RNA, 22 nt, Human
ggccuguccagccugccuggcu

SEQ ID NO: 985640 - RNA, 22 nt, Human
accugccuucucaaggacauga

SEQ ID NO: 985641 - RNA, 22 nt, Human
gcucugcuguguuuguucagca

SEQ ID NO: 985642 - RNA, 23 nt, Human
uuuuaauuuggacauaagaagau

SEQ ID NO: 985643 - RNA, 22 nt, Human
ccucauggaccucagacugucc

SEQ ID NO: 985644 - RNA, 22 nt, Human
gaaaauguuuguccggagcuga

SEQ ID NO: 985645 - RNA, 20 nt, Human
gggcuggcgcauggggaaag

SEQ ID NO: 985646 - RNA, 22 nt, Human
caugcuccaaaaacaagagaau

SEQ ID NO: 985647 - RNA, 22 nt, Human
guacauuuugagguuaaaacaa

SEQ ID NO: 985648 - RNA, 22 nt, Human
uaugcacauuaucuaauccauu

SEQ ID NO: 985649 - RNA, 22 nt, Human
agguacagcaauauaagagguc

SEQ ID NO: 985650 - RNA, 20 nt, Human
aggcucagagcaguaguaca

SEQ ID NO: 985651 - RNA, 22 nt, Human
ugagcuucuuuauuuggccaga

SEQ ID NO: 985652 - RNA, 22 nt, Human
aaacaugagcacuugcuucaua

SEQ ID NO: 985653 - RNA, 21 nt, Human
ccuggcugcacaguugcuggu

SEQ ID NO: 985654 - RNA, 22 nt, Human
cccagagcugagucugauauau

SEQ ID NO: 985655 - RNA, 22 nt, Human
cuggcucaugugaugagggcaa

SEQ ID NO: 985656 - RNA, 22 nt, Human
cacuacuugaaagaauuacaga

SEQ ID NO: 985657 - RNA, 19 nt, Human
ugcaggaggacugagcaga

SEQ ID NO: 985658 - RNA, 22 nt, Human
gcagcuggcccugacacgcaga

SEQ ID NO: 985659 - RNA, 22 nt, Human
ccuggcugaaccaaugaagugg

SEQ ID NO: 985660 - RNA, 22 nt, Human
uccagggaagagcagaggcuac

SEQ ID NO: 985661 - RNA, 22 nt, Human
ugacccugcuucuuggugcagg

SEQ ID NO: 985662 - RNA, 22 nt, Human
agcucccagagcucgagaguaa

SEQ ID NO: 985663 - RNA, 22 nt, Human
aagugccaucauagcauggcug

SEQ ID NO: 985664 - RNA, 22 nt, Human
acacagggauauuucagguggu

SEQ ID NO: 985665 - RNA, 17 nt, Human
acaagcaguggccaugg

SEQ ID NO: 985666 - RNA, 22 nt, Human
uuuuccucugcaauaaaagcag

SEQ ID NO: 985667 - RNA, 22 nt, Human
gggcuucucccuaaggacucug

SEQ ID NO: 985668 - RNA, 22 nt, Human
cccaagggagugccuggucaac

SEQ ID NO: 985669 - RNA, 22 nt, Human
agccccucuguggcucugccuc

SEQ ID NO: 985670 - RNA, 19 nt, Human
ugagagugaggaaggcuuc

SEQ ID NO: 985671 - RNA, 22 nt, Human
aggcaggcucaggcccaugcuu

SEQ ID NO: 985672 - RNA, 22 nt, Human
ggcugggcucgcugauuggcug

SEQ ID NO: 985673 - RNA, 22 nt, Human
ugcaggugguuuggacacugcu

SEQ ID NO: 985674 - RNA, 22 nt, Human
agagccugggaauuugcauguu

SEQ ID NO: 985675 - RNA, 20 nt, Human
ucugccacuuuuucugucac

SEQ ID NO: 985676 - RNA, 22 nt, Human
ucagaguggugguuuugccuuc

SEQ ID NO: 985677 - RNA, 22 nt, Human
gcugcaggagcuggagcugugg

SEQ ID NO: 985678 - RNA, 22 nt, Human
ucccagagaagagcuggaugga

SEQ ID NO: 985679 - RNA, 22 nt, Human
cugccugggccggccacccucu

SEQ ID NO: 985680 - RNA, 22 nt, Human
gcugcaggcauuuuccugggca

SEQ ID NO: 985681 - RNA, 22 nt, Human
aaaaccaggcguuuccuauuau

SEQ ID NO: 985682 - RNA, 23 nt, Human
agacccagagacuggcucugcuc

SEQ ID NO: 985683 - RNA, 22 nt, Human
cagcuucccuuggcugagcaga

SEQ ID NO: 985684 - RNA, 22 nt, Human
gcuggagcugcagccugggccu

SEQ ID NO: 985685 - RNA, 22 nt, Human
ggagccugacagugcccagcau

SEQ ID NO: 985686 - RNA, 22 nt, Human
gagcacagcuggagguagcauu

SEQ ID NO: 985687 - RNA, 22 nt, Human
ugugaagcuggauccuggagcu

SEQ ID NO: 985688 - RNA, 22 nt, Human
ccaggagcauuaagagaacaua

SEQ ID NO: 985689 - RNA, 22 nt, Human
ucaggcugguggucagauggcu

SEQ ID NO: 985690 - RNA, 21 nt, Human
uagagaaaagaagcuguuccu

SEQ ID NO: 985691 - RNA, 22 nt, Human
acacucuguaaugucacacucc

SEQ ID NO: 985692 - RNA, 22 nt, Human
auaacagagagcuacugaacug

SEQ ID NO: 985693 - RNA, 22 nt, Human
aaugcuguauaucuuagcuaau

SEQ ID NO: 985694 - RNA, 22 nt, Human
augcucugggcaggagcccugg

SEQ ID NO: 985695 - RNA, 22 nt, Human
uucagcaagaccaccauguacc

SEQ ID NO: 985696 - RNA, 22 nt, Human
cagagcugacccaaggauugaa

SEQ ID NO: 985697 - RNA, 22 nt, Human
agagcuguagcuuccuagagcc

SEQ ID NO: 985698 - RNA, 22 nt, Human
ccagggccucguguucugagug

SEQ ID NO: 985699 - RNA, 22 nt, Human
uuugaacaagagcuucacauua

SEQ ID NO: 985700 - RNA, 22 nt, Human
gcucucugggugugucuagaua

SEQ ID NO: 985701 - RNA, 22 nt, Human
uuuuauauugagugagaguucc

SEQ ID NO: 985702 - RNA, 22 nt, Human
ccugccagugaagcugacgggc

SEQ ID NO: 985703 - RNA, 22 nt, Human
cugggcuguaauguggcacuga

SEQ ID NO: 985704 - RNA, 22 nt, Human
ugugcagggaagggcaugcuau

SEQ ID NO: 985705 - RNA, 19 nt, Human
ugagaggcuuaaggcagcu

SEQ ID NO: 985706 - RNA, 22 nt, Human
ugguggccuugauggcaucugc

SEQ ID NO: 985707 - RNA, 22 nt, Human
aggagcccugcgggaggcagag

SEQ ID NO: 985708 - RNA, 22 nt, Human
gagccagcugagcugcacuguc

SEQ ID NO: 985709 - RNA, 18 nt, Human
gucauugcaacauacugu

SEQ ID NO: 985710 - RNA, 22 nt, Human
gaaaucugcuucuugcauagua

SEQ ID NO: 985711 - RNA, 22 nt, Human
ccaaggaguagagcaggaagcu

SEQ ID NO: 985712 - RNA, 22 nt, Human
cacuccuguuccacuaaaugag

SEQ ID NO: 985713 - RNA, 22 nt, Human
auucugucuuuuuaaaauaaua

SEQ ID NO: 985714 - RNA, 22 nt, Human
ccuggagcuuggucacgcugcg

SEQ ID NO: 985715 - RNA, 20 nt, Human
cccuggagagaagcuccacg

SEQ ID NO: 985716 - RNA, 22 nt, Human
ccaaaguccuuucuccaccugc

SEQ ID NO: 985717 - RNA, 22 nt, Human
gcugagucuugagcacugagca

SEQ ID NO: 985718 - RNA, 22 nt, Human
acugaaggcuuaacucuuucau

SEQ ID NO: 985719 - RNA, 22 nt, Human
uguccacaucacucacuuguca

SEQ ID NO: 985720 - RNA, 20 nt, Human
aaucagaaagugugagcucu

SEQ ID NO: 985721 - RNA, 22 nt, Human
agguggagaagagaugggcagu

SEQ ID NO: 985722 - RNA, 22 nt, Human
ggccagagaauaugccuuacgu

SEQ ID NO: 985723 - RNA, 22 nt, Human
cucugcugcccaggccugcuag

SEQ ID NO: 985724 - RNA, 23 nt, Human
aggcugcagaagaauagggucau

SEQ ID NO: 985725 - RNA, 22 nt, Human
ugggauaguggccaggaccccc

SEQ ID NO: 985726 - RNA, 22 nt, Human
acuauacauugaauguuaaggu

SEQ ID NO: 985727 - RNA, 22 nt, Human
ggcugcuugcuguuucuuggau

SEQ ID NO: 985728 - RNA, 22 nt, Human
uaagacauuugaaaugugaucc

SEQ ID NO: 985729 - RNA, 22 nt, Human
gcccagcacagcuggaagaguc

SEQ ID NO: 985730 - RNA, 20 nt, Human
cccugagaccagagagcagc

SEQ ID NO: 985731 - RNA, 22 nt, Human
uguggccaccagagcugcuauu

SEQ ID NO: 985732 - RNA, 22 nt, Human
guuggccugaauggucaagagg

SEQ ID NO: 985733 - RNA, 22 nt, Human
ugccaggcuaaguggaggacuu

SEQ ID NO: 985734 - RNA, 21 nt, Human
agcugcuccagggagcucagg

SEQ ID NO: 985735 - RNA, 22 nt, Human
gggcuguggagccgcgagggcu

SEQ ID NO: 985736 - RNA, 22 nt, Human
cggccaaauugcagagagaagc

SEQ ID NO: 985737 - RNA, 22 nt, Human
caggccucuccuuagucuggca

SEQ ID NO: 985738 - RNA, 22 nt, Human
gcaggggcugcugggaacucgg

SEQ ID NO: 985739 - RNA, 22 nt, Human
ggcagugacuguucagacgucc

SEQ ID NO: 985740 - RNA, 22 nt, Human
cagaagccugccucagaugcac

SEQ ID NO: 985741 - RNA, 22 nt, Human
gcucucugaggugcuggcagag

SEQ ID NO: 985742 - RNA, 22 nt, Human
agccccugggaguagcugcugc

SEQ ID NO: 985743 - RNA, 22 nt, Human
uauugaggauugaggaaagcac

SEQ ID NO: 985744 - RNA, 22 nt, Human
ugcacacaaaugugaacgugcc

SEQ ID NO: 985745 - RNA, 22 nt, Human
ucaggcacugcuuucugauaug

SEQ ID NO: 985746 - RNA, 23 nt, Human
uggagcugacagucagagggagg

SEQ ID NO: 985747 - RNA, 22 nt, Human
ugcugaaaacucaaccauugug

SEQ ID NO: 985748 - RNA, 22 nt, Human
acaguguuuuaugagaauuguu

SEQ ID NO: 985749 - RNA, 22 nt, Human
aagcagccucauuugugguaag

SEQ ID NO: 985750 - RNA, 22 nt, Human
gcacuaaaccaacauguaauaa

SEQ ID NO: 985751 - RNA, 22 nt, Human
acuuccuggcguagcugacauu

SEQ ID NO: 985752 - RNA, 22 nt, Human
ggauuugggcuugcagcagagc

SEQ ID NO: 985753 - RNA, 22 nt, Human
uguaagauauucagcuuauuga

SEQ ID NO: 985754 - RNA, 22 nt, Human
cggggcuguagcacagcugagc

SEQ ID NO: 985755 - RNA, 21 nt, Human
ccccugggagcccugucagua

SEQ ID NO: 985756 - RNA, 22 nt, Human
uccugggcugugugccacucug

SEQ ID NO: 985757 - RNA, 22 nt, Human
aaauaacuuaugaucgucuggc

SEQ ID NO: 985758 - RNA, 22 nt, Human
augcacuaugaugagcuagucu

SEQ ID NO: 985759 - RNA, 22 nt, Human
uaaauguguuagucaugguuuu

SEQ ID NO: 985760 - RNA, 22 nt, Human
ccuggcuguggcggugcucuca

SEQ ID NO: 985761 - RNA, 22 nt, Human
aggccucacucucagagcuucu

SEQ ID NO: 985762 - RNA, 20 nt, Human
gggcaguggcgcuaucucag

SEQ ID NO: 985763 - RNA, 22 nt, Human
uuuaggaucaaugagaaagucu

SEQ ID NO: 985764 - RNA, 22 nt, Human
cccucugaccuccugccacagu

SEQ ID NO: 985765 - RNA, 22 nt, Human
agagcccucucauuggcuuauu

SEQ ID NO: 985766 - RNA, 22 nt, Human
uggcaguguauagguggcuccu

SEQ ID NO: 985767 - RNA, 22 nt, Human
cggggacacacuggcagcuccu

SEQ ID NO: 985768 - RNA, 22 nt, Human
gggagcaggagccugccugcca

SEQ ID NO: 985769 - RNA, 22 nt, Human
gccagguggucuggcuccagag

SEQ ID NO: 985770 - RNA, 22 nt, Human
uuucacauaaauauuaugccua

SEQ ID NO: 985771 - RNA, 22 nt, Human
agggaggagaauggacuccuuc

SEQ ID NO: 985772 - RNA, 17 nt, Human
uagcugccccgaaugcu

SEQ ID NO: 985773 - RNA, 22 nt, Human
cccucugccucugaguaggaca

SEQ ID NO: 985774 - RNA, 22 nt, Human
ucugggcugggagcguguggac

SEQ ID NO: 985775 - RNA, 22 nt, Human
gcagggugaaggucacauagaa

SEQ ID NO: 985776 - RNA, 22 nt, Human
acugugcaugaaccgaaacaaa

SEQ ID NO: 985777 - RNA, 21 nt, Human
gaugaagcaaucuuucuguug

SEQ ID NO: 985778 - RNA, 22 nt, Human
gccugcuguuaacugcaggaau

SEQ ID NO: 985779 - RNA, 22 nt, Human
ucagggacuuacaaaccagaag

SEQ ID NO: 985780 - RNA, 22 nt, Human
gacacuaaaguauaggguaucu

SEQ ID NO: 985781 - RNA, 22 nt, Human
gcacagguugcaaaaguucaca

SEQ ID NO: 985782 - RNA, 22 nt, Human
acauuucuuucuauucaguagc

SEQ ID NO: 985783 - RNA, 22 nt, Human
gaagcagcgaaguggaagggac

SEQ ID NO: 985784 - RNA, 22 nt, Human
cucaaguaagaaacagaauugg

SEQ ID NO: 985785 - RNA, 22 nt, Human
uggccugccccgagauccuggc

SEQ ID NO: 985786 - RNA, 22 nt, Human
cugccucuguugggcauggucu

SEQ ID NO: 985787 - RNA, 22 nt, Human
acucucucacagcuuggcugau

SEQ ID NO: 985788 - RNA, 22 nt, Human
ccagcuggugacauccccaacc

SEQ ID NO: 985789 - RNA, 18 nt, Human
uguuaggaagggcacaca

SEQ ID NO: 985790 - RNA, 22 nt, Human
uuaaguaagaccuuaugucuug

SEQ ID NO: 985791 - RNA, 22 nt, Human
ggcugggcaaacaagacucuuc

SEQ ID NO: 985792 - RNA, 22 nt, Human
cucaggagacaguguccacaug

SEQ ID NO: 985793 - RNA, 22 nt, Human
aagagcuggcucuugcagcagc

SEQ ID NO: 985794 - RNA, 22 nt, Human
ggcccugugguuuugcaaaguc

SEQ ID NO: 985795 - RNA, 22 nt, Human
aucuacaggauuuuacagaguu

SEQ ID NO: 985796 - RNA, 22 nt, Human
cuccugggcucaagugauccuc

SEQ ID NO: 985797 - RNA, 22 nt, Human
acagaauugaaaguauaaucug

SEQ ID NO: 985798 - RNA, 22 nt, Human
ggcucuggugaggguaggagau

SEQ ID NO: 985799 - RNA, 22 nt, Human
uuuuaaucaugcuucuaugucc

SEQ ID NO: 985800 - RNA, 22 nt, Human
ccuuuucuaaucuuaagaaugu

SEQ ID NO: 985801 - RNA, 22 nt, Human
gacagaggcaagaccagaagcc

SEQ ID NO: 985802 - RNA, 22 nt, Human
acugcuuuucagagucugccug

SEQ ID NO: 985803 - RNA, 22 nt, Human
caggagugaaaugaggcccagg

SEQ ID NO: 985804 - RNA, 22 nt, Human
gaggaggaaacccuguuccucu

SEQ ID NO: 985805 - RNA, 21 nt, Human
ccugugugucugacugggcua

SEQ ID NO: 985806 - RNA, 22 nt, Human
uauuauguagaguaaggguuaa

SEQ ID NO: 985807 - RNA, 22 nt, Human
cccagcauuucugggcugcacu

SEQ ID NO: 985808 - RNA, 22 nt, Human
acuggccaggagcuggaaauac

SEQ ID NO: 985809 - RNA, 22 nt, Human
agcagcugaccagugaguccug

SEQ ID NO: 985810 - RNA, 22 nt, Human
gggcagcucuggcugugggaag

SEQ ID NO: 985811 - RNA, 22 nt, Human
agccacaccuguccugccagcu

SEQ ID NO: 985812 - RNA, 22 nt, Human
cuuguggcccauggcuuccugc

SEQ ID NO: 985813 - RNA, 22 nt, Human
ggcugggcuccgggagcaugcg

SEQ ID NO: 985814 - RNA, 22 nt, Human
ucuccuggcucuaaaaggcugu

SEQ ID NO: 985815 - RNA, 17 nt, Human
agccccucagcgucacc

SEQ ID NO: 985816 - RNA, 22 nt, Human
gcaucuucacacaaagccagug

SEQ ID NO: 985817 - RNA, 22 nt, Human
aaaagguuuugaguacaaauau

SEQ ID NO: 985818 - RNA, 22 nt, Human
cucagaguucuccugggaggug

SEQ ID NO: 985819 - RNA, 22 nt, Human
cugggcagugcagcuauagaac

SEQ ID NO: 985820 - RNA, 22 nt, Human
agggcagaggcggacacggaag

SEQ ID NO: 985821 - RNA, 22 nt, Human
cuggcgcaacagaaaaucugga

SEQ ID NO: 985822 - RNA, 22 nt, Human
ccugucucuuucaaucugagag

SEQ ID NO: 985823 - RNA, 22 nt, Human
ucaaauacauggucaaucaacu

SEQ ID NO: 985824 - RNA, 22 nt, Human
gagucaguaauggauaugucau

SEQ ID NO: 985825 - RNA, 22 nt, Human
agagugauggguugugcugacc

SEQ ID NO: 985826 - RNA, 21 nt, Human
aucagcaaaugccugucuccc

SEQ ID NO: 985827 - RNA, 22 nt, Human
gccagccuucuguggccugcaa

SEQ ID NO: 985828 - RNA, 22 nt, Human
accccagcccugcuucugggag

SEQ ID NO: 985829 - RNA, 22 nt, Human
cagagcugauuggauccagaga

SEQ ID NO: 985830 - RNA, 22 nt, Human
uagacacauccguggaagcuuc

SEQ ID NO: 985831 - RNA, 22 nt, Human
ucaaagucucugcuucuguaac

SEQ ID NO: 985832 - RNA, 22 nt, Human
uggcuuccuccagagcaggagg

SEQ ID NO: 985833 - RNA, 22 nt, Human
cugggccuuggauugacacugu

SEQ ID NO: 985834 - RNA, 22 nt, Human
aaauuauuuucagaauggagaa

SEQ ID NO: 985835 - RNA, 22 nt, Human
aaagacauuagauuaacguaca

SEQ ID NO: 985836 - RNA, 22 nt, Human
cacugcuucuggaggaauuugg

SEQ ID NO: 985837 - RNA, 22 nt, Human
aaacacuagcaggaagcacuga

SEQ ID NO: 985838 - RNA, 22 nt, Human
ggcuggccuguguggccgccac

SEQ ID NO: 985839 - RNA, 22 nt, Human
uugaaaggccuguuuauccagc

SEQ ID NO: 985840 - RNA, 22 nt, Human
aaaugcagguaguauuuauuuu

SEQ ID NO: 985841 - RNA, 22 nt, Human
ugcagcuucuccaucuccuugu

SEQ ID NO: 985842 - RNA, 22 nt, Human
uauauuaguggaaugauaugaa

SEQ ID NO: 985843 - RNA, 22 nt, Human
caguuucugggcguucacaggu

SEQ ID NO: 985844 - RNA, 22 nt, Human
caguacuugggggguucuaagu

SEQ ID NO: 985845 - RNA, 22 nt, Human
ggagccagugcccucuggugga

SEQ ID NO: 985846 - RNA, 22 nt, Human
ucaucuaagagucuuacauuua

SEQ ID NO: 985847 - RNA, 22 nt, Human
uucaacuagauuuauacaauuc

SEQ ID NO: 985848 - RNA, 22 nt, Human
augcaguaaaauaggagguaau

SEQ ID NO: 985849 - RNA, 22 nt, Human
cucccacuccuggcucaccaca

SEQ ID NO: 985850 - RNA, 22 nt, Human
aaauguguauaugaaacaugau

SEQ ID NO: 985851 - RNA, 22 nt, Human
auuaggauuugguauggucaua

SEQ ID NO: 985852 - RNA, 22 nt, Human
gagguggguguaucacagguca

SEQ ID NO: 985853 - RNA, 22 nt, Human
uaaaugcagauuccugagccua

SEQ ID NO: 985854 - RNA, 22 nt, Human
aacuucuggauguuucaaaugu

SEQ ID NO: 985855 - RNA, 22 nt, Human
uucaaucauuagaaucucaggc

SEQ ID NO: 985856 - RNA, 22 nt, Human
agagcugggugaagugccauca

SEQ ID NO: 985857 - RNA, 22 nt, Human
caggagugucuccacacagcaa

SEQ ID NO: 985858 - RNA, 22 nt, Human
ucaaauaaugccauucaucauc

SEQ ID NO: 985859 - RNA, 22 nt, Human
ugacuucaaaggcucuacuccu

SEQ ID NO: 985860 - RNA, 22 nt, Human
aggaggugacagccugcaucug

SEQ ID NO: 985861 - RNA, 22 nt, Human
cagcagcuuugccaagucagcc

SEQ ID NO: 985862 - RNA, 22 nt, Human
uaagacacaugcguacaagaua

SEQ ID NO: 985863 - RNA, 22 nt, Human
aguuuagaguucaaauuaguuc

SEQ ID NO: 985864 - RNA, 22 nt, Human
acaguaauauugaugcucguca

SEQ ID NO: 985865 - RNA, 22 nt, Human
ggcucagguuuccuucccagcu

SEQ ID NO: 985866 - RNA, 22 nt, Human
ugugaaaggggucacagggaaa

SEQ ID NO: 985867 - RNA, 22 nt, Human
uauuucuguaugcauaaaagga

SEQ ID NO: 985868 - RNA, 22 nt, Human
caggcagcaucagucugcugua

SEQ ID NO: 985869 - RNA, 22 nt, Human
cucccuggaggugagcuggcac

SEQ ID NO: 985870 - RNA, 19 nt, Human
acucaagucuaaugaaauc

SEQ ID NO: 985871 - RNA, 22 nt, Human
uuaauuuuuauguauagugugu

SEQ ID NO: 985872 - RNA, 22 nt, Human
gaaugcagauggcugguguaug

SEQ ID NO: 985873 - RNA, 22 nt, Human
uucaagauggcugcaaauacuu

SEQ ID NO: 985874 - RNA, 22 nt, Human
gugacucacacaggccugggcu

SEQ ID NO: 985875 - RNA, 22 nt, Human
gcugucaccaaagcaggcacug

SEQ ID NO: 985876 - RNA, 22 nt, Human
agaaauguuacaguuguuauuu

SEQ ID NO: 985877 - RNA, 22 nt, Human
ccuguuuaucuaucuagagaug

SEQ ID NO: 985878 - RNA, 22 nt, Human
gaugugagugguagcugggauu

SEQ ID NO: 985879 - RNA, 22 nt, Human
auaacagaguugggaagugaaa

SEQ ID NO: 985880 - RNA, 22 nt, Human
ucccuggacagccuugccuggg

SEQ ID NO: 985881 - RNA, 23 nt, Human
agcacagacuagaaaggucuuuc

SEQ ID NO: 985882 - RNA, 22 nt, Human
ucucuucuugauuuucacugga

SEQ ID NO: 985883 - RNA, 22 nt, Human
agcucccagcagagcuggccac

SEQ ID NO: 985884 - RNA, 22 nt, Human
gagcagcucugggugacccagu

SEQ ID NO: 985885 - RNA, 22 nt, Human
auuauguauuugguauaguuug

SEQ ID NO: 985886 - RNA, 22 nt, Human
cucaggauuuaaaggggcacuc

SEQ ID NO: 985887 - RNA, 18 nt, Human
gaugggagcaagagaaga

SEQ ID NO: 985888 - RNA, 22 nt, Human
uacaucuagccuuacaauuauu

SEQ ID NO: 985889 - RNA, 22 nt, Human
cagagugagggccugcaccugc

SEQ ID NO: 985890 - RNA, 22 nt, Human
guuugcauaaaguggaugcagg

SEQ ID NO: 985891 - RNA, 22 nt, Human
cagcagcuggugagacacagcc

SEQ ID NO: 985892 - RNA, 22 nt, Human
acugaaauacugcucuuggauu

SEQ ID NO: 985893 - RNA, 22 nt, Human
cugggagggguagccaauccua

SEQ ID NO: 985894 - RNA, 22 nt, Human
ccuggcagcagcacaugccuuc

SEQ ID NO: 985895 - RNA, 22 nt, Human
ccagcuccccucagcagguaau

SEQ ID NO: 985896 - RNA, 22 nt, Human
cugcccugcccaggccuugggc

SEQ ID NO: 985897 - RNA, 22 nt, Human
ccugguccuuacgucauugcuu

SEQ ID NO: 985898 - RNA, 22 nt, Human
auaaggcagucccuuaacaagg

SEQ ID NO: 985899 - RNA, 22 nt, Human
uugaauaauuaauuacacucag

SEQ ID NO: 985900 - RNA, 22 nt, Human
gggaggcuggcucuggccacag

SEQ ID NO: 985901 - RNA, 22 nt, Human
aagaauguucauuaaacuguug

SEQ ID NO: 985902 - RNA, 22 nt, Human
acuccaggguuuugcaccugga

SEQ ID NO: 985903 - RNA, 22 nt, Human
gagcucccaggccccagcaagg

SEQ ID NO: 985904 - RNA, 22 nt, Human
uuucaugugcaauuagcaauau

SEQ ID NO: 985905 - RNA, 22 nt, Human
cacauuucuaggaaauuaaaug

SEQ ID NO: 985906 - RNA, 22 nt, Human
cugcucugacccuuucaccuuc

SEQ ID NO: 985907 - RNA, 22 nt, Human
agagacaggauaucugcucaug

SEQ ID NO: 985908 - RNA, 22 nt, Human
cugggguggauggguccaaguu

SEQ ID NO: 985909 - RNA, 22 nt, Human
cugcagcugucucuacugggca

SEQ ID NO: 985910 - RNA, 22 nt, Human
cuggcucaggaaaguugcugcu

SEQ ID NO: 985911 - RNA, 22 nt, Human
gcccugucccuuggcuucuagg

SEQ ID NO: 985912 - RNA, 22 nt, Human
agccagcugccuuucacaucug

SEQ ID NO: 985913 - RNA, 22 nt, Human
gaggccugucgcuaggccucug

SEQ ID NO: 985914 - RNA, 22 nt, Human
guuuaauaauguugaauuacua

SEQ ID NO: 985915 - RNA, 22 nt, Human
ccuccagcgcgauccacuccgg

SEQ ID NO: 985916 - RNA, 22 nt, Human
ggucccaguccucucccugcua

SEQ ID NO: 985917 - RNA, 22 nt, Human
aacucugcaaccuauguagacc

SEQ ID NO: 985918 - RNA, 22 nt, Human
agcuuaggaggaugaugaacau

SEQ ID NO: 985919 - RNA, 22 nt, Human
agagcccuuucuccaggcaccu

SEQ ID NO: 985920 - RNA, 22 nt, Human
auacauacguacauacguaugu

SEQ ID NO: 985921 - RNA, 19 nt, Human
aguagcagaaagugcagug

SEQ ID NO: 985922 - RNA, 21 nt, Human
ggcagaaguagcauggacggg

SEQ ID NO: 985923 - RNA, 22 nt, Human
cagggugccucccgcucgccgg

SEQ ID NO: 985924 - RNA, 22 nt, Human
aagagcuggaguuugcagcccu

SEQ ID NO: 985925 - RNA, 22 nt, Human
uuccucaucugugcaccucacu

SEQ ID NO: 985926 - RNA, 22 nt, Human
gcccagcugcacccuggugggu

SEQ ID NO: 985927 - RNA, 22 nt, Human
ugauuuccuagcugacaugaaa

SEQ ID NO: 985928 - RNA, 22 nt, Human
uucaagauggcaccagugagug

SEQ ID NO: 985929 - RNA, 22 nt, Human
cagaacauuccaugugcccugc

SEQ ID NO: 985930 - RNA, 19 nt, Human
cccagagcauccugaacuu

SEQ ID NO: 985931 - RNA, 22 nt, Human
cugagccuguguuucucuggca

SEQ ID NO: 985932 - RNA, 22 nt, Human
gugcagcagggggaagacagug

SEQ ID NO: 985933 - RNA, 22 nt, Human
uagcagggaaggugugcugagc

SEQ ID NO: 985934 - RNA, 22 nt, Human
gagggcugccacguugggcgag

SEQ ID NO: 985935 - RNA, 22 nt, Human
agcugggucuugggccaggaga

SEQ ID NO: 985936 - RNA, 22 nt, Human
caggcagccuucucgucucaca

SEQ ID NO: 985937 - RNA, 22 nt, Human
gagagcugcauucucagacaca

SEQ ID NO: 985938 - RNA, 22 nt, Human
caggugggcuugggagaacacu

SEQ ID NO: 985939 - RNA, 22 nt, Human
caggcacugugcuagauccuug

SEQ ID NO: 985940 - RNA, 19 nt, Human
ggucucagugcagcugcag

SEQ ID NO: 985941 - RNA, 22 nt, Human
aaaguuuggauuagcaguuaga

SEQ ID NO: 985942 - RNA, 22 nt, Human
cggcagcuccgcgccguaggac

SEQ ID NO: 985943 - RNA, 22 nt, Human
ugggcucugugccagguuggug

SEQ ID NO: 985944 - RNA, 22 nt, Human
aacucaguucuuuccacaaugc

SEQ ID NO: 985945 - RNA, 22 nt, Human
agcagagcugcaguggccugcu

SEQ ID NO: 985946 - RNA, 22 nt, Human
cuggccuuggaagggagcccgu

SEQ ID NO: 985947 - RNA, 22 nt, Human
ccagaggcuggguucaccucag

SEQ ID NO: 985948 - RNA, 22 nt, Human
gaauguaauagucaguagaaca

SEQ ID NO: 985949 - RNA, 22 nt, Human
caagagcuuuagaaaugcucau

SEQ ID NO: 985950 - RNA, 18 nt, Human
uccagagguguuggagcc

SEQ ID NO: 985951 - RNA, 21 nt, Human
auggagccuaagaguggaggu

SEQ ID NO: 985952 - RNA, 22 nt, Human
guccucaguaagagggccucug

SEQ ID NO: 985953 - RNA, 22 nt, Human
uuucacaucagagguagauuag

SEQ ID NO: 985954 - RNA, 22 nt, Human
cuguuuauuacacuggauagca

SEQ ID NO: 985955 - RNA, 22 nt, Human
cagcaggguagguuguaucagu

SEQ ID NO: 985956 - RNA, 22 nt, Human
ugcugcuccccagcacacagca

SEQ ID NO: 985957 - RNA, 22 nt, Human
uugucuguccaggcaccccaag

SEQ ID NO: 985958 - RNA, 22 nt, Human
aggauaguugugaagauaggcu

SEQ ID NO: 985959 - RNA, 22 nt, Human
uggccuuggacagagcgcuccu

SEQ ID NO: 985960 - RNA, 22 nt, Human
ucagcuggagaugagaaccgaa

SEQ ID NO: 985961 - RNA, 22 nt, Human
gucauuucuguuucuucagugc

SEQ ID NO: 985962 - RNA, 22 nt, Human
gaggcccuccagcugucagcug

SEQ ID NO: 985963 - RNA, 22 nt, Human
agcuggagcuucaagcagguaa

SEQ ID NO: 985964 - RNA, 22 nt, Human
cugagagcagggacuugagcca

SEQ ID NO: 985965 - RNA, 22 nt, Human
ugagguguguccccagggaggu

SEQ ID NO: 985966 - RNA, 22 nt, Human
aaauguguuucuuugugaaugg

SEQ ID NO: 985967 - RNA, 22 nt, Human
acugggaggcaaagagcaagga

SEQ ID NO: 985968 - RNA, 22 nt, Human
cugagaggaugcugcaguggag

SEQ ID NO: 985969 - RNA, 22 nt, Human
acaaggaggucuggggggcccu

SEQ ID NO: 985970 - RNA, 22 nt, Human
caggaccuggaaugcuugugaa

SEQ ID NO: 985971 - RNA, 20 nt, Human
agaauucuuacccuuugaug

SEQ ID NO: 985972 - RNA, 22 nt, Human
uguaugcuuguguauaauauaa

SEQ ID NO: 985973 - RNA, 18 nt, Human
agaguguucucagugaaa

SEQ ID NO: 985974 - RNA, 22 nt, Human
cagagccuuccuagcagacucu

SEQ ID NO: 985975 - RNA, 22 nt, Human
agggcugcaggcaagauauggc

SEQ ID NO: 985976 - RNA, 22 nt, Human
gauaugaaguggcauugugaag

SEQ ID NO: 985977 - RNA, 22 nt, Human
gagagaagggggauaugagccu

SEQ ID NO: 985978 - RNA, 22 nt, Human
auacaaagacaaaucucaaucu

SEQ ID NO: 985979 - RNA, 22 nt, Human
caugggcuacagaagcaugcug

SEQ ID NO: 985980 - RNA, 22 nt, Human
ugcucagacaagcugaacagua

SEQ ID NO: 985981 - RNA, 22 nt, Human
ugggcagaggcagcagaaaccu

SEQ ID NO: 985982 - RNA, 22 nt, Human
gacaggguacgggcuaggcaca

SEQ ID NO: 985983 - RNA, 22 nt, Human
uuugcauugcagugguuuacag

SEQ ID NO: 985984 - RNA, 22 nt, Human
gccuggaguuguggugaagcca

SEQ ID NO: 985985 - RNA, 22 nt, Human
aaggcacuugcccagagcugca

SEQ ID NO: 985986 - RNA, 22 nt, Human
agccacaggaaacagagacagc

SEQ ID NO: 985987 - RNA, 23 nt, Human
aaaugcagggucgcagguuacag

SEQ ID NO: 985988 - RNA, 22 nt, Human
gggagccuugggagugccagcc

SEQ ID NO: 985989 - RNA, 22 nt, Human
agaaaucaugacuaagagcagu

SEQ ID NO: 985990 - RNA, 19 nt, Human
gcaggcacagcccugggug

SEQ ID NO: 985991 - RNA, 22 nt, Human
gcugcaggcgccugcggucucu

SEQ ID NO: 985992 - RNA, 22 nt, Human
uggcacauaguaggugcucaau

SEQ ID NO: 985993 - RNA, 22 nt, Human
aagcaggcauuccagagacaau

SEQ ID NO: 985994 - RNA, 22 nt, Human
ucccagacaaucauuggccacc

SEQ ID NO: 985995 - RNA, 22 nt, Human
cauuaugugggaaaauguucuu

SEQ ID NO: 985996 - RNA, 20 nt, Human
cucucuggaaggugggagcc

SEQ ID NO: 985997 - RNA, 22 nt, Human
agcugagccagcagcaacagga

SEQ ID NO: 985998 - RNA, 22 nt, Human
uccuggaggggacagcaugggc

SEQ ID NO: 985999 - RNA, 22 nt, Human
ucaacagaagugauagcuauua

SEQ ID NO: 986000 - RNA, 22 nt, Human
cagcuggcagaaccugcaucca

SEQ ID NO: 986001 - RNA, 22 nt, Human
agcauuuaugacuaauguaaaa

SEQ ID NO: 986002 - RNA, 22 nt, Human
cuuagaaauaaugguuucaguu

SEQ ID NO: 986003 - RNA, 22 nt, Human
gggcugacucugcacugagcca

SEQ ID NO: 986004 - RNA, 22 nt, Human
cacauuugaaggaauuagcauu

SEQ ID NO: 986005 - RNA, 22 nt, Human
gcuccuggccagcacagggccc

SEQ ID NO: 986006 - RNA, 21 nt, Human
ugcucacagaugugcucagug

SEQ ID NO: 986007 - RNA, 23 nt, Human
gcucugcucuguuucauagacag

SEQ ID NO: 986008 - RNA, 22 nt, Human
ugucuccucauacugucauauu

SEQ ID NO: 986009 - RNA, 22 nt, Human
gaaugcacucacccaucacuca

SEQ ID NO: 986010 - RNA, 22 nt, Human
uccuccuucgggacugcuugac

SEQ ID NO: 986011 - RNA, 23 nt, Human
ugcuucucugcuugacaguucug

SEQ ID NO: 986012 - RNA, 22 nt, Human
cacccaggcagguggcugagaa

SEQ ID NO: 986013 - RNA, 20 nt, Human
uccugggguaagccaugguc

SEQ ID NO: 986014 - RNA, 22 nt, Human
agaauaaacugcuuuagggcag

SEQ ID NO: 986015 - RNA, 22 nt, Human
agcagccaagguaaccugugcu

SEQ ID NO: 986016 - RNA, 22 nt, Human
caguugaugggacucauguggg

SEQ ID NO: 986017 - RNA, 22 nt, Human
uguacacaauucuuaacauaca

SEQ ID NO: 986018 - RNA, 22 nt, Human
ccagagcuccagggcuacagaa

SEQ ID NO: 986019 - RNA, 22 nt, Human
gagccagccuucuucugagguc

SEQ ID NO: 986020 - RNA, 22 nt, Human
ucagcagggagaggagaaugca

SEQ ID NO: 986021 - RNA, 20 nt, Human
ugagugauggaggcggguca

SEQ ID NO: 986022 - RNA, 22 nt, Human
ugggcagacgggagcuugccuu

SEQ ID NO: 986023 - RNA, 22 nt, Human
guccugggcccaggggcugccu

SEQ ID NO: 986024 - RNA, 22 nt, Human
ccucagagaaagguauggcuga

SEQ ID NO: 986025 - RNA, 22 nt, Human
uuauguacucugcaauguuuga

SEQ ID NO: 986026 - RNA, 22 nt, Human
ggcacugauuccauucaugaag

SEQ ID NO: 986027 - RNA, 22 nt, Human
gugggcuucuguuagggaggcu

SEQ ID NO: 986028 - RNA, 22 nt, Human
agcagcugagccccagcuguga

SEQ ID NO: 986029 - RNA, 22 nt, Human
ugccuggguguaaagggccaac

SEQ ID NO: 986030 - RNA, 22 nt, Human
caggaggcccaaagggcgcaga

SEQ ID NO: 986031 - RNA, 22 nt, Human
ccagggugugagaaggaaguag

SEQ ID NO: 986032 - RNA, 22 nt, Human
gggcacuguacacugugcaugg

SEQ ID NO: 986033 - RNA, 22 nt, Human
gcuggugcauuagcugcaguuc

SEQ ID NO: 986034 - RNA, 22 nt, Human
guggccaauaggagcagcuauc

SEQ ID NO: 986035 - RNA, 22 nt, Human
guuuuccuucucagccauugcc

SEQ ID NO: 986036 - RNA, 22 nt, Human
gcugccaguguggcaugaugca

SEQ ID NO: 986037 - RNA, 22 nt, Human
agaaaagguugaaaguaggauu

SEQ ID NO: 986038 - RNA, 23 nt, Human
ugauuaggucuacucuuggcucc

SEQ ID NO: 986039 - RNA, 22 nt, Human
gccugggagugcacagugaggu

SEQ ID NO: 986040 - RNA, 22 nt, Human
ccacugggggcugcaggcacuc

SEQ ID NO: 986041 - RNA, 22 nt, Human
caagcagagacuagauagcugu

SEQ ID NO: 986042 - RNA, 21 nt, Human
aagcuucccugcucuccaggg

SEQ ID NO: 986043 - RNA, 21 nt, Human
guauugcagaguuaugugcuc

SEQ ID NO: 986044 - RNA, 22 nt, Human
aagcagccuggacuugggcugg

SEQ ID NO: 986045 - RNA, 22 nt, Human
cuccugagcucugaggaagcuu

SEQ ID NO: 986046 - RNA, 22 nt, Human
uuggaaggugagucccuggguu

SEQ ID NO: 986047 - RNA, 22 nt, Human
caggagcugggucuggaagcag

SEQ ID NO: 986048 - RNA, 22 nt, Human
acugagcugugacaaugcuuaa

SEQ ID NO: 986049 - RNA, 22 nt, Human
ccagcagcuuuauuggcucucc

SEQ ID NO: 986050 - RNA, 22 nt, Human
acacaggggaaaguggagcuga

SEQ ID NO: 986051 - RNA, 22 nt, Human
gugggcuggacccuccugcucc

SEQ ID NO: 986052 - RNA, 22 nt, Human
gcagggccagugcagagaggaa

SEQ ID NO: 986053 - RNA, 22 nt, Human
cagggucuuauaaggccaauuu

SEQ ID NO: 986054 - RNA, 22 nt, Human
gaagaacaccugcugcccagug

SEQ ID NO: 986055 - RNA, 22 nt, Human
ccacaggggcccacgagccgcu

SEQ ID NO: 986056 - RNA, 23 nt, Human
gcugcagcuguggauguucucag

SEQ ID NO: 986057 - RNA, 22 nt, Human
caagagcuagacuuugucagga

SEQ ID NO: 986058 - RNA, 22 nt, Human
ccagagcugauuccugggacuu

SEQ ID NO: 986059 - RNA, 22 nt, Human
aguuacaaccaugacacaagca

SEQ ID NO: 986060 - RNA, 22 nt, Human
aagccaggaagagagccuucac

SEQ ID NO: 986061 - RNA, 22 nt, Human
acucccacuccagaguagaagc

SEQ ID NO: 986062 - RNA, 22 nt, Human
uuggcugagagaggaaaagggc

SEQ ID NO: 986063 - RNA, 22 nt, Human
aacauuucauuggaagcuaugu

SEQ ID NO: 986064 - RNA, 22 nt, Human
caccuuguggcccagucagguu

SEQ ID NO: 986065 - RNA, 22 nt, Human
gcaggcagguggcaucuuguga

SEQ ID NO: 986066 - RNA, 22 nt, Human
aguguacaguuuguaguacuac

SEQ ID NO: 986067 - RNA, 22 nt, Human
gcugcucuacccaugcaucugu

SEQ ID NO: 986068 - RNA, 22 nt, Human
ucucaccaaagccuugaccaua

SEQ ID NO: 986069 - RNA, 22 nt, Human
gagggagagugauggaccauug

SEQ ID NO: 986070 - RNA, 22 nt, Human
uaacuccagagaauccauccau

SEQ ID NO: 986071 - RNA, 22 nt, Human
uccuggagcuuccuucauggua

SEQ ID NO: 986072 - RNA, 22 nt, Human
cauacauugcucauucaguauc

SEQ ID NO: 986073 - RNA, 22 nt, Human
agugaccaacaaugcugagaag

SEQ ID NO: 986074 - RNA, 22 nt, Human
uaaguucaguuggucgaaguag

SEQ ID NO: 986075 - RNA, 22 nt, Human
uuuaucagagauauguguggac

SEQ ID NO: 986076 - RNA, 17 nt, Human
uuccuggaagucauucc

SEQ ID NO: 986077 - RNA, 22 nt, Human
uggcccugaggggcugugcccc

SEQ ID NO: 986078 - RNA, 22 nt, Human
cugggggcaauggucagagugu

SEQ ID NO: 986079 - RNA, 22 nt, Human
gcuggccugggcagccugucgg

SEQ ID NO: 986080 - RNA, 21 nt, Human
acagaugggaugagcacacug

SEQ ID NO: 986081 - RNA, 21 nt, Human
ucucuacacuuucacuaggcu

SEQ ID NO: 986082 - RNA, 22 nt, Human
caaauauuccagguacaucccu

SEQ ID NO: 986083 - RNA, 19 nt, Human
cucugccucuggcuguggc

SEQ ID NO: 986084 - RNA, 22 nt, Human
ccuuucucuuugcugaucaugu

SEQ ID NO: 986085 - RNA, 22 nt, Human
cugggccagucucggccgcucu

SEQ ID NO: 986086 - RNA, 22 nt, Human
uaaugcaguacugauauaaaca

SEQ ID NO: 986087 - RNA, 22 nt, Human
gggagggaggugcugguucacg

SEQ ID NO: 986088 - RNA, 20 nt, Human
aggauuugagaaggcgucuu

SEQ ID NO: 986089 - RNA, 22 nt, Human
uaggaaaagucuagauugauga

SEQ ID NO: 986090 - RNA, 22 nt, Human
ugaagcagcaccauuuuagagc

SEQ ID NO: 986091 - RNA, 22 nt, Human
cuaauacucauuucuguaacuc

SEQ ID NO: 986092 - RNA, 22 nt, Human
caacuccuccccagcaugccaa

SEQ ID NO: 986093 - RNA, 22 nt, Human
uuugggcaguagauguaucacu

SEQ ID NO: 986094 - RNA, 22 nt, Human
uccucaugccgggucucacgcu

SEQ ID NO: 986095 - RNA, 22 nt, Human
agccaacuaggagauuaaggua

SEQ ID NO: 986096 - RNA, 22 nt, Human
accagcagaguugaggaggaca

SEQ ID NO: 986097 - RNA, 22 nt, Human
cagguggggcgcccucaggcag

SEQ ID NO: 986098 - RNA, 22 nt, Human
ugcauuauacuuuuagaaauuu

SEQ ID NO: 986099 - RNA, 20 nt, Human
uuggccaaaucuuagucaug

SEQ ID NO: 986100 - RNA, 22 nt, Human
aaaaaguauuggccaugguuga

SEQ ID NO: 986101 - RNA, 22 nt, Human
agcuuccuuggcgcugaggccu

SEQ ID NO: 986102 - RNA, 18 nt, Human
ugaacagaugaguugaag

SEQ ID NO: 986103 - RNA, 23 nt, Human
acuuaaaugguucuuuaucucag

SEQ ID NO: 986104 - RNA, 22 nt, Human
ucccacugcuuugcucugcuca

SEQ ID NO: 986105 - RNA, 22 nt, Human
gucaaguuuauccgcucauuca

SEQ ID NO: 986106 - RNA, 23 nt, Human
ucagugauguugaaccuagcagu

SEQ ID NO: 986107 - RNA, 22 nt, Human
uggcugaacuaaugugcuguuu

SEQ ID NO: 986108 - RNA, 22 nt, Human
augcuuuacaguuuuccaaaca

SEQ ID NO: 986109 - RNA, 22 nt, Human
uugaagcauuucuuugagcuuc

SEQ ID NO: 986110 - RNA, 22 nt, Human
uggcagcuggagggcaauggcc

SEQ ID NO: 986111 - RNA, 22 nt, Human
cucuggaggccuaaggaagugg

SEQ ID NO: 986112 - RNA, 22 nt, Human
ccaggcugcuuagccuuaucuu

SEQ ID NO: 986113 - RNA, 22 nt, Human
uaaggcacccauguucauacag

SEQ ID NO: 986114 - RNA, 22 nt, Human
guuauguaaucuaacacucagu

SEQ ID NO: 986115 - RNA, 22 nt, Human
ucugccuggauuuuggaaagcu

SEQ ID NO: 986116 - RNA, 22 nt, Human
acugcagccuugaacucugggc

SEQ ID NO: 986117 - RNA, 20 nt, Human
gaggcugcggacugcuggac

SEQ ID NO: 986118 - RNA, 22 nt, Human
gagcagcuccagccgcaugacu

SEQ ID NO: 986119 - RNA, 22 nt, Human
gcauuucuuccuggugugagcc

SEQ ID NO: 986120 - RNA, 22 nt, Human
cugucugucaaguucaucucca

SEQ ID NO: 986121 - RNA, 22 nt, Human
ucugcuguugccaugaguaaua

SEQ ID NO: 986122 - RNA, 22 nt, Human
uccagugguaguaaagaggucu

SEQ ID NO: 986123 - RNA, 22 nt, Human
ugcugaggucaccuugcugcua

SEQ ID NO: 986124 - RNA, 22 nt, Human
gccccuggcuggccagcuccuc

SEQ ID NO: 986125 - RNA, 22 nt, Human
acagauauaugauuguguaaau

SEQ ID NO: 986126 - RNA, 22 nt, Human
aagugagauuauauguacggga

SEQ ID NO: 986127 - RNA, 18 nt, Human
agcagagcccaugcauuc

SEQ ID NO: 986128 - RNA, 22 nt, Human
cagcaauaagguaagcuucucc

SEQ ID NO: 986129 - RNA, 22 nt, Human
ucugaggcuaagagacagaggc

SEQ ID NO: 986130 - RNA, 22 nt, Human
acuugaaaggaagcucuaaaac

SEQ ID NO: 986131 - RNA, 22 nt, Human
uuuugaaagaguccugcuacag

SEQ ID NO: 986132 - RNA, 22 nt, Human
cagcaggcccaggugcugguga

SEQ ID NO: 986133 - RNA, 22 nt, Human
uccagagggcgauggcuggggg

SEQ ID NO: 986134 - RNA, 23 nt, Human
gagguacagcaccagugaauagg

SEQ ID NO: 986135 - RNA, 22 nt, Human
cacugcuuuuuuggcuauguac

SEQ ID NO: 986136 - RNA, 22 nt, Human
ugcagaggagucagccugggca

SEQ ID NO: 986137 - RNA, 22 nt, Human
auggggcucugcggcugcuccc

SEQ ID NO: 986138 - RNA, 22 nt, Human
uaugcacaacaugcagguuugu

SEQ ID NO: 986139 - RNA, 22 nt, Human
ugaggccacuuccccacagccc

SEQ ID NO: 986140 - RNA, 22 nt, Human
gggagggaagguaccuguguga

SEQ ID NO: 986141 - RNA, 22 nt, Human
aggcccugaagucggccccuca

SEQ ID NO: 986142 - RNA, 23 nt, Human
caguacuuaguguagcguuaauu

SEQ ID NO: 986143 - RNA, 22 nt, Human
gggcccacuggcugucugaccc

SEQ ID NO: 986144 - RNA, 22 nt, Human
cuuaacagauacaucugugguu

SEQ ID NO: 986145 - RNA, 22 nt, Human
gagcuggcaggaggcuccccga

SEQ ID NO: 986146 - RNA, 22 nt, Human
gaggccuggagccgccuaggcg

SEQ ID NO: 986147 - RNA, 22 nt, Human
ggcuggcaagugucugcucaug

SEQ ID NO: 986148 - RNA, 22 nt, Human
ucaugccacuuacaaaauaaug

SEQ ID NO: 986149 - RNA, 22 nt, Human
acucugcucuuauaguguuaua

SEQ ID NO: 986150 - RNA, 22 nt, Human
uuucucaucuggaaacagugcu

SEQ ID NO: 986151 - RNA, 22 nt, Human
uaaaacugaauacauacugagg

SEQ ID NO: 986152 - RNA, 22 nt, Human
auaaacaucuguuucucuucug

SEQ ID NO: 986153 - RNA, 22 nt, Human
ugggggacugcacuggcgucag

SEQ ID NO: 986154 - RNA, 22 nt, Human
agcagggguaacagaaggaaag

SEQ ID NO: 986155 - RNA, 22 nt, Human
agagcuuauaucuuggccaucc

SEQ ID NO: 986156 - RNA, 21 nt, Human
gccugccugcgugacccucuu

SEQ ID NO: 986157 - RNA, 22 nt, Human
uccucuggcccagcugccucug

SEQ ID NO: 986158 - RNA, 22 nt, Human
caccguuugguuuggauuuaca

SEQ ID NO: 986159 - RNA, 22 nt, Human
gacagagaggcugagcaguaca

SEQ ID NO: 986160 - RNA, 22 nt, Human
gcugaagggagugcugagucug

SEQ ID NO: 986161 - RNA, 22 nt, Human
uaguaucuauuaguaacaagag

SEQ ID NO: 986162 - RNA, 22 nt, Human
ucucagagaggggccgggccuu

SEQ ID NO: 986163 - RNA, 22 nt, Human
aaggcucucugauggcagcagu

SEQ ID NO: 986164 - RNA, 22 nt, Human
cucucuggaccucaacuauuuu

SEQ ID NO: 986165 - RNA, 22 nt, Human
agucucagaaaauaugcuuuuu

SEQ ID NO: 986166 - RNA, 22 nt, Human
ugguaucagagccaucuguauu

SEQ ID NO: 986167 - RNA, 22 nt, Human
ccuauugacaauucucuucucc

SEQ ID NO: 986168 - RNA, 22 nt, Human
ccucucauagucuguauccuuu

SEQ ID NO: 986169 - RNA, 22 nt, Human
gugcagggcuggcaccggaggc

SEQ ID NO: 986170 - RNA, 22 nt, Human
uucuuauucuugaaauguggga

SEQ ID NO: 986171 - RNA, 22 nt, Human
cugccgagugggucaugaggca

SEQ ID NO: 986172 - RNA, 22 nt, Human
agaaguauaaagaauguuuaug

SEQ ID NO: 986173 - RNA, 22 nt, Human
cccaggagguggagguugcagc

SEQ ID NO: 986174 - RNA, 22 nt, Human
cuguccauuuucgugccuccuu

SEQ ID NO: 986175 - RNA, 22 nt, Human
uccagcagguccgagacaaguu

SEQ ID NO: 986176 - RNA, 22 nt, Human
agggcagcagcuccuccuagcu

SEQ ID NO: 986177 - RNA, 22 nt, Human
cccagcccaucucaaaggucua

SEQ ID NO: 986178 - RNA, 22 nt, Human
gagagcacaugaacauggagga

SEQ ID NO: 986179 - RNA, 21 nt, Human
aggagcuguguuagcuggucg

SEQ ID NO: 986180 - RNA, 22 nt, Human
caacaaguggguacuuuacagg

SEQ ID NO: 986181 - RNA, 22 nt, Human
aagcacaaugaacaucuuagau

SEQ ID NO: 986182 - RNA, 22 nt, Human
cguggccagccauuuccuggaa

SEQ ID NO: 986183 - RNA, 22 nt, Human
aucaggaucagggcuagcagag

SEQ ID NO: 986184 - RNA, 22 nt, Human
ccaucuccacugucccugucaa

SEQ ID NO: 986185 - RNA, 22 nt, Human
uugaaagggauauaucuuucug

SEQ ID NO: 986186 - RNA, 22 nt, Human
caagagcuggagaggcagucua

SEQ ID NO: 986187 - RNA, 22 nt, Human
agucuuaacuaugcaaguacua

SEQ ID NO: 986188 - RNA, 22 nt, Human
aagagcugcaucuaagccauga

SEQ ID NO: 986189 - RNA, 22 nt, Human
uaggauguagcuaugucaucau

SEQ ID NO: 986190 - RNA, 22 nt, Human
ccugccuggaucagccauccug

SEQ ID NO: 986191 - RNA, 22 nt, Human
auugaaagcauggauuuggauu

SEQ ID NO: 986192 - RNA, 22 nt, Human
uacuuuuagccuauuugauucu

SEQ ID NO: 986193 - RNA, 20 nt, Human
cagagacccaggcuucagcu

SEQ ID NO: 986194 - RNA, 22 nt, Human
aagcuuccugaaugcucauuua

SEQ ID NO: 986195 - RNA, 22 nt, Human
aggauccuuuuucugcuguuug

SEQ ID NO: 986196 - RNA, 20 nt, Human
guaaaauauggucuuugggu

SEQ ID NO: 986197 - RNA, 22 nt, Human
aggcacugugcagucccaagca

SEQ ID NO: 986198 - RNA, 21 nt, Human
caugcaggauuuaaccuagaa

SEQ ID NO: 986199 - RNA, 22 nt, Human
auugacaagacaauggcucuua

SEQ ID NO: 986200 - RNA, 17 nt, Human
aguggcaggcagauggg

SEQ ID NO: 986201 - RNA, 22 nt, Human
caggggcucugggugaugugag

SEQ ID NO: 986202 - RNA, 22 nt, Human
aaacugaauucccaagggcaug

SEQ ID NO: 986203 - RNA, 19 nt, Human
agcaccugugagagccugg

SEQ ID NO: 986204 - RNA, 21 nt, Human
ccuggccaaucugauaggguu

SEQ ID NO: 986205 - RNA, 22 nt, Human
ucuuuccuaggugauaugcaau

SEQ ID NO: 986206 - RNA, 22 nt, Human
cucuggccagagccugcgggaa

SEQ ID NO: 986207 - RNA, 22 nt, Human
cugcagagcauaaaucugaaua

SEQ ID NO: 986208 - RNA, 22 nt, Human
agaaggaguguacaggucaugc

SEQ ID NO: 986209 - RNA, 22 nt, Human
uugggcugaacccugcagcuga

SEQ ID NO: 986210 - RNA, 22 nt, Human
cugcaggcugagcgccugccgg

SEQ ID NO: 986211 - RNA, 22 nt, Human
uccagaguacggaagagucauc

SEQ ID NO: 986212 - RNA, 22 nt, Human
auguaguguagagauuagucuc

SEQ ID NO: 986213 - RNA, 22 nt, Human
uuccauaauaaccugagagaaa

SEQ ID NO: 986214 - RNA, 22 nt, Human
gcugagcucccagcaguaucug

SEQ ID NO: 986215 - RNA, 19 nt, Human
uccccagcaccucugaguc

SEQ ID NO: 986216 - RNA, 18 nt, Human
augcuuugcuuacguuau

SEQ ID NO: 986217 - RNA, 22 nt, Human
uagccgggugugguggaacucc

SEQ ID NO: 986218 - RNA, 22 nt, Human
cccuggaguagcacugggucgc

SEQ ID NO: 986219 - RNA, 16 nt, Human
gcucugcugaggccca

SEQ ID NO: 986220 - RNA, 22 nt, Human
cucacugucuguacuagcugau

SEQ ID NO: 986221 - RNA, 22 nt, Human
caggcugggaacgccacccgcu

SEQ ID NO: 986222 - RNA, 22 nt, Human
cuggccugaucucaugcugucc

SEQ ID NO: 986223 - RNA, 22 nt, Human
ggaaggaggggcaaagcaguuc

SEQ ID NO: 986224 - RNA, 22 nt, Human
ggccgggcaggucucagccagc

SEQ ID NO: 986225 - RNA, 22 nt, Human
acagagaaagugggcugaagau

SEQ ID NO: 986226 - RNA, 22 nt, Human
agcuugaguuuuggaugaagug

SEQ ID NO: 986227 - RNA, 22 nt, Human
uuauuuauggcacuguuggugg

SEQ ID NO: 986228 - RNA, 22 nt, Human
gcagagcuaucuucuggauuug

SEQ ID NO: 986229 - RNA, 23 nt, Human
gccucuggagccccagugcucag

SEQ ID NO: 986230 - RNA, 22 nt, Human
auggggcugggauucuccucgg

SEQ ID NO: 986231 - RNA, 19 nt, Human
gcugcucugggucucaucu

SEQ ID NO: 986232 - RNA, 22 nt, Human
gagauggggaauaggagcaagc

SEQ ID NO: 986233 - RNA, 22 nt, Human
ggcuccugggaugggacugagc

SEQ ID NO: 986234 - RNA, 22 nt, Human
cuggggugugcucagagcaggg

SEQ ID NO: 986235 - RNA, 22 nt, Human
caaauaucuuuggcaaagagaa

SEQ ID NO: 986236 - RNA, 22 nt, Human
ugcugaggagguggcugugcuu

SEQ ID NO: 986237 - RNA, 23 nt, Human
ccugaagggucaggguccucagc

SEQ ID NO: 986238 - RNA, 18 nt, Human
agcugcagaccaggaggu

SEQ ID NO: 986239 - RNA, 22 nt, Human
gcagaagggaauaaggagcuuu

SEQ ID NO: 986240 - RNA, 22 nt, Human
aggagcugacuuguaaagcauu

SEQ ID NO: 986241 - RNA, 22 nt, Human
gccaggcagccacccucugcga

SEQ ID NO: 986242 - RNA, 19 nt, Human
gcagccaccgcggcggccg

SEQ ID NO: 986243 - RNA, 22 nt, Human
ucuggcucacuucaggcuucac

SEQ ID NO: 986244 - RNA, 20 nt, Human
gucucagaauggauuugcau

SEQ ID NO: 986245 - RNA, 22 nt, Human
gcuggagguuucaccugaguuu

SEQ ID NO: 986246 - RNA, 22 nt, Human
ggcucagguuaccagucccucc

SEQ ID NO: 986247 - RNA, 22 nt, Human
aucaguuuauacuuauaaaucu

SEQ ID NO: 986248 - RNA, 22 nt, Human
auguuuaagaaagucuuccaua

SEQ ID NO: 986249 - RNA, 22 nt, Human
ugaggcuguucuaccagggcca

SEQ ID NO: 986250 - RNA, 22 nt, Human
ggcuucaccgcgggguugcagg

SEQ ID NO: 986251 - RNA, 22 nt, Human
uggagcagcuaagccucugaga

SEQ ID NO: 986252 - RNA, 22 nt, Human
acagggccauuaucuguucuag

SEQ ID NO: 986253 - RNA, 22 nt, Human
agggaauguagcaagaugccaa

SEQ ID NO: 986254 - RNA, 22 nt, Human
auugagaauccauuugagauga

SEQ ID NO: 986255 - RNA, 23 nt, Human
aucagucuugguagcugugccca

SEQ ID NO: 986256 - RNA, 21 nt, Human
uggaaagauucaaagaccagg

SEQ ID NO: 986257 - RNA, 22 nt, Human
ucugucugagggagugacauuu

SEQ ID NO: 986258 - RNA, 22 nt, Human
aggaaaaaagucugugauuaua

SEQ ID NO: 986259 - RNA, 22 nt, Human
aaguuaugaaauuuggacagcu

SEQ ID NO: 986260 - RNA, 22 nt, Human
uacaguucacaguaucauaaau

SEQ ID NO: 986261 - RNA, 22 nt, Human
gaaagaggaaggagauguauua

SEQ ID NO: 986262 - RNA, 23 nt, Human
cauggcagcaagagcucauggcc

SEQ ID NO: 986263 - RNA, 22 nt, Human
aaggagaaaugguagaugugca

SEQ ID NO: 986264 - RNA, 22 nt, Human
ucacaaaucauuuuaucugugu

SEQ ID NO: 986265 - RNA, 22 nt, Human
cugggccacaagccugugugau

SEQ ID NO: 986266 - RNA, 22 nt, Human
cagcaggguuaagugacucacc

SEQ ID NO: 986267 - RNA, 22 nt, Human
ccagagccggauugugaagugc

SEQ ID NO: 986268 - RNA, 17 nt, Human
agauggcaggaggcaga

SEQ ID NO: 986269 - RNA, 22 nt, Human
cagugcauaaucuaaauggggg

SEQ ID NO: 986270 - RNA, 22 nt, Human
agagcugaaaaagcugacccgg

SEQ ID NO: 986271 - RNA, 22 nt, Human
aacugcauucagaaagcucacu

SEQ ID NO: 986272 - RNA, 22 nt, Human
acuuagaacaggcagaauucca

SEQ ID NO: 986273 - RNA, 22 nt, Human
ugggacagggaaucugaucccc

SEQ ID NO: 986274 - RNA, 22 nt, Human
uuuuaucugcuucauuaguuga

SEQ ID NO: 986275 - RNA, 22 nt, Human
guggagaccuccuaggaugugu

SEQ ID NO: 986276 - RNA, 22 nt, Human
acagaauucucucugcagaggc

SEQ ID NO: 986277 - RNA, 22 nt, Human
aacuagaaaacaagaugcugau

SEQ ID NO: 986278 - RNA, 22 nt, Human
gggaguguugagcgcccugcca

SEQ ID NO: 986279 - RNA, 22 nt, Human
uugaauucauuucucauugagu

SEQ ID NO: 986280 - RNA, 22 nt, Human
gcccucagaugggaaaggaggg

SEQ ID NO: 986281 - RNA, 22 nt, Human
ucagaaauagucuuuaaaauga

SEQ ID NO: 986282 - RNA, 22 nt, Human
gcugggagaggcccugaaguga

SEQ ID NO: 986283 - RNA, 22 nt, Human
ggcagagacuggguuggcagag

SEQ ID NO: 986284 - RNA, 22 nt, Human
cucugguguccuuuagaauuua

SEQ ID NO: 986285 - RNA, 22 nt, Human
uaagaacaagauguuccuguuu

SEQ ID NO: 986286 - RNA, 22 nt, Human
guguaauugaaauugagaacca

SEQ ID NO: 986287 - RNA, 22 nt, Human
uguacaguaggaacuuguuauu

SEQ ID NO: 986288 - RNA, 22 nt, Human
caggcagccugagggaucuggg

SEQ ID NO: 986289 - RNA, 22 nt, Human
uaacagaaauuuuaguuagggg

SEQ ID NO: 986290 - RNA, 22 nt, Human
gagguauguaugcuacauucuu

SEQ ID NO: 986291 - RNA, 22 nt, Human
ucauucagguugggcaaguguc

SEQ ID NO: 986292 - RNA, 22 nt, Human
ucacugcagagaccucuaguca

SEQ ID NO: 986293 - RNA, 22 nt, Human
aauuugcaugaugagaacaaua

SEQ ID NO: 986294 - RNA, 21 nt, Human
auuguuaucauugugcugugu

SEQ ID NO: 986295 - RNA, 22 nt, Human
caaaugcuggcccugcuacuua

SEQ ID NO: 986296 - RNA, 22 nt, Human
aaugcugcaagaggugaaaaga

SEQ ID NO: 986297 - RNA, 22 nt, Human
ccagaggcauguucaaagcaau

SEQ ID NO: 986298 - RNA, 17 nt, Human
ugagaaguaggcaucau

SEQ ID NO: 986299 - RNA, 22 nt, Human
ucugccagugguuuggcccuga

SEQ ID NO: 986300 - RNA, 22 nt, Human
caccucuuugauuugaggcaag

SEQ ID NO: 986301 - RNA, 22 nt, Human
ggaaggagggcggcaaugauga

SEQ ID NO: 986302 - RNA, 23 nt, Human
uaguuauuuucucuguaauuugc

SEQ ID NO: 986303 - RNA, 22 nt, Human
gcguaaggccucuggucucgga

SEQ ID NO: 986304 - RNA, 22 nt, Human
gggcuuggcacaugggcucagc

SEQ ID NO: 986305 - RNA, 22 nt, Human
agggcugccauuucuggcccaa

SEQ ID NO: 986306 - RNA, 22 nt, Human
auagucacucuguuagguguuu

SEQ ID NO: 986307 - RNA, 22 nt, Human
aggcccuguccauggugcugaa

SEQ ID NO: 986308 - RNA, 22 nt, Human
cuuuggaagugaccacaauccu

SEQ ID NO: 986309 - RNA, 22 nt, Human
cugggcagccucacacaauguu

SEQ ID NO: 986310 - RNA, 22 nt, Human
uagagcuagcuucaaaaugcga

SEQ ID NO: 986311 - RNA, 20 nt, Human
gccagcacagggagcaguuc

SEQ ID NO: 986312 - RNA, 22 nt, Human
uggagcccagggugagaaggag

SEQ ID NO: 986313 - RNA, 22 nt, Human
caugggaggucugcaaggugcu

SEQ ID NO: 986314 - RNA, 22 nt, Human
guacauguugguuguuuccagu

SEQ ID NO: 986315 - RNA, 22 nt, Human
gacagggcauggugcagaguuc

SEQ ID NO: 986316 - RNA, 22 nt, Human
guggcugcuaagucuccuuccu

SEQ ID NO: 986317 - RNA, 22 nt, Human
uaacugauauugaaaaacauca

SEQ ID NO: 986318 - RNA, 22 nt, Human
agggaagagcuugcaagaaacc

SEQ ID NO: 986319 - RNA, 17 nt, Human
gagugcugguggagcuc

SEQ ID NO: 986320 - RNA, 22 nt, Human
ucuccuggaagugauuccccug

SEQ ID NO: 986321 - RNA, 22 nt, Human
cgcugccaggauccccugccgg

SEQ ID NO: 986322 - RNA, 22 nt, Human
ggcucuggaaaguguccuugau

SEQ ID NO: 986323 - RNA, 21 nt, Human
cucacaggaugcaguguuacu

SEQ ID NO: 986324 - RNA, 22 nt, Human
ugugaaagucaaauuaauugaa

SEQ ID NO: 986325 - RNA, 22 nt, Human
cucaguuucugacauuaaaauc

SEQ ID NO: 986326 - RNA, 22 nt, Human
gucagugucuuaacagagauua

SEQ ID NO: 986327 - RNA, 22 nt, Human
aggggcugccuggcuuggcacu

SEQ ID NO: 986328 - RNA, 22 nt, Human
gucaucuugcuguuuuagaucu

SEQ ID NO: 986329 - RNA, 22 nt, Human
accagagcuuacaugcuagaaa

SEQ ID NO: 986330 - RNA, 22 nt, Human
ccugggcuucugucuagauguu

SEQ ID NO: 986331 - RNA, 22 nt, Human
agccacagcccacaggacucuu

SEQ ID NO: 986332 - RNA, 22 nt, Human
agucucugccagcuuguccucu

SEQ ID NO: 986333 - RNA, 21 nt, Human
gcagcaguguucuagaauacu

SEQ ID NO: 986334 - RNA, 22 nt, Human
cugccuguuagucuagcaguua

SEQ ID NO: 986335 - RNA, 22 nt, Human
uugcaaauuccaauccaauauu

SEQ ID NO: 986336 - RNA, 22 nt, Human
aagcgccaugguuccugcgcag

SEQ ID NO: 986337 - RNA, 22 nt, Human
agauuuagacugccuuaaucau

SEQ ID NO: 986338 - RNA, 22 nt, Human
aagcagccaccucaucuccacu

SEQ ID NO: 986339 - RNA, 22 nt, Human
uugaaauacugcauuguucagu

SEQ ID NO: 986340 - RNA, 22 nt, Human
guauuagguuggugcaaaauug

SEQ ID NO: 986341 - RNA, 22 nt, Human
ggucugaguggugcugacucag

SEQ ID NO: 986342 - RNA, 23 nt, Human
uucaaaacuggaaaaucagaugc

SEQ ID NO: 986343 - RNA, 22 nt, Human
aauguucaguagaauaggaaug

SEQ ID NO: 986344 - RNA, 22 nt, Human
gcuggagccuucugcucuguug

SEQ ID NO: 986345 - RNA, 22 nt, Human
caaaugcaaaauauaacccugu

SEQ ID NO: 986346 - RNA, 22 nt, Human
uggcacauagcagguacucagu

SEQ ID NO: 986347 - RNA, 22 nt, Human
ccugagugaauucccucacugu

SEQ ID NO: 986348 - RNA, 22 nt, Human
ugggggagauugugcaucucua

SEQ ID NO: 986349 - RNA, 22 nt, Human
gcagcuggacccacacggcuua

SEQ ID NO: 986350 - RNA, 22 nt, Human
ucaggagagaaagaauacaauu

SEQ ID NO: 986351 - RNA, 22 nt, Human
aacaucagaauauccauguugg

SEQ ID NO: 986352 - RNA, 20 nt, Human
gcugccuguuucuguaagua

SEQ ID NO: 986353 - RNA, 22 nt, Human
cuuccugggcaauguucugcuu

SEQ ID NO: 986354 - RNA, 20 nt, Human
ugugcccaauguccagguuc

SEQ ID NO: 986355 - RNA, 23 nt, Human
ucugggcaccuuguugacaugau

SEQ ID NO: 986356 - RNA, 22 nt, Human
ggcagcuuuuaucccugacaga

SEQ ID NO: 986357 - RNA, 20 nt, Human
ggccuuggccucuuugcagc

SEQ ID NO: 986358 - RNA, 22 nt, Human
accuacccuuagaucacaaggg

SEQ ID NO: 986359 - RNA, 22 nt, Human
ucaucaaagucaaagaaugacu

SEQ ID NO: 986360 - RNA, 22 nt, Human
cuggcucacuagcccugcccug

SEQ ID NO: 986361 - RNA, 23 nt, Human
ucugucaccuauggcugcucuuc

SEQ ID NO: 986362 - RNA, 22 nt, Human
acaugucaauuuaguacucuua

SEQ ID NO: 986363 - RNA, 19 nt, Human
cugggccagagcuguccuc

SEQ ID NO: 986364 - RNA, 22 nt, Human
aaaucaguaaauguucauuaac

SEQ ID NO: 986365 - RNA, 22 nt, Human
ggcuucugaaaucucugugcgu

SEQ ID NO: 986366 - RNA, 22 nt, Human
uugcaggggaaggagcagagcu

SEQ ID NO: 986367 - RNA, 22 nt, Human
accucugcaacccuggaauggg

SEQ ID NO: 986368 - RNA, 22 nt, Human
gcuggggagggcgucaaggcca

SEQ ID NO: 986369 - RNA, 22 nt, Human
uagcagugccaggauuuugcug

SEQ ID NO: 986370 - RNA, 22 nt, Human
auagugguuggauaugucagag

SEQ ID NO: 986371 - RNA, 22 nt, Human
agccugagugcuuaggacuguu

SEQ ID NO: 986372 - RNA, 22 nt, Human
acagaggccccgugggagagcc

SEQ ID NO: 986373 - RNA, 22 nt, Human
guccucuggccuuucccaggac

SEQ ID NO: 986374 - RNA, 22 nt, Human
cugcagcuauauuuucccacag

SEQ ID NO: 986375 - RNA, 22 nt, Human
cuggccagacuacacaugugug

SEQ ID NO: 986376 - RNA, 22 nt, Human
aacauuucagcaccugauuccu

SEQ ID NO: 986377 - RNA, 22 nt, Human
agcugguggauuaugcuguaca

SEQ ID NO: 986378 - RNA, 22 nt, Human
cacucugcagcugaagggcugg

SEQ ID NO: 986379 - RNA, 22 nt, Human
agaggcugucccuugcuauucc

SEQ ID NO: 986380 - RNA, 21 nt, Human
aaacugaccuugccugagaca

SEQ ID NO: 986381 - RNA, 22 nt, Human
ucacuguauuugcugaugcaua

SEQ ID NO: 986382 - RNA, 22 nt, Human
ucaacacucuuuggcacaguua

SEQ ID NO: 986383 - RNA, 22 nt, Human
cauuuucucaaugaacccucuu

SEQ ID NO: 986384 - RNA, 22 nt, Human
acaccuuucagguccagacagu

SEQ ID NO: 986385 - RNA, 18 nt, Human
uguuccaaggaaggaauc

SEQ ID NO: 986386 - RNA, 22 nt, Human
cuucuuaaagauuacacaauga

SEQ ID NO: 986387 - RNA, 19 nt, Human
ucaaugcaugaaaucagcc

SEQ ID NO: 986388 - RNA, 22 nt, Human
uacauauagacaguuacucuag

SEQ ID NO: 986389 - RNA, 22 nt, Human
uuugcauuugcaaauaaugaaa

SEQ ID NO: 986390 - RNA, 22 nt, Human
ucuuucucucuaaucaagcaca

SEQ ID NO: 986391 - RNA, 22 nt, Human
guugaaauccuaacccccuagu

SEQ ID NO: 986392 - RNA, 22 nt, Human
aggcagcccacaggacacagga

SEQ ID NO: 986393 - RNA, 22 nt, Human
ccacccagccagaugcaggaag

SEQ ID NO: 986394 - RNA, 22 nt, Human
gcagggacgccagggacagcaa

SEQ ID NO: 986395 - RNA, 22 nt, Human
gcuggucacucugggagcugcu

SEQ ID NO: 986396 - RNA, 22 nt, Human
ugaagcagcuucuuucugucaa

SEQ ID NO: 986397 - RNA, 20 nt, Human
aggcacuggggauagguaag

SEQ ID NO: 986398 - RNA, 22 nt, Human
cucuggaguucucaugaggaac

SEQ ID NO: 986399 - RNA, 22 nt, Human
caaagguauaaguuaauauaca

SEQ ID NO: 986400 - RNA, 22 nt, Human
uuuucauuguaaaucaggaaac

SEQ ID NO: 986401 - RNA, 22 nt, Human
ucaaauaugugauagaagcuaa

SEQ ID NO: 986402 - RNA, 22 nt, Human
cuggcucaccuccgcuccagca

SEQ ID NO: 986403 - RNA, 22 nt, Human
ccgggcgggggcucucgucacc

SEQ ID NO: 986404 - RNA, 22 nt, Human
ucaggccacggcucacugagac

SEQ ID NO: 986405 - RNA, 22 nt, Human
gcugagagcaguguggccuuaa

SEQ ID NO: 986406 - RNA, 22 nt, Human
gcacugaacuuuaaucauuucu

SEQ ID NO: 986407 - RNA, 22 nt, Human
aagugacaccucuucccuuucc

SEQ ID NO: 986408 - RNA, 22 nt, Human
aaucaguuaaauauugaguaca

SEQ ID NO: 986409 - RNA, 22 nt, Human
agauuguagaaacuguagcauu

SEQ ID NO: 986410 - RNA, 22 nt, Human
ucuguuccauguuuuguuccau

SEQ ID NO: 986411 - RNA, 22 nt, Human
ugcugggcuugaaagcugcuaa

SEQ ID NO: 986412 - RNA, 22 nt, Human
ccagaggugccacagaaagagc

SEQ ID NO: 986413 - RNA, 22 nt, Human
agaaugcaagauaaacuuuauu

SEQ ID NO: 986414 - RNA, 22 nt, Human
guccugucccccaaggcugugg

SEQ ID NO: 986415 - RNA, 22 nt, Human
uagaacagaggguugcccagau

SEQ ID NO: 986416 - RNA, 22 nt, Human
guuaggauauggugaaauggag

SEQ ID NO: 986417 - RNA, 22 nt, Human
gccugcuggcuguccauugcag

SEQ ID NO: 986418 - RNA, 22 nt, Human
cuggccuggagccucugggugg

SEQ ID NO: 986419 - RNA, 22 nt, Human
cugccuguuuucugauagauuu

SEQ ID NO: 986420 - RNA, 22 nt, Human
uugaacagcuguuacauuguua

SEQ ID NO: 986421 - RNA, 22 nt, Human
aggauccuguauggagaagcug

SEQ ID NO: 986422 - RNA, 22 nt, Human
ccuggcagcgccgaagcuggcc

SEQ ID NO: 986423 - RNA, 22 nt, Human
ccacagaguuacaaaacaguca

SEQ ID NO: 986424 - RNA, 22 nt, Human
cccaggagauggagguugcagu

SEQ ID NO: 986425 - RNA, 22 nt, Human
cccugagcccauaguugacauu

SEQ ID NO: 986426 - RNA, 22 nt, Human
uuccagaauuuuguucugcuug

SEQ ID NO: 986427 - RNA, 22 nt, Human
ugaauggucacugagcaucugu

SEQ ID NO: 986428 - RNA, 22 nt, Human
agcagagcccuuccauggccuu

SEQ ID NO: 986429 - RNA, 22 nt, Human
aaccaggugacucauggugagc

SEQ ID NO: 986430 - RNA, 22 nt, Human
ccaaaaaguacauuuaggugug

SEQ ID NO: 986431 - RNA, 22 nt, Human
ccagggcuggguuugucggugu

SEQ ID NO: 986432 - RNA, 22 nt, Human
ucauaaaacacaccagguaguu

SEQ ID NO: 986433 - RNA, 22 nt, Human
auucacauguugaagcccuaac

SEQ ID NO: 986434 - RNA, 22 nt, Human
caugcacagugauaucugaaga

SEQ ID NO: 986435 - RNA, 21 nt, Human
acaggcucuggggaugcuggg

SEQ ID NO: 986436 - RNA, 22 nt, Human
gcucccacaaccuucuugcucc

SEQ ID NO: 986437 - RNA, 22 nt, Human
ucucagagugacaaugagaauu

SEQ ID NO: 986438 - RNA, 22 nt, Human
uaugagaaaauaaauaucuguu

SEQ ID NO: 986439 - RNA, 22 nt, Human
gugucacaagagcccaggaaac

SEQ ID NO: 986440 - RNA, 22 nt, Human
cuggcugggagcgagcugcuca

SEQ ID NO: 986441 - RNA, 22 nt, Human
guuauguaugggggccuuauga

SEQ ID NO: 986442 - RNA, 22 nt, Human
uucagcaacucaaaccuauuag

SEQ ID NO: 986443 - RNA, 22 nt, Human
acagaaagaagguguauuugag

SEQ ID NO: 986444 - RNA, 18 nt, Human
uugauaaacaauuucauu

SEQ ID NO: 986445 - RNA, 22 nt, Human
gugcuaggauuacaggcauggg

SEQ ID NO: 986446 - RNA, 22 nt, Human
aggcacugaagugguaaaugua

SEQ ID NO: 986447 - RNA, 22 nt, Human
cuuuggcaaugaaacacaagaa

SEQ ID NO: 986448 - RNA, 22 nt, Human
gccuggagccucagcaaggagg

SEQ ID NO: 986449 - RNA, 22 nt, Human
cugucucucuaggacacugggg

SEQ ID NO: 986450 - RNA, 22 nt, Human
gcucugucauuuugcagacacu

SEQ ID NO: 986451 - RNA, 22 nt, Human
guaagagcacugucuccugcug

SEQ ID NO: 986452 - RNA, 22 nt, Human
cccccuggcaggcuggccucuc

SEQ ID NO: 986453 - RNA, 21 nt, Human
ugcuccuuagcugccccugcc

SEQ ID NO: 986454 - RNA, 22 nt, Human
agggccagcccauaaugccaaa

SEQ ID NO: 986455 - RNA, 22 nt, Human
gccugccuguuggcugaggugc

SEQ ID NO: 986456 - RNA, 22 nt, Human
cccuggaguccuggcaguugau

SEQ ID NO: 986457 - RNA, 23 nt, Human
ccagccucugggucuucauccag

SEQ ID NO: 986458 - RNA, 22 nt, Human
auccuugacacacuccaguacu

SEQ ID NO: 986459 - RNA, 22 nt, Human
cauuucuguucucuuccuguac

SEQ ID NO: 986460 - RNA, 22 nt, Human
cugcucacgccaccguucauca

SEQ ID NO: 986461 - RNA, 22 nt, Human
aaagucauuguaauauaugcua

SEQ ID NO: 986462 - RNA, 21 nt, Human
ccugggccaaauucccuggac

SEQ ID NO: 986463 - RNA, 22 nt, Human
aggggagcuaacaccagagccc

SEQ ID NO: 986464 - RNA, 22 nt, Human
aggaaagggguagguguggacg

SEQ ID NO: 986465 - RNA, 23 nt, Human
aggcagagccaaggucaaaaccc

SEQ ID NO: 986466 - RNA, 22 nt, Human
ugccugggccuucccaccucug

SEQ ID NO: 986467 - RNA, 19 nt, Human
gccugggaugggcagaacu

SEQ ID NO: 986468 - RNA, 22 nt, Human
acacuuuacagcuuccuuugca

SEQ ID NO: 986469 - RNA, 22 nt, Human
aaaugccucugcuguacacaau

SEQ ID NO: 986470 - RNA, 22 nt, Human
aggucagaagugccagggaauu

SEQ ID NO: 986471 - RNA, 22 nt, Human
gccaccaggagcccaguccaaa

SEQ ID NO: 986472 - RNA, 22 nt, Human
aggcucagcugguggugaucgc

SEQ ID NO: 986473 - RNA, 22 nt, Human
cucuccagaucugcugagccag

SEQ ID NO: 986474 - RNA, 22 nt, Human
gcaggggaguggaugauggauu

SEQ ID NO: 986475 - RNA, 22 nt, Human
agaggcugagaaacccucuucu

SEQ ID NO: 986476 - RNA, 17 nt, Human
ucugccgacugccagcu

SEQ ID NO: 986477 - RNA, 22 nt, Human
caggccacaaguuggguucaag

SEQ ID NO: 986478 - RNA, 22 nt, Human
ggcugggccagggccuguggac

SEQ ID NO: 986479 - RNA, 22 nt, Human
uccugggaagagaccugagcau

SEQ ID NO: 986480 - RNA, 22 nt, Human
aggcugccaaagcuucugucuc

SEQ ID NO: 986481 - RNA, 22 nt, Human
agggcacagccuaaagccuaug

SEQ ID NO: 986482 - RNA, 22 nt, Human
uggagcuggaauuugagcugga

SEQ ID NO: 986483 - RNA, 22 nt, Human
uuuaguaaguucacugcaaagc

SEQ ID NO: 986484 - RNA, 22 nt, Human
agucucagccacacagaccuau

SEQ ID NO: 986485 - RNA, 22 nt, Human
aguaggaggcgggagcaugaag

SEQ ID NO: 986486 - RNA, 22 nt, Human
aacucaguuacauauuagaaua

SEQ ID NO: 986487 - RNA, 22 nt, Human
uguauguguauguacauaugca

SEQ ID NO: 986488 - RNA, 18 nt, Human
uacaucuauauaguguuu

SEQ ID NO: 986489 - RNA, 22 nt, Human
gagcugaguuaccuccagauca

SEQ ID NO: 986490 - RNA, 22 nt, Human
cugccuggaaggagcaagggga

SEQ ID NO: 986491 - RNA, 22 nt, Human
cuggcagcuggaggcuagaggc

SEQ ID NO: 986492 - RNA, 22 nt, Human
ugcuugagacacauaugaauuu

SEQ ID NO: 986493 - RNA, 22 nt, Human
ggcagcacugcagcuuguuggg

SEQ ID NO: 986494 - RNA, 19 nt, Human
ugggcuuccccagggcaga

SEQ ID NO: 986495 - RNA, 22 nt, Human
ugggccuguugccugaguccau

SEQ ID NO: 986496 - RNA, 22 nt, Human
aaggcccuggccccagcuucuu

SEQ ID NO: 986497 - RNA, 22 nt, Human
cagcagugugcaggugugcugg

SEQ ID NO: 986498 - RNA, 22 nt, Human
ugccuggaugugcuggccucac

SEQ ID NO: 986499 - RNA, 23 nt, Human
ccuccugggcacaggccugaugg

SEQ ID NO: 986500 - RNA, 22 nt, Human
gauuucaaagguucugcaugcc

SEQ ID NO: 986501 - RNA, 22 nt, Human
aaggcagccgugugacugcaug

SEQ ID NO: 986502 - RNA, 22 nt, Human
agaguguuucagucuuccuaga

SEQ ID NO: 986503 - RNA, 22 nt, Human
uggcucagaagaaaagguaaac

SEQ ID NO: 986504 - RNA, 22 nt, Human
gcugccugccuugccuggagga

SEQ ID NO: 986505 - RNA, 22 nt, Human
acauugaucagccucccaugca

SEQ ID NO: 986506 - RNA, 22 nt, Human
agcagccaggaaucugcagagc

SEQ ID NO: 986507 - RNA, 22 nt, Human
gcugccugaagugucuacacug

SEQ ID NO: 986508 - RNA, 22 nt, Human
gauucugagcugguguuuuacg

SEQ ID NO: 986509 - RNA, 22 nt, Human
ggccugaggcaauagucagaca

SEQ ID NO: 986510 - RNA, 22 nt, Human
ucuuuauuuuaugcuugugcaa

SEQ ID NO: 986511 - RNA, 22 nt, Human
aaaucugguucaguaaguccuc

SEQ ID NO: 986512 - RNA, 22 nt, Human
gcucugggaacugacugccuuc

SEQ ID NO: 986513 - RNA, 22 nt, Human
gggccucugugcagaggggccu

SEQ ID NO: 986514 - RNA, 22 nt, Human
cugccuggagcauucugaaggu

SEQ ID NO: 986515 - RNA, 22 nt, Human
agggcagcuagcuguagaaaga

SEQ ID NO: 986516 - RNA, 22 nt, Human
aggaccuguaccucagcaucua

SEQ ID NO: 986517 - RNA, 22 nt, Human
aagccaggcugcacuugcuggg

SEQ ID NO: 986518 - RNA, 22 nt, Human
uaaaaguggauaagcuguagga

SEQ ID NO: 986519 - RNA, 22 nt, Human
guuuuguugcugcagagcucaa

SEQ ID NO: 986520 - RNA, 22 nt, Human
uaggauaugugaaaucauauua

SEQ ID NO: 986521 - RNA, 22 nt, Human
ugcagcucauugcuggggucug

SEQ ID NO: 986522 - RNA, 23 nt, Human
auggagcugguacuagcuaccuc

SEQ ID NO: 986523 - RNA, 22 nt, Human
acugucuucaaaugaauauauu

SEQ ID NO: 986524 - RNA, 22 nt, Human
gcugcuucucugauggagucca

SEQ ID NO: 986525 - RNA, 22 nt, Human
cuggcugccacuucagggucuu

SEQ ID NO: 986526 - RNA, 22 nt, Human
agcaguggccuggggcucugug

SEQ ID NO: 986527 - RNA, 22 nt, Human
cuggcagcgguuugcagccugg

SEQ ID NO: 986528 - RNA, 22 nt, Human
ugggcucauggcccagcacugg

SEQ ID NO: 986529 - RNA, 22 nt, Human
ggcuucuccccuuugagucuuc

SEQ ID NO: 986530 - RNA, 22 nt, Human
ugcuuccuauccacacaaugcc

SEQ ID NO: 986531 - RNA, 22 nt, Human
ccaggcugggcuacaaguugag

SEQ ID NO: 986532 - RNA, 23 nt, Human
cauguacacacagcuguacagug

SEQ ID NO: 986533 - RNA, 22 nt, Human
aaugaugggaaggagaaaagca

SEQ ID NO: 986534 - RNA, 22 nt, Human
ggagccaggggaccuucacaga

SEQ ID NO: 986535 - RNA, 22 nt, Human
uggccuccccuaacagccucuu

SEQ ID NO: 986536 - RNA, 22 nt, Human
ugccuguccugaggaugagggu

SEQ ID NO: 986537 - RNA, 22 nt, Human
ucccacugugaauccaaggccu

SEQ ID NO: 986538 - RNA, 22 nt, Human
uggccugcagaggcuguggggc

SEQ ID NO: 986539 - RNA, 23 nt, Human
aguuccagaaaaaugcucaagca

SEQ ID NO: 986540 - RNA, 22 nt, Human
aaauguagaccuauagggaccu

SEQ ID NO: 986541 - RNA, 22 nt, Human
acagagcauauaaagugcuuug

SEQ ID NO: 986542 - RNA, 22 nt, Human
uauguacauaacaugaaaugca

SEQ ID NO: 986543 - RNA, 22 nt, Human
aacuccagugucagcugcaaug

SEQ ID NO: 986544 - RNA, 22 nt, Human
ucacauacacuaggauauuuuu

SEQ ID NO: 986545 - RNA, 22 nt, Human
cuguuuauagcagagcaagccu

SEQ ID NO: 986546 - RNA, 22 nt, Human
gcaguggauccaaugguaucuu

SEQ ID NO: 986547 - RNA, 22 nt, Human
aauguguguauuucuaggcgag

SEQ ID NO: 986548 - RNA, 22 nt, Human
ggugaaggcacaagagggcaag

SEQ ID NO: 986549 - RNA, 22 nt, Human
aaaucaguucucccuuucuuca

SEQ ID NO: 986550 - RNA, 22 nt, Human
agaagcugccuacaugaccagc

SEQ ID NO: 986551 - RNA, 22 nt, Human
uggcagcauguuauguaaggaa

SEQ ID NO: 986552 - RNA, 22 nt, Human
cgcaccacugaauuccagccug

SEQ ID NO: 986553 - RNA, 21 nt, Human
cucucugcuuaugaauaguga

SEQ ID NO: 986554 - RNA, 23 nt, Human
caugggagugagaaugccagcuc

SEQ ID NO: 986555 - RNA, 22 nt, Human
gucagcugucuccccagagugg

SEQ ID NO: 986556 - RNA, 22 nt, Human
uagaaauguuagauguauugag

SEQ ID NO: 986557 - RNA, 22 nt, Human
uggcucaggauaauuuucccaa

SEQ ID NO: 986558 - RNA, 22 nt, Human
auaaggcagugacuucaucuau

SEQ ID NO: 986559 - RNA, 22 nt, Human
uacauuccacuagugacuggcg

SEQ ID NO: 986560 - RNA, 19 nt, Human
cugaggcccauguaccaug

SEQ ID NO: 986561 - RNA, 21 nt, Human
agacagaacaacugcucucca

SEQ ID NO: 986562 - RNA, 22 nt, Human
gccuguccacuaaacagccaag

SEQ ID NO: 986563 - RNA, 22 nt, Human
cuggcucagugccuucagaagu

SEQ ID NO: 986564 - RNA, 19 nt, Human
agugucaucagcuacucag

SEQ ID NO: 986565 - RNA, 22 nt, Human
aaaugaccagaauacaggcuuc

SEQ ID NO: 986566 - RNA, 21 nt, Human
uggccucccacacuuccaugg

SEQ ID NO: 986567 - RNA, 22 nt, Human
acaaagucuuuuacaacaguca

SEQ ID NO: 986568 - RNA, 22 nt, Human
ccagccaguccagcauuggugu

SEQ ID NO: 986569 - RNA, 22 nt, Human
cuuggcagcuuuuggaggagcc

SEQ ID NO: 986570 - RNA, 22 nt, Human
uggcucaggcuugaaaauagau

SEQ ID NO: 986571 - RNA, 22 nt, Human
ugccucuguggaaauggugguc

SEQ ID NO: 986572 - RNA, 22 nt, Human
uguauguaaaguuuguaauaga

SEQ ID NO: 986573 - RNA, 22 nt, Human
aaagauuuaugaaguucaauua

SEQ ID NO: 986574 - RNA, 22 nt, Human
agaggcuguuacacucccagau

SEQ ID NO: 986575 - RNA, 22 nt, Human
agcaauauuucagcuagcaggu

SEQ ID NO: 986576 - RNA, 22 nt, Human
uggagcugguaaacagugacau

SEQ ID NO: 986577 - RNA, 19 nt, Human
gcugugccucucuccugcu

SEQ ID NO: 986578 - RNA, 22 nt, Human
uccuggccuagcucacccugga

SEQ ID NO: 986579 - RNA, 22 nt, Human
ccagcucucagcgggagacuca

SEQ ID NO: 986580 - RNA, 22 nt, Human
aggagucauaaaugugaacaaa

SEQ ID NO: 986581 - RNA, 22 nt, Human
cugcccugagggccuguguguu

SEQ ID NO: 986582 - RNA, 22 nt, Human
acacugcagaugaaagcauaag

SEQ ID NO: 986583 - RNA, 20 nt, Human
aaaauauguauaacucuucu

SEQ ID NO: 986584 - RNA, 22 nt, Human
uuguaacagguacuaaauaacu

SEQ ID NO: 986585 - RNA, 22 nt, Human
aggcagaggaaggguggauuug

SEQ ID NO: 986586 - RNA, 22 nt, Human
uggccuguggcuuaaggucugu

SEQ ID NO: 986587 - RNA, 22 nt, Human
uuugcaaaaugucuuguguuag

SEQ ID NO: 986588 - RNA, 22 nt, Human
uuuuccucugagcuuugaauaa

SEQ ID NO: 986589 - RNA, 22 nt, Human
gcucugagauugagccuuuggu

SEQ ID NO: 986590 - RNA, 22 nt, Human
cuggagccugcaguuuucacuu

SEQ ID NO: 986591 - RNA, 22 nt, Human
ccaggcagagggauccccaucc

SEQ ID NO: 986592 - RNA, 22 nt, Human
auuuauuauugugguuacuucu

SEQ ID NO: 986593 - RNA, 20 nt, Human
ucugugugccaucaccuaac

SEQ ID NO: 986594 - RNA, 22 nt, Human
ccaggagcuggagggugcagug

SEQ ID NO: 986595 - RNA, 22 nt, Human
augaaaacuuuagccucauuag

SEQ ID NO: 986596 - RNA, 22 nt, Human
uggccaagaaugauaugugaag

SEQ ID NO: 986597 - RNA, 22 nt, Human
ucugagccaccugccagugcug

SEQ ID NO: 986598 - RNA, 22 nt, Human
ccugccagcccgcguucaugcc

SEQ ID NO: 986599 - RNA, 22 nt, Human
gggagggacacaaagaguuccc

SEQ ID NO: 986600 - RNA, 22 nt, Human
uagaaaugauugguugagcucu

SEQ ID NO: 986601 - RNA, 22 nt, Human
agcaugaaagcauaggacaguc

SEQ ID NO: 986602 - RNA, 22 nt, Human
cugcugucuuuauuucacugcu

SEQ ID NO: 986603 - RNA, 22 nt, Human
gcacagaagagcuuuggaauga

SEQ ID NO: 986604 - RNA, 22 nt, Human
ugagguaggugguaagagauac

SEQ ID NO: 986605 - RNA, 22 nt, Human
guggccagcaagugcugccucu

SEQ ID NO: 986606 - RNA, 22 nt, Human
caggaaagggaugggcugccac

SEQ ID NO: 986607 - RNA, 22 nt, Human
aagaauguucuuguagucauga

SEQ ID NO: 986608 - RNA, 22 nt, Human
cuggccuuuagccccagugucu

SEQ ID NO: 986609 - RNA, 22 nt, Human
ccuccuggagcauuggugagga

SEQ ID NO: 986610 - RNA, 22 nt, Human
caguacuucuuggaaacuggau

SEQ ID NO: 986611 - RNA, 21 nt, Human
uggcugccuacaugcugcagg

SEQ ID NO: 986612 - RNA, 22 nt, Human
ggcauggcuggguucuggugag

SEQ ID NO: 986613 - RNA, 22 nt, Human
uaaagacaugguguaggugaac

SEQ ID NO: 986614 - RNA, 20 nt, Human
uaacagaaguagaagugggu

SEQ ID NO: 986615 - RNA, 22 nt, Human
ccccuuccacagugcuuccuaa

SEQ ID NO: 986616 - RNA, 22 nt, Human
ucaaaacaaucauuggaugugc

SEQ ID NO: 986617 - RNA, 22 nt, Human
guuuauuauucaacuucauguu

SEQ ID NO: 986618 - RNA, 22 nt, Human
gccagcaguauguccuggcagu

SEQ ID NO: 986619 - RNA, 22 nt, Human
ucuucuuccuccacagggccca

SEQ ID NO: 986620 - RNA, 22 nt, Human
agucaguguucuccggagaggc

SEQ ID NO: 986621 - RNA, 22 nt, Human
acagccagaggugguccugggu

SEQ ID NO: 986622 - RNA, 22 nt, Human
cguggccuuugagugagcuccc

SEQ ID NO: 986623 - RNA, 22 nt, Human
ucuuuacacaagacaagaauaa

SEQ ID NO: 986624 - RNA, 22 nt, Human
gcuggccugcgagggcaggcug

SEQ ID NO: 986625 - RNA, 22 nt, Human
ugcagccaucgcagagucugua

SEQ ID NO: 986626 - RNA, 22 nt, Human
agaaaugacacacaugagacau

SEQ ID NO: 986627 - RNA, 22 nt, Human
caggugggagccacagcguaca

SEQ ID NO: 986628 - RNA, 19 nt, Human
auaaauaaaaagugggaga

SEQ ID NO: 986629 - RNA, 22 nt, Human
aguuuaauauccuucaacuuuc

SEQ ID NO: 986630 - RNA, 22 nt, Human
aggguggagggagucccugagc

SEQ ID NO: 986631 - RNA, 21 nt, Human
ucacauuucucauggguaaau

SEQ ID NO: 986632 - RNA, 21 nt, Human
auuuggcaaaggcgaugcaca

SEQ ID NO: 986633 - RNA, 22 nt, Human
agcagagucugugugcacuuua

SEQ ID NO: 986634 - RNA, 23 nt, Human
uacauuguggauggaguccuggg

SEQ ID NO: 986635 - RNA, 22 nt, Human
cugaggcucaagggcagguggg

SEQ ID NO: 986636 - RNA, 22 nt, Human
gggccuggcaugcagccccguu

SEQ ID NO: 986637 - RNA, 22 nt, Human
ccagggcauguaacuaauggug

SEQ ID NO: 986638 - RNA, 22 nt, Human
ucccagaggaaauggcagcuga

SEQ ID NO: 986639 - RNA, 22 nt, Human
uuuaaauaggacuccugggggu

SEQ ID NO: 986640 - RNA, 22 nt, Human
gcugggagucgcgucuguggcc

SEQ ID NO: 986641 - RNA, 22 nt, Human
agcuucuggaaggcaaggcuug

SEQ ID NO: 986642 - RNA, 22 nt, Human
ugacacaggcagcucccagcac

SEQ ID NO: 986643 - RNA, 22 nt, Human
ggcucuggucagugaggggccu

SEQ ID NO: 986644 - RNA, 22 nt, Human
uccaagggaaugugggcaaugc

SEQ ID NO: 986645 - RNA, 22 nt, Human
gccuggugugcgccgcgcagcu

SEQ ID NO: 986646 - RNA, 22 nt, Human
aaggguggauuucugagcucua

SEQ ID NO: 986647 - RNA, 22 nt, Human
ugcugucugcaacaguacuaca

SEQ ID NO: 986648 - RNA, 22 nt, Human
uuuuccuauaugcaaagaaugc

SEQ ID NO: 986649 - RNA, 22 nt, Human
cucaggauugugccuagggaga

SEQ ID NO: 986650 - RNA, 22 nt, Human
gcauuauuaauagcugcaugag

SEQ ID NO: 986651 - RNA, 22 nt, Human
ccccuuccaggaagcagaaucg

SEQ ID NO: 986652 - RNA, 21 nt, Human
ccuccaggagcagagcccuga

SEQ ID NO: 986653 - RNA, 22 nt, Human
acagagcacauagauuggaguu

SEQ ID NO: 986654 - RNA, 22 nt, Human
uuugucagucaugucugcuuuu

SEQ ID NO: 986655 - RNA, 22 nt, Human
gccaggugcauggcugagucuc

SEQ ID NO: 986656 - RNA, 20 nt, Human
ggccuuggguuucgccuguu

SEQ ID NO: 986657 - RNA, 22 nt, Human
ugucugguggguugacaggcag

SEQ ID NO: 986658 - RNA, 22 nt, Human
aggaucuugcuguagaggauag

SEQ ID NO: 986659 - RNA, 22 nt, Human
caggagugcagguggugaggca

SEQ ID NO: 986660 - RNA, 22 nt, Human
ggcuuccuaauacucccuacac

SEQ ID NO: 986661 - RNA, 22 nt, Human
gguucacacuaagcuuaagugg

SEQ ID NO: 986662 - RNA, 22 nt, Human
uggcagagucucuccuuuccag

SEQ ID NO: 986663 - RNA, 22 nt, Human
ggguccagcuacaucagggugg

SEQ ID NO: 986664 - RNA, 22 nt, Human
aagggcaggcacccacccucac

SEQ ID NO: 986665 - RNA, 22 nt, Human
ugucaucugauauuacuuauag

SEQ ID NO: 986666 - RNA, 23 nt, Human
guggagccacaucacaggcuccu

SEQ ID NO: 986667 - RNA, 22 nt, Human
uagacacaucaaguauaguuaa

SEQ ID NO: 986668 - RNA, 22 nt, Human
agagaugucgccuugcccaggg

SEQ ID NO: 986669 - RNA, 22 nt, Human
ugcagcccuuccuuccucuggg

SEQ ID NO: 986670 - RNA, 22 nt, Human
uucaaaggcaggauagcagcug

SEQ ID NO: 986671 - RNA, 22 nt, Human
auggggagagaagggcugagcu

SEQ ID NO: 986672 - RNA, 23 nt, Human
uggccaagauaaucucaguuuuc

SEQ ID NO: 986673 - RNA, 22 nt, Human
augcacagcagugaguucagug

SEQ ID NO: 986674 - RNA, 22 nt, Human
agugugcugcuuaaacaguugu

SEQ ID NO: 986675 - RNA, 22 nt, Human
gagacauggcaaaagcacuggu

SEQ ID NO: 986676 - RNA, 22 nt, Human
cucugggcuuguugaccugcac

SEQ ID NO: 986677 - RNA, 22 nt, Human
auggcucauuuaucuugcagcc

SEQ ID NO: 986678 - RNA, 22 nt, Human
acagagccaaaaggacauagua

SEQ ID NO: 986679 - RNA, 22 nt, Human
acuggccaggcgaaccacacug

SEQ ID NO: 986680 - RNA, 17 nt, Human
ugaagaugcauggcagc

SEQ ID NO: 986681 - RNA, 22 nt, Human
gcaguggggaaugcuggggaga

SEQ ID NO: 986682 - RNA, 22 nt, Human
ucugagcccucuuuugcagccc

SEQ ID NO: 986683 - RNA, 22 nt, Human
agugugugcaugcauucgugca

SEQ ID NO: 986684 - RNA, 22 nt, Human
ggggcccagcaccccuccucgc

SEQ ID NO: 986685 - RNA, 22 nt, Human
uuaauaaaguaugaauuggaaa

SEQ ID NO: 986686 - RNA, 22 nt, Human
gcagcuguggguuccaagucua

SEQ ID NO: 986687 - RNA, 22 nt, Human
aggaaaaucgagucuggaggca

SEQ ID NO: 986688 - RNA, 22 nt, Human
cacagggcuaaaugaaggguug

SEQ ID NO: 986689 - RNA, 22 nt, Human
ugucccaguuuugcagguuaga

SEQ ID NO: 986690 - RNA, 22 nt, Human
acuguguggaaauuugugaggg

SEQ ID NO: 986691 - RNA, 22 nt, Human
aaaugugucaguuucauucucu

SEQ ID NO: 986692 - RNA, 17 nt, Human
cagcucugcaucuuccu

SEQ ID NO: 986693 - RNA, 22 nt, Human
gagcugcugguugcuggugccu

SEQ ID NO: 986694 - RNA, 22 nt, Human
ugucccagucaaggcugucauc

SEQ ID NO: 986695 - RNA, 22 nt, Human
ugccuugguucucuacuuggag

SEQ ID NO: 986696 - RNA, 22 nt, Human
gaggugggagggcagucccuaa

SEQ ID NO: 986697 - RNA, 22 nt, Human
agaguguaauaagggcaagggc

SEQ ID NO: 986698 - RNA, 22 nt, Human
gccuucccacccugcgaggcug

SEQ ID NO: 986699 - RNA, 22 nt, Human
auguguaggugaaucgaggcug

SEQ ID NO: 986700 - RNA, 22 nt, Human
cucccuggcuuuguccugaggc

SEQ ID NO: 986701 - RNA, 23 nt, Human
acagagaucuugacuuguaugga

SEQ ID NO: 986702 - RNA, 22 nt, Human
aagagcauauuaauaguggaga

SEQ ID NO: 986703 - RNA, 22 nt, Human
ugccucuguugagccuuggcug

SEQ ID NO: 986704 - RNA, 22 nt, Human
gucacacucagaaugacuagag

SEQ ID NO: 986705 - RNA, 19 nt, Human
ugacaggcuguugccuuga

SEQ ID NO: 986706 - RNA, 22 nt, Human
ccacccuuggguucggaggccg

SEQ ID NO: 986707 - RNA, 22 nt, Human
agcugcucaggagagccagguc

SEQ ID NO: 986708 - RNA, 22 nt, Human
agaaugcaguuugaaauaaggu

SEQ ID NO: 986709 - RNA, 22 nt, Human
uccuucaguuaucacaguacug

SEQ ID NO: 986710 - RNA, 22 nt, Human
ugcagggcuacaggacuacaac

SEQ ID NO: 986711 - RNA, 22 nt, Human
gcacugaaaauguuggauucca

SEQ ID NO: 986712 - RNA, 22 nt, Human
gaguggagcaaaagagguagau

SEQ ID NO: 986713 - RNA, 22 nt, Human
ccuggccaggcuccaaguacug

SEQ ID NO: 986714 - RNA, 22 nt, Human
ucugagagagggucagaugcua

SEQ ID NO: 986715 - RNA, 23 nt, Human
agggcacugaagcuggaauuggg

SEQ ID NO: 986716 - RNA, 22 nt, Human
aaaagguagauucuccuucuau

SEQ ID NO: 986717 - RNA, 19 nt, Human
cugagcagcggcagcacuu

SEQ ID NO: 986718 - RNA, 22 nt, Human
cccugggacccgcugcagaggc

SEQ ID NO: 986719 - RNA, 22 nt, Human
agcaccuguggcucaugcucgu

SEQ ID NO: 986720 - RNA, 22 nt, Human
cuggcucuucagugcuugguuc

SEQ ID NO: 986721 - RNA, 22 nt, Human
uggcucagcagguuagaaacua

SEQ ID NO: 986722 - RNA, 22 nt, Human
ccacagagagugucagccuuug

SEQ ID NO: 986723 - RNA, 22 nt, Human
ugcugccuuagcagccaggcaa

SEQ ID NO: 986724 - RNA, 22 nt, Human
uccucaggagagcuccuaugcc

SEQ ID NO: 986725 - RNA, 22 nt, Human
aaaacagacagccaguguagag

SEQ ID NO: 986726 - RNA, 22 nt, Human
ucaccuuagcuagaggaagaga

SEQ ID NO: 986727 - RNA, 22 nt, Human
uuagcucagaaaauuuaaacuu

SEQ ID NO: 986728 - RNA, 22 nt, Human
gggcagcagaggaucccuuaau

SEQ ID NO: 986729 - RNA, 22 nt, Human
aggcucaguuugguuuccauug

SEQ ID NO: 986730 - RNA, 22 nt, Human
ugcugccaaaugcgagcucugu

SEQ ID NO: 986731 - RNA, 22 nt, Human
agaauuagucacaauuauagga

SEQ ID NO: 986732 - RNA, 22 nt, Human
uucuuaggacuaguauagcaug

SEQ ID NO: 986733 - RNA, 23 nt, Human
agacaguggccgagagguacuag

SEQ ID NO: 986734 - RNA, 22 nt, Human
ccaggccuguguuguguggagg

SEQ ID NO: 986735 - RNA, 22 nt, Human
uagaaaauagggccuguggagc

SEQ ID NO: 986736 - RNA, 22 nt, Human
uuggccaagugguuaaucucca

SEQ ID NO: 986737 - RNA, 22 nt, Human
uucuggaguauuccuggcaccu

SEQ ID NO: 986738 - RNA, 19 nt, Human
aggugaugugacucuagaa

SEQ ID NO: 986739 - RNA, 22 nt, Human
gccaccucuuugucucugccgc

SEQ ID NO: 986740 - RNA, 22 nt, Human
uauguacauggagagcaauuga

SEQ ID NO: 986741 - RNA, 22 nt, Human
agucucugcugguugugccuau

SEQ ID NO: 986742 - RNA, 22 nt, Human
uacauuaacuuacguccacaug

SEQ ID NO: 986743 - RNA, 22 nt, Human
agcagagccagaauuggaccag

SEQ ID NO: 986744 - RNA, 22 nt, Human
aaaauguaaagcuugaguguag

SEQ ID NO: 986745 - RNA, 22 nt, Human
auguaguauuuggaaauguaaa

SEQ ID NO: 986746 - RNA, 22 nt, Human
ugaggcaggaguucaggcugcg

SEQ ID NO: 986747 - RNA, 21 nt, Human
uucuuuccccagaggacuaaa

SEQ ID NO: 986748 - RNA, 22 nt, Human
gcuucauuacugacagucugug

SEQ ID NO: 986749 - RNA, 22 nt, Human
cuugaucuacauagugaaaccc

SEQ ID NO: 986750 - RNA, 22 nt, Human
uucuuacuaguauguuucagca

SEQ ID NO: 986751 - RNA, 22 nt, Human
guguaauuauauaaagaucuac

SEQ ID NO: 986752 - RNA, 23 nt, Human
ucaguuuuggcuguucaguguug

SEQ ID NO: 986753 - RNA, 22 nt, Human
aggcagagaaaaaccagauaug

SEQ ID NO: 986754 - RNA, 22 nt, Human
ucccuggagauaacuucuggga

SEQ ID NO: 986755 - RNA, 22 nt, Human
agcagcugggcucagagcuggg

SEQ ID NO: 986756 - RNA, 18 nt, Human
ugcucuggucucacuugg

SEQ ID NO: 986757 - RNA, 22 nt, Human
ccagcagagcauggggaggaag

SEQ ID NO: 986758 - RNA, 22 nt, Human
acagcauucaauaaauaauaac

SEQ ID NO: 986759 - RNA, 22 nt, Human
cuuacauugucuuaguuuucaa

SEQ ID NO: 986760 - RNA, 22 nt, Human
cugcccuguuuggacagcccgg

SEQ ID NO: 986761 - RNA, 22 nt, Human
gggccugggaacuugcauuuag

SEQ ID NO: 986762 - RNA, 22 nt, Human
gugggacucuucuuuggcagug

SEQ ID NO: 986763 - RNA, 22 nt, Human
ggagcugggguuggcaucuucc

SEQ ID NO: 986764 - RNA, 22 nt, Human
gggaucagcaagccacugcacc

SEQ ID NO: 986765 - RNA, 22 nt, Human
aagaaauuaaugugccauuacu

SEQ ID NO: 986766 - RNA, 22 nt, Human
gcagcaugagcuauacaaagua

SEQ ID NO: 986767 - RNA, 22 nt, Human
cagcugucuaaguugagcagga

SEQ ID NO: 986768 - RNA, 22 nt, Human
caugggagcuaucuccaucacu

SEQ ID NO: 986769 - RNA, 22 nt, Human
ccugcuucagggaugauggcac

SEQ ID NO: 986770 - RNA, 22 nt, Human
aaaagagguuaaccaggugugu

SEQ ID NO: 986771 - RNA, 22 nt, Human
cccauggcuuaggagggagugu

SEQ ID NO: 986772 - RNA, 22 nt, Human
agucagcagccuggccaggaga

SEQ ID NO: 986773 - RNA, 20 nt, Human
ccaagagcaugcaugaggaa

SEQ ID NO: 986774 - RNA, 22 nt, Human
gccuggaggaauguagcugagg

SEQ ID NO: 986775 - RNA, 22 nt, Human
gcugccaguaguuggagcucca

SEQ ID NO: 986776 - RNA, 21 nt, Human
ugcuggccucaagggugacuu

SEQ ID NO: 986777 - RNA, 22 nt, Human
ggaggaccccagcagcucccca

SEQ ID NO: 986778 - RNA, 22 nt, Human
aagugguagacaaagauaauug

SEQ ID NO: 986779 - RNA, 22 nt, Human
ugcaauaacuacuuuaauguug

SEQ ID NO: 986780 - RNA, 22 nt, Human
uaaggcacuucaauguuuagaa

SEQ ID NO: 986781 - RNA, 22 nt, Human
aggcagaauguuggaaaggaag

SEQ ID NO: 986782 - RNA, 22 nt, Human
uguccucaaggagcuucagucu

SEQ ID NO: 986783 - RNA, 22 nt, Human
aguguuucccaguaggaugaaa

SEQ ID NO: 986784 - RNA, 22 nt, Human
ggcccaaggcccaggucgagcu

SEQ ID NO: 986785 - RNA, 22 nt, Human
gaaauauuacaguggaggggau

SEQ ID NO: 986786 - RNA, 23 nt, Human
uuccuggcagguacaacuuuuac

SEQ ID NO: 986787 - RNA, 22 nt, Human
cuccucuggcuuccuggaggca

SEQ ID NO: 986788 - RNA, 21 nt, Human
ucaggggcuguguuuuccauc

SEQ ID NO: 986789 - RNA, 22 nt, Human
agacuuugagcucuuagagaag

SEQ ID NO: 986790 - RNA, 20 nt, Human
ugggcagcacugcuggcugg

SEQ ID NO: 986791 - RNA, 22 nt, Human
cagcuuugcccuuugcccaauc

SEQ ID NO: 986792 - RNA, 22 nt, Human
ugaagcagauggucuggucauu

SEQ ID NO: 986793 - RNA, 22 nt, Human
gagccugggacugggggucaug

SEQ ID NO: 986794 - RNA, 22 nt, Human
ggcaggagauaaaauauuaguu

SEQ ID NO: 986795 - RNA, 22 nt, Human
aacucuggagcacgcccuggcc

SEQ ID NO: 986796 - RNA, 22 nt, Human
ccagggcaggggcuggaguuca

SEQ ID NO: 986797 - RNA, 22 nt, Human
uauugaaauccauuacguucuu

SEQ ID NO: 986798 - RNA, 22 nt, Human
ucagaaauuuucucaguaguuc

SEQ ID NO: 986799 - RNA, 22 nt, Human
aaagagcuaacauugccgagau

SEQ ID NO: 986800 - RNA, 20 nt, Human
ccucucugaagaggucaucu

SEQ ID NO: 986801 - RNA, 22 nt, Human
gagagcuggguucaaguagcug

SEQ ID NO: 986802 - RNA, 22 nt, Human
agucauguguucaucuuucauu

SEQ ID NO: 986803 - RNA, 22 nt, Human
cugcacagagcagggcagacac

SEQ ID NO: 986804 - RNA, 22 nt, Human
gagagugagauaauuucacaua

SEQ ID NO: 986805 - RNA, 18 nt, Human
caggucagccuggccuca

SEQ ID NO: 986806 - RNA, 22 nt, Human
uccuugaauccuagcauccuau

SEQ ID NO: 986807 - RNA, 22 nt, Human
aggccuccuggcuccaggccuu

SEQ ID NO: 986808 - RNA, 22 nt, Human
uggcucuggcgugaagcccaga

SEQ ID NO: 986809 - RNA, 22 nt, Human
ggcuucucucccccagcuccac

SEQ ID NO: 986810 - RNA, 23 nt, Human
uggcucugagcuuccugguggcc

SEQ ID NO: 986811 - RNA, 22 nt, Human
cauugcacgggcgucugucugu

SEQ ID NO: 986812 - RNA, 22 nt, Human
acuuucucaaaucagacuuuaa

SEQ ID NO: 986813 - RNA, 22 nt, Human
ugugugcagccucugucuuugg

SEQ ID NO: 986814 - RNA, 22 nt, Human
gggcucugggauucagagcaag

SEQ ID NO: 986815 - RNA, 22 nt, Human
cagggagaaaucuccaggaggu

SEQ ID NO: 986816 - RNA, 22 nt, Human
auccaguuuaugucauauucuu

SEQ ID NO: 986817 - RNA, 21 nt, Human
ggccuuggcgggggccgaauu

SEQ ID NO: 986818 - RNA, 22 nt, Human
ucagugcuucggcgagcaccua

SEQ ID NO: 986819 - RNA, 23 nt, Human
ccagcuccgugagccucgggcuc

SEQ ID NO: 986820 - RNA, 22 nt, Human
aaaugaacaguugcauucucug

SEQ ID NO: 986821 - RNA, 22 nt, Human
auuagagaaauguugccaagau

SEQ ID NO: 986822 - RNA, 20 nt, Human
cagcccuccaguggaggcag

SEQ ID NO: 986823 - RNA, 22 nt, Human
gcagagccagaauggccaggac

SEQ ID NO: 986824 - RNA, 22 nt, Human
cccuggguucuggcugggcugc

SEQ ID NO: 986825 - RNA, 22 nt, Human
cagagccagaacuagaccuugu

SEQ ID NO: 986826 - RNA, 22 nt, Human
uucagauaaacuacaaauaauu

SEQ ID NO: 986827 - RNA, 22 nt, Human
ucucuucuuguguuuuccugcc

SEQ ID NO: 986828 - RNA, 22 nt, Human
gccaggcugcuggcugcugucc

SEQ ID NO: 986829 - RNA, 22 nt, Human
cugcaagauuggaagaugcaau

SEQ ID NO: 986830 - RNA, 22 nt, Human
cugcugagcaucagggcugccc

SEQ ID NO: 986831 - RNA, 22 nt, Human
ccagccuucugagcugccugga

SEQ ID NO: 986832 - RNA, 22 nt, Human
ccacugggcguuucuguccaau

SEQ ID NO: 986833 - RNA, 20 nt, Human
ugccaugguaacagagugug

SEQ ID NO: 986834 - RNA, 22 nt, Human
uucuuaagcaccuaaaaagugg

SEQ ID NO: 986835 - RNA, 22 nt, Human
cagaggcugaugugggaugggc

SEQ ID NO: 986836 - RNA, 22 nt, Human
uccucagggaagaugagccuca

SEQ ID NO: 986837 - RNA, 22 nt, Human
auuauuagacuuauaugguagu

SEQ ID NO: 986838 - RNA, 22 nt, Human
aaagucauugcuguuaucaaug

SEQ ID NO: 986839 - RNA, 22 nt, Human
uuguuaaaaugcauauucuggu

SEQ ID NO: 986840 - RNA, 22 nt, Human
ucuggcuccacucugugcaugc

SEQ ID NO: 986841 - RNA, 22 nt, Human
cuucuaggcuucucagggggca

SEQ ID NO: 986842 - RNA, 22 nt, Human
ugagccugcaauaagcacagcc

SEQ ID NO: 986843 - RNA, 22 nt, Human
ccagcccuugcugaaggguggc

SEQ ID NO: 986844 - RNA, 22 nt, Human
aaggcccuggcaggaagcagga

SEQ ID NO: 986845 - RNA, 22 nt, Human
agucucugcacaguaagaagca

SEQ ID NO: 986846 - RNA, 22 nt, Human
ugucuucaguaaaauacacuau

SEQ ID NO: 986847 - RNA, 22 nt, Human
gggccuccggggugagcugugg

SEQ ID NO: 986848 - RNA, 22 nt, Human
gggcucuggaaggugcaccaug

SEQ ID NO: 986849 - RNA, 22 nt, Human
gagcucauccccaugguccguc

SEQ ID NO: 986850 - RNA, 22 nt, Human
uaacagaaacagauaaguguaa

SEQ ID NO: 986851 - RNA, 22 nt, Human
ggagccuggcaaugcugcgucc

SEQ ID NO: 986852 - RNA, 22 nt, Human
cccagccucuguuugcuccucu

SEQ ID NO: 986853 - RNA, 22 nt, Human
gggcagagaaauggacaguugg

SEQ ID NO: 986854 - RNA, 22 nt, Human
uucaaucauuuuuacauagucc

SEQ ID NO: 986855 - RNA, 22 nt, Human
caucaguguggcaguucacugu

SEQ ID NO: 986856 - RNA, 22 nt, Human
agcuggccuucggugucacugg

SEQ ID NO: 986857 - RNA, 22 nt, Human
acagagguguguguaggacagu

SEQ ID NO: 986858 - RNA, 22 nt, Human
guucacaucacuucacugaacc

SEQ ID NO: 986859 - RNA, 22 nt, Human
cugcucugcagcuuggacuccc

SEQ ID NO: 986860 - RNA, 22 nt, Human
gcugcccugucugcagcaggac

SEQ ID NO: 986861 - RNA, 22 nt, Human
ccuccagguguuacauaugacu

SEQ ID NO: 986862 - RNA, 23 nt, Human
aggcuuccuaucuuagagcuggg

SEQ ID NO: 986863 - RNA, 22 nt, Human
uuuguaaagucuguucugaguu

SEQ ID NO: 986864 - RNA, 18 nt, Human
cacaggcucccagugagg

SEQ ID NO: 986865 - RNA, 22 nt, Human
cuggcucccagcuuucagggag

SEQ ID NO: 986866 - RNA, 22 nt, Human
gccuggugguauccuggcaaga

SEQ ID NO: 986867 - RNA, 22 nt, Human
uagucuuuuuaauaaauaaugc

SEQ ID NO: 986868 - RNA, 22 nt, Human
cucugagcagaggccguggcua

SEQ ID NO: 986869 - RNA, 22 nt, Human
ucacacgugagguucuauccug

SEQ ID NO: 986870 - RNA, 22 nt, Human
cuuccuggccauugccauggca

SEQ ID NO: 986871 - RNA, 22 nt, Human
cagucccagacccagaaggugg

SEQ ID NO: 986872 - RNA, 22 nt, Human
aguauguauuuuauacuuacag

SEQ ID NO: 986873 - RNA, 20 nt, Human
gcugcucuccacggucugca

SEQ ID NO: 986874 - RNA, 20 nt, Human
uccaggagaacugggagccg

SEQ ID NO: 986875 - RNA, 22 nt, Human
gcccucugcuggccucaccucg

SEQ ID NO: 986876 - RNA, 22 nt, Human
ucuuuuaaaagcccugcugucu

SEQ ID NO: 986877 - RNA, 22 nt, Human
gcucaggaaggcucaaccagga

SEQ ID NO: 986878 - RNA, 22 nt, Human
aaucagaauuuauugaaucuuu

SEQ ID NO: 986879 - RNA, 22 nt, Human
acuccagguuuuuucacugaag

SEQ ID NO: 986880 - RNA, 22 nt, Human
ggucauugucagagccuguacu

SEQ ID NO: 986881 - RNA, 22 nt, Human
aucaaaguccaucagaagguag

SEQ ID NO: 986882 - RNA, 22 nt, Human
cagagugaaauaggggaucaag

SEQ ID NO: 986883 - RNA, 22 nt, Human
accuuuuuucagaacucuaaag

SEQ ID NO: 986884 - RNA, 23 nt, Human
agaggcaggaguggcuugcccgg

SEQ ID NO: 986885 - RNA, 22 nt, Human
gagcagcugagcuggaaugaga

SEQ ID NO: 986886 - RNA, 18 nt, Human
cugccuguugcugagagg

SEQ ID NO: 986887 - RNA, 22 nt, Human
ggucccaggcugcgggcuggug

SEQ ID NO: 986888 - RNA, 20 nt, Human
aguaccuuuuguauguuacc

SEQ ID NO: 986889 - RNA, 22 nt, Human
cugccucucagccugaccgcca

SEQ ID NO: 986890 - RNA, 18 nt, Human
gccugcaggcacgggggu

SEQ ID NO: 986891 - RNA, 22 nt, Human
uggcucagauuuuuguaggcuu

SEQ ID NO: 986892 - RNA, 22 nt, Human
agaggccagcagugccuaucug

SEQ ID NO: 986893 - RNA, 22 nt, Human
agaaacauuuagauuauauguc

SEQ ID NO: 986894 - RNA, 22 nt, Human
ccuggggcucaagauggcgccg

SEQ ID NO: 986895 - RNA, 19 nt, Human
gguaaaagugagcuucagg

SEQ ID NO: 986896 - RNA, 22 nt, Human
aguguccaacucagcuugucaa

SEQ ID NO: 986897 - RNA, 22 nt, Human
cccugcaggggaccugcagccu

SEQ ID NO: 986898 - RNA, 22 nt, Human
acaugaaaccugagucuaacuc

SEQ ID NO: 986899 - RNA, 22 nt, Human
auacauacauguacacauaaau

SEQ ID NO: 986900 - RNA, 22 nt, Human
ucagagcugcccaugcaagggg

SEQ ID NO: 986901 - RNA, 22 nt, Human
augcacccagugucuggacuau

SEQ ID NO: 986902 - RNA, 20 nt, Human
ccuggccaaugagauaggaa

SEQ ID NO: 986903 - RNA, 22 nt, Human
ucauuucuccgaccugcugucc

SEQ ID NO: 986904 - RNA, 22 nt, Human
ugcaugugcccacucuggcuua

SEQ ID NO: 986905 - RNA, 22 nt, Human
gcuggccuugugucugaggaag

SEQ ID NO: 986906 - RNA, 22 nt, Human
agaacagaugugggcagaccug

SEQ ID NO: 986907 - RNA, 22 nt, Human
uggcagcuguguccagguagaa

SEQ ID NO: 986908 - RNA, 22 nt, Human
aaauguuagguuguacugaguc

SEQ ID NO: 986909 - RNA, 22 nt, Human
acagcuguggggacucuugccc

SEQ ID NO: 986910 - RNA, 19 nt, Human
agguggucuaggcuggaga

SEQ ID NO: 986911 - RNA, 22 nt, Human
aacuccagggcauugucuccug

SEQ ID NO: 986912 - RNA, 22 nt, Human
cuggcucuaucuccaaggcugg

SEQ ID NO: 986913 - RNA, 22 nt, Human
ucaguuuuaagguuugagaauu

SEQ ID NO: 986914 - RNA, 22 nt, Human
ucagggacauuuagacacugau

SEQ ID NO: 986915 - RNA, 22 nt, Human
cggcuggguucggcugcaggcc

SEQ ID NO: 986916 - RNA, 22 nt, Human
uuuuccucaggaaugcuaagcu

SEQ ID NO: 986917 - RNA, 22 nt, Human
ggcugccugaacuuuggggaaa

SEQ ID NO: 986918 - RNA, 22 nt, Human
agcauuuaguuaguaaauguuu

SEQ ID NO: 986919 - RNA, 22 nt, Human
cugcagcuguagaggacagugg

SEQ ID NO: 986920 - RNA, 22 nt, Human
agggccugcucuaucacucuca

SEQ ID NO: 986921 - RNA, 22 nt, Human
accuuuuccagcuucuagaggc

SEQ ID NO: 986922 - RNA, 22 nt, Human
cugccuuggaaaaugugguaau

SEQ ID NO: 986923 - RNA, 22 nt, Human
cuccuucccuucaaguguuccu

SEQ ID NO: 986924 - RNA, 22 nt, Human
cagggcaguuugugccuaugag

SEQ ID NO: 986925 - RNA, 19 nt, Human
uggaagaggaagggaaaua

SEQ ID NO: 986926 - RNA, 22 nt, Human
ggccccuggcaccaggcugauu

SEQ ID NO: 986927 - RNA, 22 nt, Human
acacuugauaggucaaaucagu

SEQ ID NO: 986928 - RNA, 22 nt, Human
ugcacccucaucagucaaaugg

SEQ ID NO: 986929 - RNA, 19 nt, Human
uuggaaggagccagagugg

SEQ ID NO: 986930 - RNA, 22 nt, Human
gcugcugcgcuugucuacuguu

SEQ ID NO: 986931 - RNA, 18 nt, Human
aaugcacacauuuacucc

SEQ ID NO: 986932 - RNA, 22 nt, Human
cuggcuggccggagcgaggcgg

SEQ ID NO: 986933 - RNA, 22 nt, Human
cuggccucaccucagacuuacu

SEQ ID NO: 986934 - RNA, 22 nt, Human
cagcuccccucuguggggcagu

SEQ ID NO: 986935 - RNA, 22 nt, Human
gaggcuggcagaaaagcacagg

SEQ ID NO: 986936 - RNA, 22 nt, Human
auugaaagauuuugggcucaug

SEQ ID NO: 986937 - RNA, 22 nt, Human
uggaggaugagugugggcucug

SEQ ID NO: 986938 - RNA, 22 nt, Human
gccuucugauaucucuuggcau

SEQ ID NO: 986939 - RNA, 22 nt, Human
gcagcuggucuggccuagagua

SEQ ID NO: 986940 - RNA, 22 nt, Human
cucacagaugcugugggucagg

SEQ ID NO: 986941 - RNA, 22 nt, Human
guaucuuuccacaucuucagua

SEQ ID NO: 986942 - RNA, 22 nt, Human
aggaccaacauagcagcagugg

SEQ ID NO: 986943 - RNA, 22 nt, Human
aagccagccagugccagucuua

SEQ ID NO: 986944 - RNA, 22 nt, Human
caggccugucugcacaugaggc

SEQ ID NO: 986945 - RNA, 22 nt, Human
cugugucccccucagccaggug

SEQ ID NO: 986946 - RNA, 22 nt, Human
aucaaaguggaaguuuacuagg

SEQ ID NO: 986947 - RNA, 22 nt, Human
caguacuuggucaaggaagcag

SEQ ID NO: 986948 - RNA, 22 nt, Human
agaaagaacguugguuaucuua

SEQ ID NO: 986949 - RNA, 22 nt, Human
cucagggucugguccuuagauu

SEQ ID NO: 986950 - RNA, 22 nt, Human
ggcacugaucugauuucccucc

SEQ ID NO: 986951 - RNA, 22 nt, Human
cagcucugcugggaggaugcag

SEQ ID NO: 986952 - RNA, 22 nt, Human
gggcugggcaugguguucccuc

SEQ ID NO: 986953 - RNA, 22 nt, Human
uguggcucucagauccuccaau

SEQ ID NO: 986954 - RNA, 22 nt, Human
ggcgcuggccacgguggcucug

SEQ ID NO: 986955 - RNA, 22 nt, Human
uauuggcagcaugagcuccugg

SEQ ID NO: 986956 - RNA, 22 nt, Human
ugucuguaagguguuuauguua

SEQ ID NO: 986957 - RNA, 22 nt, Human
cugcccugucuuuuucugauga

SEQ ID NO: 986958 - RNA, 22 nt, Human
guccucugacucagccuuggga

SEQ ID NO: 986959 - RNA, 22 nt, Human
cucucuguuaugcuuucaugaa

SEQ ID NO: 986960 - RNA, 22 nt, Human
auaugccauuagcuagaaauaa

SEQ ID NO: 986961 - RNA, 22 nt, Human
aggagcugucagagugccagag

SEQ ID NO: 986962 - RNA, 22 nt, Human
gcuggcuguaucaccuggccag

SEQ ID NO: 986963 - RNA, 22 nt, Human
gagcagggccacuucuguaccu

SEQ ID NO: 986964 - RNA, 22 nt, Human
ugggcugcagggguugagagcu

SEQ ID NO: 986965 - RNA, 22 nt, Human
uucaguuucagucuugcaaaaa

SEQ ID NO: 986966 - RNA, 22 nt, Human
agcugucuaccugcagaguccu

SEQ ID NO: 986967 - RNA, 22 nt, Human
aggcucagagagcuguguccau

SEQ ID NO: 986968 - RNA, 22 nt, Human
cagcugcccaggccaccuggag

SEQ ID NO: 986969 - RNA, 22 nt, Human
uacuuuagaaggaaauaaguuc

SEQ ID NO: 986970 - RNA, 22 nt, Human
cuguuuauacgacagguggagg

SEQ ID NO: 986971 - RNA, 22 nt, Human
cguguacagucuaucuuuuuuc

SEQ ID NO: 986972 - RNA, 22 nt, Human
agggaaaguaagcauuucauua

SEQ ID NO: 986973 - RNA, 22 nt, Human
aaaugcuugcucuugauuauuu

SEQ ID NO: 986974 - RNA, 17 nt, Human
gcugcagcgguaggcag

SEQ ID NO: 986975 - RNA, 22 nt, Human
ugcuugggaauguggagucaga

SEQ ID NO: 986976 - RNA, 22 nt, Human
cuacugaguccuucagcugcca

SEQ ID NO: 986977 - RNA, 22 nt, Human
auguuauaguuauaaaaugagg

SEQ ID NO: 986978 - RNA, 22 nt, Human
gcaguggcuaggagucuggcgu

SEQ ID NO: 986979 - RNA, 22 nt, Human
acagccaggaauucuggagaag

SEQ ID NO: 986980 - RNA, 22 nt, Human
aaggccaugcacauccuaggca

SEQ ID NO: 986981 - RNA, 18 nt, Human
uggcagccagcugcuccu

SEQ ID NO: 986982 - RNA, 22 nt, Human
cagccagccucucaaccaugca

SEQ ID NO: 986983 - RNA, 22 nt, Human
gaagaacaagcagugcuuuccu

SEQ ID NO: 986984 - RNA, 22 nt, Human
gagagcugggaaagccguggag

SEQ ID NO: 986985 - RNA, 22 nt, Human
aagggcugaaagaccuugggca

SEQ ID NO: 986986 - RNA, 22 nt, Human
cuggcccaggaagacguguccc

SEQ ID NO: 986987 - RNA, 22 nt, Human
gcugccugcacagagcugcuuu

SEQ ID NO: 986988 - RNA, 22 nt, Human
uacaaaugaaccaacuuugaug

SEQ ID NO: 986989 - RNA, 22 nt, Human
ccagcccucacugaggccucuc

SEQ ID NO: 986990 - RNA, 22 nt, Human
uugaaucauuacaauagauaag

SEQ ID NO: 986991 - RNA, 22 nt, Human
agccuggauccuaggcucagcu

SEQ ID NO: 986992 - RNA, 22 nt, Human
aggauuuuagauaagacagcaa

SEQ ID NO: 986993 - RNA, 22 nt, Human
ucagggaacuacuucucccuau

SEQ ID NO: 986994 - RNA, 18 nt, Human
cagggcuguggggucacu

SEQ ID NO: 986995 - RNA, 23 nt, Human
agaaaagcuuggacacauggccu

SEQ ID NO: 986996 - RNA, 17 nt, Human
acucugcugaaguagaa

SEQ ID NO: 986997 - RNA, 22 nt, Human
aauccagguggcggagguugug

SEQ ID NO: 986998 - RNA, 22 nt, Human
uggcagcacaagguggcccaug

SEQ ID NO: 986999 - RNA, 22 nt, Human
acauuguauaaugauuaucaca

SEQ ID NO: 987000 - RNA, 22 nt, Human
agggcagaccacgugcaaggau

SEQ ID NO: 987001 - RNA, 22 nt, Human
uccuugaauggacauuacacug

SEQ ID NO: 987002 - RNA, 22 nt, Human
agacaggaugcauacucuuggu

SEQ ID NO: 987003 - RNA, 22 nt, Human
gagagugaggccugggaaucua

SEQ ID NO: 987004 - RNA, 22 nt, Human
cagucccaugagcccagaacau

SEQ ID NO: 987005 - RNA, 22 nt, Human
aauuaggaaaugagaguauuug

SEQ ID NO: 987006 - RNA, 22 nt, Human
cugcagagcuaggcugagugaa

SEQ ID NO: 987007 - RNA, 22 nt, Human
cccuucagcugagugggacagc

SEQ ID NO: 987008 - RNA, 22 nt, Human
ccugggaggcagagguugcagu

SEQ ID NO: 987009 - RNA, 22 nt, Human
uggggagugaugccucggauaa

SEQ ID NO: 987010 - RNA, 22 nt, Human
ucaaaccaccuuguuacugggg

SEQ ID NO: 987011 - RNA, 22 nt, Human
gcugggcagccuggccgcugcc

SEQ ID NO: 987012 - RNA, 22 nt, Human
caggccuggcccccggcacacc

SEQ ID NO: 987013 - RNA, 22 nt, Human
ggcucuggugggaagguuagau

SEQ ID NO: 987014 - RNA, 22 nt, Human
uuuuccucuguuauuaguguga

SEQ ID NO: 987015 - RNA, 22 nt, Human
cacaggguuguucugaggauuc

SEQ ID NO: 987016 - RNA, 22 nt, Human
gcugagaggcacuaucuccgga

SEQ ID NO: 987017 - RNA, 22 nt, Human
ucuggccagugaaaugcagaau

SEQ ID NO: 987018 - RNA, 22 nt, Human
ugcauuaugcuacccagaagcu

SEQ ID NO: 987019 - RNA, 22 nt, Human
agccagcaggugagugcagccu

SEQ ID NO: 987020 - RNA, 22 nt, Human
ccugaagagcacucuagaguug

SEQ ID NO: 987021 - RNA, 22 nt, Human
aaggccugggaguacugggaca

SEQ ID NO: 987022 - RNA, 22 nt, Human
acauuucuaucauccuguaaug

SEQ ID NO: 987023 - RNA, 22 nt, Human
guggccuggaguuugauguagg

SEQ ID NO: 987024 - RNA, 22 nt, Human
gacccuguuucuacaaauaauu

SEQ ID NO: 987025 - RNA, 22 nt, Human
uuugcauuuugauaagaucacu

SEQ ID NO: 987026 - RNA, 22 nt, Human
uggcucaguuugggggauugaa

SEQ ID NO: 987027 - RNA, 22 nt, Human
ggcagagaugugggucagaauc

SEQ ID NO: 987028 - RNA, 22 nt, Human
ccugauggagcccugcugcaug

SEQ ID NO: 987029 - RNA, 22 nt, Human
agagcuguucaacguagcaaug

SEQ ID NO: 987030 - RNA, 22 nt, Human
ucacucugcaggaaggagcagc

SEQ ID NO: 987031 - RNA, 22 nt, Human
ggcugccugggagcccuccucu

SEQ ID NO: 987032 - RNA, 22 nt, Human
aaguucaagucuccugaguaua

SEQ ID NO: 987033 - RNA, 22 nt, Human
ugcauuguugaauauuucauag

SEQ ID NO: 987034 - RNA, 22 nt, Human
ccucugcaccauagccuucagc

SEQ ID NO: 987035 - RNA, 19 nt, Human
ccaguagagacagcugcag

SEQ ID NO: 987036 - RNA, 22 nt, Human
uggcucagagccuugagagcug

SEQ ID NO: 987037 - RNA, 22 nt, Human
acaugcauacaagcacauguag

SEQ ID NO: 987038 - RNA, 22 nt, Human
uggcuuccacugugugcccccu

SEQ ID NO: 987039 - RNA, 22 nt, Human
gcagggcagcuuagucccuguc

SEQ ID NO: 987040 - RNA, 22 nt, Human
guuugcauuuauuagucuucug

SEQ ID NO: 987041 - RNA, 21 nt, Human
agcagcugcaguuucuaucug

SEQ ID NO: 987042 - RNA, 22 nt, Human
agcugcccugggucuugcugcu

SEQ ID NO: 987043 - RNA, 22 nt, Human
gggccaggucggugaaugguca

SEQ ID NO: 987044 - RNA, 22 nt, Human
gcugucugcugggucgcucagg

SEQ ID NO: 987045 - RNA, 22 nt, Human
cccagcucaagcagagagcuaa

SEQ ID NO: 987046 - RNA, 22 nt, Human
cacagagagcuacgugcagcgu

SEQ ID NO: 987047 - RNA, 22 nt, Human
uucauucauuacgugccaggca

SEQ ID NO: 987048 - RNA, 22 nt, Human
uuagaaaucugcugccaugcaa

SEQ ID NO: 987049 - RNA, 22 nt, Human
caaaggcaguuacugaaugaag

SEQ ID NO: 987050 - RNA, 22 nt, Human
ucaaacuguuuacagugagaua

SEQ ID NO: 987051 - RNA, 22 nt, Human
ugucaucuuuuuaaagaagaga

SEQ ID NO: 987052 - RNA, 22 nt, Human
cagcagcccacgcgugcugucc

SEQ ID NO: 987053 - RNA, 23 nt, Human
augcaguauaugucaguaguuua

SEQ ID NO: 987054 - RNA, 22 nt, Human
cugucccaggagcuguaagaca

SEQ ID NO: 987055 - RNA, 22 nt, Human
gcagagcagugcuugcccagcg

SEQ ID NO: 987056 - RNA, 22 nt, Human
uguuucagucccuguguucaau

SEQ ID NO: 987057 - RNA, 22 nt, Human
agcagcucugagaggccagcac

SEQ ID NO: 987058 - RNA, 22 nt, Human
gucuggaguggggccugagaau

SEQ ID NO: 987059 - RNA, 22 nt, Human
aaucuggcauuugagaguagga

SEQ ID NO: 987060 - RNA, 22 nt, Human
ccagggugugggcgucggcacg

SEQ ID NO: 987061 - RNA, 22 nt, Human
cugaggcucccucgggucugcu

SEQ ID NO: 987062 - RNA, 19 nt, Human
ggaugagggucaggcauag

SEQ ID NO: 987063 - RNA, 22 nt, Human
gauuuccuagacauggggcaga

SEQ ID NO: 987064 - RNA, 22 nt, Human
uaaagguaugucuuaaucaaac

SEQ ID NO: 987065 - RNA, 22 nt, Human
acagaacugggaaaugcacaua

SEQ ID NO: 987066 - RNA, 22 nt, Human
agcugaaggcuagaacagcugg

SEQ ID NO: 987067 - RNA, 22 nt, Human
uuccaggggcagcagugauggu

SEQ ID NO: 987068 - RNA, 22 nt, Human
uauugaaaugaaugacagugau

SEQ ID NO: 987069 - RNA, 22 nt, Human
aagauuucucuccuggaaagca

SEQ ID NO: 987070 - RNA, 20 nt, Human
cagcaggaaaagugccucag

SEQ ID NO: 987071 - RNA, 22 nt, Human
uuaaaguucauuaaaugagcca

SEQ ID NO: 987072 - RNA, 22 nt, Human
ccacacagucaguuuccaagaa

SEQ ID NO: 987073 - RNA, 22 nt, Human
ugaugcugcugggaguggugcu

SEQ ID NO: 987074 - RNA, 22 nt, Human
ggaggccaaggcaggcggauca

SEQ ID NO: 987075 - RNA, 22 nt, Human
gagggggcgugcaaggcuccgc

SEQ ID NO: 987076 - RNA, 22 nt, Human
gcaggcagagaaggaacauuua

SEQ ID NO: 987077 - RNA, 22 nt, Human
cuucacauguuggaguccuuug

SEQ ID NO: 987078 - RNA, 19 nt, Human
cugguccugacugaggggu

SEQ ID NO: 987079 - RNA, 22 nt, Human
uuuuaauugcaauuaugguccc

SEQ ID NO: 987080 - RNA, 22 nt, Human
gaauuguagagggaacagaagc

SEQ ID NO: 987081 - RNA, 19 nt, Human
ucugcuggcagaauucccu

SEQ ID NO: 987082 - RNA, 22 nt, Human
ccugcccagcuucaccucaggc

SEQ ID NO: 987083 - RNA, 22 nt, Human
ucaagcaucuuggucuacgauc

SEQ ID NO: 987084 - RNA, 22 nt, Human
cuggcucaggguggucuggguc

SEQ ID NO: 987085 - RNA, 22 nt, Human
agagaggcugggcguagggcuu

SEQ ID NO: 987086 - RNA, 22 nt, Human
cauugcacuccacccuaggcaa

SEQ ID NO: 987087 - RNA, 22 nt, Human
uggcagaggaaaaagucacugg

SEQ ID NO: 987088 - RNA, 22 nt, Human
gaaggagcuaaagggagcccug

SEQ ID NO: 987089 - RNA, 22 nt, Human
ccugagggaggguauaggcugu

SEQ ID NO: 987090 - RNA, 22 nt, Human
aaagcuauuugugaguuauaga

SEQ ID NO: 987091 - RNA, 22 nt, Human
ucagggcaucaucaugaauaua

SEQ ID NO: 987092 - RNA, 22 nt, Human
auguuaaaugguuuauuauuaa

SEQ ID NO: 987093 - RNA, 22 nt, Human
uggcagagaugaagaguuguuu

SEQ ID NO: 987094 - RNA, 22 nt, Human
aucuggcucgcuaggcucuggg

SEQ ID NO: 987095 - RNA, 22 nt, Human
gccugaaguuucaugccucuau

SEQ ID NO: 987096 - RNA, 22 nt, Human
guucacaagcugauugucuuuc

SEQ ID NO: 987097 - RNA, 22 nt, Human
acagaaugcguagugcauguug

SEQ ID NO: 987098 - RNA, 22 nt, Human
uaacagaagaugaaacuucuuu

SEQ ID NO: 987099 - RNA, 22 nt, Human
uggcagcuacagacagagguga

SEQ ID NO: 987100 - RNA, 19 nt, Human
gagcugccuuuugaagacc

SEQ ID NO: 987101 - RNA, 22 nt, Human
gccagggggucagcaggcacuu

SEQ ID NO: 987102 - RNA, 22 nt, Human
auuauuagugauguuguuacug

SEQ ID NO: 987103 - RNA, 22 nt, Human
ggcaaaaaccgcaauaacuucu

SEQ ID NO: 987104 - RNA, 22 nt, Human
accaggggugucaacagcauuu

SEQ ID NO: 987105 - RNA, 22 nt, Human
acacaguaccccaaggcugggc

SEQ ID NO: 987106 - RNA, 22 nt, Human
gucugucuguuguugagaagca

SEQ ID NO: 987107 - RNA, 22 nt, Human
aagaacaguugggaggugagcc

SEQ ID NO: 987108 - RNA, 21 nt, Human
ggcagccugacccccagagag

SEQ ID NO: 987109 - RNA, 22 nt, Human
guuuuauuuccaugagagaccg

SEQ ID NO: 987110 - RNA, 22 nt, Human
augcuuccaaggcuaagacaag

SEQ ID NO: 987111 - RNA, 22 nt, Human
agguggccggugccagccgggc

SEQ ID NO: 987112 - RNA, 22 nt, Human
caggcagcagccacucugguau

SEQ ID NO: 987113 - RNA, 22 nt, Human
ugccacccagccaggaguggga

SEQ ID NO: 987114 - RNA, 22 nt, Human
cuggcagggugggcuuugcuuu

SEQ ID NO: 987115 - RNA, 23 nt, Human
aacaauagguuuuggcagaauag

SEQ ID NO: 987116 - RNA, 19 nt, Human
ccaggccuccugggagguc

SEQ ID NO: 987117 - RNA, 22 nt, Human
gauuuccuaauguggaucucug

SEQ ID NO: 987118 - RNA, 22 nt, Human
uggcucagcaagacauugaccu

SEQ ID NO: 987119 - RNA, 22 nt, Human
ugaccaaaggugguuuauuugg

SEQ ID NO: 987120 - RNA, 21 nt, Human
uggcagacaggaggagcucac

SEQ ID NO: 987121 - RNA, 22 nt, Human
uuuuacuuaauucuuggucaug

SEQ ID NO: 987122 - RNA, 22 nt, Human
ugcauguggaccccuggugccu

SEQ ID NO: 987123 - RNA, 22 nt, Human
ggggcagagcauagcuccaauu

SEQ ID NO: 987124 - RNA, 22 nt, Human
cuauugaauuaacuauuaaagu

SEQ ID NO: 987125 - RNA, 22 nt, Human
aagguacaguuuuaagaauaag

SEQ ID NO: 987126 - RNA, 22 nt, Human
accauuuaauaaguauuuccau

SEQ ID NO: 987127 - RNA, 22 nt, Human
agagggcauuaacucugucuug

SEQ ID NO: 987128 - RNA, 22 nt, Human
gcauccagucuuggcuccugga

SEQ ID NO: 987129 - RNA, 22 nt, Human
accugagggcccaaacuuggua

SEQ ID NO: 987130 - RNA, 22 nt, Human
gacagccucaugaggagcaaaa

SEQ ID NO: 987131 - RNA, 22 nt, Human
cuguccuggagggcauaggacg

SEQ ID NO: 987132 - RNA, 23 nt, Human
ggccuccuggucuaggcuagacu

SEQ ID NO: 987133 - RNA, 22 nt, Human
ccccagcugcauacuugccaag

SEQ ID NO: 987134 - RNA, 22 nt, Human
uggguaaacugggucuggagag

SEQ ID NO: 987135 - RNA, 22 nt, Human
ucacaggguuuggaagccuccu

SEQ ID NO: 987136 - RNA, 22 nt, Human
acucugccccgaguucugggaa

SEQ ID NO: 987137 - RNA, 22 nt, Human
ucuuaaaaguaugccaauugga

SEQ ID NO: 987138 - RNA, 22 nt, Human
aguguuguaugggaugacugcu

SEQ ID NO: 987139 - RNA, 22 nt, Human
acagagauguggaugagggauu

SEQ ID NO: 987140 - RNA, 20 nt, Human
uacagaaacaggacuuuugg

SEQ ID NO: 987141 - RNA, 22 nt, Human
uguggcuuaagaaugccuuuaa

SEQ ID NO: 987142 - RNA, 22 nt, Human
ucugaagccaccucugcuuguc

SEQ ID NO: 987143 - RNA, 22 nt, Human
cugcccugccuggccagugugg

SEQ ID NO: 987144 - RNA, 22 nt, Human
cuguuuaucccuuuggucagca

SEQ ID NO: 987145 - RNA, 22 nt, Human
ugcuauaagaauuauauuacuc

SEQ ID NO: 987146 - RNA, 20 nt, Human
cauuggacuuggcuucaugg

SEQ ID NO: 987147 - RNA, 22 nt, Human
gggcugcuuauacugaugauaa

SEQ ID NO: 987148 - RNA, 22 nt, Human
cugagcugaaacuugagaggcu

SEQ ID NO: 987149 - RNA, 22 nt, Human
ucuuacauauagcaugaguaca

SEQ ID NO: 987150 - RNA, 20 nt, Human
gcccuggagccuuguccugg

SEQ ID NO: 987151 - RNA, 22 nt, Human
gucccagggaugcagacaugag

SEQ ID NO: 987152 - RNA, 22 nt, Human
gccuaauaugcaaaauugauac

SEQ ID NO: 987153 - RNA, 22 nt, Human
cugacucuccucaagcauaaau

SEQ ID NO: 987154 - RNA, 22 nt, Human
ccugccagggccuuggaagaaa

SEQ ID NO: 987155 - RNA, 22 nt, Human
aauguguagauguugcauuccu

SEQ ID NO: 987156 - RNA, 22 nt, Human
gcuggcaucacuggcuucggug

SEQ ID NO: 987157 - RNA, 22 nt, Human
uagauaaauuagaaaguuuacu

SEQ ID NO: 987158 - RNA, 22 nt, Human
gccuucugcgcucgugucuccg

SEQ ID NO: 987159 - RNA, 22 nt, Human
uggcucagcugacucggcuucu

SEQ ID NO: 987160 - RNA, 19 nt, Human
gggcuuggggcugaagccu

SEQ ID NO: 987161 - RNA, 22 nt, Human
auuuagaaauuccaaaaguauu

SEQ ID NO: 987162 - RNA, 22 nt, Human
agcagccacacgccuccuucuc

SEQ ID NO: 987163 - RNA, 22 nt, Human
ugccuuggugcuucuucaugug

SEQ ID NO: 987164 - RNA, 20 nt, Human
auacacauauucuugcaacu

SEQ ID NO: 987165 - RNA, 22 nt, Human
aaguguguugacugaauugggg

SEQ ID NO: 987166 - RNA, 22 nt, Human
ucugagcauugaauuuucuucc

SEQ ID NO: 987167 - RNA, 22 nt, Human
agguaggguuaauggagauaua

SEQ ID NO: 987168 - RNA, 22 nt, Human
cagaguccuggacacagagaca

SEQ ID NO: 987169 - RNA, 22 nt, Human
agguggagacccagagaaggcg

SEQ ID NO: 987170 - RNA, 22 nt, Human
agggagcaugggugaagcaggc

SEQ ID NO: 987171 - RNA, 22 nt, Human
aguaacuaugcuugagaaucag

SEQ ID NO: 987172 - RNA, 22 nt, Human
acugucaccaucagagcgggaa

SEQ ID NO: 987173 - RNA, 22 nt, Human
ggcgaggccgggacaggcugga

SEQ ID NO: 987174 - RNA, 20 nt, Human
gccuggaggcagagauaaag

SEQ ID NO: 987175 - RNA, 22 nt, Human
gaaugcacacgugugugcaugc

SEQ ID NO: 987176 - RNA, 22 nt, Human
cuggcccuucucuugcuuccug

SEQ ID NO: 987177 - RNA, 22 nt, Human
gggcugcugccaccagguggau

SEQ ID NO: 987178 - RNA, 19 nt, Human
agggaaggauucugucauu

SEQ ID NO: 987179 - RNA, 22 nt, Human
ggugacuggagggacccaggcc

SEQ ID NO: 987180 - RNA, 22 nt, Human
cuacauuuuaauaagcugcuua

SEQ ID NO: 987181 - RNA, 22 nt, Human
uggccucuuacgacauagccuu

SEQ ID NO: 987182 - RNA, 22 nt, Human
ucugccugcaguguggcagggc

SEQ ID NO: 987183 - RNA, 22 nt, Human
auuucuuuucaagagggugcuu

SEQ ID NO: 987184 - RNA, 22 nt, Human
agggcagacuaggauggaagug

SEQ ID NO: 987185 - RNA, 22 nt, Human
gcucccaccaggcagaccuacc

SEQ ID NO: 987186 - RNA, 22 nt, Human
cucuggagcgcugcuucccgcg

SEQ ID NO: 987187 - RNA, 22 nt, Human
cagcugccugucuggaggcaau

SEQ ID NO: 987188 - RNA, 22 nt, Human
uggcucucaggccugcugcguu

SEQ ID NO: 987189 - RNA, 22 nt, Human
agggagcugcucugcuuccgug

SEQ ID NO: 987190 - RNA, 19 nt, Human
ucuaagccucaauguuuuc

SEQ ID NO: 987191 - RNA, 22 nt, Human
gcuggcuguguuccuucugcca

SEQ ID NO: 987192 - RNA, 22 nt, Human
aggauccugcgcuuugggggag

SEQ ID NO: 987193 - RNA, 22 nt, Human
gcuuccuaaaugcacagggcag

SEQ ID NO: 987194 - RNA, 19 nt, Human
uucacauuggaagaaguag

SEQ ID NO: 987195 - RNA, 22 nt, Human
ugucaguguauacauacaguau

SEQ ID NO: 987196 - RNA, 22 nt, Human
ggccugcuccgggggcugagcu

SEQ ID NO: 987197 - RNA, 22 nt, Human
agccugguguggggcugcagag

SEQ ID NO: 987198 - RNA, 22 nt, Human
auauuucuccaaauguuuucaa

SEQ ID NO: 987199 - RNA, 22 nt, Human
gcaaagcugggugugaaugcac

SEQ ID NO: 987200 - RNA, 18 nt, Human
agcagcugugccacacug

SEQ ID NO: 987201 - RNA, 22 nt, Human
ucugcgcugccuugauccuugg

SEQ ID NO: 987202 - RNA, 22 nt, Human
acacugaaugcuguuuagaaau

SEQ ID NO: 987203 - RNA, 22 nt, Human
gccaggcuggugucacaacucu

SEQ ID NO: 987204 - RNA, 21 nt, Human
acagcaagccuuccuuucagg

SEQ ID NO: 987205 - RNA, 22 nt, Human
ucagaaaugaucguuauucauu

SEQ ID NO: 987206 - RNA, 22 nt, Human
auucacaacugauccuugcuca

SEQ ID NO: 987207 - RNA, 20 nt, Human
cugugcuuuggaaccuggaa

SEQ ID NO: 987208 - RNA, 22 nt, Human
gggaaauugugugagaucuuug

SEQ ID NO: 987209 - RNA, 21 nt, Human
aaugugugcuauuuaucuuuu

SEQ ID NO: 987210 - RNA, 22 nt, Human
gcagcagaguuugggagauggu

SEQ ID NO: 987211 - RNA, 22 nt, Human
ccacagggucagccacucugca

SEQ ID NO: 987212 - RNA, 22 nt, Human
gaugaagccugacuucucggug

SEQ ID NO: 987213 - RNA, 17 nt, Human
ugcauuguuggaaauuu

SEQ ID NO: 987214 - RNA, 16 nt, Human
uggaaggggucuccgg

SEQ ID NO: 987215 - RNA, 22 nt, Human
agggccagagucuguguagaua

SEQ ID NO: 987216 - RNA, 18 nt, Human
cagauccaggcagcuauu

SEQ ID NO: 987217 - RNA, 22 nt, Human
agaaauuccuaagguacacaag

SEQ ID NO: 987218 - RNA, 22 nt, Human
guggagacuucuacuagagacc

SEQ ID NO: 987219 - RNA, 22 nt, Human
uuugacaguaauaaagcacaag

SEQ ID NO: 987220 - RNA, 22 nt, Human
agguuauaugucauacugaagu

SEQ ID NO: 987221 - RNA, 22 nt, Human
gcauugucaaaagugguaugac

SEQ ID NO: 987222 - RNA, 22 nt, Human
gcauuucugugcauacacauga

SEQ ID NO: 987223 - RNA, 22 nt, Human
uuggaaggcccugccuagcagg

SEQ ID NO: 987224 - RNA, 22 nt, Human
gcccucagaggacagcugacuu

SEQ ID NO: 987225 - RNA, 22 nt, Human
augggaugaacuugaucugcuu

SEQ ID NO: 987226 - RNA, 22 nt, Human
uggaggcauaggccugggcccu

SEQ ID NO: 987227 - RNA, 20 nt, Human
agaaucugacccagagagac

SEQ ID NO: 987228 - RNA, 22 nt, Human
auucacaauagcagcuugcaug

SEQ ID NO: 987229 - RNA, 22 nt, Human
gcagaggccaucaacuuugcca

SEQ ID NO: 987230 - RNA, 23 nt, Human
ggaguuggauuguacuugcugcu

SEQ ID NO: 987231 - RNA, 22 nt, Human
gcccuggaaucucuccauggga

SEQ ID NO: 987232 - RNA, 22 nt, Human
gaaggagggugcggaucugagc

SEQ ID NO: 987233 - RNA, 22 nt, Human
ggcucuggcaaggggaggcuac

SEQ ID NO: 987234 - RNA, 22 nt, Human
ucuuagaaaugaaguucuuucu

SEQ ID NO: 987235 - RNA, 22 nt, Human
guauccuuugcggaaauuucua

SEQ ID NO: 987236 - RNA, 22 nt, Human
uugcagagaucagcagguuuga

SEQ ID NO: 987237 - RNA, 22 nt, Human
uacucugcucauuggagugugu

SEQ ID NO: 987238 - RNA, 22 nt, Human
aggcauguauaugugcacaugu

SEQ ID NO: 987239 - RNA, 23 nt, Human
cugcagucgccggccugggugcc

SEQ ID NO: 987240 - RNA, 22 nt, Human
aauucacagcauuugcccaucu

SEQ ID NO: 987241 - RNA, 20 nt, Human
cugagcgucuaagaggugag

SEQ ID NO: 987242 - RNA, 22 nt, Human
ugcaguggaagagguggagauc

SEQ ID NO: 987243 - RNA, 17 nt, Human
ccuuucucuuucaucuc

SEQ ID NO: 987244 - RNA, 22 nt, Human
auaagguaugaaaaguaaaugg

SEQ ID NO: 987245 - RNA, 22 nt, Human
cagcuccugaggacugcuggga

SEQ ID NO: 987246 - RNA, 22 nt, Human
ggaguucacugugcaggcucug

SEQ ID NO: 987247 - RNA, 22 nt, Human
ugauuuccaaaaggcuucuaag

SEQ ID NO: 987248 - RNA, 22 nt, Human
gucucagauucagacaucuaca

SEQ ID NO: 987249 - RNA, 22 nt, Human
aggcugcucugcgaagucagcu

SEQ ID NO: 987250 - RNA, 22 nt, Human
agaaaguucacugguauauuuu

SEQ ID NO: 987251 - RNA, 22 nt, Human
caguagcagggauuauuuuagg

SEQ ID NO: 987252 - RNA, 21 nt, Human
ucauuuuuauugcuaccuugc

SEQ ID NO: 987253 - RNA, 22 nt, Human
uaccuuuugcuuauuaugacac

SEQ ID NO: 987254 - RNA, 22 nt, Human
uggcuggcccugggagugcaga

SEQ ID NO: 987255 - RNA, 22 nt, Human
auaaggcauauagucacuuuuu

SEQ ID NO: 987256 - RNA, 22 nt, Human
caaagggcucuagacucagcag

SEQ ID NO: 987257 - RNA, 22 nt, Human
cuguuacacggaccuucaaauc

SEQ ID NO: 987258 - RNA, 22 nt, Human
agaauucuccuucagggcagga

SEQ ID NO: 987259 - RNA, 22 nt, Human
uucuuacagcccuauuacuaaa

SEQ ID NO: 987260 - RNA, 22 nt, Human
ucagagaugcagugccaccuac

SEQ ID NO: 987261 - RNA, 22 nt, Human
gccuugcuuugcuucuggacag

SEQ ID NO: 987262 - RNA, 22 nt, Human
acagcagccuuguugguuucga

SEQ ID NO: 987263 - RNA, 22 nt, Human
aaucaguuagaaggaagagaau

SEQ ID NO: 987264 - RNA, 22 nt, Human
guggcucuaggugagcauggag

SEQ ID NO: 987265 - RNA, 22 nt, Human
uagcccagagucccaauuccag

SEQ ID NO: 987266 - RNA, 22 nt, Human
caaggagaaaacggcuucugaa

SEQ ID NO: 987267 - RNA, 22 nt, Human
uauguacaguccuuaacuuaaa

SEQ ID NO: 987268 - RNA, 21 nt, Human
aagagcuggaucaaggauaag

SEQ ID NO: 987269 - RNA, 22 nt, Human
uccuggccuugcuccugaugcc

SEQ ID NO: 987270 - RNA, 22 nt, Human
cagaggccccagaacuagcucu

SEQ ID NO: 987271 - RNA, 22 nt, Human
cauacuuugggauaagagugga

SEQ ID NO: 987272 - RNA, 22 nt, Human
uuuucauuuuuguagaugcaag

SEQ ID NO: 987273 - RNA, 23 nt, Human
agcaauaagaagggauacaugug

SEQ ID NO: 987274 - RNA, 22 nt, Human
ugggaccaagucauuucuuuag

SEQ ID NO: 987275 - RNA, 22 nt, Human
uggacagcgaaagugccuggga

SEQ ID NO: 987276 - RNA, 20 nt, Human
aaagucuuaugguuaauuuu

SEQ ID NO: 987277 - RNA, 22 nt, Human
ugucccagcagcuggguucucu

SEQ ID NO: 987278 - RNA, 22 nt, Human
aagaacagauucagccugaacu

SEQ ID NO: 987279 - RNA, 22 nt, Human
aggacaggauugagcugaacug

SEQ ID NO: 987280 - RNA, 22 nt, Human
auaugcacauacauacauaggu

SEQ ID NO: 987281 - RNA, 22 nt, Human
ggaugcugacuuuggagcaugg

SEQ ID NO: 987282 - RNA, 22 nt, Human
aguuuuaugcaguguucugaua

SEQ ID NO: 987283 - RNA, 22 nt, Human
gcagggcucaacaggacacccc

SEQ ID NO: 987284 - RNA, 22 nt, Human
agcucugggccaggaacccuaa

SEQ ID NO: 987285 - RNA, 22 nt, Human
guucuccauucagcuuccugug

SEQ ID NO: 987286 - RNA, 22 nt, Human
uuuccucuccaccaggaggucu

SEQ ID NO: 987287 - RNA, 22 nt, Human
cacagcugcccuacuccaugug

SEQ ID NO: 987288 - RNA, 20 nt, Human
agucucuguagugccugaga

SEQ ID NO: 987289 - RNA, 22 nt, Human
aggcucugguuggcaaguaaag

SEQ ID NO: 987290 - RNA, 22 nt, Human
ugcaugcagcuggugauaagaa

SEQ ID NO: 987291 - RNA, 22 nt, Human
ucucagaguaauucuuuaaggu

SEQ ID NO: 987292 - RNA, 22 nt, Human
cucagggggaaucaggucacag

SEQ ID NO: 987293 - RNA, 22 nt, Human
gggcagcugccaagugcaucgc

SEQ ID NO: 987294 - RNA, 18 nt, Human
uccauuguucuacuguga

SEQ ID NO: 987295 - RNA, 22 nt, Human
caguauguacucuuaucaugua

SEQ ID NO: 987296 - RNA, 22 nt, Human
acuguacuguguauuguagaau

SEQ ID NO: 987297 - RNA, 22 nt, Human
acagcugggugcugcucagagc

SEQ ID NO: 987298 - RNA, 17 nt, Human
gagaguguauuggaugc

SEQ ID NO: 987299 - RNA, 22 nt, Human
uggacucagugcugccauuccc

SEQ ID NO: 987300 - RNA, 22 nt, Human
agccuccuggaguuucugggau

SEQ ID NO: 987301 - RNA, 21 nt, Human
gggugcuguggucaugcagga

SEQ ID NO: 987302 - RNA, 22 nt, Human
uggugccuugggccuacagcgc

SEQ ID NO: 987303 - RNA, 22 nt, Human
uagacagauuuaaaggaaugga

SEQ ID NO: 987304 - RNA, 22 nt, Human
ccugcugggccugagcaaugag

SEQ ID NO: 987305 - RNA, 20 nt, Human
caccaggcgcucugagaaca

SEQ ID NO: 987306 - RNA, 22 nt, Human
ggcuagaacuuuacacuuugca

SEQ ID NO: 987307 - RNA, 22 nt, Human
uuuuucaugagacuagaaguca

SEQ ID NO: 987308 - RNA, 22 nt, Human
aggcuggguaccugucauaugc

SEQ ID NO: 987309 - RNA, 22 nt, Human
cugggugguucuaacuguugau

SEQ ID NO: 987310 - RNA, 22 nt, Human
agcugccaaguuggaguagcaa

SEQ ID NO: 987311 - RNA, 22 nt, Human
ccaggagccacucaggcccaca

SEQ ID NO: 987312 - RNA, 22 nt, Human
gcagauggcucagacacugggg

SEQ ID NO: 987313 - RNA, 22 nt, Human
aggaagccuggggcugcccucg

SEQ ID NO: 987314 - RNA, 22 nt, Human
agcuucuugaccaagccuguaa

SEQ ID NO: 987315 - RNA, 22 nt, Human
gggagggaaagcuugaucuguc

SEQ ID NO: 987316 - RNA, 22 nt, Human
auuagguaagauaaagcagagg

SEQ ID NO: 987317 - RNA, 22 nt, Human
cccaggaguuugaguucagcau

SEQ ID NO: 987318 - RNA, 22 nt, Human
ggcuggagauaugucuggaaca

SEQ ID NO: 987319 - RNA, 22 nt, Human
aggccucuucagggagcaugga

SEQ ID NO: 987320 - RNA, 22 nt, Human
uuagucuucuuccuuauauguu

SEQ ID NO: 987321 - RNA, 22 nt, Human
agcugcaguaaagcucuccagg

SEQ ID NO: 987322 - RNA, 22 nt, Human
ucacaugcccuguauuuaccag

SEQ ID NO: 987323 - RNA, 22 nt, Human
ggcuucucgugccgaagcaaga

SEQ ID NO: 987324 - RNA, 22 nt, Human
ggaaagagcuaaaagggugaga

SEQ ID NO: 987325 - RNA, 22 nt, Human
cuucacaauucuaacagggcaa

SEQ ID NO: 987326 - RNA, 22 nt, Human
gcagagccaggagagacccuug

SEQ ID NO: 987327 - RNA, 22 nt, Human
accaaggagacaaagguguauu

SEQ ID NO: 987328 - RNA, 23 nt, Human
ccuggcuggauucucugcauuca

SEQ ID NO: 987329 - RNA, 23 nt, Human
aguacauucgaaaaauucuguga

SEQ ID NO: 987330 - RNA, 22 nt, Human
uagcugccauugcuccaggaag

SEQ ID NO: 987331 - RNA, 22 nt, Human
aaaaugagauacaguuugaaag

SEQ ID NO: 987332 - RNA, 22 nt, Human
agauggggcucaguguggaggc

SEQ ID NO: 987333 - RNA, 22 nt, Human
guggccaagggacucuaaggca

SEQ ID NO: 987334 - RNA, 22 nt, Human
uacaccuuaaucauaugugucu

SEQ ID NO: 987335 - RNA, 22 nt, Human
cuccucugucuaccacgagggu

SEQ ID NO: 987336 - RNA, 22 nt, Human
uggcagagcaaaaagauagaau

SEQ ID NO: 987337 - RNA, 22 nt, Human
gaggaugugucuggucugggca

SEQ ID NO: 987338 - RNA, 22 nt, Human
aaggcugagagucacaguccua

SEQ ID NO: 987339 - RNA, 19 nt, Human
caugcugaccugcuguggu

SEQ ID NO: 987340 - RNA, 22 nt, Human
ugccugaugcaggaguaucaga

SEQ ID NO: 987341 - RNA, 22 nt, Human
acagagcucccagccaucuccu

SEQ ID NO: 987342 - RNA, 22 nt, Human
guauuagguuggugcaaaagua

SEQ ID NO: 987343 - RNA, 22 nt, Human
ugaacccaggagguugcaguga

SEQ ID NO: 987344 - RNA, 22 nt, Human
ggcugccuacuuucccagaguu

SEQ ID NO: 987345 - RNA, 20 nt, Human
gcaggcagggaaugggggug

SEQ ID NO: 987346 - RNA, 21 nt, Human
auuuggauauugcuggcaaau

SEQ ID NO: 987347 - RNA, 22 nt, Human
ggcugccuccucgagacaggau

SEQ ID NO: 987348 - RNA, 22 nt, Human
agcuucuggaagccuggcagca

SEQ ID NO: 987349 - RNA, 22 nt, Human
cucagagaagucuuugcuaaac

SEQ ID NO: 987350 - RNA, 22 nt, Human
ccuuuugcucucccauccagaa

SEQ ID NO: 987351 - RNA, 22 nt, Human
uggcacugccuggcagggcccc

SEQ ID NO: 987352 - RNA, 22 nt, Human
aaguuuuaacaaguacuuacua

SEQ ID NO: 987353 - RNA, 22 nt, Human
auuucagcccaguaugagcccc

SEQ ID NO: 987354 - RNA, 22 nt, Human
gggcuggcaucgguugcugaga

SEQ ID NO: 987355 - RNA, 22 nt, Human
cagggcagagggaaacuccuuu

SEQ ID NO: 987356 - RNA, 22 nt, Human
uggccugcagcucucagggaag

SEQ ID NO: 987357 - RNA, 22 nt, Human
ugguuugcccacucgagugauu

SEQ ID NO: 987358 - RNA, 22 nt, Human
gaccuuuuuacuguguacgcug

SEQ ID NO: 987359 - RNA, 22 nt, Human
ugggagagugcucaaugugcaa

SEQ ID NO: 987360 - RNA, 22 nt, Human
uccagcagcccgaaggcccauc

SEQ ID NO: 987361 - RNA, 22 nt, Human
cacagaaaaaggcuugaaaauc

SEQ ID NO: 987362 - RNA, 22 nt, Human
aggaguguggccagggcucugg

SEQ ID NO: 987363 - RNA, 22 nt, Human
auuauaggcuugagccaccgug

SEQ ID NO: 987364 - RNA, 22 nt, Human
agauacauuaguaguuacuugu

SEQ ID NO: 987365 - RNA, 22 nt, Human
cgagcaugaugacggcuguggc

SEQ ID NO: 987366 - RNA, 22 nt, Human
cagcugcaggaacaaaaaugug

SEQ ID NO: 987367 - RNA, 22 nt, Human
gcucccagauuucagccuugug

SEQ ID NO: 987368 - RNA, 19 nt, Human
aucuuacagagcagaguac

SEQ ID NO: 987369 - RNA, 22 nt, Human
uggcccgaccucugcucaugca

SEQ ID NO: 987370 - RNA, 22 nt, Human
aaguucuaauuuugcauucagg

SEQ ID NO: 987371 - RNA, 21 nt, Human
ucacuuauaauguauuugcug

SEQ ID NO: 987372 - RNA, 22 nt, Human
aggcugggaaaccugaaguugu

SEQ ID NO: 987373 - RNA, 22 nt, Human
auggcccaggccuccuguggcu

SEQ ID NO: 987374 - RNA, 22 nt, Human
cuuaagaauauugaaguugugg

SEQ ID NO: 987375 - RNA, 22 nt, Human
uggcucagccuggcccuuucau

SEQ ID NO: 987376 - RNA, 22 nt, Human
uaugaagauauaucugaucucu

SEQ ID NO: 987377 - RNA, 21 nt, Human
gagacagacuuucguccccug

SEQ ID NO: 987378 - RNA, 22 nt, Human
auaucuuuuagagcaagcuugu

SEQ ID NO: 987379 - RNA, 22 nt, Human
uggccugccugggagcagcagg

SEQ ID NO: 987380 - RNA, 22 nt, Human
ugccugucucugacugccauua

SEQ ID NO: 987381 - RNA, 23 nt, Human
ugggccuggccucccaguccagc

SEQ ID NO: 987382 - RNA, 22 nt, Human
ggcggggguccaggagccugca

SEQ ID NO: 987383 - RNA, 22 nt, Human
cuuugaaaacuuaaauaacagc

SEQ ID NO: 987384 - RNA, 22 nt, Human
augauguuauuuucagaaacau

SEQ ID NO: 987385 - RNA, 22 nt, Human
cugagaggugacagcgugcugg

SEQ ID NO: 987386 - RNA, 22 nt, Human
aaacuguauauuuauggcaugu

SEQ ID NO: 987387 - RNA, 22 nt, Human
uggcuuccugcauggauccucu

SEQ ID NO: 987388 - RNA, 23 nt, Human
aggagaagagauuuccacaugca

SEQ ID NO: 987389 - RNA, 22 nt, Human
gccugguguccagaggcgagug

SEQ ID NO: 987390 - RNA, 22 nt, Human
ugggagcugggguuggacgucu

SEQ ID NO: 987391 - RNA, 20 nt, Human
gucagugucuucaguaguga

SEQ ID NO: 987392 - RNA, 22 nt, Human
cucagagcaaugaacaugcaaa

SEQ ID NO: 987393 - RNA, 22 nt, Human
cuguguggccucaagccagccu

SEQ ID NO: 987394 - RNA, 22 nt, Human
uggcagggccugaaucuuauac

SEQ ID NO: 987395 - RNA, 21 nt, Human
uaucuacuggugucuuucaga

SEQ ID NO: 987396 - RNA, 22 nt, Human
caggccugugaguugaggcccc

SEQ ID NO: 987397 - RNA, 18 nt, Human
ugucucugaauuccagug

SEQ ID NO: 987398 - RNA, 22 nt, Human
uugacagcaaagauugugccua

SEQ ID NO: 987399 - RNA, 22 nt, Human
cuggcuccaucacugggugaug

SEQ ID NO: 987400 - RNA, 22 nt, Human
acucugcaauguggcaagaaca

SEQ ID NO: 987401 - RNA, 22 nt, Human
ugcugccacaaauucagcugcc

SEQ ID NO: 987402 - RNA, 20 nt, Human
gagauuuccaaucaugccca

SEQ ID NO: 987403 - RNA, 22 nt, Human
auguacaguggaaacuaacaaa

SEQ ID NO: 987404 - RNA, 22 nt, Human
gggguggauuccuacaggucca

SEQ ID NO: 987405 - RNA, 22 nt, Human
uggccagguguggguucucaga

SEQ ID NO: 987406 - RNA, 22 nt, Human
cagagguacaagcuaaguuggg

SEQ ID NO: 987407 - RNA, 21 nt, Human
uggcacugcuuagcagguucc

SEQ ID NO: 987408 - RNA, 22 nt, Human
uggcucaggggucuggcucugu

SEQ ID NO: 987409 - RNA, 22 nt, Human
cagucccaggguugguucagcu

SEQ ID NO: 987410 - RNA, 22 nt, Human
cagccucucuguaucucaggau

SEQ ID NO: 987411 - RNA, 22 nt, Human
aagugacacauggcacuucuau

SEQ ID NO: 987412 - RNA, 23 nt, Human
gcuguuagauuuaauaagcauuu

SEQ ID NO: 987413 - RNA, 22 nt, Human
guggcuugaccaucccugcuac

SEQ ID NO: 987414 - RNA, 16 nt, Human
gagggcagaggcggaa

SEQ ID NO: 987415 - RNA, 22 nt, Human
cuccagggagcugcgggagcca

SEQ ID NO: 987416 - RNA, 22 nt, Human
cagaggccuuucuacagugaua

SEQ ID NO: 987417 - RNA, 22 nt, Human
uauaguaaaauuuucauuuaug

SEQ ID NO: 987418 - RNA, 22 nt, Human
aaaugcagguucuugagccaag

SEQ ID NO: 987419 - RNA, 22 nt, Human
uggcaguggcucagagugcaga

SEQ ID NO: 987420 - RNA, 22 nt, Human
acacacaacucauuguguaaua

SEQ ID NO: 987421 - RNA, 22 nt, Human
auucacaaguucuagggauuag

SEQ ID NO: 987422 - RNA, 22 nt, Human
ugauuuccuggcuuuggaguuc

SEQ ID NO: 987423 - RNA, 21 nt, Human
agagaagaggacuuucucaca

SEQ ID NO: 987424 - RNA, 22 nt, Human
ggucaggguuccagguaucuuc

SEQ ID NO: 987425 - RNA, 22 nt, Human
aguguauugauuggaacagccu

SEQ ID NO: 987426 - RNA, 20 nt, Human
gcuuccuucccagcccccac

SEQ ID NO: 987427 - RNA, 19 nt, Human
ggcugucuggcguguggau

SEQ ID NO: 987428 - RNA, 20 nt, Human
agguggcuccugcugggggu

SEQ ID NO: 987429 - RNA, 22 nt, Human
ugagccaaacuucuccuugguc

SEQ ID NO: 987430 - RNA, 22 nt, Human
uccuucaggguugaggccgacu

SEQ ID NO: 987431 - RNA, 22 nt, Human
aaaguucugggggagaagaacg

SEQ ID NO: 987432 - RNA, 22 nt, Human
cugcugcauuacucuucucaag

SEQ ID NO: 987433 - RNA, 22 nt, Human
cuggcagguuuggugucuggug

SEQ ID NO: 987434 - RNA, 22 nt, Human
acugucugcuggccccugguua

SEQ ID NO: 987435 - RNA, 22 nt, Human
aggccaaauguguauaaaacau

SEQ ID NO: 987436 - RNA, 23 nt, Human
acaguuauagcugugaauaacau

SEQ ID NO: 987437 - RNA, 22 nt, Human
ucagcuuggacagcuugguuga

SEQ ID NO: 987438 - RNA, 22 nt, Human
agggcacaagacucugagcccc

SEQ ID NO: 987439 - RNA, 22 nt, Human
ugguggcaauguccuggagaag

SEQ ID NO: 987440 - RNA, 22 nt, Human
aagaguaugcaugcauguuugu

SEQ ID NO: 987441 - RNA, 22 nt, Human
gcucagagcaucccagugaaug

SEQ ID NO: 987442 - RNA, 16 nt, Human
ugggcagaugagaaga

SEQ ID NO: 987443 - RNA, 22 nt, Human
ggagcugucuguagggcacagg

SEQ ID NO: 987444 - RNA, 22 nt, Human
uucaggagcuggcugcgaagga

SEQ ID NO: 987445 - RNA, 22 nt, Human
cagcacuggggggauucggagc

SEQ ID NO: 987446 - RNA, 17 nt, Human
aggcagcucagaacauc

SEQ ID NO: 987447 - RNA, 22 nt, Human
agguggggugagcugcagacua

SEQ ID NO: 987448 - RNA, 22 nt, Human
aauguggaaucauggacuuuau

SEQ ID NO: 987449 - RNA, 23 nt, Human
cuggcucuguagguggcauccuu

SEQ ID NO: 987450 - RNA, 22 nt, Human
gcucccagcauugcuucccagg

SEQ ID NO: 987451 - RNA, 22 nt, Human
acuccuggguucuaaauuugaa

SEQ ID NO: 987452 - RNA, 22 nt, Human
cuggcagcguguuuaugaacau

SEQ ID NO: 987453 - RNA, 20 nt, Human
caggcacacucauuccugcu

SEQ ID NO: 987454 - RNA, 22 nt, Human
uaaaugcaguuaguacuugcca

SEQ ID NO: 987455 - RNA, 22 nt, Human
gaguuauuuguagggauuauau

SEQ ID NO: 987456 - RNA, 22 nt, Human
gagcucaggagcaucagaagaa

SEQ ID NO: 987457 - RNA, 22 nt, Human
gcccagcaggacagagugguuu

SEQ ID NO: 987458 - RNA, 22 nt, Human
gagcuuugcuggaagccugggg

SEQ ID NO: 987459 - RNA, 22 nt, Human
acuggacagaggaaauauggag

SEQ ID NO: 987460 - RNA, 22 nt, Human
uuguguccugauuugacacaau

SEQ ID NO: 987461 - RNA, 22 nt, Human
ugcugccaccugguggcugaag

SEQ ID NO: 987462 - RNA, 22 nt, Human
aggccuggccugggcggcauug

SEQ ID NO: 987463 - RNA, 22 nt, Human
uaacagaaauagaaaugagagu

SEQ ID NO: 987464 - RNA, 22 nt, Human
ccagcccugccagagagagcug

SEQ ID NO: 987465 - RNA, 22 nt, Human
uuuauuaauguagcauccaugg

SEQ ID NO: 987466 - RNA, 22 nt, Human
ggucucagcaguugcuuugacu

SEQ ID NO: 987467 - RNA, 22 nt, Human
uguguauuucuggaacagacua

SEQ ID NO: 987468 - RNA, 22 nt, Human
gugucccaggccucuggaauua

SEQ ID NO: 987469 - RNA, 22 nt, Human
ucagagagccucaggcacugcc

SEQ ID NO: 987470 - RNA, 22 nt, Human
ggugaggggagagugaaagaaa

SEQ ID NO: 987471 - RNA, 22 nt, Human
ggagggcugccagguggagcgg

SEQ ID NO: 987472 - RNA, 22 nt, Human
gcugccuggagcucagccugcc

SEQ ID NO: 987473 - RNA, 20 nt, Human
aauaaaagaagccuucaccc

SEQ ID NO: 987474 - RNA, 22 nt, Human
agcacauucuugccuuaaccuc

SEQ ID NO: 987475 - RNA, 22 nt, Human
aggcugggaagguaaaguugua

SEQ ID NO: 987476 - RNA, 20 nt, Human
cugggccauccuuuuacaau

SEQ ID NO: 987477 - RNA, 22 nt, Human
guaacagaggguuugcagauau

SEQ ID NO: 987478 - RNA, 22 nt, Human
uuggccaaggaaguagcaacgg

SEQ ID NO: 987479 - RNA, 22 nt, Human
ucuggagcuuguuucagauggu

SEQ ID NO: 987480 - RNA, 22 nt, Human
uagugauuaaaggcagaauguu

SEQ ID NO: 987481 - RNA, 22 nt, Human
gaaaggugccccauaggcagga

SEQ ID NO: 987482 - RNA, 22 nt, Human
ggaggccaaggcagguggaucg

SEQ ID NO: 987483 - RNA, 22 nt, Human
gaggccuggaccagccacagag

SEQ ID NO: 987484 - RNA, 22 nt, Human
ccucccuggccagagcagcagc

SEQ ID NO: 987485 - RNA, 22 nt, Human
ucaaggcuaaacuuucagagua

SEQ ID NO: 987486 - RNA, 22 nt, Human
acuggcaguuugagaaugcauu

SEQ ID NO: 987487 - RNA, 22 nt, Human
uccugccuaccuugcggaggug

SEQ ID NO: 987488 - RNA, 17 nt, Human
uucucuuccuggauagu

SEQ ID NO: 987489 - RNA, 17 nt, Human
uggcuucccugggccac

SEQ ID NO: 987490 - RNA, 22 nt, Human
cugagcauggccgguccauggu

SEQ ID NO: 987491 - RNA, 22 nt, Human
cacacaugaaucccuaguaccu

SEQ ID NO: 987492 - RNA, 22 nt, Human
aaguucaauggaaaagcuuuag

SEQ ID NO: 987493 - RNA, 22 nt, Human
ugagaggcagaauggugccugc

SEQ ID NO: 987494 - RNA, 22 nt, Human
gggccagagcuuggcagcuggg

SEQ ID NO: 987495 - RNA, 23 nt, Human
ccagcccuccaccagcucuaggc

SEQ ID NO: 987496 - RNA, 22 nt, Human
ggggagugacgcagggccauag

SEQ ID NO: 987497 - RNA, 22 nt, Human
agugcacaccuuaguacaaagu

SEQ ID NO: 987498 - RNA, 22 nt, Human
ccuggccaggcauggagucaca

SEQ ID NO: 987499 - RNA, 22 nt, Human
ugugaaaggagccauagacagu

SEQ ID NO: 987500 - RNA, 22 nt, Human
aaaugcagaucccugaaucuca

SEQ ID NO: 987501 - RNA, 22 nt, Human
ggcugccacgucgaggguccaa

SEQ ID NO: 987502 - RNA, 22 nt, Human
cucccagggccaucgagucacu

SEQ ID NO: 987503 - RNA, 22 nt, Human
gaagcagcugccagagaugucu

SEQ ID NO: 987504 - RNA, 22 nt, Human
ccugccugucccucaguccaca

SEQ ID NO: 987505 - RNA, 22 nt, Human
agccaagcacucaacuccugga

SEQ ID NO: 987506 - RNA, 22 nt, Human
gagcacagaaucuucccaugca

SEQ ID NO: 987507 - RNA, 22 nt, Human
guagcccaccuggggagggcga

SEQ ID NO: 987508 - RNA, 22 nt, Human
agucucugagguucagaugccu

SEQ ID NO: 987509 - RNA, 22 nt, Human
uccauuuacuauucucauaucg

SEQ ID NO: 987510 - RNA, 22 nt, Human
gcagugggaagguuggcacaug

SEQ ID NO: 987511 - RNA, 22 nt, Human
ugcagggcuuccucuuggaguu

SEQ ID NO: 987512 - RNA, 22 nt, Human
uccagggauguccuguagcacu

SEQ ID NO: 987513 - RNA, 22 nt, Human
ccugccugcguccucugagggc

SEQ ID NO: 987514 - RNA, 22 nt, Human
aaaacucugcaguuaguuucua

SEQ ID NO: 987515 - RNA, 22 nt, Human
uggcagcagcuaacuuaggcag

SEQ ID NO: 987516 - RNA, 22 nt, Human
uuccucugaaauggcuuggaaa

SEQ ID NO: 987517 - RNA, 22 nt, Human
acagggaauggagggaucagua

SEQ ID NO: 987518 - RNA, 22 nt, Human
ccucugcucugguccaugugcu

SEQ ID NO: 987519 - RNA, 22 nt, Human
cugugcauugucuugucuguag

SEQ ID NO: 987520 - RNA, 22 nt, Human
auaaggcagaaauagggaaagu

SEQ ID NO: 987521 - RNA, 22 nt, Human
uuccucucgcucuccggggccc

SEQ ID NO: 987522 - RNA, 22 nt, Human
cagagccaaaccucagggcccg

SEQ ID NO: 987523 - RNA, 22 nt, Human
aacagacaacuccuguggcuca

SEQ ID NO: 987524 - RNA, 22 nt, Human
cagacagacagccguggccacc

SEQ ID NO: 987525 - RNA, 22 nt, Human
cugucaguucuuccagauagag

SEQ ID NO: 987526 - RNA, 21 nt, Human
ccagagccugcugagcccccu

SEQ ID NO: 987527 - RNA, 22 nt, Human
gcugaguguaaugauggcagag

SEQ ID NO: 987528 - RNA, 22 nt, Human
uggcucaguagcagugugguca

SEQ ID NO: 987529 - RNA, 22 nt, Human
cagagcuguugcggggcuuggc

SEQ ID NO: 987530 - RNA, 22 nt, Human
aagaacugugcuccaggcucca

SEQ ID NO: 987531 - RNA, 22 nt, Human
ggccaggcuggucucagacuuc

SEQ ID NO: 987532 - RNA, 20 nt, Human
cuguaucagguuacaaagua

SEQ ID NO: 987533 - RNA, 19 nt, Human
augauacaggugaaaauug

SEQ ID NO: 987534 - RNA, 22 nt, Human
guuugcauguauuaagucaaua

SEQ ID NO: 987535 - RNA, 22 nt, Human
cugcuuuggcucagugacauca

SEQ ID NO: 987536 - RNA, 22 nt, Human
aaaggugacacucugccagcug

SEQ ID NO: 987537 - RNA, 22 nt, Human
acacuuuuguguauauccaguu

SEQ ID NO: 987538 - RNA, 22 nt, Human
cugccuggcuaaacucaagucg

SEQ ID NO: 987539 - RNA, 22 nt, Human
ugcuuccugaggccgucuucuc

SEQ ID NO: 987540 - RNA, 22 nt, Human
aaaugcacagagccuuagagau

SEQ ID NO: 987541 - RNA, 22 nt, Human
gcccacacaccagcucaggagg

SEQ ID NO: 987542 - RNA, 21 nt, Human
gggagcuggaaacugggugac

SEQ ID NO: 987543 - RNA, 21 nt, Human
ggcagcccgcccucuccuggc

SEQ ID NO: 987544 - RNA, 22 nt, Human
gcucaggacuggaggagcgggg

SEQ ID NO: 987545 - RNA, 22 nt, Human
aagcuccccgaaacccaccucu

SEQ ID NO: 987546 - RNA, 22 nt, Human
gcucuggcuacuguggcuaccg

SEQ ID NO: 987547 - RNA, 22 nt, Human
gcugggcugagcuagacuuggc

SEQ ID NO: 987548 - RNA, 22 nt, Human
ugcugcuccugccuggcuccca

SEQ ID NO: 987549 - RNA, 20 nt, Human
ucucccaggcucagggaaga

SEQ ID NO: 987550 - RNA, 22 nt, Human
gcuguccaugucuggccucagu

SEQ ID NO: 987551 - RNA, 22 nt, Human
aggucauuuccuuagaggcaga

SEQ ID NO: 987552 - RNA, 22 nt, Human
aacucagcauccugcacagaga

SEQ ID NO: 987553 - RNA, 22 nt, Human
acagagcaauaacagggagagg

SEQ ID NO: 987554 - RNA, 22 nt, Human
agggucaggagacacuggcaac

SEQ ID NO: 987555 - RNA, 22 nt, Human
uccucugcuggaagggcaagag

SEQ ID NO: 987556 - RNA, 22 nt, Human
cugcagccuccugggguacaug

SEQ ID NO: 987557 - RNA, 21 nt, Human
acaugucucuaaucucaguga

SEQ ID NO: 987558 - RNA, 22 nt, Human
caaaguauauuggauugaaugg

SEQ ID NO: 987559 - RNA, 22 nt, Human
uggagaagucaaagugaacagg

SEQ ID NO: 987560 - RNA, 22 nt, Human
gagacagugguugcagaagcuc

SEQ ID NO: 987561 - RNA, 21 nt, Human
gcacagcaugaguguuggcau

SEQ ID NO: 987562 - RNA, 22 nt, Human
uucuuucccaguagaugugaaa

SEQ ID NO: 987563 - RNA, 22 nt, Human
uacaaaguuuucuuggauugag

SEQ ID NO: 987564 - RNA, 22 nt, Human
cuggcuccuccaaggccuggag

SEQ ID NO: 987565 - RNA, 22 nt, Human
aaaugucuuucaauagagaaau

SEQ ID NO: 987566 - RNA, 22 nt, Human
ggccugagcuugggcagcguau

SEQ ID NO: 987567 - RNA, 22 nt, Human
uuggcagggccaggcucucucu

SEQ ID NO: 987568 - RNA, 22 nt, Human
cacugcuuuaaggcugaguaac

SEQ ID NO: 987569 - RNA, 22 nt, Human
uguaugcuuuccaaaaaugcug

SEQ ID NO: 987570 - RNA, 22 nt, Human
ucuguuuaggcaaaauagcuac

SEQ ID NO: 987571 - RNA, 19 nt, Human
uccugggcugggccagguc

SEQ ID NO: 987572 - RNA, 22 nt, Human
cagcuggcuggucagugcacaa

SEQ ID NO: 987573 - RNA, 16 nt, Human
ccuuucucugccuucc

SEQ ID NO: 987574 - RNA, 19 nt, Human
agggagaauuccaagagga

SEQ ID NO: 987575 - RNA, 20 nt, Human
uggggccuguuucugugguu

SEQ ID NO: 987576 - RNA, 22 nt, Human
aaugaugguuaaacacuggagg

SEQ ID NO: 987577 - RNA, 18 nt, Human
gagcccugagucugcaca

SEQ ID NO: 987578 - RNA, 22 nt, Human
agccacagucugaugccugaga

SEQ ID NO: 987579 - RNA, 22 nt, Human
gugccugguuuggggaauguuc

SEQ ID NO: 987580 - RNA, 22 nt, Human
agggcagagcacugaauuggga

SEQ ID NO: 987581 - RNA, 22 nt, Human
ggccucugcccucacuccuguc

SEQ ID NO: 987582 - RNA, 20 nt, Human
cucucccagcacagcuuccu

SEQ ID NO: 987583 - RNA, 22 nt, Human
gggagggaaggaggcgccgugu

SEQ ID NO: 987584 - RNA, 22 nt, Human
auggccuggccagagcucugcu

SEQ ID NO: 987585 - RNA, 22 nt, Human
ggucccaggagaauaggugcaa

SEQ ID NO: 987586 - RNA, 22 nt, Human
ucaggcaguagaauugcuugaa

SEQ ID NO: 987587 - RNA, 22 nt, Human
cuccaggagcugugucuuucuu

SEQ ID NO: 987588 - RNA, 22 nt, Human
uaguaacagauuuauacagucu

SEQ ID NO: 987589 - RNA, 22 nt, Human
guacauuucauuuaaaugaugu

SEQ ID NO: 987590 - RNA, 22 nt, Human
ugcuccagugagcuggccaucc

SEQ ID NO: 987591 - RNA, 22 nt, Human
gugugccaacaaaagacagugc

SEQ ID NO: 987592 - RNA, 22 nt, Human
gucugaggaagaugcaggggga

SEQ ID NO: 987593 - RNA, 22 nt, Human
cugugcuugacagugggaagca

SEQ ID NO: 987594 - RNA, 22 nt, Human
gaggcagaaguugcagugagca

SEQ ID NO: 987595 - RNA, 22 nt, Human
ggcaucuguccaucucuccagc

SEQ ID NO: 987596 - RNA, 22 nt, Human
ccucugcucccuggugucugag

SEQ ID NO: 987597 - RNA, 22 nt, Human
aauguuaaaaccuucagugcuu

SEQ ID NO: 987598 - RNA, 22 nt, Human
uacauagcaaggaaaugacaga

SEQ ID NO: 987599 - RNA, 22 nt, Human
gggaguggagagcaauggauga

SEQ ID NO: 987600 - RNA, 22 nt, Human
aucaaaguucguaacugauaac

SEQ ID NO: 987601 - RNA, 22 nt, Human
gaugccugcauuucaggagagu

SEQ ID NO: 987602 - RNA, 22 nt, Human
gaggagagggcugcgggcccac

SEQ ID NO: 987603 - RNA, 22 nt, Human
gugcauuggugcgccacuucac

SEQ ID NO: 987604 - RNA, 22 nt, Human
guaucuuucccaccaaucacaa

SEQ ID NO: 987605 - RNA, 16 nt, Human
ggagagugucugcaaa

SEQ ID NO: 987606 - RNA, 19 nt, Human
cuuauuagagugagagcuu

SEQ ID NO: 987607 - RNA, 22 nt, Human
ucuguggauuuuaguguucaug

SEQ ID NO: 987608 - RNA, 22 nt, Human
ggagccugugcccaagcccaga

SEQ ID NO: 987609 - RNA, 22 nt, Human
cuuugaaagcucccaggacuua

SEQ ID NO: 987610 - RNA, 22 nt, Human
ucauacaucuuguauaucuauc

SEQ ID NO: 987611 - RNA, 22 nt, Human
uucacagggccacuggcaggag

SEQ ID NO: 987612 - RNA, 22 nt, Human
uggcucaguuucaguccugguu

SEQ ID NO: 987613 - RNA, 22 nt, Human
gcagacaucaagcacaggccca

SEQ ID NO: 987614 - RNA, 22 nt, Human
gagccaggggucagcuccgagg

SEQ ID NO: 987615 - RNA, 22 nt, Human
caggcacagaguuauucauuua

SEQ ID NO: 987616 - RNA, 22 nt, Human
ugugcugguacaugugaggaug

SEQ ID NO: 987617 - RNA, 22 nt, Human
cuggcuuccaugcuguaguggc

SEQ ID NO: 987618 - RNA, 21 nt, Human
cugguguagcacucaggugcu

SEQ ID NO: 987619 - RNA, 23 nt, Human
agagcuuagggaauucacaugag

SEQ ID NO: 987620 - RNA, 22 nt, Human
agguaaagacagugaaagaggg

SEQ ID NO: 987621 - RNA, 22 nt, Human
agccucugguccucccucagcu

SEQ ID NO: 987622 - RNA, 22 nt, Human
ucccagccacagguguagcccu

SEQ ID NO: 987623 - RNA, 22 nt, Human
gacagcagggacauguaggaag

SEQ ID NO: 987624 - RNA, 17 nt, Human
agagagagcaugccacc

SEQ ID NO: 987625 - RNA, 22 nt, Human
agaggaugguugaggaagaccu

SEQ ID NO: 987626 - RNA, 22 nt, Human
ugaaaguugcacauaagagaau

SEQ ID NO: 987627 - RNA, 22 nt, Human
aggacucaucccugcuugucag

SEQ ID NO: 987628 - RNA, 22 nt, Human
uacucugccccagccaauaaug

SEQ ID NO: 987629 - RNA, 22 nt, Human
gcugggagccccgagccagcgc

SEQ ID NO: 987630 - RNA, 19 nt, Human
uccaaaggacccaccucca

SEQ ID NO: 987631 - RNA, 22 nt, Human
cucuggagcaccgggcuaucca

SEQ ID NO: 987632 - RNA, 22 nt, Human
gauuuggccuuucgcaugguau

SEQ ID NO: 987633 - RNA, 22 nt, Human
cugagccagcgggcucacuuuu

SEQ ID NO: 987634 - RNA, 22 nt, Human
cagcagcugggaaggaggcuga

SEQ ID NO: 987635 - RNA, 22 nt, Human
ucagagccccuccgcuguccca

SEQ ID NO: 987636 - RNA, 22 nt, Human
gaagagcugcaguuuccugggc

SEQ ID NO: 987637 - RNA, 22 nt, Human
aggacagaccuaggacuggagc

SEQ ID NO: 987638 - RNA, 22 nt, Human
agagccaggcaggcaauguuga

SEQ ID NO: 987639 - RNA, 22 nt, Human
caagagcauuuaguuagcuggu

SEQ ID NO: 987640 - RNA, 22 nt, Human
ggagaugguggaagcuggugca

SEQ ID NO: 987641 - RNA, 22 nt, Human
guacaguuuucaguguucacug

SEQ ID NO: 987642 - RNA, 22 nt, Human
gacacauagaucuaucucacuc

SEQ ID NO: 987643 - RNA, 22 nt, Human
uuggcacacaguaagcccuaag

SEQ ID NO: 987644 - RNA, 23 nt, Human
agccucuuuucuccugcccugca

SEQ ID NO: 987645 - RNA, 22 nt, Human
gcuggcaccugcaccaagcagg

SEQ ID NO: 987646 - RNA, 22 nt, Human
gggcuggcaucaguugccgaga

SEQ ID NO: 987647 - RNA, 22 nt, Human
gagagcugcagccgagaggggg

SEQ ID NO: 987648 - RNA, 22 nt, Human
cugagguguugaugaccuaugc

SEQ ID NO: 987649 - RNA, 22 nt, Human
ggagccagcagggugacacuga

SEQ ID NO: 987650 - RNA, 22 nt, Human
cuguccugcaguugggggcagg

SEQ ID NO: 987651 - RNA, 22 nt, Human
uggagcagagaugguggccuuc

SEQ ID NO: 987652 - RNA, 20 nt, Human
ccaggcacugucccaugcag

SEQ ID NO: 987653 - RNA, 22 nt, Human
cuuuauuagauguagacuuucu

SEQ ID NO: 987654 - RNA, 22 nt, Human
gagcugucucuauaugaaugcu

SEQ ID NO: 987655 - RNA, 22 nt, Human
aucuggcucaccuggguaaaua

SEQ ID NO: 987656 - RNA, 22 nt, Human
cuggcuccacucccugccugac

SEQ ID NO: 987657 - RNA, 22 nt, Human
cugggcuggagugcaauggcgc

SEQ ID NO: 987658 - RNA, 22 nt, Human
ccagccagcugcccuuggggcc

SEQ ID NO: 987659 - RNA, 22 nt, Human
ggaugcaggacggcauggaugu

SEQ ID NO: 987660 - RNA, 23 nt, Human
cauguacagaguuugauaaagug

SEQ ID NO: 987661 - RNA, 20 nt, Human
gugaccagaagacagugggu

SEQ ID NO: 987662 - RNA, 19 nt, Human
agacacacuugauaugugu

SEQ ID NO: 987663 - RNA, 20 nt, Human
uaggcagagcugugcagccu

SEQ ID NO: 987664 - RNA, 22 nt, Human
uggcagcagccauggaaggccc

SEQ ID NO: 987665 - RNA, 22 nt, Human
ccuccuggaaaaauucccuggc

SEQ ID NO: 987666 - RNA, 22 nt, Human
cagggcugaaaucaagguguag

SEQ ID NO: 987667 - RNA, 22 nt, Human
cugccuggcauggagaagagaa

SEQ ID NO: 987668 - RNA, 18 nt, Human
aggccagcccugcuacug

SEQ ID NO: 987669 - RNA, 22 nt, Human
guagcuuauuagggauaauagu

SEQ ID NO: 987670 - RNA, 22 nt, Human
cugggcuggcgcauccgacacg

SEQ ID NO: 987671 - RNA, 22 nt, Human
uggacucaaguccaaguucacg

SEQ ID NO: 987672 - RNA, 22 nt, Human
caggggcuuaagugacagaagg

SEQ ID NO: 987673 - RNA, 22 nt, Human
cuccuuggccguuaaugucaca

SEQ ID NO: 987674 - RNA, 22 nt, Human
cacaugcauaaggauaauuacu

SEQ ID NO: 987675 - RNA, 22 nt, Human
ccagccuccauguagauagcug

SEQ ID NO: 987676 - RNA, 22 nt, Human
acagagccacuuuggugccuac

SEQ ID NO: 987677 - RNA, 21 nt, Human
ugggagagggcucagcuaccc

SEQ ID NO: 987678 - RNA, 22 nt, Human
aucugaagcuaucugcacuuca

SEQ ID NO: 987679 - RNA, 22 nt, Human
uauucacagguucuggggauca

SEQ ID NO: 987680 - RNA, 22 nt, Human
ugucucaguacacuccgauguu

SEQ ID NO: 987681 - RNA, 21 nt, Human
gcagggacaaagcuucaggag

SEQ ID NO: 987682 - RNA, 18 nt, Human
caaagcucacguuccauc

SEQ ID NO: 987683 - RNA, 22 nt, Human
uuugaguugcuuauuuaauagg

SEQ ID NO: 987684 - RNA, 22 nt, Human
ccugugcauccgguggucauug

SEQ ID NO: 987685 - RNA, 22 nt, Human
agcuccugcacccagccuugag

SEQ ID NO: 987686 - RNA, 22 nt, Human
aagggcuggccacauucugggu

SEQ ID NO: 987687 - RNA, 22 nt, Human
caagagcucaccggagagcauu

SEQ ID NO: 987688 - RNA, 19 nt, Human
agugaaauggaguauucaa

SEQ ID NO: 987689 - RNA, 22 nt, Human
cugaaggacuuggugauaguug

SEQ ID NO: 987690 - RNA, 22 nt, Human
ccucucaucauuaucgcuuugu

SEQ ID NO: 987691 - RNA, 22 nt, Human
ccagcagagggucuuggccauu

SEQ ID NO: 987692 - RNA, 22 nt, Human
agagugaaaagcuagagcagua

SEQ ID NO: 987693 - RNA, 16 nt, Human
gagccaggugccuuga

SEQ ID NO: 987694 - RNA, 22 nt, Human
guguggcugauugacaugguca

SEQ ID NO: 987695 - RNA, 22 nt, Human
ugcuggagaucauuaauguuca

SEQ ID NO: 987696 - RNA, 22 nt, Human
gaggccagaaugagcugaaugc

SEQ ID NO: 987697 - RNA, 22 nt, Human
accagccugucugagucguggg

SEQ ID NO: 987698 - RNA, 22 nt, Human
ugguaaaguguacugaauauga

SEQ ID NO: 987699 - RNA, 22 nt, Human
gcccucugcacagcucugagca

SEQ ID NO: 987700 - RNA, 22 nt, Human
accacugcccauggugaaaacu

SEQ ID NO: 987701 - RNA, 22 nt, Human
gccagguggcugagugacugag

SEQ ID NO: 987702 - RNA, 22 nt, Human
agucccagugagaugaaccagg

SEQ ID NO: 987703 - RNA, 22 nt, Human
cagugcaugaaacaauaugcag

SEQ ID NO: 987704 - RNA, 22 nt, Human
auuuaucaccaguuagcugacu

SEQ ID NO: 987705 - RNA, 22 nt, Human
caggggcucugagauugucuaa

SEQ ID NO: 987706 - RNA, 22 nt, Human
cuggcagcgcagcaugaagucg

SEQ ID NO: 987707 - RNA, 22 nt, Human
gcagcagagaacacaaugaugg

SEQ ID NO: 987708 - RNA, 22 nt, Human
gcugccugguuucucagcugca

SEQ ID NO: 987709 - RNA, 22 nt, Human
uacauguauugauuucucuucu

SEQ ID NO: 987710 - RNA, 22 nt, Human
agccagcuggugggucagcugg

SEQ ID NO: 987711 - RNA, 22 nt, Human
guggccugaugccagcccugug

SEQ ID NO: 987712 - RNA, 23 nt, Human
ggggccugcaccggucugcgcgg

SEQ ID NO: 987713 - RNA, 22 nt, Human
cagcagugucuccagcaucaca

SEQ ID NO: 987714 - RNA, 19 nt, Human
gugauuucuuuccacaagc

SEQ ID NO: 987715 - RNA, 22 nt, Human
cuucagggugacgcaggcugca

SEQ ID NO: 987716 - RNA, 22 nt, Human
uccuucagaggacggcagccag

SEQ ID NO: 987717 - RNA, 22 nt, Human
auggggugaccaugagcauuua

SEQ ID NO: 987718 - RNA, 22 nt, Human
uggccuggugcucaggcaguag

SEQ ID NO: 987719 - RNA, 22 nt, Human
aagcagcugauuucacagcuca

SEQ ID NO: 987720 - RNA, 22 nt, Human
cagcuugcaguacuuguuuuug

SEQ ID NO: 987721 - RNA, 22 nt, Human
cucugggcacauuuuccaggac

SEQ ID NO: 987722 - RNA, 22 nt, Human
ugcugccagccaggccauggag

SEQ ID NO: 987723 - RNA, 22 nt, Human
ccaccagcuucagcagccgcgg

SEQ ID NO: 987724 - RNA, 22 nt, Human
gcucagaggaugcuccuuuaug

SEQ ID NO: 987725 - RNA, 22 nt, Human
acuggcagagguuggacaccau

SEQ ID NO: 987726 - RNA, 22 nt, Human
ugccucugcugcuguggcauca

SEQ ID NO: 987727 - RNA, 21 nt, Human
agcagccauggaugguaugua

SEQ ID NO: 987728 - RNA, 22 nt, Human
auuugucuucaguagguucuuc

SEQ ID NO: 987729 - RNA, 22 nt, Human
gcucaggaccgaggggugggaa

SEQ ID NO: 987730 - RNA, 22 nt, Human
uagauuucucauucauagauug

SEQ ID NO: 987731 - RNA, 22 nt, Human
aaggcacuuaacgugggaggau

SEQ ID NO: 987732 - RNA, 21 nt, Human
acacauuaugagcauagacuc

SEQ ID NO: 987733 - RNA, 22 nt, Human
cagucacacaaguggacuuggg

SEQ ID NO: 987734 - RNA, 22 nt, Human
auacuuuggggguuaguguaga

SEQ ID NO: 987735 - RNA, 22 nt, Human
aaagauuucacaucccaagccu

SEQ ID NO: 987736 - RNA, 22 nt, Human
gagggcagagacagugauucac

SEQ ID NO: 987737 - RNA, 21 nt, Human
uuuauguacuucauagaguag

SEQ ID NO: 987738 - RNA, 22 nt, Human
guggggggacguuggucacuuu

SEQ ID NO: 987739 - RNA, 22 nt, Human
aagccagggauuccugagggag

SEQ ID NO: 987740 - RNA, 19 nt, Human
gccugagccagccaugcaa

SEQ ID NO: 987741 - RNA, 22 nt, Human
uggccaggggaguuccccucca

SEQ ID NO: 987742 - RNA, 22 nt, Human
aaauauaguaaaugcauaguuc

SEQ ID NO: 987743 - RNA, 22 nt, Human
aucuuccuucacuuucucccac

SEQ ID NO: 987744 - RNA, 20 nt, Human
ucagccagcuaacaugggga

SEQ ID NO: 987745 - RNA, 22 nt, Human
ugcauuugucuugucucaugaa

SEQ ID NO: 987746 - RNA, 22 nt, Human
ggccucagaccggagcuggcca

SEQ ID NO: 987747 - RNA, 22 nt, Human
cauugcuguuaauugucucuag

SEQ ID NO: 987748 - RNA, 22 nt, Human
gccugugacucgucuugggcca

SEQ ID NO: 987749 - RNA, 22 nt, Human
agcagggccaacaguaaacacc

SEQ ID NO: 987750 - RNA, 22 nt, Human
gaacccaaccucacuuggggua

SEQ ID NO: 987751 - RNA, 22 nt, Human
acauuuaggauguuuugagaga

SEQ ID NO: 987752 - RNA, 22 nt, Human
ggcucugcuggauugaggccag

SEQ ID NO: 987753 - RNA, 22 nt, Human
ccacugucugcaggccucagca

SEQ ID NO: 987754 - RNA, 22 nt, Human
uuagaaaacauaagugguaaag

SEQ ID NO: 987755 - RNA, 22 nt, Human
aagcugcccuguguuagaguuc

SEQ ID NO: 987756 - RNA, 20 nt, Human
ugcagaagaacguucugguu

SEQ ID NO: 987757 - RNA, 22 nt, Human
uuuauuauagugguggggacug

SEQ ID NO: 987758 - RNA, 20 nt, Human
ugcugcaguuucaugggacu

SEQ ID NO: 987759 - RNA, 23 nt, Human
gcaggugguucgaacagaaguuu

SEQ ID NO: 987760 - RNA, 17 nt, Human
cgagggcuugcuggcuc

SEQ ID NO: 987761 - RNA, 22 nt, Human
gugcauuuggugacucucaccc

SEQ ID NO: 987762 - RNA, 22 nt, Human
agaaugcauuuuguguagcuau

SEQ ID NO: 987763 - RNA, 22 nt, Human
gggcuggagccagcuguggcug

SEQ ID NO: 987764 - RNA, 21 nt, Human
cucuggaggcaagggagagug

SEQ ID NO: 987765 - RNA, 21 nt, Human
ucagaguguguuacagcaagc

SEQ ID NO: 987766 - RNA, 22 nt, Human
caguauguuugggagacaugac

SEQ ID NO: 987767 - RNA, 22 nt, Human
ccugucugcaugaucccugcca

SEQ ID NO: 987768 - RNA, 22 nt, Human
gccagcagccacagaagucacu

SEQ ID NO: 987769 - RNA, 22 nt, Human
agucugcuuccuggagaacuca

SEQ ID NO: 987770 - RNA, 19 nt, Human
ccuuggaguuccaggugga

SEQ ID NO: 987771 - RNA, 22 nt, Human
ggaggaugagcuacgaggagcu

SEQ ID NO: 987772 - RNA, 22 nt, Human
guucagggagggacagaugaag

SEQ ID NO: 987773 - RNA, 21 nt, Human
gccaccucgucucggagcagc

SEQ ID NO: 987774 - RNA, 22 nt, Human
gaugcacagugacccugccagu

SEQ ID NO: 987775 - RNA, 22 nt, Human
ggucagguuuuuaggagugacc

SEQ ID NO: 987776 - RNA, 22 nt, Human
aagauuucugcuuuuggaggca

SEQ ID NO: 987777 - RNA, 21 nt, Human
agacaguaacucuucuacucc

SEQ ID NO: 987778 - RNA, 22 nt, Human
agcagcugcagggagggucugc

SEQ ID NO: 987779 - RNA, 22 nt, Human
cucacugcaaguuccaccuacc

SEQ ID NO: 987780 - RNA, 22 nt, Human
ugaagcagagugaaggugaauu

SEQ ID NO: 987781 - RNA, 22 nt, Human
uuccuugaaugagucauggaaa

SEQ ID NO: 987782 - RNA, 22 nt, Human
uccucugcuguucugguucuuu

SEQ ID NO: 987783 - RNA, 22 nt, Human
ucaucacucauuggacaacaga

SEQ ID NO: 987784 - RNA, 22 nt, Human
cuugcugggguaagucugugcu

SEQ ID NO: 987785 - RNA, 22 nt, Human
uuucaguguaagguuuccagga

SEQ ID NO: 987786 - RNA, 22 nt, Human
ccuuucucuaucgacccaucgc

SEQ ID NO: 987787 - RNA, 20 nt, Human
cccucugcuacacugggagc

SEQ ID NO: 987788 - RNA, 22 nt, Human
agaggcuccaccuucucugucc

SEQ ID NO: 987789 - RNA, 22 nt, Human
aggggccuggacauggacgcgc

SEQ ID NO: 987790 - RNA, 22 nt, Human
acacucugugaggcauguaaug

SEQ ID NO: 987791 - RNA, 20 nt, Human
uuugagaccagucugcccaa

SEQ ID NO: 987792 - RNA, 22 nt, Human
cauuguauugaggauacuuaag

SEQ ID NO: 987793 - RNA, 22 nt, Human
ucaauaaaauuguuuuccuauc

SEQ ID NO: 987794 - RNA, 22 nt, Human
guccugggccugcugaggcuga

SEQ ID NO: 987795 - RNA, 22 nt, Human
agggcagcucucaccucuggcc

SEQ ID NO: 987796 - RNA, 22 nt, Human
caggccuggagugcaauggcac

SEQ ID NO: 987797 - RNA, 22 nt, Human
gugcucuguguauuaggauguc

SEQ ID NO: 987798 - RNA, 22 nt, Human
aagggcaggugggcauuucugg

SEQ ID NO: 987799 - RNA, 22 nt, Human
gcacacaggcaguuuccagcca

SEQ ID NO: 987800 - RNA, 22 nt, Human
acagcagccugcagcccugugu

SEQ ID NO: 987801 - RNA, 22 nt, Human
agccagccaguucacuaggaaa

SEQ ID NO: 987802 - RNA, 22 nt, Human
ccaggcucugucuggucagaag

SEQ ID NO: 987803 - RNA, 22 nt, Human
ugucacauaauuuaucuguagg

SEQ ID NO: 987804 - RNA, 22 nt, Human
ugcuggccaauggcagaggcgg

SEQ ID NO: 987805 - RNA, 23 nt, Human
gcagagcugcccuauugccuugg

SEQ ID NO: 987806 - RNA, 23 nt, Human
ugcauuauccucucugaagacca

SEQ ID NO: 987807 - RNA, 22 nt, Human
gcagggacaaggcagguguucu

SEQ ID NO: 987808 - RNA, 22 nt, Human
caccagcuacagacuacugugu

SEQ ID NO: 987809 - RNA, 22 nt, Human
agacaggagagggaacugccgg

SEQ ID NO: 987810 - RNA, 22 nt, Human
acuuccugcagcuucucagccc

SEQ ID NO: 987811 - RNA, 22 nt, Human
caaagugcuggaauuacaggug

SEQ ID NO: 987812 - RNA, 22 nt, Human
ucagugucuugaccugggugug

SEQ ID NO: 987813 - RNA, 22 nt, Human
caaggagaguaauugaaugaga

SEQ ID NO: 987814 - RNA, 22 nt, Human
ugccugucagggggagugggaa

SEQ ID NO: 987815 - RNA, 21 nt, Human
ucagaguggaagacaguuuga

SEQ ID NO: 987816 - RNA, 23 nt, Human
ugcugggguaguuuguggcacag

SEQ ID NO: 987817 - RNA, 22 nt, Human
uugcauugggagugaggagacc

SEQ ID NO: 987818 - RNA, 22 nt, Human
uuccauaacugaccgaaugcau

SEQ ID NO: 987819 - RNA, 22 nt, Human
gcagccacacuguuacagaaug

SEQ ID NO: 987820 - RNA, 20 nt, Human
auacaaagagauugauguau

SEQ ID NO: 987821 - RNA, 22 nt, Human
acaaaaguguaggaauuccuua

SEQ ID NO: 987822 - RNA, 22 nt, Human
agagcuguggauaguccuggau

SEQ ID NO: 987823 - RNA, 22 nt, Human
caacuccuggcuguuaggcaca

SEQ ID NO: 987824 - RNA, 22 nt, Human
acucugcuuauugcugcaggca

SEQ ID NO: 987825 - RNA, 23 nt, Human
uccugagaugagacagugcugcc

SEQ ID NO: 987826 - RNA, 22 nt, Human
gcagcuggagcaucuucucauc

SEQ ID NO: 987827 - RNA, 22 nt, Human
agcuauguauuuguguguuaaa

SEQ ID NO: 987828 - RNA, 20 nt, Human
cccucccagaugcuucccaa

SEQ ID NO: 987829 - RNA, 22 nt, Human
aagaauucacugguagagucaa

SEQ ID NO: 987830 - RNA, 22 nt, Human
agaauucuguucuucgggugug

SEQ ID NO: 987831 - RNA, 22 nt, Human
cucaggccauucuuccagcugc

SEQ ID NO: 987832 - RNA, 22 nt, Human
gcaggcaguugcaguuuucuag

SEQ ID NO: 987833 - RNA, 22 nt, Human
ugucccagaucacaggagggga

SEQ ID NO: 987834 - RNA, 22 nt, Human
auugacaagugagcugggcugc

SEQ ID NO: 987835 - RNA, 20 nt, Human
ugggagcuggugaggucuca

SEQ ID NO: 987836 - RNA, 22 nt, Human
uucacaggaauguaggggucuu

SEQ ID NO: 987837 - RNA, 22 nt, Human
cuuguagaauugaaauggucuc

SEQ ID NO: 987838 - RNA, 22 nt, Human
gcagggacagggcagggccuuu

SEQ ID NO: 987839 - RNA, 22 nt, Human
ucaggggagguugaaucgucuc

SEQ ID NO: 987840 - RNA, 15 nt, Human
ucacucuggaaggga

SEQ ID NO: 987841 - RNA, 22 nt, Human
gaguuauuaauggcugaguuug

SEQ ID NO: 987842 - RNA, 22 nt, Human
agcacaggaccaaggaagcugu

SEQ ID NO: 987843 - RNA, 22 nt, Human
agccuggcuguaaccucauggu

SEQ ID NO: 987844 - RNA, 22 nt, Human
ugggcccugacuucaagcaucc

SEQ ID NO: 987845 - RNA, 22 nt, Human
auuuguacaaauuuauguuagu

SEQ ID NO: 987846 - RNA, 22 nt, Human
gcugugcagucuuuggugugcc

SEQ ID NO: 987847 - RNA, 22 nt, Human
cuuucucuguguuucacaugcu

SEQ ID NO: 987848 - RNA, 22 nt, Human
uucacauuaucaggauuguuuc

SEQ ID NO: 987849 - RNA, 20 nt, Human
uccugagauuuaagggguuc

SEQ ID NO: 987850 - RNA, 22 nt, Human
gagagugagauccuccugggga

SEQ ID NO: 987851 - RNA, 22 nt, Human
ugcagaagaaugagcuuggagu

SEQ ID NO: 987852 - RNA, 22 nt, Human
agagcccugaagcagagcuaaa

SEQ ID NO: 987853 - RNA, 22 nt, Human
cugagagucagcuucuccuccu

SEQ ID NO: 987854 - RNA, 22 nt, Human
ugcagccaauucauucauucuu

SEQ ID NO: 987855 - RNA, 22 nt, Human
agacucugcuaagaauauaauu

SEQ ID NO: 987856 - RNA, 20 nt, Human
gcagagccucacugcaaggg

SEQ ID NO: 987857 - RNA, 18 nt, Human
ucugucucuguccuugcu

SEQ ID NO: 987858 - RNA, 22 nt, Human
aggcuggggaauugaauuugcu

SEQ ID NO: 987859 - RNA, 22 nt, Human
gggcagcugcagggauggugac

SEQ ID NO: 987860 - RNA, 22 nt, Human
guggcuucugcggugugcgcag

SEQ ID NO: 987861 - RNA, 22 nt, Human
aaccuucacuugcuucauuuga

SEQ ID NO: 987862 - RNA, 22 nt, Human
ucugggagagcugcugucagag

SEQ ID NO: 987863 - RNA, 20 nt, Human
ugcuccaucuaaagugauua

SEQ ID NO: 987864 - RNA, 22 nt, Human
aguggcagccgagcaggagaug

SEQ ID NO: 987865 - RNA, 20 nt, Human
agcagcuguguuuucauccu

SEQ ID NO: 987866 - RNA, 22 nt, Human
uagcauuuauggucaugugucc

SEQ ID NO: 987867 - RNA, 22 nt, Human
uggcuggcuuguucacugacug

SEQ ID NO: 987868 - RNA, 22 nt, Human
ggcugccaggagggaggccagu

SEQ ID NO: 987869 - RNA, 23 nt, Human
uggggcugauggagacggaccag

SEQ ID NO: 987870 - RNA, 22 nt, Human
auguggcacagcacaguaagag

SEQ ID NO: 987871 - RNA, 22 nt, Human
gugucauguagaaauugaugaa

SEQ ID NO: 987872 - RNA, 22 nt, Human
gccaggcagcagcgaggauggu

SEQ ID NO: 987873 - RNA, 22 nt, Human
aagagguugucugugaugaguu

SEQ ID NO: 987874 - RNA, 22 nt, Human
ucauccaguucacauggugagu

SEQ ID NO: 987875 - RNA, 22 nt, Human
ggaggugaggccguagggugug

SEQ ID NO: 987876 - RNA, 20 nt, Human
aagagcauaguacaggaaga

SEQ ID NO: 987877 - RNA, 22 nt, Human
agcagcucuuaacaaagcaugg

SEQ ID NO: 987878 - RNA, 22 nt, Human
gagcugccaguguaugaauucu

SEQ ID NO: 987879 - RNA, 22 nt, Human
ggagccuggccuggcucugugu

SEQ ID NO: 987880 - RNA, 19 nt, Human
gcugcuggcucuggcugga

SEQ ID NO: 987881 - RNA, 22 nt, Human
gaugaggggucauuggcuggga

SEQ ID NO: 987882 - RNA, 22 nt, Human
cuccuugguguaguacugagca

SEQ ID NO: 987883 - RNA, 22 nt, Human
aagagcuggauggaaucuggga

SEQ ID NO: 987884 - RNA, 22 nt, Human
ccagagccggcucccucagcuu

SEQ ID NO: 987885 - RNA, 22 nt, Human
agcuggaggauaacucacuucu

SEQ ID NO: 987886 - RNA, 22 nt, Human
uuggcuuccaggaucucagcag

SEQ ID NO: 987887 - RNA, 19 nt, Human
ggcugcugguuacagaggc

SEQ ID NO: 987888 - RNA, 22 nt, Human
uucuuucccuuccagcagcucc

SEQ ID NO: 987889 - RNA, 22 nt, Human
uacaugcuccacuuucuccugu

SEQ ID NO: 987890 - RNA, 18 nt, Human
augugcaauuuuguauuu

SEQ ID NO: 987891 - RNA, 22 nt, Human
caagggcucacggucugcuggg

SEQ ID NO: 987892 - RNA, 22 nt, Human
uucucuagguuuuagaugaaga

SEQ ID NO: 987893 - RNA, 22 nt, Human
ugucccauggauaccaggcuau

SEQ ID NO: 987894 - RNA, 22 nt, Human
cagggcagaacauauagauagu

SEQ ID NO: 987895 - RNA, 22 nt, Human
uucaagaugucuucacaauagu

SEQ ID NO: 987896 - RNA, 22 nt, Human
agacaaagacagcaucucaggu

SEQ ID NO: 987897 - RNA, 22 nt, Human
ucacugaagacugggcucuaaa

SEQ ID NO: 987898 - RNA, 22 nt, Human
uuuauuaaaacuguuggcucug

SEQ ID NO: 987899 - RNA, 22 nt, Human
augcaaaaguaacugugauuuu

SEQ ID NO: 987900 - RNA, 22 nt, Human
gugcuuuccauccucccugcug

SEQ ID NO: 987901 - RNA, 22 nt, Human
gacucugcuaggaaaaucucag

SEQ ID NO: 987902 - RNA, 22 nt, Human
agucccagagaggucggggcca

SEQ ID NO: 987903 - RNA, 22 nt, Human
ccaguugguuucaaugggacag

SEQ ID NO: 987904 - RNA, 22 nt, Human
cagcauggugccagugagucca

SEQ ID NO: 987905 - RNA, 22 nt, Human
agcucccagaaggcccugcgcc

SEQ ID NO: 987906 - RNA, 20 nt, Human
ccuggaagagcuccccaggc

SEQ ID NO: 987907 - RNA, 23 nt, Human
agggcccaagccuggacagcagg

SEQ ID NO: 987908 - RNA, 22 nt, Human
aaguucaaguguaaucuuuauu

SEQ ID NO: 987909 - RNA, 22 nt, Human
aucaguuuuuauuaauguagcu

SEQ ID NO: 987910 - RNA, 22 nt, Human
uauaucuuauaugugcagguac

SEQ ID NO: 987911 - RNA, 22 nt, Human
ucaaaguuuuugagaauuacau

SEQ ID NO: 987912 - RNA, 22 nt, Human
ugcuuccuucccguucuucucc

SEQ ID NO: 987913 - RNA, 22 nt, Human
uccugccugagcguggaggagg

SEQ ID NO: 987914 - RNA, 22 nt, Human
uggcccugacuuggaggccuga

SEQ ID NO: 987915 - RNA, 22 nt, Human
ugucucagaguaucccugaacu

SEQ ID NO: 987916 - RNA, 22 nt, Human
uggcuggcuagugggcaggauu

SEQ ID NO: 987917 - RNA, 22 nt, Human
cccuggagugccggaaucaaga

SEQ ID NO: 987918 - RNA, 22 nt, Human
auccuucaaggggcugacagcu

SEQ ID NO: 987919 - RNA, 22 nt, Human
ucugcagcuuuuugguggggug

SEQ ID NO: 987920 - RNA, 22 nt, Human
gcagcguggggcugagucagcu

SEQ ID NO: 987921 - RNA, 20 nt, Human
gagccuuccccucaccacug

SEQ ID NO: 987922 - RNA, 22 nt, Human
cugggccugggaggccaggucu

SEQ ID NO: 987923 - RNA, 22 nt, Human
caggcagggagcuggaaaggau

SEQ ID NO: 987924 - RNA, 22 nt, Human
uggcccugucccuggagccugg

SEQ ID NO: 987925 - RNA, 22 nt, Human
cagggcuguuagcugcugcucu

SEQ ID NO: 987926 - RNA, 22 nt, Human
ugauuucccuguagccucugaa

SEQ ID NO: 987927 - RNA, 22 nt, Human
aagucagagcaacugagacauu

SEQ ID NO: 987928 - RNA, 22 nt, Human
aggagccaagauggggcaagua

SEQ ID NO: 987929 - RNA, 22 nt, Human
cacauuucugugagucaauauu

SEQ ID NO: 987930 - RNA, 22 nt, Human
caguuucuacgacuuaagcaca

SEQ ID NO: 987931 - RNA, 22 nt, Human
uauuucaugugcaccauaauuc

SEQ ID NO: 987932 - RNA, 22 nt, Human
agauacauugaguuuccuccug

SEQ ID NO: 987933 - RNA, 22 nt, Human
ugcauguuauuguggcaagaau

SEQ ID NO: 987934 - RNA, 22 nt, Human
cccaggcuggauuucgguggca

SEQ ID NO: 987935 - RNA, 22 nt, Human
ccugaagaugcuguggccuggu

SEQ ID NO: 987936 - RNA, 22 nt, Human
ccugucuggccaccagggcgau

SEQ ID NO: 987937 - RNA, 22 nt, Human
aacucaguguguuucuuaguau

SEQ ID NO: 987938 - RNA, 22 nt, Human
aaggaaagacauauaaaugacu

SEQ ID NO: 987939 - RNA, 22 nt, Human
uccguauuugacuauugcaccg

SEQ ID NO: 987940 - RNA, 22 nt, Human
cagggugacugcccuggccacu

SEQ ID NO: 987941 - RNA, 19 nt, Human
agccagggugagaaggagc

SEQ ID NO: 987942 - RNA, 22 nt, Human
cagggcaggacagauacauuac

SEQ ID NO: 987943 - RNA, 22 nt, Human
gccagagccggcuucacaggau

SEQ ID NO: 987944 - RNA, 22 nt, Human
gagugcagaugaacagaagauu

SEQ ID NO: 987945 - RNA, 22 nt, Human
ugagagagccugaaucucuuac

SEQ ID NO: 987946 - RNA, 22 nt, Human
uacuacauuaauaaaacauuca

SEQ ID NO: 987947 - RNA, 22 nt, Human
ugcuggccgugagcucucggga

SEQ ID NO: 987948 - RNA, 22 nt, Human
gcaggcugaugacuggaguugg

SEQ ID NO: 987949 - RNA, 22 nt, Human
ugaggcagcaauuguauuguau

SEQ ID NO: 987950 - RNA, 22 nt, Human
ucacagugaugacgugggagca

SEQ ID NO: 987951 - RNA, 22 nt, Human
ggaggccaccugaccugcuguu

SEQ ID NO: 987952 - RNA, 22 nt, Human
cugccaaggcuggggaggacaa

SEQ ID NO: 987953 - RNA, 22 nt, Human
aacaugaaaguugcuaagugca

SEQ ID NO: 987954 - RNA, 22 nt, Human
cauaagaaauaaugaugaugac

SEQ ID NO: 987955 - RNA, 22 nt, Human
aagauuuagggccaguuuacau

SEQ ID NO: 987956 - RNA, 21 nt, Human
agaugaggauacugaggccua

SEQ ID NO: 987957 - RNA, 22 nt, Human
gcuguggcuguacagagaccau

SEQ ID NO: 987958 - RNA, 22 nt, Human
cucccuggaggcccagaccugg

SEQ ID NO: 987959 - RNA, 22 nt, Human
agaggccuaaccaagauguccu

SEQ ID NO: 987960 - RNA, 22 nt, Human
agccaaggagugcagguggcuu

SEQ ID NO: 987961 - RNA, 22 nt, Human
uuuuuccaccguacuuccugag

SEQ ID NO: 987962 - RNA, 22 nt, Human
caggcacuggccagucagcaca

SEQ ID NO: 987963 - RNA, 22 nt, Human
agggagcucaguuggaagcggu

SEQ ID NO: 987964 - RNA, 22 nt, Human
uaaaugugaccuucauuuuaua

SEQ ID NO: 987965 - RNA, 22 nt, Human
uacuuccagcaaucugcauauu

SEQ ID NO: 987966 - RNA, 22 nt, Human
gaauuacaaagugagacaagcu

SEQ ID NO: 987967 - RNA, 22 nt, Human
gcacugcaucuacuggcaagua

SEQ ID NO: 987968 - RNA, 22 nt, Human
agaauucuuggugguuagaaua

SEQ ID NO: 987969 - RNA, 22 nt, Human
gaaaauguuuccuguuauuugc

SEQ ID NO: 987970 - RNA, 22 nt, Human
cuugcaggauuuugcugcugua

SEQ ID NO: 987971 - RNA, 22 nt, Human
uggcagcaaaaccagaaucaga

SEQ ID NO: 987972 - RNA, 22 nt, Human
ugcagggcacacgcacgggugu

SEQ ID NO: 987973 - RNA, 22 nt, Human
uuagagaaauucugguaaugua

SEQ ID NO: 987974 - RNA, 22 nt, Human
uggccugcuuucauuugaugcu

SEQ ID NO: 987975 - RNA, 22 nt, Human
uuacauuuuaguuaaccuguga

SEQ ID NO: 987976 - RNA, 22 nt, Human
ucugucugacaggguaugaacu

SEQ ID NO: 987977 - RNA, 22 nt, Human
cagagaccccgcugcccuucug

SEQ ID NO: 987978 - RNA, 22 nt, Human
ugggccuggagcccuggagagu

SEQ ID NO: 987979 - RNA, 22 nt, Human
uauaaagaaguguaaacaggaa

SEQ ID NO: 987980 - RNA, 22 nt, Human
ccaggcucugcgcuggacaugg

SEQ ID NO: 987981 - RNA, 22 nt, Human
ucagaacauuuaaaaagugguu

SEQ ID NO: 987982 - RNA, 22 nt, Human
ucucagaguuuagagcugagcc

SEQ ID NO: 987983 - RNA, 22 nt, Human
cuggagcugcuguccuugggug

SEQ ID NO: 987984 - RNA, 22 nt, Human
cucugugcccuacugcucagcu

SEQ ID NO: 987985 - RNA, 22 nt, Human
gaggccugggagccuguccucc

SEQ ID NO: 987986 - RNA, 22 nt, Human
aaaauaacuucuacuauuugca

SEQ ID NO: 987987 - RNA, 23 nt, Human
gaagcagaugucugaguaggcag

SEQ ID NO: 987988 - RNA, 22 nt, Human
aaaaguaauugaugcaaucgua

SEQ ID NO: 987989 - RNA, 22 nt, Human
cuuugaauuccaguacaauaac

SEQ ID NO: 987990 - RNA, 21 nt, Human
aagggagauaggaaucaggcc

SEQ ID NO: 987991 - RNA, 22 nt, Human
gccuucagcggccgcucgcugc

SEQ ID NO: 987992 - RNA, 20 nt, Human
ggccgaaauaauaguggcuu

SEQ ID NO: 987993 - RNA, 22 nt, Human
uauuagcgcuuacugaguugcc

SEQ ID NO: 987994 - RNA, 23 nt, Human
uggcccugugcaugcugcuuccc

SEQ ID NO: 987995 - RNA, 22 nt, Human
gccagagcaugcacugccugca

SEQ ID NO: 987996 - RNA, 22 nt, Human
cugccucuggccucaggcccag

SEQ ID NO: 987997 - RNA, 22 nt, Human
uuucacaaugcaauccuacuuc

SEQ ID NO: 987998 - RNA, 22 nt, Human
uucaagucaaggaaagaggucu

SEQ ID NO: 987999 - RNA, 22 nt, Human
cucucccccacagcagccuucu

SEQ ID NO: 988000 - RNA, 22 nt, Human
ccuguggcacaugcagggauuc

SEQ ID NO: 988001 - RNA, 22 nt, Human
uuaggcauauggcacaugauag

SEQ ID NO: 988002 - RNA, 22 nt, Human
gcugucacaaauauuucucagc

SEQ ID NO: 988003 - RNA, 22 nt, Human
cauaacuagagugaaauguuga

SEQ ID NO: 988004 - RNA, 22 nt, Human
ucugucuccugccagugccucu

SEQ ID NO: 988005 - RNA, 22 nt, Human
uguaugugcuugagaagguggg

SEQ ID NO: 988006 - RNA, 22 nt, Human
ggcugagcaauuuugaugacau

SEQ ID NO: 988007 - RNA, 22 nt, Human
agggcugggcugcuuguuguca

SEQ ID NO: 988008 - RNA, 22 nt, Human
aggagcugcuuaaaugguuggu

SEQ ID NO: 988009 - RNA, 21 nt, Human
ugucagaaauaagcaugugau

SEQ ID NO: 988010 - RNA, 22 nt, Human
cugacccauauaagaguggagg

SEQ ID NO: 988011 - RNA, 22 nt, Human
aagcacagaaaaggagcaugga

SEQ ID NO: 988012 - RNA, 22 nt, Human
acgcagaagggccuggcgugcc

SEQ ID NO: 988013 - RNA, 22 nt, Human
cugagcuggucuauggacuugg

SEQ ID NO: 988014 - RNA, 23 nt, Human
uuguuuuuagagguggcaugaga

SEQ ID NO: 988015 - RNA, 22 nt, Human
acagucauuagauacaaugucu

SEQ ID NO: 988016 - RNA, 22 nt, Human
gcaaaugcuaaaguguagagac

SEQ ID NO: 988017 - RNA, 20 nt, Human
gugggcagaugugugcaugg

SEQ ID NO: 988018 - RNA, 22 nt, Human
ugucucugugacuccuuccgcc

SEQ ID NO: 988019 - RNA, 22 nt, Human
ucaguuuucucaucuguaauuu

SEQ ID NO: 988020 - RNA, 21 nt, Human
auguaggaguuauuggaacag

SEQ ID NO: 988021 - RNA, 20 nt, Human
cacaggcuauaugagagcca

SEQ ID NO: 988022 - RNA, 22 nt, Human
agggagcuguggucagcucagu

SEQ ID NO: 988023 - RNA, 22 nt, Human
uuuuaauucaaagugaauagug

SEQ ID NO: 988024 - RNA, 22 nt, Human
cagcucucacacccuccuccca

SEQ ID NO: 988025 - RNA, 22 nt, Human
uggagcauauucuggagcuugg

SEQ ID NO: 988026 - RNA, 22 nt, Human
cucugcuaagcaugaacaauua

SEQ ID NO: 988027 - RNA, 22 nt, Human
uuucaaagguggaagagugaau

SEQ ID NO: 988028 - RNA, 22 nt, Human
gggcacagagggucuugaagaa

SEQ ID NO: 988029 - RNA, 22 nt, Human
uuuauuugucuugccauuuagu

SEQ ID NO: 988030 - RNA, 22 nt, Human
cuccuggcuuucccagaccagg

SEQ ID NO: 988031 - RNA, 19 nt, Human
guuuuucccagacgaggca

SEQ ID NO: 988032 - RNA, 22 nt, Human
ggcagaggagcuggaaacaugg

SEQ ID NO: 988033 - RNA, 22 nt, Human
cuggaugcuuccucucugcuag

SEQ ID NO: 988034 - RNA, 21 nt, Human
gagccuucccucugcccuuuc

SEQ ID NO: 988035 - RNA, 22 nt, Human
cagggcagggccacacccccug

SEQ ID NO: 988036 - RNA, 22 nt, Human
gguggagcuguggacaggaagg

SEQ ID NO: 988037 - RNA, 22 nt, Human
aaaugucuuucuucugcuacgu

SEQ ID NO: 988038 - RNA, 22 nt, Human
aggccuguuccuuccugggcac

SEQ ID NO: 988039 - RNA, 22 nt, Human
ugggcucugcugcguaccaguu

SEQ ID NO: 988040 - RNA, 22 nt, Human
cgucuuccucuuacgaugcgcu

SEQ ID NO: 988041 - RNA, 22 nt, Human
gcagaggcauuucugacgcugc

SEQ ID NO: 988042 - RNA, 22 nt, Human
ccagaagggcuauugcagugac

SEQ ID NO: 988043 - RNA, 22 nt, Human
uggcagagaauaaaucuugacu

SEQ ID NO: 988044 - RNA, 22 nt, Human
ccucuggguaucuguggaagua

SEQ ID NO: 988045 - RNA, 22 nt, Human
ggagccuguuaguugagugcuc

SEQ ID NO: 988046 - RNA, 18 nt, Human
aaaugcuaggcuacauga

SEQ ID NO: 988047 - RNA, 22 nt, Human
auuuggcacacuggguucucgu

SEQ ID NO: 988048 - RNA, 22 nt, Human
cccugcagcuuuugcauaguca

SEQ ID NO: 988049 - RNA, 22 nt, Human
gcugucagugaggugagacaug

SEQ ID NO: 988050 - RNA, 22 nt, Human
aacucagucauaaagcgaaugc

SEQ ID NO: 988051 - RNA, 22 nt, Human
aguaaugugccugaaauacuug

SEQ ID NO: 988052 - RNA, 23 nt, Human
ugagcccaggaggucaaggcugc

SEQ ID NO: 988053 - RNA, 22 nt, Human
uugaaggacauccuauuucuag

SEQ ID NO: 988054 - RNA, 22 nt, Human
gugcccugaguggguaggagag

SEQ ID NO: 988055 - RNA, 22 nt, Human
ggcaggcugcuugggucauguc

SEQ ID NO: 988056 - RNA, 22 nt, Human
ccugcagaccacacucaguccu

SEQ ID NO: 988057 - RNA, 22 nt, Human
ccuggccugugaaucugagagc

SEQ ID NO: 988058 - RNA, 22 nt, Human
cuccagggaggucugcaggacu

SEQ ID NO: 988059 - RNA, 22 nt, Human
ccagggcacuuaggcccagccc

SEQ ID NO: 988060 - RNA, 22 nt, Human
aucaguuuugggggacauacug

SEQ ID NO: 988061 - RNA, 22 nt, Human
uccucugccccagaugaaauuu

SEQ ID NO: 988062 - RNA, 22 nt, Human
ccagggugaggaggcucccacg

SEQ ID NO: 988063 - RNA, 22 nt, Human
uuccuuccgggcaccaggcacu

SEQ ID NO: 988064 - RNA, 22 nt, Human
aggcacugacaauucuggacug

SEQ ID NO: 988065 - RNA, 22 nt, Human
cagagagagucaaaucuuugcu

SEQ ID NO: 988066 - RNA, 22 nt, Human
uaugagcuuccaguguugcaug

SEQ ID NO: 988067 - RNA, 22 nt, Human
agcagaugagccucaugacugg

SEQ ID NO: 988068 - RNA, 17 nt, Human
auguuaauuucacauuu

SEQ ID NO: 988069 - RNA, 22 nt, Human
uggccuuguguuuuagagaaag

SEQ ID NO: 988070 - RNA, 21 nt, Human
cagaggggcuagccuggcugc

SEQ ID NO: 988071 - RNA, 22 nt, Human
ugcagaagauggucugagcacc

SEQ ID NO: 988072 - RNA, 22 nt, Human
cagagcugcucaugguggccag

SEQ ID NO: 988073 - RNA, 22 nt, Human
cagagcagcagagcuuccaugg

SEQ ID NO: 988074 - RNA, 22 nt, Human
aguacuucagaggcugcccagg

SEQ ID NO: 988075 - RNA, 23 nt, Human
gugcucugcggucugcuagucug

SEQ ID NO: 988076 - RNA, 22 nt, Human
ggaggaugccaagcugugcaca

SEQ ID NO: 988077 - RNA, 22 nt, Human
gcagagccaugggagguuuuug

SEQ ID NO: 988078 - RNA, 22 nt, Human
cugggcuccuaaccauccaggu

SEQ ID NO: 988079 - RNA, 20 nt, Human
gcccacucuaauccacuguc

SEQ ID NO: 988080 - RNA, 22 nt, Human
auuugucucugcacuuuacuca

SEQ ID NO: 988081 - RNA, 22 nt, Human
acauuuaaugauccuacuguga

SEQ ID NO: 988082 - RNA, 22 nt, Human
auggcagcaaaugucuggcugg

SEQ ID NO: 988083 - RNA, 22 nt, Human
cuccuggcucgcccccagcuga

SEQ ID NO: 988084 - RNA, 22 nt, Human
ggggcagagagaaggaagcuug

SEQ ID NO: 988085 - RNA, 22 nt, Human
aucuuucaaucaggaaaaaucu

SEQ ID NO: 988086 - RNA, 22 nt, Human
acaccagggccuagccagggcg

SEQ ID NO: 988087 - RNA, 21 nt, Human
gcaugccugcaucuuaguguu

SEQ ID NO: 988088 - RNA, 23 nt, Human
agcccagcagagaaccuaggucc

SEQ ID NO: 988089 - RNA, 22 nt, Human
augaugguuguccuaggugcau

SEQ ID NO: 988090 - RNA, 22 nt, Human
aaggccaugaccacuugcugug

SEQ ID NO: 988091 - RNA, 22 nt, Human
ugcuggcugggcugcuggagac

SEQ ID NO: 988092 - RNA, 22 nt, Human
aguuauagaaccagguccucac

SEQ ID NO: 988093 - RNA, 22 nt, Human
ugugugcauucacaugcaugcc

SEQ ID NO: 988094 - RNA, 22 nt, Human
ugucauugaggaaaacuaggug

SEQ ID NO: 988095 - RNA, 18 nt, Human
gggcaucauucacaaagu

SEQ ID NO: 988096 - RNA, 22 nt, Human
ucauugcagugauguuguaugu

SEQ ID NO: 988097 - RNA, 22 nt, Human
cccuggagggacagcugcucua

SEQ ID NO: 988098 - RNA, 22 nt, Human
aacuuuaaggcuauaaauuaug

SEQ ID NO: 988099 - RNA, 22 nt, Human
ccagcagccaccuucucgaaau

SEQ ID NO: 988100 - RNA, 22 nt, Human
gggugggagucuggcccucaaa

SEQ ID NO: 988101 - RNA, 22 nt, Human
gucccacaccuugaggggucuu

SEQ ID NO: 988102 - RNA, 22 nt, Human
gccugaagaacagcugugagga

SEQ ID NO: 988103 - RNA, 22 nt, Human
ucugucacccagagugcagugg

SEQ ID NO: 988104 - RNA, 20 nt, Human
cacaagagaauacacacugg

SEQ ID NO: 988105 - RNA, 22 nt, Human
aucuggcuuuuaccccacggcc

SEQ ID NO: 988106 - RNA, 22 nt, Human
agcugguaugaacaggauagga

SEQ ID NO: 988107 - RNA, 22 nt, Human
uggcaggagguuuucuccagga

SEQ ID NO: 988108 - RNA, 22 nt, Human
cugggcacuuuggggagccuac

SEQ ID NO: 988109 - RNA, 22 nt, Human
ucaaugaaagagcaugcauuuu

SEQ ID NO: 988110 - RNA, 22 nt, Human
augauguugauaaauuacuuua

SEQ ID NO: 988111 - RNA, 22 nt, Human
guaacacagaaaugaaauucca

SEQ ID NO: 988112 - RNA, 22 nt, Human
cagagcugguaagugguagagg

SEQ ID NO: 988113 - RNA, 22 nt, Human
gcugccagcucacucuccugag

SEQ ID NO: 988114 - RNA, 22 nt, Human
acugagcugcuugaagugaacu

SEQ ID NO: 988115 - RNA, 22 nt, Human
gggcucugguacuuccuggcuc

SEQ ID NO: 988116 - RNA, 20 nt, Human
uguucacaguaguugcugcu

SEQ ID NO: 988117 - RNA, 22 nt, Human
gcacagcaauuucuauaagcuc

SEQ ID NO: 988118 - RNA, 22 nt, Human
gaaaugugcagaauguguuaga

SEQ ID NO: 988119 - RNA, 22 nt, Human
aaggcgacacaggcagcaggcc

SEQ ID NO: 988120 - RNA, 22 nt, Human
cccucuggcucuucucaggccg

SEQ ID NO: 988121 - RNA, 22 nt, Human
ggucauuguucuuuucugugau

SEQ ID NO: 988122 - RNA, 22 nt, Human
uuaaaaccaucagcuguaagau

SEQ ID NO: 988123 - RNA, 22 nt, Human
ggccucacccaucggugccuuu

SEQ ID NO: 988124 - RNA, 22 nt, Human
acaaagugaauugcaucgaguu

SEQ ID NO: 988125 - RNA, 22 nt, Human
aaaagucagucucuccuagcuc

SEQ ID NO: 988126 - RNA, 22 nt, Human
cauuccuuaacguggggagucu

SEQ ID NO: 988127 - RNA, 22 nt, Human
agguggguccuggcucugccau

SEQ ID NO: 988128 - RNA, 22 nt, Human
ggaaagaggauaguggguaggu

SEQ ID NO: 988129 - RNA, 22 nt, Human
gcuccagguauuugcccuuuua

SEQ ID NO: 988130 - RNA, 22 nt, Human
uuaguaggagagcuuguucauu

SEQ ID NO: 988131 - RNA, 22 nt, Human
caggccucagagaguggcgggg

SEQ ID NO: 988132 - RNA, 22 nt, Human
agagucuuccaggcagccugag

SEQ ID NO: 988133 - RNA, 18 nt, Human
gggaagaggaucuggccc

SEQ ID NO: 988134 - RNA, 22 nt, Human
cucugcaggggaggcaugcacu

SEQ ID NO: 988135 - RNA, 18 nt, Human
acauuucuccuucugacc

SEQ ID NO: 988136 - RNA, 20 nt, Human
cugugccuaaaccuccgggu

SEQ ID NO: 988137 - RNA, 22 nt, Human
ucuccuucgaggcccagcuccc

SEQ ID NO: 988138 - RNA, 21 nt, Human
ucugggcccaugcugccucac

SEQ ID NO: 988139 - RNA, 22 nt, Human
cugagucucccggcaguggagg

SEQ ID NO: 988140 - RNA, 19 nt, Human
ucucagaggaaaaauugcu

SEQ ID NO: 988141 - RNA, 22 nt, Human
uccucugcuccaucuuuacugu

SEQ ID NO: 988142 - RNA, 22 nt, Human
ucugaaaucuguaagcacuagc

SEQ ID NO: 988143 - RNA, 22 nt, Human
gccugugcuuaacugacgugag

SEQ ID NO: 988144 - RNA, 18 nt, Human
gcuccugguuggaaagaa

SEQ ID NO: 988145 - RNA, 21 nt, Human
uggcagaguugaguaguuaug

SEQ ID NO: 988146 - RNA, 22 nt, Human
ugucccaguuuaucugggacug

SEQ ID NO: 988147 - RNA, 22 nt, Human
ccauuuguucgcccagcuccaa

SEQ ID NO: 988148 - RNA, 22 nt, Human
ucagcaguggcucucaugcagu

SEQ ID NO: 988149 - RNA, 22 nt, Human
gggcugccaagccugccugccu

SEQ ID NO: 988150 - RNA, 22 nt, Human
ugugccuggaucucugugacaa

SEQ ID NO: 988151 - RNA, 22 nt, Human
uacuuagagcgauaauuuauac

SEQ ID NO: 988152 - RNA, 22 nt, Human
gcuguccucuuggacucagggc

SEQ ID NO: 988153 - RNA, 22 nt, Human
acauacuuuuuaaaagauugcu

SEQ ID NO: 988154 - RNA, 22 nt, Human
cuguagccaguuuggccucacc

SEQ ID NO: 988155 - RNA, 22 nt, Human
aucagcaaguccuguuaauucu

SEQ ID NO: 988156 - RNA, 22 nt, Human
ucagagcuuaucucuugcugga

SEQ ID NO: 988157 - RNA, 22 nt, Human
ccuggccacccagccuuggcca

SEQ ID NO: 988158 - RNA, 17 nt, Human
aggagucucagaugagc

SEQ ID NO: 988159 - RNA, 22 nt, Human
agaugggcgcccuggacugagg

SEQ ID NO: 988160 - RNA, 22 nt, Human
gaugagggccugguggcugugc

SEQ ID NO: 988161 - RNA, 22 nt, Human
uccucagggggccaacccagcc

SEQ ID NO: 988162 - RNA, 22 nt, Human
acagguggggaggcugagguuc

SEQ ID NO: 988163 - RNA, 22 nt, Human
gucugcugcagagcauggcuuu

SEQ ID NO: 988164 - RNA, 22 nt, Human
cuggcucauuuuagcaucaggu

SEQ ID NO: 988165 - RNA, 22 nt, Human
guucauauuacuuugagugcag

SEQ ID NO: 988166 - RNA, 22 nt, Human
gggcuggugaggcugcccugca

SEQ ID NO: 988167 - RNA, 22 nt, Human
aagaguuuucuauaaucuuggc

SEQ ID NO: 988168 - RNA, 22 nt, Human
aaaaucugcuuccuuuuacaga

SEQ ID NO: 988169 - RNA, 22 nt, Human
accuuuuauguaaauauauguu

SEQ ID NO: 988170 - RNA, 22 nt, Human
ugggccuggacaaggccacuag

SEQ ID NO: 988171 - RNA, 18 nt, Human
ugcucuguuuaaugauuu

SEQ ID NO: 988172 - RNA, 22 nt, Human
caaagguaguauauauauuguu

SEQ ID NO: 988173 - RNA, 22 nt, Human
ggccucuggucaagacaagcau

SEQ ID NO: 988174 - RNA, 22 nt, Human
ugggggugaaagucuggacagu

SEQ ID NO: 988175 - RNA, 22 nt, Human
ucucauucauacccuacaugcu

SEQ ID NO: 988176 - RNA, 18 nt, Human
gcacucugacugcagagc

SEQ ID NO: 988177 - RNA, 22 nt, Human
cagaacugggcagggagcagag

SEQ ID NO: 988178 - RNA, 23 nt, Human
uggggccaagugaggaagggucu

SEQ ID NO: 988179 - RNA, 22 nt, Human
gcagggcaugggcccugucugc

SEQ ID NO: 988180 - RNA, 22 nt, Human
uagaaaucagguuuuuagaaag

SEQ ID NO: 988181 - RNA, 22 nt, Human
ggugaagggccuuaggagacag

SEQ ID NO: 988182 - RNA, 22 nt, Human
auacagaagaacuauagccacu

SEQ ID NO: 988183 - RNA, 23 nt, Human
acagggcauugcuggccucgagg

SEQ ID NO: 988184 - RNA, 22 nt, Human
ucccaggaucugagggcagaga

SEQ ID NO: 988185 - RNA, 22 nt, Human
gcugcagcuuuaggauccagug

SEQ ID NO: 988186 - RNA, 20 nt, Human
cugagccaacucucuucuug

SEQ ID NO: 988187 - RNA, 17 nt, Human
agcagcuggcacaggag

SEQ ID NO: 988188 - RNA, 22 nt, Human
ccaaaaagcucagagauauguu

SEQ ID NO: 988189 - RNA, 22 nt, Human
aggcaggugggucacuugaguc

SEQ ID NO: 988190 - RNA, 22 nt, Human
uauagaagagacaugugcauag

SEQ ID NO: 988191 - RNA, 22 nt, Human
gccuggugcuaugagggccagc

SEQ ID NO: 988192 - RNA, 19 nt, Human
cuguccuuggcugcacugu

SEQ ID NO: 988193 - RNA, 22 nt, Human
cacuggcaugugaggcgguggc

SEQ ID NO: 988194 - RNA, 22 nt, Human
aucaauucuuaggaaaauagcu

SEQ ID NO: 988195 - RNA, 22 nt, Human
aaaugcacagguuuuaaauccu

SEQ ID NO: 988196 - RNA, 22 nt, Human
aagccagcauuuucccauuccu

SEQ ID NO: 988197 - RNA, 22 nt, Human
caggagcaaggagcagugggau

SEQ ID NO: 988198 - RNA, 22 nt, Human
cucugcugggauguaaagucuu

SEQ ID NO: 988199 - RNA, 22 nt, Human
ggucucuguugccuccaucaag

SEQ ID NO: 988200 - RNA, 22 nt, Human
aauuaggaaauucagccauuuu

SEQ ID NO: 988201 - RNA, 22 nt, Human
uccuugaagagugggcggucga

SEQ ID NO: 988202 - RNA, 22 nt, Human
uaauaucuacuucauagaguuu

SEQ ID NO: 988203 - RNA, 22 nt, Human
caguggccaugguggcaggggu

SEQ ID NO: 988204 - RNA, 22 nt, Human
agagugaaguuuuugaaaguga

SEQ ID NO: 988205 - RNA, 22 nt, Human
caggcugcagaggccuuucaug

SEQ ID NO: 988206 - RNA, 22 nt, Human
gcugucugucuucacaucucgc

SEQ ID NO: 988207 - RNA, 22 nt, Human
gcagacagccagacugcacugg

SEQ ID NO: 988208 - RNA, 22 nt, Human
aggagcagcccacuccuguccu

SEQ ID NO: 988209 - RNA, 22 nt, Human
aggcuggaguacaguggcuauu

SEQ ID NO: 988210 - RNA, 20 nt, Human
cucaguguggccugaguguu

SEQ ID NO: 988211 - RNA, 22 nt, Human
gggucucucucggcuccacgcg

SEQ ID NO: 988212 - RNA, 22 nt, Human
uccuggcccucugcaaacgcca

SEQ ID NO: 988213 - RNA, 22 nt, Human
ucaguuuucucauuuaugagau

SEQ ID NO: 988214 - RNA, 22 nt, Human
uaaagguagugugacauauugu

SEQ ID NO: 988215 - RNA, 20 nt, Human
caggccagagguuugauggc

SEQ ID NO: 988216 - RNA, 22 nt, Human
ccagccagucccgcaugaccgc

SEQ ID NO: 988217 - RNA, 22 nt, Human
ccaggcaggcagcguucucagg

SEQ ID NO: 988218 - RNA, 22 nt, Human
uccaagggcuuuggcgugaagu

SEQ ID NO: 988219 - RNA, 22 nt, Human
agaaacuucagcuauucuuuug

SEQ ID NO: 988220 - RNA, 22 nt, Human
gcccugggauuggguggaggcu

SEQ ID NO: 988221 - RNA, 22 nt, Human
ccuggccagcuaauugcccauc

SEQ ID NO: 988222 - RNA, 22 nt, Human
ucuccugggugcuuuaucagaa

SEQ ID NO: 988223 - RNA, 22 nt, Human
gcuggcuccucuguccucacgg

SEQ ID NO: 988224 - RNA, 22 nt, Human
gcuguccucugaucucuggagg

SEQ ID NO: 988225 - RNA, 22 nt, Human
gggcugcuguagagaacauguu

SEQ ID NO: 988226 - RNA, 22 nt, Human
gcaccaggcuuagagccccagg

SEQ ID NO: 988227 - RNA, 22 nt, Human
gcaccuuuggaaugaaaaguug

SEQ ID NO: 988228 - RNA, 22 nt, Human
agcaaggcagucagcuggcugg

SEQ ID NO: 988229 - RNA, 22 nt, Human
ccagcucugcagggccuggggu

SEQ ID NO: 988230 - RNA, 22 nt, Human
cugaaggagcauagucaguuuu

SEQ ID NO: 988231 - RNA, 22 nt, Human
uuuuaugauugagcuggcuaca

SEQ ID NO: 988232 - RNA, 22 nt, Human
agggcuggcaagggauugaaau

SEQ ID NO: 988233 - RNA, 22 nt, Human
cacagguguaugaauaugucca

SEQ ID NO: 988234 - RNA, 22 nt, Human
gagcccagguucugcuuccagc

SEQ ID NO: 988235 - RNA, 22 nt, Human
ucuggcucccagccugcucuca

SEQ ID NO: 988236 - RNA, 22 nt, Human
uacaaaaaauugauacugacga

SEQ ID NO: 988237 - RNA, 22 nt, Human
ugcagcugcuggcccaggugcu

SEQ ID NO: 988238 - RNA, 22 nt, Human
gagcuucccucugcagucccug

SEQ ID NO: 988239 - RNA, 22 nt, Human
uuuacuguuuacagcuaaugca

SEQ ID NO: 988240 - RNA, 22 nt, Human
cuggggugagcagaaacagggg

SEQ ID NO: 988241 - RNA, 22 nt, Human
cagcucccuauggugaggcgac

SEQ ID NO: 988242 - RNA, 22 nt, Human
gcaggagagucugugccagguu

SEQ ID NO: 988243 - RNA, 22 nt, Human
agacagguaaauagagaugcug

SEQ ID NO: 988244 - RNA, 22 nt, Human
ggcugccuucagacuccagcuu

SEQ ID NO: 988245 - RNA, 22 nt, Human
uucacauuauaaucaguucugc

SEQ ID NO: 988246 - RNA, 22 nt, Human
ucugagccacagauguccuguu

SEQ ID NO: 988247 - RNA, 22 nt, Human
agccuucacugggaccuuggau

SEQ ID NO: 988248 - RNA, 22 nt, Human
aaauucuuucauggcuaauaag

SEQ ID NO: 988249 - RNA, 18 nt, Human
ccugcagcccaggaggcc

SEQ ID NO: 988250 - RNA, 22 nt, Human
caguggccugagccaggcuucc

SEQ ID NO: 988251 - RNA, 22 nt, Human
gccagcagguggagagaucaag

SEQ ID NO: 988252 - RNA, 22 nt, Human
gcugucuguggugucagcugac

SEQ ID NO: 988253 - RNA, 22 nt, Human
uucuuagaugauuaaugauggg

SEQ ID NO: 988254 - RNA, 22 nt, Human
aagagagagcauucuucuguua

SEQ ID NO: 988255 - RNA, 22 nt, Human
ugaagggggagauauaugugug

SEQ ID NO: 988256 - RNA, 20 nt, Human
ccagagcagccacugaaguu

SEQ ID NO: 988257 - RNA, 19 nt, Human
uguguaaagucugugguca

SEQ ID NO: 988258 - RNA, 22 nt, Human
auguaucaauuaucugucugca

SEQ ID NO: 988259 - RNA, 22 nt, Human
ggcugccagugagugcagaccg

SEQ ID NO: 988260 - RNA, 22 nt, Human
agaugguguuuccccaggugga

SEQ ID NO: 988261 - RNA, 22 nt, Human
ccugccugcuuucugcuuugca

SEQ ID NO: 988262 - RNA, 22 nt, Human
ggacuggccggcgcugaggccc

SEQ ID NO: 988263 - RNA, 22 nt, Human
gggccccaaaaugccaggcucu

SEQ ID NO: 988264 - RNA, 22 nt, Human
ugcaagagguaaaaugaaagga

SEQ ID NO: 988265 - RNA, 22 nt, Human
caaaggagguaaugggugugag

SEQ ID NO: 988266 - RNA, 22 nt, Human
uagcugucagcaaucaaguggu

SEQ ID NO: 988267 - RNA, 22 nt, Human
ggugggcaggcgaggcccaggu

SEQ ID NO: 988268 - RNA, 22 nt, Human
aaugaacaaaauaugcuuugca

SEQ ID NO: 988269 - RNA, 21 nt, Human
gccugcagaccccaccaggcu

SEQ ID NO: 988270 - RNA, 22 nt, Human
uuucacaaacugaggagacaau

SEQ ID NO: 988271 - RNA, 22 nt, Human
cucuuuccaggguaccccaggu

SEQ ID NO: 988272 - RNA, 22 nt, Human
ccugagagcagcuuccugcuua

SEQ ID NO: 988273 - RNA, 20 nt, Human
gcugaggucauuaugccuca

SEQ ID NO: 988274 - RNA, 23 nt, Human
uggcucagcuaguuuuccauuuc

SEQ ID NO: 988275 - RNA, 22 nt, Human
aagggaggaggauuuauuguac

SEQ ID NO: 988276 - RNA, 22 nt, Human
ugcagagguguugcugagauaa

SEQ ID NO: 988277 - RNA, 19 nt, Human
gggcucuggccucaguggg

SEQ ID NO: 988278 - RNA, 18 nt, Human
ucaagacaucaugaaaua

SEQ ID NO: 988279 - RNA, 22 nt, Human
aaauaugaaugauaagaguuau

SEQ ID NO: 988280 - RNA, 22 nt, Human
ucucugcuaagauugugucuag

SEQ ID NO: 988281 - RNA, 20 nt, Human
aagaaacuugaaaguacaag

SEQ ID NO: 988282 - RNA, 22 nt, Human
aaguuugagaagcuuauagaua

SEQ ID NO: 988283 - RNA, 22 nt, Human
ucugcugcugagcacacuccua

SEQ ID NO: 988284 - RNA, 22 nt, Human
agauuucccacuccauguauug

SEQ ID NO: 988285 - RNA, 22 nt, Human
cauucugugauucuaaaucccu

SEQ ID NO: 988286 - RNA, 22 nt, Human
aaguuuguguaguuuagcaucc

SEQ ID NO: 988287 - RNA, 22 nt, Human
agguccagcuguugcagccucc

SEQ ID NO: 988288 - RNA, 22 nt, Human
cuucagaggggacucaaaguca

SEQ ID NO: 988289 - RNA, 22 nt, Human
gaggcugcuguuagcccugggc

SEQ ID NO: 988290 - RNA, 22 nt, Human
acauacauaugacaacuuuccu

SEQ ID NO: 988291 - RNA, 22 nt, Human
ucagaagcauguggggagccug

SEQ ID NO: 988292 - RNA, 22 nt, Human
aauaaaaugaacugguagaguu

SEQ ID NO: 988293 - RNA, 22 nt, Human
ccucugccaccucccacgaggc

SEQ ID NO: 988294 - RNA, 22 nt, Human
aggagaguucacacuggucaga

SEQ ID NO: 988295 - RNA, 21 nt, Human
aggcagcucaggcccagagag

SEQ ID NO: 988296 - RNA, 22 nt, Human
aggagguggccugagcgugccc

SEQ ID NO: 988297 - RNA, 17 nt, Human
cucagaguugcuuuguc

SEQ ID NO: 988298 - RNA, 22 nt, Human
aguacauuuauuaaugguaaaa

SEQ ID NO: 988299 - RNA, 22 nt, Human
ccaaggagcucauauucuuguu

SEQ ID NO: 988300 - RNA, 22 nt, Human
cccuggagcaucucugcugucu

SEQ ID NO: 988301 - RNA, 22 nt, Human
aagugguaggaagagagcacug

SEQ ID NO: 988302 - RNA, 20 nt, Human
agagccuugaggaagaugau

SEQ ID NO: 988303 - RNA, 17 nt, Human
agugaaauuuacauugc

SEQ ID NO: 988304 - RNA, 22 nt, Human
gcugucuggguugagggcccug

SEQ ID NO: 988305 - RNA, 22 nt, Human
ccauuguaaagaguauacuuug

SEQ ID NO: 988306 - RNA, 22 nt, Human
gcuggcuuugcacugggugcau

SEQ ID NO: 988307 - RNA, 22 nt, Human
uggcagcauuuuuuccagaaca

SEQ ID NO: 988308 - RNA, 22 nt, Human
gcagagccugugucugagcaaa

SEQ ID NO: 988309 - RNA, 22 nt, Human
uuagcuaaacuguaacuagaau

SEQ ID NO: 988310 - RNA, 22 nt, Human
uccaggagguuuggaggaagca

SEQ ID NO: 988311 - RNA, 22 nt, Human
ugcagcugaggccagcuaugcc

SEQ ID NO: 988312 - RNA, 22 nt, Human
gagccugagugcugccuccccu

SEQ ID NO: 988313 - RNA, 20 nt, Human
ugaaauaaggaguuguccuu

SEQ ID NO: 988314 - RNA, 21 nt, Human
agucccaggggugagugaugu

SEQ ID NO: 988315 - RNA, 22 nt, Human
auggccaagaucacagacuuca

SEQ ID NO: 988316 - RNA, 22 nt, Human
cacugaagaugcgacuagugcu

SEQ ID NO: 988317 - RNA, 22 nt, Human
aggaagccugcaggugacugcu

SEQ ID NO: 988318 - RNA, 23 nt, Human
augcucugggcugugggaccugc

SEQ ID NO: 988319 - RNA, 22 nt, Human
agaggagguggugaugcuuuaa

SEQ ID NO: 988320 - RNA, 22 nt, Human
caggaaccuaaugaaggcucac

SEQ ID NO: 988321 - RNA, 22 nt, Human
cagcccugagagaaccaucuau

SEQ ID NO: 988322 - RNA, 22 nt, Human
cugcucugugguccaugagaca

SEQ ID NO: 988323 - RNA, 22 nt, Human
cucuguccacagguuugucccu

SEQ ID NO: 988324 - RNA, 22 nt, Human
aaaugucuuugaguauuucugc

SEQ ID NO: 988325 - RNA, 22 nt, Human
uugucuuaaauggauggacaau

SEQ ID NO: 988326 - RNA, 22 nt, Human
agcuguguagggaaucagagaa

SEQ ID NO: 988327 - RNA, 22 nt, Human
agcaggguuuggggauuggcac

SEQ ID NO: 988328 - RNA, 22 nt, Human
ucugggcucuuaguguacccuc

SEQ ID NO: 988329 - RNA, 22 nt, Human
agucaguggcuccgagccuggu

SEQ ID NO: 988330 - RNA, 22 nt, Human
gugggcaaggucccugccagcu

SEQ ID NO: 988331 - RNA, 18 nt, Human
ucacagugcucuugccua

SEQ ID NO: 988332 - RNA, 22 nt, Human
cugaggugcuagggucccugcu

SEQ ID NO: 988333 - RNA, 22 nt, Human
cacucugagaaguacaagcucc

SEQ ID NO: 988334 - RNA, 22 nt, Human
acaauucuggguauuuauauag

SEQ ID NO: 988335 - RNA, 22 nt, Human
aacugccuggccaggcugcaac

SEQ ID NO: 988336 - RNA, 23 nt, Human
gcauugucuccccacuucugggc

SEQ ID NO: 988337 - RNA, 22 nt, Human
agacauuuauugaacaccuagc

SEQ ID NO: 988338 - RNA, 22 nt, Human
ucauugcaggcauuccccugcc

SEQ ID NO: 988339 - RNA, 22 nt, Human
ucugccuguucaagucuucuag

SEQ ID NO: 988340 - RNA, 21 nt, Human
ucugagagcaacugcccuuua

SEQ ID NO: 988341 - RNA, 22 nt, Human
aacaggagaguaaauauaugau

SEQ ID NO: 988342 - RNA, 22 nt, Human
caggguggcccuguggucucau

SEQ ID NO: 988343 - RNA, 22 nt, Human
aauagaauuuguacuguguuuu

SEQ ID NO: 988344 - RNA, 22 nt, Human
ggcaccuggagguuuacuggau

SEQ ID NO: 988345 - RNA, 22 nt, Human
gacaggggucccucugggcugu

SEQ ID NO: 988346 - RNA, 22 nt, Human
auguaagguucagaguauguga

SEQ ID NO: 988347 - RNA, 22 nt, Human
aucucccagccacagcauucuu

SEQ ID NO: 988348 - RNA, 22 nt, Human
gcaggugggggucggugcaucu

SEQ ID NO: 988349 - RNA, 23 nt, Human
gguggcaggaguggaugcugagc

SEQ ID NO: 988350 - RNA, 22 nt, Human
uacauguaagacaugagacucu

SEQ ID NO: 988351 - RNA, 22 nt, Human
aauuccugucuuaacaguucug

SEQ ID NO: 988352 - RNA, 19 nt, Human
ucucuggggacacuuucac

SEQ ID NO: 988353 - RNA, 22 nt, Human
acuuucucccacccacccgucu

SEQ ID NO: 988354 - RNA, 22 nt, Human
cccauuuaaacacaagcuuuca

SEQ ID NO: 988355 - RNA, 19 nt, Human
uggcaggcccaggauggac

SEQ ID NO: 988356 - RNA, 20 nt, Human
uguuccaugacuauuuggau

SEQ ID NO: 988357 - RNA, 22 nt, Human
uggcagcauuaauuauucaggu

SEQ ID NO: 988358 - RNA, 22 nt, Human
cccucaggagaugucagcugga

SEQ ID NO: 988359 - RNA, 22 nt, Human
aagcagccuggcaugaugcuuu

SEQ ID NO: 988360 - RNA, 21 nt, Human
gggcuggacaugguggcucau

SEQ ID NO: 988361 - RNA, 22 nt, Human
ccuggaggagcgcugaccagcu

SEQ ID NO: 988362 - RNA, 22 nt, Human
cagcucugugggagcguaugug

SEQ ID NO: 988363 - RNA, 22 nt, Human
acagggccagccugggaccugg

SEQ ID NO: 988364 - RNA, 22 nt, Human
cuucccagacgggguggcagcc

SEQ ID NO: 988365 - RNA, 22 nt, Human
uccaggcuggacaugaggcggg

SEQ ID NO: 988366 - RNA, 22 nt, Human
agcagggcagcugaugcgcacg

SEQ ID NO: 988367 - RNA, 22 nt, Human
acacuuuuagcuaugaguuaau

SEQ ID NO: 988368 - RNA, 21 nt, Human
aaaguucaugcuuuaauauuc

SEQ ID NO: 988369 - RNA, 22 nt, Human
ccuggugcuuaccagagcuuuu

SEQ ID NO: 988370 - RNA, 22 nt, Human
uuccuggcaugaaaaauaucac

SEQ ID NO: 988371 - RNA, 22 nt, Human
agcugagcauuugauccaccuc

SEQ ID NO: 988372 - RNA, 22 nt, Human
ucuggcccagccccugagguca

SEQ ID NO: 988373 - RNA, 22 nt, Human
ggcugcugguagggguaggaag

SEQ ID NO: 988374 - RNA, 22 nt, Human
ccaaagugcugggguuacaggc

SEQ ID NO: 988375 - RNA, 22 nt, Human
ugccuggcaagaggggcuggcu

SEQ ID NO: 988376 - RNA, 22 nt, Human
ucucugcucaggcaccagcccu

SEQ ID NO: 988377 - RNA, 22 nt, Human
auccuugagccaaugacugauu

SEQ ID NO: 988378 - RNA, 20 nt, Human
ggggcccaagcccucuugcc

SEQ ID NO: 988379 - RNA, 22 nt, Human
aggggagccccugguccuggug

SEQ ID NO: 988380 - RNA, 22 nt, Human
ugggcuccucgucacucgcugu

SEQ ID NO: 988381 - RNA, 22 nt, Human
cugggccuagaggaagcugaca

SEQ ID NO: 988382 - RNA, 19 nt, Human
agacagagcucaguggguu

SEQ ID NO: 988383 - RNA, 22 nt, Human
cggcuggguagaggugccgggu

SEQ ID NO: 988384 - RNA, 22 nt, Human
uccacagaauguaagauccaca

SEQ ID NO: 988385 - RNA, 19 nt, Human
ccugggagucagcugaagg

SEQ ID NO: 988386 - RNA, 22 nt, Human
cuccccagguucaggagguggg

SEQ ID NO: 988387 - RNA, 23 nt, Human
cagaccuggcagucauccucaac

SEQ ID NO: 988388 - RNA, 22 nt, Human
cagagccuaaaacgacuccacu

SEQ ID NO: 988389 - RNA, 22 nt, Human
ucagcagggcugugguguggcu

SEQ ID NO: 988390 - RNA, 22 nt, Human
gagggcagaaaauuaugcggug

SEQ ID NO: 988391 - RNA, 22 nt, Human
cccagcuccagagccagaaaca

SEQ ID NO: 988392 - RNA, 22 nt, Human
uccaugugccaaggggcagagg

SEQ ID NO: 988393 - RNA, 22 nt, Human
gugcagugacccuggagagcug

SEQ ID NO: 988394 - RNA, 22 nt, Human
agccauugaauuuagugccuuu

SEQ ID NO: 988395 - RNA, 22 nt, Human
uggccugguaccacauagauuu

SEQ ID NO: 988396 - RNA, 22 nt, Human
gcauuguccugcuucugagugu

SEQ ID NO: 988397 - RNA, 23 nt, Human
auauuagggagauuagcccucua

SEQ ID NO: 988398 - RNA, 22 nt, Human
gggcucugcgcucagcuccagc

SEQ ID NO: 988399 - RNA, 22 nt, Human
aucuggcuuuuacugaauugcu

SEQ ID NO: 988400 - RNA, 22 nt, Human
ggaggugggagacauaggcggc

SEQ ID NO: 988401 - RNA, 22 nt, Human
gcagacuggucuucagccuugg

SEQ ID NO: 988402 - RNA, 22 nt, Human
caggaucccuggccuccgccca

SEQ ID NO: 988403 - RNA, 21 nt, Human
uugaagcaaggguggcucuga

SEQ ID NO: 988404 - RNA, 22 nt, Human
aagcugcccaagacugaagcau

SEQ ID NO: 988405 - RNA, 22 nt, Human
cccugggcagucugcacuucag

SEQ ID NO: 988406 - RNA, 22 nt, Human
cuucuggggauggagcccagaa

SEQ ID NO: 988407 - RNA, 22 nt, Human
ugagagucucagaccuccuggu

SEQ ID NO: 988408 - RNA, 22 nt, Human
agcugccagaugacagugcuau

SEQ ID NO: 988409 - RNA, 22 nt, Human
uugcaaaugggcaaagcagauc

SEQ ID NO: 988410 - RNA, 22 nt, Human
cagggcucaucugugugaccag

SEQ ID NO: 988411 - RNA, 22 nt, Human
aucuggcuauugacauguuaua

SEQ ID NO: 988412 - RNA, 22 nt, Human
uguggucucguuauguugccca

SEQ ID NO: 988413 - RNA, 22 nt, Human
agaagcagacucugaggcaagg

SEQ ID NO: 988414 - RNA, 22 nt, Human
cuccugugggucaccaauaggc

SEQ ID NO: 988415 - RNA, 22 nt, Human
ggggauggauuccgggucccug

SEQ ID NO: 988416 - RNA, 22 nt, Human
gaaaagcuaggccaguucagcu

SEQ ID NO: 988417 - RNA, 22 nt, Human
augggaggaaggaggcccuuga

SEQ ID NO: 988418 - RNA, 22 nt, Human
ucuggcucaggucagacaggga

SEQ ID NO: 988419 - RNA, 22 nt, Human
uugggcucaggaguuugagacc

SEQ ID NO: 988420 - RNA, 22 nt, Human
cucugagcugaaacaugagcau

SEQ ID NO: 988421 - RNA, 22 nt, Human
ccagcuggcacuguggcugccc

SEQ ID NO: 988422 - RNA, 22 nt, Human
gguggggucacgacagagggaa

SEQ ID NO: 988423 - RNA, 22 nt, Human
auuaggaaacugaaugucagaa

SEQ ID NO: 988424 - RNA, 22 nt, Human
uguuccaugucuuuguaggacu

SEQ ID NO: 988425 - RNA, 22 nt, Human
ccuuuuucccuggagggacagc

SEQ ID NO: 988426 - RNA, 22 nt, Human
cuggcagguccagcuggacuca

SEQ ID NO: 988427 - RNA, 23 nt, Human
uggccacagggugcuccauugua

SEQ ID NO: 988428 - RNA, 22 nt, Human
aguaucaaggaucuccagcacc

SEQ ID NO: 988429 - RNA, 22 nt, Human
ugccugggccucugaggaaggc

SEQ ID NO: 988430 - RNA, 22 nt, Human
ccagguggaaggucugugcucu

SEQ ID NO: 988431 - RNA, 22 nt, Human
ucaguuuucucaucugugaaau

SEQ ID NO: 988432 - RNA, 22 nt, Human
cagagacagggcagggagugug

SEQ ID NO: 988433 - RNA, 22 nt, Human
ccugggcaacauagugagaccc

SEQ ID NO: 988434 - RNA, 22 nt, Human
gccugcagaacugugaggcaau

SEQ ID NO: 988435 - RNA, 22 nt, Human
guaaaugugcuucuuuuaacuu

SEQ ID NO: 988436 - RNA, 22 nt, Human
gcuggccugucuagagccuuac

SEQ ID NO: 988437 - RNA, 22 nt, Human
cugguucauccccuuccaggaa

SEQ ID NO: 988438 - RNA, 22 nt, Human
aguauuucugcucaugaaagag

SEQ ID NO: 988439 - RNA, 22 nt, Human
ccugcagcuccggauuucuggg

SEQ ID NO: 988440 - RNA, 22 nt, Human
cucuuccucucaugcggucaua

SEQ ID NO: 988441 - RNA, 22 nt, Human
agggucuguggaugcaucuggg

SEQ ID NO: 988442 - RNA, 22 nt, Human
cugcaguguucuggaaugcauu

SEQ ID NO: 988443 - RNA, 22 nt, Human
agccuugaacacugacugaagg

SEQ ID NO: 988444 - RNA, 22 nt, Human
caacccaagguuaguuggucuu

SEQ ID NO: 988445 - RNA, 22 nt, Human
cagggccacuguagaugaggag

SEQ ID NO: 988446 - RNA, 22 nt, Human
agaagauuuagguugacgcuau

SEQ ID NO: 988447 - RNA, 22 nt, Human
uuucuucugagaucagggagaa

SEQ ID NO: 988448 - RNA, 22 nt, Human
cucuggccugcuuccucaggua

SEQ ID NO: 988449 - RNA, 22 nt, Human
auuuuuaugacaaaccauccuc

SEQ ID NO: 988450 - RNA, 22 nt, Human
acauuucucauucuccccuaac

SEQ ID NO: 988451 - RNA, 22 nt, Human
uguacauuuagagcucaauaga

SEQ ID NO: 988452 - RNA, 19 nt, Human
acagaagcauagaaaagga

SEQ ID NO: 988453 - RNA, 22 nt, Human
cgagaguggacagggcgcagcu

SEQ ID NO: 988454 - RNA, 23 nt, Human
cagggccaggcagcagcugucac

SEQ ID NO: 988455 - RNA, 22 nt, Human
gaacaguaaauuuaugcagcac

SEQ ID NO: 988456 - RNA, 22 nt, Human
ugaaagcuguccacuaggcugu

SEQ ID NO: 988457 - RNA, 17 nt, Human
auuagguuuugucauga

SEQ ID NO: 988458 - RNA, 22 nt, Human
ucuggcaaaggcaaccacaguu

SEQ ID NO: 988459 - RNA, 22 nt, Human
cccaggagguagagguugcagu

SEQ ID NO: 988460 - RNA, 22 nt, Human
gccugcagccucaagggcugag

SEQ ID NO: 988461 - RNA, 22 nt, Human
gcuccaggagagggaagcagau

SEQ ID NO: 988462 - RNA, 22 nt, Human
gcccaggcuagcguagagugca

SEQ ID NO: 988463 - RNA, 22 nt, Human
uucacauugguucuugauagcu

SEQ ID NO: 988464 - RNA, 22 nt, Human
ugcuagaaaucugaaacuagca

SEQ ID NO: 988465 - RNA, 22 nt, Human
agcagggcuuugcagacuuggg

SEQ ID NO: 988466 - RNA, 22 nt, Human
ccagcuggaagagugcagaacu

SEQ ID NO: 988467 - RNA, 22 nt, Human
cucugggcaaguuucuucauga

SEQ ID NO: 988468 - RNA, 22 nt, Human
guuuauuagaguuuucugucug

SEQ ID NO: 988469 - RNA, 22 nt, Human
auugucuguacuuuaaaaaugu

SEQ ID NO: 988470 - RNA, 22 nt, Human
agcaccuggucuccuggcgcug

SEQ ID NO: 988471 - RNA, 22 nt, Human
aucaggaucugcaucauaagaa

SEQ ID NO: 988472 - RNA, 22 nt, Human
ccagagccuaagaucugauccu

SEQ ID NO: 988473 - RNA, 22 nt, Human
cuggagccgcauggagcaggga

SEQ ID NO: 988474 - RNA, 22 nt, Human
gugugcagugagcaaaagaucu

SEQ ID NO: 988475 - RNA, 22 nt, Human
uugagggucuggaucugcugcu

SEQ ID NO: 988476 - RNA, 22 nt, Human
uugcauugugauuacagaggug

SEQ ID NO: 988477 - RNA, 22 nt, Human
caggucccgccccgggcugacc

SEQ ID NO: 988478 - RNA, 22 nt, Human
ugugucagagguagagauggca

SEQ ID NO: 988479 - RNA, 22 nt, Human
aaucuggcucagaagaagauga

SEQ ID NO: 988480 - RNA, 22 nt, Human
acugagcucuugacugggaguu

SEQ ID NO: 988481 - RNA, 22 nt, Human
acauuucagcgugcaugacaug

SEQ ID NO: 988482 - RNA, 22 nt, Human
cauguacaguuuuucuguccug

SEQ ID NO: 988483 - RNA, 22 nt, Human
ucagcaauaugauaggcuuugu

SEQ ID NO: 988484 - RNA, 22 nt, Human
agauuucaauggauauugcaag

SEQ ID NO: 988485 - RNA, 22 nt, Human
aggcugaggcagguggaucacu

SEQ ID NO: 988486 - RNA, 21 nt, Human
caugaagccgguucccuguuu

SEQ ID NO: 988487 - RNA, 22 nt, Human
uagccucuggaauccuuucucu

SEQ ID NO: 988488 - RNA, 22 nt, Human
aauaaauguuaagauugucuca

SEQ ID NO: 988489 - RNA, 22 nt, Human
auucuuuucccaacugcuuuaa

SEQ ID NO: 988490 - RNA, 22 nt, Human
ucugagccguauggcuuggcua

SEQ ID NO: 988491 - RNA, 22 nt, Human
uggcccugacugauguggaggg

SEQ ID NO: 988492 - RNA, 22 nt, Human
ccagggcauguccaagacuuag

SEQ ID NO: 988493 - RNA, 22 nt, Human
cggagccugcuuguugcagcug

SEQ ID NO: 988494 - RNA, 22 nt, Human
uucuaacucuguuauguguuuc

SEQ ID NO: 988495 - RNA, 22 nt, Human
ucuuagaaugucaacugauguu

SEQ ID NO: 988496 - RNA, 22 nt, Human
uuccucucucuugccagaaugu

SEQ ID NO: 988497 - RNA, 23 nt, Human
ugccucugccucccuagucugca

SEQ ID NO: 988498 - RNA, 22 nt, Human
ccugugugcugaugacgacaga

SEQ ID NO: 988499 - RNA, 22 nt, Human
caggggacaguaugguggauga

SEQ ID NO: 988500 - RNA, 22 nt, Human
ugccugggguuggcaaacugcu

SEQ ID NO: 988501 - RNA, 22 nt, Human
acaggccugacacacagagggc

SEQ ID NO: 988502 - RNA, 22 nt, Human
gcugcccugugguccagcaggu

SEQ ID NO: 988503 - RNA, 17 nt, Human
gagagcugcugcuuccg

SEQ ID NO: 988504 - RNA, 22 nt, Human
aaaucugggucaagguggagug

SEQ ID NO: 988505 - RNA, 22 nt, Human
cuggccugggagcugcuagcgu

SEQ ID NO: 988506 - RNA, 22 nt, Human
acuaaauaguuuugacagaaca

SEQ ID NO: 988507 - RNA, 22 nt, Human
cacaagucuguggucuccaaca

SEQ ID NO: 988508 - RNA, 22 nt, Human
ugggugggagcgcccugucugg

SEQ ID NO: 988509 - RNA, 22 nt, Human
acagcagcgucaacuuaaaauu

SEQ ID NO: 988510 - RNA, 22 nt, Human
uagucuuuugagaaguauaucu

SEQ ID NO: 988511 - RNA, 22 nt, Human
gguggggcccuggcacugguau

SEQ ID NO: 988512 - RNA, 22 nt, Human
uggaaagaaaguaaaggcguau

SEQ ID NO: 988513 - RNA, 22 nt, Human
ccaaggagcaaggcucaacaag

SEQ ID NO: 988514 - RNA, 22 nt, Human
auaaggcacacauagauagggu

SEQ ID NO: 988515 - RNA, 22 nt, Human
ugggaggaucgcuugagcccag

SEQ ID NO: 988516 - RNA, 22 nt, Human
agcccccaaaagugcuuaugau

SEQ ID NO: 988517 - RNA, 22 nt, Human
aaaugcagcagcuaauugaaaa

SEQ ID NO: 988518 - RNA, 22 nt, Human
uuguuacuaagccuuuaaauag

SEQ ID NO: 988519 - RNA, 22 nt, Human
aguuucuuuagauagaaaguuc

SEQ ID NO: 988520 - RNA, 22 nt, Human
agccagagcugaugucauucuc

SEQ ID NO: 988521 - RNA, 17 nt, Human
gcacugaacaauccugu

SEQ ID NO: 988522 - RNA, 22 nt, Human
uggcugccuuucaccucaucuc

SEQ ID NO: 988523 - RNA, 22 nt, Human
agcagccagagucugaacauua

SEQ ID NO: 988524 - RNA, 21 nt, Human
agcugggccucagccugcagu

SEQ ID NO: 988525 - RNA, 22 nt, Human
gauuucaaggaguuuucacagu

SEQ ID NO: 988526 - RNA, 22 nt, Human
uuuagaaauucaucuauggccu

SEQ ID NO: 988527 - RNA, 20 nt, Human
uguuccaagcuaaugaauga

SEQ ID NO: 988528 - RNA, 21 nt, Human
ccacucugaguguugaacaga

SEQ ID NO: 988529 - RNA, 22 nt, Human
cugugcuuccaggauggcagcu

SEQ ID NO: 988530 - RNA, 22 nt, Human
uguucuugggaaucuuacaguu

SEQ ID NO: 988531 - RNA, 22 nt, Human
caccaggcuggagugcagaggu

SEQ ID NO: 988532 - RNA, 22 nt, Human
cugcagagaauuguggggcuuc

SEQ ID NO: 988533 - RNA, 22 nt, Human
ggcugccugcucaggugcggcg

SEQ ID NO: 988534 - RNA, 22 nt, Human
ugaauauguuccucacaaguuc

SEQ ID NO: 988535 - RNA, 22 nt, Human
agcacucuucugugauaguugu

SEQ ID NO: 988536 - RNA, 22 nt, Human
uuagauaaauuaagacuuuaca

SEQ ID NO: 988537 - RNA, 22 nt, Human
gcagcugagcgugaggaagagu

SEQ ID NO: 988538 - RNA, 22 nt, Human
uggggugccgacagggagggca

SEQ ID NO: 988539 - RNA, 22 nt, Human
gccuggaguagcauggcaagcc

SEQ ID NO: 988540 - RNA, 22 nt, Human
aaaguguaaggaauuuaaguaa

SEQ ID NO: 988541 - RNA, 22 nt, Human
uuucauaaugucacagucaaaa

SEQ ID NO: 988542 - RNA, 22 nt, Human
ggccuggccuccagaugugggc

SEQ ID NO: 988543 - RNA, 18 nt, Human
uccugccugugccccagg

SEQ ID NO: 988544 - RNA, 22 nt, Human
ucucucagucagaugcuaaaga

SEQ ID NO: 988545 - RNA, 22 nt, Human
agggccuggaacugugggcagg

SEQ ID NO: 988546 - RNA, 22 nt, Human
uucuuuggggaauauucugguu

SEQ ID NO: 988547 - RNA, 22 nt, Human
guggaggacaaaagaagccuuu

SEQ ID NO: 988548 - RNA, 22 nt, Human
agccucugcuggcccuggcacu

SEQ ID NO: 988549 - RNA, 22 nt, Human
uggacagguuugggugccuguu

SEQ ID NO: 988550 - RNA, 22 nt, Human
uaucuugagagacaacacagca

SEQ ID NO: 988551 - RNA, 21 nt, Human
agcuggugucagagcucuggg

SEQ ID NO: 988552 - RNA, 22 nt, Human
gcugccuuugugagccaagggg

SEQ ID NO: 988553 - RNA, 22 nt, Human
gcugccugucccaggaugagga

SEQ ID NO: 988554 - RNA, 22 nt, Human
uuaugcuaaaugaaucaaguca

SEQ ID NO: 988555 - RNA, 22 nt, Human
uagaaauguugguauuaacauu

SEQ ID NO: 988556 - RNA, 21 nt, Human
gcagcagaggcuugacagaca

SEQ ID NO: 988557 - RNA, 22 nt, Human
agcaggugaauuccuggaugug

SEQ ID NO: 988558 - RNA, 22 nt, Human
ggaaggucgagcugcaucuggc

SEQ ID NO: 988559 - RNA, 22 nt, Human
ggugcccaccugucuuccugga

SEQ ID NO: 988560 - RNA, 21 nt, Human
agauuguauggaggugagagg

SEQ ID NO: 988561 - RNA, 22 nt, Human
augguacaaaauguauaaaguc

SEQ ID NO: 988562 - RNA, 22 nt, Human
gcaggaugaaggcagaggcuga

SEQ ID NO: 988563 - RNA, 22 nt, Human
acauuucuucccuuuagcagaa

SEQ ID NO: 988564 - RNA, 22 nt, Human
ggagcugaaggggugggcucag

SEQ ID NO: 988565 - RNA, 22 nt, Human
ggaagagagggcugggccucaa

SEQ ID NO: 988566 - RNA, 19 nt, Human
gccugcagaaaaggcaggg

SEQ ID NO: 988567 - RNA, 22 nt, Human
cuguccuguagcuccaucaguc

SEQ ID NO: 988568 - RNA, 22 nt, Human
cccucugcaggcuggaccugcc

SEQ ID NO: 988569 - RNA, 22 nt, Human
gaggcccaggucaagcagccac

SEQ ID NO: 988570 - RNA, 22 nt, Human
acaggggcuccgaaggugaggg

SEQ ID NO: 988571 - RNA, 22 nt, Human
acaggugggcuuaagagucggc

SEQ ID NO: 988572 - RNA, 22 nt, Human
uggccacauccuuuccuuguca

SEQ ID NO: 988573 - RNA, 22 nt, Human
uccaggagaggccugaccaggu

SEQ ID NO: 988574 - RNA, 18 nt, Human
ugacagaaccuggagccu

SEQ ID NO: 988575 - RNA, 22 nt, Human
gcucaggagcugacagccucaa

SEQ ID NO: 988576 - RNA, 22 nt, Human
cucagaaucugccaaguucagg

SEQ ID NO: 988577 - RNA, 20 nt, Human
gccugccucagcuagcugag

SEQ ID NO: 988578 - RNA, 22 nt, Human
aaaguguaaaagcauguuaggg

SEQ ID NO: 988579 - RNA, 22 nt, Human
aacauuuaugguagucauugca

SEQ ID NO: 988580 - RNA, 23 nt, Human
uggcuaaaggcucuaguccugcu

SEQ ID NO: 988581 - RNA, 22 nt, Human
ucaggcagaugcagggauggau

SEQ ID NO: 988582 - RNA, 22 nt, Human
uuugauucuguaaaauaacagg

SEQ ID NO: 988583 - RNA, 22 nt, Human
aaaaugaggucaauauccuuuu

SEQ ID NO: 988584 - RNA, 20 nt, Human
gagagcuggggaugaggcug

SEQ ID NO: 988585 - RNA, 22 nt, Human
caaaaguaccuugugugcuuug

SEQ ID NO: 988586 - RNA, 22 nt, Human
cuucuggaggacacuggcccca

SEQ ID NO: 988587 - RNA, 22 nt, Human
agccccaggcccggacgccucu

SEQ ID NO: 988588 - RNA, 22 nt, Human
auguaucagauaaagcaugugg

SEQ ID NO: 988589 - RNA, 22 nt, Human
ccagucacuggaaaaugggaau

SEQ ID NO: 988590 - RNA, 22 nt, Human
aaaauacacauacuaggggaaa

SEQ ID NO: 988591 - RNA, 22 nt, Human
ugcugccaugcagagcaacaga

SEQ ID NO: 988592 - RNA, 22 nt, Human
uaaauguguuguggaugaaguu

SEQ ID NO: 988593 - RNA, 22 nt, Human
acagagguguuccagaccuagg

SEQ ID NO: 988594 - RNA, 21 nt, Human
gcugcugccccuagugaggcc

SEQ ID NO: 988595 - RNA, 22 nt, Human
aaugcugcucucauaauuauag

SEQ ID NO: 988596 - RNA, 20 nt, Human
gaagcagcuucauguagaca

SEQ ID NO: 988597 - RNA, 22 nt, Human
ucucccaggugggugccuggag

SEQ ID NO: 988598 - RNA, 21 nt, Human
gcugucucuggcuccugggaa

SEQ ID NO: 988599 - RNA, 22 nt, Human
ucuggcucucauacucgccagu

SEQ ID NO: 988600 - RNA, 22 nt, Human
uggcagaaguacacaagcaugc

SEQ ID NO: 988601 - RNA, 22 nt, Human
uaacacugguauuucauuuagu

SEQ ID NO: 988602 - RNA, 22 nt, Human
cagagccaugguaugggcuugu

SEQ ID NO: 988603 - RNA, 22 nt, Human
ccagccaggcauugcaaacuga

SEQ ID NO: 988604 - RNA, 22 nt, Human
cugcucugaagccaggauucug

SEQ ID NO: 988605 - RNA, 22 nt, Human
ucaccugggagggcugugguag

SEQ ID NO: 988606 - RNA, 22 nt, Human
ggaggcucccacgcagcucaca

SEQ ID NO: 988607 - RNA, 22 nt, Human
cuugccuguggcuaguuggcuc

SEQ ID NO: 988608 - RNA, 22 nt, Human
ugcagcuccucuggcugccuga

SEQ ID NO: 988609 - RNA, 22 nt, Human
uaaauguggagacucaggaguc

SEQ ID NO: 988610 - RNA, 22 nt, Human
ggucccugcugaagccuuggug

SEQ ID NO: 988611 - RNA, 22 nt, Human
agaggcuccuucacucuggcac

SEQ ID NO: 988612 - RNA, 22 nt, Human
gcaugcugcaccagagccucuc

SEQ ID NO: 988613 - RNA, 23 nt, Human
auaaggcauaaagguacauugga

SEQ ID NO: 988614 - RNA, 22 nt, Human
gcucugcugucuucuugcaggc

SEQ ID NO: 988615 - RNA, 22 nt, Human
ggcagcuggguuggccagaaac

SEQ ID NO: 988616 - RNA, 22 nt, Human
guccucugggagccuugagccu

SEQ ID NO: 988617 - RNA, 22 nt, Human
ggcuggcuuucucuccgcaccu

SEQ ID NO: 988618 - RNA, 23 nt, Human
uggaccugaaccagugccucugu

SEQ ID NO: 988619 - RNA, 22 nt, Human
gagagugaggcaucaggggcag

SEQ ID NO: 988620 - RNA, 22 nt, Human
ucugagcuuuuauuaucaaccu

SEQ ID NO: 988621 - RNA, 22 nt, Human
gcagcuggggccacacuuaggc

SEQ ID NO: 988622 - RNA, 22 nt, Human
gagacagcagggccagggccug

SEQ ID NO: 988623 - RNA, 22 nt, Human
ugaaagguagcuggccucauag

SEQ ID NO: 988624 - RNA, 22 nt, Human
ggucauugaaaucagaaggguu

SEQ ID NO: 988625 - RNA, 17 nt, Human
uucugagccacuuccuu

SEQ ID NO: 988626 - RNA, 22 nt, Human
cuggagagggagcccuggcagu

SEQ ID NO: 988627 - RNA, 22 nt, Human
ucacaacucuuuccauuuaaua

SEQ ID NO: 988628 - RNA, 23 nt, Human
ggcuggcccggggcugcuccuga

SEQ ID NO: 988629 - RNA, 22 nt, Human
agauuuagugguggaauuuugg

SEQ ID NO: 988630 - RNA, 22 nt, Human
uggggcuguccuuagucugaga

SEQ ID NO: 988631 - RNA, 22 nt, Human
cacugggcguguccugggugag

SEQ ID NO: 988632 - RNA, 22 nt, Human
gccucugcggagcuguacauca

SEQ ID NO: 988633 - RNA, 21 nt, Human
cugcucuggggaccggcugug

SEQ ID NO: 988634 - RNA, 21 nt, Human
ugcugccaucaugcagagaug

SEQ ID NO: 988635 - RNA, 21 nt, Human
uggagcugaauuuuuggcauc

SEQ ID NO: 988636 - RNA, 22 nt, Human
augucuuuggcuuugacauggc

SEQ ID NO: 988637 - RNA, 22 nt, Human
ugagggaggcccuuugagcaga

SEQ ID NO: 988638 - RNA, 22 nt, Human
ugugacaucgcugugucuguuu

SEQ ID NO: 988639 - RNA, 22 nt, Human
uaacagaagagcaggcagcccu

SEQ ID NO: 988640 - RNA, 22 nt, Human
agccuggaagaaccugaagucu

SEQ ID NO: 988641 - RNA, 22 nt, Human
cugcucuggcguacucggcauc

SEQ ID NO: 988642 - RNA, 22 nt, Human
guauuaggaggaacacaggccu

SEQ ID NO: 988643 - RNA, 22 nt, Human
cucuggccugcagauccaugcu

SEQ ID NO: 988644 - RNA, 22 nt, Human
acauucaaggccuucugacaca

SEQ ID NO: 988645 - RNA, 22 nt, Human
agccucugcuuaugcaaaggua

SEQ ID NO: 988646 - RNA, 20 nt, Human
ggaagcagagaacuguuuuc

SEQ ID NO: 988647 - RNA, 22 nt, Human
gauacauuuuaucuccuaacag

SEQ ID NO: 988648 - RNA, 22 nt, Human
aaagaggaaccaagagcacgug

SEQ ID NO: 988649 - RNA, 22 nt, Human
ugggagaagcagcagccaagug

SEQ ID NO: 988650 - RNA, 22 nt, Human
aggccugggacgggagccguga

SEQ ID NO: 988651 - RNA, 23 nt, Human
cagcugaagcagccugggcugga

SEQ ID NO: 988652 - RNA, 22 nt, Human
agcagcuucuuucacuccugga

SEQ ID NO: 988653 - RNA, 20 nt, Human
ccuggagccuggaaggaguc

SEQ ID NO: 988654 - RNA, 22 nt, Human
aguuuuauuccaaugugcagca

SEQ ID NO: 988655 - RNA, 22 nt, Human
uagaaauccccagucucauagu

SEQ ID NO: 988656 - RNA, 22 nt, Human
ggcuccucucuggccgcucccg

SEQ ID NO: 988657 - RNA, 22 nt, Human
gccucuggucccucaugcugug

SEQ ID NO: 988658 - RNA, 22 nt, Human
cugccucuccccagaguggccc

SEQ ID NO: 988659 - RNA, 22 nt, Human
uuccuguauuuugcgaauuuuc

SEQ ID NO: 988660 - RNA, 22 nt, Human
cgaugguucuggcugcuuguau

SEQ ID NO: 988661 - RNA, 22 nt, Human
agcugucugucuccugaggaga

SEQ ID NO: 988662 - RNA, 22 nt, Human
ggccaagauggaaggagagaug

SEQ ID NO: 988663 - RNA, 22 nt, Human
uugaaaggugacauuguuagag

SEQ ID NO: 988664 - RNA, 22 nt, Human
agggauguaaauucuucuucuu

SEQ ID NO: 988665 - RNA, 20 nt, Human
gcauugaguauagacagaug

SEQ ID NO: 988666 - RNA, 22 nt, Human
gagaggagucccuaucacaguu

SEQ ID NO: 988667 - RNA, 22 nt, Human
uaggagcuaaaauauuuuauau

SEQ ID NO: 988668 - RNA, 22 nt, Human
agcuauguuauagcauguauca

SEQ ID NO: 988669 - RNA, 22 nt, Human
agcugccauccgaggugucaga

SEQ ID NO: 988670 - RNA, 22 nt, Human
ucacucugggccagcgcaggua

SEQ ID NO: 988671 - RNA, 22 nt, Human
aguugcagacgcagagauguug

SEQ ID NO: 988672 - RNA, 22 nt, Human
ucacaggcuccagggccuggau

SEQ ID NO: 988673 - RNA, 23 nt, Human
uggcagugaucaaaagcuuacau

SEQ ID NO: 988674 - RNA, 22 nt, Human
gccaggaguucagaugcauguu

SEQ ID NO: 988675 - RNA, 22 nt, Human
cuccagggggcauccacacagc

SEQ ID NO: 988676 - RNA, 22 nt, Human
uccuccagugucuggggccuug

SEQ ID NO: 988677 - RNA, 23 nt, Human
gccucugcucugcguuggggacu

SEQ ID NO: 988678 - RNA, 22 nt, Human
cuggcuucugggccagggcaga

SEQ ID NO: 988679 - RNA, 22 nt, Human
gcccauggcagaacugugagca

SEQ ID NO: 988680 - RNA, 22 nt, Human
agccuucaaccuagcuagagca

SEQ ID NO: 988681 - RNA, 22 nt, Human
cagcccagcacuaaguagauuu

SEQ ID NO: 988682 - RNA, 22 nt, Human
gaagccaacauuccaaguagaa

SEQ ID NO: 988683 - RNA, 22 nt, Human
cuguggcuaugguguacauacu

SEQ ID NO: 988684 - RNA, 22 nt, Human
cacugaaucucaaggggagggu

SEQ ID NO: 988685 - RNA, 22 nt, Human
cugcucugagaggcucuuccua

SEQ ID NO: 988686 - RNA, 22 nt, Human
acaguaccugcucucaagcaaa

SEQ ID NO: 988687 - RNA, 22 nt, Human
gucccagaggacagggucacau

SEQ ID NO: 988688 - RNA, 22 nt, Human
guuauaaaggugauaaugguca

SEQ ID NO: 988689 - RNA, 22 nt, Human
ucugucugcucauuuaccucag

SEQ ID NO: 988690 - RNA, 22 nt, Human
agugucugaaccaccggggcau

SEQ ID NO: 988691 - RNA, 22 nt, Human
gucuggaggaggaagaaggcac

SEQ ID NO: 988692 - RNA, 22 nt, Human
guccagggcuaaaucagguucc

SEQ ID NO: 988693 - RNA, 22 nt, Human
agucauauguggcauuuucuaa

SEQ ID NO: 988694 - RNA, 22 nt, Human
caggcagccugcggucugcaca

SEQ ID NO: 988695 - RNA, 22 nt, Human
uucaagaugacccagucacacg

SEQ ID NO: 988696 - RNA, 22 nt, Human
ccaggguguagggauuccagau

SEQ ID NO: 988697 - RNA, 22 nt, Human
aaaucagucccucuuggaauuu

SEQ ID NO: 988698 - RNA, 22 nt, Human
auuaggauuuuguccaaguagc

SEQ ID NO: 988699 - RNA, 22 nt, Human
uaagcauaacuaaaaaugauuu

SEQ ID NO: 988700 - RNA, 22 nt, Human
ucuuugcaaauguuauuaucuu

SEQ ID NO: 988701 - RNA, 22 nt, Human
ucauguuuggaguuugcucacu

SEQ ID NO: 988702 - RNA, 22 nt, Human
uagcagagcagggaucagagcc

SEQ ID NO: 988703 - RNA, 22 nt, Human
gucugucucccugugacugaga

SEQ ID NO: 988704 - RNA, 22 nt, Human
gcugcucucagagcucaugcug

SEQ ID NO: 988705 - RNA, 22 nt, Human
uauugucuguccgggucaaagc

SEQ ID NO: 988706 - RNA, 22 nt, Human
cugaaggauguguggugggagu

SEQ ID NO: 988707 - RNA, 22 nt, Human
uggcagaguuauggguauuuau

SEQ ID NO: 988708 - RNA, 23 nt, Human
aggaggccugaaacugaggcuga

SEQ ID NO: 988709 - RNA, 22 nt, Human
ucuaaaaaagucuguucacuug

SEQ ID NO: 988710 - RNA, 22 nt, Human
caggaacagcaccaggagcuag

SEQ ID NO: 988711 - RNA, 22 nt, Human
uccuucaguucaauuaguccgu

SEQ ID NO: 988712 - RNA, 22 nt, Human
cuccuggaagcccgcccugcug

SEQ ID NO: 988713 - RNA, 22 nt, Human
uacagccucacauuuacuuaca

SEQ ID NO: 988714 - RNA, 22 nt, Human
gcagcuuggugaaaggugaugg

SEQ ID NO: 988715 - RNA, 22 nt, Human
gcagaagcugggcagcgaggug

SEQ ID NO: 988716 - RNA, 22 nt, Human
uccaggagagguguggggacug

SEQ ID NO: 988717 - RNA, 22 nt, Human
aagacagagacucugcaacagg

SEQ ID NO: 988718 - RNA, 18 nt, Human
ccucaggggaccuggcag

SEQ ID NO: 988719 - RNA, 18 nt, Human
uccuggccacacuaccuu

SEQ ID NO: 988720 - RNA, 22 nt, Human
ugcucugguaacucacuuccau

SEQ ID NO: 988721 - RNA, 21 nt, Human
ugcaggagucugugagucagg

SEQ ID NO: 988722 - RNA, 22 nt, Human
acuuuguauaagacaauaaaga

SEQ ID NO: 988723 - RNA, 22 nt, Human
ggacucagcagccaggaguggc

SEQ ID NO: 988724 - RNA, 22 nt, Human
ugcuccuuccucauccugugca

SEQ ID NO: 988725 - RNA, 22 nt, Human
ccucauggccuugagcugaggg

SEQ ID NO: 988726 - RNA, 23 nt, Human
uucaagauacgguuuccaggcug

SEQ ID NO: 988727 - RNA, 22 nt, Human
ggcagggguccugguguugacu

SEQ ID NO: 988728 - RNA, 20 nt, Human
ugcucugucuaaaacuuccc

SEQ ID NO: 988729 - RNA, 22 nt, Human
aguagaaagaaggcacugggcc

SEQ ID NO: 988730 - RNA, 22 nt, Human
caccaggcugaaccagagggga

SEQ ID NO: 988731 - RNA, 22 nt, Human
gggauggcuuuguggcugacuc

SEQ ID NO: 988732 - RNA, 22 nt, Human
gcuguguccucacacagccuuu

SEQ ID NO: 988733 - RNA, 22 nt, Human
acaguggagaaggcaugaggcu

SEQ ID NO: 988734 - RNA, 22 nt, Human
uuuauuauguacaggcacuaua

SEQ ID NO: 988735 - RNA, 22 nt, Human
cugccagguuggcgcucgcucu

SEQ ID NO: 988736 - RNA, 22 nt, Human
uggagcugagagccaggcuggc

SEQ ID NO: 988737 - RNA, 22 nt, Human
uaggaugaaaauccagcuuaua

SEQ ID NO: 988738 - RNA, 22 nt, Human
aagggccuccuggggagccugg

SEQ ID NO: 988739 - RNA, 22 nt, Human
accugaggccuccccagcagac

SEQ ID NO: 988740 - RNA, 22 nt, Human
gaaagagaaccugggccuagau

SEQ ID NO: 988741 - RNA, 22 nt, Human
augggaggaagagaagaugucu

SEQ ID NO: 988742 - RNA, 22 nt, Human
cacaagacuuauuuguguagaa

SEQ ID NO: 988743 - RNA, 22 nt, Human
ccaguccagugccaugcauggc

SEQ ID NO: 988744 - RNA, 22 nt, Human
uuucaaauggagucgugaaaug

SEQ ID NO: 988745 - RNA, 22 nt, Human
agcaugcacaugacuggcuuaa

SEQ ID NO: 988746 - RNA, 22 nt, Human
ggagagaauuccauggacaugu

SEQ ID NO: 988747 - RNA, 22 nt, Human
uauugaaauucuucauguccuc

SEQ ID NO: 988748 - RNA, 20 nt, Human
gccagcccugacacaggagc

SEQ ID NO: 988749 - RNA, 22 nt, Human
ugcuggcccuggcucagggaac

SEQ ID NO: 988750 - RNA, 22 nt, Human
gagcagcuuaugucaagccaga

SEQ ID NO: 988751 - RNA, 22 nt, Human
ccaggguggcguagaugcuggg

SEQ ID NO: 988752 - RNA, 22 nt, Human
accuggccauccagcuggcauc

SEQ ID NO: 988753 - RNA, 22 nt, Human
acuccugguuuguguccuggcu

SEQ ID NO: 988754 - RNA, 22 nt, Human
uuauucaggcucucuuuggcua

SEQ ID NO: 988755 - RNA, 22 nt, Human
uauuucuguaacucagggucug

SEQ ID NO: 988756 - RNA, 22 nt, Human
ugggccaggauuucaagacccu

SEQ ID NO: 988757 - RNA, 22 nt, Human
ccagguggaggugugagguccu

SEQ ID NO: 988758 - RNA, 22 nt, Human
ucuguaucuaauuuuacaguag

SEQ ID NO: 988759 - RNA, 22 nt, Human
ugucucugguauuaggugaaaa

SEQ ID NO: 988760 - RNA, 22 nt, Human
uggccacaguguccagcagcag

SEQ ID NO: 988761 - RNA, 22 nt, Human
ccugccucaucaacuugucgug

SEQ ID NO: 988762 - RNA, 22 nt, Human
agagccagcaacucuagcccug

SEQ ID NO: 988763 - RNA, 22 nt, Human
agggccuggcuucacuuucuca

SEQ ID NO: 988764 - RNA, 22 nt, Human
aaaugcaucagcucauaagaga

SEQ ID NO: 988765 - RNA, 22 nt, Human
gaaaggagggaaacagagcggu

SEQ ID NO: 988766 - RNA, 22 nt, Human
caguggggaggccaggauagaa

SEQ ID NO: 988767 - RNA, 22 nt, Human
ucccagcagcauagcucagaau

SEQ ID NO: 988768 - RNA, 22 nt, Human
accaaggaagaaucuauuugag

SEQ ID NO: 988769 - RNA, 22 nt, Human
ggcuuccuggggccuccugcaa

SEQ ID NO: 988770 - RNA, 22 nt, Human
aauauguucaaaauagaucacu

SEQ ID NO: 988771 - RNA, 22 nt, Human
ucauuuccucaaauucaagguu

SEQ ID NO: 988772 - RNA, 22 nt, Human
gaacaguaucaguagugccagu

SEQ ID NO: 988773 - RNA, 22 nt, Human
gcaagcuggcuguuagaggaug

SEQ ID NO: 988774 - RNA, 22 nt, Human
agagcagauggagcuggaagag

SEQ ID NO: 988775 - RNA, 22 nt, Human
ccuccagcugccucagucucuu

SEQ ID NO: 988776 - RNA, 18 nt, Human
ucuccuggguaggggccu

SEQ ID NO: 988777 - RNA, 23 nt, Human
uucuuauuuacuuuggaaucucc

SEQ ID NO: 988778 - RNA, 22 nt, Human
ugcugccagagagacagggacu

SEQ ID NO: 988779 - RNA, 22 nt, Human
aagaugauagaucugucaaugu

SEQ ID NO: 988780 - RNA, 22 nt, Human
cauagaaacugagacaaggauu

SEQ ID NO: 988781 - RNA, 22 nt, Human
cacauggggcgcugcauuggcc

SEQ ID NO: 988782 - RNA, 22 nt, Human
aagauguaucaguuaagucuuc

SEQ ID NO: 988783 - RNA, 23 nt, Human
uauuagggccaggacuggcaaau

SEQ ID NO: 988784 - RNA, 22 nt, Human
cagcaauaacucaaagccauuu

SEQ ID NO: 988785 - RNA, 22 nt, Human
ugcagcauugcaaagcagucuu

SEQ ID NO: 988786 - RNA, 22 nt, Human
aagcuggagaguuaggugaaua

SEQ ID NO: 988787 - RNA, 22 nt, Human
uggcagggccuaccccaauauc

SEQ ID NO: 988788 - RNA, 22 nt, Human
ucauugaauuugguucaauaug

SEQ ID NO: 988789 - RNA, 22 nt, Human
gcugccuuuuaaagccucgcuu

SEQ ID NO: 988790 - RNA, 22 nt, Human
uggaggaaguggcuggccagaa

SEQ ID NO: 988791 - RNA, 22 nt, Human
uguguuaauuccacaaacauuc

SEQ ID NO: 988792 - RNA, 22 nt, Human
aaagccuucaaguagauguaag

SEQ ID NO: 988793 - RNA, 18 nt, Human
gaaaugugauucuagggc

SEQ ID NO: 988794 - RNA, 22 nt, Human
ugcaauaaguuguguuaucacu

SEQ ID NO: 988795 - RNA, 22 nt, Human
ugcuggggcucugaccacucca

SEQ ID NO: 988796 - RNA, 22 nt, Human
cugggccagauccagccucaca

SEQ ID NO: 988797 - RNA, 22 nt, Human
ggcccagcugugcuuccagccc

SEQ ID NO: 988798 - RNA, 22 nt, Human
cccaggcugaguuagagguguc

SEQ ID NO: 988799 - RNA, 22 nt, Human
ugagaaccaugaaaagcuguca

SEQ ID NO: 988800 - RNA, 22 nt, Human
auggcaggcccagguguucauu

SEQ ID NO: 988801 - RNA, 22 nt, Human
accaaggaguuugguauuuuag

SEQ ID NO: 988802 - RNA, 22 nt, Human
uguuuguucccucucuuuccug

SEQ ID NO: 988803 - RNA, 22 nt, Human
guggcugggcuccgagcggcuu

SEQ ID NO: 988804 - RNA, 18 nt, Human
uccugccugcgggcuccc

SEQ ID NO: 988805 - RNA, 22 nt, Human
aguggggacuuaugccagcauu

SEQ ID NO: 988806 - RNA, 21 nt, Human
ucagcagcuuuugcagucccu

SEQ ID NO: 988807 - RNA, 18 nt, Human
accugccuguucuucucu

SEQ ID NO: 988808 - RNA, 22 nt, Human
agugccuggaccccaugacaua

SEQ ID NO: 988809 - RNA, 22 nt, Human
aggagcugcauggauaccuggu

SEQ ID NO: 988810 - RNA, 22 nt, Human
ggcuugcuucuuguccaggaau

SEQ ID NO: 988811 - RNA, 22 nt, Human
caaauaguaugagcaaugauuc

SEQ ID NO: 988812 - RNA, 22 nt, Human
uccugccuagcaggugaccuau

SEQ ID NO: 988813 - RNA, 22 nt, Human
gcugaaggaggcucugguacua

SEQ ID NO: 988814 - RNA, 22 nt, Human
cuguauuuucaugccuacguac

SEQ ID NO: 988815 - RNA, 22 nt, Human
accugaggcuguuagucuaggu

SEQ ID NO: 988816 - RNA, 22 nt, Human
acuggcucagaguuccuagaga

SEQ ID NO: 988817 - RNA, 22 nt, Human
aacaaaugaccugauuucuucc

SEQ ID NO: 988818 - RNA, 22 nt, Human
ccagcuggcaggagagucaggg

SEQ ID NO: 988819 - RNA, 22 nt, Human
gcugcugguccucagagcucau

SEQ ID NO: 988820 - RNA, 22 nt, Human
ggggacccucaggacugcgucu

SEQ ID NO: 988821 - RNA, 20 nt, Human
uggagccaaggugugucugg

SEQ ID NO: 988822 - RNA, 22 nt, Human
uugagucaguaauuccauuucu

SEQ ID NO: 988823 - RNA, 22 nt, Human
gccaccagccccaugcgcugug

SEQ ID NO: 988824 - RNA, 22 nt, Human
cuguauuuaguuaaaaugcuaa

SEQ ID NO: 988825 - RNA, 22 nt, Human
gggagagagaaaacguggcgca

SEQ ID NO: 988826 - RNA, 22 nt, Human
uggcccugccacucacugcuga

SEQ ID NO: 988827 - RNA, 22 nt, Human
auucuccaucaccacuggcacu

SEQ ID NO: 988828 - RNA, 22 nt, Human
agagaacaaauuaaaggugguu

SEQ ID NO: 988829 - RNA, 22 nt, Human
accuguuuuccuaucuagauug

SEQ ID NO: 988830 - RNA, 22 nt, Human
uuuccucugaugcugacuugga

SEQ ID NO: 988831 - RNA, 22 nt, Human
gaggggcuggcacgauggcugc

SEQ ID NO: 988832 - RNA, 17 nt, Human
gcagugaaaagagauca

SEQ ID NO: 988833 - RNA, 22 nt, Human
uccuucaaagcuccuagugagc

SEQ ID NO: 988834 - RNA, 22 nt, Human
uugucugaaagaucauuacauu

SEQ ID NO: 988835 - RNA, 22 nt, Human
gcccagagagaugcuguagacc

SEQ ID NO: 988836 - RNA, 22 nt, Human
agggcacaucugcugggaaugg

SEQ ID NO: 988837 - RNA, 22 nt, Human
gaggcaggcagauugcuugagg

SEQ ID NO: 988838 - RNA, 22 nt, Human
agcugccaggccccugagaacc

SEQ ID NO: 988839 - RNA, 17 nt, Human
aggcugcugggccaggg

SEQ ID NO: 988840 - RNA, 22 nt, Human
cucaaauauguggucagaaagc

SEQ ID NO: 988841 - RNA, 22 nt, Human
uucauuccugagcccauauuua

SEQ ID NO: 988842 - RNA, 23 nt, Human
agccuucaggcaaugucaguaga

SEQ ID NO: 988843 - RNA, 22 nt, Human
ccuccuggccugugcagagccc

SEQ ID NO: 988844 - RNA, 22 nt, Human
agggcagcacagcugugcuccu

SEQ ID NO: 988845 - RNA, 22 nt, Human
ccaguuuuuccagugcuuucug

SEQ ID NO: 988846 - RNA, 22 nt, Human
uuacauuuggcuauguccucua

SEQ ID NO: 988847 - RNA, 21 nt, Human
ccaggcagagcugugaguucu

SEQ ID NO: 988848 - RNA, 22 nt, Human
ggaggccaggaaggcucggaga

SEQ ID NO: 988849 - RNA, 22 nt, Human
ccagcugguuaaaauagagaaa

SEQ ID NO: 988850 - RNA, 18 nt, Human
caugucugcgccacaagg

SEQ ID NO: 988851 - RNA, 22 nt, Human
uagauuucgcugcaucucaauc

SEQ ID NO: 988852 - RNA, 22 nt, Human
gccaccagggggcuccagugag

SEQ ID NO: 988853 - RNA, 22 nt, Human
aagaauguuaguuucugauaca

SEQ ID NO: 988854 - RNA, 22 nt, Human
gccugaugagcuuccagcugag

SEQ ID NO: 988855 - RNA, 22 nt, Human
augauguuaccaguacuuagag

SEQ ID NO: 988856 - RNA, 21 nt, Human
agggcagauuagcuguaagag

SEQ ID NO: 988857 - RNA, 22 nt, Human
gcucagaaaagugaggcucagu

SEQ ID NO: 988858 - RNA, 22 nt, Human
accuuucaaaguggcuaucacu

SEQ ID NO: 988859 - RNA, 20 nt, Human
aauuuacucacagaaugaau

SEQ ID NO: 988860 - RNA, 22 nt, Human
aacucugcagugacuuauaaag

SEQ ID NO: 988861 - RNA, 22 nt, Human
cuccauugaacauccucucaga

SEQ ID NO: 988862 - RNA, 22 nt, Human
cagagcugcaaaugccccuccg

SEQ ID NO: 988863 - RNA, 19 nt, Human
cuguggcugaccucuggcc

SEQ ID NO: 988864 - RNA, 22 nt, Human
cuccugggcucauaucauucag

SEQ ID NO: 988865 - RNA, 18 nt, Human
uuaagagcugaaagggga

SEQ ID NO: 988866 - RNA, 22 nt, Human
ggcugccauaacagaguaccac

SEQ ID NO: 988867 - RNA, 22 nt, Human
gagaggggcgcgcagcucgcga

SEQ ID NO: 988868 - RNA, 22 nt, Human
gggcucugggaugcucuuagag

SEQ ID NO: 988869 - RNA, 22 nt, Human
cugccagcaaugugaccaugcu

SEQ ID NO: 988870 - RNA, 19 nt, Human
ucucugcuucucuuggcau

SEQ ID NO: 988871 - RNA, 19 nt, Human
caucuggaugauucuccug

SEQ ID NO: 988872 - RNA, 22 nt, Human
ugucacauguguggcauuuuuc

SEQ ID NO: 988873 - RNA, 19 nt, Human
cacagggcaggucucaugu

SEQ ID NO: 988874 - RNA, 22 nt, Human
uaaccaaagggccuaaggaaug

SEQ ID NO: 988875 - RNA, 22 nt, Human
agucccagccuaggcugugcug

SEQ ID NO: 988876 - RNA, 22 nt, Human
ugcauuucagaagaaaauucgg

SEQ ID NO: 988877 - RNA, 22 nt, Human
caagggugguauugggagcaua

SEQ ID NO: 988878 - RNA, 22 nt, Human
acaaagguggaccauguggcuu

SEQ ID NO: 988879 - RNA, 22 nt, Human
cacuggcccauuccugucuggc

SEQ ID NO: 988880 - RNA, 22 nt, Human
uuaauguggaaagcucuugagu

SEQ ID NO: 988881 - RNA, 22 nt, Human
aggccuggcaugagaccugaga

SEQ ID NO: 988882 - RNA, 22 nt, Human
gagccaggcccguacuugcugu

SEQ ID NO: 988883 - RNA, 22 nt, Human
uccucuggcucuuucccuagga

SEQ ID NO: 988884 - RNA, 22 nt, Human
ggcagucagugugguucauaaa

SEQ ID NO: 988885 - RNA, 22 nt, Human
caggggcugugggcggagccuc

SEQ ID NO: 988886 - RNA, 18 nt, Human
ggcucaggcuauccuaac

SEQ ID NO: 988887 - RNA, 22 nt, Human
ugcauuaucuuuaauguucuca

SEQ ID NO: 988888 - RNA, 22 nt, Human
acagagcaauucuuggguguuu

SEQ ID NO: 988889 - RNA, 22 nt, Human
agauguuccagccaaugggaau

SEQ ID NO: 988890 - RNA, 22 nt, Human
uacauuccauguguguguauuc

SEQ ID NO: 988891 - RNA, 22 nt, Human
ggcagcaguccauggcccaagg

SEQ ID NO: 988892 - RNA, 22 nt, Human
ggccuggcucuugcccagccug

SEQ ID NO: 988893 - RNA, 22 nt, Human
cuggagccauguauagccuaug

SEQ ID NO: 988894 - RNA, 22 nt, Human
caggagcccguugcuccggcgg

SEQ ID NO: 988895 - RNA, 22 nt, Human
ccuggagcuuuuccauccugga

SEQ ID NO: 988896 - RNA, 22 nt, Human
uccagugguuugaaaggggugu

SEQ ID NO: 988897 - RNA, 22 nt, Human
accaucagucauugucaguggg

SEQ ID NO: 988898 - RNA, 22 nt, Human
gcuuagucaauuauaaauaggc

SEQ ID NO: 988899 - RNA, 17 nt, Human
ugaaggaaggaugaugu

SEQ ID NO: 988900 - RNA, 22 nt, Human
ggaaaaggccacagggacacau

SEQ ID NO: 988901 - RNA, 22 nt, Human
uguuaaucaaucaacaguauua

SEQ ID NO: 988902 - RNA, 17 nt, Human
cucugcagugcauggcu

SEQ ID NO: 988903 - RNA, 22 nt, Human
uguagaaagaauauguuucaua

SEQ ID NO: 988904 - RNA, 22 nt, Human
agugcuguccaguuucacaggu

SEQ ID NO: 988905 - RNA, 22 nt, Human
uaauccacaauagagauuaucu

SEQ ID NO: 988906 - RNA, 22 nt, Human
cucugcagaauuugagcugcuc

SEQ ID NO: 988907 - RNA, 22 nt, Human
cuggcagcuuccuuugcaucug

SEQ ID NO: 988908 - RNA, 22 nt, Human
guucucucugcuuccaagaugg

SEQ ID NO: 988909 - RNA, 22 nt, Human
agccaagcugaucuccugcuga

SEQ ID NO: 988910 - RNA, 22 nt, Human
ccacaggggucucuguagcuga

SEQ ID NO: 988911 - RNA, 22 nt, Human
ugaugcuucacgcugaauaugc

SEQ ID NO: 988912 - RNA, 22 nt, Human
aaauaguucagcuuguaaaccc

SEQ ID NO: 988913 - RNA, 20 nt, Human
ccugccugccucggcucauu

SEQ ID NO: 988914 - RNA, 22 nt, Human
ucccagagauuuccucuccuuc

SEQ ID NO: 988915 - RNA, 22 nt, Human
gauuucuuuagguguaauagug

SEQ ID NO: 988916 - RNA, 22 nt, Human
aagucauugguagcuugauagg

SEQ ID NO: 988917 - RNA, 22 nt, Human
caguuuuugccauuaagaguaa

SEQ ID NO: 988918 - RNA, 22 nt, Human
gcuaccugagcaagagcuucaa

SEQ ID NO: 988919 - RNA, 22 nt, Human
gcagccacugggagugcuuaua

SEQ ID NO: 988920 - RNA, 22 nt, Human
aauacaaucaaauucacuagca

SEQ ID NO: 988921 - RNA, 18 nt, Human
ugucauugccagggaagc

SEQ ID NO: 988922 - RNA, 22 nt, Human
uccagagccuauauguucaacu

SEQ ID NO: 988923 - RNA, 22 nt, Human
uccagggaaggugugaggcugg

SEQ ID NO: 988924 - RNA, 22 nt, Human
uuuucauuuacauuagggaaga

SEQ ID NO: 988925 - RNA, 22 nt, Human
uauuauuauaguuauugggaag

SEQ ID NO: 988926 - RNA, 22 nt, Human
cagggcaggaauuugacauugc

SEQ ID NO: 988927 - RNA, 22 nt, Human
acagagcauuugggacagagag

SEQ ID NO: 988928 - RNA, 21 nt, Human
uagaaaucagcuggugccucu

SEQ ID NO: 988929 - RNA, 22 nt, Human
ugucccuggaacuauggcucca

SEQ ID NO: 988930 - RNA, 21 nt, Human
gccagccuguuuaccuguggu

SEQ ID NO: 988931 - RNA, 22 nt, Human
caucacagauguuguguggagu

SEQ ID NO: 988932 - RNA, 22 nt, Human
cagcugagcucccaggccauca

SEQ ID NO: 988933 - RNA, 19 nt, Human
cauuccuuugucugccaaa

SEQ ID NO: 988934 - RNA, 22 nt, Human
ggcuggcuugccaagcucaggg

SEQ ID NO: 988935 - RNA, 22 nt, Human
acagggcagagugaaaugcuau

SEQ ID NO: 988936 - RNA, 22 nt, Human
gccuucaguagugucagcugua

SEQ ID NO: 988937 - RNA, 22 nt, Human
ugagccagccuugcagcugugc

SEQ ID NO: 988938 - RNA, 22 nt, Human
ccaggagcaacuugaaggcaag

SEQ ID NO: 988939 - RNA, 22 nt, Human
ucuuugcacacaucccuucccg

SEQ ID NO: 988940 - RNA, 22 nt, Human
cauggggagacaccuagggaaa

SEQ ID NO: 988941 - RNA, 22 nt, Human
cuuauuagaaagaaaagacaug

SEQ ID NO: 988942 - RNA, 22 nt, Human
accaaggagaaggugcaagcuu

SEQ ID NO: 988943 - RNA, 22 nt, Human
auacaguauuaccuguucagga

SEQ ID NO: 988944 - RNA, 22 nt, Human
aaagcacauuacaagcucaguc

SEQ ID NO: 988945 - RNA, 22 nt, Human
uggcuaggcuccaagagcugga

SEQ ID NO: 988946 - RNA, 22 nt, Human
ggucagccuuggauuugguagc

SEQ ID NO: 988947 - RNA, 21 nt, Human
gcagccacagccaccaagcua

SEQ ID NO: 988948 - RNA, 22 nt, Human
gagcugagccuggguggaccgc

SEQ ID NO: 988949 - RNA, 22 nt, Human
ugacagaaagaauaugucaauc

SEQ ID NO: 988950 - RNA, 22 nt, Human
ccugucugcggaggaguggaag

SEQ ID NO: 988951 - RNA, 16 nt, Human
uguuagcugugcauua

SEQ ID NO: 988952 - RNA, 22 nt, Human
cagaggccuauccaguguccau

SEQ ID NO: 988953 - RNA, 17 nt, Human
ugcugccaagucccaac

SEQ ID NO: 988954 - RNA, 22 nt, Human
ccuccuggggugaaggauggga

SEQ ID NO: 988955 - RNA, 22 nt, Human
ccacaaguuucagcacccagag

SEQ ID NO: 988956 - RNA, 22 nt, Human
cugcaggauucucccaguugga

SEQ ID NO: 988957 - RNA, 22 nt, Human
uccuuccucggggacccagauc

SEQ ID NO: 988958 - RNA, 22 nt, Human
aucaguuucugugaagaacaca

SEQ ID NO: 988959 - RNA, 20 nt, Human
uucaggauucuagaccacac

SEQ ID NO: 988960 - RNA, 22 nt, Human
cuggcccauggugagcucuggg

SEQ ID NO: 988961 - RNA, 18 nt, Human
uuucacaaccuccagagg

SEQ ID NO: 988962 - RNA, 22 nt, Human
uggagccaggagccugggaguc

SEQ ID NO: 988963 - RNA, 22 nt, Human
gccaaagcagucuugccucugc

SEQ ID NO: 988964 - RNA, 22 nt, Human
acagguggcauaggcaguuuga

SEQ ID NO: 988965 - RNA, 22 nt, Human
augauucagcaauuuuauaucu

SEQ ID NO: 988966 - RNA, 22 nt, Human
agaguguuuuucugucaaggac

SEQ ID NO: 988967 - RNA, 22 nt, Human
aagccucuggggccucaucugu

SEQ ID NO: 988968 - RNA, 19 nt, Human
gccagcagaaugaugaggc

SEQ ID NO: 988969 - RNA, 22 nt, Human
ugcaggagaaaguacggagcgu

SEQ ID NO: 988970 - RNA, 22 nt, Human
gucccuggggaaucagcuggag

SEQ ID NO: 988971 - RNA, 22 nt, Human
caggccucccggugcacacuga

SEQ ID NO: 988972 - RNA, 22 nt, Human
ugggggagccuucacaguagcu

SEQ ID NO: 988973 - RNA, 18 nt, Human
cuuucagauggauaugcu

SEQ ID NO: 988974 - RNA, 21 nt, Human
ggugucaguuuuggucauuag

SEQ ID NO: 988975 - RNA, 22 nt, Human
uucaagguaugguagcugguca

SEQ ID NO: 988976 - RNA, 22 nt, Human
cagacaggcaggugcugcuuug

SEQ ID NO: 988977 - RNA, 21 nt, Human
uuguucuuccagaagcaaagu

SEQ ID NO: 988978 - RNA, 22 nt, Human
cuguuuuugugcugugucuccc

SEQ ID NO: 988979 - RNA, 22 nt, Human
ggugaaggaggaagcugaugga

SEQ ID NO: 988980 - RNA, 22 nt, Human
gcugcagcucgccuuccggccu

SEQ ID NO: 988981 - RNA, 22 nt, Human
agauuucaaugugagcauuagu

SEQ ID NO: 988982 - RNA, 22 nt, Human
cuggggcuggugaggcaggcuc

SEQ ID NO: 988983 - RNA, 22 nt, Human
auacauguaacugcauuguaau

SEQ ID NO: 988984 - RNA, 22 nt, Human
ggcagcuguaagaugagugaau

SEQ ID NO: 988985 - RNA, 22 nt, Human
gcaggaugggagcuucacuuug

SEQ ID NO: 988986 - RNA, 23 nt, Human
uuggcagcgggucaggcuguggg

SEQ ID NO: 988987 - RNA, 22 nt, Human
agagcugcaauuucauguggug

SEQ ID NO: 988988 - RNA, 22 nt, Human
guccucaggaaagcagauaaca

SEQ ID NO: 988989 - RNA, 20 nt, Human
ugcuuccuggccacugcggg

SEQ ID NO: 988990 - RNA, 22 nt, Human
ggcacugaauuucuuggcaucu

SEQ ID NO: 988991 - RNA, 22 nt, Human
gggcuggaggugagcaggacag

SEQ ID NO: 988992 - RNA, 22 nt, Human
uugcauaaaugcuuaaaauuug

SEQ ID NO: 988993 - RNA, 22 nt, Human
guucccauacaguaucagugcu

SEQ ID NO: 988994 - RNA, 22 nt, Human
cacagcuugggcucugacaaua

SEQ ID NO: 988995 - RNA, 22 nt, Human
ggcccaucucuugcucuggguu

SEQ ID NO: 988996 - RNA, 22 nt, Human
uucugagcugcaacacuaacau

SEQ ID NO: 988997 - RNA, 22 nt, Human
uuccaaagucauguugcugaua

SEQ ID NO: 988998 - RNA, 22 nt, Human
ucuccucugcgcggcagugccc

SEQ ID NO: 988999 - RNA, 22 nt, Human
acacaguaugaaaagucuaguu

SEQ ID NO: 989000 - RNA, 22 nt, Human
cucuggccuggggccugcuccc

SEQ ID NO: 989001 - RNA, 22 nt, Human
aggaccagaggccagagucagc

SEQ ID NO: 989002 - RNA, 22 nt, Human
uguuuaguaggaguuuaauacu

SEQ ID NO: 989003 - RNA, 21 nt, Human
ucccugcuuucuggcccaguc

SEQ ID NO: 989004 - RNA, 22 nt, Human
ccagcagaggggcggagugcag

SEQ ID NO: 989005 - RNA, 22 nt, Human
ggccugagucacaucaggagag

SEQ ID NO: 989006 - RNA, 22 nt, Human
agguaagggucacaguucauau

SEQ ID NO: 989007 - RNA, 22 nt, Human
ugaagcagcaaaugaugggaga

SEQ ID NO: 989008 - RNA, 22 nt, Human
caaggaaacaugaaaugcauug

SEQ ID NO: 989009 - RNA, 22 nt, Human
ggccaggagcaagccaggcucu

SEQ ID NO: 989010 - RNA, 22 nt, Human
acaggcucuggggcaggauggc

SEQ ID NO: 989011 - RNA, 22 nt, Human
aaauauguauggaguucaugaa

SEQ ID NO: 989012 - RNA, 22 nt, Human
cuggccaacaucuggggcacau

SEQ ID NO: 989013 - RNA, 22 nt, Human
ccugccuggcuuccagaagaga

SEQ ID NO: 989014 - RNA, 22 nt, Human
ccacagaaaguugucuagagua

SEQ ID NO: 989015 - RNA, 22 nt, Human
cacagggcuucucauggggugc

SEQ ID NO: 989016 - RNA, 22 nt, Human
auugaaagagaauguagcucuu

SEQ ID NO: 989017 - RNA, 22 nt, Human
cugcuuuguggaaucacacugg

SEQ ID NO: 989018 - RNA, 22 nt, Human
ccagcagcuguggcuuugccuc

SEQ ID NO: 989019 - RNA, 22 nt, Human
augcccaaugucacaauuuuug

SEQ ID NO: 989020 - RNA, 22 nt, Human
gaaaagagaacaucugaggauc

SEQ ID NO: 989021 - RNA, 22 nt, Human
gcuccugggcccugggcuaacu

SEQ ID NO: 989022 - RNA, 22 nt, Human
ggcucugguugaccaugauggc

SEQ ID NO: 989023 - RNA, 20 nt, Human
cuuugccuauucucugccug

SEQ ID NO: 989024 - RNA, 22 nt, Human
agggccucugacgcccccagcc

SEQ ID NO: 989025 - RNA, 22 nt, Human
cucaaggacuuauucaugccug

SEQ ID NO: 989026 - RNA, 22 nt, Human
cugggagucuggccucuggucc

SEQ ID NO: 989027 - RNA, 22 nt, Human
ugucugagugugccugggcauu

SEQ ID NO: 989028 - RNA, 22 nt, Human
ggcuuccuuucacuacccucag

SEQ ID NO: 989029 - RNA, 22 nt, Human
uaaagucaucuuuacaucuuug

SEQ ID NO: 989030 - RNA, 19 nt, Human
cucugccucccuccugggu

SEQ ID NO: 989031 - RNA, 19 nt, Human
ucaaaacacaaaugguuga

SEQ ID NO: 989032 - RNA, 22 nt, Human
cucaggaggaggaaguucauug

SEQ ID NO: 989033 - RNA, 22 nt, Human
uccuuccugcaggccaaguccu

SEQ ID NO: 989034 - RNA, 22 nt, Human
gcuggcagaagagcugguucaa

SEQ ID NO: 989035 - RNA, 22 nt, Human
aagagcuggcccaaucugagca

SEQ ID NO: 989036 - RNA, 22 nt, Human
uauucacaguugauuuacaguu

SEQ ID NO: 989037 - RNA, 22 nt, Human
caggaagagaacauggaggcug

SEQ ID NO: 989038 - RNA, 22 nt, Human
gggggcuguccugugcauugua

SEQ ID NO: 989039 - RNA, 22 nt, Human
cagagccugcucacgucucugu

SEQ ID NO: 989040 - RNA, 22 nt, Human
auuauuagauucuuaauuguaa

SEQ ID NO: 989041 - RNA, 22 nt, Human
auugaaagauaggcuacugugg

SEQ ID NO: 989042 - RNA, 22 nt, Human
uuauguagugacugacuguuag

SEQ ID NO: 989043 - RNA, 22 nt, Human
uaaggcaccauaauauauuuaa

SEQ ID NO: 989044 - RNA, 22 nt, Human
ccagagcccgggaccuggacuu

SEQ ID NO: 989045 - RNA, 22 nt, Human
caccagcagaagacugagggug

SEQ ID NO: 989046 - RNA, 22 nt, Human
uggaggccagagguacugggac

SEQ ID NO: 989047 - RNA, 22 nt, Human
cccugccuacaggguuuucuuu

SEQ ID NO: 989048 - RNA, 22 nt, Human
uucaggaugaaagugugcaaca

SEQ ID NO: 989049 - RNA, 22 nt, Human
uuguccuuaccucaaucuggaa

SEQ ID NO: 989050 - RNA, 22 nt, Human
agugcugaagacuggcuaggga

SEQ ID NO: 989051 - RNA, 21 nt, Human
acucugcugcgggcuuggccu

SEQ ID NO: 989052 - RNA, 22 nt, Human
cacaggcucuucucacuugauu

SEQ ID NO: 989053 - RNA, 22 nt, Human
auugaaagguuuugagcagaua

SEQ ID NO: 989054 - RNA, 22 nt, Human
auauugaacccuacagacugua

SEQ ID NO: 989055 - RNA, 22 nt, Human
uuuucucuacaaaauaaccagc

SEQ ID NO: 989056 - RNA, 22 nt, Human
auccuuggaugugucuuuuugu

SEQ ID NO: 989057 - RNA, 22 nt, Human
aggagagaauguuccaggcuug

SEQ ID NO: 989058 - RNA, 22 nt, Human
caggugggagcgaggagcuacu

SEQ ID NO: 989059 - RNA, 22 nt, Human
cugcccugggauggucugugcg

SEQ ID NO: 989060 - RNA, 22 nt, Human
cuggagcuaauaauccaucuga

SEQ ID NO: 989061 - RNA, 22 nt, Human
guauuaggagguggagccuuug

SEQ ID NO: 989062 - RNA, 22 nt, Human
guggguggaucaccugagguca

SEQ ID NO: 989063 - RNA, 21 nt, Human
ggacuuacauagguaaggggu

SEQ ID NO: 989064 - RNA, 22 nt, Human
gcugcaggggggucuggacuug

SEQ ID NO: 989065 - RNA, 22 nt, Human
ugaaaaacuuuaauccauaaag

SEQ ID NO: 989066 - RNA, 22 nt, Human
uggcaaacuggaggaagcccug

SEQ ID NO: 989067 - RNA, 22 nt, Human
auguacaaaaugccacugaauu

SEQ ID NO: 989068 - RNA, 22 nt, Human
uggcaccugaacuuagaggugu

SEQ ID NO: 989069 - RNA, 22 nt, Human
gccaggcuccccggaucccugg

SEQ ID NO: 989070 - RNA, 22 nt, Human
ggcucugcaugugagugggugg

SEQ ID NO: 989071 - RNA, 22 nt, Human
uuaaaagaauccuguuauccuc

SEQ ID NO: 989072 - RNA, 22 nt, Human
gcuggcccagggucaccuagga

SEQ ID NO: 989073 - RNA, 22 nt, Human
uaauuuaauccaaguguuacau

SEQ ID NO: 989074 - RNA, 22 nt, Human
gccccagguugccugucccagg

SEQ ID NO: 989075 - RNA, 22 nt, Human
caaaaugugagucccaccucaa

SEQ ID NO: 989076 - RNA, 22 nt, Human
uggugcugauaauggcaggauu

SEQ ID NO: 989077 - RNA, 22 nt, Human
auacaucucauguaagagauaa

SEQ ID NO: 989078 - RNA, 22 nt, Human
ucacaggguaucugggauggau

SEQ ID NO: 989079 - RNA, 16 nt, Human
cagaguguaaacagga

SEQ ID NO: 989080 - RNA, 22 nt, Human
gagcugcccugagcuuugcaug

SEQ ID NO: 989081 - RNA, 22 nt, Human
ugagugaggaagcgguggagga

SEQ ID NO: 989082 - RNA, 22 nt, Human
agaaauaugcugauuagaugaa

SEQ ID NO: 989083 - RNA, 22 nt, Human
cuggcagcuuagcacucugguu

SEQ ID NO: 989084 - RNA, 22 nt, Human
gagcagcuggacaggccucccu

SEQ ID NO: 989085 - RNA, 19 nt, Human
ugcuuccucaccaucuccc

SEQ ID NO: 989086 - RNA, 22 nt, Human
ugaagcaggaaccagcagcauu

SEQ ID NO: 989087 - RNA, 22 nt, Human
uucagagccacuucaagucuaa

SEQ ID NO: 989088 - RNA, 22 nt, Human
cuggcugcaggaugaggcugcc

SEQ ID NO: 989089 - RNA, 22 nt, Human
aggcugaggcagguggaucauu

SEQ ID NO: 989090 - RNA, 22 nt, Human
agggcccaggacagcaucaggg

SEQ ID NO: 989091 - RNA, 22 nt, Human
ggcugccuggaccuccucuuuc

SEQ ID NO: 989092 - RNA, 22 nt, Human
uacauggugguggcacuugacu

SEQ ID NO: 989093 - RNA, 22 nt, Human
ugacucuguaccugucugccuu

SEQ ID NO: 989094 - RNA, 22 nt, Human
uaguacuuaucucugucauugu

SEQ ID NO: 989095 - RNA, 22 nt, Human
cagucccagacauaguaaggga

SEQ ID NO: 989096 - RNA, 22 nt, Human
caggcagagugagguggucuaa

SEQ ID NO: 989097 - RNA, 22 nt, Human
uucagcagugcagacacccagu

SEQ ID NO: 989098 - RNA, 22 nt, Human
uuggccaaccagaacggagguc

SEQ ID NO: 989099 - RNA, 22 nt, Human
aauugugcuaugauuaugaaag

SEQ ID NO: 989100 - RNA, 22 nt, Human
auaaugugauauuucauuuaca

SEQ ID NO: 989101 - RNA, 22 nt, Human
aggcuucuaggguuggcagcgg

SEQ ID NO: 989102 - RNA, 22 nt, Human
cugcccugucugcagccuggcu

SEQ ID NO: 989103 - RNA, 22 nt, Human
guccucagggaauguggcgggu

SEQ ID NO: 989104 - RNA, 22 nt, Human
uucugagccucauucaugaggc

SEQ ID NO: 989105 - RNA, 22 nt, Human
ccaggccuggaccaugccaggg

SEQ ID NO: 989106 - RNA, 22 nt, Human
uaguuaggguucugcagagaca

SEQ ID NO: 989107 - RNA, 22 nt, Human
cacucccuucaggagccuagga

SEQ ID NO: 989108 - RNA, 22 nt, Human
ucuuuccuacuuuauugugaac

SEQ ID NO: 989109 - RNA, 19 nt, Human
ggaccagguccugggcagc

SEQ ID NO: 989110 - RNA, 22 nt, Human
aggcugccucgugagcucgcug

SEQ ID NO: 989111 - RNA, 22 nt, Human
ggagcagagcauuucacagccu

SEQ ID NO: 989112 - RNA, 22 nt, Human
aaggcacuuuuccugagaugau

SEQ ID NO: 989113 - RNA, 22 nt, Human
caggcuggaguuaccuuuaggg

SEQ ID NO: 989114 - RNA, 22 nt, Human
gguggcagaggugcaucagccc

SEQ ID NO: 989115 - RNA, 22 nt, Human
cucuggagggaggcugagcugg

SEQ ID NO: 989116 - RNA, 22 nt, Human
ccaggguggggcaggcccacug

SEQ ID NO: 989117 - RNA, 22 nt, Human
acguuuucuagagaauaugcag

SEQ ID NO: 989118 - RNA, 22 nt, Human
uaacagaaaggcucaggugcuc

SEQ ID NO: 989119 - RNA, 22 nt, Human
uugccuugauucuucucaugug

SEQ ID NO: 989120 - RNA, 22 nt, Human
aggcuggcgacaucuggcgggc

SEQ ID NO: 989121 - RNA, 22 nt, Human
ccuucagaccuagacaggaauc

SEQ ID NO: 989122 - RNA, 22 nt, Human
uacaaaaguaauuacgguuuuu

SEQ ID NO: 989123 - RNA, 22 nt, Human
cuggcagcagcuucuggaucga

SEQ ID NO: 989124 - RNA, 19 nt, Human
gcacacccugcaccaccau

SEQ ID NO: 989125 - RNA, 22 nt, Human
cuucagaacuauaaaaaguacu

SEQ ID NO: 989126 - RNA, 22 nt, Human
ucacucugccuccauauuacua

SEQ ID NO: 989127 - RNA, 22 nt, Human
gcagcugggccccagccucucc

SEQ ID NO: 989128 - RNA, 22 nt, Human
aagagcuggauugugcugcaga

SEQ ID NO: 989129 - RNA, 22 nt, Human
cucuccagaauaugccgccgug

SEQ ID NO: 989130 - RNA, 21 nt, Human
agcagcagaucuggugagggc

SEQ ID NO: 989131 - RNA, 22 nt, Human
uggaggcauuuuagguugucac

SEQ ID NO: 989132 - RNA, 22 nt, Human
gcucuggagauggagccuugag

SEQ ID NO: 989133 - RNA, 22 nt, Human
uggcagcaguggagguagaaag

SEQ ID NO: 989134 - RNA, 22 nt, Human
uggagcaggugccaggugugug

SEQ ID NO: 989135 - RNA, 22 nt, Human
uuuauucuugagagugagaaga

SEQ ID NO: 989136 - RNA, 23 nt, Human
ugggggugcacgggccacaucuu

SEQ ID NO: 989137 - RNA, 22 nt, Human
agggcagaaguacagacacuua

SEQ ID NO: 989138 - RNA, 22 nt, Human
agcagcucuguuuaccuggagg

SEQ ID NO: 989139 - RNA, 22 nt, Human
ucucagagcuucagaaagcacc

SEQ ID NO: 989140 - RNA, 22 nt, Human
acagagauggcacagagaaggu

SEQ ID NO: 989141 - RNA, 22 nt, Human
acaugcaugucuaugggcaggu

SEQ ID NO: 989142 - RNA, 22 nt, Human
auuuuucucuccacuccauuaa

SEQ ID NO: 989143 - RNA, 22 nt, Human
cucuguccuugcacaguuccua

SEQ ID NO: 989144 - RNA, 22 nt, Human
gcuccacuugcagcuaggcuug

SEQ ID NO: 989145 - RNA, 22 nt, Human
cugguccauucucucccugaag

SEQ ID NO: 989146 - RNA, 22 nt, Human
agcaauauaaauguuggguaga

SEQ ID NO: 989147 - RNA, 22 nt, Human
agggaaauuaaugugagcaaug

SEQ ID NO: 989148 - RNA, 22 nt, Human
ucugccacuuuugcuuacuggg

SEQ ID NO: 989149 - RNA, 22 nt, Human
ggggagaguccuuuccaguucc

SEQ ID NO: 989150 - RNA, 22 nt, Human
gugauuucagguuuuucauacu

SEQ ID NO: 989151 - RNA, 22 nt, Human
cuggcuggccggaggcaucccu

SEQ ID NO: 989152 - RNA, 22 nt, Human
caggaugggauguagugggccc

SEQ ID NO: 989153 - RNA, 22 nt, Human
uauuuguauuucaugcaguaaa

SEQ ID NO: 989154 - RNA, 22 nt, Human
ccuguccuccaagagcacaucu

SEQ ID NO: 989155 - RNA, 22 nt, Human
aguuuuucugggaggcacugcu

SEQ ID NO: 989156 - RNA, 22 nt, Human
aggcuucccaagcagcugcaaa

SEQ ID NO: 989157 - RNA, 22 nt, Human
caggagacaauggcuguggggc

SEQ ID NO: 989158 - RNA, 22 nt, Human
uggcccugaggacccagugugg

SEQ ID NO: 989159 - RNA, 22 nt, Human
aagucauucuauuucucuaugu

SEQ ID NO: 989160 - RNA, 22 nt, Human
uggagggcaugcuguccauggg

SEQ ID NO: 989161 - RNA, 22 nt, Human
ggcagcagggcugucucccuac

SEQ ID NO: 989162 - RNA, 22 nt, Human
ugucauuuucuaaucuguuguc

SEQ ID NO: 989163 - RNA, 22 nt, Human
cuuuggcaugguccucacuaua

SEQ ID NO: 989164 - RNA, 22 nt, Human
gggggcucugacucccucagcu

SEQ ID NO: 989165 - RNA, 22 nt, Human
uaugcacauugguuuccucauu

SEQ ID NO: 989166 - RNA, 22 nt, Human
agauaaauuccuaagauuucag

SEQ ID NO: 989167 - RNA, 22 nt, Human
accucuggccuucaggcaucau

SEQ ID NO: 989168 - RNA, 19 nt, Human
gagguggguccccgcagcc

SEQ ID NO: 989169 - RNA, 22 nt, Human
ucuggagccacaaaccucagcu

SEQ ID NO: 989170 - RNA, 18 nt, Human
gcccugguggagcuggug

SEQ ID NO: 989171 - RNA, 22 nt, Human
agagaauuacagaagaauguca

SEQ ID NO: 989172 - RNA, 22 nt, Human
guguuuccucacuucucugacu

SEQ ID NO: 989173 - RNA, 22 nt, Human
auggccugggcccgcuucagau

SEQ ID NO: 989174 - RNA, 22 nt, Human
aaugggaggauuuucucucuug

SEQ ID NO: 989175 - RNA, 22 nt, Human
aggccaaauugaucaucuuuag

SEQ ID NO: 989176 - RNA, 22 nt, Human
aagauuucugcuccugagagaa

SEQ ID NO: 989177 - RNA, 19 nt, Human
cuugguuaugguaugaugc

SEQ ID NO: 989178 - RNA, 22 nt, Human
uggagccaaggccaguucucag

SEQ ID NO: 989179 - RNA, 22 nt, Human
ucugagggcuugaggggaagua

SEQ ID NO: 989180 - RNA, 22 nt, Human
cacagugcaugaugggcagaag

SEQ ID NO: 989181 - RNA, 22 nt, Human
uuucauaugggcauuggcaaua

SEQ ID NO: 989182 - RNA, 22 nt, Human
uaaccuuuggugaaauauuaac

SEQ ID NO: 989183 - RNA, 22 nt, Human
uggccugccuucgcugagcuga

SEQ ID NO: 989184 - RNA, 22 nt, Human
uuuauguaaguggaaugaugcc

SEQ ID NO: 989185 - RNA, 22 nt, Human
ucagacaguuugcagugugccu

SEQ ID NO: 989186 - RNA, 22 nt, Human
ucccuuaaaacucauguguugu

SEQ ID NO: 989187 - RNA, 22 nt, Human
uuuccaauaaagugucauuguu

SEQ ID NO: 989188 - RNA, 22 nt, Human
gcugccuguggcccuucugggu

SEQ ID NO: 989189 - RNA, 18 nt, Human
cagaaguccuucaaggcc

SEQ ID NO: 989190 - RNA, 22 nt, Human
agaggccuaauugcuacccuuu

SEQ ID NO: 989191 - RNA, 22 nt, Human
ggcaagcauaaccuguacagcc

SEQ ID NO: 989192 - RNA, 22 nt, Human
caccuugugauccucuugccuu

SEQ ID NO: 989193 - RNA, 22 nt, Human
gcugccugaucauacaccaggg

SEQ ID NO: 989194 - RNA, 21 nt, Human
gcacagugccaggcacacagu

SEQ ID NO: 989195 - RNA, 20 nt, Human
ucacaggggaccaggagcag

SEQ ID NO: 989196 - RNA, 22 nt, Human
ggcuccuguccccucagcugcu

SEQ ID NO: 989197 - RNA, 22 nt, Human
ugcccacauggugccauggcca

SEQ ID NO: 989198 - RNA, 22 nt, Human
cugaggccucuguucaccagaa

SEQ ID NO: 989199 - RNA, 22 nt, Human
caggcacuucugcugcuugucu

SEQ ID NO: 989200 - RNA, 22 nt, Human
ugcauauuuguaugauguuuag

SEQ ID NO: 989201 - RNA, 22 nt, Human
ucaagagaaggggaaauagacu

SEQ ID NO: 989202 - RNA, 21 nt, Human
uagggcaggcauuggaagaga

SEQ ID NO: 989203 - RNA, 19 nt, Human
caaggguugggucugucau

SEQ ID NO: 989204 - RNA, 22 nt, Human
aagggcagaaagggacgcuuug

SEQ ID NO: 989205 - RNA, 22 nt, Human
acuuccuguguuggucuugcug

SEQ ID NO: 989206 - RNA, 22 nt, Human
gauauagguucauaguguuaca

SEQ ID NO: 989207 - RNA, 22 nt, Human
uaacagaaaagaacugaguuug

SEQ ID NO: 989208 - RNA, 22 nt, Human
uuugcuauaaaagggucacacg

SEQ ID NO: 989209 - RNA, 18 nt, Human
gucaccuggaucagauua

SEQ ID NO: 989210 - RNA, 22 nt, Human
uuugcauuccugccugcauuca

SEQ ID NO: 989211 - RNA, 22 nt, Human
ccuuuuaugaacuugagcaggu

SEQ ID NO: 989212 - RNA, 22 nt, Human
ucuauuuacagaaagcagaauu

SEQ ID NO: 989213 - RNA, 22 nt, Human
cuguaaaacugcuuaaguaugc

SEQ ID NO: 989214 - RNA, 20 nt, Human
aguguuccggaagacuggca

SEQ ID NO: 989215 - RNA, 22 nt, Human
uagaaaugugauaauagcuuaa

SEQ ID NO: 989216 - RNA, 22 nt, Human
aaaaauguuaucuacuguccga

SEQ ID NO: 989217 - RNA, 22 nt, Human
aggugcuggagucugggcagga

SEQ ID NO: 989218 - RNA, 22 nt, Human
ggcucaggacacagugguuuag

SEQ ID NO: 989219 - RNA, 22 nt, Human
uuaucauugucgcagucuaauu

SEQ ID NO: 989220 - RNA, 22 nt, Human
agggcagcuaaggugcugacug

SEQ ID NO: 989221 - RNA, 21 nt, Human
ggcagcugaccgcgcggugca

SEQ ID NO: 989222 - RNA, 22 nt, Human
uuauuugguugcugacuuggaa

SEQ ID NO: 989223 - RNA, 22 nt, Human
gcugucacucaccaggccugca

SEQ ID NO: 989224 - RNA, 22 nt, Human
aucuagaaguggcaugaauuac

SEQ ID NO: 989225 - RNA, 18 nt, Human
ggcugugcguggaggcug

SEQ ID NO: 989226 - RNA, 22 nt, Human
guaggcagauaggagugcagcc

SEQ ID NO: 989227 - RNA, 19 nt, Human
ucuggcuccugccaggcug

SEQ ID NO: 989228 - RNA, 17 nt, Human
uguggccuucugagcuu

SEQ ID NO: 989229 - RNA, 22 nt, Human
ugagcuguagcagaugcuguug

SEQ ID NO: 989230 - RNA, 22 nt, Human
cccuggagggcagacagaugcc

SEQ ID NO: 989231 - RNA, 22 nt, Human
ugguggcuucugaggauggcga

SEQ ID NO: 989232 - RNA, 21 nt, Human
uccugccuuaguccagagcag

SEQ ID NO: 989233 - RNA, 19 nt, Human
uccucaggggcucacagac

SEQ ID NO: 989234 - RNA, 22 nt, Human
gcuccuggauguucaagucggc

SEQ ID NO: 989235 - RNA, 22 nt, Human
gcacucugugaucugcagagcc

SEQ ID NO: 989236 - RNA, 22 nt, Human
ccaggccuuccaguacgcagaa

SEQ ID NO: 989237 - RNA, 22 nt, Human
gugccagcaguuauggugauuu

SEQ ID NO: 989238 - RNA, 22 nt, Human
guuccacaaaauguacccaguu

SEQ ID NO: 989239 - RNA, 22 nt, Human
cucaggauagauuguccucuca

SEQ ID NO: 989240 - RNA, 22 nt, Human
uggggugggcaugcgcuguccu

SEQ ID NO: 989241 - RNA, 22 nt, Human
ugucugucugcaagccagaaag

SEQ ID NO: 989242 - RNA, 22 nt, Human
agagugaaguucaucgugcagc

SEQ ID NO: 989243 - RNA, 22 nt, Human
cagagguaccagcagccucugg

SEQ ID NO: 989244 - RNA, 22 nt, Human
ggcuccugauaggagaaugcgg

SEQ ID NO: 989245 - RNA, 22 nt, Human
aaagcuauuuuauugcagcucu

SEQ ID NO: 989246 - RNA, 22 nt, Human
acaaaaauuagcugggcauggu

SEQ ID NO: 989247 - RNA, 22 nt, Human
cugggagucaccaggagcaagg

SEQ ID NO: 989248 - RNA, 22 nt, Human
ccuggcacgaagggcugagguu

SEQ ID NO: 989249 - RNA, 22 nt, Human
uuuccuuccagguuccuaaggc

SEQ ID NO: 989250 - RNA, 22 nt, Human
aaauaauugaguuggucaauau

SEQ ID NO: 989251 - RNA, 22 nt, Human
aguguacauguuuacagcaucu

SEQ ID NO: 989252 - RNA, 22 nt, Human
gucugagaaucuugcauaucau

SEQ ID NO: 989253 - RNA, 22 nt, Human
uaaaugugagugaugcggugaa

SEQ ID NO: 989254 - RNA, 22 nt, Human
ggguggcuccuaugggcauagc

SEQ ID NO: 989255 - RNA, 22 nt, Human
guuuucuuugaaugcuucuaga

SEQ ID NO: 989256 - RNA, 22 nt, Human
ugaagcaggaaacuucuuguuu

SEQ ID NO: 989257 - RNA, 22 nt, Human
agggagagguugaaaccucagu

SEQ ID NO: 989258 - RNA, 22 nt, Human
ucugucucaaguucuugcacuc

SEQ ID NO: 989259 - RNA, 22 nt, Human
caaaugcagucccuuuguugcu

SEQ ID NO: 989260 - RNA, 22 nt, Human
ugccucugguuaucugguaccu

SEQ ID NO: 989261 - RNA, 22 nt, Human
auuauuaggacuacugggguug

SEQ ID NO: 989262 - RNA, 22 nt, Human
ugcaucuuacguuuugaaaggg

SEQ ID NO: 989263 - RNA, 22 nt, Human
gcuggccaggugcuuugguucu

SEQ ID NO: 989264 - RNA, 22 nt, Human
aaaugguaagacaacacauuau

SEQ ID NO: 989265 - RNA, 22 nt, Human
aagggcaggcagagaucauaua

SEQ ID NO: 989266 - RNA, 22 nt, Human
augucuaaaagauaaaguuuaa

SEQ ID NO: 989267 - RNA, 22 nt, Human
auaugaagucagacaaacuggg

SEQ ID NO: 989268 - RNA, 22 nt, Human
aguaugaagaugaugaaaaaua

SEQ ID NO: 989269 - RNA, 22 nt, Human
aaggcacuagcaagcugccugg

SEQ ID NO: 989270 - RNA, 22 nt, Human
agggacagucuacuguucacug

SEQ ID NO: 989271 - RNA, 22 nt, Human
ucaggggacagccagcuggagg

SEQ ID NO: 989272 - RNA, 22 nt, Human
guuagaaagugucugcuugggu

SEQ ID NO: 989273 - RNA, 22 nt, Human
uuuuccuaguaggccuauuaga

SEQ ID NO: 989274 - RNA, 22 nt, Human
uuguggcucgugagauguuagg

SEQ ID NO: 989275 - RNA, 22 nt, Human
uacaaaguuugagaaugcuuuc

SEQ ID NO: 989276 - RNA, 22 nt, Human
cuguccuccggccaccuacagu

SEQ ID NO: 989277 - RNA, 22 nt, Human
ggcugcuguuucagagacuguu

SEQ ID NO: 989278 - RNA, 22 nt, Human
ugucccagauacuggacauaga

SEQ ID NO: 989279 - RNA, 17 nt, Human
gagauggguggaucacc

SEQ ID NO: 989280 - RNA, 22 nt, Human
gggcuucucuuaugcuaacugg

SEQ ID NO: 989281 - RNA, 22 nt, Human
agggcccuccccgcucagggca

SEQ ID NO: 989282 - RNA, 22 nt, Human
cagagcuguccaaacccugaca

SEQ ID NO: 989283 - RNA, 22 nt, Human
ugaaaucuccucuuuauauauc

SEQ ID NO: 989284 - RNA, 22 nt, Human
uagagcugauaaugaggccaag

SEQ ID NO: 989285 - RNA, 22 nt, Human
aggggcugacuggaaagugcca

SEQ ID NO: 989286 - RNA, 22 nt, Human
gccuggugaaaggcagagagcg

SEQ ID NO: 989287 - RNA, 22 nt, Human
agccagccgggggaccacagug

SEQ ID NO: 989288 - RNA, 15 nt, Human
aaucuggcggcaagu

SEQ ID NO: 989289 - RNA, 22 nt, Human
cauuuagaaacuguuuuuaaca

SEQ ID NO: 989290 - RNA, 22 nt, Human
agagccuggcucccagcuaccg

SEQ ID NO: 989291 - RNA, 22 nt, Human
ucaguguaaguuauguagaugu

SEQ ID NO: 989292 - RNA, 21 nt, Human
gauuucacuuaccuucauuua

SEQ ID NO: 989293 - RNA, 22 nt, Human
aaggaagggaaauagugauguc

SEQ ID NO: 989294 - RNA, 20 nt, Human
cugagcugagcuccaugggu

SEQ ID NO: 989295 - RNA, 22 nt, Human
ggccugcugacccaaguccugu

SEQ ID NO: 989296 - RNA, 22 nt, Human
gagcucagauucuggugucaga

SEQ ID NO: 989297 - RNA, 22 nt, Human
cugagcuuggccaggaaugaau

SEQ ID NO: 989298 - RNA, 22 nt, Human
aggucauuggggacuaucuccg

SEQ ID NO: 989299 - RNA, 23 nt, Human
gccucugcagccuaguuaguguc

SEQ ID NO: 989300 - RNA, 22 nt, Human
ggccuucacgugaccuggcgug

SEQ ID NO: 989301 - RNA, 22 nt, Human
uaugcauaauuggauaaguaga

SEQ ID NO: 989302 - RNA, 22 nt, Human
agaaaucacaggaggcagaagg

SEQ ID NO: 989303 - RNA, 22 nt, Human
uguggcccagaugagugugcua

SEQ ID NO: 989304 - RNA, 22 nt, Human
caggagaagguuuggagugcag

SEQ ID NO: 989305 - RNA, 22 nt, Human
gcagggccuuagcagcggcugc

SEQ ID NO: 989306 - RNA, 22 nt, Human
ugugcuucugcagagacuauuu

SEQ ID NO: 989307 - RNA, 22 nt, Human
acuuccugggcaugcagagucc

SEQ ID NO: 989308 - RNA, 22 nt, Human
ggcacugaaguggguguugggu

SEQ ID NO: 989309 - RNA, 19 nt, Human
agccuggcuuugcucugcu

SEQ ID NO: 989310 - RNA, 22 nt, Human
uggcagggaauacagauguuua

SEQ ID NO: 989311 - RNA, 22 nt, Human
gcacccagcccagggcgugaug

SEQ ID NO: 989312 - RNA, 22 nt, Human
acccagcuggaugcauggaggc

SEQ ID NO: 989313 - RNA, 22 nt, Human
ggacagaggguugacagaguau

SEQ ID NO: 989314 - RNA, 22 nt, Human
gaaaaguaaacacuagggguca

SEQ ID NO: 989315 - RNA, 22 nt, Human
aggggcugcuggguccgccccu

SEQ ID NO: 989316 - RNA, 22 nt, Human
agcuuccugaugcaagagggcu

SEQ ID NO: 989317 - RNA, 21 nt, Human
aguucauacugaguaacaaaa

SEQ ID NO: 989318 - RNA, 22 nt, Human
uaacccaaaggcaaugucucga

SEQ ID NO: 989319 - RNA, 22 nt, Human
caauaauauccugugcuguuug

SEQ ID NO: 989320 - RNA, 21 nt, Human
agcugcuuucagcuccuagag

SEQ ID NO: 989321 - RNA, 22 nt, Human
gguguccaucaggcugugcuuc

SEQ ID NO: 989322 - RNA, 22 nt, Human
cagagagggcggcccuggcuuc

SEQ ID NO: 989323 - RNA, 22 nt, Human
augugucaauuuucaaaugcuu

SEQ ID NO: 989324 - RNA, 22 nt, Human
cauuuguauguuccuccuuagg

SEQ ID NO: 989325 - RNA, 22 nt, Human
gcagauggugccaugucuugug

SEQ ID NO: 989326 - RNA, 22 nt, Human
ggggcuggcucacuaagagacu

SEQ ID NO: 989327 - RNA, 22 nt, Human
ugcccugcagugagugcgucug

SEQ ID NO: 989328 - RNA, 22 nt, Human
uaugucacauuguaacagugug

SEQ ID NO: 989329 - RNA, 22 nt, Human
uccagcagaccaucaaggcuca

SEQ ID NO: 989330 - RNA, 20 nt, Human
ccugggguacacuggcaugu

SEQ ID NO: 989331 - RNA, 22 nt, Human
uucagcaauuuuuuaagcuaau

SEQ ID NO: 989332 - RNA, 22 nt, Human
agcccagccggauucccaguuc

SEQ ID NO: 989333 - RNA, 22 nt, Human
ccugcagguugcagaggcggaa

SEQ ID NO: 989334 - RNA, 22 nt, Human
aaagacagagcuguaggggaaa

SEQ ID NO: 989335 - RNA, 22 nt, Human
gcucugcucuugacuuaccagg

SEQ ID NO: 989336 - RNA, 22 nt, Human
ucaaauguucccuguacuggcc

SEQ ID NO: 989337 - RNA, 22 nt, Human
aggagagagcugagcuuugcug

SEQ ID NO: 989338 - RNA, 22 nt, Human
gagccagguuggaggcugcagu

SEQ ID NO: 989339 - RNA, 22 nt, Human
caggcuggagugcaguugugca

SEQ ID NO: 989340 - RNA, 22 nt, Human
aguguggguuuuauggagcccu

SEQ ID NO: 989341 - RNA, 22 nt, Human
acagguggagugguuagcaggc

SEQ ID NO: 989342 - RNA, 22 nt, Human
ugcugucccccgugucugggcu

SEQ ID NO: 989343 - RNA, 22 nt, Human
gccacguugccacccgggugac

SEQ ID NO: 989344 - RNA, 22 nt, Human
augagcuguaagguggcuuccu

SEQ ID NO: 989345 - RNA, 22 nt, Human
cugucacacugauaucaggcuu

SEQ ID NO: 989346 - RNA, 22 nt, Human
guauguauguauauguuuaaga

SEQ ID NO: 989347 - RNA, 22 nt, Human
aagcagccacuggccaguuaua

SEQ ID NO: 989348 - RNA, 21 nt, Human
ccuccaggugauuccgugcuc

SEQ ID NO: 989349 - RNA, 22 nt, Human
uaauuuacuugcaaauaacaau

SEQ ID NO: 989350 - RNA, 22 nt, Human
acauaaauagauuauugggagg

SEQ ID NO: 989351 - RNA, 22 nt, Human
gaaaugcagauucugauucugu

SEQ ID NO: 989352 - RNA, 22 nt, Human
aaugccaguguguugauuccag

SEQ ID NO: 989353 - RNA, 22 nt, Human
uuugauaacagugaauaucaug

SEQ ID NO: 989354 - RNA, 22 nt, Human
cagcagggaagcugugcuguuu

SEQ ID NO: 989355 - RNA, 22 nt, Human
ugcagaagaauguaggcauaag

SEQ ID NO: 989356 - RNA, 22 nt, Human
acuuucuccagaaaaccaagga

SEQ ID NO: 989357 - RNA, 22 nt, Human
ugcugccagggcucugcccaca

SEQ ID NO: 989358 - RNA, 22 nt, Human
uuucaaauaccauaaaccuaau

SEQ ID NO: 989359 - RNA, 22 nt, Human
aaauaauguuaggccuuugcuc

SEQ ID NO: 989360 - RNA, 22 nt, Human
ccaaagucuggagcagcagagc

SEQ ID NO: 989361 - RNA, 20 nt, Human
ccagcauguacacaugugga

SEQ ID NO: 989362 - RNA, 22 nt, Human
caugggcuuuggaggcuggagg

SEQ ID NO: 989363 - RNA, 22 nt, Human
ucuggcucaggagcuguguuca

SEQ ID NO: 989364 - RNA, 20 nt, Human
guguuucaugugauacaaug

SEQ ID NO: 989365 - RNA, 22 nt, Human
accucugcaaugcaaugucaug

SEQ ID NO: 989366 - RNA, 22 nt, Human
ucugagccuauuucaaauuccu

SEQ ID NO: 989367 - RNA, 22 nt, Human
ugcagcaggagccaggccuggu

SEQ ID NO: 989368 - RNA, 22 nt, Human
acaaaguuauucuuucagagga

SEQ ID NO: 989369 - RNA, 22 nt, Human
ggagccagaggcugcugcugug

SEQ ID NO: 989370 - RNA, 22 nt, Human
cccuuucccuucuggcucaggg

SEQ ID NO: 989371 - RNA, 22 nt, Human
uccagggcugacuugggagagg

SEQ ID NO: 989372 - RNA, 22 nt, Human
agagccaggacugugucucacu

SEQ ID NO: 989373 - RNA, 18 nt, Human
uggcagcaggaagccauu

SEQ ID NO: 989374 - RNA, 22 nt, Human
ucaggcagagcuguggagcucu

SEQ ID NO: 989375 - RNA, 22 nt, Human
ugcagucuggauguccucagau

SEQ ID NO: 989376 - RNA, 22 nt, Human
gcagggcugcugaaacuuguuu

SEQ ID NO: 989377 - RNA, 22 nt, Human
caggugcuguccugcacauguc

SEQ ID NO: 989378 - RNA, 22 nt, Human
auggggcuguucucugcccugc

SEQ ID NO: 989379 - RNA, 22 nt, Human
uuugcauucuagaaaaauuucu

SEQ ID NO: 989380 - RNA, 22 nt, Human
ucacucugacuuggccuccaac

SEQ ID NO: 989381 - RNA, 22 nt, Human
gcccuuccuuagacagcaggau

SEQ ID NO: 989382 - RNA, 22 nt, Human
agagccagccuucucagcuuac

SEQ ID NO: 989383 - RNA, 22 nt, Human
auauuagggucucuaaauucua

SEQ ID NO: 989384 - RNA, 23 nt, Human
ugggccuggaaagccuuagagag

SEQ ID NO: 989385 - RNA, 19 nt, Human
ucucaauguucagaaagcu

SEQ ID NO: 989386 - RNA, 22 nt, Human
ugucauguguucuuaaauacau

SEQ ID NO: 989387 - RNA, 22 nt, Human
uuguuucugaguuuucauguau

SEQ ID NO: 989388 - RNA, 22 nt, Human
guggcugcuguccucucugguu

SEQ ID NO: 989389 - RNA, 22 nt, Human
cuggagcaggcuugucccagcu

SEQ ID NO: 989390 - RNA, 22 nt, Human
uauucacauucucaggccuggu

SEQ ID NO: 989391 - RNA, 22 nt, Human
uugggaaggcguggaagcagaa

SEQ ID NO: 989392 - RNA, 22 nt, Human
caguacuuaguucucaugguuu

SEQ ID NO: 989393 - RNA, 22 nt, Human
cugggaggacaacuuggagcuc

SEQ ID NO: 989394 - RNA, 21 nt, Human
cugccuugaaugguacuggga

SEQ ID NO: 989395 - RNA, 22 nt, Human
gugcaugugucuuuauaguaga

SEQ ID NO: 989396 - RNA, 22 nt, Human
cagcugcccauccugggaaaug

SEQ ID NO: 989397 - RNA, 22 nt, Human
agcucccaggcagucaugagga

SEQ ID NO: 989398 - RNA, 22 nt, Human
gccugagcaggcguggaccaug

SEQ ID NO: 989399 - RNA, 18 nt, Human
cuuguucuucucuuggcg

SEQ ID NO: 989400 - RNA, 22 nt, Human
ucauugcaccccagucccagcu

SEQ ID NO: 989401 - RNA, 22 nt, Human
auaaacaguagagaaagguggu

SEQ ID NO: 989402 - RNA, 22 nt, Human
ucucagagaugucaagagucua

SEQ ID NO: 989403 - RNA, 22 nt, Human
aacauaaauuugaaguggcaaa

SEQ ID NO: 989404 - RNA, 22 nt, Human
agcccucauggaacagcuccua

SEQ ID NO: 989405 - RNA, 22 nt, Human
ggacagcccauacacaugucug

SEQ ID NO: 989406 - RNA, 22 nt, Human
gcuggccugggcucaagaccag

SEQ ID NO: 989407 - RNA, 22 nt, Human
ccugccugauuccaggauggcu

SEQ ID NO: 989408 - RNA, 22 nt, Human
uaaauacuuuuacuccacugau

SEQ ID NO: 989409 - RNA, 22 nt, Human
cugucuguuucugauucaaccu

SEQ ID NO: 989410 - RNA, 22 nt, Human
uuggccaagggcucuuuaggcu

SEQ ID NO: 989411 - RNA, 22 nt, Human
ggagccuuccagacugcccaca

SEQ ID NO: 989412 - RNA, 22 nt, Human
agagccagagaccuggguucac

SEQ ID NO: 989413 - RNA, 22 nt, Human
cuaaauaaucccucuggucuua

SEQ ID NO: 989414 - RNA, 22 nt, Human
aaugcacaaaaauuguauguaa

SEQ ID NO: 989415 - RNA, 23 nt, Human
aggagccaggugcagcccuugug

SEQ ID NO: 989416 - RNA, 17 nt, Human
agguggguggaucaccu

SEQ ID NO: 989417 - RNA, 22 nt, Human
cauugcugugggcauuugcugc

SEQ ID NO: 989418 - RNA, 22 nt, Human
gaguuuaaauaacacauuucca

SEQ ID NO: 989419 - RNA, 22 nt, Human
uucacaggauauaugugcaggg

SEQ ID NO: 989420 - RNA, 22 nt, Human
gccagggcaggggagcaucugc

SEQ ID NO: 989421 - RNA, 22 nt, Human
cagggcccauggcucagguagg

SEQ ID NO: 989422 - RNA, 22 nt, Human
aauguguauaugaacauacagg

SEQ ID NO: 989423 - RNA, 20 nt, Human
uauuugaaauggccaagugu

SEQ ID NO: 989424 - RNA, 19 nt, Human
ggcugccuuuccuuaccag

SEQ ID NO: 989425 - RNA, 22 nt, Human
agagcugggacuuggacucaau

SEQ ID NO: 989426 - RNA, 18 nt, Human
gcaggagauggguggggu

SEQ ID NO: 989427 - RNA, 22 nt, Human
aaaugcagauugucauucagga

SEQ ID NO: 989428 - RNA, 23 nt, Human
cuggggcuuucaaaucugggcag

SEQ ID NO: 989429 - RNA, 22 nt, Human
ucuggcucugaauucacuucug

SEQ ID NO: 989430 - RNA, 22 nt, Human
cugcuucuaagaaccugcagcu

SEQ ID NO: 989431 - RNA, 22 nt, Human
aggccaaagugcuccuuuuaga

SEQ ID NO: 989432 - RNA, 22 nt, Human
cacagcuuaugccacugauugg

SEQ ID NO: 989433 - RNA, 22 nt, Human
uuuauuguuguuagucauaagu

SEQ ID NO: 989434 - RNA, 22 nt, Human
ccuggccaggcucucagcacug

SEQ ID NO: 989435 - RNA, 22 nt, Human
uauguagguaaacacagacaua

SEQ ID NO: 989436 - RNA, 22 nt, Human
uuugaauaucacaaacuuucaa

SEQ ID NO: 989437 - RNA, 22 nt, Human
gcccuggccuucaucucagaca

SEQ ID NO: 989438 - RNA, 22 nt, Human
ggaggagacaguaaaaagcacg

SEQ ID NO: 989439 - RNA, 22 nt, Human
cagaaauguucuaaugauucag

SEQ ID NO: 989440 - RNA, 22 nt, Human
cuugugcauuucauuccucagg

SEQ ID NO: 989441 - RNA, 17 nt, Human
ccacucaguaauuucuc

SEQ ID NO: 989442 - RNA, 22 nt, Human
ugcugcacgauaaauaauuucu

SEQ ID NO: 989443 - RNA, 18 nt, Human
gcucugcccaggcugccc

SEQ ID NO: 989444 - RNA, 19 nt, Human
acacugaauguagaauugg

SEQ ID NO: 989445 - RNA, 22 nt, Human
ggccugagaaccauggggccaa

SEQ ID NO: 989446 - RNA, 22 nt, Human
aggcacugaagaacucuuuuug

SEQ ID NO: 989447 - RNA, 22 nt, Human
aacaaaccuucccuauacgucu

SEQ ID NO: 989448 - RNA, 22 nt, Human
ucaggcagaccaccgugggcag

SEQ ID NO: 989449 - RNA, 22 nt, Human
ccuggaaggugaugguacagca

SEQ ID NO: 989450 - RNA, 22 nt, Human
ugggcaaguaucggacucugag

SEQ ID NO: 989451 - RNA, 22 nt, Human
cauuacaugguccaggauauau

SEQ ID NO: 989452 - RNA, 22 nt, Human
acugggccuggauuggcguguc

SEQ ID NO: 989453 - RNA, 22 nt, Human
cagccagguaugggcgugcggg

SEQ ID NO: 989454 - RNA, 22 nt, Human
uccagggaugguaaugagcagu

SEQ ID NO: 989455 - RNA, 22 nt, Human
acagcuuuucaauucugcugag

SEQ ID NO: 989456 - RNA, 22 nt, Human
ccacucugauuucaagggagau

SEQ ID NO: 989457 - RNA, 21 nt, Human
ugggggagaauugguugcuuu

SEQ ID NO: 989458 - RNA, 20 nt, Human
acaggagaucugaggaaagg

SEQ ID NO: 989459 - RNA, 22 nt, Human
agcaggaguguccccuggcugu

SEQ ID NO: 989460 - RNA, 22 nt, Human
uccuggucuacacugcauuggg

SEQ ID NO: 989461 - RNA, 22 nt, Human
gccaggcuggucuugaacuccu

SEQ ID NO: 989462 - RNA, 22 nt, Human
gccuggaguggacuuggccccu

SEQ ID NO: 989463 - RNA, 22 nt, Human
ucuggcuccguguccgcuccca

SEQ ID NO: 989464 - RNA, 22 nt, Human
ccucccucuuucagucccacag

SEQ ID NO: 989465 - RNA, 22 nt, Human
acuaaggaauaugacaaacuca

SEQ ID NO: 989466 - RNA, 22 nt, Human
cucuuccuacagucugcuaugc

SEQ ID NO: 989467 - RNA, 22 nt, Human
uguuuaauucaccaucauguuc

SEQ ID NO: 989468 - RNA, 22 nt, Human
ccuggcuccugccucugcaggg

SEQ ID NO: 989469 - RNA, 22 nt, Human
ugggcugcacccucagccucug

SEQ ID NO: 989470 - RNA, 22 nt, Human
gcucacugccauucucuagaug

SEQ ID NO: 989471 - RNA, 23 nt, Human
uucuuucaagaaguucacagugc

SEQ ID NO: 989472 - RNA, 22 nt, Human
cuuccaaagcacuuuauggacc

SEQ ID NO: 989473 - RNA, 22 nt, Human
uuggccaaauacacaccuuuug

SEQ ID NO: 989474 - RNA, 22 nt, Human
cccaggcagagagcuggugagc

SEQ ID NO: 989475 - RNA, 22 nt, Human
uagcagggccaggcugggaacc

SEQ ID NO: 989476 - RNA, 22 nt, Human
auugacaagcaguaugucuuag

SEQ ID NO: 989477 - RNA, 17 nt, Human
agcuccugcccauggcu

SEQ ID NO: 989478 - RNA, 22 nt, Human
ggaaaaggccauuguuucucug

SEQ ID NO: 989479 - RNA, 22 nt, Human
caguggugaagagcaggggcuc

SEQ ID NO: 989480 - RNA, 22 nt, Human
ucuuggagacucuuguauauuu

SEQ ID NO: 989481 - RNA, 23 nt, Human
ugcagcugccucuggcgggccgg

SEQ ID NO: 989482 - RNA, 22 nt, Human
agucagugaaaacuagaauguu

SEQ ID NO: 989483 - RNA, 22 nt, Human
gagagcugauagaugagcuacu

SEQ ID NO: 989484 - RNA, 22 nt, Human
ccuguuuagugaggugaggagu

SEQ ID NO: 989485 - RNA, 22 nt, Human
aagggcugcuguagaagcagag

SEQ ID NO: 989486 - RNA, 22 nt, Human
ucugggagcacacgcagugauc

SEQ ID NO: 989487 - RNA, 22 nt, Human
agaaaugugagccccuuaucaa

SEQ ID NO: 989488 - RNA, 17 nt, Human
ugagacagggcaggccc

SEQ ID NO: 989489 - RNA, 22 nt, Human
uguguuuugaacucaucuacug

SEQ ID NO: 989490 - RNA, 22 nt, Human
uaccuugggguuuuguugcucu

SEQ ID NO: 989491 - RNA, 22 nt, Human
ggcagccauggacacuggcuag

SEQ ID NO: 989492 - RNA, 22 nt, Human
ggagggagcauccccuugcuga

SEQ ID NO: 989493 - RNA, 22 nt, Human
gcuucucuggccugcagggcau

SEQ ID NO: 989494 - RNA, 21 nt, Human
agagucugcauuucugacaag

SEQ ID NO: 989495 - RNA, 22 nt, Human
cugagcugcucccgcugcagcg

SEQ ID NO: 989496 - RNA, 19 nt, Human
aggcagaggcuuggcuagc

SEQ ID NO: 989497 - RNA, 22 nt, Human
caugcaggcacccagagcccac

SEQ ID NO: 989498 - RNA, 22 nt, Human
ucacucugguccauccgagagc

SEQ ID NO: 989499 - RNA, 22 nt, Human
ccuccugggagagcacggaggg

SEQ ID NO: 989500 - RNA, 23 nt, Human
acacaauagaguacuauucagcc

SEQ ID NO: 989501 - RNA, 22 nt, Human
gacagggcgagacucagucuca

SEQ ID NO: 989502 - RNA, 22 nt, Human
uuguaacacuuuucuauuaaua

SEQ ID NO: 989503 - RNA, 22 nt, Human
ucuggccagcaugagaccuggu

SEQ ID NO: 989504 - RNA, 22 nt, Human
uguaugcaaauuuauuagcaca

SEQ ID NO: 989505 - RNA, 22 nt, Human
gagacacacacaggagguggca

SEQ ID NO: 989506 - RNA, 22 nt, Human
ugucccaguucccaggguugcu

SEQ ID NO: 989507 - RNA, 22 nt, Human
cuucugagcagaccuccugggg

SEQ ID NO: 989508 - RNA, 22 nt, Human
cucagaauuacaucccauuuua

SEQ ID NO: 989509 - RNA, 22 nt, Human
ucauaauacaaagaguucugca

SEQ ID NO: 989510 - RNA, 22 nt, Human
cucuccagccacagaagcugcu

SEQ ID NO: 989511 - RNA, 23 nt, Human
ugggcaucuccucugugccaggc

SEQ ID NO: 989512 - RNA, 22 nt, Human
acaccuuuuauucgccaggcac

SEQ ID NO: 989513 - RNA, 22 nt, Human
ucaggagcagcaugggugagag

SEQ ID NO: 989514 - RNA, 23 nt, Human
gggcugcuccaggccaaggcugg

SEQ ID NO: 989515 - RNA, 22 nt, Human
cucagggcaguauggcugagag

SEQ ID NO: 989516 - RNA, 22 nt, Human
ggagucaggagcaggcugggcu

SEQ ID NO: 989517 - RNA, 22 nt, Human
aacugcauuuaacaaauacucu

SEQ ID NO: 989518 - RNA, 22 nt, Human
ugcugggcuaggguggagcucu

SEQ ID NO: 989519 - RNA, 21 nt, Human
auuauuauuucuguguccagc

SEQ ID NO: 989520 - RNA, 22 nt, Human
acagaggucauggagaguucuc

SEQ ID NO: 989521 - RNA, 22 nt, Human
ucagcugccuuucccaugcuag

SEQ ID NO: 989522 - RNA, 22 nt, Human
gcagggccagggcucaggcugu

SEQ ID NO: 989523 - RNA, 22 nt, Human
aagcagcacaguaauauuggug

SEQ ID NO: 989524 - RNA, 19 nt, Human
uugcauuguaguuggacug

SEQ ID NO: 989525 - RNA, 22 nt, Human
aaacagcugucauuguuuuaaa

SEQ ID NO: 989526 - RNA, 22 nt, Human
ggcugcagggcagcuggugugg

SEQ ID NO: 989527 - RNA, 22 nt, Human
gggugggguucaggaaucuuca

SEQ ID NO: 989528 - RNA, 22 nt, Human
cucuugaagcaggggccaguuc

SEQ ID NO: 989529 - RNA, 22 nt, Human
uauuggaugauucacuuggcag

SEQ ID NO: 989530 - RNA, 22 nt, Human
gugggugauguacuggaggcca

SEQ ID NO: 989531 - RNA, 22 nt, Human
gaguguucccacaccccaguug

SEQ ID NO: 989532 - RNA, 22 nt, Human
uggccugggucacaccaggguc

SEQ ID NO: 989533 - RNA, 20 nt, Human
gcagcugcccccagucccug

SEQ ID NO: 989534 - RNA, 20 nt, Human
caguuuaacuuugagcaguu

SEQ ID NO: 989535 - RNA, 22 nt, Human
agcaggcuaagggaccuguuua

SEQ ID NO: 989536 - RNA, 18 nt, Human
cagucccaaaccuuagga

SEQ ID NO: 989537 - RNA, 22 nt, Human
ucagaacagaagcuggcuauaa

SEQ ID NO: 989538 - RNA, 21 nt, Human
gcccucaggggaggauggccu

SEQ ID NO: 989539 - RNA, 17 nt, Human
ggcugcugugcuggugc

SEQ ID NO: 989540 - RNA, 22 nt, Human
acagcuugcaauggcuuucaac

SEQ ID NO: 989541 - RNA, 22 nt, Human
cagugcaguugguggcaggggu

SEQ ID NO: 989542 - RNA, 22 nt, Human
ggcuucagugagcugagcucac

SEQ ID NO: 989543 - RNA, 22 nt, Human
uggggcuggcacagucucuauu

SEQ ID NO: 989544 - RNA, 18 nt, Human
gugagcagagagcaucac

SEQ ID NO: 989545 - RNA, 22 nt, Human
agugcauugcaucucugcuuca

SEQ ID NO: 989546 - RNA, 22 nt, Human
caggaaggcccaccuguccugu

SEQ ID NO: 989547 - RNA, 22 nt, Human
ggggccugcgagguucaacuuc

SEQ ID NO: 989548 - RNA, 22 nt, Human
guccucuggaagaugaguucuu

SEQ ID NO: 989549 - RNA, 22 nt, Human
agucucagcaagcauggcuagu

SEQ ID NO: 989550 - RNA, 22 nt, Human
ucucuuuuauguacacccugac

SEQ ID NO: 989551 - RNA, 22 nt, Human
auaugcauaugucaaaacuuau

SEQ ID NO: 989552 - RNA, 22 nt, Human
gaaggaaaacagaucugccuga

SEQ ID NO: 989553 - RNA, 20 nt, Human
uccagcugggaacagcugau

SEQ ID NO: 989554 - RNA, 22 nt, Human
ccacaggaccagaggagaucac

SEQ ID NO: 989555 - RNA, 22 nt, Human
gaaaagggcaagagagagggca

SEQ ID NO: 989556 - RNA, 22 nt, Human
uggagcagcaucacuuugagcu

SEQ ID NO: 989557 - RNA, 21 nt, Human
uucugagcacucaucacuguc

SEQ ID NO: 989558 - RNA, 22 nt, Human
aagcugcccucauucccagugc

SEQ ID NO: 989559 - RNA, 22 nt, Human
uuuauguacauauccacaagga

SEQ ID NO: 989560 - RNA, 22 nt, Human
ggcauggcucggagucagaaca

SEQ ID NO: 989561 - RNA, 22 nt, Human
ucaagagauugaauaauaacug

SEQ ID NO: 989562 - RNA, 22 nt, Human
gggcuccaacggugagcaugga

SEQ ID NO: 989563 - RNA, 22 nt, Human
gaggcagcugaaggagugacag

SEQ ID NO: 989564 - RNA, 22 nt, Human
ccuggagcacagcccaguccca

SEQ ID NO: 989565 - RNA, 22 nt, Human
acagccauagaugcuuauguaa

SEQ ID NO: 989566 - RNA, 22 nt, Human
uggccuugggcagguggccugc

SEQ ID NO: 989567 - RNA, 20 nt, Human
ggcagagcuaugucuguugc

SEQ ID NO: 989568 - RNA, 22 nt, Human
acacugaagagcacuuucaaag

SEQ ID NO: 989569 - RNA, 21 nt, Human
uucaaagagugggcauuguca

SEQ ID NO: 989570 - RNA, 22 nt, Human
ucagccugcuccaagugcugcc

SEQ ID NO: 989571 - RNA, 22 nt, Human
cucacaggcaucucaucaggcu

SEQ ID NO: 989572 - RNA, 22 nt, Human
uggcccugcuuaugucucucuu

SEQ ID NO: 989573 - RNA, 22 nt, Human
gccugcagugagugcagaaggu

SEQ ID NO: 989574 - RNA, 22 nt, Human
cccagcagaccgcugugauggc

SEQ ID NO: 989575 - RNA, 22 nt, Human
ugggccugggucuuugcugcca

SEQ ID NO: 989576 - RNA, 22 nt, Human
agucaaagcuacaggcauuuga

SEQ ID NO: 989577 - RNA, 18 nt, Human
acagaacucaggggcacc

SEQ ID NO: 989578 - RNA, 22 nt, Human
agguaacacuacuuaguauacu

SEQ ID NO: 989579 - RNA, 18 nt, Human
gagacacaagggccugga

SEQ ID NO: 989580 - RNA, 22 nt, Human
ucccagagaaagucaaggucuu

SEQ ID NO: 989581 - RNA, 22 nt, Human
uuuaccaagcuuuaauuacaua

SEQ ID NO: 989582 - RNA, 22 nt, Human
ugagguggcuagggaggcacuc

SEQ ID NO: 989583 - RNA, 21 nt, Human
aggccucuucauggccaugau

SEQ ID NO: 989584 - RNA, 22 nt, Human
guggcuucacauggcauuuggc

SEQ ID NO: 989585 - RNA, 22 nt, Human
agggcucuguccccagaggccc

SEQ ID NO: 989586 - RNA, 22 nt, Human
ucagugucuugggcuugaaugc

SEQ ID NO: 989587 - RNA, 22 nt, Human
uagaaacauguucuguucuguu

SEQ ID NO: 989588 - RNA, 22 nt, Human
aaaugcaccuugcugugagacu

SEQ ID NO: 989589 - RNA, 22 nt, Human
ggacacagcugcagccacaccc

SEQ ID NO: 989590 - RNA, 22 nt, Human
gaaucauagaacauuaauagaa

SEQ ID NO: 989591 - RNA, 22 nt, Human
gucaggggccaugggccaagga

SEQ ID NO: 989592 - RNA, 22 nt, Human
ccugccugcagaaaguaucucc

SEQ ID NO: 989593 - RNA, 22 nt, Human
uuuuugcaccaaccuaauagaa

SEQ ID NO: 989594 - RNA, 22 nt, Human
cacagggccuugugugacugca

SEQ ID NO: 989595 - RNA, 22 nt, Human
uagcugccaaaagggugggcua

SEQ ID NO: 989596 - RNA, 22 nt, Human
acaggggauugauuggaagucu

SEQ ID NO: 989597 - RNA, 17 nt, Human
agcugccagggagugug

SEQ ID NO: 989598 - RNA, 20 nt, Human
uuggcagcuucaggguacua

SEQ ID NO: 989599 - RNA, 20 nt, Human
acagccagaggaggcagaca

SEQ ID NO: 989600 - RNA, 17 nt, Human
ucaugcccaacuauuac

SEQ ID NO: 989601 - RNA, 22 nt, Human
ggugggcacccgagacuggauc

SEQ ID NO: 989602 - RNA, 22 nt, Human
uggcagagcuggcugcggauga

SEQ ID NO: 989603 - RNA, 22 nt, Human
uagagcaguuggcagcuguauu

SEQ ID NO: 989604 - RNA, 22 nt, Human
aggugccaauuuucagugaaca

SEQ ID NO: 989605 - RNA, 22 nt, Human
agaugaagauaucugcaggggc

SEQ ID NO: 989606 - RNA, 22 nt, Human
gagccaggguuugaaacuagac

SEQ ID NO: 989607 - RNA, 22 nt, Human
agggucugacuccucuggcaag

SEQ ID NO: 989608 - RNA, 22 nt, Human
cagcucugaagaaaggugucua

SEQ ID NO: 989609 - RNA, 22 nt, Human
cccugagaugccucacccuagu

SEQ ID NO: 989610 - RNA, 22 nt, Human
uggcucagaaggcugccuucac

SEQ ID NO: 989611 - RNA, 22 nt, Human
agacccagaaagcagcugcauu

SEQ ID NO: 989612 - RNA, 22 nt, Human
ugggcuguccagcaccugggcu

SEQ ID NO: 989613 - RNA, 22 nt, Human
ccacuugugaaauaaucaaaua

SEQ ID NO: 989614 - RNA, 22 nt, Human
gggcugcacagaucuucaaggg

SEQ ID NO: 989615 - RNA, 22 nt, Human
ugcauuguuugauaggugaauu

SEQ ID NO: 989616 - RNA, 22 nt, Human
acaaauguggacauggauaaug

SEQ ID NO: 989617 - RNA, 22 nt, Human
cuggccacaacuagcccaggac

SEQ ID NO: 989618 - RNA, 22 nt, Human
aggccaaagcacagagcuggaa

SEQ ID NO: 989619 - RNA, 22 nt, Human
cuggcaggagcauucacagagg

SEQ ID NO: 989620 - RNA, 22 nt, Human
agggcugcaccggggcuucgcg

SEQ ID NO: 989621 - RNA, 22 nt, Human
ucagaggugguaaaggacagca

SEQ ID NO: 989622 - RNA, 22 nt, Human
aggagcuggguuccuuuggugg

SEQ ID NO: 989623 - RNA, 22 nt, Human
gaggagggagcuggaagcucuu

SEQ ID NO: 989624 - RNA, 22 nt, Human
ggcagggaggaggugaaaguga

SEQ ID NO: 989625 - RNA, 17 nt, Human
ucaggcugugccuggua

SEQ ID NO: 989626 - RNA, 22 nt, Human
gguggccugcccugaucccugg

SEQ ID NO: 989627 - RNA, 22 nt, Human
ccaggcuggagugcaauggugc

SEQ ID NO: 989628 - RNA, 22 nt, Human
auggaagguccuacagagcgca

SEQ ID NO: 989629 - RNA, 22 nt, Human
augaagucugcacaugcaugug

SEQ ID NO: 989630 - RNA, 22 nt, Human
gagaugaauguaaacaaaggca

SEQ ID NO: 989631 - RNA, 22 nt, Human
guggugcauccuugaguaagcu

SEQ ID NO: 989632 - RNA, 22 nt, Human
ucugccaccuucauccuccacu

SEQ ID NO: 989633 - RNA, 22 nt, Human
ccaggccuggccaggggaugcc

SEQ ID NO: 989634 - RNA, 22 nt, Human
aaauguguuuagaugguuuauu

SEQ ID NO: 989635 - RNA, 22 nt, Human
uuugcauugcauuaaguauucu

SEQ ID NO: 989636 - RNA, 22 nt, Human
guggagcccugccuugcucaug

SEQ ID NO: 989637 - RNA, 22 nt, Human
accccagaggcggaggcugcag

SEQ ID NO: 989638 - RNA, 22 nt, Human
acaggcucucagccaguuggca

SEQ ID NO: 989639 - RNA, 22 nt, Human
gguggcuggaggagcugaugga

SEQ ID NO: 989640 - RNA, 22 nt, Human
uaagccugguucauaauuugcu

SEQ ID NO: 989641 - RNA, 22 nt, Human
caaagcaaggcucaguuugaac

SEQ ID NO: 989642 - RNA, 22 nt, Human
cacaugggcguaauguccaugg

SEQ ID NO: 989643 - RNA, 22 nt, Human
ucucagagcaucauuuucuuag

SEQ ID NO: 989644 - RNA, 22 nt, Human
acauuucucuugaugucucuau

SEQ ID NO: 989645 - RNA, 22 nt, Human
gccuggcaggccucaugagggg

SEQ ID NO: 989646 - RNA, 21 nt, Human
gagugucuaauccaggcuguc

SEQ ID NO: 989647 - RNA, 22 nt, Human
cugaagaggacgcagcagcaag

SEQ ID NO: 989648 - RNA, 22 nt, Human
aaggcugcuuuuaacaugcaua

SEQ ID NO: 989649 - RNA, 22 nt, Human
uuccuguccgcaauggccuggg

SEQ ID NO: 989650 - RNA, 20 nt, Human
ccucaagcagacugacagcu

SEQ ID NO: 989651 - RNA, 22 nt, Human
ucaggaucaggggccuuuccuu

SEQ ID NO: 989652 - RNA, 22 nt, Human
uggcucagagagggagugugga

SEQ ID NO: 989653 - RNA, 22 nt, Human
gcugagagugagcacuggauau

SEQ ID NO: 989654 - RNA, 19 nt, Human
uagcagcugccaaaggaga

SEQ ID NO: 989655 - RNA, 22 nt, Human
ccucuggucccagcucugcugc

SEQ ID NO: 989656 - RNA, 22 nt, Human
auuugucuuuggaccugugaga

SEQ ID NO: 989657 - RNA, 22 nt, Human
cagaggccaccuguggccacug

SEQ ID NO: 989658 - RNA, 22 nt, Human
gggacagacccaugggccaggu

SEQ ID NO: 989659 - RNA, 22 nt, Human
gccagggcucgcggucccucgu

SEQ ID NO: 989660 - RNA, 22 nt, Human
gcagcuggaagugacacucugu

SEQ ID NO: 989661 - RNA, 22 nt, Human
uacaguaaccuuauuugucauu

SEQ ID NO: 989662 - RNA, 22 nt, Human
uccaaagaagucacaaacgaag

SEQ ID NO: 989663 - RNA, 22 nt, Human
gcagccacccucaaggcugaau

SEQ ID NO: 989664 - RNA, 22 nt, Human
augauggugagguugagcacag

SEQ ID NO: 989665 - RNA, 22 nt, Human
auaccuuuuagacauguaguug

SEQ ID NO: 989666 - RNA, 22 nt, Human
ggagaguggauuccagcuguau

SEQ ID NO: 989667 - RNA, 22 nt, Human
uuauguacaauguuaauguaaa

SEQ ID NO: 989668 - RNA, 21 nt, Human
uccauaagagaccaucuccua

SEQ ID NO: 989669 - RNA, 22 nt, Human
agcugguucagaaauuagaugg

SEQ ID NO: 989670 - RNA, 22 nt, Human
cugcccuggcagccuaccaugg

SEQ ID NO: 989671 - RNA, 22 nt, Human
gcugccacuuggucaugucaug

SEQ ID NO: 989672 - RNA, 22 nt, Human
uggugcuguggaggggcagaag

SEQ ID NO: 989673 - RNA, 20 nt, Human
uugcagcagugaggugaagg

SEQ ID NO: 989674 - RNA, 22 nt, Human
ugaugauguuuaucuugguauu

SEQ ID NO: 989675 - RNA, 22 nt, Human
ggggauggugggaaggcaaucu

SEQ ID NO: 989676 - RNA, 22 nt, Human
cagccaucccagccugugguuc

SEQ ID NO: 989677 - RNA, 22 nt, Human
uguacaaugccagggaacacca

SEQ ID NO: 989678 - RNA, 22 nt, Human
cucuggagguugagcccagcaa

SEQ ID NO: 989679 - RNA, 22 nt, Human
gacagagugcagggcuagaaga

SEQ ID NO: 989680 - RNA, 22 nt, Human
cccagagcuccgguccugccca

SEQ ID NO: 989681 - RNA, 22 nt, Human
aauuuagauugauaaacaugga

SEQ ID NO: 989682 - RNA, 22 nt, Human
gcuguggccaacaaaccacuuu

SEQ ID NO: 989683 - RNA, 22 nt, Human
cccuggaggaaaaucugaggcu

SEQ ID NO: 989684 - RNA, 22 nt, Human
cacauuucucuaccucacacaa

SEQ ID NO: 989685 - RNA, 22 nt, Human
aaguaugcuaauuaacuagcac

SEQ ID NO: 989686 - RNA, 22 nt, Human
gcagagugagccgaggcugcuc

SEQ ID NO: 989687 - RNA, 18 nt, Human
ucagcuggggcugcagcc

SEQ ID NO: 989688 - RNA, 22 nt, Human
gcagugaaacaauaggaucaaa

SEQ ID NO: 989689 - RNA, 22 nt, Human
aagacuuucucccaaauccuca

SEQ ID NO: 989690 - RNA, 22 nt, Human
ggcagcucugugucugggaagc

SEQ ID NO: 989691 - RNA, 21 nt, Human
ccagccucagaucagggagcu

SEQ ID NO: 989692 - RNA, 22 nt, Human
aagggcugccagggggugccag

SEQ ID NO: 989693 - RNA, 22 nt, Human
ccagggcaacgcugucucagag

SEQ ID NO: 989694 - RNA, 22 nt, Human
ccagucccaucucugucgcuua

SEQ ID NO: 989695 - RNA, 22 nt, Human
cagggcugugcccaucuucccc

SEQ ID NO: 989696 - RNA, 22 nt, Human
uggcccugcagaacuagccugg

SEQ ID NO: 989697 - RNA, 22 nt, Human
aggcagccagauggcagccugc

SEQ ID NO: 989698 - RNA, 22 nt, Human
cucucugggcccaguuggcacc

SEQ ID NO: 989699 - RNA, 22 nt, Human
auguaacaggugaagcucugag

SEQ ID NO: 989700 - RNA, 22 nt, Human
agcagcauagaagcugggagga

SEQ ID NO: 989701 - RNA, 22 nt, Human
cucuuaguuuaucuuugacaaa

SEQ ID NO: 989702 - RNA, 22 nt, Human
ugagaguauuuuggcauuauca

SEQ ID NO: 989703 - RNA, 22 nt, Human
auuuauuaugggauuuggcuca

SEQ ID NO: 989704 - RNA, 22 nt, Human
gccagggaacccaagggccuca

SEQ ID NO: 989705 - RNA, 22 nt, Human
caggggccaggcugucugcugu

SEQ ID NO: 989706 - RNA, 22 nt, Human
uuuauaagaagcaaugucugag

SEQ ID NO: 989707 - RNA, 22 nt, Human
gugccagggggcacugaacaga

SEQ ID NO: 989708 - RNA, 22 nt, Human
ggcagaagaaaggcuaagucuc

SEQ ID NO: 989709 - RNA, 17 nt, Human
acagagguuauacagac

SEQ ID NO: 989710 - RNA, 22 nt, Human
cugccagcucucuggaggcucu

SEQ ID NO: 989711 - RNA, 22 nt, Human
caggguggaaaagcuaguugga

SEQ ID NO: 989712 - RNA, 22 nt, Human
aaagacuagcauuuauauguac

SEQ ID NO: 989713 - RNA, 22 nt, Human
cuggagccccaggcugugcaga

SEQ ID NO: 989714 - RNA, 22 nt, Human
uaugcacgucuauuuaugaaga

SEQ ID NO: 989715 - RNA, 22 nt, Human
ggccucugguucacagggagga

SEQ ID NO: 989716 - RNA, 22 nt, Human
cucucugcuguauccuuaggcu

SEQ ID NO: 989717 - RNA, 22 nt, Human
aagauuucuuacuuauugaugc

SEQ ID NO: 989718 - RNA, 19 nt, Human
cuggcucuuggguggagga

SEQ ID NO: 989719 - RNA, 18 nt, Human
cucugcuaaugggcagcu

SEQ ID NO: 989720 - RNA, 22 nt, Human
uaaggcagaaauaugagcaggg

SEQ ID NO: 989721 - RNA, 22 nt, Human
gagaggccauggcugugcagug

SEQ ID NO: 989722 - RNA, 22 nt, Human
uuguauuagcuguaaauuuucu

SEQ ID NO: 989723 - RNA, 22 nt, Human
aaguuuaagguggaaguggugg

SEQ ID NO: 989724 - RNA, 22 nt, Human
uccagggacacagaguccuucu

SEQ ID NO: 989725 - RNA, 22 nt, Human
ugcucccaggcucuguggucug

SEQ ID NO: 989726 - RNA, 22 nt, Human
ucugcagauuuaucagcagcug

SEQ ID NO: 989727 - RNA, 21 nt, Human
ggccucugccuugccccacuc

SEQ ID NO: 989728 - RNA, 22 nt, Human
aagcaauauacugauaugauua

SEQ ID NO: 989729 - RNA, 22 nt, Human
cacugggcaauucugagccuaa

SEQ ID NO: 989730 - RNA, 19 nt, Human
cagcaauaaugccagaugg

SEQ ID NO: 989731 - RNA, 22 nt, Human
gcuucucucucagacugcaagc

SEQ ID NO: 989732 - RNA, 22 nt, Human
acuggagcccguggaggcgcag

SEQ ID NO: 989733 - RNA, 22 nt, Human
ggcagagcugcaugagcacuca

SEQ ID NO: 989734 - RNA, 22 nt, Human
ggcagugaaugaaacagaggcu

SEQ ID NO: 989735 - RNA, 22 nt, Human
uccugccucuccaugcuaacua

SEQ ID NO: 989736 - RNA, 22 nt, Human
uguuccuguguggaaaagggcc

SEQ ID NO: 989737 - RNA, 22 nt, Human
gcugccaauccagcugugggag

SEQ ID NO: 989738 - RNA, 19 nt, Human
gcauaaaaugucaaugugu

SEQ ID NO: 989739 - RNA, 22 nt, Human
ccuggcagacagcacugaagcu

SEQ ID NO: 989740 - RNA, 22 nt, Human
uacaugcucaguaacuuucagu

SEQ ID NO: 989741 - RNA, 22 nt, Human
uaaguucauuagacuacagaua

SEQ ID NO: 989742 - RNA, 22 nt, Human
ugcguugcgcuccugcagcagg

SEQ ID NO: 989743 - RNA, 22 nt, Human
uggcucagugacauuccuccca

SEQ ID NO: 989744 - RNA, 22 nt, Human
ucaccaggcuggaaugcagugg

SEQ ID NO: 989745 - RNA, 22 nt, Human
acagaauuaucaggaaauguua

SEQ ID NO: 989746 - RNA, 22 nt, Human
ggugccaggcuguagucagggu

SEQ ID NO: 989747 - RNA, 22 nt, Human
caguacuuauuucuauuuaggg

SEQ ID NO: 989748 - RNA, 19 nt, Human
acagagcucucugcuucug

SEQ ID NO: 989749 - RNA, 22 nt, Human
aagcagaaguugaucuaccaua

SEQ ID NO: 989750 - RNA, 22 nt, Human
gggagccaaggagagaggccuu

SEQ ID NO: 989751 - RNA, 23 nt, Human
gccuggagaaaagcugcaguuca

SEQ ID NO: 989752 - RNA, 22 nt, Human
ucauugcaagcucauuuaucug

SEQ ID NO: 989753 - RNA, 22 nt, Human
gggcugcuuuuaagggucucag

SEQ ID NO: 989754 - RNA, 22 nt, Human
gccugagaaggauaggaagcga

SEQ ID NO: 989755 - RNA, 18 nt, Human
aguggucuguuauaucau

SEQ ID NO: 989756 - RNA, 22 nt, Human
ucugcagcuugcacaggcaggc

SEQ ID NO: 989757 - RNA, 22 nt, Human
gaguuauuucagaaggaaagau

SEQ ID NO: 989758 - RNA, 18 nt, Human
ccuggcuuccaucuuggu

SEQ ID NO: 989759 - RNA, 22 nt, Human
aggaaucccgcaccagcugcug

SEQ ID NO: 989760 - RNA, 22 nt, Human
aaaguucagugccuucuauaca

SEQ ID NO: 989761 - RNA, 22 nt, Human
cccuggagcuagucugagcaga

SEQ ID NO: 989762 - RNA, 22 nt, Human
gcuggcagucccaucagcuggg

SEQ ID NO: 989763 - RNA, 22 nt, Human
ucauaacagcuaagucccuuuc

SEQ ID NO: 989764 - RNA, 22 nt, Human
ucaguuuuucuauacuuuguag

SEQ ID NO: 989765 - RNA, 20 nt, Human
cccugagacaaaggaggggc

SEQ ID NO: 989766 - RNA, 22 nt, Human
ucccuggcagcuaagggugguc

SEQ ID NO: 989767 - RNA, 19 nt, Human
ccugcagggaugagagguu

SEQ ID NO: 989768 - RNA, 22 nt, Human
ucagggacuaggugcugccuga

SEQ ID NO: 989769 - RNA, 22 nt, Human
uuucacaaucaaauggugaaau

SEQ ID NO: 989770 - RNA, 22 nt, Human
uaguccaguaaaacagcuaacg

SEQ ID NO: 989771 - RNA, 22 nt, Human
acacaugcauaagccuucccuu

SEQ ID NO: 989772 - RNA, 22 nt, Human
uucaccuugaauaugucuuaaa

SEQ ID NO: 989773 - RNA, 22 nt, Human
ucccagccugacagugcaucaa

SEQ ID NO: 989774 - RNA, 22 nt, Human
cuaaaugccuuuccuaccuaac

SEQ ID NO: 989775 - RNA, 22 nt, Human
acagagccuccaggagugcugg

SEQ ID NO: 989776 - RNA, 22 nt, Human
guugggaaggcaagaaguagaa

SEQ ID NO: 989777 - RNA, 22 nt, Human
agccauuggcugccuggugcgu

SEQ ID NO: 989778 - RNA, 22 nt, Human
uguaacaguaagccugugagcu

SEQ ID NO: 989779 - RNA, 22 nt, Human
ugaugggaaaaugaggccuggg

SEQ ID NO: 989780 - RNA, 19 nt, Human
ucaaaugccaaugucacag

SEQ ID NO: 989781 - RNA, 22 nt, Human
ucuggcucggauuugucuagca

SEQ ID NO: 989782 - RNA, 18 nt, Human
ccugagcccugcuuacuu

SEQ ID NO: 989783 - RNA, 22 nt, Human
cagcuuuuuagaaucuagggca

SEQ ID NO: 989784 - RNA, 22 nt, Human
cugugggcugaaagugcucccg

SEQ ID NO: 989785 - RNA, 22 nt, Human
cagggcaguaccgcccucuggc

SEQ ID NO: 989786 - RNA, 22 nt, Human
ccucugagagaaggccuucagc

SEQ ID NO: 989787 - RNA, 22 nt, Human
aacagaaaagguagguggcuuu

SEQ ID NO: 989788 - RNA, 22 nt, Human
gccuggagugcaguggcgugau

SEQ ID NO: 989789 - RNA, 19 nt, Human
gccucugcuggggacaggc

SEQ ID NO: 989790 - RNA, 22 nt, Human
ucuucaaacugaaaauuuagaa

SEQ ID NO: 989791 - RNA, 22 nt, Human
uaaaucucacuggguauauugg

SEQ ID NO: 989792 - RNA, 22 nt, Human
acucugcucaaaguccugaggc

SEQ ID NO: 989793 - RNA, 22 nt, Human
uagggaggcuacuucuuguagg

SEQ ID NO: 989794 - RNA, 21 nt, Human
gagugcaggucugaugccauc

SEQ ID NO: 989795 - RNA, 22 nt, Human
gcagcagaugcuuucauggaca

SEQ ID NO: 989796 - RNA, 22 nt, Human
uuccagggcuaauuccugugga

SEQ ID NO: 989797 - RNA, 22 nt, Human
uuccagaaaucuuucagcucaa

SEQ ID NO: 989798 - RNA, 22 nt, Human
gccuggagcucaugugggcauu

SEQ ID NO: 989799 - RNA, 22 nt, Human
gccugggugucgaucacuagug

SEQ ID NO: 989800 - RNA, 22 nt, Human
gucugagcgcuggagcuugugu

SEQ ID NO: 989801 - RNA, 22 nt, Human
cacaguggcagguguggguugu

SEQ ID NO: 989802 - RNA, 22 nt, Human
uaaaaguaggaaugaaacgcau

SEQ ID NO: 989803 - RNA, 22 nt, Human
uuaggaaauuaugguuucagau

SEQ ID NO: 989804 - RNA, 22 nt, Human
cucccaggcacagggaggagcc

SEQ ID NO: 989805 - RNA, 19 nt, Human
auuagcaugcuugaggaug

SEQ ID NO: 989806 - RNA, 22 nt, Human
caggcuggagugaguguagugg

SEQ ID NO: 989807 - RNA, 20 nt, Human
aggagaaauucgggacaccu

SEQ ID NO: 989808 - RNA, 22 nt, Human
uuuuuccuaagcaguggagcug

SEQ ID NO: 989809 - RNA, 23 nt, Human
ccuggcagcaaacgaggagguua

SEQ ID NO: 989810 - RNA, 22 nt, Human
agguggcuccucccauggcugg

SEQ ID NO: 989811 - RNA, 22 nt, Human
gcaaaacagucgaugccuccca

SEQ ID NO: 989812 - RNA, 22 nt, Human
uuugcauuaguuuagauuucaa

SEQ ID NO: 989813 - RNA, 22 nt, Human
cagagcagucuggagauccagc

SEQ ID NO: 989814 - RNA, 22 nt, Human
ugcugggcuagaagcugaggcc

SEQ ID NO: 989815 - RNA, 22 nt, Human
agcaggcuuguuaugucugaga

SEQ ID NO: 989816 - RNA, 22 nt, Human
cuggggcucucuggaaugcuug

SEQ ID NO: 989817 - RNA, 20 nt, Human
cucugcugcccgccggcugc

SEQ ID NO: 989818 - RNA, 20 nt, Human
acugagcugcauggagagga

SEQ ID NO: 989819 - RNA, 21 nt, Human
uggcagacuagaguauagaug

SEQ ID NO: 989820 - RNA, 22 nt, Human
gccaggcuggccagcaccuucu

SEQ ID NO: 989821 - RNA, 22 nt, Human
cuucaagauccauagauauugc

SEQ ID NO: 989822 - RNA, 22 nt, Human
agaacuguccuuggaggagagu

SEQ ID NO: 989823 - RNA, 22 nt, Human
uaagaacagugacagccaacau

SEQ ID NO: 989824 - RNA, 23 nt, Human
aacugagauaauguauguaaagc

SEQ ID NO: 989825 - RNA, 22 nt, Human
aagcagugcgcucaucuaaggg

SEQ ID NO: 989826 - RNA, 22 nt, Human
ugccugcuaggcccugcugggu

SEQ ID NO: 989827 - RNA, 22 nt, Human
cacaccuguaauaccagcuacu

SEQ ID NO: 989828 - RNA, 22 nt, Human
ucauugcauuuauucacuggca

SEQ ID NO: 989829 - RNA, 22 nt, Human
uuugcauuuuagauuuaggccu

SEQ ID NO: 989830 - RNA, 22 nt, Human
ggugggugagcccugggagcug

SEQ ID NO: 989831 - RNA, 22 nt, Human
ucccagccuuccagucugguuu

SEQ ID NO: 989832 - RNA, 22 nt, Human
caguacuuguccucagguguua

SEQ ID NO: 989833 - RNA, 22 nt, Human
ggguggggcccaggaaaucuau

SEQ ID NO: 989834 - RNA, 22 nt, Human
aggcaugugacccuggacucag

SEQ ID NO: 989835 - RNA, 22 nt, Human
caguccuggggaccaggcugag

SEQ ID NO: 989836 - RNA, 22 nt, Human
uggcucaguggcagccgcagcu

SEQ ID NO: 989837 - RNA, 20 nt, Human
caggaggcaaggucaagguc

SEQ ID NO: 989838 - RNA, 22 nt, Human
uggaggagggcuggugucugua

SEQ ID NO: 989839 - RNA, 22 nt, Human
uaucuuugcaaauaucucuaag

SEQ ID NO: 989840 - RNA, 22 nt, Human
ucuggcugcugcgugagugcuu

SEQ ID NO: 989841 - RNA, 22 nt, Human
accugggagucacaccugagaa

SEQ ID NO: 989842 - RNA, 22 nt, Human
gcaaaaaaugcuuguugcuuag

SEQ ID NO: 989843 - RNA, 19 nt, Human
augagcuggcauuucaggu

SEQ ID NO: 989844 - RNA, 23 nt, Human
ugucuggcucauggugggucuca

SEQ ID NO: 989845 - RNA, 22 nt, Human
cuucucucccuggcacucagac

SEQ ID NO: 989846 - RNA, 22 nt, Human
uuuaauguucaucucaaaggau

SEQ ID NO: 989847 - RNA, 22 nt, Human
auugaaagaguuuucugcugca

SEQ ID NO: 989848 - RNA, 22 nt, Human
ugugucccuuggaaccucagcu

SEQ ID NO: 989849 - RNA, 22 nt, Human
ucuggaaguuagaggaggaaag

SEQ ID NO: 989850 - RNA, 22 nt, Human
ugguccuggggaucugcaguga

SEQ ID NO: 989851 - RNA, 18 nt, Human
auccuugaugagaggucu

SEQ ID NO: 989852 - RNA, 22 nt, Human
cacacaggaugaagcagcagaa

SEQ ID NO: 989853 - RNA, 22 nt, Human
cugggcaguuuuacaucauugc

SEQ ID NO: 989854 - RNA, 22 nt, Human
gcucccuccaugaggcagaccg

SEQ ID NO: 989855 - RNA, 22 nt, Human
ucccagagccucugccacucug

SEQ ID NO: 989856 - RNA, 22 nt, Human
ucuugcuaaagaccaacacauu

SEQ ID NO: 989857 - RNA, 20 nt, Human
aagagcugacucacaguggu

SEQ ID NO: 989858 - RNA, 22 nt, Human
cauuauguucaguagcuuaaaa

SEQ ID NO: 989859 - RNA, 22 nt, Human
gccugguggacacugggcauca

SEQ ID NO: 989860 - RNA, 18 nt, Human
acccucuggcuucugagc

SEQ ID NO: 989861 - RNA, 22 nt, Human
cccaugccuucugacucacagg

SEQ ID NO: 989862 - RNA, 19 nt, Human
cagagcugcuggccucguc

SEQ ID NO: 989863 - RNA, 22 nt, Human
auauuaggcaaggagauuauuu

SEQ ID NO: 989864 - RNA, 22 nt, Human
cucuccuccaacagcccugccg

SEQ ID NO: 989865 - RNA, 22 nt, Human
aagagcuggucacagguccauu

SEQ ID NO: 989866 - RNA, 22 nt, Human
uuggagcccugaggaucuggau

SEQ ID NO: 989867 - RNA, 22 nt, Human
uucaaacaguguagaauauaug

SEQ ID NO: 989868 - RNA, 22 nt, Human
uggcagggugggcuucagcccc

SEQ ID NO: 989869 - RNA, 22 nt, Human
uggcucaggccuacgacgccuu

SEQ ID NO: 989870 - RNA, 22 nt, Human
guucaaagcuccugguacagua

SEQ ID NO: 989871 - RNA, 22 nt, Human
caagggccuccaccuugcucgu

SEQ ID NO: 989872 - RNA, 22 nt, Human
gcagcugccgugagcucacgcc

SEQ ID NO: 989873 - RNA, 19 nt, Human
gcuggcagauguggccgug

SEQ ID NO: 989874 - RNA, 22 nt, Human
cugggaguguucuaggucacau

SEQ ID NO: 989875 - RNA, 20 nt, Human
aagggcagagggaacagacu

SEQ ID NO: 989876 - RNA, 22 nt, Human
uaggauaugguagaaaucauuc

SEQ ID NO: 989877 - RNA, 22 nt, Human
auccuugaacuuagacacuagg

SEQ ID NO: 989878 - RNA, 22 nt, Human
uuuccucuccggggccuccagg

SEQ ID NO: 989879 - RNA, 22 nt, Human
ugugacaugugucaucuuuucu

SEQ ID NO: 989880 - RNA, 22 nt, Human
ggcuucugagugcucugcuguu

SEQ ID NO: 989881 - RNA, 22 nt, Human
cauacuuuugcccugacauucu

SEQ ID NO: 989882 - RNA, 22 nt, Human
agcuuuauauuuaaugaauucu

SEQ ID NO: 989883 - RNA, 22 nt, Human
gaggccugaaaggggaccuaug

SEQ ID NO: 989884 - RNA, 22 nt, Human
aucagugcuaaagcaaaugccc

SEQ ID NO: 989885 - RNA, 22 nt, Human
ggcugcagcggauuggggauug

SEQ ID NO: 989886 - RNA, 22 nt, Human
cucaaggaaagucuggagaaga

SEQ ID NO: 989887 - RNA, 22 nt, Human
uuccauaaucaccuuauucuuu

SEQ ID NO: 989888 - RNA, 22 nt, Human
ccaggcuggauuuugcaguuca

SEQ ID NO: 989889 - RNA, 22 nt, Human
uccagggccaagucauggaacc

SEQ ID NO: 989890 - RNA, 19 nt, Human
agccuggagggcuggucac

SEQ ID NO: 989891 - RNA, 22 nt, Human
cucuggaaaaccacuagcagga

SEQ ID NO: 989892 - RNA, 22 nt, Human
uggcagucggacuucuaucuca

SEQ ID NO: 989893 - RNA, 22 nt, Human
gcguggugcugcccugcacaca

SEQ ID NO: 989894 - RNA, 22 nt, Human
gugcagugaaaaaagaaugucc

SEQ ID NO: 989895 - RNA, 22 nt, Human
gacacagcacuguacaaggaau

SEQ ID NO: 989896 - RNA, 22 nt, Human
gggccacauugaagggugggua

SEQ ID NO: 989897 - RNA, 19 nt, Human
gccugccuggguuucugag

SEQ ID NO: 989898 - RNA, 22 nt, Human
agcaggguauguuagagcugua

SEQ ID NO: 989899 - RNA, 22 nt, Human
uuaagaauggaaugaggaauuu

SEQ ID NO: 989900 - RNA, 22 nt, Human
gcccaggcuggagugcaguagc

SEQ ID NO: 989901 - RNA, 23 nt, Human
acucacaaagcaggaucauguug

SEQ ID NO: 989902 - RNA, 19 nt, Human
gagaggccugugcuugaag

SEQ ID NO: 989903 - RNA, 19 nt, Human
ugcagaagacacaguggug

SEQ ID NO: 989904 - RNA, 22 nt, Human
cucaggacccgguccagguggg

SEQ ID NO: 989905 - RNA, 22 nt, Human
ccugucuguccucucaugagcc

SEQ ID NO: 989906 - RNA, 20 nt, Human
agucccuuuggucagguauu

SEQ ID NO: 989907 - RNA, 18 nt, Human
gagguccugcucuagccc

SEQ ID NO: 989908 - RNA, 22 nt, Human
uggagggaacaaaggaguccca

SEQ ID NO: 989909 - RNA, 22 nt, Human
ugcuguagcccugcacagugca

SEQ ID NO: 989910 - RNA, 22 nt, Human
guggcagcaaaauccugcauuc

SEQ ID NO: 989911 - RNA, 22 nt, Human
ugugucagaaggcaauggggau

SEQ ID NO: 989912 - RNA, 22 nt, Human
gaaacccaaacuaagacaguag

SEQ ID NO: 989913 - RNA, 22 nt, Human
cugaagcacagcauauaaauaa

SEQ ID NO: 989914 - RNA, 22 nt, Human
cuggcagcauggagccugugcu

SEQ ID NO: 989915 - RNA, 22 nt, Human
agccccuuccaguucucagauc

SEQ ID NO: 989916 - RNA, 22 nt, Human
guuauguaucuugauugggugg

SEQ ID NO: 989917 - RNA, 22 nt, Human
aaaugugcuugugaucagcugu

SEQ ID NO: 989918 - RNA, 22 nt, Human
guugggaagcagauggaugagc

SEQ ID NO: 989919 - RNA, 22 nt, Human
cagcuggccugaucccuguggc

SEQ ID NO: 989920 - RNA, 22 nt, Human
uaacagaauagcagaaacagaa

SEQ ID NO: 989921 - RNA, 22 nt, Human
acuggcagcuguaggaugcaug

SEQ ID NO: 989922 - RNA, 22 nt, Human
cugucagcacucuacuacagau

SEQ ID NO: 989923 - RNA, 19 nt, Human
uuuggcacucugaaguguu

SEQ ID NO: 989924 - RNA, 22 nt, Human
agcugccacugagggugcacag

SEQ ID NO: 989925 - RNA, 22 nt, Human
caaaaguaauugcgguuuuugc

SEQ ID NO: 989926 - RNA, 21 nt, Human
aacauuucugggagaacucac

SEQ ID NO: 989927 - RNA, 22 nt, Human
acacuucuauucccugcacaaa

SEQ ID NO: 989928 - RNA, 19 nt, Human
ucauaaaaaugguaaccca

SEQ ID NO: 989929 - RNA, 22 nt, Human
gcauuuauuucuuuacugcauc

SEQ ID NO: 989930 - RNA, 22 nt, Human
cugugcugauucagcacaggcc

SEQ ID NO: 989931 - RNA, 22 nt, Human
ucucccaggcugcccuguggac

SEQ ID NO: 989932 - RNA, 22 nt, Human
uuccauaauuaaguggagagaa

SEQ ID NO: 989933 - RNA, 22 nt, Human
cagccaggccuggugaccaaag

SEQ ID NO: 989934 - RNA, 22 nt, Human
cugcagugcaagcccagaugga

SEQ ID NO: 989935 - RNA, 22 nt, Human
cgggcagaucacacagggcuug

SEQ ID NO: 989936 - RNA, 22 nt, Human
caucugccuaaguggcccuguu

SEQ ID NO: 989937 - RNA, 22 nt, Human
gggggcuggaauauccaucaac

SEQ ID NO: 989938 - RNA, 22 nt, Human
cuggccugagaaugcuacccuu

SEQ ID NO: 989939 - RNA, 22 nt, Human
uacuuacagagcuuauaaguua

SEQ ID NO: 989940 - RNA, 22 nt, Human
accaucagagcacaguccgugc

SEQ ID NO: 989941 - RNA, 22 nt, Human
ugcaccauuuugucaggcuacu

SEQ ID NO: 989942 - RNA, 22 nt, Human
uguuggcauuagaggguuauug

SEQ ID NO: 989943 - RNA, 22 nt, Human
aagucauuaucucuucuaaucu

SEQ ID NO: 989944 - RNA, 22 nt, Human
ucucuucuagcuucuugugguu

SEQ ID NO: 989945 - RNA, 22 nt, Human
cacugcaguaacucuaggacug

SEQ ID NO: 989946 - RNA, 22 nt, Human
acacauaagaaacuacaaagag

SEQ ID NO: 989947 - RNA, 22 nt, Human
agucucagaaaagaagcaugga

SEQ ID NO: 989948 - RNA, 22 nt, Human
gaggagagagggacugucugca

SEQ ID NO: 989949 - RNA, 21 nt, Human
agcugccacccuagcuucuga

SEQ ID NO: 989950 - RNA, 22 nt, Human
agcagcugagaugguaagauuc

SEQ ID NO: 989951 - RNA, 22 nt, Human
gagcagaacuacucacauaucg

SEQ ID NO: 989952 - RNA, 22 nt, Human
ucaggacagccagggugcagac

SEQ ID NO: 989953 - RNA, 22 nt, Human
guguacauagaauugugcuuug

SEQ ID NO: 989954 - RNA, 22 nt, Human
aaauauguaagauuagcacuag

SEQ ID NO: 989955 - RNA, 22 nt, Human
uggugugggcguggcaggcaag

SEQ ID NO: 989956 - RNA, 22 nt, Human
uugcauguuauuuaaucuguau

SEQ ID NO: 989957 - RNA, 22 nt, Human
agggaaggaaaagcugucgcuu

SEQ ID NO: 989958 - RNA, 22 nt, Human
ucugccuggaugauggcagggc

SEQ ID NO: 989959 - RNA, 22 nt, Human
ucugagaguacgggcugcgcgc

SEQ ID NO: 989960 - RNA, 22 nt, Human
acagggucaagggugcuacaag

SEQ ID NO: 989961 - RNA, 22 nt, Human
gcucagagauguucaguagcuu

SEQ ID NO: 989962 - RNA, 22 nt, Human
cuauuagguaugugguugcuau

SEQ ID NO: 989963 - RNA, 22 nt, Human
ugggcagagaucuggaucaaac

SEQ ID NO: 989964 - RNA, 22 nt, Human
aaggcacugcuuugcugcgccc

SEQ ID NO: 989965 - RNA, 22 nt, Human
ccucaggguggcaucagaucuu

SEQ ID NO: 989966 - RNA, 22 nt, Human
acugaaggaaagccuuugcaug

SEQ ID NO: 989967 - RNA, 22 nt, Human
agauguguuucuaguuccugca

SEQ ID NO: 989968 - RNA, 22 nt, Human
uacaaagugugcccaugcugag

SEQ ID NO: 989969 - RNA, 22 nt, Human
uggaggagaauuuauggucgaa

SEQ ID NO: 989970 - RNA, 22 nt, Human
cagggcagccaggccccguggg

SEQ ID NO: 989971 - RNA, 22 nt, Human
agacagcaugauacaugaugcu

SEQ ID NO: 989972 - RNA, 22 nt, Human
guugaaaugagggauuaaucag

SEQ ID NO: 989973 - RNA, 22 nt, Human
ggcagcuggccuccucgcccac

SEQ ID NO: 989974 - RNA, 22 nt, Human
ugggaggacuugugggcuucau

SEQ ID NO: 989975 - RNA, 22 nt, Human
gcugcucuugaggggcucacug

SEQ ID NO: 989976 - RNA, 22 nt, Human
aucuggcuuucuuaaugacuua

SEQ ID NO: 989977 - RNA, 22 nt, Human
ggagaggugaauggcugcucua

SEQ ID NO: 989978 - RNA, 22 nt, Human
gugucaugggagucagaaguga

SEQ ID NO: 989979 - RNA, 22 nt, Human
ucugcugcacaaauucaucucu

SEQ ID NO: 989980 - RNA, 19 nt, Human
aggaaagguggccuuagca

SEQ ID NO: 989981 - RNA, 22 nt, Human
gagaggcuaugagguucugugu

SEQ ID NO: 989982 - RNA, 22 nt, Human
uacaggaggauuaucaaaggau

SEQ ID NO: 989983 - RNA, 22 nt, Human
agccuggaggaggaguugagca

SEQ ID NO: 989984 - RNA, 22 nt, Human
acagccagggcauugucgccga

SEQ ID NO: 989985 - RNA, 22 nt, Human
uaccugagcccagugcagcaua

SEQ ID NO: 989986 - RNA, 22 nt, Human
ggcuccuggcaucuggugggua

SEQ ID NO: 989987 - RNA, 22 nt, Human
uggagggaacccaggcugcucu

SEQ ID NO: 989988 - RNA, 22 nt, Human
cccaggcucccaggugggacaa

SEQ ID NO: 989989 - RNA, 17 nt, Human
ggagagugggaauggcc

SEQ ID NO: 989990 - RNA, 22 nt, Human
ucugcaggaaaaaagugccugg

SEQ ID NO: 989991 - RNA, 22 nt, Human
acauuucuccuugcaggaguca

SEQ ID NO: 989992 - RNA, 22 nt, Human
cagcugaggucaaagaagcagg

SEQ ID NO: 989993 - RNA, 22 nt, Human
ggggccuguagagcuucaggga

SEQ ID NO: 989994 - RNA, 20 nt, Human
gucagaggacccuagagcga

SEQ ID NO: 989995 - RNA, 22 nt, Human
ggcuggaaguccaagaucaagg

SEQ ID NO: 989996 - RNA, 22 nt, Human
ugcugagaaucacagguuauaa

SEQ ID NO: 989997 - RNA, 22 nt, Human
gcugccaccguggagaugagug

SEQ ID NO: 989998 - RNA, 22 nt, Human
augcagguugggcaaguguggg

SEQ ID NO: 989999 - RNA, 22 nt, Human
uaaccauauuuuccauuaaguu

SEQ ID NO: 990000 - RNA, 22 nt, Human
gauccuugcaacucugugaggu

SEQ ID NO: 990001 - RNA, 21 nt, Human
acccuggguucuccauacccu

SEQ ID NO: 990002 - RNA, 22 nt, Human
gcccacagcucguuccucuccu

SEQ ID NO: 990003 - RNA, 22 nt, Human
caggcagcugcuggguucagcc

SEQ ID NO: 990004 - RNA, 22 nt, Human
agggaguguaaauggugcucag

SEQ ID NO: 990005 - RNA, 22 nt, Human
gggccaaggggagcuggaaggg

SEQ ID NO: 990006 - RNA, 22 nt, Human
cugaaggauucaaaauggcagg

SEQ ID NO: 990007 - RNA, 23 nt, Human
aagaauaaaugacauuaaaggug

SEQ ID NO: 990008 - RNA, 22 nt, Human
ggcagcucugaugaugcucugg

SEQ ID NO: 990009 - RNA, 22 nt, Human
aggccugcagcaggagcaaacc

SEQ ID NO: 990010 - RNA, 22 nt, Human
uaggccaguggcagguugugug

SEQ ID NO: 990011 - RNA, 22 nt, Human
cacuguaucuuuuccaaagucu

SEQ ID NO: 990012 - RNA, 18 nt, Human
gccugggaggaggaaaug

SEQ ID NO: 990013 - RNA, 22 nt, Human
caguacuuuucuggcuuucuac

SEQ ID NO: 990014 - RNA, 23 nt, Human
agccacuucuaucuugcuccugg

SEQ ID NO: 990015 - RNA, 22 nt, Human
gccagcaguccugcugugugcc

SEQ ID NO: 990016 - RNA, 22 nt, Human
aauuaggagaaaacuguugucu

SEQ ID NO: 990017 - RNA, 22 nt, Human
ggguccagacacuccagaggaa

SEQ ID NO: 990018 - RNA, 22 nt, Human
ugagcccaggaguuggaggcug

SEQ ID NO: 990019 - RNA, 22 nt, Human
ugggcaggaugcguugauucuu

SEQ ID NO: 990020 - RNA, 22 nt, Human
ucauugcacuccagccugggca

SEQ ID NO: 990021 - RNA, 22 nt, Human
caggccucuauggucagcugag

SEQ ID NO: 990022 - RNA, 22 nt, Human
ugucccagguccuagaugacca

SEQ ID NO: 990023 - RNA, 22 nt, Human
gcuggggcugggcugaggaaga

SEQ ID NO: 990024 - RNA, 22 nt, Human
aaugcacaugucuuggccucac

SEQ ID NO: 990025 - RNA, 22 nt, Human
ucugagagcuguagaagccuau

SEQ ID NO: 990026 - RNA, 22 nt, Human
agcugggaggugggcagugaga

SEQ ID NO: 990027 - RNA, 22 nt, Human
guucacaauggcuuuaccuaag

SEQ ID NO: 990028 - RNA, 22 nt, Human
caucugcuguuccuuggacuca

SEQ ID NO: 990029 - RNA, 19 nt, Human
gcaggcaguggcauucgga

SEQ ID NO: 990030 - RNA, 22 nt, Human
gagcacaggcuuugguggacac

SEQ ID NO: 990031 - RNA, 22 nt, Human
ugugcccauuacacagaggcau

SEQ ID NO: 990032 - RNA, 22 nt, Human
uuuccucuuuguaccuugacua

SEQ ID NO: 990033 - RNA, 22 nt, Human
aaggcacucagccuugggacag

SEQ ID NO: 990034 - RNA, 22 nt, Human
agggcagaaauauugauacugu

SEQ ID NO: 990035 - RNA, 22 nt, Human
gugugccaccagucaaggugaa

SEQ ID NO: 990036 - RNA, 22 nt, Human
uucaucaauguguuuaauaaug

SEQ ID NO: 990037 - RNA, 22 nt, Human
acacugaauguuuaagaacuug

SEQ ID NO: 990038 - RNA, 22 nt, Human
aggaagaauguuuacauaucaa

SEQ ID NO: 990039 - RNA, 22 nt, Human
acaguaaugauucugagucucu

SEQ ID NO: 990040 - RNA, 21 nt, Human
aaagagguuaauauuguaagu

SEQ ID NO: 990041 - RNA, 22 nt, Human
ugggcugcccaagguggccaug

SEQ ID NO: 990042 - RNA, 22 nt, Human
gugcuuaauacaugucaauaac

SEQ ID NO: 990043 - RNA, 22 nt, Human
aggucaaaccacagcucuaggc

SEQ ID NO: 990044 - RNA, 22 nt, Human
ugccugagugauguggcagcca

SEQ ID NO: 990045 - RNA, 22 nt, Human
uuuaauuaggaaaugggcaggg

SEQ ID NO: 990046 - RNA, 21 nt, Human
cccagggaagccgcagucacc

SEQ ID NO: 990047 - RNA, 20 nt, Human
uguauauuuucugguguaaa

SEQ ID NO: 990048 - RNA, 22 nt, Human
gcugccuguguggccacucacu

SEQ ID NO: 990049 - RNA, 22 nt, Human
gauuucaaccuaacaguaugac

SEQ ID NO: 990050 - RNA, 22 nt, Human
uagaacaugugaaaauauagcc

SEQ ID NO: 990051 - RNA, 22 nt, Human
uacagucuuuggaaagagauag

SEQ ID NO: 990052 - RNA, 22 nt, Human
aaagccuugagauccuauaguu

SEQ ID NO: 990053 - RNA, 22 nt, Human
ggcuggccucaggguccucgcu

SEQ ID NO: 990054 - RNA, 22 nt, Human
ccucuuccacugggccccaucc

SEQ ID NO: 990055 - RNA, 21 nt, Human
aaaaugugagcgugaugcuua

SEQ ID NO: 990056 - RNA, 22 nt, Human
gcuguuccugcuuagaggucgg

SEQ ID NO: 990057 - RNA, 22 nt, Human
guacaugucaaaaaaugcauaa

SEQ ID NO: 990058 - RNA, 22 nt, Human
ugcaggccucacaccuggcacc

SEQ ID NO: 990059 - RNA, 22 nt, Human
cuccuggcacugucuugaccca

SEQ ID NO: 990060 - RNA, 22 nt, Human
agggacacacuccaguguuauu

SEQ ID NO: 990061 - RNA, 22 nt, Human
guguguccaggcgggagucaag

SEQ ID NO: 990062 - RNA, 22 nt, Human
ccuuugggugaauuccucucuu

SEQ ID NO: 990063 - RNA, 22 nt, Human
cuuauguauaauguuccacaua

SEQ ID NO: 990064 - RNA, 19 nt, Human
ggcagaagguguaggggga

SEQ ID NO: 990065 - RNA, 23 nt, Human
aucaaaguggaaaucaauuaucu

SEQ ID NO: 990066 - RNA, 22 nt, Human
uaucuacaggugucagguaaga

SEQ ID NO: 990067 - RNA, 22 nt, Human
uggcugaauaaaauaugguguu

SEQ ID NO: 990068 - RNA, 22 nt, Human
cagcucccagagugaccagcag

SEQ ID NO: 990069 - RNA, 22 nt, Human
agccaggaaccagcuacagucu

SEQ ID NO: 990070 - RNA, 22 nt, Human
cuggcucaauuuguacugcugu

SEQ ID NO: 990071 - RNA, 22 nt, Human
agagccagcauuugacacuggc

SEQ ID NO: 990072 - RNA, 22 nt, Human
aaaggucaaaaucgugacauug

SEQ ID NO: 990073 - RNA, 22 nt, Human
uauccuuguacuauaguauuua

SEQ ID NO: 990074 - RNA, 22 nt, Human
ccagccugguucagaauuggcu

SEQ ID NO: 990075 - RNA, 20 nt, Human
cuucaggacccauccucccc

SEQ ID NO: 990076 - RNA, 22 nt, Human
ugaagcaguuacuggguguuaa

SEQ ID NO: 990077 - RNA, 22 nt, Human
aguccuucaagaaaucuggaaa

SEQ ID NO: 990078 - RNA, 17 nt, Human
ccucccacaccgcccug

SEQ ID NO: 990079 - RNA, 22 nt, Human
aggcccugggcaguucuguagc

SEQ ID NO: 990080 - RNA, 22 nt, Human
ugaggccaaugacccugggcag

SEQ ID NO: 990081 - RNA, 22 nt, Human
guugaaauuugugauaauuuag

SEQ ID NO: 990082 - RNA, 22 nt, Human
guuugcauggaagacagugagu

SEQ ID NO: 990083 - RNA, 19 nt, Human
ugcuagaaauucugugacu

SEQ ID NO: 990084 - RNA, 22 nt, Human
gggcugcacguauucugcucac

SEQ ID NO: 990085 - RNA, 22 nt, Human
aacuagaaccacuuguauuucc

SEQ ID NO: 990086 - RNA, 22 nt, Human
aacuucugggcuguccaaaacu

SEQ ID NO: 990087 - RNA, 22 nt, Human
auuuguaauuucuuaucugugu

SEQ ID NO: 990088 - RNA, 19 nt, Human
ugccagcauuaggcugaag

SEQ ID NO: 990089 - RNA, 22 nt, Human
gagagcccugcuccuaucccag

SEQ ID NO: 990090 - RNA, 21 nt, Human
augacagaugcugcagaucgu

SEQ ID NO: 990091 - RNA, 22 nt, Human
cacagcagaaauaugaaggcag

SEQ ID NO: 990092 - RNA, 22 nt, Human
ccuggaaggcaggcauggauug

SEQ ID NO: 990093 - RNA, 22 nt, Human
cugugcuggcagaccuggaguu

SEQ ID NO: 990094 - RNA, 22 nt, Human
ucacucugucccccauugagau

SEQ ID NO: 990095 - RNA, 22 nt, Human
ugaaggugucuuugugaacauc

SEQ ID NO: 990096 - RNA, 22 nt, Human
agccucuggcccuagacugcuu

SEQ ID NO: 990097 - RNA, 18 nt, Human
ggcugccuguuccugaag

SEQ ID NO: 990098 - RNA, 22 nt, Human
gggccuguguguucaggagccu

SEQ ID NO: 990099 - RNA, 19 nt, Human
guggccugcgcugggugcg

SEQ ID NO: 990100 - RNA, 22 nt, Human
aaggcccuaauagagcacauau

SEQ ID NO: 990101 - RNA, 22 nt, Human
uccagccaacugccuagggagc

SEQ ID NO: 990102 - RNA, 22 nt, Human
ggucugaguagagggcuggcga

SEQ ID NO: 990103 - RNA, 22 nt, Human
acucugacuggagugagagagg

SEQ ID NO: 990104 - RNA, 22 nt, Human
aauguacaaaagucagccaacu

SEQ ID NO: 990105 - RNA, 22 nt, Human
ccuggccauagggcccaggaaa

SEQ ID NO: 990106 - RNA, 22 nt, Human
ugcugaaagucccaaaucucau

SEQ ID NO: 990107 - RNA, 23 nt, Human
ggccacaaauagucuccccuggc

SEQ ID NO: 990108 - RNA, 22 nt, Human
ccuggagauuauuugguccaau

SEQ ID NO: 990109 - RNA, 22 nt, Human
gcagagccccucaagccagccu

SEQ ID NO: 990110 - RNA, 22 nt, Human
uaguuuaaaaguuagggaugau

SEQ ID NO: 990111 - RNA, 22 nt, Human
ccugccugggcucacuugccag

SEQ ID NO: 990112 - RNA, 22 nt, Human
cagacuugacggcagcugcuuu

SEQ ID NO: 990113 - RNA, 20 nt, Human
ugcuggggacauacagggug

SEQ ID NO: 990114 - RNA, 23 nt, Human
cccuggaguaaauucuuggaagg

SEQ ID NO: 990115 - RNA, 20 nt, Human
cagccuccacucacucagcu

SEQ ID NO: 990116 - RNA, 22 nt, Human
gccagguggcugagcagcugca

SEQ ID NO: 990117 - RNA, 22 nt, Human
agucccagacuccaguuuucug

SEQ ID NO: 990118 - RNA, 22 nt, Human
auuaggcagggcaugguggcuc

SEQ ID NO: 990119 - RNA, 22 nt, Human
agcuuuguauuugagcauacga

SEQ ID NO: 990120 - RNA, 22 nt, Human
auggccaagaaguauuccugac

SEQ ID NO: 990121 - RNA, 22 nt, Human
gcagguggauuaucagaagugc

SEQ ID NO: 990122 - RNA, 23 nt, Human
gcccaugcuguugggcccgagca

SEQ ID NO: 990123 - RNA, 22 nt, Human
agugcauauaugaagaguauga

SEQ ID NO: 990124 - RNA, 22 nt, Human
ggcagccaugucccagggcuuc

SEQ ID NO: 990125 - RNA, 21 nt, Human
auccauccaucuuggccuaac

SEQ ID NO: 990126 - RNA, 22 nt, Human
uauguacaccggggaagguggg

SEQ ID NO: 990127 - RNA, 22 nt, Human
uguggcucucaugcacucccag

SEQ ID NO: 990128 - RNA, 22 nt, Human
cuggugagacgguugacaggag

SEQ ID NO: 990129 - RNA, 21 nt, Human
ucucuggaauuagaccauguu

SEQ ID NO: 990130 - RNA, 22 nt, Human
cugggcagugguggcccuuccc

SEQ ID NO: 990131 - RNA, 22 nt, Human
gucucccaaccccugugcccag

SEQ ID NO: 990132 - RNA, 22 nt, Human
gagcagugggaaggaacagggu

SEQ ID NO: 990133 - RNA, 22 nt, Human
agaacagcagcacgucaagcug

SEQ ID NO: 990134 - RNA, 22 nt, Human
gagggcugauaacaggaauaca

SEQ ID NO: 990135 - RNA, 22 nt, Human
gggacaggccccucgcuagcuu

SEQ ID NO: 990136 - RNA, 22 nt, Human
agcuguucccucacugcaguca

SEQ ID NO: 990137 - RNA, 22 nt, Human
gaaggccuagggaugcucugcg

SEQ ID NO: 990138 - RNA, 22 nt, Human
uggcgugcccuccagacuuggc

SEQ ID NO: 990139 - RNA, 22 nt, Human
uuugacaggacuaacauauggc

SEQ ID NO: 990140 - RNA, 22 nt, Human
cacaggcugcccgcagcuggga

SEQ ID NO: 990141 - RNA, 22 nt, Human
cacaggagagcugggaggugcc

SEQ ID NO: 990142 - RNA, 22 nt, Human
acugagcugcaagucagggagg

SEQ ID NO: 990143 - RNA, 22 nt, Human
cagggcagcuuccuuuguuagg

SEQ ID NO: 990144 - RNA, 22 nt, Human
uggcucagcuuacuuuugaggg

SEQ ID NO: 990145 - RNA, 22 nt, Human
caggcuugcugcuagagcacuu

SEQ ID NO: 990146 - RNA, 22 nt, Human
agaggagcugggaggcccucgu

SEQ ID NO: 990147 - RNA, 22 nt, Human
cacagggcagaggguccguggc

SEQ ID NO: 990148 - RNA, 21 nt, Human
gccauuguuuucuaccuggag

SEQ ID NO: 990149 - RNA, 22 nt, Human
cuggagcauccaugcccagggu

SEQ ID NO: 990150 - RNA, 22 nt, Human
cuccucuggaaauuccucugcc

SEQ ID NO: 990151 - RNA, 22 nt, Human
uguacacugcaggaugcauugc

SEQ ID NO: 990152 - RNA, 21 nt, Human
uccacaaguuagaaggaaauu

SEQ ID NO: 990153 - RNA, 22 nt, Human
ugcauuaugcuugugcuguaua

SEQ ID NO: 990154 - RNA, 22 nt, Human
uggcuccuaucaaggagugggu

SEQ ID NO: 990155 - RNA, 22 nt, Human
aaaucaguuguuauauuaaaga

SEQ ID NO: 990156 - RNA, 22 nt, Human
uuaacagauguuuauggagcau

SEQ ID NO: 990157 - RNA, 22 nt, Human
agcugagagguggcaagcugua

SEQ ID NO: 990158 - RNA, 22 nt, Human
ccagacuguggaguuccuggug

SEQ ID NO: 990159 - RNA, 22 nt, Human
aucuggcuuacgaagcacuggu

SEQ ID NO: 990160 - RNA, 22 nt, Human
cagggccagcgucucgggcuau

SEQ ID NO: 990161 - RNA, 23 nt, Human
cugucuccugggcuagguggaau

SEQ ID NO: 990162 - RNA, 22 nt, Human
ccugggugaugugcugcccucg

SEQ ID NO: 990163 - RNA, 22 nt, Human
ggcuggguuauuuauggccaag

SEQ ID NO: 990164 - RNA, 22 nt, Human
cccuggaggcggagcuugcagu

SEQ ID NO: 990165 - RNA, 22 nt, Human
aggcccugcccagagcuccucg

SEQ ID NO: 990166 - RNA, 22 nt, Human
cagaaugagauaacccagauug

SEQ ID NO: 990167 - RNA, 22 nt, Human
gcucucuggaggccauggacag

SEQ ID NO: 990168 - RNA, 22 nt, Human
agugacucacuagcucucagug

SEQ ID NO: 990169 - RNA, 22 nt, Human
cugggccuggcguuccaggcug

SEQ ID NO: 990170 - RNA, 22 nt, Human
ugggcuggcguggagaguuuag

SEQ ID NO: 990171 - RNA, 22 nt, Human
cacugaagcuuucauucucuug

SEQ ID NO: 990172 - RNA, 22 nt, Human
gcucccugcacucugcagcccu

SEQ ID NO: 990173 - RNA, 22 nt, Human
cagcuuuguccugcaaaccuga

SEQ ID NO: 990174 - RNA, 22 nt, Human
cagagccaacgccaccugccca

SEQ ID NO: 990175 - RNA, 22 nt, Human
uaaauucccaacucugcucuuc

SEQ ID NO: 990176 - RNA, 22 nt, Human
ucucagaggugcccuggcaucu

SEQ ID NO: 990177 - RNA, 22 nt, Human
agcuugccucuuaaucaccuca

SEQ ID NO: 990178 - RNA, 22 nt, Human
aggggaggagcuuuucuugccu

SEQ ID NO: 990179 - RNA, 22 nt, Human
auuaaauacugcaggcuaagca

SEQ ID NO: 990180 - RNA, 22 nt, Human
ggcagggugccuggcuccuguu

SEQ ID NO: 990181 - RNA, 22 nt, Human
acugccuugaaagauuguugag

SEQ ID NO: 990182 - RNA, 22 nt, Human
aaugcacauaaauauggucuua

SEQ ID NO: 990183 - RNA, 22 nt, Human
cucuccuugcagauggcugccu

SEQ ID NO: 990184 - RNA, 22 nt, Human
guuccuauauagccuuaaggau

SEQ ID NO: 990185 - RNA, 20 nt, Human
aacagggggcugcagagggc

SEQ ID NO: 990186 - RNA, 22 nt, Human
agggcaaguugagugugcgugg

SEQ ID NO: 990187 - RNA, 22 nt, Human
caggguccaucuuucaucacug

SEQ ID NO: 990188 - RNA, 22 nt, Human
gagagcuguuuaucuucuucaa

SEQ ID NO: 990189 - RNA, 22 nt, Human
ucccaaggcacagggcagggac

SEQ ID NO: 990190 - RNA, 22 nt, Human
aaauugugagcuauagaucuag

SEQ ID NO: 990191 - RNA, 20 nt, Human
uguuucuuuuaaugagcggc

SEQ ID NO: 990192 - RNA, 22 nt, Human
gcaggcuccaggccggccccuu

SEQ ID NO: 990193 - RNA, 22 nt, Human
aacugcuggggaggccaaacuc

SEQ ID NO: 990194 - RNA, 22 nt, Human
cuuguccuuuacuugagacuca

SEQ ID NO: 990195 - RNA, 22 nt, Human
cccagcauggagugaggacuca

SEQ ID NO: 990196 - RNA, 21 nt, Human
cagaaguaaggguaacuucuc

SEQ ID NO: 990197 - RNA, 22 nt, Human
ggugaggcuaagugacacaggg

SEQ ID NO: 990198 - RNA, 22 nt, Human
uacauuaucuuguuaucuuuca

SEQ ID NO: 990199 - RNA, 22 nt, Human
ucucuccuuaucauuguguuua

SEQ ID NO: 990200 - RNA, 22 nt, Human
ucagaggauugccucagcgagc

SEQ ID NO: 990201 - RNA, 23 nt, Human
agcagggccagaauacuugcugu

SEQ ID NO: 990202 - RNA, 20 nt, Human
gcagcugaaaguaugacacc

SEQ ID NO: 990203 - RNA, 22 nt, Human
ucuagaaaaaaacugcugugga

SEQ ID NO: 990204 - RNA, 22 nt, Human
cagggccugccugguuccugga

SEQ ID NO: 990205 - RNA, 22 nt, Human
ccuccugguugcaaugaaaugg

SEQ ID NO: 990206 - RNA, 22 nt, Human
ugcccugugugugcaagcacug

SEQ ID NO: 990207 - RNA, 22 nt, Human
gcugucuccauagcuguguguc

SEQ ID NO: 990208 - RNA, 22 nt, Human
aaguucaaggaagccuccaguu

SEQ ID NO: 990209 - RNA, 22 nt, Human
aacaguaaugugguguuggguu

SEQ ID NO: 990210 - RNA, 22 nt, Human
cugcugcucagugucaucaugu

SEQ ID NO: 990211 - RNA, 22 nt, Human
aauaugucugcuaauuguuucu

SEQ ID NO: 990212 - RNA, 22 nt, Human
cccuggggcugagggauggccg

SEQ ID NO: 990213 - RNA, 22 nt, Human
uugaaaaguuuugaaacacucu

SEQ ID NO: 990214 - RNA, 22 nt, Human
gcugccuggaauaacggcuggc

SEQ ID NO: 990215 - RNA, 19 nt, Human
agauggggaagagugugag

SEQ ID NO: 990216 - RNA, 22 nt, Human
aaagaaauagauggcauuuaaa

SEQ ID NO: 990217 - RNA, 22 nt, Human
uggaaggcaacggagugagcug

SEQ ID NO: 990218 - RNA, 22 nt, Human
ucugcaggaggcuggcugcagg

SEQ ID NO: 990219 - RNA, 22 nt, Human
agacauaagugcuaugacauug

SEQ ID NO: 990220 - RNA, 22 nt, Human
ggcacugacacuagcauggcac

SEQ ID NO: 990221 - RNA, 19 nt, Human
auaaggcaggaggaaauuu

SEQ ID NO: 990222 - RNA, 22 nt, Human
caggcagcugggucaccguccc

SEQ ID NO: 990223 - RNA, 22 nt, Human
ucaguggauauuucuguggcug

SEQ ID NO: 990224 - RNA, 22 nt, Human
aaaugcauuuuuaauuagaccc

SEQ ID NO: 990225 - RNA, 23 nt, Human
uggcuggcagaaacugaagcaug

SEQ ID NO: 990226 - RNA, 22 nt, Human
uaaaugcagcaguuucuguucu

SEQ ID NO: 990227 - RNA, 22 nt, Human
gcaggguccauggaggcagccc

SEQ ID NO: 990228 - RNA, 22 nt, Human
agagcugagaauguggcuuccu

SEQ ID NO: 990229 - RNA, 22 nt, Human
uucuuuccucccagccuuugga

SEQ ID NO: 990230 - RNA, 22 nt, Human
cccaaggccucuccuuggcuug

SEQ ID NO: 990231 - RNA, 22 nt, Human
cagcuggcuccaccucugggcu

SEQ ID NO: 990232 - RNA, 22 nt, Human
ccagcuggugggucuuucucug

SEQ ID NO: 990233 - RNA, 22 nt, Human
uuacaaagagaaguuguagaau

SEQ ID NO: 990234 - RNA, 22 nt, Human
caaauguguuuuuucuucuaca

SEQ ID NO: 990235 - RNA, 22 nt, Human
caggccugugacaccgugucug

SEQ ID NO: 990236 - RNA, 22 nt, Human
aggcugagauagguggaucauu

SEQ ID NO: 990237 - RNA, 22 nt, Human
uccuguuaguguuagacuuccc

SEQ ID NO: 990238 - RNA, 19 nt, Human
ccuggguccacucagacua

SEQ ID NO: 990239 - RNA, 22 nt, Human
uaagaacaucuguccccagauu

SEQ ID NO: 990240 - RNA, 22 nt, Human
uauacuuuccugcaacuuugau

SEQ ID NO: 990241 - RNA, 22 nt, Human
ccaaggcuggagugcaguggcg

SEQ ID NO: 990242 - RNA, 22 nt, Human
auguauguuaguguauuaucua

SEQ ID NO: 990243 - RNA, 22 nt, Human
uagcaggguccaaugugaggca

SEQ ID NO: 990244 - RNA, 22 nt, Human
gaguaagagcuggcuuuggugu

SEQ ID NO: 990245 - RNA, 22 nt, Human
cucucugguacauagaguuugg

SEQ ID NO: 990246 - RNA, 22 nt, Human
gguggcagcgucuaucugacau

SEQ ID NO: 990247 - RNA, 22 nt, Human
acauuguagacuuuucauaugu

SEQ ID NO: 990248 - RNA, 22 nt, Human
ucacugcaaggaggcuucucaa

SEQ ID NO: 990249 - RNA, 19 nt, Human
ugcucauggggacuucucc

SEQ ID NO: 990250 - RNA, 22 nt, Human
aggugcagcugguggagucugg

SEQ ID NO: 990251 - RNA, 22 nt, Human
cugcucuggggaagccagaugu

SEQ ID NO: 990252 - RNA, 22 nt, Human
aggaagcucggagagggcaaau

SEQ ID NO: 990253 - RNA, 22 nt, Human
gagacagaguuucacucuuguu

SEQ ID NO: 990254 - RNA, 22 nt, Human
cugccuuggcccuaguucaugg

SEQ ID NO: 990255 - RNA, 22 nt, Human
ccugggcaggaugggcccggug

SEQ ID NO: 990256 - RNA, 22 nt, Human
guauuaggaaauaugaagaaag

SEQ ID NO: 990257 - RNA, 22 nt, Human
uccucagaaaccccugugaggu

SEQ ID NO: 990258 - RNA, 22 nt, Human
gaacccaaaccuggaccucccu

SEQ ID NO: 990259 - RNA, 22 nt, Human
guucauuuaugauguaacaugu

SEQ ID NO: 990260 - RNA, 22 nt, Human
agaaugcuccagagcugaaaga

SEQ ID NO: 990261 - RNA, 22 nt, Human
cagcugcaguucaaugcuugcu

SEQ ID NO: 990262 - RNA, 21 nt, Human
cauugucgacauuuuccccuc

SEQ ID NO: 990263 - RNA, 22 nt, Human
guaggcagucucucaggugauc

SEQ ID NO: 990264 - RNA, 22 nt, Human
uacuuuuugucucuuugaaugu

SEQ ID NO: 990265 - RNA, 22 nt, Human
aaucaguuaggguguuaaugag

SEQ ID NO: 990266 - RNA, 22 nt, Human
gcugugugacugagagccuggc

SEQ ID NO: 990267 - RNA, 22 nt, Human
uagaaguuaaaggaauacagaa

SEQ ID NO: 990268 - RNA, 22 nt, Human
ugggaggcuuccagaccuugcu

SEQ ID NO: 990269 - RNA, 22 nt, Human
ucaagauaccaccauuauaugu

SEQ ID NO: 990270 - RNA, 23 nt, Human
aagcugccagucugaagccuggg

SEQ ID NO: 990271 - RNA, 22 nt, Human
uggggccuggucagagcugcac

SEQ ID NO: 990272 - RNA, 22 nt, Human
aaaugaguuuccucaauguccu

SEQ ID NO: 990273 - RNA, 22 nt, Human
uccugcagagacagaggccuca

SEQ ID NO: 990274 - RNA, 22 nt, Human
uaagaagcuucugcuaaugccu

SEQ ID NO: 990275 - RNA, 22 nt, Human
uucuuuccccauggaguucgga

SEQ ID NO: 990276 - RNA, 22 nt, Human
cuuaggauuuaauuucagacuc

SEQ ID NO: 990277 - RNA, 22 nt, Human
gggcuggaggaccggccucgga

SEQ ID NO: 990278 - RNA, 22 nt, Human
cacauguacagaagcaggcugg

SEQ ID NO: 990279 - RNA, 20 nt, Human
uccuugaaagugggguauau

SEQ ID NO: 990280 - RNA, 22 nt, Human
acuuuauuuccuauugcaucca

SEQ ID NO: 990281 - RNA, 22 nt, Human
uuggcugaagguuaagugcugg

SEQ ID NO: 990282 - RNA, 22 nt, Human
uguaggacauguacuuguaaca

SEQ ID NO: 990283 - RNA, 22 nt, Human
aaagaaggaccuggaggaggau

SEQ ID NO: 990284 - RNA, 22 nt, Human
gaaucacgguauucugcacggg

SEQ ID NO: 990285 - RNA, 19 nt, Human
gcagcugugggaagagcca

SEQ ID NO: 990286 - RNA, 22 nt, Human
ugggcugcugucugcacaugcu

SEQ ID NO: 990287 - RNA, 22 nt, Human
cuggaagguuccucccagcucc

SEQ ID NO: 990288 - RNA, 16 nt, Human
ccacagggcaaggggc

SEQ ID NO: 990289 - RNA, 22 nt, Human
uuuauuuggcaucucugccaag

SEQ ID NO: 990290 - RNA, 22 nt, Human
auauaaaguguuuagaaagcug

SEQ ID NO: 990291 - RNA, 22 nt, Human
gcugucacaucaaggcacuaaa

SEQ ID NO: 990292 - RNA, 22 nt, Human
aggcucugugacaaucaagcug

SEQ ID NO: 990293 - RNA, 17 nt, Human
aauagcugcucagagag

SEQ ID NO: 990294 - RNA, 22 nt, Human
gcucucuguuauuaagaucuuu

SEQ ID NO: 990295 - RNA, 22 nt, Human
gcugagugagguccagagcuug

SEQ ID NO: 990296 - RNA, 22 nt, Human
caaaaguaauugugguuuuugc

SEQ ID NO: 990297 - RNA, 22 nt, Human
uuccauuuauucuuguccagau

SEQ ID NO: 990298 - RNA, 22 nt, Human
ccuccagggcagacggggagca

SEQ ID NO: 990299 - RNA, 20 nt, Human
ccagagcugauggcugcccg

SEQ ID NO: 990300 - RNA, 22 nt, Human
gugcagagaaaugagaagucga

SEQ ID NO: 990301 - RNA, 22 nt, Human
gcagggcuauuggaaggagaug

SEQ ID NO: 990302 - RNA, 22 nt, Human
ucauugcagaaauaaaggugaa

SEQ ID NO: 990303 - RNA, 22 nt, Human
uaguaucuuucuauauuuccca

SEQ ID NO: 990304 - RNA, 22 nt, Human
gcuggccuuugaggaagcugcg

SEQ ID NO: 990305 - RNA, 18 nt, Human
cugcugcaggcacucagg

SEQ ID NO: 990306 - RNA, 22 nt, Human
ggggcagagucuggacuguugu

SEQ ID NO: 990307 - RNA, 20 nt, Human
gugccuggagaagaggcugu

SEQ ID NO: 990308 - RNA, 22 nt, Human
ggccaggaagggaagaucagca

SEQ ID NO: 990309 - RNA, 22 nt, Human
cuguuuauggagguaaggcauc

SEQ ID NO: 990310 - RNA, 22 nt, Human
uggccuggggaccugugagacc

SEQ ID NO: 990311 - RNA, 18 nt, Human
ugucaucuguuuaaaacc

SEQ ID NO: 990312 - RNA, 22 nt, Human
gaggcaggcccugaaugaguca

SEQ ID NO: 990313 - RNA, 22 nt, Human
cagaguguuucuuugggugggu

SEQ ID NO: 990314 - RNA, 22 nt, Human
ugcauuccauguguuuccugag

SEQ ID NO: 990315 - RNA, 18 nt, Human
ucugagggugcgggagcu

SEQ ID NO: 990316 - RNA, 22 nt, Human
gguuggggcgagcuggaggccc

SEQ ID NO: 990317 - RNA, 22 nt, Human
ucugaggccccugggcaggaug

SEQ ID NO: 990318 - RNA, 22 nt, Human
acagcuguauccccagagcuca

SEQ ID NO: 990319 - RNA, 22 nt, Human
uuaaaagagcagcccagcauau

SEQ ID NO: 990320 - RNA, 22 nt, Human
gagggcaguagccucguacccu

SEQ ID NO: 990321 - RNA, 22 nt, Human
uggccugggccugccggugcaa

SEQ ID NO: 990322 - RNA, 15 nt, Human
cagucccagggaccc

SEQ ID NO: 990323 - RNA, 22 nt, Human
agcugguucauucauucauggu

SEQ ID NO: 990324 - RNA, 22 nt, Human
gaaggcuugcagcucuguggca

SEQ ID NO: 990325 - RNA, 22 nt, Human
gagcagagacaguacaacuggc

SEQ ID NO: 990326 - RNA, 22 nt, Human
uauuuugagguauuuuugagcu

SEQ ID NO: 990327 - RNA, 22 nt, Human
cucaggggaccuggcuccgagu

SEQ ID NO: 990328 - RNA, 22 nt, Human
ggccuguguccuccuugcccug

SEQ ID NO: 990329 - RNA, 22 nt, Human
augucacauggccuguacuuug

SEQ ID NO: 990330 - RNA, 22 nt, Human
uuacaaaguucugaguucaaac

SEQ ID NO: 990331 - RNA, 22 nt, Human
gccuggagcuacuggacacuga

SEQ ID NO: 990332 - RNA, 22 nt, Human
ugggcagaaugugggauccaga

SEQ ID NO: 990333 - RNA, 22 nt, Human
ccuggagguggagguugcagug

SEQ ID NO: 990334 - RNA, 22 nt, Human
cacugccugugagcugugugcc

SEQ ID NO: 990335 - RNA, 19 nt, Human
uuacaucugcaacacuggu

SEQ ID NO: 990336 - RNA, 22 nt, Human
cagcuccugcagcugcugccgu

SEQ ID NO: 990337 - RNA, 22 nt, Human
gggccacacagaaccuccuggu

SEQ ID NO: 990338 - RNA, 22 nt, Human
ucucagaggucuucagccucug

SEQ ID NO: 990339 - RNA, 22 nt, Human
cuccagggaaaggggcguccgc

SEQ ID NO: 990340 - RNA, 22 nt, Human
cuggcucauagagcagcuccaa

SEQ ID NO: 990341 - RNA, 22 nt, Human
aacagaauaguugauguacagu

SEQ ID NO: 990342 - RNA, 22 nt, Human
aaucuuucccuauuaaaugugg

SEQ ID NO: 990343 - RNA, 22 nt, Human
aaagauuuaagaauaauuugug

SEQ ID NO: 990344 - RNA, 22 nt, Human
ccagcuggagcucgcagauagg

SEQ ID NO: 990345 - RNA, 22 nt, Human
agagaagagcaaugauaaauuu

SEQ ID NO: 990346 - RNA, 18 nt, Human
acauacauucugucugca

SEQ ID NO: 990347 - RNA, 22 nt, Human
ggguuggggcccagcagucugc

SEQ ID NO: 990348 - RNA, 22 nt, Human
agcagaaccugcagaccugucu

SEQ ID NO: 990349 - RNA, 22 nt, Human
agagcugcaccuaugcagaccu

SEQ ID NO: 990350 - RNA, 22 nt, Human
cagaagcauugacuccuugcuc

SEQ ID NO: 990351 - RNA, 22 nt, Human
uauuucuugaguggucaguuuc

SEQ ID NO: 990352 - RNA, 22 nt, Human
ccaaagucugcauuuuaacaug

SEQ ID NO: 990353 - RNA, 22 nt, Human
aucagcaagcauuuauugagug

SEQ ID NO: 990354 - RNA, 17 nt, Human
uuaagguggaucagcac

SEQ ID NO: 990355 - RNA, 22 nt, Human
aaaguucaugguguuauagaaa

SEQ ID NO: 990356 - RNA, 22 nt, Human
aggcacuggguaauuaguagcu

SEQ ID NO: 990357 - RNA, 21 nt, Human
agcagccauuucacagagacu

SEQ ID NO: 990358 - RNA, 22 nt, Human
cuguagccagaagcagaaggcc

SEQ ID NO: 990359 - RNA, 22 nt, Human
uccagggagauacuggcugcca

SEQ ID NO: 990360 - RNA, 23 nt, Human
cccagcagagaugaggagggguc

SEQ ID NO: 990361 - RNA, 22 nt, Human
agaggccaucugcucugugggg

SEQ ID NO: 990362 - RNA, 22 nt, Human
uguuuuguuuaugagagcacag

SEQ ID NO: 990363 - RNA, 22 nt, Human
cagguccccuccccuaccaggc

SEQ ID NO: 990364 - RNA, 22 nt, Human
uacaguaaccagucuacuuaga

SEQ ID NO: 990365 - RNA, 22 nt, Human
gggcccuggggccugauuugca

SEQ ID NO: 990366 - RNA, 22 nt, Human
uccaggaggaggaaggcugcca

SEQ ID NO: 990367 - RNA, 22 nt, Human
gagaccaggaaguacagcagcc

SEQ ID NO: 990368 - RNA, 22 nt, Human
gaguuuaaagcauacauauuuu

SEQ ID NO: 990369 - RNA, 22 nt, Human
uggaagggggaagacagcucug

SEQ ID NO: 990370 - RNA, 22 nt, Human
gcuggggagcuagaccucagca

SEQ ID NO: 990371 - RNA, 22 nt, Human
auucacaaaaugauauagauac

SEQ ID NO: 990372 - RNA, 20 nt, Human
aggcugggguguuuugccca

SEQ ID NO: 990373 - RNA, 22 nt, Human
gaaaugugggucaugacccauu

SEQ ID NO: 990374 - RNA, 19 nt, Human
uaaaaugucuguggucagu

SEQ ID NO: 990375 - RNA, 22 nt, Human
caggagcuacucagguuggguu

SEQ ID NO: 990376 - RNA, 22 nt, Human
uguuauugagguuacuuauaag

SEQ ID NO: 990377 - RNA, 22 nt, Human
agugauggugagugagaagcuc

SEQ ID NO: 990378 - RNA, 22 nt, Human
agaugaaaagauaagcagcaau

SEQ ID NO: 990379 - RNA, 18 nt, Human
ggccugaggauuucagca

SEQ ID NO: 990380 - RNA, 22 nt, Human
gcuggccacacugcugauggag

SEQ ID NO: 990381 - RNA, 22 nt, Human
aggggcuggcuuaucugagagu

SEQ ID NO: 990382 - RNA, 22 nt, Human
acagaacugcaggaggaaaagc

SEQ ID NO: 990383 - RNA, 22 nt, Human
gcagcugcaggcaggcuugcug

SEQ ID NO: 990384 - RNA, 22 nt, Human
uguauagaguuggaagaugacu

SEQ ID NO: 990385 - RNA, 22 nt, Human
gcagagccugggggucugcgga

SEQ ID NO: 990386 - RNA, 22 nt, Human
gcaggcugauagaggauuccau

SEQ ID NO: 990387 - RNA, 22 nt, Human
ucagaccauccugcuguuagug

SEQ ID NO: 990388 - RNA, 22 nt, Human
gaugcacaugugaguauagaag

SEQ ID NO: 990389 - RNA, 20 nt, Human
cacugaagacuucuugcuca

SEQ ID NO: 990390 - RNA, 22 nt, Human
ccagucccaggcagaaauccag

SEQ ID NO: 990391 - RNA, 22 nt, Human
ugccugugucacagugauguuu

SEQ ID NO: 990392 - RNA, 22 nt, Human
acugcuuuagaccuagagcucu

SEQ ID NO: 990393 - RNA, 22 nt, Human
gcuccuggucuggagcuucaag

SEQ ID NO: 990394 - RNA, 22 nt, Human
guguggcugccagccaagaggc

SEQ ID NO: 990395 - RNA, 22 nt, Human
agaagcaguuauuuuuugcaca

SEQ ID NO: 990396 - RNA, 22 nt, Human
ugcugcucucagccaccaggaa

SEQ ID NO: 990397 - RNA, 22 nt, Human
cuccucccugcgauugcucugc

SEQ ID NO: 990398 - RNA, 22 nt, Human
guggccaaggugcagagcagcu

SEQ ID NO: 990399 - RNA, 22 nt, Human
cugggagagaagcgaagcuggg

SEQ ID NO: 990400 - RNA, 22 nt, Human
cuugcaggcagggccuccugga

SEQ ID NO: 990401 - RNA, 22 nt, Human
uacauauuugucuuuguacugu

SEQ ID NO: 990402 - RNA, 22 nt, Human
caggguggaauggaaugcuggc

SEQ ID NO: 990403 - RNA, 22 nt, Human
gcuggcugggucccugagaggc

SEQ ID NO: 990404 - RNA, 22 nt, Human
augaagauaagaccaggcugga

SEQ ID NO: 990405 - RNA, 22 nt, Human
uccuucagccaugggcucucca

SEQ ID NO: 990406 - RNA, 22 nt, Human
ugcucuguaacaaauugacaug

SEQ ID NO: 990407 - RNA, 22 nt, Human
uaaaaugacuuccuccaacauc

SEQ ID NO: 990408 - RNA, 22 nt, Human
aggcagaaaauagucauccaaa

SEQ ID NO: 990409 - RNA, 22 nt, Human
uuugcauuguaauauuuaguuc

SEQ ID NO: 990410 - RNA, 22 nt, Human
aaugaacaucaaaugccuacca

SEQ ID NO: 990411 - RNA, 22 nt, Human
uggcagcagggaggccaguguu

SEQ ID NO: 990412 - RNA, 22 nt, Human
uuucauuacguguuugacuugu

SEQ ID NO: 990413 - RNA, 22 nt, Human
aaucgguugaacccaggaagug

SEQ ID NO: 990414 - RNA, 22 nt, Human
gcacagaacuucucuuaguagg

SEQ ID NO: 990415 - RNA, 22 nt, Human
uccagucaggcugaauucaagg

SEQ ID NO: 990416 - RNA, 22 nt, Human
ucacuguaucauguugcacuua

SEQ ID NO: 990417 - RNA, 22 nt, Human
gucuggccuuuuuagcuugugg

SEQ ID NO: 990418 - RNA, 22 nt, Human
ggaggccaugaggcucuaggug

SEQ ID NO: 990419 - RNA, 22 nt, Human
gcaggcaguuugcuuuucccuc

SEQ ID NO: 990420 - RNA, 22 nt, Human
agagccagguguagucucggag

SEQ ID NO: 990421 - RNA, 22 nt, Human
cagcaggcguugggagaaagac

SEQ ID NO: 990422 - RNA, 22 nt, Human
caguggaggcucaagugugcuu

SEQ ID NO: 990423 - RNA, 22 nt, Human
cugaggugagcuucccugggcu

SEQ ID NO: 990424 - RNA, 22 nt, Human
cucacagguaccagcacccucc

SEQ ID NO: 990425 - RNA, 19 nt, Human
ggcugggucuggcagguuc

SEQ ID NO: 990426 - RNA, 22 nt, Human
gggcuggucuggcuuagucagg

SEQ ID NO: 990427 - RNA, 22 nt, Human
cugcugggcagaggcugcauga

SEQ ID NO: 990428 - RNA, 22 nt, Human
cugcugcaggaugggcacucug

SEQ ID NO: 990429 - RNA, 22 nt, Human
uggcagagguauauugggagga

SEQ ID NO: 990430 - RNA, 21 nt, Human
agcuuccugcagugggagguc

SEQ ID NO: 990431 - RNA, 22 nt, Human
uuucuuccuuaccuuacuagag

SEQ ID NO: 990432 - RNA, 23 nt, Human
ucucagaggauuccugggccuug

SEQ ID NO: 990433 - RNA, 22 nt, Human
cccaggaggccaagguugcagu

SEQ ID NO: 990434 - RNA, 22 nt, Human
ucagcagggaggcucugugccc

SEQ ID NO: 990435 - RNA, 22 nt, Human
cagggcacaguuauggaggugg

SEQ ID NO: 990436 - RNA, 22 nt, Human
uuucuauucuggaucuguggca

SEQ ID NO: 990437 - RNA, 22 nt, Human
guuuaaguuucagaagcuaaga

SEQ ID NO: 990438 - RNA, 22 nt, Human
acugaaggguaaugugggagcc

SEQ ID NO: 990439 - RNA, 22 nt, Human
agcagccagaaauccagaggug

SEQ ID NO: 990440 - RNA, 22 nt, Human
uggcacuggcgcaggauggcgg

SEQ ID NO: 990441 - RNA, 22 nt, Human
agcugucagugcugugccugua

SEQ ID NO: 990442 - RNA, 22 nt, Human
ugcauauugugaaaauguagau

SEQ ID NO: 990443 - RNA, 22 nt, Human
cucccugggcagauguggcucu

SEQ ID NO: 990444 - RNA, 18 nt, Human
uggguggcuagggaguuu

SEQ ID NO: 990445 - RNA, 22 nt, Human
auuagcauauuaaauagucauu

SEQ ID NO: 990446 - RNA, 22 nt, Human
uugggugcugucauggggcacg

SEQ ID NO: 990447 - RNA, 22 nt, Human
ugccugucuuggaguccuggcc

SEQ ID NO: 990448 - RNA, 22 nt, Human
gcuggccugggcagaggcuaug

SEQ ID NO: 990449 - RNA, 22 nt, Human
uuuucuuacugucugugauccu

SEQ ID NO: 990450 - RNA, 20 nt, Human
agacaggagcccccauucag

SEQ ID NO: 990451 - RNA, 22 nt, Human
gugucauuaaccaccaugcaaa

SEQ ID NO: 990452 - RNA, 22 nt, Human
auagauacauuagguaacuugu

SEQ ID NO: 990453 - RNA, 22 nt, Human
ggagcugggacccugucaucug

SEQ ID NO: 990454 - RNA, 22 nt, Human
gcagcugcuggaaguuccugcc

SEQ ID NO: 990455 - RNA, 22 nt, Human
uuucaacagcucucaaaugauc

SEQ ID NO: 990456 - RNA, 22 nt, Human
ucaucaaagcgcuuggaguagg

SEQ ID NO: 990457 - RNA, 22 nt, Human
cagccagagaaagggcacugcc

SEQ ID NO: 990458 - RNA, 22 nt, Human
gggccccuuguaucucuggcuc

SEQ ID NO: 990459 - RNA, 22 nt, Human
ucaaugauagacaagaucuaag

SEQ ID NO: 990460 - RNA, 22 nt, Human
ucuuccucucuaauugaucaga

SEQ ID NO: 990461 - RNA, 22 nt, Human
uagggauguaaacauaguaauu

SEQ ID NO: 990462 - RNA, 22 nt, Human
uuuuuauaugaaggauagugcg

SEQ ID NO: 990463 - RNA, 22 nt, Human
acagaaauaacuuuuuauguuu

SEQ ID NO: 990464 - RNA, 22 nt, Human
acuccuggguuccggagauucu

SEQ ID NO: 990465 - RNA, 22 nt, Human
ccugacgaaaggcgugcuggag

SEQ ID NO: 990466 - RNA, 22 nt, Human
acauuuaaauaugccuuauauu

SEQ ID NO: 990467 - RNA, 22 nt, Human
aggaggcuguggagcacuccau

SEQ ID NO: 990468 - RNA, 22 nt, Human
uguuacuuaucucacgugaugc

SEQ ID NO: 990469 - RNA, 22 nt, Human
ccacagggccuuuccugcuggc

SEQ ID NO: 990470 - RNA, 22 nt, Human
uugcauguguaauuuuucuaaa

SEQ ID NO: 990471 - RNA, 22 nt, Human
aaggcacuacgcugcuggggcg

SEQ ID NO: 990472 - RNA, 23 nt, Human
cacuccuguuucuaagccagcau

SEQ ID NO: 990473 - RNA, 22 nt, Human
gcugcucuggcucugcaguguc

SEQ ID NO: 990474 - RNA, 22 nt, Human
agugguaacuaaguccugcuua

SEQ ID NO: 990475 - RNA, 22 nt, Human
ugaugguuuuauuaauaggacc

SEQ ID NO: 990476 - RNA, 22 nt, Human
uuuaaaaaacuagucugagucu

SEQ ID NO: 990477 - RNA, 22 nt, Human
auucuguauggaaaagcacuau

SEQ ID NO: 990478 - RNA, 22 nt, Human
gaucuuggggggaucaccaugg

SEQ ID NO: 990479 - RNA, 22 nt, Human
uccagcagggaauuaguagucu

SEQ ID NO: 990480 - RNA, 23 nt, Human
gggagccaggaccucgcgcccca

SEQ ID NO: 990481 - RNA, 22 nt, Human
cuaggaggcgggggcugcagua

SEQ ID NO: 990482 - RNA, 20 nt, Human
aggaaaaauggaaacuggag

SEQ ID NO: 990483 - RNA, 22 nt, Human
uucaagaucgaguuuaaaguga

SEQ ID NO: 990484 - RNA, 22 nt, Human
agcugaaagugcuuugaggacu

SEQ ID NO: 990485 - RNA, 22 nt, Human
uuucucugaggcuggccucccu

SEQ ID NO: 990486 - RNA, 22 nt, Human
ggagcugggaauuggaucaucu

SEQ ID NO: 990487 - RNA, 22 nt, Human
auuaggacacauacauguacag

SEQ ID NO: 990488 - RNA, 22 nt, Human
uaaaacuagugguugggacuaa

SEQ ID NO: 990489 - RNA, 22 nt, Human
gucuuguuugggauguggaugg

SEQ ID NO: 990490 - RNA, 22 nt, Human
caauagcagcuucugaaugcaa

SEQ ID NO: 990491 - RNA, 22 nt, Human
aggaagccaugguggacgucua

SEQ ID NO: 990492 - RNA, 22 nt, Human
guauuugauagauuucaaagga

SEQ ID NO: 990493 - RNA, 21 nt, Human
ccuggcagaagccugauaugc

SEQ ID NO: 990494 - RNA, 22 nt, Human
auggcagccuguggacagucaa

SEQ ID NO: 990495 - RNA, 22 nt, Human
gggaaauugucaacacucucaa

SEQ ID NO: 990496 - RNA, 22 nt, Human
gagcuuggugaugccuccuggu

SEQ ID NO: 990497 - RNA, 22 nt, Human
cacagcuucuccuugauaucgc

SEQ ID NO: 990498 - RNA, 22 nt, Human
aaacacauuuuaggaaaaucua

SEQ ID NO: 990499 - RNA, 22 nt, Human
caaaaguaauugcaguuuuugc

SEQ ID NO: 990500 - RNA, 22 nt, Human
gaggggcuggcuguggucccau

SEQ ID NO: 990501 - RNA, 22 nt, Human
gggcagccucggugccugcugc

SEQ ID NO: 990502 - RNA, 22 nt, Human
ggucaggguauaaucaagugag

SEQ ID NO: 990503 - RNA, 22 nt, Human
uugaacaguuuugucagguuca

SEQ ID NO: 990504 - RNA, 22 nt, Human
ggcagccaugcacgcugccugg

SEQ ID NO: 990505 - RNA, 22 nt, Human
cagcagcaaaucuagaagagga

SEQ ID NO: 990506 - RNA, 22 nt, Human
ucagcugaguucuagagcacuc

SEQ ID NO: 990507 - RNA, 22 nt, Human
ucugcaagauggucuuagaggu

SEQ ID NO: 990508 - RNA, 22 nt, Human
cucuugaaaauuggaacacaga

SEQ ID NO: 990509 - RNA, 22 nt, Human
gagguacagaguguuccaaugu

SEQ ID NO: 990510 - RNA, 22 nt, Human
guuaauaaagguauagaaucag

SEQ ID NO: 990511 - RNA, 22 nt, Human
gcaggggcaggagaucucaggc

SEQ ID NO: 990512 - RNA, 22 nt, Human
cccugccuuguuggagccuaug

SEQ ID NO: 990513 - RNA, 22 nt, Human
gccuccccugcaauuguccuug

SEQ ID NO: 990514 - RNA, 22 nt, Human
gagccaagaucgcaccacugca

SEQ ID NO: 990515 - RNA, 22 nt, Human
cucaggauucucgacacucaca

SEQ ID NO: 990516 - RNA, 20 nt, Human
cccuccagcaaccaggacuu

SEQ ID NO: 990517 - RNA, 22 nt, Human
ucaaggugcugugcugugcuag

SEQ ID NO: 990518 - RNA, 22 nt, Human
uaaaaaguugaaaggacuuauc

SEQ ID NO: 990519 - RNA, 22 nt, Human
uaaaaguauacuuucaaaggag

SEQ ID NO: 990520 - RNA, 22 nt, Human
ggcagagcuugcagugagccga

SEQ ID NO: 990521 - RNA, 22 nt, Human
ccuggcagacugugagggcagg

SEQ ID NO: 990522 - RNA, 22 nt, Human
guccugggaaggaagccaggga

SEQ ID NO: 990523 - RNA, 22 nt, Human
uaaugaauaaacuugagaguca

SEQ ID NO: 990524 - RNA, 22 nt, Human
ucuuugcaugugcuucuuggcc

SEQ ID NO: 990525 - RNA, 22 nt, Human
gggcagagagcuggaacuccuu

SEQ ID NO: 990526 - RNA, 22 nt, Human
acugccuuauaugcugugugug

SEQ ID NO: 990527 - RNA, 22 nt, Human
gcuggcucccauugguccuucc

SEQ ID NO: 990528 - RNA, 22 nt, Human
ugggcagacgcuguuggaaggc

SEQ ID NO: 990529 - RNA, 22 nt, Human
gggcacagcugcuacccagugc

SEQ ID NO: 990530 - RNA, 21 nt, Human
ugggaugggucugggaccagc

SEQ ID NO: 990531 - RNA, 22 nt, Human
aacacugcugcuggguucugug

SEQ ID NO: 990532 - RNA, 22 nt, Human
aaaguuucaauagaggaagugg

SEQ ID NO: 990533 - RNA, 22 nt, Human
ccugggucuugguucaugcucu

SEQ ID NO: 990534 - RNA, 22 nt, Human
cugggccaagaaguuguguaug

SEQ ID NO: 990535 - RNA, 22 nt, Human
aaaaagguugauccagauuagg

SEQ ID NO: 990536 - RNA, 22 nt, Human
ugcugucuguuuacuggcuaua

SEQ ID NO: 990537 - RNA, 22 nt, Human
auucacaaugauacauaagcga

SEQ ID NO: 990538 - RNA, 22 nt, Human
uccuggagccacggagcuuuca

SEQ ID NO: 990539 - RNA, 19 nt, Human
caggagagcaugcacuuug

SEQ ID NO: 990540 - RNA, 22 nt, Human
ugcagcuguaacagaggccuca

SEQ ID NO: 990541 - RNA, 22 nt, Human
cuucaucaacucuaacaaaugu

SEQ ID NO: 990542 - RNA, 22 nt, Human
uccagccaugcaugacaaucac

SEQ ID NO: 990543 - RNA, 22 nt, Human
cugggaggauacacaagaucag

SEQ ID NO: 990544 - RNA, 22 nt, Human
agaggaugauuuuaaggacacu

SEQ ID NO: 990545 - RNA, 22 nt, Human
gcucugagcacugugcggcugg

SEQ ID NO: 990546 - RNA, 22 nt, Human
uuuauugcauacacaaauguca

SEQ ID NO: 990547 - RNA, 22 nt, Human
cuggcucucugagauauugagu

SEQ ID NO: 990548 - RNA, 22 nt, Human
ugugugacccccagugaagccu

SEQ ID NO: 990549 - RNA, 22 nt, Human
ucugugccaccucuccaguguc

SEQ ID NO: 990550 - RNA, 22 nt, Human
augcaguggcagcuccuggugu

SEQ ID NO: 990551 - RNA, 22 nt, Human
uuuuugaaggcugaugugauua

SEQ ID NO: 990552 - RNA, 22 nt, Human
acauuucugcuagaauagguga

SEQ ID NO: 990553 - RNA, 22 nt, Human
ugaaacaggaaguaaacagaca

SEQ ID NO: 990554 - RNA, 22 nt, Human
agccucugugacucacagguca

SEQ ID NO: 990555 - RNA, 23 nt, Human
ucccagccucuucucuugcauac

SEQ ID NO: 990556 - RNA, 22 nt, Human
uucaagaucuuccaaaggauac

SEQ ID NO: 990557 - RNA, 22 nt, Human
agcagccauagauagcaugcaa

SEQ ID NO: 990558 - RNA, 22 nt, Human
uuucuuaguccuagagugauuu

SEQ ID NO: 990559 - RNA, 22 nt, Human
ggaggccacgguuuagcaccga

SEQ ID NO: 990560 - RNA, 17 nt, Human
aggugcuggagcaucag

SEQ ID NO: 990561 - RNA, 22 nt, Human
uauguacauguuaaagggcaaa

SEQ ID NO: 990562 - RNA, 22 nt, Human
gagcucuguguagccugagggu

SEQ ID NO: 990563 - RNA, 23 nt, Human
gccuucagcucgggaaggcuccc

SEQ ID NO: 990564 - RNA, 18 nt, Human
aggcacagagcauacaua

SEQ ID NO: 990565 - RNA, 22 nt, Human
cacaugggugugccuggaggaa

SEQ ID NO: 990566 - RNA, 23 nt, Human
agucucagcuggaaacauguguc

SEQ ID NO: 990567 - RNA, 22 nt, Human
aggccuggcuuugguuugcuga

SEQ ID NO: 990568 - RNA, 22 nt, Human
auuacaaaagaagggagaaggu

SEQ ID NO: 990569 - RNA, 22 nt, Human
gcuuccugucccucagccauga

SEQ ID NO: 990570 - RNA, 22 nt, Human
gaaauauugggacucagagcuu

SEQ ID NO: 990571 - RNA, 22 nt, Human
agcagugaugcaugacagccua

SEQ ID NO: 990572 - RNA, 22 nt, Human
uugcaaaagccgaggcacucca

SEQ ID NO: 990573 - RNA, 17 nt, Human
cuccuggccaccccucu

SEQ ID NO: 990574 - RNA, 22 nt, Human
cagaguguugaccauaagccca

SEQ ID NO: 990575 - RNA, 22 nt, Human
ucagaagcaaacaucacucuag

SEQ ID NO: 990576 - RNA, 22 nt, Human
aacagacagaaaaaugugaucu

SEQ ID NO: 990577 - RNA, 22 nt, Human
uuacugaaaauucuucaggauu

SEQ ID NO: 990578 - RNA, 22 nt, Human
uccucaggugacuagguaucuu

SEQ ID NO: 990579 - RNA, 19 nt, Human
uugaggggccaggggagau

SEQ ID NO: 990580 - RNA, 22 nt, Human
cugagcugggaguggauagugg

SEQ ID NO: 990581 - RNA, 22 nt, Human
acauuugagaugccuuuuaggu

SEQ ID NO: 990582 - RNA, 22 nt, Human
cugggagcccgcguccuggugg

SEQ ID NO: 990583 - RNA, 22 nt, Human
gcucagagaugucugcugccuu

SEQ ID NO: 990584 - RNA, 22 nt, Human
cugagcccaggcgggagcugag

SEQ ID NO: 990585 - RNA, 22 nt, Human
gcucugagucucagcuaccaca

SEQ ID NO: 990586 - RNA, 22 nt, Human
gagcuggugugugcccgagcac

SEQ ID NO: 990587 - RNA, 23 nt, Human
uccagggauuaaugaagucaguc

SEQ ID NO: 990588 - RNA, 22 nt, Human
gcucccaccuuugcuaucagua

SEQ ID NO: 990589 - RNA, 22 nt, Human
agcaggaggguuuuguagaguc

SEQ ID NO: 990590 - RNA, 22 nt, Human
augccuggacugacaugcacug

SEQ ID NO: 990591 - RNA, 20 nt, Human
ggcucuggaaucuggugggc

SEQ ID NO: 990592 - RNA, 22 nt, Human
cauggccuugagugacugcacu

SEQ ID NO: 990593 - RNA, 22 nt, Human
cagcugugcuguauuaagcucu

SEQ ID NO: 990594 - RNA, 22 nt, Human
ugcugucugauucagggugauu

SEQ ID NO: 990595 - RNA, 22 nt, Human
gggugcugacuggggccugaaa

SEQ ID NO: 990596 - RNA, 22 nt, Human
uggucaaaagaaagcucagaac

SEQ ID NO: 990597 - RNA, 22 nt, Human
gccugagacagugugguccaau

SEQ ID NO: 990598 - RNA, 21 nt, Human
acugccugucuccauagucua

SEQ ID NO: 990599 - RNA, 22 nt, Human
agcagccagaaagggcagucga

SEQ ID NO: 990600 - RNA, 22 nt, Human
aguuauauaacuaucuagaugc

SEQ ID NO: 990601 - RNA, 22 nt, Human
uguuuaagcugaugagguaucg

SEQ ID NO: 990602 - RNA, 22 nt, Human
gagaaagcuucuuucccacagg

SEQ ID NO: 990603 - RNA, 21 nt, Human
gcagccacugccuucaacaau

SEQ ID NO: 990604 - RNA, 22 nt, Human
ugcugggggugucucaccaggc

SEQ ID NO: 990605 - RNA, 22 nt, Human
ucagcaggcgguuccuuguggg

SEQ ID NO: 990606 - RNA, 22 nt, Human
ggcugugccucaaggcuacuca

SEQ ID NO: 990607 - RNA, 22 nt, Human
auucacaauuagaaguagauaa

SEQ ID NO: 990608 - RNA, 22 nt, Human
accaaggagccacauacaaccu

SEQ ID NO: 990609 - RNA, 22 nt, Human
ccuggccugcucggcucuuaag

SEQ ID NO: 990610 - RNA, 22 nt, Human
uguggccuccuguuccugggua

SEQ ID NO: 990611 - RNA, 22 nt, Human
agagugauucuaguuagggaau

SEQ ID NO: 990612 - RNA, 22 nt, Human
uccuugaacagagggccugggu

SEQ ID NO: 990613 - RNA, 22 nt, Human
uuccugagggacuuuugagauu

SEQ ID NO: 990614 - RNA, 23 nt, Human
uuucauaugguguggaugaagaa

SEQ ID NO: 990615 - RNA, 22 nt, Human
ucuccugugcacccucccugug

SEQ ID NO: 990616 - RNA, 22 nt, Human
ccuggcagcuguuuggcuuggc

SEQ ID NO: 990617 - RNA, 22 nt, Human
agcacagguacggagaugcuac

SEQ ID NO: 990618 - RNA, 22 nt, Human
uugcauaaagauuuuauugcau

SEQ ID NO: 990619 - RNA, 22 nt, Human
caagccucagaaucuucuccau

SEQ ID NO: 990620 - RNA, 22 nt, Human
aguaaugucccuuaaauguggu

SEQ ID NO: 990621 - RNA, 22 nt, Human
gcaugugucuccccaguggagg

SEQ ID NO: 990622 - RNA, 22 nt, Human
caggugggcguggcgagaaggc

SEQ ID NO: 990623 - RNA, 22 nt, Human
ucuggccuacuggaguccauga

SEQ ID NO: 990624 - RNA, 22 nt, Human
augaaaacggaccagagcuauu

SEQ ID NO: 990625 - RNA, 22 nt, Human
cagcccaaagccccaggcuaga

SEQ ID NO: 990626 - RNA, 22 nt, Human
uugacaauguccuuugaauuuc

SEQ ID NO: 990627 - RNA, 22 nt, Human
guggcccugucccaggccuccu

SEQ ID NO: 990628 - RNA, 22 nt, Human
cuaauguggacucuaucaaagu

SEQ ID NO: 990629 - RNA, 22 nt, Human
aggugcugccccgagaaggaug

SEQ ID NO: 990630 - RNA, 22 nt, Human
uaacacugauuuguucucaggg

SEQ ID NO: 990631 - RNA, 22 nt, Human
ucccagagucuucuccuguaau

SEQ ID NO: 990632 - RNA, 22 nt, Human
ucagggcauguauguuucuuua

SEQ ID NO: 990633 - RNA, 22 nt, Human
agacagagauacuauguuguca

SEQ ID NO: 990634 - RNA, 22 nt, Human
cagccagcuucagauccaagcc

SEQ ID NO: 990635 - RNA, 22 nt, Human
accagagcagacuacuggaggu

SEQ ID NO: 990636 - RNA, 22 nt, Human
ucagagucucccccaguuuggg

SEQ ID NO: 990637 - RNA, 22 nt, Human
agcugguuagcaaucuaaguga

SEQ ID NO: 990638 - RNA, 22 nt, Human
acguuuucagugacugugcuuc

SEQ ID NO: 990639 - RNA, 22 nt, Human
aaaaaucacuuuuauaggcagc

SEQ ID NO: 990640 - RNA, 22 nt, Human
aaggcacugaacuuaaauucug

SEQ ID NO: 990641 - RNA, 22 nt, Human
ucucugcucugugccucaguuu

SEQ ID NO: 990642 - RNA, 22 nt, Human
guacauuuuacuuuguuugaau

SEQ ID NO: 990643 - RNA, 22 nt, Human
acaacaggguaaggcaggccau

SEQ ID NO: 990644 - RNA, 22 nt, Human
cagggcagggagcuuagaauga

SEQ ID NO: 990645 - RNA, 20 nt, Human
ggagagcagggaagacagua

SEQ ID NO: 990646 - RNA, 21 nt, Human
uuucugucucugccacuaguu

SEQ ID NO: 990647 - RNA, 22 nt, Human
cagccuguagaauacaguaaau

SEQ ID NO: 990648 - RNA, 22 nt, Human
cuguggagcuuguggcaguggg

SEQ ID NO: 990649 - RNA, 18 nt, Human
uuccauaauguauguaac

SEQ ID NO: 990650 - RNA, 22 nt, Human
ucagggcacauucugcaguggc

SEQ ID NO: 990651 - RNA, 22 nt, Human
uguguacagcaggauuucucaa

SEQ ID NO: 990652 - RNA, 22 nt, Human
uggccucuggcugaggacuaac

SEQ ID NO: 990653 - RNA, 22 nt, Human
guuauauaagacaaaucagagu

SEQ ID NO: 990654 - RNA, 22 nt, Human
ucagcagcagcucagcauguuu

SEQ ID NO: 990655 - RNA, 22 nt, Human
uacaguagaauuuuuaguaacu

SEQ ID NO: 990656 - RNA, 22 nt, Human
ggguggaguagaaagaugaauu

SEQ ID NO: 990657 - RNA, 22 nt, Human
caagaugaaacuacagggagga

SEQ ID NO: 990658 - RNA, 22 nt, Human
gcuugcucaacccccgucucuc

SEQ ID NO: 990659 - RNA, 22 nt, Human
ccacucugcugugcuccaugau

SEQ ID NO: 990660 - RNA, 22 nt, Human
gcugucugacuccaaguuggag

SEQ ID NO: 990661 - RNA, 22 nt, Human
ucacagugagccaugucagaga

SEQ ID NO: 990662 - RNA, 22 nt, Human
uucauuccuucccuaagcaacu

SEQ ID NO: 990663 - RNA, 22 nt, Human
agagcagugcugaagaguaggg

SEQ ID NO: 990664 - RNA, 22 nt, Human
acuuugcaauacuuaauacaaa

SEQ ID NO: 990665 - RNA, 22 nt, Human
guccaaauaaguugcaaaauag

SEQ ID NO: 990666 - RNA, 22 nt, Human
cagagcagggugcaccuugggc

SEQ ID NO: 990667 - RNA, 22 nt, Human
ggcagugguuagaaacaugagc

SEQ ID NO: 990668 - RNA, 20 nt, Human
acuuucucgguuucucaccu

SEQ ID NO: 990669 - RNA, 22 nt, Human
cugugucggacgugggcagcag

SEQ ID NO: 990670 - RNA, 22 nt, Human
acaggugauucaggcucuggga

SEQ ID NO: 990671 - RNA, 22 nt, Human
uuccuguuucauagaaaacuga

SEQ ID NO: 990672 - RNA, 22 nt, Human
gggcagcagagcccugccgagu

SEQ ID NO: 990673 - RNA, 22 nt, Human
agcagcuuacauguggccuauc

SEQ ID NO: 990674 - RNA, 22 nt, Human
gcuggccagugucccagggauc

SEQ ID NO: 990675 - RNA, 22 nt, Human
ugggcugcuucuauuggugguc

SEQ ID NO: 990676 - RNA, 22 nt, Human
acucugaggagugacuagaggu

SEQ ID NO: 990677 - RNA, 22 nt, Human
ugucucugauaaguaguucagu

SEQ ID NO: 990678 - RNA, 22 nt, Human
uaaguauguuagaaaaucaagu

SEQ ID NO: 990679 - RNA, 22 nt, Human
aggauuucugugccuggaaaau

SEQ ID NO: 990680 - RNA, 22 nt, Human
caggcugggcagccuccccggc

SEQ ID NO: 990681 - RNA, 22 nt, Human
gugcuucucuucacacccaacu

SEQ ID NO: 990682 - RNA, 22 nt, Human
cugcugcucgaccagucccagg

SEQ ID NO: 990683 - RNA, 22 nt, Human
ccagcccugaacccugcugcau

SEQ ID NO: 990684 - RNA, 22 nt, Human
cccaggagguggagcuugcagu

SEQ ID NO: 990685 - RNA, 22 nt, Human
ucucagagggaaaggccaauuu

SEQ ID NO: 990686 - RNA, 22 nt, Human
aaggcaggaugcggacccaucu

SEQ ID NO: 990687 - RNA, 22 nt, Human
ucucagagagaugaaacuucca

SEQ ID NO: 990688 - RNA, 22 nt, Human
cagaguacugggagaacagaag

SEQ ID NO: 990689 - RNA, 22 nt, Human
aaaagaggagugguuuaugaca

SEQ ID NO: 990690 - RNA, 23 nt, Human
agggcugaugccauugcagcucu

SEQ ID NO: 990691 - RNA, 22 nt, Human
gcccaugcacuuucugugaugg

SEQ ID NO: 990692 - RNA, 17 nt, Human
auccccagcaucuagaa

SEQ ID NO: 990693 - RNA, 22 nt, Human
cuacacaguucugccuaauggc

SEQ ID NO: 990694 - RNA, 22 nt, Human
ggccuggaagaggacagagaaa

SEQ ID NO: 990695 - RNA, 22 nt, Human
cagagguagccgagugcaaucg

SEQ ID NO: 990696 - RNA, 22 nt, Human
cucuggaguuagugaucugggc

SEQ ID NO: 990697 - RNA, 23 nt, Human
ucugcucugaaguucggcugagc

SEQ ID NO: 990698 - RNA, 22 nt, Human
agcagacauaucucaugucaca

SEQ ID NO: 990699 - RNA, 22 nt, Human
uugugucugggggagugacauc

SEQ ID NO: 990700 - RNA, 22 nt, Human
gcagagugauggaaugugggug

SEQ ID NO: 990701 - RNA, 22 nt, Human
aggaccuguagggccugcaucc

SEQ ID NO: 990702 - RNA, 20 nt, Human
guauuagguguuccucuuuc

SEQ ID NO: 990703 - RNA, 19 nt, Human
cccucaggucugagcaguc

SEQ ID NO: 990704 - RNA, 20 nt, Human
ugaagcagccuugauucugu

SEQ ID NO: 990705 - RNA, 22 nt, Human
aaaucugggagcagcucggcca

SEQ ID NO: 990706 - RNA, 22 nt, Human
cugcugccggcgagccucccuu

SEQ ID NO: 990707 - RNA, 22 nt, Human
uuaaaaugcagauucugauuca

SEQ ID NO: 990708 - RNA, 22 nt, Human
acacacagguaaaggagccugg

SEQ ID NO: 990709 - RNA, 22 nt, Human
gacugucauucuagugcccaug

SEQ ID NO: 990710 - RNA, 22 nt, Human
auggccaaggggccuaggcagg

SEQ ID NO: 990711 - RNA, 22 nt, Human
acugucuguccugcucuccgug

SEQ ID NO: 990712 - RNA, 22 nt, Human
ugcucugugguccaagauggcu

SEQ ID NO: 990713 - RNA, 22 nt, Human
gccagcucccaagugagccccu

SEQ ID NO: 990714 - RNA, 22 nt, Human
aaggagugcaugacucagagua

SEQ ID NO: 990715 - RNA, 22 nt, Human
auugcaccuuggguuuugaaag

SEQ ID NO: 990716 - RNA, 22 nt, Human
agagggagcccagucauagcug

SEQ ID NO: 990717 - RNA, 22 nt, Human
gccagagcagaauagaguggcc

SEQ ID NO: 990718 - RNA, 22 nt, Human
uucuggagagaaaccuuacaaa

SEQ ID NO: 990719 - RNA, 22 nt, Human
uauguagaagcugcucaaagaa

SEQ ID NO: 990720 - RNA, 22 nt, Human
agggagguaggagcuucuagcu

SEQ ID NO: 990721 - RNA, 22 nt, Human
agggguggccugccuuacuccc

SEQ ID NO: 990722 - RNA, 22 nt, Human
ggccugagcucuggggaggcaa

SEQ ID NO: 990723 - RNA, 22 nt, Human
ugaagcaacuggacaaguuggc

SEQ ID NO: 990724 - RNA, 22 nt, Human
ucaggggacuuaggagagaagu

SEQ ID NO: 990725 - RNA, 20 nt, Human
uccagggcuagggagcucau

SEQ ID NO: 990726 - RNA, 22 nt, Human
aagcuggcaauuaucaaaacug

SEQ ID NO: 990727 - RNA, 22 nt, Human
gccucugcucggacuuugccuc

SEQ ID NO: 990728 - RNA, 22 nt, Human
uggcagcacuugaacuugagcc

SEQ ID NO: 990729 - RNA, 22 nt, Human
gggcuucuagaccagcagugag

SEQ ID NO: 990730 - RNA, 22 nt, Human
ucagaacagaagaaggaacacg

SEQ ID NO: 990731 - RNA, 22 nt, Human
ggccucucuccuuggcuugcag

SEQ ID NO: 990732 - RNA, 20 nt, Human
ucaccuuuguugguauucau

SEQ ID NO: 990733 - RNA, 22 nt, Human
ggccugucucacccccgggugc

SEQ ID NO: 990734 - RNA, 22 nt, Human
agggcagcagcccauggcucug

SEQ ID NO: 990735 - RNA, 22 nt, Human
aauguguagggugccuguuuuu

SEQ ID NO: 990736 - RNA, 22 nt, Human
ccugugugucugucacugcaca

SEQ ID NO: 990737 - RNA, 22 nt, Human
cacagguguucuugcagugaaa

SEQ ID NO: 990738 - RNA, 22 nt, Human
uuucucuaaauagggaggcuua

SEQ ID NO: 990739 - RNA, 22 nt, Human
ugagccugguugcagugucugg

SEQ ID NO: 990740 - RNA, 22 nt, Human
uggagcaggugcucaggguaau

SEQ ID NO: 990741 - RNA, 22 nt, Human
cccagcuaccucugcuaggaga

SEQ ID NO: 990742 - RNA, 22 nt, Human
aucagcaaaaaugccuucagaa

SEQ ID NO: 990743 - RNA, 22 nt, Human
uuagaaaugauuucaccucuuu

SEQ ID NO: 990744 - RNA, 22 nt, Human
agggaagugaaugacagauauc

SEQ ID NO: 990745 - RNA, 22 nt, Human
cugagccaaggggacagugaca

SEQ ID NO: 990746 - RNA, 22 nt, Human
gccugagcccaggugugcagag

SEQ ID NO: 990747 - RNA, 22 nt, Human
agagcuguuuggacaucugagu

SEQ ID NO: 990748 - RNA, 22 nt, Human
uccuuuuugguccaaggugacc

SEQ ID NO: 990749 - RNA, 22 nt, Human
cccaaggcauggcaugguggca

SEQ ID NO: 990750 - RNA, 22 nt, Human
ugcagccaucuuucuuggagga

SEQ ID NO: 990751 - RNA, 22 nt, Human
cagcagugcuucagugugagau

SEQ ID NO: 990752 - RNA, 22 nt, Human
ccagcugcaggggagcagugga

SEQ ID NO: 990753 - RNA, 22 nt, Human
gggcaguggcucacgccuguaa

SEQ ID NO: 990754 - RNA, 22 nt, Human
aauaguaaaagauacagcuaau

SEQ ID NO: 990755 - RNA, 22 nt, Human
aaagaacaauguggaaucuccu

SEQ ID NO: 990756 - RNA, 22 nt, Human
accugccuaucagcugccugcu

SEQ ID NO: 990757 - RNA, 22 nt, Human
aucauuccacauguaccacuag

SEQ ID NO: 990758 - RNA, 22 nt, Human
auagauguucaaucagauauuu

SEQ ID NO: 990759 - RNA, 22 nt, Human
gccuaggagacaagcgugaaag

SEQ ID NO: 990760 - RNA, 22 nt, Human
caauaagccagguguuuguguu

SEQ ID NO: 990761 - RNA, 22 nt, Human
ugcaggugccucuugagcuugu

SEQ ID NO: 990762 - RNA, 22 nt, Human
ucccagagucagagguggggcc

SEQ ID NO: 990763 - RNA, 22 nt, Human
agagaaaacucauugagguguc

SEQ ID NO: 990764 - RNA, 22 nt, Human
ccagagugacgugaagugugaa

SEQ ID NO: 990765 - RNA, 22 nt, Human
ggagccaguuuagaccucaguu

SEQ ID NO: 990766 - RNA, 22 nt, Human
uugucuguaaagacggccacca

SEQ ID NO: 990767 - RNA, 22 nt, Human
acuguguccuauuuccuugaca

SEQ ID NO: 990768 - RNA, 22 nt, Human
ugaaaucugucccacuuuagcu

SEQ ID NO: 990769 - RNA, 19 nt, Human
ucgagucaagacacuaggc

SEQ ID NO: 990770 - RNA, 22 nt, Human
uuauuagagugcuuugagaaag

SEQ ID NO: 990771 - RNA, 22 nt, Human
uuaagucacuuaucuaaagaca

SEQ ID NO: 990772 - RNA, 22 nt, Human
guuugauucaagaacaaagagu

SEQ ID NO: 990773 - RNA, 22 nt, Human
aauauccagguagaugucuucu

SEQ ID NO: 990774 - RNA, 22 nt, Human
uugcagggcaggaccauggaca

SEQ ID NO: 990775 - RNA, 20 nt, Human
ugggccugagccugugggcu

SEQ ID NO: 990776 - RNA, 22 nt, Human
uuagauaaauugcaacuugauu

SEQ ID NO: 990777 - RNA, 22 nt, Human
uggcagcaaguucuugggaggu

SEQ ID NO: 990778 - RNA, 22 nt, Human
aauguuauuacacuugugaaau

SEQ ID NO: 990779 - RNA, 22 nt, Human
aaggcagagggcuggaucagag

SEQ ID NO: 990780 - RNA, 22 nt, Human
gaagcagcucagauugacugaa

SEQ ID NO: 990781 - RNA, 22 nt, Human
gugggccucuugaggguggcua

SEQ ID NO: 990782 - RNA, 22 nt, Human
acagcagagacacucaggaggc

SEQ ID NO: 990783 - RNA, 22 nt, Human
ugccugucuucaggagugucac

SEQ ID NO: 990784 - RNA, 22 nt, Human
uguaguaagugcgcaauaaaua

SEQ ID NO: 990785 - RNA, 22 nt, Human
uuuccuaugauauucuaugugu

SEQ ID NO: 990786 - RNA, 22 nt, Human
uucaaagugcauguuccucaga

SEQ ID NO: 990787 - RNA, 22 nt, Human
ggggcagcucccgagggcagga

SEQ ID NO: 990788 - RNA, 22 nt, Human
auugcacaaacacagucagacu

SEQ ID NO: 990789 - RNA, 22 nt, Human
ggggcugggauuugaacccagg

SEQ ID NO: 990790 - RNA, 22 nt, Human
ggcagccuccagggcacuggug

SEQ ID NO: 990791 - RNA, 22 nt, Human
accucccagcucugagcuuggg

SEQ ID NO: 990792 - RNA, 22 nt, Human
cagcaaaagccagcauaagcuc

SEQ ID NO: 990793 - RNA, 22 nt, Human
ucuggcaggcaaucggcucugg

SEQ ID NO: 990794 - RNA, 23 nt, Human
acaaaugcccauacaucuaguuc

SEQ ID NO: 990795 - RNA, 22 nt, Human
cugggcucagaugagaggaagg

SEQ ID NO: 990796 - RNA, 23 nt, Human
gcagauggccccagagugcugcc

SEQ ID NO: 990797 - RNA, 22 nt, Human
gggccuggggacaccaccauga

SEQ ID NO: 990798 - RNA, 22 nt, Human
uggaagagggagcuggguggcc

SEQ ID NO: 990799 - RNA, 22 nt, Human
aacccuggggcagcugcuaggg

SEQ ID NO: 990800 - RNA, 22 nt, Human
agaggccuccgaaaggugggcu

SEQ ID NO: 990801 - RNA, 22 nt, Human
ugcaguggaggccgugagacag

SEQ ID NO: 990802 - RNA, 22 nt, Human
uggcacauagaaaaggaucaau

SEQ ID NO: 990803 - RNA, 22 nt, Human
aagccuuccugagugcaaggcc

SEQ ID NO: 990804 - RNA, 22 nt, Human
gccuggcacucacugaagaggc

SEQ ID NO: 990805 - RNA, 22 nt, Human
ugguccugccccgugcacagag

SEQ ID NO: 990806 - RNA, 21 nt, Human
ugcauaaagaaauacaaauac

SEQ ID NO: 990807 - RNA, 22 nt, Human
acugcagccuuugggcucauaa

SEQ ID NO: 990808 - RNA, 22 nt, Human
ugccagcuccgaggagcugcag

SEQ ID NO: 990809 - RNA, 22 nt, Human
gccuuucaguuccaucaaagga

SEQ ID NO: 990810 - RNA, 22 nt, Human
ccaguggguaggccauggugag

SEQ ID NO: 990811 - RNA, 22 nt, Human
ucuggccacuugcuucacacug

SEQ ID NO: 990812 - RNA, 22 nt, Human
uccaagggaaacugcacuucua

SEQ ID NO: 990813 - RNA, 22 nt, Human
cggcagagcuuccugcucagcg

SEQ ID NO: 990814 - RNA, 22 nt, Human
acaauucucucauaucuuauua

SEQ ID NO: 990815 - RNA, 22 nt, Human
gaaauauuucucuugagccccu

SEQ ID NO: 990816 - RNA, 18 nt, Human
ggagagugagaucaaaca

SEQ ID NO: 990817 - RNA, 22 nt, Human
ugaaagguguccaauauuucuc

SEQ ID NO: 990818 - RNA, 22 nt, Human
ggacuggacucucaggcucaca

SEQ ID NO: 990819 - RNA, 22 nt, Human
gcugucugucucugugacuuaa

SEQ ID NO: 990820 - RNA, 22 nt, Human
uaaagaacacagggaauagcac

SEQ ID NO: 990821 - RNA, 22 nt, Human
ccugagggaaggaugcuaccca

SEQ ID NO: 990822 - RNA, 22 nt, Human
cauuucugauuacagaauacua

SEQ ID NO: 990823 - RNA, 22 nt, Human
ggagaagggacagacucagcuu

SEQ ID NO: 990824 - RNA, 22 nt, Human
acaccuuugccccaagucauag

SEQ ID NO: 990825 - RNA, 23 nt, Human
cagaaaguuugagaagauacauc

SEQ ID NO: 990826 - RNA, 22 nt, Human
gcaggcaggagcccaacugccu

SEQ ID NO: 990827 - RNA, 22 nt, Human
gccuggcccagggcuccgcagg

SEQ ID NO: 990828 - RNA, 22 nt, Human
gucccagaaacauauugcuggu

SEQ ID NO: 990829 - RNA, 22 nt, Human
gcccagaaguugaggcugcagu

SEQ ID NO: 990830 - RNA, 22 nt, Human
caggaggaggugagguagaacu

SEQ ID NO: 990831 - RNA, 22 nt, Human
acuuugcaaugggcagaaccca

SEQ ID NO: 990832 - RNA, 20 nt, Human
aagcagaagcugcucucagc

SEQ ID NO: 990833 - RNA, 22 nt, Human
aggagcugggcugcugcuggga

SEQ ID NO: 990834 - RNA, 22 nt, Human
ucugcagcuucuugccagagag

SEQ ID NO: 990835 - RNA, 22 nt, Human
aggcacugggaauaugcugagg

SEQ ID NO: 990836 - RNA, 22 nt, Human
ugcagcagguuccaaaggguua

SEQ ID NO: 990837 - RNA, 22 nt, Human
aaggccuggauuuagguuguga

SEQ ID NO: 990838 - RNA, 22 nt, Human
cugcugggucuaugcaagugga

SEQ ID NO: 990839 - RNA, 22 nt, Human
ggcuggaaguccaagaucaaga

SEQ ID NO: 990840 - RNA, 22 nt, Human
aaaguuugagugauuugacaca

SEQ ID NO: 990841 - RNA, 22 nt, Human
ugggaggaaugucacugagcca

SEQ ID NO: 990842 - RNA, 22 nt, Human
gaagcccuauccucuccuggga

SEQ ID NO: 990843 - RNA, 22 nt, Human
auggaaaggcuguggaaacuua

SEQ ID NO: 990844 - RNA, 22 nt, Human
ugucaugccauuuaaaauguuu

SEQ ID NO: 990845 - RNA, 22 nt, Human
acuaaauagccucugguaguug

SEQ ID NO: 990846 - RNA, 22 nt, Human
cugucucugucuuaacucccag

SEQ ID NO: 990847 - RNA, 22 nt, Human
cagaggcucaccagccuuucac

SEQ ID NO: 990848 - RNA, 22 nt, Human
ccugggaagagcugacaggagg

SEQ ID NO: 990849 - RNA, 22 nt, Human
agauacauauagaaaacaucaa

SEQ ID NO: 990850 - RNA, 22 nt, Human
acauugaugaaaagguaucauu

SEQ ID NO: 990851 - RNA, 22 nt, Human
cagucccacaagaucuccacaa

SEQ ID NO: 990852 - RNA, 22 nt, Human
ugggccugugaugcugggcuau

SEQ ID NO: 990853 - RNA, 22 nt, Human
cuggggggagcugcguccagca

SEQ ID NO: 990854 - RNA, 22 nt, Human
aacuccugaggaaauggucuca

SEQ ID NO: 990855 - RNA, 20 nt, Human
ucugucucugagcuagacuu

SEQ ID NO: 990856 - RNA, 22 nt, Human
cagggcugguuugucgaagaaa

SEQ ID NO: 990857 - RNA, 22 nt, Human
gagccuccuccuggugugccga

SEQ ID NO: 990858 - RNA, 22 nt, Human
guggauggacaugggcaagagg

SEQ ID NO: 990859 - RNA, 22 nt, Human
ucacaccuguaaucccaggccu

SEQ ID NO: 990860 - RNA, 22 nt, Human
agcccaaggcuucccugcuggc

SEQ ID NO: 990861 - RNA, 22 nt, Human
uuaguaaauaaagucuacuuuc

SEQ ID NO: 990862 - RNA, 22 nt, Human
caguggguggcuaaguggcuga

SEQ ID NO: 990863 - RNA, 23 nt, Human
ccagcucccaggucugaggacug

SEQ ID NO: 990864 - RNA, 22 nt, Human
ugacagcugagccccaggcaag

SEQ ID NO: 990865 - RNA, 22 nt, Human
cacagggccacuuucccaguaa

SEQ ID NO: 990866 - RNA, 22 nt, Human
aagcagcuuaaauuagagccug

SEQ ID NO: 990867 - RNA, 22 nt, Human
agcagcaacuuauuuuucuuau

SEQ ID NO: 990868 - RNA, 22 nt, Human
aucuagaaaguguugaagauca

SEQ ID NO: 990869 - RNA, 22 nt, Human
ccaggacuuauuacaguauaac

SEQ ID NO: 990870 - RNA, 22 nt, Human
aauccuggaauacaagagugaa

SEQ ID NO: 990871 - RNA, 22 nt, Human
ugggcagaucuuugguggcuag

SEQ ID NO: 990872 - RNA, 19 nt, Human
ccucccacggauuccuucc

SEQ ID NO: 990873 - RNA, 22 nt, Human
ccucacuuuccuuucuccuggg

SEQ ID NO: 990874 - RNA, 22 nt, Human
gcuggguggaucggaggcucug

SEQ ID NO: 990875 - RNA, 22 nt, Human
gcuggccuucugcagaguucug

SEQ ID NO: 990876 - RNA, 22 nt, Human
uuuugucuaagaacuuugcaaa

SEQ ID NO: 990877 - RNA, 22 nt, Human
agacagugcaagaagagcaggc

SEQ ID NO: 990878 - RNA, 22 nt, Human
ccagugggugcugggcucugcc

SEQ ID NO: 990879 - RNA, 22 nt, Human
caggcaccccaggugagcacug

SEQ ID NO: 990880 - RNA, 22 nt, Human
cugcuggggucagagcacuggg

SEQ ID NO: 990881 - RNA, 22 nt, Human
ggcugccugaggcagugagaga

SEQ ID NO: 990882 - RNA, 22 nt, Human
agggcuggcuccguuaccuuga

SEQ ID NO: 990883 - RNA, 22 nt, Human
gcuggcagggacagcugcgugu

SEQ ID NO: 990884 - RNA, 22 nt, Human
aaguaugcaaaucgucuuagaa

SEQ ID NO: 990885 - RNA, 20 nt, Human
acugggcauaccuguccugu

SEQ ID NO: 990886 - RNA, 22 nt, Human
agcagugggggaguguuaguuu

SEQ ID NO: 990887 - RNA, 22 nt, Human
agaggcugggaaggguccccgg

SEQ ID NO: 990888 - RNA, 22 nt, Human
aaaagcucuuucugcuguagau

SEQ ID NO: 990889 - RNA, 22 nt, Human
cuggcucaguucuugguuuuca

SEQ ID NO: 990890 - RNA, 20 nt, Human
ccacaggaguccagucgacc

SEQ ID NO: 990891 - RNA, 22 nt, Human
uagcacaucuggcgcuuauagg

SEQ ID NO: 990892 - RNA, 22 nt, Human
caguacuuugaagauauuuuag

SEQ ID NO: 990893 - RNA, 22 nt, Human
uggcagagcccagaacugagca

SEQ ID NO: 990894 - RNA, 22 nt, Human
acaggcugcugggcuccgugcu

SEQ ID NO: 990895 - RNA, 22 nt, Human
ggucacugcucuaaacaaaagu

SEQ ID NO: 990896 - RNA, 22 nt, Human
ugggcugccggcaggcucugcc

SEQ ID NO: 990897 - RNA, 22 nt, Human
aggugccagugcuguggucccc

SEQ ID NO: 990898 - RNA, 22 nt, Human
auucacaacaaaaggauaugag

SEQ ID NO: 990899 - RNA, 23 nt, Human
gggagccauggguggucauggag

SEQ ID NO: 990900 - RNA, 21 nt, Human
ucaggcaggcgcagagggaag

SEQ ID NO: 990901 - RNA, 22 nt, Human
ucuggccaacaaaaacuaaguc

SEQ ID NO: 990902 - RNA, 23 nt, Human
uggcagagacccagaaucuacau

SEQ ID NO: 990903 - RNA, 22 nt, Human
gagcucccuggagguucagaua

SEQ ID NO: 990904 - RNA, 22 nt, Human
aaugucugccugaacuuuauau

SEQ ID NO: 990905 - RNA, 22 nt, Human
agcccuccucacaucagcgucc

SEQ ID NO: 990906 - RNA, 22 nt, Human
gguggguuuggaagagcaggcu

SEQ ID NO: 990907 - RNA, 22 nt, Human
gagggggagaugugcacacacu

SEQ ID NO: 990908 - RNA, 22 nt, Human
cagacacagauaugcauauggc

SEQ ID NO: 990909 - RNA, 17 nt, Human
cagacagauauccuggg

SEQ ID NO: 990910 - RNA, 21 nt, Human
aggcucagcagguguauaaag

SEQ ID NO: 990911 - RNA, 22 nt, Human
aucagcaagcaugguuaggugu

SEQ ID NO: 990912 - RNA, 22 nt, Human
ggccagaggccacagcuguguc

SEQ ID NO: 990913 - RNA, 22 nt, Human
acuguguggaccacucugaggc

SEQ ID NO: 990914 - RNA, 22 nt, Human
gcugggagugggcaagaugaga

SEQ ID NO: 990915 - RNA, 22 nt, Human
ccuggguggcagagguugcagu

SEQ ID NO: 990916 - RNA, 22 nt, Human
gaggccuggcucugcccuccug

SEQ ID NO: 990917 - RNA, 22 nt, Human
ggcagaaggccucccagcuccu

SEQ ID NO: 990918 - RNA, 22 nt, Human
acagcaagccagcuugucacug

SEQ ID NO: 990919 - RNA, 19 nt, Human
gggaaauucacuugcuucc

SEQ ID NO: 990920 - RNA, 18 nt, Human
ccagagcuggcuccucgc

SEQ ID NO: 990921 - RNA, 22 nt, Human
ccuccaaguuugacucaggaca

SEQ ID NO: 990922 - RNA, 22 nt, Human
agaacagaagggaggaaggccu

SEQ ID NO: 990923 - RNA, 22 nt, Human
cuggcucagacagcugugcagu

SEQ ID NO: 990924 - RNA, 22 nt, Human
uguaauggaagugggauugcau

SEQ ID NO: 990925 - RNA, 19 nt, Human
cagcugccuuuucuuugca

SEQ ID NO: 990926 - RNA, 20 nt, Human
aguagcagugugacauugac

SEQ ID NO: 990927 - RNA, 22 nt, Human
ucaggcugccuaucagacugug

SEQ ID NO: 990928 - RNA, 22 nt, Human
acugaaggucucagcaaggaug

SEQ ID NO: 990929 - RNA, 22 nt, Human
uggcagggugccaguugcgagu

SEQ ID NO: 990930 - RNA, 22 nt, Human
ggguggaggagaacaggcccca

SEQ ID NO: 990931 - RNA, 22 nt, Human
gcaccugcaggaugagccaggg

SEQ ID NO: 990932 - RNA, 22 nt, Human
uaagugcaauguuuuacuuaaa

SEQ ID NO: 990933 - RNA, 22 nt, Human
aagcugccuagaguugaauguc

SEQ ID NO: 990934 - RNA, 22 nt, Human
gggcauguagugugcauagaga

SEQ ID NO: 990935 - RNA, 22 nt, Human
ggcugccugugcccaggcacac

SEQ ID NO: 990936 - RNA, 22 nt, Human
aagcaaagaguuuaguggguga

SEQ ID NO: 990937 - RNA, 22 nt, Human
uaccuucaccagcgaauguuug

SEQ ID NO: 990938 - RNA, 22 nt, Human
cugcuggagguuggagcaugca

SEQ ID NO: 990939 - RNA, 22 nt, Human
gugcccugguccccagcauaua

SEQ ID NO: 990940 - RNA, 20 nt, Human
agugccagggcaggugagag

SEQ ID NO: 990941 - RNA, 22 nt, Human
gcugagggcuguaacagcagag

SEQ ID NO: 990942 - RNA, 22 nt, Human
ucaaaacacuauuaccuuuaau

SEQ ID NO: 990943 - RNA, 22 nt, Human
ggcugcugcccaccccugcaug

SEQ ID NO: 990944 - RNA, 22 nt, Human
cauuuacagugagaguuuuuac

SEQ ID NO: 990945 - RNA, 22 nt, Human
gugucaugcacacucaguguug

SEQ ID NO: 990946 - RNA, 22 nt, Human
ugcauuauaacugaauguuguu

SEQ ID NO: 990947 - RNA, 22 nt, Human
uucacauuggugauauguuucu

SEQ ID NO: 990948 - RNA, 22 nt, Human
cagaccuggaaaacaggcuugc

SEQ ID NO: 990949 - RNA, 22 nt, Human
aaucacaauuacuuuugcacca

SEQ ID NO: 990950 - RNA, 22 nt, Human
acauuucugucuuagggacugu

SEQ ID NO: 990951 - RNA, 22 nt, Human
guucacaaaguacuguaugcau

SEQ ID NO: 990952 - RNA, 22 nt, Human
agcagcugccagagagaguucc

SEQ ID NO: 990953 - RNA, 22 nt, Human
ggaggccaaggaggagcuugcc

SEQ ID NO: 990954 - RNA, 20 nt, Human
cccagggaccugagcuccau

SEQ ID NO: 990955 - RNA, 19 nt, Human
ggucacagggguuacaagg

SEQ ID NO: 990956 - RNA, 22 nt, Human
ucucagagauguuagggaagag

SEQ ID NO: 990957 - RNA, 22 nt, Human
cagcugaacauguagagcaucu

SEQ ID NO: 990958 - RNA, 22 nt, Human
cuuaauaaaugguagcuguuau

SEQ ID NO: 990959 - RNA, 22 nt, Human
cauuucauaguugucacaauaa

SEQ ID NO: 990960 - RNA, 22 nt, Human
cacuaugcuuacaugcuuauau

SEQ ID NO: 990961 - RNA, 22 nt, Human
aguuaaagucugaaauagagaa

SEQ ID NO: 990962 - RNA, 22 nt, Human
ccuggcaggccccuccuggauu

SEQ ID NO: 990963 - RNA, 22 nt, Human
ugaaaaggguagaucccuaagu

SEQ ID NO: 990964 - RNA, 21 nt, Human
gcagcuggucucagagcuugc

SEQ ID NO: 990965 - RNA, 22 nt, Human
gcaccuggcugcccagguggag

SEQ ID NO: 990966 - RNA, 22 nt, Human
auguagcaucuauccugauaaa

SEQ ID NO: 990967 - RNA, 22 nt, Human
cucugagcuccuggaagcgugc

SEQ ID NO: 990968 - RNA, 22 nt, Human
uguuuaauugggccaacagcgg

SEQ ID NO: 990969 - RNA, 22 nt, Human
acagggcccuugccagcacaag

SEQ ID NO: 990970 - RNA, 22 nt, Human
uguuggcagauugucuaggguu

SEQ ID NO: 990971 - RNA, 22 nt, Human
agggccugggguagcuuacugc

SEQ ID NO: 990972 - RNA, 22 nt, Human
ggcagacaccuuuaugucuaau

SEQ ID NO: 990973 - RNA, 22 nt, Human
ucacucugauagauaagcuaac

SEQ ID NO: 990974 - RNA, 22 nt, Human
caagcagacaguaggccuagaa

SEQ ID NO: 990975 - RNA, 22 nt, Human
aggcugcagaacagucaggugc

SEQ ID NO: 990976 - RNA, 22 nt, Human
gauuaggacauggauguauguu

SEQ ID NO: 990977 - RNA, 22 nt, Human
cugcugggcuccucaugugacu

SEQ ID NO: 990978 - RNA, 22 nt, Human
augcacuugcguguuugcaaau

SEQ ID NO: 990979 - RNA, 22 nt, Human
uggcugccuagucccucagccu

SEQ ID NO: 990980 - RNA, 22 nt, Human
aggcuuccgaguagcugggacu

SEQ ID NO: 990981 - RNA, 22 nt, Human
uaggcagggauuaggguugauu

SEQ ID NO: 990982 - RNA, 22 nt, Human
ugagcuuccucccugcauccau

SEQ ID NO: 990983 - RNA, 21 nt, Human
cagaggcagguccugggacgg

SEQ ID NO: 990984 - RNA, 22 nt, Human
cccagcacuuugaauaugucac

SEQ ID NO: 990985 - RNA, 22 nt, Human
cuucacaaauggccuagaguuc

SEQ ID NO: 990986 - RNA, 22 nt, Human
ggaucauuaacacauccaucac

SEQ ID NO: 990987 - RNA, 22 nt, Human
agccuggcacugaggcagggcg

SEQ ID NO: 990988 - RNA, 17 nt, Human
gugcagggaugaaggau

SEQ ID NO: 990989 - RNA, 22 nt, Human
agccauggcgccacuagaggga

SEQ ID NO: 990990 - RNA, 22 nt, Human
ccuccuggugggcgcuucuggc

SEQ ID NO: 990991 - RNA, 17 nt, Human
ucuguccagggagugug

SEQ ID NO: 990992 - RNA, 22 nt, Human
ugcugccacauuuaaagagggg

SEQ ID NO: 990993 - RNA, 22 nt, Human
aauguauaaaguguuaauaacu

SEQ ID NO: 990994 - RNA, 22 nt, Human
gcucugcucccucaaaugacau

SEQ ID NO: 990995 - RNA, 22 nt, Human
ugugccuuaugaauucuuucug

SEQ ID NO: 990996 - RNA, 22 nt, Human
ggcagcagaacuggcccuguau

SEQ ID NO: 990997 - RNA, 22 nt, Human
caggagcccagaguccucagcu

SEQ ID NO: 990998 - RNA, 22 nt, Human
aggcacugcuucuaaguaggaa

SEQ ID NO: 990999 - RNA, 22 nt, Human
ucaggcugugggcacuggccau

SEQ ID NO: 991000 - RNA, 22 nt, Human
aaacuccugggcucaagcaguu

SEQ ID NO: 991001 - RNA, 22 nt, Human
gcuggcauuacaggagagaacc

SEQ ID NO: 991002 - RNA, 22 nt, Human
uaugcacaguuacaagaauauc

SEQ ID NO: 991003 - RNA, 22 nt, Human
ccaaggcuccucagcuggucuu

SEQ ID NO: 991004 - RNA, 22 nt, Human
ucacugcucucuaagcaucgcc

SEQ ID NO: 991005 - RNA, 22 nt, Human
ucuuggcaauuugaucucaguu

SEQ ID NO: 991006 - RNA, 22 nt, Human
uccugagagcagaguccaggug

SEQ ID NO: 991007 - RNA, 22 nt, Human
auuauguaacugugguucagca

SEQ ID NO: 991008 - RNA, 22 nt, Human
uuaaacaguguuucaugugggg

SEQ ID NO: 991009 - RNA, 22 nt, Human
cugcagaggccucgccuccucu

SEQ ID NO: 991010 - RNA, 22 nt, Human
uggcucagucauggaugaguaa

SEQ ID NO: 991011 - RNA, 22 nt, Human
agacaacaccaaaugcuagugu

SEQ ID NO: 991012 - RNA, 22 nt, Human
ccaggaguuggagguugcagug

SEQ ID NO: 991013 - RNA, 22 nt, Human
ugaaaucuuagccauucugccu

SEQ ID NO: 991014 - RNA, 17 nt, Human
uuccaguuuaguauugu

SEQ ID NO: 991015 - RNA, 22 nt, Human
ggcagcaggcgacuucccuauu

SEQ ID NO: 991016 - RNA, 22 nt, Human
uugcauugaugucuauacgcug

SEQ ID NO: 991017 - RNA, 22 nt, Human
uucugagguccaugcaguacug

SEQ ID NO: 991018 - RNA, 22 nt, Human
cuugucugugucggauaaaacu

SEQ ID NO: 991019 - RNA, 22 nt, Human
cugggcagagcuaacaccugag

SEQ ID NO: 991020 - RNA, 22 nt, Human
aagcugaggcccauggcaaggu

SEQ ID NO: 991021 - RNA, 22 nt, Human
acauuucuuagccuaguuccag

SEQ ID NO: 991022 - RNA, 21 nt, Human
ggucuuccaaauaaggagaaa

SEQ ID NO: 991023 - RNA, 22 nt, Human
ucaaugauaucagcaggaugug

SEQ ID NO: 991024 - RNA, 22 nt, Human
ugccagugggugugcagagacu

SEQ ID NO: 991025 - RNA, 22 nt, Human
cuuaacagcaagaucuguguca

SEQ ID NO: 991026 - RNA, 23 nt, Human
uggcucucucagugcugcagagg

SEQ ID NO: 991027 - RNA, 22 nt, Human
gcacagccagcaucugagggau

SEQ ID NO: 991028 - RNA, 22 nt, Human
acuuccuggcugggugaccugg

SEQ ID NO: 991029 - RNA, 22 nt, Human
ucacugaauacuugucucaucc

SEQ ID NO: 991030 - RNA, 22 nt, Human
ucauaaaaugcuccugauauug

SEQ ID NO: 991031 - RNA, 22 nt, Human
cuacuucugugaugaaacuaca

SEQ ID NO: 991032 - RNA, 22 nt, Human
cccagcucucucaguucugcuu

SEQ ID NO: 991033 - RNA, 22 nt, Human
aguucuuuugugaacauaugcu

SEQ ID NO: 991034 - RNA, 19 nt, Human
uggcucugucgaaggcaca

SEQ ID NO: 991035 - RNA, 22 nt, Human
cuagagggauguuaggauagca

SEQ ID NO: 991036 - RNA, 22 nt, Human
ccuggcugguggcagcgacaag

SEQ ID NO: 991037 - RNA, 22 nt, Human
aaguguauauaugacuuauaaa

SEQ ID NO: 991038 - RNA, 22 nt, Human
caagggaguuacugagggcggg

SEQ ID NO: 991039 - RNA, 19 nt, Human
gcuccugggccucacucau

SEQ ID NO: 991040 - RNA, 22 nt, Human
cccauuuaucccaagguuacuc

SEQ ID NO: 991041 - RNA, 22 nt, Human
aagaauaaauuaagauacuuag

SEQ ID NO: 991042 - RNA, 22 nt, Human
caagaauuguacaaacugggug

SEQ ID NO: 991043 - RNA, 22 nt, Human
gguggcaggcccugagcauccc

SEQ ID NO: 991044 - RNA, 22 nt, Human
agggggugcuacuuccagaguu

SEQ ID NO: 991045 - RNA, 22 nt, Human
cuucuccucugaguccugggag

SEQ ID NO: 991046 - RNA, 22 nt, Human
ugugccauuucuauucugcagc

SEQ ID NO: 991047 - RNA, 22 nt, Human
uauagagguggaaacugagguu

SEQ ID NO: 991048 - RNA, 22 nt, Human
ucacaaagggagggauagcugg

SEQ ID NO: 991049 - RNA, 22 nt, Human
cuggucugagggcucuugaggc

SEQ ID NO: 991050 - RNA, 22 nt, Human
aguacuuuacuucuuacaguuu

SEQ ID NO: 991051 - RNA, 22 nt, Human
uugcuuccaguccaagucuguu

SEQ ID NO: 991052 - RNA, 22 nt, Human
uacagggguaacaguggggaau

SEQ ID NO: 991053 - RNA, 22 nt, Human
ccucagggacuccaugcugcag

SEQ ID NO: 991054 - RNA, 22 nt, Human
gcucccugaaaagaacaaaguc

SEQ ID NO: 991055 - RNA, 20 nt, Human
caguagcaauaauuagaagc

SEQ ID NO: 991056 - RNA, 22 nt, Human
gcaaagguagccaaggagcuca

SEQ ID NO: 991057 - RNA, 22 nt, Human
uggagcaggacugcugcccuca

SEQ ID NO: 991058 - RNA, 22 nt, Human
agaggggcucaagcaguggucu

SEQ ID NO: 991059 - RNA, 22 nt, Human
uguguacacaaugauugcagag

SEQ ID NO: 991060 - RNA, 22 nt, Human
ugauuuccccagucuugcugcu

SEQ ID NO: 991061 - RNA, 22 nt, Human
gcagugggagcuuaggcagugc

SEQ ID NO: 991062 - RNA, 22 nt, Human
gaggcaugucuggccuguccca

SEQ ID NO: 991063 - RNA, 22 nt, Human
augacacaauuuuagagcugaa

SEQ ID NO: 991064 - RNA, 22 nt, Human
aagcaauaagccagauuuggau

SEQ ID NO: 991065 - RNA, 22 nt, Human
cagcuccucacgagucuugaaa

SEQ ID NO: 991066 - RNA, 22 nt, Human
gguccccagcaguggcugcuuc

SEQ ID NO: 991067 - RNA, 22 nt, Human
caaagucccagcugcuuagaga

SEQ ID NO: 991068 - RNA, 20 nt, Human
cagagcuguuauggaugaug

SEQ ID NO: 991069 - RNA, 22 nt, Human
uacaguauuaugagugauugaa

SEQ ID NO: 991070 - RNA, 22 nt, Human
aggcugggaaauguagucuucc

SEQ ID NO: 991071 - RNA, 22 nt, Human
cagccagaaccuaggaugagcu

SEQ ID NO: 991072 - RNA, 21 nt, Human
ugaaacacucuuuccaugaga

SEQ ID NO: 991073 - RNA, 22 nt, Human
uccuugaaugaagagaggugac

SEQ ID NO: 991074 - RNA, 22 nt, Human
agcagggggaguuagacuagau

SEQ ID NO: 991075 - RNA, 22 nt, Human
aguuuguaucaauuugcuuuau

SEQ ID NO: 991076 - RNA, 18 nt, Human
cucucugggugaggacaa

SEQ ID NO: 991077 - RNA, 22 nt, Human
cagagguagaaggcaugcagug

SEQ ID NO: 991078 - RNA, 22 nt, Human
augggcuguccuaguccagccc

SEQ ID NO: 991079 - RNA, 22 nt, Human
gggacugggagauccuccuggc

SEQ ID NO: 991080 - RNA, 22 nt, Human
gcacacagccagcugagggcua

SEQ ID NO: 991081 - RNA, 22 nt, Human
aggccuggugaaugaaguaucu

SEQ ID NO: 991082 - RNA, 22 nt, Human
uuuucauuguuacuaugagcua

SEQ ID NO: 991083 - RNA, 22 nt, Human
ccagcuugaagaugugcugguu

SEQ ID NO: 991084 - RNA, 22 nt, Human
ugcaggggcuugucugggccug

SEQ ID NO: 991085 - RNA, 22 nt, Human
cccagcuccuuacagggccgaa

SEQ ID NO: 991086 - RNA, 22 nt, Human
ucucagggagggcgagucagcg

SEQ ID NO: 991087 - RNA, 20 nt, Human
auucacaaagccaguguugc

SEQ ID NO: 991088 - RNA, 22 nt, Human
aagacauuacuggaaucugacu

SEQ ID NO: 991089 - RNA, 22 nt, Human
agagugaagguugacacuucac

SEQ ID NO: 991090 - RNA, 22 nt, Human
uuucaauguaugucuuucugag

SEQ ID NO: 991091 - RNA, 22 nt, Human
uggagcaggaagucuauggcug

SEQ ID NO: 991092 - RNA, 17 nt, Human
uucaaugauuaaugcau

SEQ ID NO: 991093 - RNA, 22 nt, Human
uuucacaaacucagggugugug

SEQ ID NO: 991094 - RNA, 22 nt, Human
ucaggagauggucuuuauaggc

SEQ ID NO: 991095 - RNA, 22 nt, Human
caggagacaaguuagcagcuga

SEQ ID NO: 991096 - RNA, 22 nt, Human
augucuuucgcaucaguagcua

SEQ ID NO: 991097 - RNA, 22 nt, Human
gccacaggcacuuaagggcugg

SEQ ID NO: 991098 - RNA, 22 nt, Human
acugcagggcauccuggccaag

SEQ ID NO: 991099 - RNA, 22 nt, Human
acuccagggcuccaucccuugu

SEQ ID NO: 991100 - RNA, 22 nt, Human
uaggauaggauggagacagaau

SEQ ID NO: 991101 - RNA, 22 nt, Human
cuauuucugccuaaugaccugu

SEQ ID NO: 991102 - RNA, 22 nt, Human
aacucugccagguuucaggagc

SEQ ID NO: 991103 - RNA, 22 nt, Human
aaaucuaggcucauccuggucc

SEQ ID NO: 991104 - RNA, 20 nt, Human
agugucugggccucaggccc

SEQ ID NO: 991105 - RNA, 22 nt, Human
gaggcagcagggcugguuccuu

SEQ ID NO: 991106 - RNA, 22 nt, Human
agaucaaagccaugagagauuu

SEQ ID NO: 991107 - RNA, 22 nt, Human
ugccagaagugcuuuauaagug

SEQ ID NO: 991108 - RNA, 22 nt, Human
uguuaaauguuccuuuacugga

SEQ ID NO: 991109 - RNA, 22 nt, Human
cccuggaggcggauguugcagu

SEQ ID NO: 991110 - RNA, 22 nt, Human
cuggcccagagcucuggccuuu

SEQ ID NO: 991111 - RNA, 22 nt, Human
auacauuagcucauaugauuaa

SEQ ID NO: 991112 - RNA, 21 nt, Human
ugccagcauuaaacagucauu

SEQ ID NO: 991113 - RNA, 22 nt, Human
ggcagaggaagcuggaaguggg

SEQ ID NO: 991114 - RNA, 21 nt, Human
aagaagcaauuuauuggaagg

SEQ ID NO: 991115 - RNA, 22 nt, Human
ggcaaaaacagcaaugacuuuu

SEQ ID NO: 991116 - RNA, 22 nt, Human
agcuuccuguugagagagggag

SEQ ID NO: 991117 - RNA, 22 nt, Human
agccagcuggagaccacuguuu

SEQ ID NO: 991118 - RNA, 22 nt, Human
cuggcuggcaaguagaacacaa

SEQ ID NO: 991119 - RNA, 22 nt, Human
acccugagggguauagcagaag

SEQ ID NO: 991120 - RNA, 22 nt, Human
gugcaagguacauccuugaugu

SEQ ID NO: 991121 - RNA, 22 nt, Human
cuuccugcauugugccagaguu

SEQ ID NO: 991122 - RNA, 22 nt, Human
augcugagacuggagcagcugg

SEQ ID NO: 991123 - RNA, 22 nt, Human
agggugggcuagacucuucccc

SEQ ID NO: 991124 - RNA, 22 nt, Human
gcucugaggcugggagcacucu

SEQ ID NO: 991125 - RNA, 22 nt, Human
ucucagagaagugaugagcaau

SEQ ID NO: 991126 - RNA, 19 nt, Human
agaaaucucgagauuuguu

SEQ ID NO: 991127 - RNA, 22 nt, Human
gcugucuguucgagcguguguu

SEQ ID NO: 991128 - RNA, 22 nt, Human
aaagaugucauacacauuaaga

SEQ ID NO: 991129 - RNA, 22 nt, Human
cuuacauuaaguaagagauuga

SEQ ID NO: 991130 - RNA, 22 nt, Human
auugucgcuuauuuaggugcuu

SEQ ID NO: 991131 - RNA, 21 nt, Human
acagagccgggcacaaagcug

SEQ ID NO: 991132 - RNA, 22 nt, Human
caggcaggagccagggauucca

SEQ ID NO: 991133 - RNA, 22 nt, Human
uuccuggccccaccccuggaga

SEQ ID NO: 991134 - RNA, 22 nt, Human
cuacauuaaauuggcuuacuua

SEQ ID NO: 991135 - RNA, 22 nt, Human
acaaaaagggagaugagguaga

SEQ ID NO: 991136 - RNA, 22 nt, Human
cccaggaggcagaaguugcagu

SEQ ID NO: 991137 - RNA, 22 nt, Human
cuggcugcuuguagacucgacu

SEQ ID NO: 991138 - RNA, 22 nt, Human
gccaggcuguggggaacuugaa

SEQ ID NO: 991139 - RNA, 22 nt, Human
gaaggaaaaauacucuguaagg

SEQ ID NO: 991140 - RNA, 22 nt, Human
agaggcaguauacaauccgagc

SEQ ID NO: 991141 - RNA, 22 nt, Human
ucaagaaagggcuucaccagga

SEQ ID NO: 991142 - RNA, 22 nt, Human
acucugugugaguagagccugu

SEQ ID NO: 991143 - RNA, 22 nt, Human
auacauguucguguacauguuc

SEQ ID NO: 991144 - RNA, 22 nt, Human
gugcauuugugcaugcacaugu

SEQ ID NO: 991145 - RNA, 22 nt, Human
uagagcugcuggacuguaacag

SEQ ID NO: 991146 - RNA, 22 nt, Human
uuuggaaaguguacaaauuuga

SEQ ID NO: 991147 - RNA, 22 nt, Human
cacaggcuuccaguccccagcu

SEQ ID NO: 991148 - RNA, 22 nt, Human
cugcaggaauucaaagugagcu

SEQ ID NO: 991149 - RNA, 22 nt, Human
uggcagccacaucucguggauu

SEQ ID NO: 991150 - RNA, 22 nt, Human
uacaaaguauauuucuagcugu

SEQ ID NO: 991151 - RNA, 22 nt, Human
gcugguuagaaaacagagcuca

SEQ ID NO: 991152 - RNA, 22 nt, Human
gccugccugcugugugcaaguu

SEQ ID NO: 991153 - RNA, 22 nt, Human
uggcagcuccuggggccagcac

SEQ ID NO: 991154 - RNA, 22 nt, Human
gggguugguuuaaaugcuugag

SEQ ID NO: 991155 - RNA, 23 nt, Human
cuucacaaucaaaaucaguucug

SEQ ID NO: 991156 - RNA, 22 nt, Human
gcaggccucuguugagggccuu

SEQ ID NO: 991157 - RNA, 22 nt, Human
ucugaggcauacccaggccccc

SEQ ID NO: 991158 - RNA, 22 nt, Human
aggcuccuuguucaucauccau

SEQ ID NO: 991159 - RNA, 22 nt, Human
ucuucucaguuucucuaggaug

SEQ ID NO: 991160 - RNA, 22 nt, Human
aaguucaagagugacauauuag

SEQ ID NO: 991161 - RNA, 22 nt, Human
uugaaaugcagauuccaaucca

SEQ ID NO: 991162 - RNA, 22 nt, Human
gagagucacugucugcauuucc

SEQ ID NO: 991163 - RNA, 22 nt, Human
acagaccaaguuuccagcaggu

SEQ ID NO: 991164 - RNA, 22 nt, Human
auaacagauacucucugugagg

SEQ ID NO: 991165 - RNA, 22 nt, Human
uccugccucuuuucuuauucca

SEQ ID NO: 991166 - RNA, 22 nt, Human
uagcagcucacagccucccauu

SEQ ID NO: 991167 - RNA, 22 nt, Human
guggccaaaucaugucaaaggc

SEQ ID NO: 991168 - RNA, 22 nt, Human
cacagggcagagaccugggugc

SEQ ID NO: 991169 - RNA, 21 nt, Human
uguaaguuucaucugaauugg

SEQ ID NO: 991170 - RNA, 19 nt, Human
uccugggcugcgucuugcc

SEQ ID NO: 991171 - RNA, 22 nt, Human
gcccaucaucacuguggaggcu

SEQ ID NO: 991172 - RNA, 22 nt, Human
ugggcagagucauacaggagac

SEQ ID NO: 991173 - RNA, 22 nt, Human
ccugaagcaaggguaggcaggu

SEQ ID NO: 991174 - RNA, 21 nt, Human
uggcucugcucagagcagucc

SEQ ID NO: 991175 - RNA, 22 nt, Human
gaagcccaggcuuccuuggcuu

SEQ ID NO: 991176 - RNA, 22 nt, Human
uuguuuuuaugaacauccagga

SEQ ID NO: 991177 - RNA, 22 nt, Human
cccagggaaugacucuggccuu

SEQ ID NO: 991178 - RNA, 22 nt, Human
uuuuaauacugcuauuguagga

SEQ ID NO: 991179 - RNA, 22 nt, Human
aguuauauuccauagauucaga

SEQ ID NO: 991180 - RNA, 22 nt, Human
ccacacagggggaugaguuauu

SEQ ID NO: 991181 - RNA, 22 nt, Human
auuaggaaauguguugcaagca

SEQ ID NO: 991182 - RNA, 22 nt, Human
ucccagcauuaaugccugucag

SEQ ID NO: 991183 - RNA, 22 nt, Human
gcuuagaaguuccuauaaaaug

SEQ ID NO: 991184 - RNA, 22 nt, Human
aggaggccgcugaugggcuccc

SEQ ID NO: 991185 - RNA, 19 nt, Human
cucagcuguagcucaugug

SEQ ID NO: 991186 - RNA, 22 nt, Human
ugcuggggguucagaugaguaa

SEQ ID NO: 991187 - RNA, 17 nt, Human
ccagguggaaucgugga

SEQ ID NO: 991188 - RNA, 22 nt, Human
aguggggagguccaggccaccc

SEQ ID NO: 991189 - RNA, 19 nt, Human
acaagggcaggcaagguga

SEQ ID NO: 991190 - RNA, 22 nt, Human
gaaggaagucauuagugcagac

SEQ ID NO: 991191 - RNA, 22 nt, Human
ggcuucauggaggaggugaguc

SEQ ID NO: 991192 - RNA, 22 nt, Human
aaaaguauuggccaccauuucu

SEQ ID NO: 991193 - RNA, 18 nt, Human
gguggcaggucagaugcc

SEQ ID NO: 991194 - RNA, 22 nt, Human
ccucuggggguccucagagucu

SEQ ID NO: 991195 - RNA, 22 nt, Human
ucucagggccccaaaggcuagu

SEQ ID NO: 991196 - RNA, 22 nt, Human
gcagcccagagcgcaggacccc

SEQ ID NO: 991197 - RNA, 20 nt, Human
gccugcagguuggaugggau

SEQ ID NO: 991198 - RNA, 22 nt, Human
aaaugugcuucuuacucucaau

SEQ ID NO: 991199 - RNA, 22 nt, Human
cucuggccgcagcucagcucug

SEQ ID NO: 991200 - RNA, 22 nt, Human
caggcugcagcagcaguggccc

SEQ ID NO: 991201 - RNA, 17 nt, Human
ccucacagggaccagac

SEQ ID NO: 991202 - RNA, 22 nt, Human
gccuggucucuuucaugucagu

SEQ ID NO: 991203 - RNA, 22 nt, Human
gugucccaggagaggagacaau

SEQ ID NO: 991204 - RNA, 22 nt, Human
ucagagugggagaaugugccaa

SEQ ID NO: 991205 - RNA, 22 nt, Human
ccaggugguucaggucaccaua

SEQ ID NO: 991206 - RNA, 22 nt, Human
gcuggagccaagcugcucuugg

SEQ ID NO: 991207 - RNA, 20 nt, Human
uuucagugguuugugccuag

SEQ ID NO: 991208 - RNA, 22 nt, Human
gggaaccagccgcuuccgccuc

SEQ ID NO: 991209 - RNA, 22 nt, Human
auaucuuuguaugguucagcag

SEQ ID NO: 991210 - RNA, 22 nt, Human
cgcugccaggucaccaggggua

SEQ ID NO: 991211 - RNA, 22 nt, Human
cugcucugaguauuaacggagg

SEQ ID NO: 991212 - RNA, 22 nt, Human
cuuucacauaauugaccuugaa

SEQ ID NO: 991213 - RNA, 22 nt, Human
acauagaaccuggcacauagua

SEQ ID NO: 991214 - RNA, 22 nt, Human
ucagcugagcuccagcucauag

SEQ ID NO: 991215 - RNA, 22 nt, Human
gugccugugcggacucagggaa

SEQ ID NO: 991216 - RNA, 22 nt, Human
aaauugcaaaaguacuuuuagg

SEQ ID NO: 991217 - RNA, 22 nt, Human
agaacuuaggaacaacagcuua

SEQ ID NO: 991218 - RNA, 22 nt, Human
ugauuuccaugaagcugaaggc

SEQ ID NO: 991219 - RNA, 22 nt, Human
uccaggcugggcugaagggugc

SEQ ID NO: 991220 - RNA, 22 nt, Human
gaggcaggguguugauuacaga

SEQ ID NO: 991221 - RNA, 22 nt, Human
cacagaggacuguagcggggag

SEQ ID NO: 991222 - RNA, 22 nt, Human
ggaagggccucgggcgugggac

SEQ ID NO: 991223 - RNA, 22 nt, Human
ccaucagcaugggagcaugggc

SEQ ID NO: 991224 - RNA, 22 nt, Human
cagggcuguaaauuagugcuga

SEQ ID NO: 991225 - RNA, 22 nt, Human
gucaugccuggcuucuuagaca

SEQ ID NO: 991226 - RNA, 22 nt, Human
ccucccagugccuccagagcag

SEQ ID NO: 991227 - RNA, 22 nt, Human
cucaggauguacuacagaaggc

SEQ ID NO: 991228 - RNA, 22 nt, Human
augagcugggccauccagugau

SEQ ID NO: 991229 - RNA, 22 nt, Human
cgcagcagccccgugguaggug

SEQ ID NO: 991230 - RNA, 22 nt, Human
uuggcaucaguguaggaccugu

SEQ ID NO: 991231 - RNA, 22 nt, Human
aaguuauugcagcaauccaagu

SEQ ID NO: 991232 - RNA, 22 nt, Human
uccauggggcccaggaugagag

SEQ ID NO: 991233 - RNA, 22 nt, Human
uggcacaugguaagacucagua

SEQ ID NO: 991234 - RNA, 22 nt, Human
aagauuuccuggauguaauucc

SEQ ID NO: 991235 - RNA, 21 nt, Human
agaagccuggguggagguggg

SEQ ID NO: 991236 - RNA, 22 nt, Human
aggagccccucuucaguccugg

SEQ ID NO: 991237 - RNA, 22 nt, Human
agcuggcuccagaaggagucgu

SEQ ID NO: 991238 - RNA, 22 nt, Human
agggucugcauuccaacuuggg

SEQ ID NO: 991239 - RNA, 22 nt, Human
aacaguaucuuuuaucagaaau

SEQ ID NO: 991240 - RNA, 22 nt, Human
ccucaggggcuuuucguuguug

SEQ ID NO: 991241 - RNA, 22 nt, Human
ucuugggauugcccugcaguuc

SEQ ID NO: 991242 - RNA, 22 nt, Human
ucuggcucauacaagccugcaa

SEQ ID NO: 991243 - RNA, 22 nt, Human
ccuggcaggcuggggacagugc

SEQ ID NO: 991244 - RNA, 22 nt, Human
uggaggaaaauuacuggggucu

SEQ ID NO: 991245 - RNA, 20 nt, Human
agucccagaucaaauuucug

SEQ ID NO: 991246 - RNA, 22 nt, Human
auaaaaguuuccaaucaugccu

SEQ ID NO: 991247 - RNA, 20 nt, Human
acauggaaggucaaacuauc

SEQ ID NO: 991248 - RNA, 22 nt, Human
agaagccauugaagcagaccuc

SEQ ID NO: 991249 - RNA, 20 nt, Human
ucuggcucuuugcuccuccc

SEQ ID NO: 991250 - RNA, 20 nt, Human
cucuggcuccgcgugaccgc

SEQ ID NO: 991251 - RNA, 22 nt, Human
ucgagucauguucucccauuaa

SEQ ID NO: 991252 - RNA, 22 nt, Human
cccuggagcugcuugcauguug

SEQ ID NO: 991253 - RNA, 22 nt, Human
ccagcauggcaccugagaugag

SEQ ID NO: 991254 - RNA, 22 nt, Human
cugccuugaggagguuguggga

SEQ ID NO: 991255 - RNA, 22 nt, Human
caauguguuugcauauuaaaau

SEQ ID NO: 991256 - RNA, 22 nt, Human
ugcagggcccuugggguugaac

SEQ ID NO: 991257 - RNA, 22 nt, Human
aacaucuuuuuguuugcugaaa

SEQ ID NO: 991258 - RNA, 22 nt, Human
uagaaaugcccagauucugcua

SEQ ID NO: 991259 - RNA, 22 nt, Human
uccagccaccaccuugauugcc

SEQ ID NO: 991260 - RNA, 22 nt, Human
guuccaaacaagucauaaagua

SEQ ID NO: 991261 - RNA, 22 nt, Human
gaauauuaguaucaguuauacc

SEQ ID NO: 991262 - RNA, 22 nt, Human
gcaaggcagcgcggaguagcua

SEQ ID NO: 991263 - RNA, 22 nt, Human
aguggcagaagucacuggguag

SEQ ID NO: 991264 - RNA, 22 nt, Human
uggguagaggaauugggcuacc

SEQ ID NO: 991265 - RNA, 22 nt, Human
uccugccuugccugggacauca

SEQ ID NO: 991266 - RNA, 22 nt, Human
caggccagugugcuucccaggc

SEQ ID NO: 991267 - RNA, 22 nt, Human
ggggaggcugaugugggcaaag

SEQ ID NO: 991268 - RNA, 22 nt, Human
gccagcagcccagaaggacuuu

SEQ ID NO: 991269 - RNA, 22 nt, Human
ggcacugggagaggugagacgg

SEQ ID NO: 991270 - RNA, 22 nt, Human
aggucacacuuggaucauagaa

SEQ ID NO: 991271 - RNA, 19 nt, Human
ucauaaggagagaggaaau

SEQ ID NO: 991272 - RNA, 22 nt, Human
gggcuacagacaugcucuaagc

SEQ ID NO: 991273 - RNA, 22 nt, Human
aagaacaacugcuuuaaaagca

SEQ ID NO: 991274 - RNA, 22 nt, Human
gcugcagccaaauucauuguca

SEQ ID NO: 991275 - RNA, 22 nt, Human
uggcccugcuggccaaaggcua

SEQ ID NO: 991276 - RNA, 22 nt, Human
ugaggcaggagguugagaacug

SEQ ID NO: 991277 - RNA, 22 nt, Human
ugcagaggaccauuguccugga

SEQ ID NO: 991278 - RNA, 22 nt, Human
ucuuuucuggacucugcaugga

SEQ ID NO: 991279 - RNA, 22 nt, Human
uggguggaauaaaucaguucug

SEQ ID NO: 991280 - RNA, 22 nt, Human
aauuucaaugcacucaugguug

SEQ ID NO: 991281 - RNA, 22 nt, Human
agggagccagaguugggagcuc

SEQ ID NO: 991282 - RNA, 18 nt, Human
uuaaggauaagcagacua

SEQ ID NO: 991283 - RNA, 22 nt, Human
aggcugggaaauguauuccagc

SEQ ID NO: 991284 - RNA, 22 nt, Human
gagcugccagacaugggaauga

SEQ ID NO: 991285 - RNA, 17 nt, Human
agcagcuggguugaucu

SEQ ID NO: 991286 - RNA, 22 nt, Human
cugggccaaaagaaguguucuu

SEQ ID NO: 991287 - RNA, 22 nt, Human
uuaaaaugcagauuaugacuca

SEQ ID NO: 991288 - RNA, 22 nt, Human
aguggcaguagaugagcugguu

SEQ ID NO: 991289 - RNA, 22 nt, Human
gcucugugcaguucagggacac

SEQ ID NO: 991290 - RNA, 22 nt, Human
uggccacaugcgucugugaggc

SEQ ID NO: 991291 - RNA, 22 nt, Human
gacagggccgcagauggagacu

SEQ ID NO: 991292 - RNA, 22 nt, Human
uacaguauggaaaauguauagu

SEQ ID NO: 991293 - RNA, 22 nt, Human
uccugagggcgauucagcaggu

SEQ ID NO: 991294 - RNA, 22 nt, Human
uucugagcuacauaguacuggg

SEQ ID NO: 991295 - RNA, 22 nt, Human
uuauuaaugaguacaaguuauu

SEQ ID NO: 991296 - RNA, 22 nt, Human
gacauucacaguuuccgauggu

SEQ ID NO: 991297 - RNA, 22 nt, Human
agcccaagcauaggagggaggc

SEQ ID NO: 991298 - RNA, 22 nt, Human
aggcuccuugcucacaggcuca

SEQ ID NO: 991299 - RNA, 21 nt, Human
ccagcagcucaaggaucucuu

SEQ ID NO: 991300 - RNA, 23 nt, Human
ucugucacuuucugcuguggagu

SEQ ID NO: 991301 - RNA, 22 nt, Human
ugggaaauguguuucuggacca

SEQ ID NO: 991302 - RNA, 22 nt, Human
gcuccuggugcuguagagauuu

SEQ ID NO: 991303 - RNA, 19 nt, Human
ugaaggagggggauggcca

SEQ ID NO: 991304 - RNA, 22 nt, Human
aggcucugugcagccugcaucu

SEQ ID NO: 991305 - RNA, 22 nt, Human
uggcacugagcagccgcggcag

SEQ ID NO: 991306 - RNA, 22 nt, Human
ugcagaagacacaagguaacgu

SEQ ID NO: 991307 - RNA, 22 nt, Human
ggagcugcucagagccaguccc

SEQ ID NO: 991308 - RNA, 19 nt, Human
cugugcaggccgggcugag

SEQ ID NO: 991309 - RNA, 22 nt, Human
acccugggcuuggccugcucag

SEQ ID NO: 991310 - RNA, 23 nt, Human
ccagucucuuuccaaaaucacau

SEQ ID NO: 991311 - RNA, 21 nt, Human
ugccagcauguaggcuaguug

SEQ ID NO: 991312 - RNA, 22 nt, Human
uggagcagccaugaugacagag

SEQ ID NO: 991313 - RNA, 22 nt, Human
ccauuugucaccucugcacucc

SEQ ID NO: 991314 - RNA, 22 nt, Human
gcaaaugaguuguaacauaaaa

SEQ ID NO: 991315 - RNA, 22 nt, Human
agcugcuguccuaggcacugua

SEQ ID NO: 991316 - RNA, 22 nt, Human
uagauuuccucuuccucauucc

SEQ ID NO: 991317 - RNA, 21 nt, Human
ucuccuggguccaacccaugc

SEQ ID NO: 991318 - RNA, 22 nt, Human
uggccuggcagagcaaggccug

SEQ ID NO: 991319 - RNA, 18 nt, Human
ucucuuuuccccucauug

SEQ ID NO: 991320 - RNA, 22 nt, Human
acugccugcucauaacauugcu

SEQ ID NO: 991321 - RNA, 22 nt, Human
uuauugccugauugaggucauu

SEQ ID NO: 991322 - RNA, 20 nt, Human
gagauggcuaagugcugaac

SEQ ID NO: 991323 - RNA, 22 nt, Human
gcaauaaauaacauggaagaca

SEQ ID NO: 991324 - RNA, 19 nt, Human
uuagaaacuguugacacug

SEQ ID NO: 991325 - RNA, 22 nt, Human
gcugccugggcaggaggcgcug

SEQ ID NO: 991326 - RNA, 22 nt, Human
uugauacaggcucuauuucauc

SEQ ID NO: 991327 - RNA, 22 nt, Human
gaaauguguuguucauuucuaa

SEQ ID NO: 991328 - RNA, 22 nt, Human
gugcuuccugccuggugccuuu

SEQ ID NO: 991329 - RNA, 20 nt, Human
uauauaggaaauauuguguu

SEQ ID NO: 991330 - RNA, 22 nt, Human
gagcuggcuaauacugacuuau

SEQ ID NO: 991331 - RNA, 21 nt, Human
uuaagagcuuagcaguaggcc

SEQ ID NO: 991332 - RNA, 22 nt, Human
ccacucugauuggucaccucug

SEQ ID NO: 991333 - RNA, 22 nt, Human
acuccugguucccaguugagau

SEQ ID NO: 991334 - RNA, 22 nt, Human
ucaaaugcacguagagaaaaua

SEQ ID NO: 991335 - RNA, 22 nt, Human
aaaaugcaugagaaugugcucg

SEQ ID NO: 991336 - RNA, 22 nt, Human
gaaguucaggugggaauugagc

SEQ ID NO: 991337 - RNA, 22 nt, Human
ccucuggggugagugggccacu

SEQ ID NO: 991338 - RNA, 21 nt, Human
agagaauugccuuagauguuc

SEQ ID NO: 991339 - RNA, 22 nt, Human
ggauggagguucucagaugcuc

SEQ ID NO: 991340 - RNA, 22 nt, Human
gaggcagcaucuauggugggaa

SEQ ID NO: 991341 - RNA, 22 nt, Human
uggccugggcaugaagcaucgu

SEQ ID NO: 991342 - RNA, 22 nt, Human
agcugcugugugcucaggcagg

SEQ ID NO: 991343 - RNA, 22 nt, Human
ggaggccaggguggguggaucg

SEQ ID NO: 991344 - RNA, 22 nt, Human
ucugagaguccaucuccaagcc

SEQ ID NO: 991345 - RNA, 20 nt, Human
uucuuucaucuacacguugu

SEQ ID NO: 991346 - RNA, 22 nt, Human
cuggcagcugcccgagaugccc

SEQ ID NO: 991347 - RNA, 22 nt, Human
gaaaaguacacagcccaaacau

SEQ ID NO: 991348 - RNA, 22 nt, Human
cugggcagugguggcaucuuug

SEQ ID NO: 991349 - RNA, 22 nt, Human
cugggguggaggagcuccccug

SEQ ID NO: 991350 - RNA, 22 nt, Human
uuggccaauuccagaggaucau

SEQ ID NO: 991351 - RNA, 22 nt, Human
uaucuuuagaggaagagaaucu

SEQ ID NO: 991352 - RNA, 22 nt, Human
cucugggcaaagaugccucauc

SEQ ID NO: 991353 - RNA, 22 nt, Human
agccuugaguucaagugcuggc

SEQ ID NO: 991354 - RNA, 22 nt, Human
cccagccucugggcucacccaa

SEQ ID NO: 991355 - RNA, 22 nt, Human
agcccagcaaagggagguucag

SEQ ID NO: 991356 - RNA, 18 nt, Human
ucucagaggccauccuag

SEQ ID NO: 991357 - RNA, 22 nt, Human
caggccuccacuccacgcagac

SEQ ID NO: 991358 - RNA, 22 nt, Human
auguuuaaauuuauagacagug

SEQ ID NO: 991359 - RNA, 22 nt, Human
uuccaaaggaauggggagcuau

SEQ ID NO: 991360 - RNA, 22 nt, Human
gccuggagaccugcuccucuac

SEQ ID NO: 991361 - RNA, 22 nt, Human
caccagggacaaugcuaggggu

SEQ ID NO: 991362 - RNA, 22 nt, Human
ccaggaguuugaggcugcagug

SEQ ID NO: 991363 - RNA, 22 nt, Human
ugugaaggcagcagcucugucc

SEQ ID NO: 991364 - RNA, 22 nt, Human
ccugugccauccugagcauccc

SEQ ID NO: 991365 - RNA, 22 nt, Human
ucaggugggaccugcuaggaca

SEQ ID NO: 991366 - RNA, 22 nt, Human
guuuggggucugcagagcggcg

SEQ ID NO: 991367 - RNA, 22 nt, Human
ugacacauuaaaugcucacaaa

SEQ ID NO: 991368 - RNA, 22 nt, Human
aaaucaaaagacauguguuuua

SEQ ID NO: 991369 - RNA, 22 nt, Human
ugaaagcucugucaucauuccu

SEQ ID NO: 991370 - RNA, 22 nt, Human
ggagccaggcaaucuguacuuu

SEQ ID NO: 991371 - RNA, 22 nt, Human
cccuggagugugacgaggcauu

SEQ ID NO: 991372 - RNA, 22 nt, Human
acagccuguuugaucuggugcu

SEQ ID NO: 991373 - RNA, 22 nt, Human
cagugccaugucugagccccua

SEQ ID NO: 991374 - RNA, 22 nt, Human
gugcagggagcccagaaggucc

SEQ ID NO: 991375 - RNA, 20 nt, Human
cugggaggucuuccaaauca

SEQ ID NO: 991376 - RNA, 22 nt, Human
agauacaugucaagagacuuau

SEQ ID NO: 991377 - RNA, 22 nt, Human
aagaagaugguuaacuuucagu

SEQ ID NO: 991378 - RNA, 22 nt, Human
ggggugggguuacucauugugc

SEQ ID NO: 991379 - RNA, 22 nt, Human
agaauucucuuccauugaaaca

SEQ ID NO: 991380 - RNA, 22 nt, Human
aaagacauugaagaaggacuua

SEQ ID NO: 991381 - RNA, 22 nt, Human
gccucugcucucagguagccuc

SEQ ID NO: 991382 - RNA, 17 nt, Human
ccagagcuacugagacu

SEQ ID NO: 991383 - RNA, 22 nt, Human
gauuucuucauucauuagaugg

SEQ ID NO: 991384 - RNA, 22 nt, Human
cuugaaaugacaggagcacauc

SEQ ID NO: 991385 - RNA, 22 nt, Human
cugcuccacaccuccauuuccu

SEQ ID NO: 991386 - RNA, 22 nt, Human
ucucuucugaaaccugucuuua

SEQ ID NO: 991387 - RNA, 19 nt, Human
gcucugcuacuauuaccac

SEQ ID NO: 991388 - RNA, 18 nt, Human
uggugaaggguggaggag

SEQ ID NO: 991389 - RNA, 18 nt, Human
cucagggcaucagucugg

SEQ ID NO: 991390 - RNA, 22 nt, Human
ccuuggaggacugcugcuucuu

SEQ ID NO: 991391 - RNA, 22 nt, Human
cugucuccagggcaggugcagg

SEQ ID NO: 991392 - RNA, 20 nt, Human
guccugggagccacagcaca

SEQ ID NO: 991393 - RNA, 22 nt, Human
ucaaugauaguacaaucagccu

SEQ ID NO: 991394 - RNA, 22 nt, Human
aacauguugcuuuaauaauauu

SEQ ID NO: 991395 - RNA, 22 nt, Human
ugaggcucaaggucugguggag

SEQ ID NO: 991396 - RNA, 20 nt, Human
uacauucaaaacaaacucug

SEQ ID NO: 991397 - RNA, 20 nt, Human
uccagcugucuuucagagac

SEQ ID NO: 991398 - RNA, 22 nt, Human
gggcaggaugcaguuucagaga

SEQ ID NO: 991399 - RNA, 23 nt, Human
ugacacauuuccuuuccacugca

SEQ ID NO: 991400 - RNA, 22 nt, Human
ggugggcacauucagucucugu

SEQ ID NO: 991401 - RNA, 22 nt, Human
aaaggugacugcagcagcuauu

SEQ ID NO: 991402 - RNA, 22 nt, Human
ccagggcaauaggaacacuuuu

SEQ ID NO: 991403 - RNA, 22 nt, Human
agauaauuugaguaaauuaauu

SEQ ID NO: 991404 - RNA, 22 nt, Human
caguagccacuagacacaugua

SEQ ID NO: 991405 - RNA, 19 nt, Human
cagagcagugguuccugaa

SEQ ID NO: 991406 - RNA, 22 nt, Human
gaggacagugugaucugccagc

SEQ ID NO: 991407 - RNA, 22 nt, Human
cccugccuucuuggccuuuaaa

SEQ ID NO: 991408 - RNA, 22 nt, Human
ucaguuuucaauuucaucagag

SEQ ID NO: 991409 - RNA, 22 nt, Human
ccuggcugccgagugugcagcg

SEQ ID NO: 991410 - RNA, 22 nt, Human
ugguuucccauuaucugcagga

SEQ ID NO: 991411 - RNA, 22 nt, Human
gcugugugcucacguaguggaa

SEQ ID NO: 991412 - RNA, 22 nt, Human
cagaggcugcucuggguggcau

SEQ ID NO: 991413 - RNA, 22 nt, Human
guccucugcccaggucaagguu

SEQ ID NO: 991414 - RNA, 22 nt, Human
agccugccuugggcugcuugag

SEQ ID NO: 991415 - RNA, 22 nt, Human
cucugugauuuugugagccaga

SEQ ID NO: 991416 - RNA, 22 nt, Human
agggccagcugaugagaaugag

SEQ ID NO: 991417 - RNA, 19 nt, Human
uggcagaggcaguuuguac

SEQ ID NO: 991418 - RNA, 22 nt, Human
caacugagcaguagcgucugga

SEQ ID NO: 991419 - RNA, 22 nt, Human
ggagcugcuccuucagccaagu

SEQ ID NO: 991420 - RNA, 22 nt, Human
ggagggugcauuuuacccugug

SEQ ID NO: 991421 - RNA, 22 nt, Human
gcaggcuggaggcuguucuggg

SEQ ID NO: 991422 - RNA, 22 nt, Human
auucaguuaaaaacuguacuuc

SEQ ID NO: 991423 - RNA, 22 nt, Human
cugggagauugcuagagaugca

SEQ ID NO: 991424 - RNA, 19 nt, Human
ugucuuaauuaacucagag

SEQ ID NO: 991425 - RNA, 22 nt, Human
gaguuauuagucaaauagggaa

SEQ ID NO: 991426 - RNA, 22 nt, Human
ccuggaagauucaccacuacca

SEQ ID NO: 991427 - RNA, 22 nt, Human
ucagcugcucuguugagcugaa

SEQ ID NO: 991428 - RNA, 22 nt, Human
accucaggauguggacacagaa

SEQ ID NO: 991429 - RNA, 22 nt, Human
cugagcugcggcaggcaccugg

SEQ ID NO: 991430 - RNA, 19 nt, Human
gaucuuugccaauuuaagc

SEQ ID NO: 991431 - RNA, 22 nt, Human
gcacagagggcagugagccucu

SEQ ID NO: 991432 - RNA, 22 nt, Human
aggugauguccacagcuugcag

SEQ ID NO: 991433 - RNA, 22 nt, Human
accuucaaugaaaauaauaguc

SEQ ID NO: 991434 - RNA, 22 nt, Human
acagugucuccugguacccagu

SEQ ID NO: 991435 - RNA, 23 nt, Human
agcagccauagggaagcaauaca

SEQ ID NO: 991436 - RNA, 22 nt, Human
acucugcuugggccauaucugg

SEQ ID NO: 991437 - RNA, 22 nt, Human
uauuucugaggcccaggaagug

SEQ ID NO: 991438 - RNA, 22 nt, Human
ucacucugcugcccgagggcug

SEQ ID NO: 991439 - RNA, 21 nt, Human
uuuuauugaugaauggccacu

SEQ ID NO: 991440 - RNA, 22 nt, Human
aggagccaugagugacaucaca

SEQ ID NO: 991441 - RNA, 22 nt, Human
uugaacauuaacuucagucuau

SEQ ID NO: 991442 - RNA, 22 nt, Human
accuguuuggaggagguguuag

SEQ ID NO: 991443 - RNA, 22 nt, Human
uggaggcaccacuggcugcccg

SEQ ID NO: 991444 - RNA, 22 nt, Human
aggagucaggaccaaauggaaa

SEQ ID NO: 991445 - RNA, 22 nt, Human
aucacaggugguaggaaaagaa

SEQ ID NO: 991446 - RNA, 22 nt, Human
cugcuuccaugcaauggcaguc

SEQ ID NO: 991447 - RNA, 23 nt, Human
uugucugugcuuuuccaguugcu

SEQ ID NO: 991448 - RNA, 22 nt, Human
gucaccagucccagcuccugaa

SEQ ID NO: 991449 - RNA, 22 nt, Human
ugagccagucugucugggugaa

SEQ ID NO: 991450 - RNA, 22 nt, Human
aagacauuuauuugaaucaauu

SEQ ID NO: 991451 - RNA, 22 nt, Human
acucugccaucccaggugcugu

SEQ ID NO: 991452 - RNA, 22 nt, Human
ucugguuagccaauaaugccaa

SEQ ID NO: 991453 - RNA, 22 nt, Human
gagcagugaagacagaaguaca

SEQ ID NO: 991454 - RNA, 22 nt, Human
agcaggaaguagucuguaagca

SEQ ID NO: 991455 - RNA, 22 nt, Human
ucucugggaaugggccugggua

SEQ ID NO: 991456 - RNA, 22 nt, Human
uugaagcaggaaaauuucuauu

SEQ ID NO: 991457 - RNA, 22 nt, Human
gcccagcugucuggcagggaug

SEQ ID NO: 991458 - RNA, 22 nt, Human
agcugcagagguuugugcaaca

SEQ ID NO: 991459 - RNA, 22 nt, Human
gcucugcugggugggcaguuau

SEQ ID NO: 991460 - RNA, 22 nt, Human
cagccaggacagggaaacuagu

SEQ ID NO: 991461 - RNA, 22 nt, Human
ugucccaguuggguauugaauu

SEQ ID NO: 991462 - RNA, 22 nt, Human
aaauaguuagcccugcauauau

SEQ ID NO: 991463 - RNA, 22 nt, Human
caggugggaccaugauagggca

SEQ ID NO: 991464 - RNA, 22 nt, Human
uucauguauuuaucauguaaau

SEQ ID NO: 991465 - RNA, 19 nt, Human
aggccugggguuuugcacu

SEQ ID NO: 991466 - RNA, 20 nt, Human
uccuucaggcagggccuagu

SEQ ID NO: 991467 - RNA, 22 nt, Human
aaaguuacuaucacaaugaaau

SEQ ID NO: 991468 - RNA, 22 nt, Human
cagacuuucaaggagugaaggc

SEQ ID NO: 991469 - RNA, 22 nt, Human
gcuugggauaugcugauguaaa

SEQ ID NO: 991470 - RNA, 22 nt, Human
agagcuggaaucagaccucagg

SEQ ID NO: 991471 - RNA, 22 nt, Human
gagcuuccauggacgccaucug

SEQ ID NO: 991472 - RNA, 22 nt, Human
aaagauaugucuccaaagagau

SEQ ID NO: 991473 - RNA, 22 nt, Human
cccuggaggcaaagguugcagu

SEQ ID NO: 991474 - RNA, 22 nt, Human
gggugggccacugagcagcgug

SEQ ID NO: 991475 - RNA, 22 nt, Human
uacauguaauuuucauaguaag

SEQ ID NO: 991476 - RNA, 22 nt, Human
acauguuagaaaugcagaaucu

SEQ ID NO: 991477 - RNA, 22 nt, Human
aagggcuggaucucucugagca

SEQ ID NO: 991478 - RNA, 21 nt, Human
ccagacuggccuaugugguag

SEQ ID NO: 991479 - RNA, 19 nt, Human
agagaggcugugugaggga

SEQ ID NO: 991480 - RNA, 22 nt, Human
uaauacuuaccuugcagagucu

SEQ ID NO: 991481 - RNA, 22 nt, Human
gcccagaguucaaggcugcagu

SEQ ID NO: 991482 - RNA, 20 nt, Human
gacaucauguacacauugcc

SEQ ID NO: 991483 - RNA, 22 nt, Human
cuggccacugguggucauaggc

SEQ ID NO: 991484 - RNA, 22 nt, Human
ucacugcaaccucugccuuccg

SEQ ID NO: 991485 - RNA, 22 nt, Human
uuccauauuuguguggcaaaag

SEQ ID NO: 991486 - RNA, 22 nt, Human
gccagcccagcuccaggggaaa

SEQ ID NO: 991487 - RNA, 22 nt, Human
cagccucuaagcacagccucuc

SEQ ID NO: 991488 - RNA, 22 nt, Human
ggcugaaacagauuucaagaca

SEQ ID NO: 991489 - RNA, 22 nt, Human
uggagcagggcaucacugugcg

SEQ ID NO: 991490 - RNA, 22 nt, Human
gagagcugggcuuugggugaag

SEQ ID NO: 991491 - RNA, 22 nt, Human
acauuuacagugcuagacaauc

SEQ ID NO: 991492 - RNA, 22 nt, Human
uaaaagacccucuagaguccca

SEQ ID NO: 991493 - RNA, 22 nt, Human
ccuggcagucaggggaguccuu

SEQ ID NO: 991494 - RNA, 22 nt, Human
agcaugcugguguucauggcag

SEQ ID NO: 991495 - RNA, 20 nt, Human
ugucauuguuucuaggaccu

SEQ ID NO: 991496 - RNA, 22 nt, Human
acucugagcaucccaagucuua

SEQ ID NO: 991497 - RNA, 22 nt, Human
uccaucagauucccuccugaga

SEQ ID NO: 991498 - RNA, 22 nt, Human
gggccugacugagagcuccuca

SEQ ID NO: 991499 - RNA, 22 nt, Human
aaugucugagucucuguauccc

SEQ ID NO: 991500 - RNA, 22 nt, Human
ggucccugguucccucugagcu

SEQ ID NO: 991501 - RNA, 22 nt, Human
ccagggccaagagaccucgagg

SEQ ID NO: 991502 - RNA, 22 nt, Human
ugugccugaguuggcugaguac

SEQ ID NO: 991503 - RNA, 22 nt, Human
uccucacauggugagccacaca

SEQ ID NO: 991504 - RNA, 22 nt, Human
gccaggcuguuuuuauuacugu

SEQ ID NO: 991505 - RNA, 21 nt, Human
gggcagaggggccuccugggu

SEQ ID NO: 991506 - RNA, 22 nt, Human
cuucccagaccuuagagugcag

SEQ ID NO: 991507 - RNA, 22 nt, Human
agagccacugggagacagagca

SEQ ID NO: 991508 - RNA, 20 nt, Human
aagagaagaagucuuugaaa

SEQ ID NO: 991509 - RNA, 22 nt, Human
gcucagagauggggaaugaaaa

SEQ ID NO: 991510 - RNA, 19 nt, Human
uguagcaguuuaaaacaac

SEQ ID NO: 991511 - RNA, 22 nt, Human
uguguauuaccauuuuacagcu

SEQ ID NO: 991512 - RNA, 22 nt, Human
ccaaagucagugcucagucguc

SEQ ID NO: 991513 - RNA, 23 nt, Human
aggauccugguacaggagcagag

SEQ ID NO: 991514 - RNA, 22 nt, Human
uuucuguaauuaaaagggcagg

SEQ ID NO: 991515 - RNA, 22 nt, Human
gccucugcggggcccgagcccg

SEQ ID NO: 991516 - RNA, 22 nt, Human
ucagccuggcaggauggccugg

SEQ ID NO: 991517 - RNA, 22 nt, Human
ugcccaagcagaggagugauuc

SEQ ID NO: 991518 - RNA, 22 nt, Human
aggagcugaagucucugcacuc

SEQ ID NO: 991519 - RNA, 22 nt, Human
ggggcagaaagcccacagagug

SEQ ID NO: 991520 - RNA, 22 nt, Human
agaaggccuaacuugggggcaa

SEQ ID NO: 991521 - RNA, 22 nt, Human
gcagcaaucuucacagugucau

SEQ ID NO: 991522 - RNA, 22 nt, Human
ugagacaguucugcagcugggu

SEQ ID NO: 991523 - RNA, 22 nt, Human
uacauuguuuuuucuugccauc

SEQ ID NO: 991524 - RNA, 22 nt, Human
gcagagcugucuaagucacuuc

SEQ ID NO: 991525 - RNA, 23 nt, Human
uggcagcagaucuuaaagugacc

SEQ ID NO: 991526 - RNA, 22 nt, Human
ggugggcagcucuuggcaggca

SEQ ID NO: 991527 - RNA, 22 nt, Human
ugaaaggugacauuucuuggau

SEQ ID NO: 991528 - RNA, 22 nt, Human
gcugccaugccacagcacucac

SEQ ID NO: 991529 - RNA, 22 nt, Human
agagugggugaucucuguuguc

SEQ ID NO: 991530 - RNA, 22 nt, Human
ucccagggucaguggugaggcc

SEQ ID NO: 991531 - RNA, 22 nt, Human
gggcugcugcccaggaggcacc

SEQ ID NO: 991532 - RNA, 22 nt, Human
ucagaacaauugggaaccauua

SEQ ID NO: 991533 - RNA, 22 nt, Human
ggcuucccagcagagggcgcac

SEQ ID NO: 991534 - RNA, 22 nt, Human
ggcugcuggaagacugaacaag

SEQ ID NO: 991535 - RNA, 22 nt, Human
caggugaccuuuguccuaaguu

SEQ ID NO: 991536 - RNA, 22 nt, Human
ccugggcaaaugccagagacaa

SEQ ID NO: 991537 - RNA, 20 nt, Human
acagaaagagagaaugucag

SEQ ID NO: 991538 - RNA, 22 nt, Human
agggggcaucagguccuggcuc

SEQ ID NO: 991539 - RNA, 22 nt, Human
ccaggggcuggugcugagcugg

SEQ ID NO: 991540 - RNA, 21 nt, Human
aggcuguccuuugccagcccu

SEQ ID NO: 991541 - RNA, 22 nt, Human
ggcagagguagcuggaaccagg

SEQ ID NO: 991542 - RNA, 22 nt, Human
auucaguaggucuagaauaaga

SEQ ID NO: 991543 - RNA, 18 nt, Human
gaggauggaaggagaugc

SEQ ID NO: 991544 - RNA, 23 nt, Human
ggccauggagacuuagaaugggc

SEQ ID NO: 991545 - RNA, 22 nt, Human
ucuggcucagggcucugaggga

SEQ ID NO: 991546 - RNA, 22 nt, Human
gcuuucucuucacugauguuca

SEQ ID NO: 991547 - RNA, 22 nt, Human
agccucucuuucugguggcuaa

SEQ ID NO: 991548 - RNA, 22 nt, Human
gguggccuccagggcauaggug

SEQ ID NO: 991549 - RNA, 22 nt, Human
cagcuggcgggcagagccgcca

SEQ ID NO: 991550 - RNA, 22 nt, Human
auuaaggaauguaggcaagaag

SEQ ID NO: 991551 - RNA, 22 nt, Human
ugccagcccaccuuggggccuc

SEQ ID NO: 991552 - RNA, 22 nt, Human
agcagccagugggagugauaca

SEQ ID NO: 991553 - RNA, 18 nt, Human
cauuguacaaugcuuuau

SEQ ID NO: 991554 - RNA, 22 nt, Human
ucugggcacugcugagccugua

SEQ ID NO: 991555 - RNA, 22 nt, Human
aggcuucuuagauuggcuggag

SEQ ID NO: 991556 - RNA, 22 nt, Human
gugcaguggcagauccuagcuc

SEQ ID NO: 991557 - RNA, 22 nt, Human
gccagggaggcuguaggguccu

SEQ ID NO: 991558 - RNA, 22 nt, Human
uggcuuccaaaggaaugggccu

SEQ ID NO: 991559 - RNA, 22 nt, Human
uuccauaauaggcuuaagugaa

SEQ ID NO: 991560 - RNA, 22 nt, Human
uagcacugaaucacaugcugcu

SEQ ID NO: 991561 - RNA, 22 nt, Human
gaugggggccagggccugcuuu

SEQ ID NO: 991562 - RNA, 22 nt, Human
uggcucugggcaccguguccac

SEQ ID NO: 991563 - RNA, 22 nt, Human
ggccugcacagagguggcucua

SEQ ID NO: 991564 - RNA, 22 nt, Human
ccugucugcaugagugagcaua

SEQ ID NO: 991565 - RNA, 22 nt, Human
gcacugaaauuauaugcauuug

SEQ ID NO: 991566 - RNA, 22 nt, Human
ugucucaggcccaagccaguaa

SEQ ID NO: 991567 - RNA, 22 nt, Human
agagccaggaugucuucugggg

SEQ ID NO: 991568 - RNA, 22 nt, Human
cugcuuugcauagcugccagag

SEQ ID NO: 991569 - RNA, 22 nt, Human
agagugaaggccagguuacagu

SEQ ID NO: 991570 - RNA, 18 nt, Human
aagccagagaccacugcc

SEQ ID NO: 991571 - RNA, 21 nt, Human
acaugcauagagagauuucug

SEQ ID NO: 991572 - RNA, 22 nt, Human
ucaguauccacaaaugcucaaa

SEQ ID NO: 991573 - RNA, 22 nt, Human
uggcagggucuugcuguguugc

SEQ ID NO: 991574 - RNA, 22 nt, Human
gucccuuggcucacaaacagcu

SEQ ID NO: 991575 - RNA, 22 nt, Human
gugaaaucugaggcccaugaug

SEQ ID NO: 991576 - RNA, 20 nt, Human
agugacagagacuguguggc

SEQ ID NO: 991577 - RNA, 22 nt, Human
cugugcaagacuuacuuuaaua

SEQ ID NO: 991578 - RNA, 22 nt, Human
aggccugaaggaagaugagcug

SEQ ID NO: 991579 - RNA, 22 nt, Human
aggagucauugagagggguccu

SEQ ID NO: 991580 - RNA, 22 nt, Human
cuacauuuggagaguauaggaa

SEQ ID NO: 991581 - RNA, 22 nt, Human
cagacaggguccuguccgucac

SEQ ID NO: 991582 - RNA, 22 nt, Human
ggagugaguacuggaguagcug

SEQ ID NO: 991583 - RNA, 18 nt, Human
caugggugacagguggau

SEQ ID NO: 991584 - RNA, 22 nt, Human
ccugugccagcugggcccugcc

SEQ ID NO: 991585 - RNA, 22 nt, Human
ccagagccagagaggugccugc

SEQ ID NO: 991586 - RNA, 18 nt, Human
aaguaugccuauguuauu

SEQ ID NO: 991587 - RNA, 22 nt, Human
ugcaaacaggagaguaaguaua

SEQ ID NO: 991588 - RNA, 18 nt, Human
cucucuggucuggauccc

SEQ ID NO: 991589 - RNA, 22 nt, Human
acagccagguaaaggcauggca

SEQ ID NO: 991590 - RNA, 22 nt, Human
caagcuccuuacauccacaggg

SEQ ID NO: 991591 - RNA, 22 nt, Human
uggccuuggcagugagaagagu

SEQ ID NO: 991592 - RNA, 22 nt, Human
agggccuggaacuggagaccac

SEQ ID NO: 991593 - RNA, 22 nt, Human
gaggugaguggaucacgagguc

SEQ ID NO: 991594 - RNA, 22 nt, Human
guagaagugaugucauguuaua

SEQ ID NO: 991595 - RNA, 22 nt, Human
agacagggucuugaucagagcu

SEQ ID NO: 991596 - RNA, 22 nt, Human
gcugccaugguccaggcuccag

SEQ ID NO: 991597 - RNA, 22 nt, Human
acccuggggguggccagugcca

SEQ ID NO: 991598 - RNA, 21 nt, Human
agaugcugugcuccaggagca

SEQ ID NO: 991599 - RNA, 22 nt, Human
aggcacugaauauccaguaaaa

SEQ ID NO: 991600 - RNA, 22 nt, Human
uuucuaaaugguggcugcauug

SEQ ID NO: 991601 - RNA, 22 nt, Human
gaggcuggugguuaguuccauu

SEQ ID NO: 991602 - RNA, 22 nt, Human
cugggccaucagaggggcugga

SEQ ID NO: 991603 - RNA, 22 nt, Human
cagcugagucugagguucuuug

SEQ ID NO: 991604 - RNA, 22 nt, Human
agccccacacucucucugagaa

SEQ ID NO: 991605 - RNA, 22 nt, Human
gcccagcagcugguggagaagg

SEQ ID NO: 991606 - RNA, 22 nt, Human
ugggcugcuguuacaggggcug

SEQ ID NO: 991607 - RNA, 22 nt, Human
uggcucaggguccccaaauggu

SEQ ID NO: 991608 - RNA, 22 nt, Human
cugcacaguuugauuucuugcu

SEQ ID NO: 991609 - RNA, 22 nt, Human
cugugugcugaaaugcagugag

SEQ ID NO: 991610 - RNA, 22 nt, Human
uucaagauggccccagugagcc

SEQ ID NO: 991611 - RNA, 22 nt, Human
uccagagguauguagagaguau

SEQ ID NO: 991612 - RNA, 22 nt, Human
aaugcacauguuguaauaaaua

SEQ ID NO: 991613 - RNA, 22 nt, Human
cuguccucuguccucagcagga

SEQ ID NO: 991614 - RNA, 22 nt, Human
uaaguucauaagcuuauucuua

SEQ ID NO: 991615 - RNA, 22 nt, Human
cauucauuagaauagauaugua

SEQ ID NO: 991616 - RNA, 22 nt, Human
uauucacauuaauaagucuuca

SEQ ID NO: 991617 - RNA, 22 nt, Human
cagggccuuuuagcaucuucuc

SEQ ID NO: 991618 - RNA, 22 nt, Human
uuagcugcauuaucaaaguuau

SEQ ID NO: 991619 - RNA, 22 nt, Human
agucccagcuucccccaugcag

SEQ ID NO: 991620 - RNA, 21 nt, Human
cagcuuugucugucuucgggg

SEQ ID NO: 991621 - RNA, 22 nt, Human
uggcagugccccuugaccagug

SEQ ID NO: 991622 - RNA, 22 nt, Human
aauguacacugaaagccuauca

SEQ ID NO: 991623 - RNA, 22 nt, Human
cucagaguccccacaucugggu

SEQ ID NO: 991624 - RNA, 22 nt, Human
auguaacuguuauauuuuguug

SEQ ID NO: 991625 - RNA, 22 nt, Human
cuuccugguuugaagcucgccg

SEQ ID NO: 991626 - RNA, 22 nt, Human
gaaaugcauggaucuuggcaga

SEQ ID NO: 991627 - RNA, 22 nt, Human
cugggagcuagcucugagcuga

SEQ ID NO: 991628 - RNA, 22 nt, Human
ccugugaggucaucugugguaa

SEQ ID NO: 991629 - RNA, 21 nt, Human
ugcaggaaagugcugcgaccc

SEQ ID NO: 991630 - RNA, 22 nt, Human
augggaggcagcagagcccagc

SEQ ID NO: 991631 - RNA, 22 nt, Human
ucggagcuguagaugaaacccu

SEQ ID NO: 991632 - RNA, 22 nt, Human
cugccagcucgccacaaugaca

SEQ ID NO: 991633 - RNA, 22 nt, Human
cuggugguucaggagaauggcu

SEQ ID NO: 991634 - RNA, 22 nt, Human
ggccuugggcagacacgucaca

SEQ ID NO: 991635 - RNA, 22 nt, Human
cucuuucaguucugauagucuc

SEQ ID NO: 991636 - RNA, 22 nt, Human
cccagcucugcagaccugcccu

SEQ ID NO: 991637 - RNA, 22 nt, Human
agaaguuaccacauacuucucu

SEQ ID NO: 991638 - RNA, 22 nt, Human
ucugcaggccucgacaaggcca

SEQ ID NO: 991639 - RNA, 22 nt, Human
aacagcuuugcuucuggagaca

SEQ ID NO: 991640 - RNA, 22 nt, Human
ugaaccagagucuccagugguu

SEQ ID NO: 991641 - RNA, 22 nt, Human
caagagcuagaaauugguuaga

SEQ ID NO: 991642 - RNA, 22 nt, Human
aaaaaguuucaacugccaacuc

SEQ ID NO: 991643 - RNA, 22 nt, Human
aagggcugaaugaaggguugaa

SEQ ID NO: 991644 - RNA, 22 nt, Human
caguacuuuucaaccaguauga

SEQ ID NO: 991645 - RNA, 22 nt, Human
aaugugcagaugaauaaacaaa

SEQ ID NO: 991646 - RNA, 21 nt, Human
ccaggguccagcugccauggu

SEQ ID NO: 991647 - RNA, 22 nt, Human
ugucucagaauggcucauaaua

SEQ ID NO: 991648 - RNA, 22 nt, Human
cugcucuguuucuuagcugggu

SEQ ID NO: 991649 - RNA, 22 nt, Human
agccucucuguuagucacuggg

SEQ ID NO: 991650 - RNA, 20 nt, Human
caggccucugggggcccugg

SEQ ID NO: 991651 - RNA, 22 nt, Human
ccaggcugagcaugauuggagc

SEQ ID NO: 991652 - RNA, 22 nt, Human
cccuucccuucugggagaucca

SEQ ID NO: 991653 - RNA, 21 nt, Human
gccuggcagguggaagggcuc

SEQ ID NO: 991654 - RNA, 22 nt, Human
gcauccagagguagccacugug

SEQ ID NO: 991655 - RNA, 21 nt, Human
aacaaagggaugcucaucuuu

SEQ ID NO: 991656 - RNA, 22 nt, Human
aaacccugcccuucccaagaug

SEQ ID NO: 991657 - RNA, 20 nt, Human
guggccucucacauucugag

SEQ ID NO: 991658 - RNA, 22 nt, Human
cucagcagcagggaagagguca

SEQ ID NO: 991659 - RNA, 22 nt, Human
ucuggccaauguugugaucaca

SEQ ID NO: 991660 - RNA, 22 nt, Human
ccugcagcuguaggagaaggcg

SEQ ID NO: 991661 - RNA, 21 nt, Human
cccuguguuccacagcagaca

SEQ ID NO: 991662 - RNA, 22 nt, Human
ggcacugagcgggcucugagcg

SEQ ID NO: 991663 - RNA, 21 nt, Human
aggcugcuggcucaggguccu

SEQ ID NO: 991664 - RNA, 22 nt, Human
aaggagagagcuuugcuggaac

SEQ ID NO: 991665 - RNA, 22 nt, Human
ggcaugggagugagcaaccuua

SEQ ID NO: 991666 - RNA, 22 nt, Human
gggagccaugcuggucuucuuu

SEQ ID NO: 991667 - RNA, 22 nt, Human
agaaaaaucuuggcgcuugucu

SEQ ID NO: 991668 - RNA, 22 nt, Human
auucuccacacauccagaccuu

SEQ ID NO: 991669 - RNA, 22 nt, Human
cacauguuuggcaugucaccaa

SEQ ID NO: 991670 - RNA, 22 nt, Human
aagagggcugcaaucuuauugc

SEQ ID NO: 991671 - RNA, 19 nt, Human
gggaugggcccucacccuc

SEQ ID NO: 991672 - RNA, 22 nt, Human
cagacccucgggugaguuggcc

SEQ ID NO: 991673 - RNA, 22 nt, Human
ccagggcagcagaauuggggca

SEQ ID NO: 991674 - RNA, 22 nt, Human
caugucuuggcuuaggcacaga

SEQ ID NO: 991675 - RNA, 20 nt, Human
cuggcaggagcgagucuacc

SEQ ID NO: 991676 - RNA, 22 nt, Human
ucagggcucaccagccucugcc

SEQ ID NO: 991677 - RNA, 22 nt, Human
ucucugggauaaacugggccag

SEQ ID NO: 991678 - RNA, 22 nt, Human
uaaggcacacaguugcugcaug

SEQ ID NO: 991679 - RNA, 22 nt, Human
gcuggcuguuggagguaccugc

SEQ ID NO: 991680 - RNA, 23 nt, Human
agaugaaagcuucccaucacagu

SEQ ID NO: 991681 - RNA, 20 nt, Human
gucugaggagcagugggaaa

SEQ ID NO: 991682 - RNA, 22 nt, Human
cugggugaguugaugaaggaga

SEQ ID NO: 991683 - RNA, 22 nt, Human
ugucccagcacuuugggagucu

SEQ ID NO: 991684 - RNA, 22 nt, Human
gcucccagaaccaaggcugggg

SEQ ID NO: 991685 - RNA, 20 nt, Human
aggaacuggaagggaggaaa

SEQ ID NO: 991686 - RNA, 22 nt, Human
cagagccccccuucugaucaca

SEQ ID NO: 991687 - RNA, 22 nt, Human
ccagggcaauuauuuggagggu

SEQ ID NO: 991688 - RNA, 20 nt, Human
acugccuugguucaguaggu

SEQ ID NO: 991689 - RNA, 22 nt, Human
ccagcuggagccaagguggacu

SEQ ID NO: 991690 - RNA, 22 nt, Human
gcuggccauauauuuugcuguu

SEQ ID NO: 991691 - RNA, 22 nt, Human
gcacagggagacagccguggcc

SEQ ID NO: 991692 - RNA, 23 nt, Human
ugucacauuuaguuggcauuguu

SEQ ID NO: 991693 - RNA, 22 nt, Human
ugggcagagaguagaggcaacg

SEQ ID NO: 991694 - RNA, 22 nt, Human
aggcccagggcugcucucugaa

SEQ ID NO: 991695 - RNA, 22 nt, Human
uauuuugucuucugcucaucac

SEQ ID NO: 991696 - RNA, 22 nt, Human
ucucaggguuuccugggggcug

SEQ ID NO: 991697 - RNA, 22 nt, Human
cucauggauauaagaacuguuu

SEQ ID NO: 991698 - RNA, 22 nt, Human
accuuauuaaaaugaugaugua

SEQ ID NO: 991699 - RNA, 22 nt, Human
ucucacucauuuccuaggucuu

SEQ ID NO: 991700 - RNA, 22 nt, Human
uaugcacagaaguuugcugaau

SEQ ID NO: 991701 - RNA, 22 nt, Human
uacaaagccugguagauaucug

SEQ ID NO: 991702 - RNA, 22 nt, Human
cagguacacucccuugugcuga

SEQ ID NO: 991703 - RNA, 22 nt, Human
gccucugcugacaagauggaca

SEQ ID NO: 991704 - RNA, 22 nt, Human
caguggguaggaaaggcucuuc

SEQ ID NO: 991705 - RNA, 21 nt, Human
cugugcuuuuuaagugugaug

SEQ ID NO: 991706 - RNA, 22 nt, Human
uggccugauuuugcuaagagaa

SEQ ID NO: 991707 - RNA, 19 nt, Human
aauaauguucaugagauug

SEQ ID NO: 991708 - RNA, 22 nt, Human
uggagcugagaaguggagcucu

SEQ ID NO: 991709 - RNA, 22 nt, Human
cacaagagagugcgcguugcaa

SEQ ID NO: 991710 - RNA, 22 nt, Human
agcagccauccuuagagaaaga

SEQ ID NO: 991711 - RNA, 22 nt, Human
acuggaagccaguugacaauca

SEQ ID NO: 991712 - RNA, 22 nt, Human
cccaggaggucgaagcugcagu

SEQ ID NO: 991713 - RNA, 22 nt, Human
cccagaaggucgaggcugcagu

SEQ ID NO: 991714 - RNA, 18 nt, Human
acauuucucucugcguga

SEQ ID NO: 991715 - RNA, 19 nt, Human
ugggccugcaucugggucu

SEQ ID NO: 991716 - RNA, 22 nt, Human
uagcaguggaaucuuuugucca

SEQ ID NO: 991717 - RNA, 23 nt, Human
caugccaguuugugcaggcagau

SEQ ID NO: 991718 - RNA, 22 nt, Human
gccuuccuuuuaccaccagcca

SEQ ID NO: 991719 - RNA, 22 nt, Human
aggccuuccucggagacaggga

SEQ ID NO: 991720 - RNA, 22 nt, Human
cagggccauaucuugugcacca

SEQ ID NO: 991721 - RNA, 22 nt, Human
uccaguggagugugggggugaa

SEQ ID NO: 991722 - RNA, 22 nt, Human
gcccaggccggagagcagugcu

SEQ ID NO: 991723 - RNA, 22 nt, Human
ucccagagacaucauuucuccg

SEQ ID NO: 991724 - RNA, 22 nt, Human
uugaaaggcacaggcaccuggg

SEQ ID NO: 991725 - RNA, 22 nt, Human
acagaauugauggaaaucucag

SEQ ID NO: 991726 - RNA, 21 nt, Human
gggugggaggacacagcaggc

SEQ ID NO: 991727 - RNA, 22 nt, Human
cagcaguggaacuacccaggga

SEQ ID NO: 991728 - RNA, 22 nt, Human
gcagggcucauucuaguacaau

SEQ ID NO: 991729 - RNA, 22 nt, Human
guggagacgggacagaagcuaa

SEQ ID NO: 991730 - RNA, 22 nt, Human
ugcaguggcgccaucucagcuc

SEQ ID NO: 991731 - RNA, 22 nt, Human
cagcauggcuugaguguuuccu

SEQ ID NO: 991732 - RNA, 22 nt, Human
ccuggaccaaacacuggccugg

SEQ ID NO: 991733 - RNA, 22 nt, Human
gcaaagucugcaucuggaucag

SEQ ID NO: 991734 - RNA, 22 nt, Human
gcucugcuguggaauccucucc

SEQ ID NO: 991735 - RNA, 22 nt, Human
gaagcccacguuuggugaugua

SEQ ID NO: 991736 - RNA, 19 nt, Human
ucccgcccacugagcgugc

SEQ ID NO: 991737 - RNA, 22 nt, Human
ucuggcucccuggagcuccaca

SEQ ID NO: 991738 - RNA, 15 nt, Human
ugauuuccuacuaac

SEQ ID NO: 991739 - RNA, 22 nt, Human
ucaguuuuguauguuguaaguc

SEQ ID NO: 991740 - RNA, 22 nt, Human
uggccugggugcugcugacauc

SEQ ID NO: 991741 - RNA, 22 nt, Human
ggaggccaucagggagggcauu

SEQ ID NO: 991742 - RNA, 22 nt, Human
ucacagggcauuauggcuccag

SEQ ID NO: 991743 - RNA, 21 nt, Human
agguggggcugcaccucugcu

SEQ ID NO: 991744 - RNA, 22 nt, Human
aggccuccugcagggaugagug

SEQ ID NO: 991745 - RNA, 22 nt, Human
accuuucacgguaucagacauc

SEQ ID NO: 991746 - RNA, 22 nt, Human
ugcugcauuuaucuucucaaac

SEQ ID NO: 991747 - RNA, 22 nt, Human
cuugccuucuguuccuauagaa

SEQ ID NO: 991748 - RNA, 22 nt, Human
cuggguggaaagugcugagaau

SEQ ID NO: 991749 - RNA, 22 nt, Human
guggccaacucaauguuuuuca

SEQ ID NO: 991750 - RNA, 22 nt, Human
cagguggcaugacugccuacaa

SEQ ID NO: 991751 - RNA, 22 nt, Human
gcugucuggaggcucugaggga

SEQ ID NO: 991752 - RNA, 22 nt, Human
aacagugagaagguggacagga

SEQ ID NO: 991753 - RNA, 22 nt, Human
cagcugccuaugaccuagccuc

SEQ ID NO: 991754 - RNA, 22 nt, Human
auauuaggugcucaauacaugc

SEQ ID NO: 991755 - RNA, 22 nt, Human
gccuuggccaacaccuugcaaa

SEQ ID NO: 991756 - RNA, 22 nt, Human
ucuggccacuaauaggucucac

SEQ ID NO: 991757 - RNA, 22 nt, Human
uuccaguuaaggaagcuauucu

SEQ ID NO: 991758 - RNA, 21 nt, Human
cucuggagucaagagcuucca

SEQ ID NO: 991759 - RNA, 22 nt, Human
cccagcucuuuuagcggcaucu

SEQ ID NO: 991760 - RNA, 22 nt, Human
ccuuccuggcuguccgccugau

SEQ ID NO: 991761 - RNA, 22 nt, Human
ucuccuggcaugugggucaucu

SEQ ID NO: 991762 - RNA, 22 nt, Human
aucauaaagugcuaucugauug

SEQ ID NO: 991763 - RNA, 22 nt, Human
ucucagagauuuuguuucccuu

SEQ ID NO: 991764 - RNA, 22 nt, Human
uuagauaauguagagauaugag

SEQ ID NO: 991765 - RNA, 22 nt, Human
cuggagagaaaugacaaagcua

SEQ ID NO: 991766 - RNA, 22 nt, Human
ugaagcaguucucagaaguggg

SEQ ID NO: 991767 - RNA, 22 nt, Human
ucaggcagaggauggggagcgu

SEQ ID NO: 991768 - RNA, 17 nt, Human
ggaaaaggaugauacag

SEQ ID NO: 991769 - RNA, 22 nt, Human
cagcuggggcagccacgugcgg

SEQ ID NO: 991770 - RNA, 22 nt, Human
cuccaguaucuguaggaaaagg

SEQ ID NO: 991771 - RNA, 22 nt, Human
cuggagccccagacagggagag

SEQ ID NO: 991772 - RNA, 22 nt, Human
gagagugucgggggccccagga

SEQ ID NO: 991773 - RNA, 22 nt, Human
aggggcucaguuacuuuggcag

SEQ ID NO: 991774 - RNA, 22 nt, Human
gagcagggagacaacucuggug

SEQ ID NO: 991775 - RNA, 22 nt, Human
ugacagaaugugacucucagau

SEQ ID NO: 991776 - RNA, 22 nt, Human
aaaggcuccuucucccaugacc

SEQ ID NO: 991777 - RNA, 22 nt, Human
cagugggaagggcagaggcuuu

SEQ ID NO: 991778 - RNA, 21 nt, Human
gcucuuggaaggggcucagcu

SEQ ID NO: 991779 - RNA, 22 nt, Human
aggucaccauggcaugcuccac

SEQ ID NO: 991780 - RNA, 22 nt, Human
ggcccuguuagagcucccacaa

SEQ ID NO: 991781 - RNA, 22 nt, Human
gagagcuggccagcuucaguau

SEQ ID NO: 991782 - RNA, 22 nt, Human
guggccaagaggggacuggaua

SEQ ID NO: 991783 - RNA, 22 nt, Human
uuucuauuuuaaaggcauaugg

SEQ ID NO: 991784 - RNA, 22 nt, Human
ugaaaucugcaugcaaaguccu

SEQ ID NO: 991785 - RNA, 22 nt, Human
cuggaagggucuacuuagcaga

SEQ ID NO: 991786 - RNA, 22 nt, Human
agauggguaacuggagucugcu

SEQ ID NO: 991787 - RNA, 22 nt, Human
ccagcucugccaagcgucagcu

SEQ ID NO: 991788 - RNA, 22 nt, Human
agauacaucuugaacuucuaga

SEQ ID NO: 991789 - RNA, 22 nt, Human
cacagggccuggggcagcugcu

SEQ ID NO: 991790 - RNA, 22 nt, Human
ugucucagaggcaggaagagcc

SEQ ID NO: 991791 - RNA, 22 nt, Human
cacugaagccugggaguaagac

SEQ ID NO: 991792 - RNA, 18 nt, Human
aaagaaggauuggagagc

SEQ ID NO: 991793 - RNA, 22 nt, Human
acaggugguaaaauggacuguc

SEQ ID NO: 991794 - RNA, 22 nt, Human
uugcauugaucccagcuugggc

SEQ ID NO: 991795 - RNA, 22 nt, Human
auguacaguuucuagacucaaa

SEQ ID NO: 991796 - RNA, 22 nt, Human
ccaaggagaaaugcugugcuuu

SEQ ID NO: 991797 - RNA, 22 nt, Human
ggaggguuagcaaaggcacaga

SEQ ID NO: 991798 - RNA, 22 nt, Human
ccucccacauccuagcucugcu

SEQ ID NO: 991799 - RNA, 19 nt, Human
gugaggauacugcucagag

SEQ ID NO: 991800 - RNA, 22 nt, Human
ucucaccauggugcuugcuuau

SEQ ID NO: 991801 - RNA, 22 nt, Human
cugucuguuuuaccuucuccag

SEQ ID NO: 991802 - RNA, 21 nt, Human
gccaccccuggcacaggugcu

SEQ ID NO: 991803 - RNA, 22 nt, Human
ccagggucuuggagaggagugc

SEQ ID NO: 991804 - RNA, 19 nt, Human
ggcucucccuugagagagc

SEQ ID NO: 991805 - RNA, 22 nt, Human
gcagcaggagaguuuguccugc

SEQ ID NO: 991806 - RNA, 22 nt, Human
uagucucuggagacucuagggg

SEQ ID NO: 991807 - RNA, 22 nt, Human
uacuuuggauccuuacaauagc

SEQ ID NO: 991808 - RNA, 23 nt, Human
cuggcucauccugguugcagugg

SEQ ID NO: 991809 - RNA, 22 nt, Human
gagagaagaaagccaugguccu

SEQ ID NO: 991810 - RNA, 22 nt, Human
agcugcucccuauccuuuccuu

SEQ ID NO: 991811 - RNA, 23 nt, Human
ggaaagagaggaguugugcauag

SEQ ID NO: 991812 - RNA, 22 nt, Human
cugcagcuuuggaaaccuguuu

SEQ ID NO: 991813 - RNA, 22 nt, Human
ucaaauaaggagucaugaccau

SEQ ID NO: 991814 - RNA, 22 nt, Human
gcagauggugggggaggaguac

SEQ ID NO: 991815 - RNA, 22 nt, Human
cagcagguauguuuguucagca

SEQ ID NO: 991816 - RNA, 22 nt, Human
ugaagucuauuaacugauuucu

SEQ ID NO: 991817 - RNA, 23 nt, Human
gcugucaguuguuuuugucucua

SEQ ID NO: 991818 - RNA, 22 nt, Human
uggccaggcagguagaacggcc

SEQ ID NO: 991819 - RNA, 22 nt, Human
aaugggagagaacacaaagucc

SEQ ID NO: 991820 - RNA, 21 nt, Human
cuccugggcuaagauauagug

SEQ ID NO: 991821 - RNA, 22 nt, Human
uagggcaguuauaacauuagug

SEQ ID NO: 991822 - RNA, 22 nt, Human
acagcagcuggguucccaccau

SEQ ID NO: 991823 - RNA, 22 nt, Human
aaacuguaaacacagcaguaca

SEQ ID NO: 991824 - RNA, 22 nt, Human
agacaugagaaacccaccagag

SEQ ID NO: 991825 - RNA, 22 nt, Human
uaucuauuccaaauaucagcgu

SEQ ID NO: 991826 - RNA, 22 nt, Human
gcuggugagcaaaggagaagga

SEQ ID NO: 991827 - RNA, 22 nt, Human
acugcaggagacacagcugcug

SEQ ID NO: 991828 - RNA, 22 nt, Human
gacaucaauauucugcagggau

SEQ ID NO: 991829 - RNA, 22 nt, Human
caaaugaagaaccuucucaccu

SEQ ID NO: 991830 - RNA, 22 nt, Human
ugauuucccucaucauaacaga

SEQ ID NO: 991831 - RNA, 22 nt, Human
aaauguguuccuuugcuacaga

SEQ ID NO: 991832 - RNA, 22 nt, Human
uuuucuaacaucuaguaauuug

SEQ ID NO: 991833 - RNA, 20 nt, Human
acauugauuauguuuguaga

SEQ ID NO: 991834 - RNA, 22 nt, Human
agggcagaaaucgauuacaccu

SEQ ID NO: 991835 - RNA, 22 nt, Human
ggcaaaaaccacaauuacuuuu

SEQ ID NO: 991836 - RNA, 19 nt, Human
ucauucaggaccaguggau

SEQ ID NO: 991837 - RNA, 22 nt, Human
ugaggaggucagagucuggcug

SEQ ID NO: 991838 - RNA, 22 nt, Human
aucuggcuuggguguggguagc

SEQ ID NO: 991839 - RNA, 19 nt, Human
ccagcagcuuugauucucu

SEQ ID NO: 991840 - RNA, 19 nt, Human
ucucacaucagcuccuagc

SEQ ID NO: 991841 - RNA, 22 nt, Human
uggcagcuuccugcucauagga

SEQ ID NO: 991842 - RNA, 22 nt, Human
uggagcccagacacuggcauug

SEQ ID NO: 991843 - RNA, 22 nt, Human
agggcucugagugggaaagagg

SEQ ID NO: 991844 - RNA, 22 nt, Human
auguguacaaccaagcacuaaa

SEQ ID NO: 991845 - RNA, 22 nt, Human
ugaggugaccgcagaugggaag

SEQ ID NO: 991846 - RNA, 20 nt, Human
gcugaccccugcugucaugc

SEQ ID NO: 991847 - RNA, 21 nt, Human
agaaaaaccagcauguuuuca

SEQ ID NO: 991848 - RNA, 22 nt, Human
gaggcagagucacaaagagucu

SEQ ID NO: 991849 - RNA, 22 nt, Human
ucacaggacccugaggguggcg

SEQ ID NO: 991850 - RNA, 22 nt, Human
ucugccuucgcugcucccugaa

SEQ ID NO: 991851 - RNA, 22 nt, Human
gaccagagaaaggcacuggaag

SEQ ID NO: 991852 - RNA, 22 nt, Human
guucacauccuugugaggauuu

SEQ ID NO: 991853 - RNA, 20 nt, Human
cuuagaaauuuuuacccugg

SEQ ID NO: 991854 - RNA, 22 nt, Human
gcugugcagguccccacugccu

SEQ ID NO: 991855 - RNA, 22 nt, Human
uugccaggagcucaucugaggg

SEQ ID NO: 991856 - RNA, 22 nt, Human
caagcccaggauuccccaguua

SEQ ID NO: 991857 - RNA, 22 nt, Human
gccaccagugggggccugggca

SEQ ID NO: 991858 - RNA, 22 nt, Human
ugggcuggugagggaucauuua

SEQ ID NO: 991859 - RNA, 22 nt, Human
uauuagguuggugcaacaguaa

SEQ ID NO: 991860 - RNA, 22 nt, Human
gagccauacaaccuauaaagug

SEQ ID NO: 991861 - RNA, 22 nt, Human
ggcaaaguuuucaucucauaac

SEQ ID NO: 991862 - RNA, 22 nt, Human
aggcacuguucccaguuauccu

SEQ ID NO: 991863 - RNA, 22 nt, Human
uuuccucugucaugacagcuga

SEQ ID NO: 991864 - RNA, 20 nt, Human
cucaggauugucuagccccu

SEQ ID NO: 991865 - RNA, 22 nt, Human
gguuugcaugugauguugggca

SEQ ID NO: 991866 - RNA, 22 nt, Human
ggcugcugaguuggccaggaga

SEQ ID NO: 991867 - RNA, 17 nt, Human
uagaauauggugggcug

SEQ ID NO: 991868 - RNA, 22 nt, Human
gcugagcugcuguucauccugc

SEQ ID NO: 991869 - RNA, 22 nt, Human
ucugagaggcaucugcacuucu

SEQ ID NO: 991870 - RNA, 22 nt, Human
ugcccacauucaaaaggugaug

SEQ ID NO: 991871 - RNA, 22 nt, Human
ugggcugcugcggugcucuugg

SEQ ID NO: 991872 - RNA, 22 nt, Human
cagcccugccauggagccuccu

SEQ ID NO: 991873 - RNA, 22 nt, Human
uguaugcagcaaaacaauuagu

SEQ ID NO: 991874 - RNA, 22 nt, Human
gccugagccgccugagcggcgg

SEQ ID NO: 991875 - RNA, 22 nt, Human
uccauguggccagacacuggca

SEQ ID NO: 991876 - RNA, 22 nt, Human
gcauuccugagaaugcagagug

SEQ ID NO: 991877 - RNA, 22 nt, Human
cagagcaguaaaucuggggcac

SEQ ID NO: 991878 - RNA, 22 nt, Human
accaggcuggagugcaguggcg

SEQ ID NO: 991879 - RNA, 22 nt, Human
gagcucagcacuaaaaucaugu

SEQ ID NO: 991880 - RNA, 22 nt, Human
agccaggauuggcugagccuua

SEQ ID NO: 991881 - RNA, 22 nt, Human
ggcagcuccuccuagucugccc

SEQ ID NO: 991882 - RNA, 22 nt, Human
agcugcugaaugacacugcaag

SEQ ID NO: 991883 - RNA, 22 nt, Human
aaggcugaguaaaacagagaac

SEQ ID NO: 991884 - RNA, 22 nt, Human
agaauaguggcaaugacugcac

SEQ ID NO: 991885 - RNA, 22 nt, Human
uaacagaaauauuuccagguga

SEQ ID NO: 991886 - RNA, 22 nt, Human
ucccagagugugggcaucaagg

SEQ ID NO: 991887 - RNA, 22 nt, Human
gucccaggcuuauguggagcuu

SEQ ID NO: 991888 - RNA, 22 nt, Human
auccugggaagcugacauugaa

SEQ ID NO: 991889 - RNA, 19 nt, Human
ccagcagacacagcugccc

SEQ ID NO: 991890 - RNA, 22 nt, Human
gugccaggugcuaagcugugcu

SEQ ID NO: 991891 - RNA, 22 nt, Human
cccagguggcagaagcugcagu

SEQ ID NO: 991892 - RNA, 22 nt, Human
gcagugcuaaguagcuggccca

SEQ ID NO: 991893 - RNA, 22 nt, Human
cuuuauguccaccagacugcaa

SEQ ID NO: 991894 - RNA, 22 nt, Human
ggguccaggucuucaggcagag

SEQ ID NO: 991895 - RNA, 22 nt, Human
ucagaggagccaaaguucugag

SEQ ID NO: 991896 - RNA, 22 nt, Human
ucucacuggguauaaaugagua

SEQ ID NO: 991897 - RNA, 22 nt, Human
agcagcuguacuuucaucuguu

SEQ ID NO: 991898 - RNA, 22 nt, Human
gcugccugcucggcuccuggga

SEQ ID NO: 991899 - RNA, 22 nt, Human
cauguacacucauguaacuaua

SEQ ID NO: 991900 - RNA, 22 nt, Human
caguggaggccuugggaccuuu

SEQ ID NO: 991901 - RNA, 21 nt, Human
ucaaagcacauauuugcacau

SEQ ID NO: 991902 - RNA, 22 nt, Human
ggcagcaggagccaucugguag

SEQ ID NO: 991903 - RNA, 22 nt, Human
acagguggaggcuuuaggaggu

SEQ ID NO: 991904 - RNA, 22 nt, Human
gcugcccagcaggccccagggg

SEQ ID NO: 991905 - RNA, 23 nt, Human
ggacagggcccugcccuauggcc

SEQ ID NO: 991906 - RNA, 22 nt, Human
uugcaaaugaccauugccacau

SEQ ID NO: 991907 - RNA, 22 nt, Human
cuuauguaugcuacuuuguggu

SEQ ID NO: 991908 - RNA, 22 nt, Human
gaggggcagaaugugaucaggg

SEQ ID NO: 991909 - RNA, 22 nt, Human
aaacaccagcacuguuuacaaa

SEQ ID NO: 991910 - RNA, 22 nt, Human
cugcaggcucgaagacacggau

SEQ ID NO: 991911 - RNA, 22 nt, Human
ugcuccauucucuagccagugc

SEQ ID NO: 991912 - RNA, 22 nt, Human
ugcaaaugaguugcagaucagg

SEQ ID NO: 991913 - RNA, 22 nt, Human
cagcaugcaaguccagaugugg

SEQ ID NO: 991914 - RNA, 22 nt, Human
auaaaaguaggaccaacuuaca

SEQ ID NO: 991915 - RNA, 22 nt, Human
uguaccuuuuucugugcaugcu

SEQ ID NO: 991916 - RNA, 22 nt, Human
ugcugucuuccaggauggugaa

SEQ ID NO: 991917 - RNA, 22 nt, Human
aaguuacuggcaagggcugcag

SEQ ID NO: 991918 - RNA, 22 nt, Human
accugccuaguugguucugccc

SEQ ID NO: 991919 - RNA, 22 nt, Human
accugccuauggagccacaugg

SEQ ID NO: 991920 - RNA, 22 nt, Human
agaggcagcagucauacuacag

SEQ ID NO: 991921 - RNA, 22 nt, Human
uuuuaguuguacugucaacagu

SEQ ID NO: 991922 - RNA, 22 nt, Human
acagccugcugccugcuucuug

SEQ ID NO: 991923 - RNA, 22 nt, Human
uacaaagucaccagcuucuugc

SEQ ID NO: 991924 - RNA, 22 nt, Human
ucacauuuucauauucucugag

SEQ ID NO: 991925 - RNA, 22 nt, Human
agugagggaugaagaacugcgg

SEQ ID NO: 991926 - RNA, 22 nt, Human
ggcugagcucaggggcagcagg

SEQ ID NO: 991927 - RNA, 22 nt, Human
cacccaggcuggagugcagggg

SEQ ID NO: 991928 - RNA, 22 nt, Human
uggcugcuagccagagcuucag

SEQ ID NO: 991929 - RNA, 22 nt, Human
caguagcacucugucagugaag

SEQ ID NO: 991930 - RNA, 22 nt, Human
caagaaauuucuuaagaacuaa

SEQ ID NO: 991931 - RNA, 22 nt, Human
cugcuaaaccucucugagagcu

SEQ ID NO: 991932 - RNA, 22 nt, Human
gcagagguggcaucugggcucu

SEQ ID NO: 991933 - RNA, 22 nt, Human
cucaggauagcugcgcagccug

SEQ ID NO: 991934 - RNA, 22 nt, Human
auguggcauucuuggucauuuc

SEQ ID NO: 991935 - RNA, 22 nt, Human
agggcuggcuaggugcguuccc

SEQ ID NO: 991936 - RNA, 22 nt, Human
agcugccugcuuaugagcucca

SEQ ID NO: 991937 - RNA, 22 nt, Human
uggcuuccgccgcgggccucgg

SEQ ID NO: 991938 - RNA, 22 nt, Human
aguuggcauuuuauuuaaguau

SEQ ID NO: 991939 - RNA, 22 nt, Human
acuuuuuacaggguguauacca

SEQ ID NO: 991940 - RNA, 22 nt, Human
auagaauaaggcacagauucuu

SEQ ID NO: 991941 - RNA, 22 nt, Human
gcagagcauguccucaggacag

SEQ ID NO: 991942 - RNA, 22 nt, Human
uguucuugagccuuuagaccua

SEQ ID NO: 991943 - RNA, 22 nt, Human
aucuggcucucucauuuacaaa

SEQ ID NO: 991944 - RNA, 22 nt, Human
caaaguuuggcucucaugacau

SEQ ID NO: 991945 - RNA, 22 nt, Human
ggcugccaggagaagcucagug

SEQ ID NO: 991946 - RNA, 22 nt, Human
auuuucugguugagguuuaaca

SEQ ID NO: 991947 - RNA, 22 nt, Human
aagauacugaugauguaggcua

SEQ ID NO: 991948 - RNA, 18 nt, Human
gcuggcugcacuucugcu

SEQ ID NO: 991949 - RNA, 22 nt, Human
uccuggccaaguuacucucugc

SEQ ID NO: 991950 - RNA, 22 nt, Human
aggcucugcagugcuggaggac

SEQ ID NO: 991951 - RNA, 22 nt, Human
ccucagagguguggcaucucug

SEQ ID NO: 991952 - RNA, 22 nt, Human
uuuaauugauucacagucugua

SEQ ID NO: 991953 - RNA, 19 nt, Human
agucucaguguacagaggc

SEQ ID NO: 991954 - RNA, 22 nt, Human
agcucacagaaauccugcagga

SEQ ID NO: 991955 - RNA, 20 nt, Human
auugucagccuucagaggag

SEQ ID NO: 991956 - RNA, 22 nt, Human
cagucccaccaggaucgcucuu

SEQ ID NO: 991957 - RNA, 22 nt, Human
augauacaucuucaugucagug

SEQ ID NO: 991958 - RNA, 22 nt, Human
ccuuuccuuuuuagugugggag

SEQ ID NO: 991959 - RNA, 22 nt, Human
cuccagaagacccauccucaug

SEQ ID NO: 991960 - RNA, 22 nt, Human
ucacucuguggcccaggcagug

SEQ ID NO: 991961 - RNA, 22 nt, Human
ccacagcaugcaggccugacac

SEQ ID NO: 991962 - RNA, 22 nt, Human
gaaacuguauguaguuuuuggg

SEQ ID NO: 991963 - RNA, 22 nt, Human
gccucacugcagccccaggaag

SEQ ID NO: 991964 - RNA, 22 nt, Human
ucugccuggauuccauucucca

SEQ ID NO: 991965 - RNA, 22 nt, Human
gccucugcaacuccgccuuggu

SEQ ID NO: 991966 - RNA, 22 nt, Human
aggugcagaaaaaaguccuuua

SEQ ID NO: 991967 - RNA, 23 nt, Human
uggccucuccccaccuggcagaa

SEQ ID NO: 991968 - RNA, 22 nt, Human
caggaggccaacugugggacuu

SEQ ID NO: 991969 - RNA, 22 nt, Human
accugagcaugccaggagagug

SEQ ID NO: 991970 - RNA, 23 nt, Human
uccucccaaauuucagccucauu

SEQ ID NO: 991971 - RNA, 22 nt, Human
gccucugcccuccugggacugc

SEQ ID NO: 991972 - RNA, 18 nt, Human
ucuuggaguaaugaucaa

SEQ ID NO: 991973 - RNA, 22 nt, Human
ucugagccaauuucugugucca

SEQ ID NO: 991974 - RNA, 22 nt, Human
ugaaacagucuccagacuugga

SEQ ID NO: 991975 - RNA, 22 nt, Human
ugucaucuuggucuggaauaag

SEQ ID NO: 991976 - RNA, 20 nt, Human
aggcagagcgcacuuuuaga

SEQ ID NO: 991977 - RNA, 22 nt, Human
uuugcaauuugugcugcaaaug

SEQ ID NO: 991978 - RNA, 22 nt, Human
uaaaugcaaugugcuuuaccag

SEQ ID NO: 991979 - RNA, 22 nt, Human
guggccaggccgacugccaggc

SEQ ID NO: 991980 - RNA, 22 nt, Human
acacauuauagagaguauaaua

SEQ ID NO: 991981 - RNA, 22 nt, Human
ucccagccuuucuuuucugcug

SEQ ID NO: 991982 - RNA, 21 nt, Human
ugguuugcggccaaaguuaaa

SEQ ID NO: 991983 - RNA, 22 nt, Human
ucccaaagcuacucuucugacu

SEQ ID NO: 991984 - RNA, 22 nt, Human
ugcagcugauuaaagggcagac

SEQ ID NO: 991985 - RNA, 22 nt, Human
gcccugagggguggugucugua

SEQ ID NO: 991986 - RNA, 22 nt, Human
gggaugucacugugccuggcac

SEQ ID NO: 991987 - RNA, 19 nt, Human
aucagcaagguaggaugug

SEQ ID NO: 991988 - RNA, 22 nt, Human
ugccugcucuuaccacucuccc

SEQ ID NO: 991989 - RNA, 22 nt, Human
gcccucucuucugcagccucca

SEQ ID NO: 991990 - RNA, 22 nt, Human
ccagcucuagccccauguggcu

SEQ ID NO: 991991 - RNA, 22 nt, Human
acaaaguccugguguauggcca

SEQ ID NO: 991992 - RNA, 22 nt, Human
agcuucucaggagucugaggca

SEQ ID NO: 991993 - RNA, 22 nt, Human
agcuccuccugugccaggccag

SEQ ID NO: 991994 - RNA, 22 nt, Human
ugcaggcuguaaucugaggcua

SEQ ID NO: 991995 - RNA, 22 nt, Human
caggagugagaugcgaucacuu

SEQ ID NO: 991996 - RNA, 22 nt, Human
uccuggcccaaucugcccauga

SEQ ID NO: 991997 - RNA, 22 nt, Human
uaggaugacacagcaaguauag

SEQ ID NO: 991998 - RNA, 22 nt, Human
aaggucauuguugcauguucuc

SEQ ID NO: 991999 - RNA, 22 nt, Human
uuuauuaugauggacaccuucg

SEQ ID NO: 992000 - RNA, 22 nt, Human
aacauacagugagcaguggacu

SEQ ID NO: 992001 - RNA, 22 nt, Human
ucccagagcccaaguuggagag

SEQ ID NO: 992002 - RNA, 22 nt, Human
augggaggcagacacuaaguuc

SEQ ID NO: 992003 - RNA, 22 nt, Human
ugguccaggguguaguacagag

SEQ ID NO: 992004 - RNA, 22 nt, Human
gcagcccagguguagcucuuug

SEQ ID NO: 992005 - RNA, 22 nt, Human
agagucuuuugucaguaauguu

SEQ ID NO: 992006 - RNA, 22 nt, Human
acccucccauuuccauguagca

SEQ ID NO: 992007 - RNA, 22 nt, Human
uccuuucaccaaaaaguguugu

SEQ ID NO: 992008 - RNA, 22 nt, Human
uccugggcuugcuccuccagcu

SEQ ID NO: 992009 - RNA, 22 nt, Human
guccucuguagggcugggccac

SEQ ID NO: 992010 - RNA, 22 nt, Human
aaguauauuuuuugaagcauau

SEQ ID NO: 992011 - RNA, 22 nt, Human
caaaaguaauuaugguuuuugc

SEQ ID NO: 992012 - RNA, 22 nt, Human
aaauguaguauguugcauguau

SEQ ID NO: 992013 - RNA, 22 nt, Human
cagcugccacuugcucucggcu

SEQ ID NO: 992014 - RNA, 22 nt, Human
agcccagcagaaaguccagccu

SEQ ID NO: 992015 - RNA, 22 nt, Human
cugggcacauuuugacuagugu

SEQ ID NO: 992016 - RNA, 22 nt, Human
gugcagcugugugagagcucca

SEQ ID NO: 992017 - RNA, 22 nt, Human
gaaaugcauaaucuuaguagau

SEQ ID NO: 992018 - RNA, 22 nt, Human
ccaggaggcagaaguugcagug

SEQ ID NO: 992019 - RNA, 22 nt, Human
uaaaucacuccuaauaaucagu

SEQ ID NO: 992020 - RNA, 19 nt, Human
ugcagcucagggcaggggc

SEQ ID NO: 992021 - RNA, 22 nt, Human
gcuggcagaauuucuucuugcu

SEQ ID NO: 992022 - RNA, 21 nt, Human
ucacucugauuaggugucucu

SEQ ID NO: 992023 - RNA, 22 nt, Human
ucucagagcucacaccuccugg

SEQ ID NO: 992024 - RNA, 21 nt, Human
agagccugagaucuuccagca

SEQ ID NO: 992025 - RNA, 20 nt, Human
ugcagcugcaggaggguggg

SEQ ID NO: 992026 - RNA, 18 nt, Human
ugagagugugugcucuug

SEQ ID NO: 992027 - RNA, 22 nt, Human
uguauuagagcaguagaauuau

SEQ ID NO: 992028 - RNA, 22 nt, Human
ucccagauuguugauggcuuaa

SEQ ID NO: 992029 - RNA, 22 nt, Human
ggaccagagcucgggcuucuca

SEQ ID NO: 992030 - RNA, 22 nt, Human
ugcagaagaaaacagcugugug

SEQ ID NO: 992031 - RNA, 22 nt, Human
ggccugcuauuggugggcagac

SEQ ID NO: 992032 - RNA, 22 nt, Human
ugccaggcauauggccucuuug

SEQ ID NO: 992033 - RNA, 18 nt, Human
cagaaaucacaccagcac

SEQ ID NO: 992034 - RNA, 22 nt, Human
ccagcucuuuuggcugagugag

SEQ ID NO: 992035 - RNA, 22 nt, Human
uggcucugggaaucuguugcuu

SEQ ID NO: 992036 - RNA, 22 nt, Human
acacugaauauacaaugaauau

SEQ ID NO: 992037 - RNA, 22 nt, Human
auuagagaaugugcugacauug

SEQ ID NO: 992038 - RNA, 22 nt, Human
aggauccuuuggccacuucuua

SEQ ID NO: 992039 - RNA, 22 nt, Human
cagacagcugcuuucuugcugu

SEQ ID NO: 992040 - RNA, 22 nt, Human
agccuggcccugcugaacucug

SEQ ID NO: 992041 - RNA, 22 nt, Human
aacacaaagaagcugcaggauc

SEQ ID NO: 992042 - RNA, 22 nt, Human
aagcagaauuucccacuaguug

SEQ ID NO: 992043 - RNA, 22 nt, Human
aggauguugcuauuggcagucu

SEQ ID NO: 992044 - RNA, 22 nt, Human
aggcacugaccugcuuccuuga

SEQ ID NO: 992045 - RNA, 22 nt, Human
agucccuguacuuuccacugcc

SEQ ID NO: 992046 - RNA, 22 nt, Human
agcagccaauuggaggaugaag

SEQ ID NO: 992047 - RNA, 22 nt, Human
uggagccagagcgcagccuggg

SEQ ID NO: 992048 - RNA, 22 nt, Human
agggaaagguagugaggucaca

SEQ ID NO: 992049 - RNA, 22 nt, Human
gcuuuccuggcccugucccugc

SEQ ID NO: 992050 - RNA, 22 nt, Human
ggaggcaggaaagacagguuca

SEQ ID NO: 992051 - RNA, 23 nt, Human
guggccuccccggaaugccucgc

SEQ ID NO: 992052 - RNA, 22 nt, Human
ggaagaagggucauuggcagcc

SEQ ID NO: 992053 - RNA, 22 nt, Human
augccuguaaucccagugcuuu

SEQ ID NO: 992054 - RNA, 22 nt, Human
agcccaagcuaugaggugaccu

SEQ ID NO: 992055 - RNA, 22 nt, Human
aaaagacaucuauuucaggcag

SEQ ID NO: 992056 - RNA, 22 nt, Human
ucuuuggauaucgcuagaccgu

SEQ ID NO: 992057 - RNA, 18 nt, Human
aaauguacuguccauggc

SEQ ID NO: 992058 - RNA, 22 nt, Human
uugaagcaaggcgaaucuugug

SEQ ID NO: 992059 - RNA, 22 nt, Human
acacagggggcauucuaggagu

SEQ ID NO: 992060 - RNA, 22 nt, Human
cacaguggauugggugaugccc

SEQ ID NO: 992061 - RNA, 22 nt, Human
gggucuggcaugcugagaugga

SEQ ID NO: 992062 - RNA, 22 nt, Human
aggccugaggaccagauaaaug

SEQ ID NO: 992063 - RNA, 22 nt, Human
ccaggcaucacgggcauguggc

SEQ ID NO: 992064 - RNA, 20 nt, Human
ugccagggccagcagaggcu

SEQ ID NO: 992065 - RNA, 22 nt, Human
agggcagagaaauguaguugag

SEQ ID NO: 992066 - RNA, 22 nt, Human
agacagcaggggagucugguuu

SEQ ID NO: 992067 - RNA, 22 nt, Human
uuuucuuauggugaagcacaaa

SEQ ID NO: 992068 - RNA, 22 nt, Human
augccaggccccacgcugggca

SEQ ID NO: 992069 - RNA, 22 nt, Human
uggaagagaaaggaguggaucu

SEQ ID NO: 992070 - RNA, 22 nt, Human
gaaaaguauguuuauuuugacu

SEQ ID NO: 992071 - RNA, 22 nt, Human
gcagagcccuggggguauggug

SEQ ID NO: 992072 - RNA, 22 nt, Human
uggcucagcgguggcagcagac

SEQ ID NO: 992073 - RNA, 22 nt, Human
aaguugaagcaugaaccaaggu

SEQ ID NO: 992074 - RNA, 22 nt, Human
aaagaucagucugaagcaacau

SEQ ID NO: 992075 - RNA, 22 nt, Human
ucacuuauaaaaugcaagaucu

SEQ ID NO: 992076 - RNA, 19 nt, Human
acagggcagcaauaggaua

SEQ ID NO: 992077 - RNA, 22 nt, Human
aggcagagcugauguucuguga

SEQ ID NO: 992078 - RNA, 22 nt, Human
cucagaguccauaguuuacagu

SEQ ID NO: 992079 - RNA, 22 nt, Human
ccuggcugugcauugccggccc

SEQ ID NO: 992080 - RNA, 22 nt, Human
agugaaauugcuguaagaggaa

SEQ ID NO: 992081 - RNA, 23 nt, Human
ccuucagaagaaguaacaggggc

SEQ ID NO: 992082 - RNA, 22 nt, Human
caagaugaucccugaaggcagc

SEQ ID NO: 992083 - RNA, 22 nt, Human
ggucaugcugugaaucagugcu

SEQ ID NO: 992084 - RNA, 22 nt, Human
auucuccagcucacuguccaua

SEQ ID NO: 992085 - RNA, 22 nt, Human
ucuguucuauuggucuaugugu

SEQ ID NO: 992086 - RNA, 22 nt, Human
caggugggccgggguuuguucu

SEQ ID NO: 992087 - RNA, 22 nt, Human
ugaccaaaaaauucccugugag

SEQ ID NO: 992088 - RNA, 22 nt, Human
cucucugaggaaggagcaucug

SEQ ID NO: 992089 - RNA, 22 nt, Human
uuaaacagacaguaaaugaaac

SEQ ID NO: 992090 - RNA, 22 nt, Human
caggcagauuugcugcccucca

SEQ ID NO: 992091 - RNA, 22 nt, Human
gggcuggaucuccugcaggcag

SEQ ID NO: 992092 - RNA, 22 nt, Human
uaauacuuuugccuuguauuca

SEQ ID NO: 992093 - RNA, 22 nt, Human
ugcccaggguggagugcagcgg

SEQ ID NO: 992094 - RNA, 22 nt, Human
ugacaugcuuguuuuccuugaa

SEQ ID NO: 992095 - RNA, 22 nt, Human
agccagggacgcugcaggcuac

SEQ ID NO: 992096 - RNA, 22 nt, Human
acugugugaaacaucaaugugu

SEQ ID NO: 992097 - RNA, 22 nt, Human
aacaacugaaaagcuuuuucug

SEQ ID NO: 992098 - RNA, 22 nt, Human
ggaggccauaguuugggaguca

SEQ ID NO: 992099 - RNA, 22 nt, Human
aaauauuauugcuuaaggggag

SEQ ID NO: 992100 - RNA, 22 nt, Human
gccaggugcuaucccugcgcug

SEQ ID NO: 992101 - RNA, 22 nt, Human
aagaaugucguugguauuuuaa

SEQ ID NO: 992102 - RNA, 22 nt, Human
auucuuuuuuaaggaauagaac

SEQ ID NO: 992103 - RNA, 22 nt, Human
uugcagggaccugcagaaagcu

SEQ ID NO: 992104 - RNA, 22 nt, Human
cggagcugccugccaagccugc

SEQ ID NO: 992105 - RNA, 23 nt, Human
ggagccuggcauaugagacgcau

SEQ ID NO: 992106 - RNA, 22 nt, Human
aaguguuaaaagauuaaaugcu

SEQ ID NO: 992107 - RNA, 22 nt, Human
uagcagcugugaguaaaagcca

SEQ ID NO: 992108 - RNA, 22 nt, Human
ugcccuguuaucuuggaagagu

SEQ ID NO: 992109 - RNA, 22 nt, Human
cuggaaggucuguccccacugc

SEQ ID NO: 992110 - RNA, 22 nt, Human
ugucagugaguuaguugcaagu

SEQ ID NO: 992111 - RNA, 22 nt, Human
cuagaaaugcucaagagaaagu

SEQ ID NO: 992112 - RNA, 22 nt, Human
gcagccacuuugcaaccaagag

SEQ ID NO: 992113 - RNA, 23 nt, Human
aaaguugauuugcaguuuaagag

SEQ ID NO: 992114 - RNA, 22 nt, Human
gcagugcugaucccauggcaga

SEQ ID NO: 992115 - RNA, 22 nt, Human
uauuuauaaucugccaaagaga

SEQ ID NO: 992116 - RNA, 22 nt, Human
gauuuccuugcauauugguaau

SEQ ID NO: 992117 - RNA, 22 nt, Human
ggacccugggcuugcuccuggg

SEQ ID NO: 992118 - RNA, 22 nt, Human
ccugccugguguaagucuaagg

SEQ ID NO: 992119 - RNA, 22 nt, Human
ccuggcugggccugauuucuca

SEQ ID NO: 992120 - RNA, 22 nt, Human
gcucugucuucagcacacagua

SEQ ID NO: 992121 - RNA, 22 nt, Human
uggcuggcaguaggcuaguggc

SEQ ID NO: 992122 - RNA, 22 nt, Human
guuccaguaugauuccacccau

SEQ ID NO: 992123 - RNA, 22 nt, Human
aggcucagcccaagguggagag

SEQ ID NO: 992124 - RNA, 22 nt, Human
uccuugaaaggggcugcagggc

SEQ ID NO: 992125 - RNA, 22 nt, Human
gccuuggccuuccuaggccuga

SEQ ID NO: 992126 - RNA, 22 nt, Human
gagauguacaauguguauuaau

SEQ ID NO: 992127 - RNA, 22 nt, Human
ggaggggcagccauggaacucc

SEQ ID NO: 992128 - RNA, 22 nt, Human
uuguuuucacagcuuugcccgg

SEQ ID NO: 992129 - RNA, 22 nt, Human
cagccagcugaauguaccauga

SEQ ID NO: 992130 - RNA, 22 nt, Human
cagagccagcuguccuuggcau

SEQ ID NO: 992131 - RNA, 22 nt, Human
uuauguaauuuguuugcucuuc

SEQ ID NO: 992132 - RNA, 22 nt, Human
ggugauuuucgaguuucauguu

SEQ ID NO: 992133 - RNA, 22 nt, Human
cagcugagcaucacuagucugg

SEQ ID NO: 992134 - RNA, 22 nt, Human
uagaaaugcaguguacuguguc

SEQ ID NO: 992135 - RNA, 22 nt, Human
cacucugcugaaaucgccuugu

SEQ ID NO: 992136 - RNA, 22 nt, Human
uuguuuaaaauguagcaagaaa

SEQ ID NO: 992137 - RNA, 22 nt, Human
auaauuuacuaagcucuaccuu

SEQ ID NO: 992138 - RNA, 22 nt, Human
uacaaagagguaauugcauaua

SEQ ID NO: 992139 - RNA, 22 nt, Human
auuguacaaugccuggaacauu

SEQ ID NO: 992140 - RNA, 22 nt, Human
cuggagccuagguugaccuggg

SEQ ID NO: 992141 - RNA, 22 nt, Human
gugccuggagcuaauguguaua

SEQ ID NO: 992142 - RNA, 22 nt, Human
agcugcuccuuuccugcaggcg

SEQ ID NO: 992143 - RNA, 22 nt, Human
ccuggagcacauggcaggaggc

SEQ ID NO: 992144 - RNA, 22 nt, Human
caucuuuuggccuauucugagg

SEQ ID NO: 992145 - RNA, 22 nt, Human
ucaggaguccugccugcagccu

SEQ ID NO: 992146 - RNA, 22 nt, Human
ucaggcugagaaaaucuggacc

SEQ ID NO: 992147 - RNA, 22 nt, Human
gcugucacacaugggaucucag

SEQ ID NO: 992148 - RNA, 22 nt, Human
cagcacugcuucgcagccaggg

SEQ ID NO: 992149 - RNA, 20 nt, Human
cagucccaauccagggccag

SEQ ID NO: 992150 - RNA, 22 nt, Human
ucagaggucacacagcaaguuu

SEQ ID NO: 992151 - RNA, 22 nt, Human
cagcaauauacacagucuaugg

SEQ ID NO: 992152 - RNA, 22 nt, Human
uggaaagaaaaacaggccauga

SEQ ID NO: 992153 - RNA, 22 nt, Human
cccugcagccuugcaugccuuc

SEQ ID NO: 992154 - RNA, 23 nt, Human
ugagcugguauuguccaucucca

SEQ ID NO: 992155 - RNA, 22 nt, Human
agggggcccuugcaggugagcg

SEQ ID NO: 992156 - RNA, 22 nt, Human
uggaagaggcccaugacugccu

SEQ ID NO: 992157 - RNA, 22 nt, Human
caaggaaaaagcgagcucgggg

SEQ ID NO: 992158 - RNA, 22 nt, Human
gcagugacagggcugcugccuu

SEQ ID NO: 992159 - RNA, 22 nt, Human
acccaggagguggaggcugcag

SEQ ID NO: 992160 - RNA, 22 nt, Human
cacagggcagugauuguccaca

SEQ ID NO: 992161 - RNA, 22 nt, Human
aaaccaaacauuugcgguggug

SEQ ID NO: 992162 - RNA, 22 nt, Human
uuguuuguaugcugagaagaau

SEQ ID NO: 992163 - RNA, 22 nt, Human
aauaauguacauacauauuucg

SEQ ID NO: 992164 - RNA, 22 nt, Human
auguacauuuagaucauuucug

SEQ ID NO: 992165 - RNA, 22 nt, Human
ucugagcuggagcccaucaccu

SEQ ID NO: 992166 - RNA, 22 nt, Human
uugucugucccagcuugugcau

SEQ ID NO: 992167 - RNA, 22 nt, Human
cauugucacccaaagcucauag

SEQ ID NO: 992168 - RNA, 22 nt, Human
ugaagcaggcauugacugauga

SEQ ID NO: 992169 - RNA, 22 nt, Human
cagagugaaaacugagcucaaa

SEQ ID NO: 992170 - RNA, 22 nt, Human
aggcucagcaucugauucauau

SEQ ID NO: 992171 - RNA, 22 nt, Human
agcagcugcagagggcuccccc

SEQ ID NO: 992172 - RNA, 22 nt, Human
ccuggcagcauugguagagauu

SEQ ID NO: 992173 - RNA, 22 nt, Human
ggcugccuugacccuggcuccg

SEQ ID NO: 992174 - RNA, 22 nt, Human
ucuuuuauccuacauuuagcuc

SEQ ID NO: 992175 - RNA, 22 nt, Human
guuauaaaaugcacaguuguuu

SEQ ID NO: 992176 - RNA, 22 nt, Human
ucugggugcccuuugcucuguu

SEQ ID NO: 992177 - RNA, 22 nt, Human
cauaccuuucucaagcacaugu

SEQ ID NO: 992178 - RNA, 22 nt, Human
uggcucagaggggaagugguuu

SEQ ID NO: 992179 - RNA, 22 nt, Human
cuccaggccagggaaguggaca

SEQ ID NO: 992180 - RNA, 22 nt, Human
gccaggcauuuguuaggugcug

SEQ ID NO: 992181 - RNA, 22 nt, Human
gcagagugaggaagagcuucca

SEQ ID NO: 992182 - RNA, 22 nt, Human
cauuuuauccucugggaagcua

SEQ ID NO: 992183 - RNA, 22 nt, Human
gcugucacucuccggccuuccc

SEQ ID NO: 992184 - RNA, 22 nt, Human
cuggcaggcggcagagcccagg

SEQ ID NO: 992185 - RNA, 22 nt, Human
uaggaaaaauacagaauuauau

SEQ ID NO: 992186 - RNA, 22 nt, Human
guggccaaggcagagaaagagc

SEQ ID NO: 992187 - RNA, 22 nt, Human
gcccucuggcagccuuggcugg

SEQ ID NO: 992188 - RNA, 22 nt, Human
uggcagcugaggggaggcuuug

SEQ ID NO: 992189 - RNA, 22 nt, Human
gagcucuggcagggcaggucug

SEQ ID NO: 992190 - RNA, 22 nt, Human
ucccagcagucagagcuaugug

SEQ ID NO: 992191 - RNA, 22 nt, Human
uguggccuggaaggggcugcuc

SEQ ID NO: 992192 - RNA, 22 nt, Human
ccucugggagacugcuacugag

SEQ ID NO: 992193 - RNA, 22 nt, Human
cgcuggggcuuuuugcuugaga

SEQ ID NO: 992194 - RNA, 22 nt, Human
ggccagaaguuggaaaagagcc

SEQ ID NO: 992195 - RNA, 22 nt, Human
gcugccuugaacuuggccuggg

SEQ ID NO: 992196 - RNA, 22 nt, Human
agagcccucuucacugccccuu

SEQ ID NO: 992197 - RNA, 22 nt, Human
uacauucuacuuuuucacuccc

SEQ ID NO: 992198 - RNA, 22 nt, Human
gugcaggggaucagguugcagc

SEQ ID NO: 992199 - RNA, 22 nt, Human
cagggccuuauccugccauuga

SEQ ID NO: 992200 - RNA, 22 nt, Human
ugcuggcuacugauggcaggcc

SEQ ID NO: 992201 - RNA, 22 nt, Human
uuccucuccucccaccagguga

SEQ ID NO: 992202 - RNA, 22 nt, Human
cagggaauccauggucauaagg

SEQ ID NO: 992203 - RNA, 22 nt, Human
ugaagguggcauaggagagaug

SEQ ID NO: 992204 - RNA, 22 nt, Human
uucuggagaucugccuauggga

SEQ ID NO: 992205 - RNA, 22 nt, Human
cuuguacaggaauccaugguau

SEQ ID NO: 992206 - RNA, 22 nt, Human
gcagggcugggugggagacaga

SEQ ID NO: 992207 - RNA, 22 nt, Human
aauucacaaaaguuagauccau

SEQ ID NO: 992208 - RNA, 22 nt, Human
aaacuguaagagaauaaacuac

SEQ ID NO: 992209 - RNA, 22 nt, Human
uauuggauagcuugugcagaau

SEQ ID NO: 992210 - RNA, 22 nt, Human
ugaagccacagagcaucugccu

SEQ ID NO: 992211 - RNA, 22 nt, Human
augggaggguggaaaggcucug

SEQ ID NO: 992212 - RNA, 22 nt, Human
agaugcugcuccacaggccagg

SEQ ID NO: 992213 - RNA, 22 nt, Human
gccugccugaaggcuguaccag

SEQ ID NO: 992214 - RNA, 23 nt, Human
aguguuccaguugguugagagug

SEQ ID NO: 992215 - RNA, 19 nt, Human
ccuggaggugaagguucuc

SEQ ID NO: 992216 - RNA, 22 nt, Human
agggauggaagcucgucugcaa

SEQ ID NO: 992217 - RNA, 22 nt, Human
cauaucccauuggccaggacau

SEQ ID NO: 992218 - RNA, 23 nt, Human
aguuuuucugcaugguucuguau

SEQ ID NO: 992219 - RNA, 22 nt, Human
ugggccugaaggagcugcgccc

SEQ ID NO: 992220 - RNA, 17 nt, Human
gggcagggacuccuggg

SEQ ID NO: 992221 - RNA, 22 nt, Human
cuuccucacggugcaacaggaa

SEQ ID NO: 992222 - RNA, 22 nt, Human
cacagaggaaaggcaguuggua

SEQ ID NO: 992223 - RNA, 22 nt, Human
auauaaagagcuuaguauagug

SEQ ID NO: 992224 - RNA, 22 nt, Human
ucagggcaaagggcagaguuug

SEQ ID NO: 992225 - RNA, 22 nt, Human
acagaauuaaaguguuugugga

SEQ ID NO: 992226 - RNA, 22 nt, Human
acucacuuuccauucaagcacc

SEQ ID NO: 992227 - RNA, 18 nt, Human
uucacaggaaaugucuuu

SEQ ID NO: 992228 - RNA, 22 nt, Human
cauguuaaugaauuuuugcagu

SEQ ID NO: 992229 - RNA, 21 nt, Human
ugggcacugagggugcugcuc

SEQ ID NO: 992230 - RNA, 22 nt, Human
gugggccuugcagggugcaggg

SEQ ID NO: 992231 - RNA, 20 nt, Human
ugaaaggugggaauuguggg

SEQ ID NO: 992232 - RNA, 22 nt, Human
aaaugugucauauucaaaguca

SEQ ID NO: 992233 - RNA, 22 nt, Human
agccuccaaaugucaggucccg

SEQ ID NO: 992234 - RNA, 22 nt, Human
cuuagaaaugcagauucucagg

SEQ ID NO: 992235 - RNA, 21 nt, Human
ggggcagagcuaggcccugca

SEQ ID NO: 992236 - RNA, 21 nt, Human
aggcacuguuugugguuuggg

SEQ ID NO: 992237 - RNA, 22 nt, Human
uugucugugaaauggaaauagu

SEQ ID NO: 992238 - RNA, 22 nt, Human
uccagaggcuccaaagggagau

SEQ ID NO: 992239 - RNA, 22 nt, Human
aucccugcccucauggagcuua

SEQ ID NO: 992240 - RNA, 22 nt, Human
acauuuaaauaccuauguuucu

SEQ ID NO: 992241 - RNA, 22 nt, Human
ugggcagaauugugguaguuaa

SEQ ID NO: 992242 - RNA, 22 nt, Human
uaaaguuuggcagacaauaaca

SEQ ID NO: 992243 - RNA, 22 nt, Human
ugcaguggugguaaagaugcuc

SEQ ID NO: 992244 - RNA, 22 nt, Human
agggagaacaguugcagcagac

SEQ ID NO: 992245 - RNA, 22 nt, Human
gcagcugggacacugaggccag

SEQ ID NO: 992246 - RNA, 22 nt, Human
ggucccaggcucccucuugucc

SEQ ID NO: 992247 - RNA, 22 nt, Human
gcucuccacugaccacggggca

SEQ ID NO: 992248 - RNA, 22 nt, Human
gcagacagcauguugggcuauu

SEQ ID NO: 992249 - RNA, 22 nt, Human
aagggagacaguugugugagga

SEQ ID NO: 992250 - RNA, 20 nt, Human
gccugagcuauugccaggau

SEQ ID NO: 992251 - RNA, 22 nt, Human
guacacucccccugugaaguug

SEQ ID NO: 992252 - RNA, 19 nt, Human
ggcuggcaagugacagugu

SEQ ID NO: 992253 - RNA, 22 nt, Human
aagggaggccagagguuuugca

SEQ ID NO: 992254 - RNA, 22 nt, Human
cuccugggaauuuaguugugag

SEQ ID NO: 992255 - RNA, 22 nt, Human
cucucugagugagggacaagcu

SEQ ID NO: 992256 - RNA, 22 nt, Human
ucagaggaaaggucagauggcu

SEQ ID NO: 992257 - RNA, 22 nt, Human
ucagcaaugugauacugugcaa

SEQ ID NO: 992258 - RNA, 22 nt, Human
cagggacaugacuggucucugu

SEQ ID NO: 992259 - RNA, 22 nt, Human
gggauggggagcuggaaagggg

SEQ ID NO: 992260 - RNA, 19 nt, Human
ucucacaguuuccuugccu

SEQ ID NO: 992261 - RNA, 22 nt, Human
gcucccuguucucagccaugau

SEQ ID NO: 992262 - RNA, 22 nt, Human
agaagccaauucugugugaguc

SEQ ID NO: 992263 - RNA, 22 nt, Human
agucccagaugacccagcuacu

SEQ ID NO: 992264 - RNA, 22 nt, Human
ugaagcugugggcaguggagcc

SEQ ID NO: 992265 - RNA, 22 nt, Human
ucagcagucacauguuguccca

SEQ ID NO: 992266 - RNA, 20 nt, Human
gggguuggcuggcacaggga

SEQ ID NO: 992267 - RNA, 22 nt, Human
gggcucuguccauuccuucaua

SEQ ID NO: 992268 - RNA, 22 nt, Human
accaucaguacuggaugcugac

SEQ ID NO: 992269 - RNA, 18 nt, Human
uggcagggaggaaauaua

SEQ ID NO: 992270 - RNA, 22 nt, Human
guggccagaagacugcaaugcu

SEQ ID NO: 992271 - RNA, 18 nt, Human
ucugggcuucccgaggcu

SEQ ID NO: 992272 - RNA, 22 nt, Human
ccaggagguggagauugcagug

SEQ ID NO: 992273 - RNA, 21 nt, Human
gaggccacuaauaggggcaga

SEQ ID NO: 992274 - RNA, 22 nt, Human
aaagucauuggaauauuaauga

SEQ ID NO: 992275 - RNA, 22 nt, Human
uaauguguccugaaagcuucug

SEQ ID NO: 992276 - RNA, 22 nt, Human
auuguauuagcacaauacaauu

SEQ ID NO: 992277 - RNA, 22 nt, Human
uugcuucauuuuaaauaaagac

SEQ ID NO: 992278 - RNA, 22 nt, Human
gauccuugcacuugacuuggca

SEQ ID NO: 992279 - RNA, 22 nt, Human
ucacaggaaccaucagagaaau

SEQ ID NO: 992280 - RNA, 22 nt, Human
guggccaaacaccaguuuagga

SEQ ID NO: 992281 - RNA, 20 nt, Human
ugucaugcauuagaugaaga

SEQ ID NO: 992282 - RNA, 20 nt, Human
ucugcccaccccggcuccca

SEQ ID NO: 992283 - RNA, 22 nt, Human
ggccugagucccaccuggcugu

SEQ ID NO: 992284 - RNA, 22 nt, Human
aguaaaaucuuaagcacagugg

SEQ ID NO: 992285 - RNA, 22 nt, Human
ggggacugccuuccacagacac

SEQ ID NO: 992286 - RNA, 22 nt, Human
ccuuccaggugcaggcaagccu

SEQ ID NO: 992287 - RNA, 18 nt, Human
agcagaauucuaggguuc

SEQ ID NO: 992288 - RNA, 23 nt, Human
gccagccuugcucuccugcagcc

SEQ ID NO: 992289 - RNA, 22 nt, Human
gguggguauaguuagggccucu

SEQ ID NO: 992290 - RNA, 20 nt, Human
cugagcccccagccugcagg

SEQ ID NO: 992291 - RNA, 21 nt, Human
cugcaucucauagaacauguc

SEQ ID NO: 992292 - RNA, 22 nt, Human
agucucagaguaccugagggac

SEQ ID NO: 992293 - RNA, 22 nt, Human
ucuggcuccugaguccaugcuc

SEQ ID NO: 992294 - RNA, 22 nt, Human
guggcugcagcccagcggcacg

SEQ ID NO: 992295 - RNA, 22 nt, Human
agcuucuguucaucuuccaggc

SEQ ID NO: 992296 - RNA, 22 nt, Human
ccaggagcaggagcuggacaga

SEQ ID NO: 992297 - RNA, 22 nt, Human
uuguuucauggggauguuuauu

SEQ ID NO: 992298 - RNA, 22 nt, Human
agacaucagcuugugugcaggg

SEQ ID NO: 992299 - RNA, 22 nt, Human
auagacuugguuaguaaauuug

SEQ ID NO: 992300 - RNA, 22 nt, Human
agcugggccugagcuggaagcu

SEQ ID NO: 992301 - RNA, 22 nt, Human
ucugggcccuaaaccagcucua

SEQ ID NO: 992302 - RNA, 22 nt, Human
cauuuacauuuaagguuaauau

SEQ ID NO: 992303 - RNA, 22 nt, Human
uuuccucuuugugacacagcug

SEQ ID NO: 992304 - RNA, 22 nt, Human
gagaaggggugauguggguaau

SEQ ID NO: 992305 - RNA, 23 nt, Human
gagcugggauacaggcuuacugc

SEQ ID NO: 992306 - RNA, 22 nt, Human
accuuuuuguucuguucucagc

SEQ ID NO: 992307 - RNA, 22 nt, Human
gcagggucgcucuaggagauca

SEQ ID NO: 992308 - RNA, 22 nt, Human
agcccagaggcugggcgugcau

SEQ ID NO: 992309 - RNA, 22 nt, Human
ugcagggccagacuggguugga

SEQ ID NO: 992310 - RNA, 22 nt, Human
gggacuguaaauucauauggcc

SEQ ID NO: 992311 - RNA, 22 nt, Human
cuccuguauguugggcuucaca

SEQ ID NO: 992312 - RNA, 22 nt, Human
agcuggagaugcccagcaccgg

SEQ ID NO: 992313 - RNA, 22 nt, Human
agaaauguuguggguuuuguua

SEQ ID NO: 992314 - RNA, 22 nt, Human
aaggcacuagcagaauuaguga

SEQ ID NO: 992315 - RNA, 22 nt, Human
gcaaggagacuguagggccaag

SEQ ID NO: 992316 - RNA, 22 nt, Human
uccuucagugucccgcucaggu

SEQ ID NO: 992317 - RNA, 22 nt, Human
auuugcagagcucugaauuuug

SEQ ID NO: 992318 - RNA, 22 nt, Human
cucuugggagugcucuggagaa

SEQ ID NO: 992319 - RNA, 22 nt, Human
cccagccaaggugcugguguug

SEQ ID NO: 992320 - RNA, 19 nt, Human
agucugcauuucuagcaag

SEQ ID NO: 992321 - RNA, 22 nt, Human
cugaaaugguugccuggagaau

SEQ ID NO: 992322 - RNA, 22 nt, Human
uaaaaguuuuaguuguacauaa

SEQ ID NO: 992323 - RNA, 22 nt, Human
acaggcuuuuuuagaaugacau

SEQ ID NO: 992324 - RNA, 22 nt, Human
aagccagguguugugguaagag

SEQ ID NO: 992325 - RNA, 22 nt, Human
uuguuuuggaagaacuuacucu

SEQ ID NO: 992326 - RNA, 22 nt, Human
ugagccuguggggugacaacca

SEQ ID NO: 992327 - RNA, 22 nt, Human
gauacaaauucaugucugaauu

SEQ ID NO: 992328 - RNA, 22 nt, Human
ggguguccugugccaagcuggg

SEQ ID NO: 992329 - RNA, 22 nt, Human
cagcuucugagcaagccagggg

SEQ ID NO: 992330 - RNA, 20 nt, Human
gccugcagagaaggucagag

SEQ ID NO: 992331 - RNA, 22 nt, Human
aaaugcacacaccaggaaacua

SEQ ID NO: 992332 - RNA, 22 nt, Human
uuguuaguuuauauaauguagu

SEQ ID NO: 992333 - RNA, 22 nt, Human
agaggggcucauauccugucau

SEQ ID NO: 992334 - RNA, 22 nt, Human
ugagccaaugauuugaauagag

SEQ ID NO: 992335 - RNA, 22 nt, Human
ucucccacuggccuuguaugau

SEQ ID NO: 992336 - RNA, 22 nt, Human
augaaacaugagaaauggagag

SEQ ID NO: 992337 - RNA, 22 nt, Human
cucugagcccgcugcagcccca

SEQ ID NO: 992338 - RNA, 22 nt, Human
gcagggcuaauggggcaaguag

SEQ ID NO: 992339 - RNA, 22 nt, Human
cccagcucaucaggagccgccc

SEQ ID NO: 992340 - RNA, 20 nt, Human
uaacauaguccagagaacga

SEQ ID NO: 992341 - RNA, 22 nt, Human
agcucuggaauaaugaugugau

SEQ ID NO: 992342 - RNA, 22 nt, Human
uguuggcaucucugagagaguu

SEQ ID NO: 992343 - RNA, 22 nt, Human
ggaaccaguggaaugauaugcu

SEQ ID NO: 992344 - RNA, 19 nt, Human
acccagagcccuuugcagg

SEQ ID NO: 992345 - RNA, 22 nt, Human
ucucuggggauggaccugggag

SEQ ID NO: 992346 - RNA, 22 nt, Human
auguccuuccauuuugaucugu

SEQ ID NO: 992347 - RNA, 22 nt, Human
uauauuaacacccacuugccuc

SEQ ID NO: 992348 - RNA, 22 nt, Human
agggcagccaugagccuucagg

SEQ ID NO: 992349 - RNA, 20 nt, Human
ucugaggcugagcucuacuu

SEQ ID NO: 992350 - RNA, 22 nt, Human
agagugauccuaauugauuugg

SEQ ID NO: 992351 - RNA, 22 nt, Human
cuggccuuuaaaaugaccuuau

SEQ ID NO: 992352 - RNA, 22 nt, Human
aucuaggauuugaaugcacagu

SEQ ID NO: 992353 - RNA, 22 nt, Human
caugccaguuuugagaugcacc

SEQ ID NO: 992354 - RNA, 22 nt, Human
cagcagaggaaagcaaaucuaa

SEQ ID NO: 992355 - RNA, 22 nt, Human
ugagccagaguggagugugccu

SEQ ID NO: 992356 - RNA, 22 nt, Human
acuucuugggacccuggcaccg

SEQ ID NO: 992357 - RNA, 22 nt, Human
ggcagcugauuagcaucaagga

SEQ ID NO: 992358 - RNA, 22 nt, Human
cugcugagcccuggcacaggug

SEQ ID NO: 992359 - RNA, 22 nt, Human
cugcaggcccccuuccuggagu

SEQ ID NO: 992360 - RNA, 22 nt, Human
caggccuggcugcagcucgccu

SEQ ID NO: 992361 - RNA, 19 nt, Human
gggcagaauggcaucucag

SEQ ID NO: 992362 - RNA, 22 nt, Human
gcucugugccacaugcaguguu

SEQ ID NO: 992363 - RNA, 20 nt, Human
uccaguuuuggagacauucu

SEQ ID NO: 992364 - RNA, 20 nt, Human
gcugucuggauuagaagccu

SEQ ID NO: 992365 - RNA, 22 nt, Human
guggcccaggcuuggcgcuggc

SEQ ID NO: 992366 - RNA, 22 nt, Human
cugucucuguugccuguaggug

SEQ ID NO: 992367 - RNA, 22 nt, Human
agagaagacuuacagccacagu

SEQ ID NO: 992368 - RNA, 20 nt, Human
uauaacaguguugggugugu

SEQ ID NO: 992369 - RNA, 23 nt, Human
cucccuggaguuucuggaagaug

SEQ ID NO: 992370 - RNA, 22 nt, Human
cugugccuuuguagcugugccu

SEQ ID NO: 992371 - RNA, 22 nt, Human
gcagccuguuguaccagccugu

SEQ ID NO: 992372 - RNA, 22 nt, Human
gcuguauuuauuuucuaggguu

SEQ ID NO: 992373 - RNA, 22 nt, Human
cagagcuggguuugggaaaccu

SEQ ID NO: 992374 - RNA, 22 nt, Human
uugcucagcacuggagccagcu

SEQ ID NO: 992375 - RNA, 22 nt, Human
caggcagcucgaugccuuguug

SEQ ID NO: 992376 - RNA, 22 nt, Human
aaaaguuaccucuguaauauaa

SEQ ID NO: 992377 - RNA, 22 nt, Human
auuccaguucuccucucuaaag

SEQ ID NO: 992378 - RNA, 22 nt, Human
uacauucaacaugucacuaugu

SEQ ID NO: 992379 - RNA, 22 nt, Human
cagagcagguaucuuuggugaa

SEQ ID NO: 992380 - RNA, 22 nt, Human
cccucugccugggaccaagucc

SEQ ID NO: 992381 - RNA, 22 nt, Human
gcuggcucuucaguggagauag

SEQ ID NO: 992382 - RNA, 18 nt, Human
uagaauauaggucauucu

SEQ ID NO: 992383 - RNA, 22 nt, Human
ugcccaaaccucuccuagcucu

SEQ ID NO: 992384 - RNA, 22 nt, Human
ggcugccuccugcugggcugga

SEQ ID NO: 992385 - RNA, 22 nt, Human
aguuuauguaaaauuaguaaug

SEQ ID NO: 992386 - RNA, 21 nt, Human
ccuucuccacagggucuccgg

SEQ ID NO: 992387 - RNA, 22 nt, Human
agccugcaggaugggcagcacc

SEQ ID NO: 992388 - RNA, 19 nt, Human
uccaccuuucuucauuugg

SEQ ID NO: 992389 - RNA, 22 nt, Human
gccugccuagaauugcagcuuu

SEQ ID NO: 992390 - RNA, 22 nt, Human
auggaaagccaguguuccauca

SEQ ID NO: 992391 - RNA, 22 nt, Human
uuauguauggauggcugaaagu

SEQ ID NO: 992392 - RNA, 22 nt, Human
gauaccagacagggagggagaa

SEQ ID NO: 992393 - RNA, 22 nt, Human
agcuccugaaaauccagacugg

SEQ ID NO: 992394 - RNA, 17 nt, Human
gccaaaggguuccaauc

SEQ ID NO: 992395 - RNA, 22 nt, Human
guacacauugucuguuuacuuc

SEQ ID NO: 992396 - RNA, 22 nt, Human
gggcuccagcccgggaccaggu

SEQ ID NO: 992397 - RNA, 22 nt, Human
aagauauuuuagaacauucacu

SEQ ID NO: 992398 - RNA, 22 nt, Human
cugucuccuccacugcauggga

SEQ ID NO: 992399 - RNA, 20 nt, Human
auguaaaauuauaaggcuga

SEQ ID NO: 992400 - RNA, 22 nt, Human
cuggaaugccucccugucagag

SEQ ID NO: 992401 - RNA, 22 nt, Human
agucccagugacuuggccagaa

SEQ ID NO: 992402 - RNA, 22 nt, Human
ccucagcugcuucccuggagcc

SEQ ID NO: 992403 - RNA, 22 nt, Human
ugagaaagugggugccuagcaa

SEQ ID NO: 992404 - RNA, 22 nt, Human
ugaagccaucccucagauggcc

SEQ ID NO: 992405 - RNA, 22 nt, Human
cuggagcagguuuaggaguccc

SEQ ID NO: 992406 - RNA, 22 nt, Human
augcauaauguauguauugacu

SEQ ID NO: 992407 - RNA, 22 nt, Human
gagugcaucguggccauuuuaa

SEQ ID NO: 992408 - RNA, 22 nt, Human
uagcugccuaugugauaagaga

SEQ ID NO: 992409 - RNA, 22 nt, Human
acagggcaaccucugggagacu

SEQ ID NO: 992410 - RNA, 22 nt, Human
gcucucugucguuaugcuucau

SEQ ID NO: 992411 - RNA, 22 nt, Human
aauucacagaaccauggugcuc

SEQ ID NO: 992412 - RNA, 22 nt, Human
agggcagauggaacuuccccga

SEQ ID NO: 992413 - RNA, 21 nt, Human
cccuugccugcacuccucggc

SEQ ID NO: 992414 - RNA, 22 nt, Human
ggcaguggcuccucucuacucc

SEQ ID NO: 992415 - RNA, 22 nt, Human
ucucaggggauucacuggcacc

SEQ ID NO: 992416 - RNA, 22 nt, Human
gccuggaguucagccaaguccc

SEQ ID NO: 992417 - RNA, 22 nt, Human
cauucacucagcgaugccagua

SEQ ID NO: 992418 - RNA, 22 nt, Human
uggcagagagacucuccuugau

SEQ ID NO: 992419 - RNA, 22 nt, Human
caggcagcaggagcccugcucg

SEQ ID NO: 992420 - RNA, 22 nt, Human
uguguacuugaaagggcagguc

SEQ ID NO: 992421 - RNA, 22 nt, Human
cugcuuugaggggcucuguaua

SEQ ID NO: 992422 - RNA, 22 nt, Human
ucaugacaucuguuuaucucaa

SEQ ID NO: 992423 - RNA, 22 nt, Human
guuugcauuccaauuuagggga

SEQ ID NO: 992424 - RNA, 22 nt, Human
ucagggcaaaagggaaaccauu

SEQ ID NO: 992425 - RNA, 22 nt, Human
guucacaagcuggguuucugca

SEQ ID NO: 992426 - RNA, 18 nt, Human
cuccagggaacucaguca

SEQ ID NO: 992427 - RNA, 22 nt, Human
agggacuggcucucugagcagg

SEQ ID NO: 992428 - RNA, 22 nt, Human
ggcccugggaugcucagcagug

SEQ ID NO: 992429 - RNA, 22 nt, Human
aguggcagagcaggugcuggaa

SEQ ID NO: 992430 - RNA, 23 nt, Human
aucaaacuggugagaaugucagu

SEQ ID NO: 992431 - RNA, 22 nt, Human
aaccaggacaauuugaauagaa

SEQ ID NO: 992432 - RNA, 22 nt, Human
cuggccugugggcugucuccgg

SEQ ID NO: 992433 - RNA, 22 nt, Human
uggcccucagucuugcuccugc

SEQ ID NO: 992434 - RNA, 22 nt, Human
ucccuggccauuccucuaggcc

SEQ ID NO: 992435 - RNA, 22 nt, Human
uugggguguuggauggagcaag

SEQ ID NO: 992436 - RNA, 22 nt, Human
uaugcacacaggcuuaauucau

SEQ ID NO: 992437 - RNA, 22 nt, Human
agggccaggaacaccugaaggg

SEQ ID NO: 992438 - RNA, 22 nt, Human
gccucugcaucaucacuccagc

SEQ ID NO: 992439 - RNA, 21 nt, Human
uucaaaguuugccuaaagauu

SEQ ID NO: 992440 - RNA, 22 nt, Human
gcaggggcuaaggacacagaga

SEQ ID NO: 992441 - RNA, 22 nt, Human
cccuggcagaaugucucugggc

SEQ ID NO: 992442 - RNA, 22 nt, Human
uucuuccucagcagggcugccu

SEQ ID NO: 992443 - RNA, 23 nt, Human
ggcugagacuacaggcgcuugcc

SEQ ID NO: 992444 - RNA, 22 nt, Human
ccagggcauccucacaucgcag

SEQ ID NO: 992445 - RNA, 22 nt, Human
uagagcuggccgggacagcugg

SEQ ID NO: 992446 - RNA, 22 nt, Human
uuuccucuuauacaguguuuau

SEQ ID NO: 992447 - RNA, 22 nt, Human
ugaggccagcuucagcagugga

SEQ ID NO: 992448 - RNA, 22 nt, Human
auaauuaauuucaguaaucucc

SEQ ID NO: 992449 - RNA, 22 nt, Human
agggccugucagcgguguccug

SEQ ID NO: 992450 - RNA, 18 nt, Human
ggcugagguugacuagaa

SEQ ID NO: 992451 - RNA, 22 nt, Human
ggcaggaggugaguggcgggug

SEQ ID NO: 992452 - RNA, 23 nt, Human
gugcaugugucuuuacaguagca

SEQ ID NO: 992453 - RNA, 19 nt, Human
agaggcugucaccuguagc

SEQ ID NO: 992454 - RNA, 20 nt, Human
auuaggauuuuaggucauca

SEQ ID NO: 992455 - RNA, 22 nt, Human
augcugagcagagcugacaugc

SEQ ID NO: 992456 - RNA, 22 nt, Human
aucccuggacggcgccucccca

SEQ ID NO: 992457 - RNA, 22 nt, Human
cuucuuaaugacagauuaaaau

SEQ ID NO: 992458 - RNA, 22 nt, Human
agcucagggcgaucugucucgg

SEQ ID NO: 992459 - RNA, 22 nt, Human
acauucuagaagucuuugcaau

SEQ ID NO: 992460 - RNA, 22 nt, Human
cugccuggaccggcagcccucc

SEQ ID NO: 992461 - RNA, 22 nt, Human
auucuucauguugaagcuguca

SEQ ID NO: 992462 - RNA, 22 nt, Human
gggcucagccccauugaaccag

SEQ ID NO: 992463 - RNA, 19 nt, Human
gggcuucugggaucaagag

SEQ ID NO: 992464 - RNA, 22 nt, Human
ugucuuaauuuggaugauguuu

SEQ ID NO: 992465 - RNA, 22 nt, Human
cugugagcuggguggccaggac

SEQ ID NO: 992466 - RNA, 22 nt, Human
agugucugccagcugccaggug

SEQ ID NO: 992467 - RNA, 22 nt, Human
agagccaggugcugcuguuuga

SEQ ID NO: 992468 - RNA, 22 nt, Human
ggcucuggugcccuggcuccca

SEQ ID NO: 992469 - RNA, 22 nt, Human
gcuggagcuugagaggacaggg

SEQ ID NO: 992470 - RNA, 22 nt, Human
cugggagcccugacuagccugg

SEQ ID NO: 992471 - RNA, 22 nt, Human
uuacaucuaaacugugaacaau

SEQ ID NO: 992472 - RNA, 22 nt, Human
aagugacaaaaggguauccaaa

SEQ ID NO: 992473 - RNA, 22 nt, Human
cuggugggagcagcaggcagcu

SEQ ID NO: 992474 - RNA, 22 nt, Human
gcucaggaucccaggggugugc

SEQ ID NO: 992475 - RNA, 22 nt, Human
gccucccuggcccacagcagcg

SEQ ID NO: 992476 - RNA, 22 nt, Human
ggggaugguggcauuuguaaaa

SEQ ID NO: 992477 - RNA, 22 nt, Human
ggcugcuuuaucggcugcugaa

SEQ ID NO: 992478 - RNA, 20 nt, Human
gccugagcuccgccuccugu

SEQ ID NO: 992479 - RNA, 22 nt, Human
uggacaggaucugagacugaga

SEQ ID NO: 992480 - RNA, 22 nt, Human
ucagagguaagggcugagagga

SEQ ID NO: 992481 - RNA, 22 nt, Human
gcucaggauuucauccaugugu

SEQ ID NO: 992482 - RNA, 22 nt, Human
uuguuacagcagugauuucaga

SEQ ID NO: 992483 - RNA, 22 nt, Human
ggguguguuccuaaggaaacca

SEQ ID NO: 992484 - RNA, 22 nt, Human
ggcucaggccagaccacgacuc

SEQ ID NO: 992485 - RNA, 22 nt, Human
ucccuggaacagagagacaacg

SEQ ID NO: 992486 - RNA, 22 nt, Human
aggucacccguuugacuaucca

SEQ ID NO: 992487 - RNA, 22 nt, Human
caggaacacaaugagucucaaa

SEQ ID NO: 992488 - RNA, 22 nt, Human
ccaaagagcuagaauuauaggc

SEQ ID NO: 992489 - RNA, 21 nt, Human
agcuggcagauauggugucug

SEQ ID NO: 992490 - RNA, 22 nt, Human
cccuggaguccggagcucaccu

SEQ ID NO: 992491 - RNA, 22 nt, Human
ucuggccuuaucuguccaagcc

SEQ ID NO: 992492 - RNA, 22 nt, Human
ugaggccagucucaucacaggc

SEQ ID NO: 992493 - RNA, 22 nt, Human
gagcuguccuaccaggaguccu

SEQ ID NO: 992494 - RNA, 22 nt, Human
gaggucaggcuugcagcagggu

SEQ ID NO: 992495 - RNA, 22 nt, Human
gagguacaugaggauacacagg

SEQ ID NO: 992496 - RNA, 22 nt, Human
ucacugcagacaaccucaguca

SEQ ID NO: 992497 - RNA, 22 nt, Human
uccuugaauugugccacuuacc

SEQ ID NO: 992498 - RNA, 19 nt, Human
cagaacagaggucauggcc

SEQ ID NO: 992499 - RNA, 23 nt, Human
acagaaaguucugcuggacagag

SEQ ID NO: 992500 - RNA, 22 nt, Human
augcacuacuagaugcaaaagu

SEQ ID NO: 992501 - RNA, 22 nt, Human
uaacuccacaccccucuuggug

SEQ ID NO: 992502 - RNA, 22 nt, Human
ccccuuccgucucuugaguguc

SEQ ID NO: 992503 - RNA, 22 nt, Human
gaacaauagugguaacaaagcc

SEQ ID NO: 992504 - RNA, 22 nt, Human
cagggcuccccgcaccgcagcc

SEQ ID NO: 992505 - RNA, 22 nt, Human
gcagacagacugcagugauuuu

SEQ ID NO: 992506 - RNA, 22 nt, Human
ggaggccuugaggccaggagcu

SEQ ID NO: 992507 - RNA, 22 nt, Human
accucugccacuuucuaacucu

SEQ ID NO: 992508 - RNA, 22 nt, Human
acagagguaggacaugagauau

SEQ ID NO: 992509 - RNA, 22 nt, Human
uagagcugggcagugcucugag

SEQ ID NO: 992510 - RNA, 22 nt, Human
acaagagacaagagguucuucu

SEQ ID NO: 992511 - RNA, 22 nt, Human
aaaauauuuuagggccaggaga

SEQ ID NO: 992512 - RNA, 22 nt, Human
cuuccaaacccaggguaugggc

SEQ ID NO: 992513 - RNA, 22 nt, Human
acagaaauauagaagguaggaa

SEQ ID NO: 992514 - RNA, 22 nt, Human
cuuuauauccagauguuuggug

SEQ ID NO: 992515 - RNA, 22 nt, Human
cagagggcucaguccugcugga

SEQ ID NO: 992516 - RNA, 21 nt, Human
gggccacaccuucugcagacc

SEQ ID NO: 992517 - RNA, 22 nt, Human
uagggcagcugcaucaggcacu

SEQ ID NO: 992518 - RNA, 22 nt, Human
uacagaguggugagaucuuuug

SEQ ID NO: 992519 - RNA, 22 nt, Human
cgugucaucugagccuugggcg

SEQ ID NO: 992520 - RNA, 22 nt, Human
guggccuggaaaggcuggucug

SEQ ID NO: 992521 - RNA, 22 nt, Human
ggauaagaaaauuguaauaacu

SEQ ID NO: 992522 - RNA, 19 nt, Human
gcucugagaggggcauggg

SEQ ID NO: 992523 - RNA, 22 nt, Human
uccuggcccgaucccugugaag

SEQ ID NO: 992524 - RNA, 22 nt, Human
gcagcugcuguggcaucaagcu

SEQ ID NO: 992525 - RNA, 22 nt, Human
cuggaggcugaguugggucucc

SEQ ID NO: 992526 - RNA, 22 nt, Human
augcuuuuccuaaaaugaugcc

SEQ ID NO: 992527 - RNA, 22 nt, Human
agaugcugccucuccucacaag

SEQ ID NO: 992528 - RNA, 22 nt, Human
uuacauuagacccacuuucaug

SEQ ID NO: 992529 - RNA, 22 nt, Human
aagcccagaugggagcauuuca

SEQ ID NO: 992530 - RNA, 22 nt, Human
gagggucccgagcccugucaga

SEQ ID NO: 992531 - RNA, 22 nt, Human
aaugcacaugccacauguggua

SEQ ID NO: 992532 - RNA, 22 nt, Human
gcacucuguuucuccugucagc

SEQ ID NO: 992533 - RNA, 22 nt, Human
ucuccuggccgggcuguccccu

SEQ ID NO: 992534 - RNA, 22 nt, Human
ggaugcaggggcagcagagccu

SEQ ID NO: 992535 - RNA, 22 nt, Human
ccuccugggacucauuagcacc

SEQ ID NO: 992536 - RNA, 22 nt, Human
cagaauuuagcacaauguaugg

SEQ ID NO: 992537 - RNA, 22 nt, Human
ggcagggcuugucucugugaug

SEQ ID NO: 992538 - RNA, 22 nt, Human
guccuggcuuaguucgcuguaa

SEQ ID NO: 992539 - RNA, 23 nt, Human
gcagaggagcaagcuggacacca

SEQ ID NO: 992540 - RNA, 22 nt, Human
aaguaugacauuuaagacaauu

SEQ ID NO: 992541 - RNA, 22 nt, Human
uggcucugaucagauguccagu

SEQ ID NO: 992542 - RNA, 22 nt, Human
ucugucaccauucagcuugaau

SEQ ID NO: 992543 - RNA, 22 nt, Human
cagcagagcuuauguuggguca

SEQ ID NO: 992544 - RNA, 22 nt, Human
ucuguggcacgauugcacugca

SEQ ID NO: 992545 - RNA, 17 nt, Human
ggugagaccucccacuc

SEQ ID NO: 992546 - RNA, 19 nt, Human
uguuuuguuaaagcagucc

SEQ ID NO: 992547 - RNA, 22 nt, Human
agugcagugguuaggagccagg

SEQ ID NO: 992548 - RNA, 22 nt, Human
auggaaagggaagcaaggaaca

SEQ ID NO: 992549 - RNA, 22 nt, Human
ucacuuauugcucaucucaugc

SEQ ID NO: 992550 - RNA, 22 nt, Human
gaaaauguuagcuucauaguca

SEQ ID NO: 992551 - RNA, 22 nt, Human
gagagugauucccucccauaga

SEQ ID NO: 992552 - RNA, 21 nt, Human
cagggcacacagaggauggua

SEQ ID NO: 992553 - RNA, 22 nt, Human
gacagaagaggaacuuggacag

SEQ ID NO: 992554 - RNA, 21 nt, Human
guggcccugccgcagugucca

SEQ ID NO: 992555 - RNA, 22 nt, Human
gcuggggucugugaggagggcu

SEQ ID NO: 992556 - RNA, 22 nt, Human
aggaaagcucccaguagggcuc

SEQ ID NO: 992557 - RNA, 19 nt, Human
caguggagauuggaggagg

SEQ ID NO: 992558 - RNA, 22 nt, Human
cagggcuguggcuuugugcugu

SEQ ID NO: 992559 - RNA, 22 nt, Human
ggcucuggagcacagacgucug

SEQ ID NO: 992560 - RNA, 22 nt, Human
accaggaggccuggagcacaaa

SEQ ID NO: 992561 - RNA, 22 nt, Human
cugggcacacagugacucugca

SEQ ID NO: 992562 - RNA, 22 nt, Human
ucaggcagcuccaggaauggua

SEQ ID NO: 992563 - RNA, 22 nt, Human
agcugcagauucuaucuagaag

SEQ ID NO: 992564 - RNA, 22 nt, Human
aguaauaauuuauauuagggag

SEQ ID NO: 992565 - RNA, 22 nt, Human
gccauccucugagcacuaggca

SEQ ID NO: 992566 - RNA, 22 nt, Human
ggaggugguggcagugacaauu

SEQ ID NO: 992567 - RNA, 22 nt, Human
acauguggucaaucuguguagg

SEQ ID NO: 992568 - RNA, 22 nt, Human
gcagaagcccggucagcgcacg

SEQ ID NO: 992569 - RNA, 22 nt, Human
aguuuaugaaacacagauuuga

SEQ ID NO: 992570 - RNA, 22 nt, Human
agaaaucugacugcugugcaca

SEQ ID NO: 992571 - RNA, 23 nt, Human
ucuuuacauacugaugaguucuc

SEQ ID NO: 992572 - RNA, 21 nt, Human
caggaaaagcggaagucuagc

SEQ ID NO: 992573 - RNA, 22 nt, Human
aggguauaaagagcaagcagaa

SEQ ID NO: 992574 - RNA, 22 nt, Human
ugccugccaugcagaaagcuga

SEQ ID NO: 992575 - RNA, 22 nt, Human
uagucccauuuugagguauuug

SEQ ID NO: 992576 - RNA, 22 nt, Human
agggagaaugaccaagguauau

SEQ ID NO: 992577 - RNA, 22 nt, Human
agugcagccgagaucaggugcu

SEQ ID NO: 992578 - RNA, 21 nt, Human
gagcugggcgaggcuccgggg

SEQ ID NO: 992579 - RNA, 22 nt, Human
cagccugcccuggaagcccagc

SEQ ID NO: 992580 - RNA, 22 nt, Human
gggcuacauugugagagaaguu

SEQ ID NO: 992581 - RNA, 22 nt, Human
gagaagguggaccugaaggagc

SEQ ID NO: 992582 - RNA, 20 nt, Human
uauuuagauucaaguaugga

SEQ ID NO: 992583 - RNA, 22 nt, Human
cccuccagccauggacccaggu

SEQ ID NO: 992584 - RNA, 22 nt, Human
cuggccaguugccuuccugggu

SEQ ID NO: 992585 - RNA, 22 nt, Human
gaguggggcguggauccagcgu

SEQ ID NO: 992586 - RNA, 20 nt, Human
cagcugccuggcucugggau

SEQ ID NO: 992587 - RNA, 22 nt, Human
auuuuucucucacacuuaccag

SEQ ID NO: 992588 - RNA, 22 nt, Human
cugcaggggccucgagcacagg

SEQ ID NO: 992589 - RNA, 22 nt, Human
agcaugcgcuugaucagcucca

SEQ ID NO: 992590 - RNA, 22 nt, Human
auggccuggggagcaugggaag

SEQ ID NO: 992591 - RNA, 20 nt, Human
uuuuuccuucucuacaggca

SEQ ID NO: 992592 - RNA, 22 nt, Human
gccccugggagcagagccacca

SEQ ID NO: 992593 - RNA, 22 nt, Human
auuauguagcuaaaaauugugu

SEQ ID NO: 992594 - RNA, 22 nt, Human
cuguguggacugguugaggccc

SEQ ID NO: 992595 - RNA, 22 nt, Human
cugccucucaggucccugagau

SEQ ID NO: 992596 - RNA, 22 nt, Human
gcuggugccuuguuguuguuac

SEQ ID NO: 992597 - RNA, 22 nt, Human
cuggggcuucaaugcuucggug

SEQ ID NO: 992598 - RNA, 22 nt, Human
gaaaugcaaauucucucucgcu

SEQ ID NO: 992599 - RNA, 22 nt, Human
augacagaggagugcaggugau

SEQ ID NO: 992600 - RNA, 22 nt, Human
aaaguguggagauugaacuaaa

SEQ ID NO: 992601 - RNA, 22 nt, Human
cuggccugcugggugagguccu

SEQ ID NO: 992602 - RNA, 18 nt, Human
aaggcuucaaagaguaga

SEQ ID NO: 992603 - RNA, 22 nt, Human
ugcuuccuugagcucuccaauc

SEQ ID NO: 992604 - RNA, 18 nt, Human
caggaugagugaugggga

SEQ ID NO: 992605 - RNA, 22 nt, Human
uuugaacaugcugcaugauaau

SEQ ID NO: 992606 - RNA, 22 nt, Human
cuguacauauacauuuuuuucc

SEQ ID NO: 992607 - RNA, 22 nt, Human
ugcagggcuaagucagagccug

SEQ ID NO: 992608 - RNA, 22 nt, Human
cauugcacagcccuguggugau

SEQ ID NO: 992609 - RNA, 22 nt, Human
ucccagaguuuccuguguccca

SEQ ID NO: 992610 - RNA, 22 nt, Human
ccuguggcugccacuuggguga

SEQ ID NO: 992611 - RNA, 21 nt, Human
aggugccaaggagaagcaggc

SEQ ID NO: 992612 - RNA, 22 nt, Human
ccugggcagggcuggacucuca

SEQ ID NO: 992613 - RNA, 22 nt, Human
cagcugccuucugcgggaaguc

SEQ ID NO: 992614 - RNA, 22 nt, Human
cugggccauggaagucucugcc

SEQ ID NO: 992615 - RNA, 22 nt, Human
gcaccuuucuauauucaguggc

SEQ ID NO: 992616 - RNA, 21 nt, Human
uggccaaaaccauauuauuaa

SEQ ID NO: 992617 - RNA, 22 nt, Human
ccaggggaaacagggagcacuc

SEQ ID NO: 992618 - RNA, 22 nt, Human
agagccagcauuugggcccugc

SEQ ID NO: 992619 - RNA, 22 nt, Human
auccuugaaugacucugcccuc

SEQ ID NO: 992620 - RNA, 20 nt, Human
gugcauuucaccuguacugu

SEQ ID NO: 992621 - RNA, 22 nt, Human
acacuuuguuguggcauauacg

SEQ ID NO: 992622 - RNA, 22 nt, Human
uggcaggguggcaacuuuuggu

SEQ ID NO: 992623 - RNA, 22 nt, Human
uuaggauaugaaacaguauaag

SEQ ID NO: 992624 - RNA, 22 nt, Human
aagcaucucuauguggagagug

SEQ ID NO: 992625 - RNA, 22 nt, Human
cuuucacacacauacauuugga

SEQ ID NO: 992626 - RNA, 22 nt, Human
cagggccagagagggcuggcug

SEQ ID NO: 992627 - RNA, 22 nt, Human
agucccagcucagaaccacuag

SEQ ID NO: 992628 - RNA, 22 nt, Human
uaaauucuacaacuucaaagau

SEQ ID NO: 992629 - RNA, 22 nt, Human
gugccugugccaggggugugcu

SEQ ID NO: 992630 - RNA, 20 nt, Human
agaguaacuggcacauaggg

SEQ ID NO: 992631 - RNA, 22 nt, Human
acauuucucauaggagagccac

SEQ ID NO: 992632 - RNA, 22 nt, Human
uccuucaguuaaagaucucaca

SEQ ID NO: 992633 - RNA, 22 nt, Human
uguggccuccccacuucugggg

SEQ ID NO: 992634 - RNA, 22 nt, Human
ugaacauauucaccucuaaaua

SEQ ID NO: 992635 - RNA, 22 nt, Human
uggaaagacauucagccgcugg

SEQ ID NO: 992636 - RNA, 22 nt, Human
gggcagugguccaggcuacagc

SEQ ID NO: 992637 - RNA, 22 nt, Human
auuauuaggugcucucugacaa

SEQ ID NO: 992638 - RNA, 22 nt, Human
accccagcucugagccacacca

SEQ ID NO: 992639 - RNA, 22 nt, Human
acucuggcccuccugcugccag

SEQ ID NO: 992640 - RNA, 22 nt, Human
cagggcuggcucaugaaaaguu

SEQ ID NO: 992641 - RNA, 22 nt, Human
cuggcaggcagacuucugcaag

SEQ ID NO: 992642 - RNA, 22 nt, Human
gcugaagcugcagcaggaggaa

SEQ ID NO: 992643 - RNA, 22 nt, Human
ccagaggucuccugcacgggau

SEQ ID NO: 992644 - RNA, 22 nt, Human
guuugcauaucugugaaaugga

SEQ ID NO: 992645 - RNA, 22 nt, Human
uccugccucacaguugaaguuu

SEQ ID NO: 992646 - RNA, 22 nt, Human
aaacaccaagagcuagcuauua

SEQ ID NO: 992647 - RNA, 22 nt, Human
guguaaggugaaaucaacaaau

SEQ ID NO: 992648 - RNA, 23 nt, Human
cuucuggcucuauaucagaauuc

SEQ ID NO: 992649 - RNA, 22 nt, Human
ugcuggcuggccuggccuggac

SEQ ID NO: 992650 - RNA, 22 nt, Human
aauuaacaaauguagcugugau

SEQ ID NO: 992651 - RNA, 22 nt, Human
ggugaggcccagugaucugugu

SEQ ID NO: 992652 - RNA, 22 nt, Human
gcuuccugagaaacaaucugau

SEQ ID NO: 992653 - RNA, 22 nt, Human
uaaaaaguagugagaauggcgc

SEQ ID NO: 992654 - RNA, 19 nt, Human
auuuacugccuaaaaucuc

SEQ ID NO: 992655 - RNA, 22 nt, Human
cacauccuucagcugagcccag

SEQ ID NO: 992656 - RNA, 22 nt, Human
ggggacaguuaaagaccaagac

SEQ ID NO: 992657 - RNA, 22 nt, Human
aggagcugcagauucugccuug

SEQ ID NO: 992658 - RNA, 22 nt, Human
uccuugaaaagaaugucuccau

SEQ ID NO: 992659 - RNA, 22 nt, Human
cuuauuagaguuguguucuguu

SEQ ID NO: 992660 - RNA, 22 nt, Human
caaaugugguuucucagcauuc

SEQ ID NO: 992661 - RNA, 22 nt, Human
gcucccucugcucaggcacuug

SEQ ID NO: 992662 - RNA, 22 nt, Human
ucucagagauucagggagaagu

SEQ ID NO: 992663 - RNA, 22 nt, Human
uggcuccuaggauggugccugg

SEQ ID NO: 992664 - RNA, 22 nt, Human
agaaaaggauugauggaucaga

SEQ ID NO: 992665 - RNA, 22 nt, Human
agagggcccauguugggcugcu

SEQ ID NO: 992666 - RNA, 22 nt, Human
ugccucagaguugucccuacca

SEQ ID NO: 992667 - RNA, 22 nt, Human
agagccugaggaugucccagcu

SEQ ID NO: 992668 - RNA, 23 nt, Human
uccuuccuuugagaggcuccauc

SEQ ID NO: 992669 - RNA, 22 nt, Human
ggcaguggguuccccaaggcac

SEQ ID NO: 992670 - RNA, 22 nt, Human
acaaagucacaauaauuaaccu

SEQ ID NO: 992671 - RNA, 22 nt, Human
caaaagauacuugcaucuaacu

SEQ ID NO: 992672 - RNA, 22 nt, Human
cuucccugauaagagccucaga

SEQ ID NO: 992673 - RNA, 22 nt, Human
gcagccacagaggagggaugca

SEQ ID NO: 992674 - RNA, 22 nt, Human
aggcuggcuggcaggggacaca

SEQ ID NO: 992675 - RNA, 22 nt, Human
ucugugcucuucucaguaucac

SEQ ID NO: 992676 - RNA, 22 nt, Human
gcagggcuguucaggagggugg

SEQ ID NO: 992677 - RNA, 22 nt, Human
uggcaccaggcgggguggcugu

SEQ ID NO: 992678 - RNA, 22 nt, Human
aggugccagcucucaggcagga

SEQ ID NO: 992679 - RNA, 22 nt, Human
cccagccuuugcuuccugguuc

SEQ ID NO: 992680 - RNA, 22 nt, Human
gcagggaccugccacugcuguc

SEQ ID NO: 992681 - RNA, 22 nt, Human
ugggcuggagcuuguugcuucc

SEQ ID NO: 992682 - RNA, 22 nt, Human
ccagcuccagguagaugggcag

SEQ ID NO: 992683 - RNA, 20 nt, Human
ccaccuggccaaggcugugc

SEQ ID NO: 992684 - RNA, 22 nt, Human
ugcagcauucuuggccacuacu

SEQ ID NO: 992685 - RNA, 22 nt, Human
uaaauuguuuucuagaaguugu

SEQ ID NO: 992686 - RNA, 22 nt, Human
uaaagguacgaagugagggauu

SEQ ID NO: 992687 - RNA, 22 nt, Human
gagugagggcagcaggggcugc

SEQ ID NO: 992688 - RNA, 22 nt, Human
ccugggugaaaucucuccugca

SEQ ID NO: 992689 - RNA, 22 nt, Human
uggucaaaaacucucaguggac

SEQ ID NO: 992690 - RNA, 22 nt, Human
cagaggaguucaguacacagcc

SEQ ID NO: 992691 - RNA, 22 nt, Human
gcuggccauggccugcgccauc

SEQ ID NO: 992692 - RNA, 21 nt, Human
ggcacugagccagauggacuc

SEQ ID NO: 992693 - RNA, 22 nt, Human
caggggcuagcacuuaauguuu

SEQ ID NO: 992694 - RNA, 22 nt, Human
uagaauaaguugaugauauaug

SEQ ID NO: 992695 - RNA, 22 nt, Human
aauaaacugcucaauugcauca

SEQ ID NO: 992696 - RNA, 22 nt, Human
ugcaaucucggcacuuugggag

SEQ ID NO: 992697 - RNA, 21 nt, Human
acaggcuuuagaaaaugacuc

SEQ ID NO: 992698 - RNA, 22 nt, Human
aauguguauacuggcaauuaag

SEQ ID NO: 992699 - RNA, 21 nt, Human
ggagauggguaucgccugggc

SEQ ID NO: 992700 - RNA, 22 nt, Human
cugcaggcaucuaacugugggc

SEQ ID NO: 992701 - RNA, 22 nt, Human
gagccuucaucgcagccuuguu

SEQ ID NO: 992702 - RNA, 22 nt, Human
cucuggaauuaaggaagccugu

SEQ ID NO: 992703 - RNA, 22 nt, Human
auaaggcagaaaugauucuagu

SEQ ID NO: 992704 - RNA, 20 nt, Human
ccagacagcaccugccuggu

SEQ ID NO: 992705 - RNA, 22 nt, Human
agacagugauguaagcaggagu

SEQ ID NO: 992706 - RNA, 22 nt, Human
aagcaagacagaaguuacugcc

SEQ ID NO: 992707 - RNA, 22 nt, Human
gugucacaugguuuacugcagc

SEQ ID NO: 992708 - RNA, 22 nt, Human
cuuuguauucaguugggcugug

SEQ ID NO: 992709 - RNA, 22 nt, Human
aggcaguguguagcuggaagag

SEQ ID NO: 992710 - RNA, 21 nt, Human
gcugccaccgcgugcuccagg

SEQ ID NO: 992711 - RNA, 22 nt, Human
ugccuucaaucaggauggucuc

SEQ ID NO: 992712 - RNA, 22 nt, Human
uagggcagauucgguggaguuu

SEQ ID NO: 992713 - RNA, 22 nt, Human
gagggugguggcuuaaggugcu

SEQ ID NO: 992714 - RNA, 22 nt, Human
agugaaauuuguuuagauaggu

SEQ ID NO: 992715 - RNA, 22 nt, Human
caggaaugacugcagauggggc

SEQ ID NO: 992716 - RNA, 22 nt, Human
aucagcaagauguaauuucuau

SEQ ID NO: 992717 - RNA, 22 nt, Human
ggcuccuguggcaagacagcuu

SEQ ID NO: 992718 - RNA, 22 nt, Human
caugggagguuggcuuggcaug

SEQ ID NO: 992719 - RNA, 22 nt, Human
cauuucugcagaauugcucuuc

SEQ ID NO: 992720 - RNA, 22 nt, Human
gcacacccucucaccagcacug

SEQ ID NO: 992721 - RNA, 22 nt, Human
gccagcagguugucaaggagcu

SEQ ID NO: 992722 - RNA, 22 nt, Human
gcaaagucucaagacccaagug

SEQ ID NO: 992723 - RNA, 22 nt, Human
gcugucugggaugucacugcug

SEQ ID NO: 992724 - RNA, 22 nt, Human
ugagcuuacgugggaacagacu

SEQ ID NO: 992725 - RNA, 22 nt, Human
cuuuccuagauggccaucuuuc

SEQ ID NO: 992726 - RNA, 22 nt, Human
ccaggccaaauucagucagcag

SEQ ID NO: 992727 - RNA, 22 nt, Human
ucuccuggguaaaaggguugau

SEQ ID NO: 992728 - RNA, 22 nt, Human
cagcaguguggaagcugagggg

SEQ ID NO: 992729 - RNA, 23 nt, Human
ccacagagcugccaauuccugug

SEQ ID NO: 992730 - RNA, 22 nt, Human
gagcaggccagcaauggaaggg

SEQ ID NO: 992731 - RNA, 22 nt, Human
uucaagaucuggguuuucagcu

SEQ ID NO: 992732 - RNA, 22 nt, Human
gaggggcugggguugacuccaa

SEQ ID NO: 992733 - RNA, 22 nt, Human
uuacuuugaugaucaaugagcg

SEQ ID NO: 992734 - RNA, 22 nt, Human
uuagauauguuuuugcuaaugc

SEQ ID NO: 992735 - RNA, 22 nt, Human
ugcugagguuucgucugcuugc

SEQ ID NO: 992736 - RNA, 22 nt, Human
auucugagaaaugcauugucag

SEQ ID NO: 992737 - RNA, 23 nt, Human
cuuuuaacuugaucugagaccag

SEQ ID NO: 992738 - RNA, 22 nt, Human
cagagcagaagcgguccucaca

SEQ ID NO: 992739 - RNA, 22 nt, Human
aauguacaauaagacaaagagg

SEQ ID NO: 992740 - RNA, 22 nt, Human
uauucacaaaaugagguccuca

SEQ ID NO: 992741 - RNA, 22 nt, Human
guacucucuugaaggccuuucu

SEQ ID NO: 992742 - RNA, 22 nt, Human
gagggcagugaauuuugaagcu

SEQ ID NO: 992743 - RNA, 22 nt, Human
auguaucaacaaauuguacagu

SEQ ID NO: 992744 - RNA, 22 nt, Human
cacugaagguaggaccaaggcu

SEQ ID NO: 992745 - RNA, 22 nt, Human
gccugccuuugugaggaagcgg

SEQ ID NO: 992746 - RNA, 22 nt, Human
uagaaaucuacuuagacuuucu

SEQ ID NO: 992747 - RNA, 22 nt, Human
ucccagggcagcuguccagaag

SEQ ID NO: 992748 - RNA, 22 nt, Human
aaucaguuucuuggcaaguuua

SEQ ID NO: 992749 - RNA, 22 nt, Human
aaagccuuggucaucugguucc

SEQ ID NO: 992750 - RNA, 22 nt, Human
ugccucagucuaaagucucuca

SEQ ID NO: 992751 - RNA, 21 nt, Human
agaaauguaucauucuuuucc

SEQ ID NO: 992752 - RNA, 22 nt, Human
aauaauaagauacuaagggagu

SEQ ID NO: 992753 - RNA, 22 nt, Human
agaaaucaauaucuauauguug

SEQ ID NO: 992754 - RNA, 22 nt, Human
gugucauggaaaauugcaaugg

SEQ ID NO: 992755 - RNA, 21 nt, Human
agcagcugggcaacauggagg

SEQ ID NO: 992756 - RNA, 22 nt, Human
cugggcuguucugccccugggu

SEQ ID NO: 992757 - RNA, 22 nt, Human
ggcuucuguccucuggaucugu

SEQ ID NO: 992758 - RNA, 22 nt, Human
uccaagaagucaucuaaacugu

SEQ ID NO: 992759 - RNA, 22 nt, Human
aagagcugauuaagucaugagg

SEQ ID NO: 992760 - RNA, 22 nt, Human
aaacucuggagauguuuaugca

SEQ ID NO: 992761 - RNA, 22 nt, Human
uauuuagaacagacaauagaaa

SEQ ID NO: 992762 - RNA, 22 nt, Human
aucuacagcugucugcacagua

SEQ ID NO: 992763 - RNA, 18 nt, Human
ccuggagcuccacagcaa

SEQ ID NO: 992764 - RNA, 22 nt, Human
cagcccugcacgcugccuccgc

SEQ ID NO: 992765 - RNA, 22 nt, Human
ggcuguccuuggccaaggcacu

SEQ ID NO: 992766 - RNA, 22 nt, Human
gguggccucgguggugcacagg

SEQ ID NO: 992767 - RNA, 22 nt, Human
acuuucuaggucucaguccuuu

SEQ ID NO: 992768 - RNA, 22 nt, Human
auguacauuuguaguaauauca

SEQ ID NO: 992769 - RNA, 22 nt, Human
cucucuucccgugaguguugca

SEQ ID NO: 992770 - RNA, 22 nt, Human
agggacagaugaaugacugagu

SEQ ID NO: 992771 - RNA, 17 nt, Human
aagauuucauuagcuga

SEQ ID NO: 992772 - RNA, 22 nt, Human
cacagaaucugugacuccaaga

SEQ ID NO: 992773 - RNA, 22 nt, Human
augucccagcugagagacaacu

SEQ ID NO: 992774 - RNA, 22 nt, Human
ucucagagggaggauuacugcc

SEQ ID NO: 992775 - RNA, 22 nt, Human
uguuuaaucuauaaaauggaga

SEQ ID NO: 992776 - RNA, 22 nt, Human
uacauuuauaaggcuucucugu

SEQ ID NO: 992777 - RNA, 22 nt, Human
cuucugggcauucagcugcaca

SEQ ID NO: 992778 - RNA, 22 nt, Human
ccuggccuggcacucccucugc

SEQ ID NO: 992779 - RNA, 22 nt, Human
caggcugagcucuggccugggc

SEQ ID NO: 992780 - RNA, 19 nt, Human
ucaggacugacuugaaguc

SEQ ID NO: 992781 - RNA, 22 nt, Human
augcccugaggaaugucacgcu

SEQ ID NO: 992782 - RNA, 22 nt, Human
agaaacugaauuauuucugagg

SEQ ID NO: 992783 - RNA, 22 nt, Human
aggccuguuccaggccccuuuu

SEQ ID NO: 992784 - RNA, 22 nt, Human
cagucacauggaugauggauag

SEQ ID NO: 992785 - RNA, 22 nt, Human
cacacagaugguaagggaggga

SEQ ID NO: 992786 - RNA, 22 nt, Human
ggaggacaggggcugcagcaca

SEQ ID NO: 992787 - RNA, 22 nt, Human
caaaguccauaguuuacaauag

SEQ ID NO: 992788 - RNA, 18 nt, Human
cuuuaugugcagagcuuu

SEQ ID NO: 992789 - RNA, 22 nt, Human
uucuaguguccuuggacuugcu

SEQ ID NO: 992790 - RNA, 22 nt, Human
auagaaaacagauguccuuaaa

SEQ ID NO: 992791 - RNA, 22 nt, Human
ugcagagggacagccacagcuc

SEQ ID NO: 992792 - RNA, 22 nt, Human
gagggaaagguuaauacaugau

SEQ ID NO: 992793 - RNA, 22 nt, Human
cuuauguaaaacggaaagggaa

SEQ ID NO: 992794 - RNA, 22 nt, Human
ucccagaaaaaggaggcuauga

SEQ ID NO: 992795 - RNA, 22 nt, Human
gggcuggcaggaccugggcuga

SEQ ID NO: 992796 - RNA, 21 nt, Human
gcucccugcucagcuccuggg

SEQ ID NO: 992797 - RNA, 22 nt, Human
accauguuggccaagcuggucu

SEQ ID NO: 992798 - RNA, 22 nt, Human
agggcccucuggcaggccaggc

SEQ ID NO: 992799 - RNA, 22 nt, Human
agucagugaaggcauugcucaa

SEQ ID NO: 992800 - RNA, 22 nt, Human
uucuguguggguagcuccuguu

SEQ ID NO: 992801 - RNA, 20 nt, Human
uccagggcaacuagagugug

SEQ ID NO: 992802 - RNA, 21 nt, Human
uggcucugaaagagugcugca

SEQ ID NO: 992803 - RNA, 22 nt, Human
ucaguuuuuguuugccagauag

SEQ ID NO: 992804 - RNA, 22 nt, Human
uaaaauguguuucuguaugguu

SEQ ID NO: 992805 - RNA, 22 nt, Human
ggcucagguuuaaagugcuuua

SEQ ID NO: 992806 - RNA, 22 nt, Human
caaggccugccucuggcagaaa

SEQ ID NO: 992807 - RNA, 22 nt, Human
ccuccugguaauuagcgaaagg

SEQ ID NO: 992808 - RNA, 22 nt, Human
cauuugaugacucaacucauaa

SEQ ID NO: 992809 - RNA, 22 nt, Human
agccuggaauuaaggaaaugca

SEQ ID NO: 992810 - RNA, 22 nt, Human
agcaccugcuaugugucaggga

SEQ ID NO: 992811 - RNA, 22 nt, Human
aucuucaaagcacaucguuugu

SEQ ID NO: 992812 - RNA, 22 nt, Human
gcugccucccccauggcuggaa

SEQ ID NO: 992813 - RNA, 22 nt, Human
gucccagggagguucagggcuu

SEQ ID NO: 992814 - RNA, 22 nt, Human
cagaauuugaaguaauauucca

SEQ ID NO: 992815 - RNA, 22 nt, Human
cugcagccucaaccuccugagc

SEQ ID NO: 992816 - RNA, 22 nt, Human
cucucaggcuugggucguggca

SEQ ID NO: 992817 - RNA, 22 nt, Human
ugcugccuucuaggcgugcccu

SEQ ID NO: 992818 - RNA, 22 nt, Human
ccuuucagaugggcauggaccg

SEQ ID NO: 992819 - RNA, 19 nt, Human
ccuuccuccccagggccau

SEQ ID NO: 992820 - RNA, 22 nt, Human
cccuggagucagguuggccugg

SEQ ID NO: 992821 - RNA, 22 nt, Human
auaauguagguauguguauuua

SEQ ID NO: 992822 - RNA, 22 nt, Human
ugcaccauacccauuccccucu

SEQ ID NO: 992823 - RNA, 22 nt, Human
ucucagagaacaguuggugcuu

SEQ ID NO: 992824 - RNA, 22 nt, Human
ggcuucucucuucacauggcuu

SEQ ID NO: 992825 - RNA, 22 nt, Human
cuaccuuucugacucuugggau

SEQ ID NO: 992826 - RNA, 23 nt, Human
ccaggccucucagagggugugcc

SEQ ID NO: 992827 - RNA, 22 nt, Human
aauggcugggaguguauuuugg

SEQ ID NO: 992828 - RNA, 22 nt, Human
ccagcuccaaguuugggcauca

SEQ ID NO: 992829 - RNA, 17 nt, Human
aagacagaagccaugag

SEQ ID NO: 992830 - RNA, 22 nt, Human
agagcagagggcucugggacaa

SEQ ID NO: 992831 - RNA, 22 nt, Human
gcagcccaauggacugagacag

SEQ ID NO: 992832 - RNA, 22 nt, Human
agccagggagguggagguugca

SEQ ID NO: 992833 - RNA, 22 nt, Human
ugggcugcugagaaugagagag

SEQ ID NO: 992834 - RNA, 22 nt, Human
agucccagccuguaggauuggg

SEQ ID NO: 992835 - RNA, 22 nt, Human
ccucuccuugcacccgucccgc

SEQ ID NO: 992836 - RNA, 22 nt, Human
uggcucuguucgccaucaggag

SEQ ID NO: 992837 - RNA, 22 nt, Human
cuggugcaggaaggagcuggca

SEQ ID NO: 992838 - RNA, 22 nt, Human
uggagcugggaguccugggcug

SEQ ID NO: 992839 - RNA, 22 nt, Human
aaagcaaugaugguagacacgu

SEQ ID NO: 992840 - RNA, 22 nt, Human
agggcugcugaggaagccuugc

SEQ ID NO: 992841 - RNA, 22 nt, Human
gaggccuggcugucagucccca

SEQ ID NO: 992842 - RNA, 22 nt, Human
gucaccaggucugaugcagcca

SEQ ID NO: 992843 - RNA, 22 nt, Human
caggcuugauuauucagacaau

SEQ ID NO: 992844 - RNA, 22 nt, Human
uaaaguucuggugagagguaag

SEQ ID NO: 992845 - RNA, 22 nt, Human
cuagaaauacaggcacgugcca

SEQ ID NO: 992846 - RNA, 22 nt, Human
ugagccugcugucgcuggaccc

SEQ ID NO: 992847 - RNA, 17 nt, Human
ggcagcugccacuuuuu

SEQ ID NO: 992848 - RNA, 22 nt, Human
gaaaucugcggugaggccugag

SEQ ID NO: 992849 - RNA, 22 nt, Human
ugggcagacuaaggucaaagcu

SEQ ID NO: 992850 - RNA, 22 nt, Human
gugcugucguggaacugggcug

SEQ ID NO: 992851 - RNA, 22 nt, Human
uggcucagugaagagauaacuu

SEQ ID NO: 992852 - RNA, 22 nt, Human
ccagcuggucugugcucauguu

SEQ ID NO: 992853 - RNA, 22 nt, Human
accaugggucagccaccucagc

SEQ ID NO: 992854 - RNA, 22 nt, Human
guggccaagagauaaaauugug

SEQ ID NO: 992855 - RNA, 22 nt, Human
cugaagaugucugagaugcuca

SEQ ID NO: 992856 - RNA, 20 nt, Human
uguccuaauagacaagcaga

SEQ ID NO: 992857 - RNA, 22 nt, Human
ggagccagagucugcaguguaa

SEQ ID NO: 992858 - RNA, 22 nt, Human
cuggcucauccagguguugcuc

SEQ ID NO: 992859 - RNA, 22 nt, Human
agaggcuggauugagcauagac

SEQ ID NO: 992860 - RNA, 22 nt, Human
aggagcugagggagcgcccuug

SEQ ID NO: 992861 - RNA, 22 nt, Human
gcugcccauuccacuggauggu

SEQ ID NO: 992862 - RNA, 22 nt, Human
cagaaguaagauuacugugagu

SEQ ID NO: 992863 - RNA, 22 nt, Human
guaggaagcucugaggcuaguu

SEQ ID NO: 992864 - RNA, 22 nt, Human
agcugagcugcagaugacugua

SEQ ID NO: 992865 - RNA, 22 nt, Human
gcugagcugggacaguccuggg

SEQ ID NO: 992866 - RNA, 22 nt, Human
aaaagcuagucaaugauguauu

SEQ ID NO: 992867 - RNA, 22 nt, Human
gagccuggccuccugccucagc

SEQ ID NO: 992868 - RNA, 22 nt, Human
uacagauacagaucuagauaca

SEQ ID NO: 992869 - RNA, 22 nt, Human
cugugugugucugcagcauacu

SEQ ID NO: 992870 - RNA, 21 nt, Human
guuuuaagggagaaaaccuag

SEQ ID NO: 992871 - RNA, 22 nt, Human
uaauuuaauuucaugccagccu

SEQ ID NO: 992872 - RNA, 22 nt, Human
acuggccaugaacuugggaucu

SEQ ID NO: 992873 - RNA, 22 nt, Human
uguccugcaacugaaggagaag

SEQ ID NO: 992874 - RNA, 17 nt, Human
ccugggaggaguuauga

SEQ ID NO: 992875 - RNA, 22 nt, Human
acaggggaauuuacugucauua

SEQ ID NO: 992876 - RNA, 21 nt, Human
gcagccagccgagaccaugcc

SEQ ID NO: 992877 - RNA, 22 nt, Human
gucccagagagcacuaguccau

SEQ ID NO: 992878 - RNA, 22 nt, Human
gcagagcuguuaauggagcuga

SEQ ID NO: 992879 - RNA, 21 nt, Human
ugaagccugaggcauagcccc

SEQ ID NO: 992880 - RNA, 19 nt, Human
ugucacugucauggcccag

SEQ ID NO: 992881 - RNA, 20 nt, Human
uggcuccucuuggcuguggc

SEQ ID NO: 992882 - RNA, 22 nt, Human
ucagagcuuuggagaccaggaa

SEQ ID NO: 992883 - RNA, 22 nt, Human
agagcagauggccagggggccu

SEQ ID NO: 992884 - RNA, 22 nt, Human
aaugaacaggugaaugucagau

SEQ ID NO: 992885 - RNA, 22 nt, Human
agcauugccugccuauugcuaa

SEQ ID NO: 992886 - RNA, 22 nt, Human
aauaaaauggucaguuuucuca

SEQ ID NO: 992887 - RNA, 22 nt, Human
gcucccagcuggagccucaaca

SEQ ID NO: 992888 - RNA, 22 nt, Human
cagagcugcgcuuuuuccuggu

SEQ ID NO: 992889 - RNA, 22 nt, Human
agccaaggcagcuagagcucug

SEQ ID NO: 992890 - RNA, 22 nt, Human
gccuggccgcuccgagcuccgc

SEQ ID NO: 992891 - RNA, 22 nt, Human
caggguggaagcuguagagugg

SEQ ID NO: 992892 - RNA, 17 nt, Human
ucuuuccugccaugcuc

SEQ ID NO: 992893 - RNA, 22 nt, Human
gucccuaguggaaagacaugau

SEQ ID NO: 992894 - RNA, 22 nt, Human
aagaacauguuaaaagauucac

SEQ ID NO: 992895 - RNA, 22 nt, Human
uuuuaucaaucauuaagacauu

SEQ ID NO: 992896 - RNA, 22 nt, Human
gcagagcuucuguccuucagga

SEQ ID NO: 992897 - RNA, 22 nt, Human
ucugucacccgagcaggcgaga

SEQ ID NO: 992898 - RNA, 22 nt, Human
ugggacagugugccuugcuccu

SEQ ID NO: 992899 - RNA, 22 nt, Human
cugcucugcaaggcacagugau

SEQ ID NO: 992900 - RNA, 22 nt, Human
ugaaagcacugauucucaacuc

SEQ ID NO: 992901 - RNA, 22 nt, Human
accagagaaaacacagcaggcu

SEQ ID NO: 992902 - RNA, 22 nt, Human
ucucagagccuaacuaaccuaa

SEQ ID NO: 992903 - RNA, 22 nt, Human
ucagaagagcuggugcugccug

SEQ ID NO: 992904 - RNA, 22 nt, Human
ucuggagauaagacagacagau

SEQ ID NO: 992905 - RNA, 22 nt, Human
uagccaggcgaggucagugucg

SEQ ID NO: 992906 - RNA, 22 nt, Human
auccaaagauggaaagaacuuu

SEQ ID NO: 992907 - RNA, 19 nt, Human
ggaaacaggggccagagga

SEQ ID NO: 992908 - RNA, 18 nt, Human
accuucauuccuuugccu

SEQ ID NO: 992909 - RNA, 22 nt, Human
cagaagaaaguggggagacaag

SEQ ID NO: 992910 - RNA, 22 nt, Human
gcuucccacagcuggacugggg

SEQ ID NO: 992911 - RNA, 22 nt, Human
uuguuuucuccacugcaucuua

SEQ ID NO: 992912 - RNA, 22 nt, Human
cucagagcccaggguacacccg

SEQ ID NO: 992913 - RNA, 22 nt, Human
auuuccuagccucucuugcagu

SEQ ID NO: 992914 - RNA, 22 nt, Human
ccacugucuuuuccaggcugaa

SEQ ID NO: 992915 - RNA, 21 nt, Human
uugcaccaugauaaauucaga

SEQ ID NO: 992916 - RNA, 22 nt, Human
uuugcauuucucguaaggaaac

SEQ ID NO: 992917 - RNA, 22 nt, Human
cuuccugaacaaugccaucaau

SEQ ID NO: 992918 - RNA, 22 nt, Human
caggagcagaggguggucagca

SEQ ID NO: 992919 - RNA, 21 nt, Human
agccuggcccagggggaggcu

SEQ ID NO: 992920 - RNA, 22 nt, Human
guggcagcugguaugcagacag

SEQ ID NO: 992921 - RNA, 22 nt, Human
ugggcagaaaucaguaucagau

SEQ ID NO: 992922 - RNA, 22 nt, Human
cagcugccaagaaucuuuucua

SEQ ID NO: 992923 - RNA, 22 nt, Human
auggcaagcaagcugaagagau

SEQ ID NO: 992924 - RNA, 21 nt, Human
ggccucugucauccugggaag

SEQ ID NO: 992925 - RNA, 22 nt, Human
uccaaacacccuccaugcugca

SEQ ID NO: 992926 - RNA, 22 nt, Human
ugauaauauuuugaaucauaag

SEQ ID NO: 992927 - RNA, 22 nt, Human
cugagccaaaaagcagagcuug

SEQ ID NO: 992928 - RNA, 22 nt, Human
ugucucaguucccuucucugga

SEQ ID NO: 992929 - RNA, 22 nt, Human
agagcuggguggacuuguaguu

SEQ ID NO: 992930 - RNA, 22 nt, Human
uacauauacugagugauuugcu

SEQ ID NO: 992931 - RNA, 22 nt, Human
agcaguggaccucagugcuauu

SEQ ID NO: 992932 - RNA, 22 nt, Human
uggcagcaauuugugauguuga

SEQ ID NO: 992933 - RNA, 22 nt, Human
guaauguguuuugaaaaacagu

SEQ ID NO: 992934 - RNA, 22 nt, Human
ugaaggaagaauaggcaguguu

SEQ ID NO: 992935 - RNA, 22 nt, Human
aguauuuccuggcuuaucugcu

SEQ ID NO: 992936 - RNA, 22 nt, Human
uggcccugacagguccugggca

SEQ ID NO: 992937 - RNA, 22 nt, Human
aguuuuucugcuggucucacua

SEQ ID NO: 992938 - RNA, 22 nt, Human
ccucuuugugccugcaggcugc

SEQ ID NO: 992939 - RNA, 22 nt, Human
aggcugcagugcagguaggauu

SEQ ID NO: 992940 - RNA, 18 nt, Human
acugugguuuauguguag

SEQ ID NO: 992941 - RNA, 22 nt, Human
acugggaggcaucuggagcuga

SEQ ID NO: 992942 - RNA, 22 nt, Human
ggcccagcacagugcuuggggg

SEQ ID NO: 992943 - RNA, 17 nt, Human
uccagagcacagagcuc

SEQ ID NO: 992944 - RNA, 22 nt, Human
uagaggugucacuuugggaagu

SEQ ID NO: 992945 - RNA, 22 nt, Human
uggcuccuucauucuccugcca

SEQ ID NO: 992946 - RNA, 22 nt, Human
augcacuacuuggcuuuacuga

SEQ ID NO: 992947 - RNA, 22 nt, Human
gcaggguauaauacuuagguga

SEQ ID NO: 992948 - RNA, 21 nt, Human
uccaggaguggcugggcaggg

SEQ ID NO: 992949 - RNA, 22 nt, Human
uggcuucugcuuucaguggagg

SEQ ID NO: 992950 - RNA, 22 nt, Human
uccaguucuaggucacucucug

SEQ ID NO: 992951 - RNA, 22 nt, Human
uggcagagaacacggcugaucu

SEQ ID NO: 992952 - RNA, 22 nt, Human
gcagagaaaguuuuguccucag

SEQ ID NO: 992953 - RNA, 22 nt, Human
ucuagaaauuuugccuuguauu

SEQ ID NO: 992954 - RNA, 22 nt, Human
ucacaugcuugaggaaagaaaa

SEQ ID NO: 992955 - RNA, 22 nt, Human
gcugcucucucccuaaguuggg

SEQ ID NO: 992956 - RNA, 22 nt, Human
uauauuaaacccucucuguagg

SEQ ID NO: 992957 - RNA, 22 nt, Human
ucuggcuccacaccucacugca

SEQ ID NO: 992958 - RNA, 22 nt, Human
cagggcccaagacacaaugagg

SEQ ID NO: 992959 - RNA, 22 nt, Human
ucagaggacaagcucccuggug

SEQ ID NO: 992960 - RNA, 22 nt, Human
uguauuuucuucuggaagcuua

SEQ ID NO: 992961 - RNA, 22 nt, Human
cuuuagugguauuuuagcaagu

SEQ ID NO: 992962 - RNA, 22 nt, Human
aaauguauugcauaggauauuu

SEQ ID NO: 992963 - RNA, 22 nt, Human
gcauacagagaggauguggcau

SEQ ID NO: 992964 - RNA, 22 nt, Human
cugggacagcugagacaggaga

SEQ ID NO: 992965 - RNA, 22 nt, Human
ggcaggagcucuccaguuugcc

SEQ ID NO: 992966 - RNA, 22 nt, Human
ggccucugccucaucugggcac

SEQ ID NO: 992967 - RNA, 22 nt, Human
auacaucuugucagauucaugu

SEQ ID NO: 992968 - RNA, 22 nt, Human
ccuggccagaggcgugccugug

SEQ ID NO: 992969 - RNA, 22 nt, Human
aucaguuugauaauaaggcuug

SEQ ID NO: 992970 - RNA, 22 nt, Human
augaccccuaaaauuuacuguc

SEQ ID NO: 992971 - RNA, 20 nt, Human
agaagcugauacugauggaa

SEQ ID NO: 992972 - RNA, 22 nt, Human
caggaacauuuaaccacagggu

SEQ ID NO: 992973 - RNA, 22 nt, Human
gccaggcauucuagaaguagug

SEQ ID NO: 992974 - RNA, 22 nt, Human
acagaguaucuaucaggaguau

SEQ ID NO: 992975 - RNA, 22 nt, Human
acagccagggucucaggaggcg

SEQ ID NO: 992976 - RNA, 22 nt, Human
uggcacuggaaucguagccuug

SEQ ID NO: 992977 - RNA, 22 nt, Human
uggucaguugcaucagagaagu

SEQ ID NO: 992978 - RNA, 22 nt, Human
agccugucugucuccaaagcug

SEQ ID NO: 992979 - RNA, 22 nt, Human
cagugcauagauccugaggccu

SEQ ID NO: 992980 - RNA, 23 nt, Human
auacauacagucuuacugacuuu

SEQ ID NO: 992981 - RNA, 22 nt, Human
uggcagcuccggguaggggcug

SEQ ID NO: 992982 - RNA, 22 nt, Human
uuggcuucucuuaacccuaaag

SEQ ID NO: 992983 - RNA, 22 nt, Human
ggcucuggcguccaauggagcg

SEQ ID NO: 992984 - RNA, 22 nt, Human
acuccuggggcugccaucacag

SEQ ID NO: 992985 - RNA, 22 nt, Human
aggaccaguaugagagcaucug

SEQ ID NO: 992986 - RNA, 22 nt, Human
ccugagagagaagcgaccuggu

SEQ ID NO: 992987 - RNA, 22 nt, Human
uagugaaauuuaugcacagcua

SEQ ID NO: 992988 - RNA, 22 nt, Human
ggcccucccugagccagguggg

SEQ ID NO: 992989 - RNA, 22 nt, Human
guguaucaaagcacagacuuca

SEQ ID NO: 992990 - RNA, 22 nt, Human
gggagcuggagcuggaagacuc

SEQ ID NO: 992991 - RNA, 22 nt, Human
agcagccagagaaugaugcagu

SEQ ID NO: 992992 - RNA, 21 nt, Human
ugcagccauucagcccuaugc

SEQ ID NO: 992993 - RNA, 22 nt, Human
uggagccuguguuucugcccag

SEQ ID NO: 992994 - RNA, 22 nt, Human
ugggcuguggagcaccuuugca

SEQ ID NO: 992995 - RNA, 22 nt, Human
ugguggccaauucacagggcuc

SEQ ID NO: 992996 - RNA, 22 nt, Human
acccugccgugggcugcuugug

SEQ ID NO: 992997 - RNA, 22 nt, Human
uggcccugcugggucagagcug

SEQ ID NO: 992998 - RNA, 22 nt, Human
cuggcaggaagaggaaagguca

SEQ ID NO: 992999 - RNA, 22 nt, Human
caggcugucugaauggaggccc

SEQ ID NO: 993000 - RNA, 22 nt, Human
agcccugggaggccagcuugua

SEQ ID NO: 993001 - RNA, 22 nt, Human
cugggagcugucaggagcgugu

SEQ ID NO: 993002 - RNA, 22 nt, Human
uccugugccuccaccugcuccg

SEQ ID NO: 993003 - RNA, 22 nt, Human
gcugcccuaauaucacauguua

SEQ ID NO: 993004 - RNA, 21 nt, Human
ugcucaugcaaugcaugucca

SEQ ID NO: 993005 - RNA, 22 nt, Human
augggaggaucacuugaggcca

SEQ ID NO: 993006 - RNA, 22 nt, Human
uuggcagcagggaguuggccgc

SEQ ID NO: 993007 - RNA, 22 nt, Human
gaauuacauuguuagccuuccu

SEQ ID NO: 993008 - RNA, 22 nt, Human
cagucccaucucccagguggcu

SEQ ID NO: 993009 - RNA, 22 nt, Human
aguuuuucuccccuggcuucau

SEQ ID NO: 993010 - RNA, 22 nt, Human
augaggauuaacuguugucaua

SEQ ID NO: 993011 - RNA, 22 nt, Human
uggcugcugcuuggucuucuuc

SEQ ID NO: 993012 - RNA, 22 nt, Human
cagcauggagacaaagugggca

SEQ ID NO: 993013 - RNA, 21 nt, Human
ccugggagaucagcugccuuc

SEQ ID NO: 993014 - RNA, 22 nt, Human
cagcuggguuuaguggggugug

SEQ ID NO: 993015 - RNA, 22 nt, Human
ugcagcuguuacggacccuguc

SEQ ID NO: 993016 - RNA, 22 nt, Human
gccaggccugcaagugcuggug

SEQ ID NO: 993017 - RNA, 22 nt, Human
uguguacaggccuugcuagacu

SEQ ID NO: 993018 - RNA, 22 nt, Human
uuuccuuccaaaugcccgggag

SEQ ID NO: 993019 - RNA, 22 nt, Human
uugcaccaaaugaguuaaaauu

SEQ ID NO: 993020 - RNA, 22 nt, Human
gagcacagccaaaguaagaagg

SEQ ID NO: 993021 - RNA, 22 nt, Human
gugccugcugcagagucgcugu

SEQ ID NO: 993022 - RNA, 22 nt, Human
ugggugagugggaaaagcccag

SEQ ID NO: 993023 - RNA, 22 nt, Human
agugccaggagcaaggagcucc

SEQ ID NO: 993024 - RNA, 22 nt, Human
caggccugcaggaaaggcuccc

SEQ ID NO: 993025 - RNA, 22 nt, Human
agagaacacgugcaucugcaau

SEQ ID NO: 993026 - RNA, 22 nt, Human
cugauuccugauucaugcucuu

SEQ ID NO: 993027 - RNA, 22 nt, Human
ggcagcuccaaaaggaaacacu

SEQ ID NO: 993028 - RNA, 22 nt, Human
aagagggaggugcgggugcaga

SEQ ID NO: 993029 - RNA, 22 nt, Human
cagcucugaggaacacuccuuu

SEQ ID NO: 993030 - RNA, 22 nt, Human
aggcacugauucuguuuuccau

SEQ ID NO: 993031 - RNA, 22 nt, Human
gggcugagucugcugccuguca

SEQ ID NO: 993032 - RNA, 22 nt, Human
ggcugccucugaugugcagacg

SEQ ID NO: 993033 - RNA, 22 nt, Human
gucucuaucauagcugaacccu

SEQ ID NO: 993034 - RNA, 20 nt, Human
agggcagcuugaggagccgg

SEQ ID NO: 993035 - RNA, 22 nt, Human
ccagcugacgaugccuggucuc

SEQ ID NO: 993036 - RNA, 20 nt, Human
ugcagagcuggcuggcuccu

SEQ ID NO: 993037 - RNA, 22 nt, Human
ccaggcaggcgauggugcagug

SEQ ID NO: 993038 - RNA, 21 nt, Human
gucagcagauccagcacuugu

SEQ ID NO: 993039 - RNA, 22 nt, Human
uccuggguccauggcagccgaa

SEQ ID NO: 993040 - RNA, 22 nt, Human
ugggcagaggacagggaagauc

SEQ ID NO: 993041 - RNA, 22 nt, Human
acacagggcagagagcuggcuc

SEQ ID NO: 993042 - RNA, 22 nt, Human
aacccagccguguagcugccgc

SEQ ID NO: 993043 - RNA, 22 nt, Human
gcucuguccagcgugcacagaa

SEQ ID NO: 993044 - RNA, 22 nt, Human
aggagcugagucagcccgacag

SEQ ID NO: 993045 - RNA, 22 nt, Human
gaaggaaaucugugauuuaugc

SEQ ID NO: 993046 - RNA, 23 nt, Human
uagggcagcugggagggacaugc

SEQ ID NO: 993047 - RNA, 22 nt, Human
uaagaacagugucugucucaca

SEQ ID NO: 993048 - RNA, 22 nt, Human
gugauuucuaaucaucugaaug

SEQ ID NO: 993049 - RNA, 22 nt, Human
ucccagcgcggggggaggaucc

SEQ ID NO: 993050 - RNA, 20 nt, Human
acuccugguaacuuuuguga

SEQ ID NO: 993051 - RNA, 22 nt, Human
uggcucuguugagguauggauu

SEQ ID NO: 993052 - RNA, 20 nt, Human
ucagaggcugccagcugggg

SEQ ID NO: 993053 - RNA, 22 nt, Human
ucuggcucuccagugcucuuag

SEQ ID NO: 993054 - RNA, 22 nt, Human
ucaaagucauggcaggcucaga

SEQ ID NO: 993055 - RNA, 21 nt, Human
ccaggcuccugaggcugguca

SEQ ID NO: 993056 - RNA, 22 nt, Human
cagcugccacaggacuuucuga

SEQ ID NO: 993057 - RNA, 22 nt, Human
uuguuucaugaguguaaaggga

SEQ ID NO: 993058 - RNA, 22 nt, Human
ugcugccuuugggaccuggccu

SEQ ID NO: 993059 - RNA, 22 nt, Human
caguuuaaaugagugacugcag

SEQ ID NO: 993060 - RNA, 22 nt, Human
uuugcauuucuaaugagcuccg

SEQ ID NO: 993061 - RNA, 22 nt, Human
agaauucugacaauagaauugg

SEQ ID NO: 993062 - RNA, 21 nt, Human
ggucagggggugccuccaggu

SEQ ID NO: 993063 - RNA, 22 nt, Human
gucccugggaugcccuucuggg

SEQ ID NO: 993064 - RNA, 22 nt, Human
uaaguucaaugaacucaguucu

SEQ ID NO: 993065 - RNA, 22 nt, Human
ucaguuuuuacggucacaggga

SEQ ID NO: 993066 - RNA, 22 nt, Human
acuuugaaacuaaaauucauua

SEQ ID NO: 993067 - RNA, 22 nt, Human
ugggccuggaguuuguccagag

SEQ ID NO: 993068 - RNA, 22 nt, Human
uaguuuuuucaacaaauggugc

SEQ ID NO: 993069 - RNA, 22 nt, Human
ccuuaaaagaacuaucucuucu

SEQ ID NO: 993070 - RNA, 22 nt, Human
auuuguagugaagugaaaauaa

SEQ ID NO: 993071 - RNA, 22 nt, Human
uccagggacagcgcuggagcua

SEQ ID NO: 993072 - RNA, 22 nt, Human
gccagccugugcuuggccaggc

SEQ ID NO: 993073 - RNA, 22 nt, Human
uagacagauuucuuguuagaca

SEQ ID NO: 993074 - RNA, 20 nt, Human
uauuaggaaggaggaaggaa

SEQ ID NO: 993075 - RNA, 22 nt, Human
cugccuggggaaugugaggauu

SEQ ID NO: 993076 - RNA, 22 nt, Human
uguuaucugagcaacgucgacg

SEQ ID NO: 993077 - RNA, 22 nt, Human
guaaaguucuauuugaauuuag

SEQ ID NO: 993078 - RNA, 23 nt, Human
aaccagauaaauggcuccagggc

SEQ ID NO: 993079 - RNA, 22 nt, Human
aauuaacagagggcuuauuacu

SEQ ID NO: 993080 - RNA, 22 nt, Human
caggaggaacaagagguucugg

SEQ ID NO: 993081 - RNA, 22 nt, Human
aagagcuguaugccauaugauu

SEQ ID NO: 993082 - RNA, 22 nt, Human
ccagcucuuggugcacuuacau

SEQ ID NO: 993083 - RNA, 22 nt, Human
uguguccuucugggagucccag

SEQ ID NO: 993084 - RNA, 17 nt, Human
gguggccugcaguggcu

SEQ ID NO: 993085 - RNA, 22 nt, Human
cugaagcaaaugaaacagcucu

SEQ ID NO: 993086 - RNA, 22 nt, Human
cagcuuggaggaggaucuaaga

SEQ ID NO: 993087 - RNA, 22 nt, Human
cagguggguguaugaaugcaaa

SEQ ID NO: 993088 - RNA, 22 nt, Human
ccugaggacacacgcugcagga

SEQ ID NO: 993089 - RNA, 22 nt, Human
acaaaguaggucaucaaagcuc

SEQ ID NO: 993090 - RNA, 22 nt, Human
ucuguaguagguuguaguucuu

SEQ ID NO: 993091 - RNA, 22 nt, Human
cuggcacaaugucacuuuugcu

SEQ ID NO: 993092 - RNA, 19 nt, Human
agcagccaucgaccaugga

SEQ ID NO: 993093 - RNA, 22 nt, Human
uacuguauuugauaagugaagu

SEQ ID NO: 993094 - RNA, 22 nt, Human
gacuuucucuccucccaggugu

SEQ ID NO: 993095 - RNA, 22 nt, Human
agacaggcagaggcugcagagg

SEQ ID NO: 993096 - RNA, 22 nt, Human
uaaguuaucggaguguguuuca

SEQ ID NO: 993097 - RNA, 22 nt, Human
aaggcugagacagcacaggucc

SEQ ID NO: 993098 - RNA, 20 nt, Human
cuguggcucaugcaucugcc

SEQ ID NO: 993099 - RNA, 22 nt, Human
gcagggcuguggacacuuuggu

SEQ ID NO: 993100 - RNA, 22 nt, Human
ugucaucuucaucauaaguaaa

SEQ ID NO: 993101 - RNA, 22 nt, Human
ucagaguguggugagaugugca

SEQ ID NO: 993102 - RNA, 21 nt, Human
ucucugggaggacuugugaga

SEQ ID NO: 993103 - RNA, 22 nt, Human
uuccuguauucuaaagggaaag

SEQ ID NO: 993104 - RNA, 23 nt, Human
uuucaacaaugcuuagagaaaac

SEQ ID NO: 993105 - RNA, 22 nt, Human
aucuaagauguauugagcacuu

SEQ ID NO: 993106 - RNA, 22 nt, Human
aaagaacaaauuagcuguuuua

SEQ ID NO: 993107 - RNA, 23 nt, Human
gcugucugucaucucugcgggag

SEQ ID NO: 993108 - RNA, 22 nt, Human
aaucaguuguucacucugaaaa

SEQ ID NO: 993109 - RNA, 22 nt, Human
gcugucugagaacaugguggaa

SEQ ID NO: 993110 - RNA, 22 nt, Human
ggcucaggacugcagcguagag

SEQ ID NO: 993111 - RNA, 22 nt, Human
cuucaagauauuucuagaauca

SEQ ID NO: 993112 - RNA, 22 nt, Human
cuuauguacacacauauauugu

SEQ ID NO: 993113 - RNA, 22 nt, Human
ugaucagucccaugaucuucca

SEQ ID NO: 993114 - RNA, 22 nt, Human
uccaagggcaugcugaaauaag

SEQ ID NO: 993115 - RNA, 22 nt, Human
cacucugccugauguuacaugg

SEQ ID NO: 993116 - RNA, 22 nt, Human
aacaugaaguuuucuauaguga

SEQ ID NO: 993117 - RNA, 22 nt, Human
auaaaacuuauuagaauugugu

SEQ ID NO: 993118 - RNA, 22 nt, Human
ugcagaagaccuuccagggcug

SEQ ID NO: 993119 - RNA, 22 nt, Human
aagauucucagagugaaagaau

SEQ ID NO: 993120 - RNA, 22 nt, Human
augggcagcagcugccauucau

SEQ ID NO: 993121 - RNA, 23 nt, Human
uuauugaggguguagauuggugu

SEQ ID NO: 993122 - RNA, 22 nt, Human
agcucccaauugacuugaacua

SEQ ID NO: 993123 - RNA, 22 nt, Human
acauauuuccaugcagcauguc

SEQ ID NO: 993124 - RNA, 22 nt, Human
agggcagagggugccucaccug

SEQ ID NO: 993125 - RNA, 22 nt, Human
ggcugucugugguggagcguug

SEQ ID NO: 993126 - RNA, 22 nt, Human
uccugagauguggagcuccaug

SEQ ID NO: 993127 - RNA, 22 nt, Human
acaggccugagauuuugcauuu

SEQ ID NO: 993128 - RNA, 22 nt, Human
uuauuauugugaccugagaaug

SEQ ID NO: 993129 - RNA, 22 nt, Human
ugaaagguuaaaaguaguauug

SEQ ID NO: 993130 - RNA, 22 nt, Human
ggcugccugccuccaagccggg

SEQ ID NO: 993131 - RNA, 22 nt, Human
acccaggccugagagacaggag

SEQ ID NO: 993132 - RNA, 22 nt, Human
cacaggaggaggugcccgggcc

SEQ ID NO: 993133 - RNA, 22 nt, Human
aaaugcacagaggccagagagg

SEQ ID NO: 993134 - RNA, 22 nt, Human
augaugguggguaauguguaaa

SEQ ID NO: 993135 - RNA, 22 nt, Human
caguuucuucaucaguuaagca

SEQ ID NO: 993136 - RNA, 22 nt, Human
uggucaaaaaggccuagacaca

SEQ ID NO: 993137 - RNA, 18 nt, Human
uccucucuuuccccaggg

SEQ ID NO: 993138 - RNA, 22 nt, Human
augcaaaugaacauguugcuag

SEQ ID NO: 993139 - RNA, 22 nt, Human
gagguggccucaagcagucuuc

SEQ ID NO: 993140 - RNA, 22 nt, Human
uagaaacugauagucuugugcu

SEQ ID NO: 993141 - RNA, 23 nt, Human
ugccagaggcagucacaguggug

SEQ ID NO: 993142 - RNA, 22 nt, Human
cugagaggcacaaggcauuucg

SEQ ID NO: 993143 - RNA, 22 nt, Human
caguugcuacaguucaagugug

SEQ ID NO: 993144 - RNA, 22 nt, Human
uuucacaacugcuuauuugaga

SEQ ID NO: 993145 - RNA, 22 nt, Human
agaggcugcacuugcucaugau

SEQ ID NO: 993146 - RNA, 22 nt, Human
cccagcauccucagggagcggg

SEQ ID NO: 993147 - RNA, 22 nt, Human
aggccugagccccagguuuguu

SEQ ID NO: 993148 - RNA, 22 nt, Human
ggccucugguucguggugaccu

SEQ ID NO: 993149 - RNA, 19 nt, Human
uggcagggagugauauuag

SEQ ID NO: 993150 - RNA, 22 nt, Human
agcugggagcagagccacagcc

SEQ ID NO: 993151 - RNA, 22 nt, Human
uccauugucuuugguccuagcc

SEQ ID NO: 993152 - RNA, 22 nt, Human
agugcauuauauguuucaaugg

SEQ ID NO: 993153 - RNA, 19 nt, Human
uccauaagcuuguguucau

SEQ ID NO: 993154 - RNA, 22 nt, Human
aaguguguauuguuuaugcugc

SEQ ID NO: 993155 - RNA, 21 nt, Human
gcagccagacgggauucaguu

SEQ ID NO: 993156 - RNA, 22 nt, Human
ccugggagggcaagugcugaug

SEQ ID NO: 993157 - RNA, 22 nt, Human
gucuggagccacccuaagcauu

SEQ ID NO: 993158 - RNA, 22 nt, Human
uucagaaagugaaucuuguuau

SEQ ID NO: 993159 - RNA, 22 nt, Human
cagccaucaguaaagacagcuu

SEQ ID NO: 993160 - RNA, 20 nt, Human
ugcuguaagauuagagagcu

SEQ ID NO: 993161 - RNA, 22 nt, Human
auacagcagugaauaagauaaa

SEQ ID NO: 993162 - RNA, 22 nt, Human
gcucugucaacagcuagcugug

SEQ ID NO: 993163 - RNA, 22 nt, Human
acaaacagcuaacauauguuaa

SEQ ID NO: 993164 - RNA, 22 nt, Human
uggacagguugaguaggaggag

SEQ ID NO: 993165 - RNA, 22 nt, Human
ucugccuuccccauaaucugau

SEQ ID NO: 993166 - RNA, 22 nt, Human
cagcuuccaucuccacugcccu

SEQ ID NO: 993167 - RNA, 22 nt, Human
cuuuuauuuugaauuaagggcu

SEQ ID NO: 993168 - RNA, 22 nt, Human
uaaagguagcaugaaacugcaa

SEQ ID NO: 993169 - RNA, 22 nt, Human
ggugcagcugcagccugggagc

SEQ ID NO: 993170 - RNA, 22 nt, Human
gaagaacacuucaugauucauu

SEQ ID NO: 993171 - RNA, 22 nt, Human
uucacaggcuuggagguggggg

SEQ ID NO: 993172 - RNA, 22 nt, Human
gccugucugcgucacgcuuauu

SEQ ID NO: 993173 - RNA, 22 nt, Human
uccugagcugccgcaucagcag

SEQ ID NO: 993174 - RNA, 22 nt, Human
cuuguauuccccuaucucuaaa

SEQ ID NO: 993175 - RNA, 22 nt, Human
cuugaaagcuuugcgucuucua

SEQ ID NO: 993176 - RNA, 22 nt, Human
aguuuaaaucauguuuuguaac

SEQ ID NO: 993177 - RNA, 22 nt, Human
aucaguuuuguucacuacuaua

SEQ ID NO: 993178 - RNA, 22 nt, Human
ccugucagcugauggcuaugua

SEQ ID NO: 993179 - RNA, 22 nt, Human
agccaugugucuuuauucuguu

SEQ ID NO: 993180 - RNA, 20 nt, Human
agccugccagcuggcccaga

SEQ ID NO: 993181 - RNA, 22 nt, Human
ggagcugcuuugaucugaagaa

SEQ ID NO: 993182 - RNA, 22 nt, Human
auguuuuauauuuugcagcagu

SEQ ID NO: 993183 - RNA, 22 nt, Human
ccagggcagggaccacgugucu

SEQ ID NO: 993184 - RNA, 22 nt, Human
ccuccugggcuccugucugcac

SEQ ID NO: 993185 - RNA, 22 nt, Human
uauauuaacuugugauccugga

SEQ ID NO: 993186 - RNA, 22 nt, Human
uggccucuuaggacauccucua

SEQ ID NO: 993187 - RNA, 22 nt, Human
agugugggugagggaggcccuc

SEQ ID NO: 993188 - RNA, 19 nt, Human
cuggggcuuugguacugcc

SEQ ID NO: 993189 - RNA, 22 nt, Human
uucaagauccagcacaacagug

SEQ ID NO: 993190 - RNA, 22 nt, Human
uccaagggaauuuaaaguugcu

SEQ ID NO: 993191 - RNA, 22 nt, Human
ccucucuguaagggucccuccc

SEQ ID NO: 993192 - RNA, 22 nt, Human
ggccuugggcuggcugcaguau

SEQ ID NO: 993193 - RNA, 22 nt, Human
cagccugcagggcugccuguug

SEQ ID NO: 993194 - RNA, 22 nt, Human
acucugcuaaauguaaguuggu

SEQ ID NO: 993195 - RNA, 22 nt, Human
auacaagacucagcacagacgg

SEQ ID NO: 993196 - RNA, 22 nt, Human
gagggcugauaaaugcgcaugg

SEQ ID NO: 993197 - RNA, 22 nt, Human
cagauggccagaggcagcugca

SEQ ID NO: 993198 - RNA, 18 nt, Human
gguggcucagucaugggg

SEQ ID NO: 993199 - RNA, 22 nt, Human
acccaggguagagugcaguggc

SEQ ID NO: 993200 - RNA, 23 nt, Human
acacaaggguaacugccagccau

SEQ ID NO: 993201 - RNA, 22 nt, Human
caagggaccugagauggucucu

SEQ ID NO: 993202 - RNA, 22 nt, Human
agaagccacuggagguugagau

SEQ ID NO: 993203 - RNA, 22 nt, Human
aagccucaccuuuuagaagcua

SEQ ID NO: 993204 - RNA, 20 nt, Human
cagcucugggaaagaggcca

SEQ ID NO: 993205 - RNA, 22 nt, Human
caggauggucagaugcauuguc

SEQ ID NO: 993206 - RNA, 22 nt, Human
ucaaaugcaggucuggucuugg

SEQ ID NO: 993207 - RNA, 21 nt, Human
gggaaauuaggauugcucauc

SEQ ID NO: 993208 - RNA, 22 nt, Human
ccugggaggcuguuuccagccu

SEQ ID NO: 993209 - RNA, 22 nt, Human
agcaccugcacaguggaggaaa

SEQ ID NO: 993210 - RNA, 22 nt, Human
gcugucagcgcccaaggagcuc

SEQ ID NO: 993211 - RNA, 22 nt, Human
guguccagagaaacucacagcu

SEQ ID NO: 993212 - RNA, 22 nt, Human
uuacaugguuguuggaaaugcu

SEQ ID NO: 993213 - RNA, 20 nt, Human
uagaaaucuuauaaaagacu

SEQ ID NO: 993214 - RNA, 22 nt, Human
acuucuggauagagucagcuuu

SEQ ID NO: 993215 - RNA, 22 nt, Human
cuggagcccugaaugggcagga

SEQ ID NO: 993216 - RNA, 22 nt, Human
ugagcaguaggucugaauagug

SEQ ID NO: 993217 - RNA, 22 nt, Human
aaacacaucauucaugucguca

SEQ ID NO: 993218 - RNA, 22 nt, Human
gccaugaggaacuguaagacaa

SEQ ID NO: 993219 - RNA, 22 nt, Human
ccuggagggcgccgcacagucc

SEQ ID NO: 993220 - RNA, 22 nt, Human
uggagcagagaugggagcccaa

SEQ ID NO: 993221 - RNA, 22 nt, Human
ucucugcugagaagggcuggca

SEQ ID NO: 993222 - RNA, 17 nt, Human
auuucacuuagcaugag

SEQ ID NO: 993223 - RNA, 22 nt, Human
uaacagaauuugcuaaacuccg

SEQ ID NO: 993224 - RNA, 22 nt, Human
ucagagugaggcccagcaaucu

SEQ ID NO: 993225 - RNA, 21 nt, Human
aggcccagcuuuccucuugcu

SEQ ID NO: 993226 - RNA, 22 nt, Human
cacuucaauuaacuucagcauu

SEQ ID NO: 993227 - RNA, 22 nt, Human
cccuccagcucaaagcaaccgg

SEQ ID NO: 993228 - RNA, 22 nt, Human
aaguuacaggagaaagagauca

SEQ ID NO: 993229 - RNA, 22 nt, Human
ccugcagacacuuguccagcaa

SEQ ID NO: 993230 - RNA, 22 nt, Human
ucccagagcugauaagccuuua

SEQ ID NO: 993231 - RNA, 22 nt, Human
ccagcugagaaguguaaaguga

SEQ ID NO: 993232 - RNA, 22 nt, Human
ccacagccauuccagggaggcu

SEQ ID NO: 993233 - RNA, 22 nt, Human
acagcagcuaaccccugggcca

SEQ ID NO: 993234 - RNA, 22 nt, Human
acugucugcccugagaugccag

SEQ ID NO: 993235 - RNA, 22 nt, Human
cacagaguggaggcuuggccug

SEQ ID NO: 993236 - RNA, 21 nt, Human
ugguggagugugcugagcaug

SEQ ID NO: 993237 - RNA, 21 nt, Human
cagaggcugagagggcaaucu

SEQ ID NO: 993238 - RNA, 22 nt, Human
gcuggccacauugugccguccu

SEQ ID NO: 993239 - RNA, 22 nt, Human
ggcuucugccacgagagggaag

SEQ ID NO: 993240 - RNA, 22 nt, Human
uaaaugugggggccacgggcuu

SEQ ID NO: 993241 - RNA, 22 nt, Human
ucccagggugcgccugcccucg

SEQ ID NO: 993242 - RNA, 22 nt, Human
cuuucacagcugugcuuaugau

SEQ ID NO: 993243 - RNA, 22 nt, Human
ggccucuguuuggagccaggau

SEQ ID NO: 993244 - RNA, 22 nt, Human
uggccuggugucugcgaggccu

SEQ ID NO: 993245 - RNA, 22 nt, Human
agaaaucauucccaaacccaua

SEQ ID NO: 993246 - RNA, 22 nt, Human
gcaggagcuggaaagugauguu

SEQ ID NO: 993247 - RNA, 22 nt, Human
cugggcuucucccccuggcaga

SEQ ID NO: 993248 - RNA, 22 nt, Human
gcuggcuguguuucaucucuga

SEQ ID NO: 993249 - RNA, 22 nt, Human
aggucaaguuuagauagaguua

SEQ ID NO: 993250 - RNA, 22 nt, Human
acugugugggccgcucacuggg

SEQ ID NO: 993251 - RNA, 22 nt, Human
ucugggugaugaaaugcacugu

SEQ ID NO: 993252 - RNA, 22 nt, Human
agguggguaucaugagagauua

SEQ ID NO: 993253 - RNA, 22 nt, Human
acucucagaggguggcagcaau

SEQ ID NO: 993254 - RNA, 22 nt, Human
aauggacaggagagcauaguca

SEQ ID NO: 993255 - RNA, 22 nt, Human
ugagaauuacaaaugagucaca

SEQ ID NO: 993256 - RNA, 22 nt, Human
ucugucacugagcucaggauuc

SEQ ID NO: 993257 - RNA, 22 nt, Human
gccugagauucccggagccgug

SEQ ID NO: 993258 - RNA, 22 nt, Human
cuggagccggaccagggacggu

SEQ ID NO: 993259 - RNA, 22 nt, Human
gaaggcaggcuucugauuaggu

SEQ ID NO: 993260 - RNA, 22 nt, Human
aaugauggucauggcaacuuuu

SEQ ID NO: 993261 - RNA, 22 nt, Human
ucuccuuuaagauuuccucagg

SEQ ID NO: 993262 - RNA, 22 nt, Human
ucacucugaaugguacugagga

SEQ ID NO: 993263 - RNA, 22 nt, Human
ugcuggcuguauaugugagagu

SEQ ID NO: 993264 - RNA, 22 nt, Human
gcagagacuccacugucuugug

SEQ ID NO: 993265 - RNA, 22 nt, Human
aagccuugcagcauuaggcucu

SEQ ID NO: 993266 - RNA, 22 nt, Human
uaccuauagguacaauuacaag

SEQ ID NO: 993267 - RNA, 22 nt, Human
uuuauuagauuaucaaagaggu

SEQ ID NO: 993268 - RNA, 22 nt, Human
ugaugggacugccagcugcuga

SEQ ID NO: 993269 - RNA, 22 nt, Human
gccucugcaauuacauugugcc

SEQ ID NO: 993270 - RNA, 22 nt, Human
ccuggccacagggcucugcauu

SEQ ID NO: 993271 - RNA, 22 nt, Human
auguccuucuccucuuaccugc

SEQ ID NO: 993272 - RNA, 22 nt, Human
uacuuuaaaaacugauaauuca

SEQ ID NO: 993273 - RNA, 22 nt, Human
gcucaggaaauaguuuaguguu

SEQ ID NO: 993274 - RNA, 22 nt, Human
cagagccagcaguggggacagg

SEQ ID NO: 993275 - RNA, 22 nt, Human
ucacauuuucuacuacuguacg

SEQ ID NO: 993276 - RNA, 22 nt, Human
gucugucaucugagauggagug

SEQ ID NO: 993277 - RNA, 22 nt, Human
aaccaggacaauuuugaaagua

SEQ ID NO: 993278 - RNA, 22 nt, Human
aauaauuuuagcucagaguugu

SEQ ID NO: 993279 - RNA, 22 nt, Human
aggcccuggguuagggcccacu

SEQ ID NO: 993280 - RNA, 22 nt, Human
aaagaauacccugggucauaaa

SEQ ID NO: 993281 - RNA, 22 nt, Human
uauagcaagcaggacagucuca

SEQ ID NO: 993282 - RNA, 22 nt, Human
aucuggcugcugugcuuaagcu

SEQ ID NO: 993283 - RNA, 22 nt, Human
gccuggagcagacgugucccgg

SEQ ID NO: 993284 - RNA, 22 nt, Human
gauuucaaguaucuugggcgag

SEQ ID NO: 993285 - RNA, 22 nt, Human
aaggcuaugaucuuuuucauga

SEQ ID NO: 993286 - RNA, 22 nt, Human
cuuacauugugugcaugagggg

SEQ ID NO: 993287 - RNA, 22 nt, Human
gcccugcugucuucagaguaua

SEQ ID NO: 993288 - RNA, 22 nt, Human
guggauggauuuugaggaaugg

SEQ ID NO: 993289 - RNA, 22 nt, Human
acaggcagcgucauugcugcuc

SEQ ID NO: 993290 - RNA, 22 nt, Human
cuggcuuccucaggagcagugg

SEQ ID NO: 993291 - RNA, 19 nt, Human
uccuuugaauaucaguuga

SEQ ID NO: 993292 - RNA, 22 nt, Human
agccuggaguucccaggagaag

SEQ ID NO: 993293 - RNA, 22 nt, Human
ggucccagcuggucacugucag

SEQ ID NO: 993294 - RNA, 22 nt, Human
ugcagcaggcacaggacggaag

SEQ ID NO: 993295 - RNA, 22 nt, Human
gguggcagucuuaagagaucuu

SEQ ID NO: 993296 - RNA, 22 nt, Human
agcagagaagacacaggcuuca

SEQ ID NO: 993297 - RNA, 22 nt, Human
cagagccaggucuaggagucuc

SEQ ID NO: 993298 - RNA, 22 nt, Human
ucuuuccucugagcuccuguag

SEQ ID NO: 993299 - RNA, 22 nt, Human
ggcaggcaggagcgugcuuggg

SEQ ID NO: 993300 - RNA, 22 nt, Human
cuugccuucuuuuccuauagaa

SEQ ID NO: 993301 - RNA, 22 nt, Human
ucagaggguggcugggagcauc

SEQ ID NO: 993302 - RNA, 22 nt, Human
guccagggaaauagcgacaggg

SEQ ID NO: 993303 - RNA, 22 nt, Human
agguggggaggagugucucuuu

SEQ ID NO: 993304 - RNA, 22 nt, Human
cccugcagaaccacagacaaac

SEQ ID NO: 993305 - RNA, 21 nt, Human
uguucacauggagcagaaugu

SEQ ID NO: 993306 - RNA, 22 nt, Human
acugcaucugaaacauggguca

SEQ ID NO: 993307 - RNA, 22 nt, Human
ggcacugauaauguccucucuc

SEQ ID NO: 993308 - RNA, 22 nt, Human
cuuggggcugucacucuggcau

SEQ ID NO: 993309 - RNA, 22 nt, Human
gagauuucuuuugaugccuguc

SEQ ID NO: 993310 - RNA, 22 nt, Human
uauugacagagggucagaagag

SEQ ID NO: 993311 - RNA, 22 nt, Human
auacagaaaaugaugcagaguu

SEQ ID NO: 993312 - RNA, 19 nt, Human
aagaagcaauaagcuguga

SEQ ID NO: 993313 - RNA, 20 nt, Human
ucaggcaguggggaaaggca

SEQ ID NO: 993314 - RNA, 22 nt, Human
agccuucauaaucuugggcuuu

SEQ ID NO: 993315 - RNA, 22 nt, Human
agagauguucauucagcauguu

SEQ ID NO: 993316 - RNA, 22 nt, Human
ugcccagcacugugccagucac

SEQ ID NO: 993317 - RNA, 22 nt, Human
cccagccugugacagccguccu

SEQ ID NO: 993318 - RNA, 22 nt, Human
gagcugggcacacgccacuuga

SEQ ID NO: 993319 - RNA, 22 nt, Human
ugucucaguauacgaaacacuu

SEQ ID NO: 993320 - RNA, 22 nt, Human
guggccuggcgagcuggcgcgg

SEQ ID NO: 993321 - RNA, 20 nt, Human
acuggagccaucucagccua

SEQ ID NO: 993322 - RNA, 22 nt, Human
ucccagaguucaaugggaaggu

SEQ ID NO: 993323 - RNA, 22 nt, Human
gcagugaaucuggcaagaauuu

SEQ ID NO: 993324 - RNA, 22 nt, Human
uucugucacuuaggaggucaua

SEQ ID NO: 993325 - RNA, 22 nt, Human
gcagccagccccucugaccucu

SEQ ID NO: 993326 - RNA, 22 nt, Human
aagcuaugggggaguuucaacc

SEQ ID NO: 993327 - RNA, 22 nt, Human
cacugcagaucagaggcugaga

SEQ ID NO: 993328 - RNA, 22 nt, Human
agcuuccucaccucagaggucu

SEQ ID NO: 993329 - RNA, 22 nt, Human
gagccugaugaaacaggcagac

SEQ ID NO: 993330 - RNA, 22 nt, Human
auucucaaacaagugguuugau

SEQ ID NO: 993331 - RNA, 22 nt, Human
agugacugggcagggcagggcc

SEQ ID NO: 993332 - RNA, 22 nt, Human
ucacugggagaugugggaaggg

SEQ ID NO: 993333 - RNA, 22 nt, Human
gagcuuccugaugccgaccagu

SEQ ID NO: 993334 - RNA, 22 nt, Human
uuuauguaguuacggacuauca

SEQ ID NO: 993335 - RNA, 22 nt, Human
augauugaccaucugcugggcu

SEQ ID NO: 993336 - RNA, 22 nt, Human
gagugugucggucagcguggcg

SEQ ID NO: 993337 - RNA, 22 nt, Human
ugggccuggcccuguggaggag

SEQ ID NO: 993338 - RNA, 22 nt, Human
agggcugcugcuccgggcccag

SEQ ID NO: 993339 - RNA, 22 nt, Human
gcuggccagggcugcucgcgga

SEQ ID NO: 993340 - RNA, 20 nt, Human
guauuaggagguaaauguaa

SEQ ID NO: 993341 - RNA, 18 nt, Human
ggagagugacagagucgu

SEQ ID NO: 993342 - RNA, 22 nt, Human
uguguuaaguauuugauacacu

SEQ ID NO: 993343 - RNA, 22 nt, Human
cagacagaaggcuccuugaggu

SEQ ID NO: 993344 - RNA, 22 nt, Human
ccuccuggaggcucuaagggag

SEQ ID NO: 993345 - RNA, 17 nt, Human
acacagggagagggagc

SEQ ID NO: 993346 - RNA, 22 nt, Human
cagggcagugaagaacacacgu

SEQ ID NO: 993347 - RNA, 22 nt, Human
aagaacauucgaacuauuuucu

SEQ ID NO: 993348 - RNA, 22 nt, Human
gcagggacugugaucucacaga

SEQ ID NO: 993349 - RNA, 22 nt, Human
gcagauggaaagugcuugaggg

SEQ ID NO: 993350 - RNA, 22 nt, Human
ggagccuguggcugcuugaagc

SEQ ID NO: 993351 - RNA, 22 nt, Human
ggcugccauaacugauaccaua

SEQ ID NO: 993352 - RNA, 22 nt, Human
ucacauuuuaucuauuuuaagu

SEQ ID NO: 993353 - RNA, 22 nt, Human
cuggccuuggugcuugcagaca

SEQ ID NO: 993354 - RNA, 22 nt, Human
ucccaggcuaggccucugcguu

SEQ ID NO: 993355 - RNA, 17 nt, Human
aaauaugaccucaaagu

SEQ ID NO: 993356 - RNA, 18 nt, Human
gccugccuagagcuugcc

SEQ ID NO: 993357 - RNA, 22 nt, Human
agcaagcuaccuagauagucua

SEQ ID NO: 993358 - RNA, 23 nt, Human
auagucauguaaaauauuugaag

SEQ ID NO: 993359 - RNA, 20 nt, Human
cccagccccuaccuguugcc

SEQ ID NO: 993360 - RNA, 22 nt, Human
acuuugcagagccagaagagaa

SEQ ID NO: 993361 - RNA, 22 nt, Human
gagucacaaagccuuucuuauu

SEQ ID NO: 993362 - RNA, 21 nt, Human
gcagacugcccugcugucccc

SEQ ID NO: 993363 - RNA, 22 nt, Human
gacaaaggaucagagguuggga

SEQ ID NO: 993364 - RNA, 22 nt, Human
ggagagagaugccgccuugcuc

SEQ ID NO: 993365 - RNA, 22 nt, Human
gagcagcucgagaaggaagcag

SEQ ID NO: 993366 - RNA, 22 nt, Human
acaauguaggauauguacuugu

SEQ ID NO: 993367 - RNA, 22 nt, Human
uuagaaaaaggcuguggucuua

SEQ ID NO: 993368 - RNA, 22 nt, Human
agcugccacauggugucacugu

SEQ ID NO: 993369 - RNA, 22 nt, Human
ggcagggaaacagcugauccca

SEQ ID NO: 993370 - RNA, 22 nt, Human
uggcucaguuuagcagcucagu

SEQ ID NO: 993371 - RNA, 22 nt, Human
caguagcaggcaggugcuuuug

SEQ ID NO: 993372 - RNA, 22 nt, Human
uugaagcauuugcuauagcauu

SEQ ID NO: 993373 - RNA, 22 nt, Human
aacagcaauagcacuauucauu

SEQ ID NO: 993374 - RNA, 22 nt, Human
agggcugcccagugugagagcu

SEQ ID NO: 993375 - RNA, 20 nt, Human
agagaauucccuuuggagau

SEQ ID NO: 993376 - RNA, 22 nt, Human
agaggccuuucuguugagugaa

SEQ ID NO: 993377 - RNA, 22 nt, Human
uaucuacuccucuuucagaugc

SEQ ID NO: 993378 - RNA, 22 nt, Human
uugauaaaaugaugaaaucacu

SEQ ID NO: 993379 - RNA, 22 nt, Human
uagcagcuuaaguaauuagaau

SEQ ID NO: 993380 - RNA, 22 nt, Human
gaggcugcuuugaugacaggag

SEQ ID NO: 993381 - RNA, 22 nt, Human
gaauucuuuucuuucugaaagu

SEQ ID NO: 993382 - RNA, 22 nt, Human
uccuguaguugcuaaguuuguu

SEQ ID NO: 993383 - RNA, 22 nt, Human
uagaaaguaaaucaguuuuauu

SEQ ID NO: 993384 - RNA, 22 nt, Human
ucucagagcuucaguuauuuuc

SEQ ID NO: 993385 - RNA, 22 nt, Human
uggcucagcgcggccuggucuu

SEQ ID NO: 993386 - RNA, 22 nt, Human
caguacuuugcaucauuccacu

SEQ ID NO: 993387 - RNA, 22 nt, Human
cugagagccuccuguuggcuag

SEQ ID NO: 993388 - RNA, 22 nt, Human
cugcccuggucccauggcugau

SEQ ID NO: 993389 - RNA, 22 nt, Human
ccaucagcuccaguaucuucug

SEQ ID NO: 993390 - RNA, 22 nt, Human
uugggcaaaguguuucuggagc

SEQ ID NO: 993391 - RNA, 22 nt, Human
gcagauggcagcccaggcuggg

SEQ ID NO: 993392 - RNA, 22 nt, Human
agcugguguccuccuggagcug

SEQ ID NO: 993393 - RNA, 22 nt, Human
caucacugacgcugagauucca

SEQ ID NO: 993394 - RNA, 22 nt, Human
aaaagagucuuaggcagucaua

SEQ ID NO: 993395 - RNA, 22 nt, Human
gccaggcugaggcucuggaaga

SEQ ID NO: 993396 - RNA, 22 nt, Human
uggcagcaauuagcuagagcug

SEQ ID NO: 993397 - RNA, 22 nt, Human
cugagccagggccacacaugga

SEQ ID NO: 993398 - RNA, 22 nt, Human
aguuuuuccguggcuacgauaa

SEQ ID NO: 993399 - RNA, 22 nt, Human
ucauugcagacuaacaaucuca

SEQ ID NO: 993400 - RNA, 22 nt, Human
ccaggccugauugggaaucuug

SEQ ID NO: 993401 - RNA, 22 nt, Human
uaaggcauucucaugcugugaa

SEQ ID NO: 993402 - RNA, 22 nt, Human
ucaucuucuauuaauagggaga

SEQ ID NO: 993403 - RNA, 22 nt, Human
cugggagaugacucagagcagg

SEQ ID NO: 993404 - RNA, 22 nt, Human
aucucagacauguuguccauga

SEQ ID NO: 993405 - RNA, 22 nt, Human
uagcuuuguuagaaugucuuca

SEQ ID NO: 993406 - RNA, 22 nt, Human
aggccuggugugccggaugcag

SEQ ID NO: 993407 - RNA, 22 nt, Human
cuggagcucuccagagccccgu

SEQ ID NO: 993408 - RNA, 22 nt, Human
uggaagcagugauucuugucug

SEQ ID NO: 993409 - RNA, 22 nt, Human
gcugugugaaaacugggccugg

SEQ ID NO: 993410 - RNA, 22 nt, Human
uacaaagugagcaaccucuuuu

SEQ ID NO: 993411 - RNA, 22 nt, Human
ugggaguguucuuggcuugcuu

SEQ ID NO: 993412 - RNA, 22 nt, Human
gcacagggcaacaggucuguua

SEQ ID NO: 993413 - RNA, 22 nt, Human
gaguguggugaacaggagcacc

SEQ ID NO: 993414 - RNA, 22 nt, Human
gcagcuguguaaugagcccaca

SEQ ID NO: 993415 - RNA, 22 nt, Human
ucuggccugaaaguccaugcuu

SEQ ID NO: 993416 - RNA, 22 nt, Human
gcuccugggcucuaccuugcua

SEQ ID NO: 993417 - RNA, 22 nt, Human
cugacucagcagcugaugaucc

SEQ ID NO: 993418 - RNA, 22 nt, Human
guggccucaugucuauaaagag

SEQ ID NO: 993419 - RNA, 22 nt, Human
caggagacuauggcccaaggcc

SEQ ID NO: 993420 - RNA, 22 nt, Human
ucccucuguguugggcaugccu

SEQ ID NO: 993421 - RNA, 19 nt, Human
ucccuuccugucgggcucc

SEQ ID NO: 993422 - RNA, 22 nt, Human
ggggggugcugaucaguggagc

SEQ ID NO: 993423 - RNA, 23 nt, Human
uaagaacagacaagcauuuacau

SEQ ID NO: 993424 - RNA, 19 nt, Human
cugucaggggcuggauguu

SEQ ID NO: 993425 - RNA, 22 nt, Human
cugggccugucagggcuuuuug

SEQ ID NO: 993426 - RNA, 22 nt, Human
caccagcuuugcccacugccca

SEQ ID NO: 993427 - RNA, 22 nt, Human
cucuugaagggcaucugaguua

SEQ ID NO: 993428 - RNA, 22 nt, Human
uagggauggcagcauguagcuu

SEQ ID NO: 993429 - RNA, 22 nt, Human
ccugaggcuuaaucugucccaa

SEQ ID NO: 993430 - RNA, 18 nt, Human
aguaguggguuuagcuuc

SEQ ID NO: 993431 - RNA, 19 nt, Human
agcaaauauaauaguguuc

SEQ ID NO: 993432 - RNA, 22 nt, Human
ucuguggccuguguccaagugc

SEQ ID NO: 993433 - RNA, 22 nt, Human
agcaaagucaguggaaccaucc

SEQ ID NO: 993434 - RNA, 22 nt, Human
gaggucaggggagaggcugaug

SEQ ID NO: 993435 - RNA, 22 nt, Human
aucucagggcuggagcccugga

SEQ ID NO: 993436 - RNA, 22 nt, Human
gucuagagugcuuccuagucau

SEQ ID NO: 993437 - RNA, 22 nt, Human
uccucaggcugccuggaagacu

SEQ ID NO: 993438 - RNA, 22 nt, Human
aagauacauaaagguagagucu

SEQ ID NO: 993439 - RNA, 19 nt, Human
agcuggggcgguguguguu

SEQ ID NO: 993440 - RNA, 21 nt, Human
aagagcugucaggaaggcugc

SEQ ID NO: 993441 - RNA, 22 nt, Human
gcuccuggagagauugagaaag

SEQ ID NO: 993442 - RNA, 22 nt, Human
agggcuggcaucucuaaugcug

SEQ ID NO: 993443 - RNA, 22 nt, Human
gugcuuccccaagccacagccu

SEQ ID NO: 993444 - RNA, 22 nt, Human
cuggcugcgucugcucugacag

SEQ ID NO: 993445 - RNA, 21 nt, Human
uccucagggccccagagcacu

SEQ ID NO: 993446 - RNA, 22 nt, Human
cucagcuggcaauucuggcucc

SEQ ID NO: 993447 - RNA, 22 nt, Human
uaacagaaguuguucauugugg

SEQ ID NO: 993448 - RNA, 22 nt, Human
cccacucuggcucccuucuagu

SEQ ID NO: 993449 - RNA, 22 nt, Human
caggggccggcuguccgugccc

SEQ ID NO: 993450 - RNA, 22 nt, Human
ucccaggacaggccacauggaa

SEQ ID NO: 993451 - RNA, 22 nt, Human
uuuaguagugacagauucuggg

SEQ ID NO: 993452 - RNA, 22 nt, Human
cagcugaguuacucugaggucu

SEQ ID NO: 993453 - RNA, 22 nt, Human
guauacauagaugaugaacaag

SEQ ID NO: 993454 - RNA, 21 nt, Human
aaaaagcuggggcaugcaugc

SEQ ID NO: 993455 - RNA, 22 nt, Human
augguuuguguggcccagauga

SEQ ID NO: 993456 - RNA, 18 nt, Human
acagaaauagcugugccu

SEQ ID NO: 993457 - RNA, 22 nt, Human
gccuggagggcucuagagaggc

SEQ ID NO: 993458 - RNA, 22 nt, Human
ccuaugccugucacucugcgcu

SEQ ID NO: 993459 - RNA, 22 nt, Human
aucagcaaggcaaucacugcag

SEQ ID NO: 993460 - RNA, 22 nt, Human
gaggggcuugaggcccugaugg

SEQ ID NO: 993461 - RNA, 22 nt, Human
ugcaauaacccaguaucuguga

SEQ ID NO: 993462 - RNA, 22 nt, Human
ccugccuggcugucagcagagc

SEQ ID NO: 993463 - RNA, 22 nt, Human
aacagaaugcaggggaugcugc

SEQ ID NO: 993464 - RNA, 22 nt, Human
ucagaaauguaagcugaugacu

SEQ ID NO: 993465 - RNA, 22 nt, Human
cagagccaggguugcaccccug

SEQ ID NO: 993466 - RNA, 22 nt, Human
uggggacacagagccaaacuau

SEQ ID NO: 993467 - RNA, 22 nt, Human
aagcccaguuucacacugagac

SEQ ID NO: 993468 - RNA, 22 nt, Human
cagagacaguuucacagggucu

SEQ ID NO: 993469 - RNA, 22 nt, Human
cacacaugagucuccccauugg

SEQ ID NO: 993470 - RNA, 22 nt, Human
aauauuucuccuucguuauagc

SEQ ID NO: 993471 - RNA, 22 nt, Human
auaauuuaaauuaguaugugau

SEQ ID NO: 993472 - RNA, 22 nt, Human
uagggcagagcuuguacacgau

SEQ ID NO: 993473 - RNA, 22 nt, Human
uucaaugagcccaagaacguga

SEQ ID NO: 993474 - RNA, 22 nt, Human
ggagaaggaagaaagcuacuau

SEQ ID NO: 993475 - RNA, 22 nt, Human
cccaggcuggagugcaauggug

SEQ ID NO: 993476 - RNA, 22 nt, Human
cacccagcagcacuuaagacua

SEQ ID NO: 993477 - RNA, 22 nt, Human
agaggaaguaaucaggaccugc

SEQ ID NO: 993478 - RNA, 22 nt, Human
gcagagccuugcgucaugugcc

SEQ ID NO: 993479 - RNA, 22 nt, Human
ucccugcucagcucaccuggca

SEQ ID NO: 993480 - RNA, 22 nt, Human
gaggccuguagucauggaugua

SEQ ID NO: 993481 - RNA, 22 nt, Human
ugacagcauaacacuggucuug

SEQ ID NO: 993482 - RNA, 22 nt, Human
ugccuggcaacuguggugggcu

SEQ ID NO: 993483 - RNA, 22 nt, Human
uagaauguaaauuccaagggca

SEQ ID NO: 993484 - RNA, 22 nt, Human
cccuguccuggaugggagcacu

SEQ ID NO: 993485 - RNA, 22 nt, Human
ccaccagcuuugccacccugcu

SEQ ID NO: 993486 - RNA, 22 nt, Human
aaugcacacauuugguacugaa

SEQ ID NO: 993487 - RNA, 23 nt, Human
ucacaggggccagcgcucugugg

SEQ ID NO: 993488 - RNA, 20 nt, Human
aggagccauugacugcagca

SEQ ID NO: 993489 - RNA, 22 nt, Human
gugugcaguagagaaagagcag

SEQ ID NO: 993490 - RNA, 22 nt, Human
ccuccuggcuuuucccauugaa

SEQ ID NO: 993491 - RNA, 22 nt, Human
aaaucuggccccuugccuauuu

SEQ ID NO: 993492 - RNA, 22 nt, Human
uguagcucuccagccagcaagg

SEQ ID NO: 993493 - RNA, 23 nt, Human
uugcauguagcccaugaguaacu

SEQ ID NO: 993494 - RNA, 22 nt, Human
caggggcaagaaugcugucagc

SEQ ID NO: 993495 - RNA, 22 nt, Human
caaggcaggaagccugucuuau

SEQ ID NO: 993496 - RNA, 21 nt, Human
aggggacagaguagcuccagg

SEQ ID NO: 993497 - RNA, 22 nt, Human
acaccuuugugaagugaugaug

SEQ ID NO: 993498 - RNA, 22 nt, Human
aaaucaguucacguucugaggu

SEQ ID NO: 993499 - RNA, 22 nt, Human
ccauuguaguaucuguuuuagu

SEQ ID NO: 993500 - RNA, 22 nt, Human
agcuggggcugcagagaacagg

SEQ ID NO: 993501 - RNA, 23 nt, Human
ggcagcucucaucugaugacuga

SEQ ID NO: 993502 - RNA, 22 nt, Human
cccucccagaugggcuugaggu

SEQ ID NO: 993503 - RNA, 22 nt, Human
guggcagcggcccaggccgucu

SEQ ID NO: 993504 - RNA, 20 nt, Human
uuccuguauacaaagaguuc

SEQ ID NO: 993505 - RNA, 22 nt, Human
aagggcagccugacucacgguc

SEQ ID NO: 993506 - RNA, 17 nt, Human
cugucugcgcaugaggu

SEQ ID NO: 993507 - RNA, 22 nt, Human
acagacauuuucuguauugccu

SEQ ID NO: 993508 - RNA, 22 nt, Human
acagggucauuuuaugaucugu

SEQ ID NO: 993509 - RNA, 22 nt, Human
ucccugggcaucacguugcuuc

SEQ ID NO: 993510 - RNA, 22 nt, Human
ucagggcaaugucccucagaag

SEQ ID NO: 993511 - RNA, 22 nt, Human
uggcagcagaacaugaaaccca

SEQ ID NO: 993512 - RNA, 21 nt, Human
gagugcagcaagguagagucu

SEQ ID NO: 993513 - RNA, 22 nt, Human
cugugcuugcggguguggagcc

SEQ ID NO: 993514 - RNA, 22 nt, Human
uccuugaagaaugauucuugga

SEQ ID NO: 993515 - RNA, 22 nt, Human
ggacacagauaaucacacagau

SEQ ID NO: 993516 - RNA, 22 nt, Human
auuacacaggauuugccuuacu

SEQ ID NO: 993517 - RNA, 18 nt, Human
ccugccagucuggagcag

SEQ ID NO: 993518 - RNA, 22 nt, Human
gacagacauuuccugauccaau

SEQ ID NO: 993519 - RNA, 22 nt, Human
ccagggugggguccaggaacca

SEQ ID NO: 993520 - RNA, 23 nt, Human
caggcaggaugaggacuacacuc

SEQ ID NO: 993521 - RNA, 22 nt, Human
cugcuggccuagcccauccucu

SEQ ID NO: 993522 - RNA, 22 nt, Human
gugcagguguuuuggcugccag

SEQ ID NO: 993523 - RNA, 22 nt, Human
aaacagucaugguugcuguuca

SEQ ID NO: 993524 - RNA, 22 nt, Human
guaaaguucuacuagaaucaac

SEQ ID NO: 993525 - RNA, 22 nt, Human
agggccuggcgcguggccgccg

SEQ ID NO: 993526 - RNA, 22 nt, Human
gggcucuggauggagccugcag

SEQ ID NO: 993527 - RNA, 22 nt, Human
gucccagggaagaaggcagcac

SEQ ID NO: 993528 - RNA, 22 nt, Human
uuucagauggagguuuaggaca

SEQ ID NO: 993529 - RNA, 22 nt, Human
cagcugaguuuccaagucugcc

SEQ ID NO: 993530 - RNA, 22 nt, Human
cuccuuccccuacucagcaucc

SEQ ID NO: 993531 - RNA, 22 nt, Human
cacagcuuguuuagugacucac

SEQ ID NO: 993532 - RNA, 22 nt, Human
uggccucugggaaagcagauuc

SEQ ID NO: 993533 - RNA, 17 nt, Human
aggaaacauuuucuuuc

SEQ ID NO: 993534 - RNA, 22 nt, Human
uggcagggccugcucaucaucc

SEQ ID NO: 993535 - RNA, 22 nt, Human
gcaggaguguggugggacaucc

SEQ ID NO: 993536 - RNA, 22 nt, Human
uuuuuuauaucaacugaagucu

SEQ ID NO: 993537 - RNA, 22 nt, Human
uuggccaagggaucgagguugg

SEQ ID NO: 993538 - RNA, 22 nt, Human
aguggcagaucucuggucugga

SEQ ID NO: 993539 - RNA, 22 nt, Human
gaggccagcgcgcagcacuuuu

SEQ ID NO: 993540 - RNA, 22 nt, Human
agcuccugaaaagcgcuugcuu

SEQ ID NO: 993541 - RNA, 22 nt, Human
agccugagccccauccagcuga

SEQ ID NO: 993542 - RNA, 22 nt, Human
uuggccaaagcucaccagugcu

SEQ ID NO: 993543 - RNA, 22 nt, Human
agggaaaggcugaugcuguggg

SEQ ID NO: 993544 - RNA, 22 nt, Human
aacaaauguaaaaugcagaugc

SEQ ID NO: 993545 - RNA, 22 nt, Human
uuugcauuuccagaguagcaga

SEQ ID NO: 993546 - RNA, 22 nt, Human
ugggaggagcccucugggaagg

SEQ ID NO: 993547 - RNA, 22 nt, Human
gcugaaauucagauuccuaggc

SEQ ID NO: 993548 - RNA, 22 nt, Human
ccagcuucucucugaugcagcu

SEQ ID NO: 993549 - RNA, 22 nt, Human
aggcaaaauuacaaaguuauua

SEQ ID NO: 993550 - RNA, 21 nt, Human
agugaaaugaaguguaugcuc

SEQ ID NO: 993551 - RNA, 22 nt, Human
ccacagggauaggaauggggcu

SEQ ID NO: 993552 - RNA, 22 nt, Human
cacacuuuuggcauguuugguu

SEQ ID NO: 993553 - RNA, 22 nt, Human
agaggccacuuugccugugaug

SEQ ID NO: 993554 - RNA, 22 nt, Human
ccugagagcauuccacacugaa

SEQ ID NO: 993555 - RNA, 23 nt, Human
ggagugcaauggcgccaucucgg

SEQ ID NO: 993556 - RNA, 22 nt, Human
uggggacacagagguucguugg

SEQ ID NO: 993557 - RNA, 22 nt, Human
ucccuggacaacagacuucacu

SEQ ID NO: 993558 - RNA, 22 nt, Human
uggcagaguggaccauacucaa

SEQ ID NO: 993559 - RNA, 23 nt, Human
ccaggcaguagcuauugaaguga

SEQ ID NO: 993560 - RNA, 22 nt, Human
aggcuggcccuacuggcugccu

SEQ ID NO: 993561 - RNA, 22 nt, Human
cugggcugucaauggcccucug

SEQ ID NO: 993562 - RNA, 22 nt, Human
acauuucuugaugccucuguga

SEQ ID NO: 993563 - RNA, 22 nt, Human
cuccuggacauggagcggagga

SEQ ID NO: 993564 - RNA, 22 nt, Human
gggcauggugaugugcaccugu

SEQ ID NO: 993565 - RNA, 22 nt, Human
uguauuuuuaggaaugcgcuau

SEQ ID NO: 993566 - RNA, 22 nt, Human
aggcuggcuuggcucuccugug

SEQ ID NO: 993567 - RNA, 22 nt, Human
acugucuccucaucaugccugg

SEQ ID NO: 993568 - RNA, 22 nt, Human
ccucugagaccagcucugcacc

SEQ ID NO: 993569 - RNA, 22 nt, Human
ucaaaagucugcauucuucaca

SEQ ID NO: 993570 - RNA, 22 nt, Human
ggccuugggauguggcugcagc

SEQ ID NO: 993571 - RNA, 19 nt, Human
uagucuuuauucuuaauuu

SEQ ID NO: 993572 - RNA, 22 nt, Human
agccucugauggcucccaagga

SEQ ID NO: 993573 - RNA, 22 nt, Human
aaaugugugcacaaagacagcu

SEQ ID NO: 993574 - RNA, 22 nt, Human
cccagacuccucuggcuggugg

SEQ ID NO: 993575 - RNA, 22 nt, Human
cugggccucauccucagaguuu

SEQ ID NO: 993576 - RNA, 22 nt, Human
ugcacacacgcggcacaucugu

SEQ ID NO: 993577 - RNA, 22 nt, Human
cugccucuauaggaguccacca

SEQ ID NO: 993578 - RNA, 22 nt, Human
ccagggccaguaagauuggcau

SEQ ID NO: 993579 - RNA, 21 nt, Human
aaauguguuccauaaugcuuu

SEQ ID NO: 993580 - RNA, 23 nt, Human
gugugccaagcacugugccagga

SEQ ID NO: 993581 - RNA, 22 nt, Human
cagcaucaccgccauuucugau

SEQ ID NO: 993582 - RNA, 19 nt, Human
cugggagguguucagagaa

SEQ ID NO: 993583 - RNA, 22 nt, Human
augggaugcauggcuguggcca

SEQ ID NO: 993584 - RNA, 22 nt, Human
gugucccacucuggaggugaag

SEQ ID NO: 993585 - RNA, 22 nt, Human
gcagcugguuaaugggagaauu

SEQ ID NO: 993586 - RNA, 22 nt, Human
gaggaguggaguugcuggguug

SEQ ID NO: 993587 - RNA, 22 nt, Human
ugagccugggagauggaggcug

SEQ ID NO: 993588 - RNA, 17 nt, Human
uccuggcucugccacug

SEQ ID NO: 993589 - RNA, 22 nt, Human
cugggcacaggggagcagaguc

SEQ ID NO: 993590 - RNA, 22 nt, Human
aguggcagagcugugucuugaa

SEQ ID NO: 993591 - RNA, 22 nt, Human
uccaggacuagcauuucugaua

SEQ ID NO: 993592 - RNA, 22 nt, Human
uauuucugaauccaaaagguca

SEQ ID NO: 993593 - RNA, 22 nt, Human
agccaggacguugcucagcucc

SEQ ID NO: 993594 - RNA, 22 nt, Human
ucuuguuaaagugaagauacug

SEQ ID NO: 993595 - RNA, 22 nt, Human
gcugccucugcgacucugggcg

SEQ ID NO: 993596 - RNA, 22 nt, Human
ucucagaguuugaaucuggagu

SEQ ID NO: 993597 - RNA, 22 nt, Human
ucacuaagugccgaguuuaguu

SEQ ID NO: 993598 - RNA, 22 nt, Human
cuuccucccccacacacucacu

SEQ ID NO: 993599 - RNA, 19 nt, Human
ucaaggcucccugagggau

SEQ ID NO: 993600 - RNA, 22 nt, Human
gacagccaugcacuucugcugu

SEQ ID NO: 993601 - RNA, 22 nt, Human
ugggcagcagcaaagccagacu

SEQ ID NO: 993602 - RNA, 21 nt, Human
aaggcagaagcauggaaugag

SEQ ID NO: 993603 - RNA, 22 nt, Human
cccagggcccuggacagcuaca

SEQ ID NO: 993604 - RNA, 22 nt, Human
cauacauaugcauguguguaua

SEQ ID NO: 993605 - RNA, 22 nt, Human
gggcauggaggucugucugcag

SEQ ID NO: 993606 - RNA, 22 nt, Human
gcagcugauggaaguccuauug

SEQ ID NO: 993607 - RNA, 18 nt, Human
gagaggcccggcugugcc

SEQ ID NO: 993608 - RNA, 22 nt, Human
gaguuuaacacuuggagaaaag

SEQ ID NO: 993609 - RNA, 22 nt, Human
ugcuucucccaaccagggccug

SEQ ID NO: 993610 - RNA, 22 nt, Human
cccuggugguacggcacuggca

SEQ ID NO: 993611 - RNA, 20 nt, Human
accuugaacccgccagccau

SEQ ID NO: 993612 - RNA, 19 nt, Human
uggaggagaggaaaaguca

SEQ ID NO: 993613 - RNA, 22 nt, Human
ugccucugaggaagauuguguu

SEQ ID NO: 993614 - RNA, 22 nt, Human
cagcagggggcagcgcagauca

SEQ ID NO: 993615 - RNA, 22 nt, Human
gcaagcugcuuaagcucauugu

SEQ ID NO: 993616 - RNA, 22 nt, Human
cccacaggcuagggguagggca

SEQ ID NO: 993617 - RNA, 22 nt, Human
ccauggccgccgcugcucagga

SEQ ID NO: 993618 - RNA, 22 nt, Human
aggcccaguagugcugccuuua

SEQ ID NO: 993619 - RNA, 22 nt, Human
agggccugcaucaggagcuugg

SEQ ID NO: 993620 - RNA, 22 nt, Human
ugcacuggggucccagcgcacg

SEQ ID NO: 993621 - RNA, 22 nt, Human
gcacugaaugcuuuuacuguaa

SEQ ID NO: 993622 - RNA, 22 nt, Human
cuagucacucagcacugacaaa

SEQ ID NO: 993623 - RNA, 22 nt, Human
ucaacacuauccaggcaaucuu

SEQ ID NO: 993624 - RNA, 22 nt, Human
cagagagcuuagugugcugcau

SEQ ID NO: 993625 - RNA, 22 nt, Human
ccuccuggaggcucuagggaaa

SEQ ID NO: 993626 - RNA, 22 nt, Human
gagcugccugugugccaugaug

SEQ ID NO: 993627 - RNA, 22 nt, Human
cccagggacagcuagguggggc

SEQ ID NO: 993628 - RNA, 22 nt, Human
ucuuguuacaguuuauuacaug

SEQ ID NO: 993629 - RNA, 23 nt, Human
agcuggguggccugcgugaagcu

SEQ ID NO: 993630 - RNA, 22 nt, Human
aggaaaaagaguugcugccuuc

SEQ ID NO: 993631 - RNA, 22 nt, Human
ugauuuccaguugcugggugcu

SEQ ID NO: 993632 - RNA, 21 nt, Human
gacucugcaccaaauuaagcc

SEQ ID NO: 993633 - RNA, 22 nt, Human
acauaaaguacugagagacucu

SEQ ID NO: 993634 - RNA, 22 nt, Human
agcaggugacagggcuguggug

SEQ ID NO: 993635 - RNA, 22 nt, Human
ugucuuuucuacuguaagcaua

SEQ ID NO: 993636 - RNA, 22 nt, Human
ucuggcucucucaucacccaau

SEQ ID NO: 993637 - RNA, 22 nt, Human
gcagagcaguacucucuugacu

SEQ ID NO: 993638 - RNA, 22 nt, Human
cugccuuugcccuugacacugu

SEQ ID NO: 993639 - RNA, 22 nt, Human
cugugucccuugucccagagcc

SEQ ID NO: 993640 - RNA, 22 nt, Human
uucacauuagugguucuauaua

SEQ ID NO: 993641 - RNA, 22 nt, Human
agcuuccuacaaccaucucaga

SEQ ID NO: 993642 - RNA, 22 nt, Human
aauuucaagucuugaagaagua

SEQ ID NO: 993643 - RNA, 22 nt, Human
ccugucucccuggcauggcuca

SEQ ID NO: 993644 - RNA, 22 nt, Human
acauuccugaggaaauacauuc

SEQ ID NO: 993645 - RNA, 22 nt, Human
cucugaagggagggccaagccc

SEQ ID NO: 993646 - RNA, 22 nt, Human
cuggccuggcaggggaccucua

SEQ ID NO: 993647 - RNA, 22 nt, Human
aggagaaggaagugcaucacua

SEQ ID NO: 993648 - RNA, 22 nt, Human
ccagagucuaugaguccucauu

SEQ ID NO: 993649 - RNA, 22 nt, Human
aggccagguggucaugcuugcu

SEQ ID NO: 993650 - RNA, 22 nt, Human
uaacagaaauaguaggugaggg

SEQ ID NO: 993651 - RNA, 22 nt, Human
auguaucagaaauagcauuggc

SEQ ID NO: 993652 - RNA, 22 nt, Human
uccucugcucagcauuccucac

SEQ ID NO: 993653 - RNA, 22 nt, Human
gguggguauugaauacaggugu

SEQ ID NO: 993654 - RNA, 22 nt, Human
auguguauacuugugcuuacuc

SEQ ID NO: 993655 - RNA, 22 nt, Human
uaggccagaggagcagcuuugg

SEQ ID NO: 993656 - RNA, 22 nt, Human
ccaggcugcuguugguguccgc

SEQ ID NO: 993657 - RNA, 20 nt, Human
gacaggagaguuagguaggu

SEQ ID NO: 993658 - RNA, 22 nt, Human
uuugggaaacuuaggggucaga

SEQ ID NO: 993659 - RNA, 22 nt, Human
caguccaggccuggaggagcca

SEQ ID NO: 993660 - RNA, 19 nt, Human
uuuaggauaaagucuggac

SEQ ID NO: 993661 - RNA, 22 nt, Human
gcagagcucaagguguucagcu

SEQ ID NO: 993662 - RNA, 22 nt, Human
ugucucagauacgccaucaagg

SEQ ID NO: 993663 - RNA, 22 nt, Human
ugcagaagugagucaugaggaa

SEQ ID NO: 993664 - RNA, 22 nt, Human
guuuccauggcucuguuaaugg

SEQ ID NO: 993665 - RNA, 22 nt, Human
aaaugcuguaacugauauucug

SEQ ID NO: 993666 - RNA, 22 nt, Human
accagagcuggcucugagcacc

SEQ ID NO: 993667 - RNA, 22 nt, Human
cccccaggcucugacacaggag

SEQ ID NO: 993668 - RNA, 22 nt, Human
ccuccugggacaggcuggcaca

SEQ ID NO: 993669 - RNA, 22 nt, Human
cagcucaaguuucccaggucag

SEQ ID NO: 993670 - RNA, 22 nt, Human
ugggauggagccugaguauagu

SEQ ID NO: 993671 - RNA, 22 nt, Human
uuguaacagcugcuuaauagag

SEQ ID NO: 993672 - RNA, 22 nt, Human
acauuucucccugcaugccugc

SEQ ID NO: 993673 - RNA, 22 nt, Human
cccagggauuauaaaggugaaa

SEQ ID NO: 993674 - RNA, 22 nt, Human
ccacccuggacaggccucugag

SEQ ID NO: 993675 - RNA, 22 nt, Human
ugcagcugguuuagaacuagau

SEQ ID NO: 993676 - RNA, 22 nt, Human
uggcagaggagaauuaagauua

SEQ ID NO: 993677 - RNA, 22 nt, Human
auaaguucagguaaagaaauca

SEQ ID NO: 993678 - RNA, 22 nt, Human
ucucagagugguggucccucug

SEQ ID NO: 993679 - RNA, 22 nt, Human
ucuccuuugaaaguuaggacug

SEQ ID NO: 993680 - RNA, 22 nt, Human
uccugggcgguuaugugaucug

SEQ ID NO: 993681 - RNA, 22 nt, Human
cauguguagugaaauaagcagu

SEQ ID NO: 993682 - RNA, 22 nt, Human
agaaauguauucuguauguuuu

SEQ ID NO: 993683 - RNA, 22 nt, Human
ugcaggcuuuagccccauggcu

SEQ ID NO: 993684 - RNA, 20 nt, Human
caaugcacacagcugcuucu

SEQ ID NO: 993685 - RNA, 22 nt, Human
aguauacauauauuagccuucg

SEQ ID NO: 993686 - RNA, 22 nt, Human
caguuucuuaucuucaaaauug

SEQ ID NO: 993687 - RNA, 22 nt, Human
agcuccugcucuuugucccuaa

SEQ ID NO: 993688 - RNA, 22 nt, Human
uaaggcaccuguccaggcuggg

SEQ ID NO: 993689 - RNA, 22 nt, Human
uucaggauggcggauguugggg

SEQ ID NO: 993690 - RNA, 22 nt, Human
aagaggaacugggggcugaguc

SEQ ID NO: 993691 - RNA, 23 nt, Human
ugucccagagggagggauaggcu

SEQ ID NO: 993692 - RNA, 22 nt, Human
guuuuuaucuaauagcaguuau

SEQ ID NO: 993693 - RNA, 22 nt, Human
ugcagccauuuucugccaaugc

SEQ ID NO: 993694 - RNA, 22 nt, Human
ugggcuacucugggagccuaac

SEQ ID NO: 993695 - RNA, 22 nt, Human
auccuugagaaaauaaaugacc

SEQ ID NO: 993696 - RNA, 22 nt, Human
cugccucuauucacugaggcag

SEQ ID NO: 993697 - RNA, 22 nt, Human
ucugccugcggcugcagguggc

SEQ ID NO: 993698 - RNA, 22 nt, Human
guggcugcucgggcuccggccc

SEQ ID NO: 993699 - RNA, 22 nt, Human
uauucacauguacauaugcuca

SEQ ID NO: 993700 - RNA, 22 nt, Human
cagugucuuauuuguagcucag

SEQ ID NO: 993701 - RNA, 22 nt, Human
agaaauguauagugaauuuuuc

SEQ ID NO: 993702 - RNA, 22 nt, Human
gaguuauuuugagcagaugguu

SEQ ID NO: 993703 - RNA, 22 nt, Human
uuccucaugggguuccuucaga

SEQ ID NO: 993704 - RNA, 22 nt, Human
ugcuugaggggaauaaaaagaa

SEQ ID NO: 993705 - RNA, 20 nt, Human
aaaaacaguaaugcugaaga

SEQ ID NO: 993706 - RNA, 22 nt, Human
uaaggcacccuucugaguagag

SEQ ID NO: 993707 - RNA, 22 nt, Human
acaguuauucuuuaugcaacca

SEQ ID NO: 993708 - RNA, 22 nt, Human
uuagaaaggaaucuucauuuca

SEQ ID NO: 993709 - RNA, 22 nt, Human
cugggcugugguguggcccaaa

SEQ ID NO: 993710 - RNA, 22 nt, Human
ugagcuuacuucuguacacaga

SEQ ID NO: 993711 - RNA, 22 nt, Human
ugauuucaaguagugacaugcu

SEQ ID NO: 993712 - RNA, 22 nt, Human
cauagcaacagcaucaagucaa

SEQ ID NO: 993713 - RNA, 22 nt, Human
agcugccaucagccuuuggaug

SEQ ID NO: 993714 - RNA, 22 nt, Human
uugauacauagcacaguuuagg

SEQ ID NO: 993715 - RNA, 22 nt, Human
gagagcugggggacuguggaug

SEQ ID NO: 993716 - RNA, 22 nt, Human
gcacccaggcuugggcagcaac

SEQ ID NO: 993717 - RNA, 20 nt, Human
ggcagcucacuacuuucugu

SEQ ID NO: 993718 - RNA, 22 nt, Human
gcagggucugaggccacagagg

SEQ ID NO: 993719 - RNA, 22 nt, Human
ucuggccacccgaggccccugc

SEQ ID NO: 993720 - RNA, 22 nt, Human
cuccagggcagcauggcagugg

SEQ ID NO: 993721 - RNA, 22 nt, Human
cccugcagaccaaugccauaga

SEQ ID NO: 993722 - RNA, 22 nt, Human
ugggcacuggaagccugcugug

SEQ ID NO: 993723 - RNA, 22 nt, Human
uuauuaggaacucaggauuuuu

SEQ ID NO: 993724 - RNA, 19 nt, Human
cccagcuugaccaccugcu

SEQ ID NO: 993725 - RNA, 22 nt, Human
cuccuggcucugccacuuacua

SEQ ID NO: 993726 - RNA, 22 nt, Human
gaugcacugcaguauauacugu

SEQ ID NO: 993727 - RNA, 22 nt, Human
gcuccuggcauccugcuuuuaa

SEQ ID NO: 993728 - RNA, 22 nt, Human
acaguguccuuguggucccugu

SEQ ID NO: 993729 - RNA, 22 nt, Human
cagagccccucagcucucuccc

SEQ ID NO: 993730 - RNA, 22 nt, Human
gcaggggcugagcaccagcggg

SEQ ID NO: 993731 - RNA, 22 nt, Human
caauaagugcuuuuguuuagca

SEQ ID NO: 993732 - RNA, 22 nt, Human
aaggaagacacagaugaaguga

SEQ ID NO: 993733 - RNA, 22 nt, Human
cagcaggcugcgauugcucauu

SEQ ID NO: 993734 - RNA, 22 nt, Human
gcucaggaaacagcagggcuug

SEQ ID NO: 993735 - RNA, 22 nt, Human
aauucacaugcaugucugugca

SEQ ID NO: 993736 - RNA, 22 nt, Human
cuggugcuggagccuagucccu

SEQ ID NO: 993737 - RNA, 18 nt, Human
auggucucauacugggag

SEQ ID NO: 993738 - RNA, 22 nt, Human
gccuggccugaacuaggaggug

SEQ ID NO: 993739 - RNA, 22 nt, Human
auaugaagaauuccaauuugga

SEQ ID NO: 993740 - RNA, 19 nt, Human
agcagagcccugaagaucc

SEQ ID NO: 993741 - RNA, 22 nt, Human
gggacuggaacuacuggugcag

SEQ ID NO: 993742 - RNA, 22 nt, Human
gcaggcagaucaccugucagga

SEQ ID NO: 993743 - RNA, 22 nt, Human
gcccauggacacccaagugcca

SEQ ID NO: 993744 - RNA, 22 nt, Human
agcagcuguggaaaaguaacua

SEQ ID NO: 993745 - RNA, 22 nt, Human
ccaggagcagauauggacauaa

SEQ ID NO: 993746 - RNA, 22 nt, Human
ggcucaggaugagccuucucau

SEQ ID NO: 993747 - RNA, 22 nt, Human
uguaucaaggguuuauguaagc

SEQ ID NO: 993748 - RNA, 19 nt, Human
ccaggccaucccaguuccc

SEQ ID NO: 993749 - RNA, 22 nt, Human
aagauuuaccacuuuauucaag

SEQ ID NO: 993750 - RNA, 22 nt, Human
cagcuccugccugggcagcugu

SEQ ID NO: 993751 - RNA, 22 nt, Human
ugugggcaggcccgggucugag

SEQ ID NO: 993752 - RNA, 22 nt, Human
ucccuguccugggcaaucccag

SEQ ID NO: 993753 - RNA, 22 nt, Human
cuccuuccugguuagcaccuua

SEQ ID NO: 993754 - RNA, 23 nt, Human
gggagaauaugaggaugauggug

SEQ ID NO: 993755 - RNA, 22 nt, Human
ucccuggcugggggcugccuug

SEQ ID NO: 993756 - RNA, 16 nt, Human
ccaccugcagcucuca

SEQ ID NO: 993757 - RNA, 22 nt, Human
agaggcccucucucuccugaug

SEQ ID NO: 993758 - RNA, 22 nt, Human
cugggaggcacuauucaggagg

SEQ ID NO: 993759 - RNA, 22 nt, Human
cagcagagacgguaagcagaac

SEQ ID NO: 993760 - RNA, 22 nt, Human
gcugcucugugacagccuccgg

SEQ ID NO: 993761 - RNA, 22 nt, Human
caggaaccuaaagagacauuac

SEQ ID NO: 993762 - RNA, 22 nt, Human
uguagcauguaaauugguuauu

SEQ ID NO: 993763 - RNA, 22 nt, Human
aacagcaugcuggguaacauug

SEQ ID NO: 993764 - RNA, 22 nt, Human
acgcuuuuacuauuuugagcuc

SEQ ID NO: 993765 - RNA, 22 nt, Human
aaggcucuuggagugaaugcag

SEQ ID NO: 993766 - RNA, 22 nt, Human
uccugucugcucacagagcugg

SEQ ID NO: 993767 - RNA, 22 nt, Human
uauacagaaccgccugaagucu

SEQ ID NO: 993768 - RNA, 22 nt, Human
uccuuggcagcagggagcauga

SEQ ID NO: 993769 - RNA, 22 nt, Human
gagaaccucuccacaagucugg

SEQ ID NO: 993770 - RNA, 22 nt, Human
ugcaauaaagugcuauaaaucc

SEQ ID NO: 993771 - RNA, 22 nt, Human
ucugccugcuaacuccugcacc

SEQ ID NO: 993772 - RNA, 22 nt, Human
ccaggcauccauugcuuccucu

SEQ ID NO: 993773 - RNA, 22 nt, Human
acuccaggcaucugcuucugcu

SEQ ID NO: 993774 - RNA, 22 nt, Human
uguccucuuccagugcuccuuc

SEQ ID NO: 993775 - RNA, 22 nt, Human
uaaugcacaugacugaacuauu

SEQ ID NO: 993776 - RNA, 22 nt, Human
ugcucuggagggugaagcuuuu

SEQ ID NO: 993777 - RNA, 22 nt, Human
aucuggguucaccaugcuccug

SEQ ID NO: 993778 - RNA, 22 nt, Human
uuguuacacauaauaacauuuu

SEQ ID NO: 993779 - RNA, 19 nt, Human
caugagcugcucacuuccc

SEQ ID NO: 993780 - RNA, 22 nt, Human
caggguggggcuggcuaucaaa

SEQ ID NO: 993781 - RNA, 22 nt, Human
cugucugcuagaacaucuauac

SEQ ID NO: 993782 - RNA, 22 nt, Human
ccucacuggccagccaggggug

SEQ ID NO: 993783 - RNA, 22 nt, Human
gcucaggaaaacagucuaguaa

SEQ ID NO: 993784 - RNA, 22 nt, Human
auucuagaugcuguaaguagca

SEQ ID NO: 993785 - RNA, 22 nt, Human
ggcugcucugccuuccagcugg

SEQ ID NO: 993786 - RNA, 22 nt, Human
guggagcccugguagggacccc

SEQ ID NO: 993787 - RNA, 21 nt, Human
ucccagggccaggugccauca

SEQ ID NO: 993788 - RNA, 21 nt, Human
cugaggcagcacagcuaguca

SEQ ID NO: 993789 - RNA, 16 nt, Human
auucacaaggcaucgg

SEQ ID NO: 993790 - RNA, 22 nt, Human
cugaaugucgaucagcuugggu

SEQ ID NO: 993791 - RNA, 22 nt, Human
gacauacagcauggucuaugaa

SEQ ID NO: 993792 - RNA, 22 nt, Human
cuggcuccauccuugagcucug

SEQ ID NO: 993793 - RNA, 22 nt, Human
cagcugcccaagccccagaugu

SEQ ID NO: 993794 - RNA, 22 nt, Human
ggcucagaaacuaaaggcgcug

SEQ ID NO: 993795 - RNA, 22 nt, Human
ugugaaauucuugaaaugcaca

SEQ ID NO: 993796 - RNA, 22 nt, Human
ggaugcacgaaggcgccucgga

SEQ ID NO: 993797 - RNA, 20 nt, Human
uccuggccuucucgggcagu

SEQ ID NO: 993798 - RNA, 22 nt, Human
gcaugguggccuuaggguagcc

SEQ ID NO: 993799 - RNA, 22 nt, Human
aggugaaguugaggaggcagaa

SEQ ID NO: 993800 - RNA, 22 nt, Human
aucagcugaaaaacaggcagca

SEQ ID NO: 993801 - RNA, 21 nt, Human
ccuggcuucagggugcacugg

SEQ ID NO: 993802 - RNA, 22 nt, Human
uggccucugcaauggauucacc

SEQ ID NO: 993803 - RNA, 22 nt, Human
ggagccugugggaugagaugug

SEQ ID NO: 993804 - RNA, 17 nt, Human
cccagcuggcagugccg

SEQ ID NO: 993805 - RNA, 22 nt, Human
uggcugcuuguuuuagugaggc

SEQ ID NO: 993806 - RNA, 22 nt, Human
cgccaggcuugguagcucaugc

SEQ ID NO: 993807 - RNA, 22 nt, Human
gaacagaagaggcuggugccac

SEQ ID NO: 993808 - RNA, 22 nt, Human
cagggccugcuuccuucuuguu

SEQ ID NO: 993809 - RNA, 17 nt, Human
gcucccugaggacagcu

SEQ ID NO: 993810 - RNA, 22 nt, Human
ucuccugggcuugguugaaguu

SEQ ID NO: 993811 - RNA, 22 nt, Human
aagggcugagcacagugagcca

SEQ ID NO: 993812 - RNA, 22 nt, Human
ugaaagaacuagcaucuucaag

SEQ ID NO: 993813 - RNA, 22 nt, Human
ccaggccucccuuuuccagcca

SEQ ID NO: 993814 - RNA, 22 nt, Human
aguuuuuccugauuuuacagaa

SEQ ID NO: 993815 - RNA, 22 nt, Human
agauguaguagugggucuuuua

SEQ ID NO: 993816 - RNA, 22 nt, Human
cacaggggcaaacuguagggga

SEQ ID NO: 993817 - RNA, 22 nt, Human
uugaagcagagaaauacuugaa

SEQ ID NO: 993818 - RNA, 22 nt, Human
uguauacauuuaacuagauaga

SEQ ID NO: 993819 - RNA, 22 nt, Human
auuguacuuuuauuacauguag

SEQ ID NO: 993820 - RNA, 22 nt, Human
gcagugcuuuagucuguccuuu

SEQ ID NO: 993821 - RNA, 22 nt, Human
cagaggccauauuucuucacuc

SEQ ID NO: 993822 - RNA, 22 nt, Human
ucucuggaauuggcugaggcaa

SEQ ID NO: 993823 - RNA, 22 nt, Human
gagagggccgggggccagcucc

SEQ ID NO: 993824 - RNA, 22 nt, Human
gaguccaguuguucacagaggc

SEQ ID NO: 993825 - RNA, 22 nt, Human
cccacagguccccaugaacucg

SEQ ID NO: 993826 - RNA, 22 nt, Human
ugcuggaggaguuuacuguggc

SEQ ID NO: 993827 - RNA, 22 nt, Human
uccuggagggaggcggugcuac

SEQ ID NO: 993828 - RNA, 22 nt, Human
gacagcagacagaacuaccugc

SEQ ID NO: 993829 - RNA, 22 nt, Human
ccaggcagcucugauuuauguc

SEQ ID NO: 993830 - RNA, 22 nt, Human
cucuguccuaugcuugauagaa

SEQ ID NO: 993831 - RNA, 22 nt, Human
ucaaaugcuucuacuccuaaga

SEQ ID NO: 993832 - RNA, 22 nt, Human
ucacucuguuuuacucacuguu

SEQ ID NO: 993833 - RNA, 22 nt, Human
uggcuucagacuucugcuacgu

SEQ ID NO: 993834 - RNA, 22 nt, Human
cagcuggcaaguggagcagggu

SEQ ID NO: 993835 - RNA, 22 nt, Human
ggcucuggguucugcaaugcgu

SEQ ID NO: 993836 - RNA, 23 nt, Human
gucagggcuggggucagagugac

SEQ ID NO: 993837 - RNA, 22 nt, Human
uagcagcucugauucugggccc

SEQ ID NO: 993838 - RNA, 20 nt, Human
augccucuaauuuugcaaac

SEQ ID NO: 993839 - RNA, 22 nt, Human
ggcagccagagggcagcuggau

SEQ ID NO: 993840 - RNA, 22 nt, Human
agacaaagaaaccguagaagca

SEQ ID NO: 993841 - RNA, 22 nt, Human
gcccucagcuccuggacacaug

SEQ ID NO: 993842 - RNA, 18 nt, Human
uccuccuuuggccuuuuc

SEQ ID NO: 993843 - RNA, 22 nt, Human
gauuucaccugaucuugucauc

SEQ ID NO: 993844 - RNA, 22 nt, Human
uggccuuccuggugacucauga

SEQ ID NO: 993845 - RNA, 22 nt, Human
augugaaacugaagcauccaua

SEQ ID NO: 993846 - RNA, 22 nt, Human
gaggccacagcuaucagggaca

SEQ ID NO: 993847 - RNA, 22 nt, Human
uuuuuccuuagggguuacucac

SEQ ID NO: 993848 - RNA, 22 nt, Human
ugagccuggccugcagagacca

SEQ ID NO: 993849 - RNA, 22 nt, Human
gggcugucaugugucagugacc

SEQ ID NO: 993850 - RNA, 23 nt, Human
aggagccaggaaccagcuucccc

SEQ ID NO: 993851 - RNA, 22 nt, Human
aauaagaauuuacuugucaaga

SEQ ID NO: 993852 - RNA, 22 nt, Human
uccugggcuguggccccgggca

SEQ ID NO: 993853 - RNA, 22 nt, Human
ccuggagccccucuggccagcc

SEQ ID NO: 993854 - RNA, 22 nt, Human
ugcugccauggucgcugguguc

SEQ ID NO: 993855 - RNA, 22 nt, Human
gcuugcuggugccugcaggcuc

SEQ ID NO: 993856 - RNA, 22 nt, Human
agucccagcccaguccuguaag

SEQ ID NO: 993857 - RNA, 22 nt, Human
ucucccacagucucccauggcu

SEQ ID NO: 993858 - RNA, 22 nt, Human
agaugcugucacacacacuguu

SEQ ID NO: 993859 - RNA, 22 nt, Human
uacuuugucauucuaaccuucc

SEQ ID NO: 993860 - RNA, 22 nt, Human
gccuggagaaaggaagguggga

SEQ ID NO: 993861 - RNA, 19 nt, Human
auuccucaaggacagaaau

SEQ ID NO: 993862 - RNA, 22 nt, Human
gucuggggaagucagggcauca

SEQ ID NO: 993863 - RNA, 22 nt, Human
ucugaggcuucagacuguacug

SEQ ID NO: 993864 - RNA, 22 nt, Human
uccuucagcucucuauuuagau

SEQ ID NO: 993865 - RNA, 18 nt, Human
gugacagcugcuagcuca

SEQ ID NO: 993866 - RNA, 22 nt, Human
ugugggcucccccucacucugu

SEQ ID NO: 993867 - RNA, 22 nt, Human
ugaagccuuguguggccucucu

SEQ ID NO: 993868 - RNA, 22 nt, Human
ucagaggacgcacuaggguugu

SEQ ID NO: 993869 - RNA, 22 nt, Human
ucugggagauccaagcagaacu

SEQ ID NO: 993870 - RNA, 20 nt, Human
ugaugguucuuuccggguug

SEQ ID NO: 993871 - RNA, 21 nt, Human
ccagaggccucucuuggccac

SEQ ID NO: 993872 - RNA, 21 nt, Human
uucagcaguccucuagagaua

SEQ ID NO: 993873 - RNA, 22 nt, Human
agugucauuccagggacccucg

SEQ ID NO: 993874 - RNA, 22 nt, Human
uaucuguuccaggcacucagcu

SEQ ID NO: 993875 - RNA, 22 nt, Human
gggagggaaggaccuuaugaau

SEQ ID NO: 993876 - RNA, 22 nt, Human
gggaggagggugcuggcuaaac

SEQ ID NO: 993877 - RNA, 22 nt, Human
cuucuugcugggggccucagug

SEQ ID NO: 993878 - RNA, 22 nt, Human
cucaggaugcaauuccaucaag

SEQ ID NO: 993879 - RNA, 22 nt, Human
auuagguugugcuuuguggaca

SEQ ID NO: 993880 - RNA, 20 nt, Human
cagaccugcacccacuucga

SEQ ID NO: 993881 - RNA, 22 nt, Human
uggcuucuuagaccaguggccu

SEQ ID NO: 993882 - RNA, 22 nt, Human
aacuagaacgucuaguugcugg

SEQ ID NO: 993883 - RNA, 23 nt, Human
cagggcugguagggaagagcgug

SEQ ID NO: 993884 - RNA, 22 nt, Human
uguuuauuuucaggauggauug

SEQ ID NO: 993885 - RNA, 22 nt, Human
caaugauggcuaggcagcugcu

SEQ ID NO: 993886 - RNA, 22 nt, Human
ccugggcucaagugauccuccu

SEQ ID NO: 993887 - RNA, 22 nt, Human
ugcaggugugguuccucagcca

SEQ ID NO: 993888 - RNA, 22 nt, Human
cagggcugagaauuuagagaca

SEQ ID NO: 993889 - RNA, 22 nt, Human
aaaaguaauugcaauuuuguag

SEQ ID NO: 993890 - RNA, 22 nt, Human
caaagccucugauuucacuugu

SEQ ID NO: 993891 - RNA, 17 nt, Human
uuagcaaaauagcacuu

SEQ ID NO: 993892 - RNA, 22 nt, Human
auugcagcuggucaggguaauu

SEQ ID NO: 993893 - RNA, 22 nt, Human
cagccuucugaaugaacguacu

SEQ ID NO: 993894 - RNA, 22 nt, Human
ccagggugcucuguggcgucgc

SEQ ID NO: 993895 - RNA, 22 nt, Human
uuauuaggaaaaggucagaugu

SEQ ID NO: 993896 - RNA, 22 nt, Human
ugacagggugauuaugagagcu

SEQ ID NO: 993897 - RNA, 22 nt, Human
ggcuccugaaagacuaugggaa

SEQ ID NO: 993898 - RNA, 18 nt, Human
aggcccuggccucgaaca

SEQ ID NO: 993899 - RNA, 20 nt, Human
gaggaaaagcugccaggccu

SEQ ID NO: 993900 - RNA, 22 nt, Human
ggcaggugugagaucgaggcca

SEQ ID NO: 993901 - RNA, 22 nt, Human
ucuccuggucaccucagaaguc

SEQ ID NO: 993902 - RNA, 22 nt, Human
agcauggggcuccgcaaugaac

SEQ ID NO: 993903 - RNA, 22 nt, Human
agcaauauuuaaagguuugcaa

SEQ ID NO: 993904 - RNA, 23 nt, Human
ggcagagagcauggcuggggccc

SEQ ID NO: 993905 - RNA, 23 nt, Human
ugauuuccagugagucaguggga

SEQ ID NO: 993906 - RNA, 23 nt, Human
ucucaggacacacaugucuauca

SEQ ID NO: 993907 - RNA, 22 nt, Human
gcugugcacuaccuauacaucc

SEQ ID NO: 993908 - RNA, 22 nt, Human
cagggcccaggccacuggguug

SEQ ID NO: 993909 - RNA, 22 nt, Human
cauugcacucuggcuggaacgg

SEQ ID NO: 993910 - RNA, 22 nt, Human
gcagaacauuucacaguaucuu

SEQ ID NO: 993911 - RNA, 19 nt, Human
ucaaagucugagucacuuu

SEQ ID NO: 993912 - RNA, 22 nt, Human
aggcacuguggaagacaugguu

SEQ ID NO: 993913 - RNA, 22 nt, Human
gccuuugccugcgacguggcug

SEQ ID NO: 993914 - RNA, 22 nt, Human
ucuggcuccaggaccgggcaca

SEQ ID NO: 993915 - RNA, 22 nt, Human
ucuggagccuuggaugggaaag

SEQ ID NO: 993916 - RNA, 22 nt, Human
augaguaagaccauaauuuuug

SEQ ID NO: 993917 - RNA, 22 nt, Human
cauauuaaggucuguaaggggu

SEQ ID NO: 993918 - RNA, 19 nt, Human
acagaaauuaguuauuuuc

SEQ ID NO: 993919 - RNA, 22 nt, Human
ccaggccucuggcugcuuaguc

SEQ ID NO: 993920 - RNA, 22 nt, Human
aagacaagcaucaaaucaggca

SEQ ID NO: 993921 - RNA, 22 nt, Human
uggcucagaacuacuucuaguu

SEQ ID NO: 993922 - RNA, 22 nt, Human
ccugggagugucagacuugcuu

SEQ ID NO: 993923 - RNA, 22 nt, Human
ucuggccagaaagacuugaugu

SEQ ID NO: 993924 - RNA, 18 nt, Human
cagagcagagguggagcg

SEQ ID NO: 993925 - RNA, 19 nt, Human
cauuaggauuagagacaag

SEQ ID NO: 993926 - RNA, 22 nt, Human
augggguggaguccgggcagcg

SEQ ID NO: 993927 - RNA, 22 nt, Human
gccaggcuccaggcccuccuga

SEQ ID NO: 993928 - RNA, 22 nt, Human
aaugcacauauauguguauaca

SEQ ID NO: 993929 - RNA, 22 nt, Human
uagaaacacagagagacccaug

SEQ ID NO: 993930 - RNA, 22 nt, Human
auaaggcaagcugucaguuugu

SEQ ID NO: 993931 - RNA, 22 nt, Human
uccugucuaaagaccugcaggc

SEQ ID NO: 993932 - RNA, 20 nt, Human
agaggcuuccuugggaggag

SEQ ID NO: 993933 - RNA, 22 nt, Human
uacuaggaagcagcugcauugg

SEQ ID NO: 993934 - RNA, 22 nt, Human
aaaugguguuucuaaugcuaga

SEQ ID NO: 993935 - RNA, 22 nt, Human
gaacagcugcuagagaucugug

SEQ ID NO: 993936 - RNA, 18 nt, Human
ucaaagucuggcuccacu

SEQ ID NO: 993937 - RNA, 17 nt, Human
aggccucccuccaggcc

SEQ ID NO: 993938 - RNA, 22 nt, Human
gaggcugcugagagcccuguuu

SEQ ID NO: 993939 - RNA, 22 nt, Human
gcugucugcugugcacugagca

SEQ ID NO: 993940 - RNA, 22 nt, Human
uucaacacaggaacaugauaua

SEQ ID NO: 993941 - RNA, 22 nt, Human
uaacacacugaaggugagaugg

SEQ ID NO: 993942 - RNA, 22 nt, Human
agcugaguuaauucaucacuua

SEQ ID NO: 993943 - RNA, 22 nt, Human
acaaaaaccguggauucagcau

SEQ ID NO: 993944 - RNA, 22 nt, Human
cuggcccagucucagaguguca

SEQ ID NO: 993945 - RNA, 18 nt, Human
acauuucuaggugaaagc

SEQ ID NO: 993946 - RNA, 22 nt, Human
gcugcccaguucugcugcugcc

SEQ ID NO: 993947 - RNA, 22 nt, Human
ccucacucugcacccugcagca

SEQ ID NO: 993948 - RNA, 22 nt, Human
aggcacugcagauuacaggcgc

SEQ ID NO: 993949 - RNA, 22 nt, Human
gagagcuguguucauucuacca

SEQ ID NO: 993950 - RNA, 23 nt, Human
ggguccagagacaggcaugggug

SEQ ID NO: 993951 - RNA, 22 nt, Human
uggugaagucagcggagcccgg

SEQ ID NO: 993952 - RNA, 22 nt, Human
uaucuuugaugccagauguuac

SEQ ID NO: 993953 - RNA, 22 nt, Human
gcuagaaaucgacuucagaauu

SEQ ID NO: 993954 - RNA, 22 nt, Human
aucagcaagauugugucuugua

SEQ ID NO: 993955 - RNA, 22 nt, Human
ccugagccuggcucaugcacuc

SEQ ID NO: 993956 - RNA, 22 nt, Human
ucauucuccucuggaaaaggca

SEQ ID NO: 993957 - RNA, 22 nt, Human
aucaguuugagugcugugucaa

SEQ ID NO: 993958 - RNA, 22 nt, Human
auaaacagcuccauuuagugcc

SEQ ID NO: 993959 - RNA, 22 nt, Human
ucagcuccucaugcaggggaua

SEQ ID NO: 993960 - RNA, 22 nt, Human
uccugccugcaaucccagcacu

SEQ ID NO: 993961 - RNA, 22 nt, Human
aggucauuguuaagucaccaua

SEQ ID NO: 993962 - RNA, 22 nt, Human
agagucugaggcagcugcagcc

SEQ ID NO: 993963 - RNA, 22 nt, Human
auuauggacguuaauuuuggaa

SEQ ID NO: 993964 - RNA, 22 nt, Human
uuucacaacguuguggugagag

SEQ ID NO: 993965 - RNA, 22 nt, Human
acugcuuuucuaagauucugug

SEQ ID NO: 993966 - RNA, 22 nt, Human
aggucauuaaaguuaaaugagg

SEQ ID NO: 993967 - RNA, 22 nt, Human
uggcagcugucuguggggucuc

SEQ ID NO: 993968 - RNA, 22 nt, Human
uccuccaggucuaggguggcuu

SEQ ID NO: 993969 - RNA, 22 nt, Human
agaggcaggaagagcugauuuu

SEQ ID NO: 993970 - RNA, 17 nt, Human
aggcauggucuggggug

SEQ ID NO: 993971 - RNA, 22 nt, Human
ggaggccuagccagcuccaguu

SEQ ID NO: 993972 - RNA, 22 nt, Human
agugaaaugauucugagcaaga

SEQ ID NO: 993973 - RNA, 22 nt, Human
auaauuuaauuuucacaguggu

SEQ ID NO: 993974 - RNA, 22 nt, Human
aagagagaacucccuucgccag

SEQ ID NO: 993975 - RNA, 22 nt, Human
ggccugugucugugccuguccu

SEQ ID NO: 993976 - RNA, 22 nt, Human
ucuggccaggggucccugaagg

SEQ ID NO: 993977 - RNA, 22 nt, Human
ccuaggcccauuaauuccccuu

SEQ ID NO: 993978 - RNA, 22 nt, Human
ccagcaugagacgaugaugaag

SEQ ID NO: 993979 - RNA, 22 nt, Human
gggaaggagguggcuugaagug

SEQ ID NO: 993980 - RNA, 22 nt, Human
cgccugggaguccacaccugcu

SEQ ID NO: 993981 - RNA, 22 nt, Human
aguggcaggaaaguggaagaga

SEQ ID NO: 993982 - RNA, 22 nt, Human
agauaugacuagaagcucauuu

SEQ ID NO: 993983 - RNA, 22 nt, Human
accuggagucauuugaggagua

SEQ ID NO: 993984 - RNA, 22 nt, Human
ccagcgcuucccaucagggagg

SEQ ID NO: 993985 - RNA, 22 nt, Human
ggcugcugugaccucaggugau

SEQ ID NO: 993986 - RNA, 22 nt, Human
cauguacaaaaggcaaaugccu

SEQ ID NO: 993987 - RNA, 22 nt, Human
cuggccuggggccucagcugcu

SEQ ID NO: 993988 - RNA, 19 nt, Human
ucccuggcgccucucgggc

SEQ ID NO: 993989 - RNA, 17 nt, Human
cugaggcccagggccca

SEQ ID NO: 993990 - RNA, 22 nt, Human
aguuuauagcccagauucaugg

SEQ ID NO: 993991 - RNA, 22 nt, Human
aaagccuugcccgucacuggga

SEQ ID NO: 993992 - RNA, 22 nt, Human
cagguggggcagcugugggagc

SEQ ID NO: 993993 - RNA, 22 nt, Human
aaguucaaggugauaguggcag

SEQ ID NO: 993994 - RNA, 23 nt, Human
aggugccaacugagagcugagag

SEQ ID NO: 993995 - RNA, 22 nt, Human
uuuaggauauuaauguucagag

SEQ ID NO: 993996 - RNA, 20 nt, Human
uacuuaggcuuguuuuggcc

SEQ ID NO: 993997 - RNA, 22 nt, Human
ugcuuuggccacuagaauucag

SEQ ID NO: 993998 - RNA, 22 nt, Human
ugcagaagcugcaggucagugg

SEQ ID NO: 993999 - RNA, 23 nt, Human
gccucagagaaacagcugcacac

SEQ ID NO: 994000 - RNA, 22 nt, Human
uagcacaggucuuguugccauu

SEQ ID NO: 994001 - RNA, 19 nt, Human
gccaggagggcucuggcug

SEQ ID NO: 994002 - RNA, 22 nt, Human
gaggcugcccaacuggagugga

SEQ ID NO: 994003 - RNA, 22 nt, Human
uccuggagagugggcgagcaca

SEQ ID NO: 994004 - RNA, 22 nt, Human
cuuccucaugugcaaugcaagc

SEQ ID NO: 994005 - RNA, 22 nt, Human
ugaacagaucaauagaacugac

SEQ ID NO: 994006 - RNA, 22 nt, Human
ucuuguccuaagagcuggauuc

SEQ ID NO: 994007 - RNA, 22 nt, Human
gaggaaagcugguuuaaaguau

SEQ ID NO: 994008 - RNA, 20 nt, Human
aggaaaaggguggugguaga

SEQ ID NO: 994009 - RNA, 22 nt, Human
agucccagaucuccauucgguc

SEQ ID NO: 994010 - RNA, 22 nt, Human
acuccuggggauccauuccuuu

SEQ ID NO: 994011 - RNA, 22 nt, Human
gaggagcacaugaggcugaggg

SEQ ID NO: 994012 - RNA, 22 nt, Human
aggcacugacagauucuguguc

SEQ ID NO: 994013 - RNA, 22 nt, Human
uaacaucuuuagcagcucgaac

SEQ ID NO: 994014 - RNA, 22 nt, Human
uauguguaggaggaggacaggg

SEQ ID NO: 994015 - RNA, 22 nt, Human
uuuugaaagggugauuuggcuu

SEQ ID NO: 994016 - RNA, 22 nt, Human
accagagauggggcuucucugu

SEQ ID NO: 994017 - RNA, 22 nt, Human
cuuauuagugucugucugaguu

SEQ ID NO: 994018 - RNA, 22 nt, Human
uaaugaugugugcaaacugaau

SEQ ID NO: 994019 - RNA, 22 nt, Human
agagacugcgugucagcgcugg

SEQ ID NO: 994020 - RNA, 22 nt, Human
gagccaggucgggccgcggcga

SEQ ID NO: 994021 - RNA, 22 nt, Human
auagucuuagucuauaguuuug

SEQ ID NO: 994022 - RNA, 22 nt, Human
auguuuaaucggcugccuuucc

SEQ ID NO: 994023 - RNA, 18 nt, Human
ugcuggcaacuacuauug

SEQ ID NO: 994024 - RNA, 22 nt, Human
caguagcaggcacucagcacgu

SEQ ID NO: 994025 - RNA, 22 nt, Human
cugaugcuauaagccacagugg

SEQ ID NO: 994026 - RNA, 22 nt, Human
aaugcaguuucauuuguagaau

SEQ ID NO: 994027 - RNA, 22 nt, Human
uggcugggugcuauccaguacu

SEQ ID NO: 994028 - RNA, 22 nt, Human
gcagcccaaaaaagagguagau

SEQ ID NO: 994029 - RNA, 22 nt, Human
aaugauggauuuagacaagcug

SEQ ID NO: 994030 - RNA, 22 nt, Human
auacaucuuccuuuuaaaaugc

SEQ ID NO: 994031 - RNA, 22 nt, Human
uuugcauuuguucaaguauuga

SEQ ID NO: 994032 - RNA, 22 nt, Human
gucugucucucuccagagugca

SEQ ID NO: 994033 - RNA, 22 nt, Human
ucccagaguauuagcaauugcu

SEQ ID NO: 994034 - RNA, 22 nt, Human
ccacccugagccgcaagagcag

SEQ ID NO: 994035 - RNA, 22 nt, Human
aggcugggcuccgcccaacucc

SEQ ID NO: 994036 - RNA, 18 nt, Human
aaaaugcaggcgacaugg

SEQ ID NO: 994037 - RNA, 22 nt, Human
gugauuucaaauauagagugag

SEQ ID NO: 994038 - RNA, 22 nt, Human
caguggguccuaaguacaguuc

SEQ ID NO: 994039 - RNA, 22 nt, Human
uuucaguggguuuauuucaugu

SEQ ID NO: 994040 - RNA, 22 nt, Human
ggcugagggccagggcuagucu

SEQ ID NO: 994041 - RNA, 22 nt, Human
gcagcugagagaagaacagggc

SEQ ID NO: 994042 - RNA, 22 nt, Human
aggauuuguuuauaggucuuaa

SEQ ID NO: 994043 - RNA, 22 nt, Human
cccagcucucgcacuuacuagc

SEQ ID NO: 994044 - RNA, 19 nt, Human
ccucugccagcccgccucu

SEQ ID NO: 994045 - RNA, 22 nt, Human
ucuucagauugcacugagcaag

SEQ ID NO: 994046 - RNA, 22 nt, Human
uauaauccauucauugauuucu

SEQ ID NO: 994047 - RNA, 22 nt, Human
ugcaucuguucagagcugucga

SEQ ID NO: 994048 - RNA, 22 nt, Human
acagaggaaggcugagcugccc

SEQ ID NO: 994049 - RNA, 22 nt, Human
uggcccuguguccugcugccag

SEQ ID NO: 994050 - RNA, 22 nt, Human
ccugucugaggaggugcucuuu

SEQ ID NO: 994051 - RNA, 23 nt, Human
agggaaaguaguaauggccuuug

SEQ ID NO: 994052 - RNA, 22 nt, Human
cacucaggcugugucaggagga

SEQ ID NO: 994053 - RNA, 22 nt, Human
gcagcuggugcaaaugucacuc

SEQ ID NO: 994054 - RNA, 22 nt, Human
acugggccuugccauggcagcc

SEQ ID NO: 994055 - RNA, 22 nt, Human
aggagucacucagggcuucauc

SEQ ID NO: 994056 - RNA, 22 nt, Human
uggagcugaacuuugaggccag

SEQ ID NO: 994057 - RNA, 22 nt, Human
agcagcauucucugguaugggg

SEQ ID NO: 994058 - RNA, 19 nt, Human
uacauuuguguacacuugu

SEQ ID NO: 994059 - RNA, 21 nt, Human
agcagaggcagaauguaugca

SEQ ID NO: 994060 - RNA, 22 nt, Human
gcagaggcaaucagguaugugg

SEQ ID NO: 994061 - RNA, 22 nt, Human
agggcugccugacuccagagcc

SEQ ID NO: 994062 - RNA, 22 nt, Human
gcgaaaaauguguaaauauguu

SEQ ID NO: 994063 - RNA, 20 nt, Human
ugcagcugguuucacaggga

SEQ ID NO: 994064 - RNA, 22 nt, Human
gcaaggaccuuugagcgugcca

SEQ ID NO: 994065 - RNA, 22 nt, Human
ggcuggagugggcuccagaguu

SEQ ID NO: 994066 - RNA, 22 nt, Human
uggcagaguuggagguggaaga

SEQ ID NO: 994067 - RNA, 22 nt, Human
uguccucacaggaaugaacuuu

SEQ ID NO: 994068 - RNA, 22 nt, Human
ccaggccuccugugaguggacc

SEQ ID NO: 994069 - RNA, 19 nt, Human
gcuucccaccagccagccc

SEQ ID NO: 994070 - RNA, 22 nt, Human
ggccuagggaguggccaugccu

SEQ ID NO: 994071 - RNA, 22 nt, Human
acucccagguugccuggcaggc

SEQ ID NO: 994072 - RNA, 22 nt, Human
gcucccugacucaguuccugag

SEQ ID NO: 994073 - RNA, 23 nt, Human
ucugagagaacaaugccuccuau

SEQ ID NO: 994074 - RNA, 22 nt, Human
acaguuucuccauuuacaccuu

SEQ ID NO: 994075 - RNA, 20 nt, Human
ucuccuggucugguccgugc

SEQ ID NO: 994076 - RNA, 22 nt, Human
gcucugggugaacuuggagcaa

SEQ ID NO: 994077 - RNA, 22 nt, Human
ggcaggcuggcuuuguuccagg

SEQ ID NO: 994078 - RNA, 22 nt, Human
augggaggaugcucgggugcuc

SEQ ID NO: 994079 - RNA, 22 nt, Human
ugugcccaucccucuggagugu

SEQ ID NO: 994080 - RNA, 22 nt, Human
uucagcaagugucucuacuguc

SEQ ID NO: 994081 - RNA, 22 nt, Human
uccugggccuguacuccauccg

SEQ ID NO: 994082 - RNA, 22 nt, Human
gaggguccccaugcagagcuca

SEQ ID NO: 994083 - RNA, 22 nt, Human
ggcccuguccuggcugucuccg

SEQ ID NO: 994084 - RNA, 22 nt, Human
agagagcccgggccagggcaca

SEQ ID NO: 994085 - RNA, 22 nt, Human
cuacccaggcuggagugcagua

SEQ ID NO: 994086 - RNA, 19 nt, Human
ggcccaaguacugagugcc

SEQ ID NO: 994087 - RNA, 22 nt, Human
auaaggaaugauguaucaguuu

SEQ ID NO: 994088 - RNA, 22 nt, Human
ccugccagauccccugagcuga

SEQ ID NO: 994089 - RNA, 22 nt, Human
gaugugggguugagggaccagc

SEQ ID NO: 994090 - RNA, 22 nt, Human
cuggccugagcacagcggcugc

SEQ ID NO: 994091 - RNA, 22 nt, Human
ucagguguuagaagaaauuuca

SEQ ID NO: 994092 - RNA, 22 nt, Human
ucugcuguaaagaauuucugcc

SEQ ID NO: 994093 - RNA, 22 nt, Human
aggacugggugcagagggcauc

SEQ ID NO: 994094 - RNA, 22 nt, Human
ugggcccaagagagucuccaac

SEQ ID NO: 994095 - RNA, 22 nt, Human
cacugccuccccaggcuccaca

SEQ ID NO: 994096 - RNA, 22 nt, Human
acagaauucuaguauguggcuu

SEQ ID NO: 994097 - RNA, 22 nt, Human
augaaggauggcuggcugcccu

SEQ ID NO: 994098 - RNA, 17 nt, Human
auucuuugaugucucug

SEQ ID NO: 994099 - RNA, 22 nt, Human
gccagcagggcccaaaugcugg

SEQ ID NO: 994100 - RNA, 22 nt, Human
acagcagcaauagcagugacau

SEQ ID NO: 994101 - RNA, 22 nt, Human
uuaaaugaacgagauaugcaac

SEQ ID NO: 994102 - RNA, 22 nt, Human
cugugcaagcccaagauaaaac

SEQ ID NO: 994103 - RNA, 21 nt, Human
acagaguaguugaaacagaga

SEQ ID NO: 994104 - RNA, 22 nt, Human
gggcagcagcaggaggucucug

SEQ ID NO: 994105 - RNA, 21 nt, Human
ugaaaucugaugggacaaaug

SEQ ID NO: 994106 - RNA, 22 nt, Human
caacagaaggaagcagggucag

SEQ ID NO: 994107 - RNA, 22 nt, Human
augaagcugguuuuggcuuggg

SEQ ID NO: 994108 - RNA, 22 nt, Human
cagaggcuaagaugagugggug

SEQ ID NO: 994109 - RNA, 22 nt, Human
cagagggagcccuccaggagca

SEQ ID NO: 994110 - RNA, 22 nt, Human
uggcucugugucucccagcagc

SEQ ID NO: 994111 - RNA, 22 nt, Human
ccagcccuccuccaucagagga

SEQ ID NO: 994112 - RNA, 22 nt, Human
gccuaggaguggggauggcggu

SEQ ID NO: 994113 - RNA, 22 nt, Human
ggugaagggugucauggcauuu

SEQ ID NO: 994114 - RNA, 22 nt, Human
aggauguucgggucacauagcc

SEQ ID NO: 994115 - RNA, 22 nt, Human
cccagggagguagcaggagaaa

SEQ ID NO: 994116 - RNA, 22 nt, Human
acacagccaggguaguaaggcu

SEQ ID NO: 994117 - RNA, 22 nt, Human
uggaagagguggaaguggcuuc

SEQ ID NO: 994118 - RNA, 22 nt, Human
gcacccaggccggcgacugcag

SEQ ID NO: 994119 - RNA, 22 nt, Human
ucacugcaaucucugccuucca

SEQ ID NO: 994120 - RNA, 22 nt, Human
acaggugugagaacaugccuug

SEQ ID NO: 994121 - RNA, 22 nt, Human
cagcucuggcgucagggagcga

SEQ ID NO: 994122 - RNA, 22 nt, Human
ggccaaaucuguaaggcaagau

SEQ ID NO: 994123 - RNA, 22 nt, Human
caguguacuuggaauguaacag

SEQ ID NO: 994124 - RNA, 22 nt, Human
ccucuucugagugagacucccu

SEQ ID NO: 994125 - RNA, 22 nt, Human
ccacagaggacaacugccuggc

SEQ ID NO: 994126 - RNA, 22 nt, Human
gccugggagagggauagugcag

SEQ ID NO: 994127 - RNA, 22 nt, Human
uauuuauucauucagcaagcau

SEQ ID NO: 994128 - RNA, 22 nt, Human
agugauggagcuuccucugcua

SEQ ID NO: 994129 - RNA, 22 nt, Human
auggccaaauaacagcuugcau

SEQ ID NO: 994130 - RNA, 22 nt, Human
cuggcugcaggaaggagugggc

SEQ ID NO: 994131 - RNA, 22 nt, Human
augaacacauguacacauuucu

SEQ ID NO: 994132 - RNA, 22 nt, Human
ucugccuuggcaaccacagcuu

SEQ ID NO: 994133 - RNA, 17 nt, Human
agcagaagucagaggga

SEQ ID NO: 994134 - RNA, 22 nt, Human
aagcgccacgagaagcuggacc

SEQ ID NO: 994135 - RNA, 21 nt, Human
uucaaugaaaacaaagugagg

SEQ ID NO: 994136 - RNA, 22 nt, Human
agccagaggccagccugccuca

SEQ ID NO: 994137 - RNA, 22 nt, Human
ugaaauguguaauguggaugcc

SEQ ID NO: 994138 - RNA, 22 nt, Human
aauuaaauugguuuagagagga

SEQ ID NO: 994139 - RNA, 22 nt, Human
auugucuuuggugcuuccagga

SEQ ID NO: 994140 - RNA, 22 nt, Human
ggugcagaucuuucucuucagg

SEQ ID NO: 994141 - RNA, 22 nt, Human
gcuggccagcccucuuccucca

SEQ ID NO: 994142 - RNA, 23 nt, Human
aguuuguaaagaaauauuugcac

SEQ ID NO: 994143 - RNA, 22 nt, Human
ccugccuguacuagagacccag

SEQ ID NO: 994144 - RNA, 22 nt, Human
aggagaaguaaggcuagaugau

SEQ ID NO: 994145 - RNA, 22 nt, Human
gccuccugagaagccacaggcu

SEQ ID NO: 994146 - RNA, 19 nt, Human
ugccugucaguagaucuca

SEQ ID NO: 994147 - RNA, 22 nt, Human
ccucccucuguuagagcugucu

SEQ ID NO: 994148 - RNA, 22 nt, Human
cugaggccagcugcagagcucu

SEQ ID NO: 994149 - RNA, 22 nt, Human
agagugaaguaauuguuaggau

SEQ ID NO: 994150 - RNA, 22 nt, Human
ucuggagagucacagugccaga

SEQ ID NO: 994151 - RNA, 23 nt, Human
uggccuggagagaaaagaugagu

SEQ ID NO: 994152 - RNA, 22 nt, Human
caaagguauucucauuuuggaa

SEQ ID NO: 994153 - RNA, 22 nt, Human
ucccacacagcccgcucaccgg

SEQ ID NO: 994154 - RNA, 23 nt, Human
aagcuuccuucacgucuccuggg

SEQ ID NO: 994155 - RNA, 22 nt, Human
gguccuggaaauugacggaaag

SEQ ID NO: 994156 - RNA, 19 nt, Human
ccauggcaaugaucugaug

SEQ ID NO: 994157 - RNA, 22 nt, Human
acacaugagaaacaucaguugu

SEQ ID NO: 994158 - RNA, 22 nt, Human
augucuuuauaaauguauaaug

SEQ ID NO: 994159 - RNA, 22 nt, Human
guucacaaaauucuggccagug

SEQ ID NO: 994160 - RNA, 22 nt, Human
agagccaggcggcugggcaccu

SEQ ID NO: 994161 - RNA, 23 nt, Human
uugaaggagaaagcuuucuuggu

SEQ ID NO: 994162 - RNA, 22 nt, Human
cucuuuaaaguaaaauuugucu

SEQ ID NO: 994163 - RNA, 22 nt, Human
aggugcuuggcucgugcacaca

SEQ ID NO: 994164 - RNA, 22 nt, Human
agggacacugaugagaaauucu

SEQ ID NO: 994165 - RNA, 22 nt, Human
agaaauguacgauguuaugcag

SEQ ID NO: 994166 - RNA, 22 nt, Human
gugaggggaguaaagccauguu

SEQ ID NO: 994167 - RNA, 22 nt, Human
uuggaaggagucaaccagcuga

SEQ ID NO: 994168 - RNA, 22 nt, Human
uuguuacaucuuauguaagugg

SEQ ID NO: 994169 - RNA, 22 nt, Human
uuauuuaauuuucucacucaga

SEQ ID NO: 994170 - RNA, 22 nt, Human
uaaugcacauagaaguacuuag

SEQ ID NO: 994171 - RNA, 22 nt, Human
gccaggcagauaugugagcuua

SEQ ID NO: 994172 - RNA, 22 nt, Human
uggaggugagugugguacagca

SEQ ID NO: 994173 - RNA, 22 nt, Human
aaaugcauugguuucuacuugu

SEQ ID NO: 994174 - RNA, 22 nt, Human
aaguaacaaugcuguugaauug

SEQ ID NO: 994175 - RNA, 22 nt, Human
aggaagcccuugucauuucugu

SEQ ID NO: 994176 - RNA, 22 nt, Human
aagggccauaacuugcaguguu

SEQ ID NO: 994177 - RNA, 22 nt, Human
acugaaggcuuucccaagguca

SEQ ID NO: 994178 - RNA, 22 nt, Human
gccugagauucugcauuucuaa

SEQ ID NO: 994179 - RNA, 22 nt, Human
aucuggcucauucagggaacgg

SEQ ID NO: 994180 - RNA, 21 nt, Human
aaguuuguucuuguauagucu

SEQ ID NO: 994181 - RNA, 21 nt, Human
ugcugccauagaccugaggga

SEQ ID NO: 994182 - RNA, 22 nt, Human
ucuuggccccaccugugccagc

SEQ ID NO: 994183 - RNA, 19 nt, Human
aagggcugggcaccucacu

SEQ ID NO: 994184 - RNA, 19 nt, Human
auaaggcagugacuuuuuu

SEQ ID NO: 994185 - RNA, 22 nt, Human
ugcugucccuaagucucuucaa

SEQ ID NO: 994186 - RNA, 22 nt, Human
ggguaauuggggccuugcagug

SEQ ID NO: 994187 - RNA, 22 nt, Human
uuaacagagaacauagaaguag

SEQ ID NO: 994188 - RNA, 22 nt, Human
agugaccaaucaugguuagauu

SEQ ID NO: 994189 - RNA, 22 nt, Human
agaaaucagaacccugaaguuc

SEQ ID NO: 994190 - RNA, 19 nt, Human
agcauccagucaugggauc

SEQ ID NO: 994191 - RNA, 22 nt, Human
uugaagcauuguggcuuguauu

SEQ ID NO: 994192 - RNA, 22 nt, Human
cugagggugcuauucuugccuu

SEQ ID NO: 994193 - RNA, 22 nt, Human
aucaaaaugcuccagugauggu

SEQ ID NO: 994194 - RNA, 22 nt, Human
augugcauuaaaugucaauguu

SEQ ID NO: 994195 - RNA, 22 nt, Human
ccagggugaccagcuggccuag

SEQ ID NO: 994196 - RNA, 22 nt, Human
uugucccaggacuugcauagau

SEQ ID NO: 994197 - RNA, 22 nt, Human
augaagcugaccuugucuugcu

SEQ ID NO: 994198 - RNA, 22 nt, Human
uaaugcacagaauugacauggg

SEQ ID NO: 994199 - RNA, 22 nt, Human
cacccaggcuagagugcagugg

SEQ ID NO: 994200 - RNA, 18 nt, Human
agggaucaucacugcagc

SEQ ID NO: 994201 - RNA, 22 nt, Human
aagucaaaccuugcucacagga

SEQ ID NO: 994202 - RNA, 22 nt, Human
ugggggugacuaucucgggaau

SEQ ID NO: 994203 - RNA, 20 nt, Human
aggcucugcauuucugagug

SEQ ID NO: 994204 - RNA, 22 nt, Human
aaagauuucagaagccugugcc

SEQ ID NO: 994205 - RNA, 22 nt, Human
acaggcuucucacagaaaaggg

SEQ ID NO: 994206 - RNA, 22 nt, Human
uauuuuguuaauaauccagucc

SEQ ID NO: 994207 - RNA, 22 nt, Human
uggaaggggagcuggaaagggg

SEQ ID NO: 994208 - RNA, 22 nt, Human
agagccugcagcugugaagaaa

SEQ ID NO: 994209 - RNA, 20 nt, Human
ugucagugccugaggcacag

SEQ ID NO: 994210 - RNA, 22 nt, Human
uucauauauaugcacuacguac

SEQ ID NO: 994211 - RNA, 22 nt, Human
agcugccauccuguucagcacc

SEQ ID NO: 994212 - RNA, 22 nt, Human
acucugcuuccacuuuugcuaa

SEQ ID NO: 994213 - RNA, 22 nt, Human
aggguccaucaaggacugcaca

SEQ ID NO: 994214 - RNA, 22 nt, Human
gcucugcuggaaguucucugga

SEQ ID NO: 994215 - RNA, 17 nt, Human
ugaggccugcaucagug

SEQ ID NO: 994216 - RNA, 22 nt, Human
uucuuucccagaagauauguuu

SEQ ID NO: 994217 - RNA, 22 nt, Human
gccuggcuccuaagagcacaac

SEQ ID NO: 994218 - RNA, 22 nt, Human
ggcuagaauaauugacuucauu

SEQ ID NO: 994219 - RNA, 22 nt, Human
uacaguagacaauguuaguaug

SEQ ID NO: 994220 - RNA, 22 nt, Human
aucuggcugacuuugugggaca

SEQ ID NO: 994221 - RNA, 18 nt, Human
gggcucugauccuucacc

SEQ ID NO: 994222 - RNA, 22 nt, Human
acuaugcucauuguuaauauuu

SEQ ID NO: 994223 - RNA, 22 nt, Human
ugccugucuccucugcagggug

SEQ ID NO: 994224 - RNA, 22 nt, Human
uuccuguaugucagugaagagc

SEQ ID NO: 994225 - RNA, 22 nt, Human
ccagcagaagcucccgcugggu

SEQ ID NO: 994226 - RNA, 21 nt, Human
uauuucuuugacucucucccu

SEQ ID NO: 994227 - RNA, 22 nt, Human
uucagucagugacuaagcaguu

SEQ ID NO: 994228 - RNA, 22 nt, Human
acauaacaaucauaggacauag

SEQ ID NO: 994229 - RNA, 18 nt, Human
gcaggugccacugcuguu

SEQ ID NO: 994230 - RNA, 22 nt, Human
caucagcagucacaugaugcug

SEQ ID NO: 994231 - RNA, 21 nt, Human
uuucaauguguucuuuguagu

SEQ ID NO: 994232 - RNA, 19 nt, Human
caguggccuggaggucucu

SEQ ID NO: 994233 - RNA, 22 nt, Human
guuuuuccugcugacuuggguc

SEQ ID NO: 994234 - RNA, 22 nt, Human
caaaguccuagaacagugcuug

SEQ ID NO: 994235 - RNA, 22 nt, Human
uccuggaguugugcagugcaca

SEQ ID NO: 994236 - RNA, 22 nt, Human
gguggccucucaugcaagguag

SEQ ID NO: 994237 - RNA, 22 nt, Human
uggaaggcaugggaacuguucu

SEQ ID NO: 994238 - RNA, 22 nt, Human
cugggcagaauuuuaggauggc

SEQ ID NO: 994239 - RNA, 22 nt, Human
ggugucccaggccagcugugug

SEQ ID NO: 994240 - RNA, 22 nt, Human
gaggaaggucccaucagaauuu

SEQ ID NO: 994241 - RNA, 22 nt, Human
aagugaaacauguaucucuuua

SEQ ID NO: 994242 - RNA, 22 nt, Human
uauuucuggcuuugagggugau

SEQ ID NO: 994243 - RNA, 22 nt, Human
caggaguggugugagggacucc

SEQ ID NO: 994244 - RNA, 22 nt, Human
aggcacugaaagguggccagag

SEQ ID NO: 994245 - RNA, 22 nt, Human
cucaggauggaagccuacagga

SEQ ID NO: 994246 - RNA, 22 nt, Human
ggcagccauacucagaccuggg

SEQ ID NO: 994247 - RNA, 21 nt, Human
uccucugcucucauaccacaa

SEQ ID NO: 994248 - RNA, 22 nt, Human
uggcaccagcaccuagaugggg

SEQ ID NO: 994249 - RNA, 22 nt, Human
guccucagucaguuuggugggg

SEQ ID NO: 994250 - RNA, 22 nt, Human
aagcugccagcugagcugaggc

SEQ ID NO: 994251 - RNA, 22 nt, Human
ggccaugguuggggaagacaug

SEQ ID NO: 994252 - RNA, 22 nt, Human
caaugguggugucagaagagau

SEQ ID NO: 994253 - RNA, 22 nt, Human
agcagccacagucugggacagg

SEQ ID NO: 994254 - RNA, 22 nt, Human
ggugcucaagagggcauccucu

SEQ ID NO: 994255 - RNA, 22 nt, Human
gcagcugcagguggucccaugc

SEQ ID NO: 994256 - RNA, 22 nt, Human
caggugggagcggagacugauu

SEQ ID NO: 994257 - RNA, 22 nt, Human
gcuuccugauauucauacuguu

SEQ ID NO: 994258 - RNA, 22 nt, Human
ugggccuggguuccuccugggc

SEQ ID NO: 994259 - RNA, 22 nt, Human
agccuggauucgugcauccaca

SEQ ID NO: 994260 - RNA, 22 nt, Human
aauuucaaguggcaucuuugau

SEQ ID NO: 994261 - RNA, 22 nt, Human
cccagcugcaccucuauggccu

SEQ ID NO: 994262 - RNA, 21 nt, Human
uggagcugccacuuguccucc

SEQ ID NO: 994263 - RNA, 22 nt, Human
cccaggaggcagagguugcagu

SEQ ID NO: 994264 - RNA, 22 nt, Human
ccuccuggguucaagcgauucu

SEQ ID NO: 994265 - RNA, 22 nt, Human
cagcaucuaaucuucaugccgg

SEQ ID NO: 994266 - RNA, 22 nt, Human
ggggaugguagaccggugacgu

SEQ ID NO: 994267 - RNA, 22 nt, Human
gcugagagcggccagcugggaa

SEQ ID NO: 994268 - RNA, 19 nt, Human
cagcucaguuugauucucu

SEQ ID NO: 994269 - RNA, 22 nt, Human
gggacagaaggaagugagcaca

SEQ ID NO: 994270 - RNA, 22 nt, Human
agaaaagggcaggagggauaca

SEQ ID NO: 994271 - RNA, 22 nt, Human
uuaaaugaugcauaucauuuag

SEQ ID NO: 994272 - RNA, 22 nt, Human
cagagcugcagauugaaggcau

SEQ ID NO: 994273 - RNA, 21 nt, Human
ucuuguccuugcucucccacu

SEQ ID NO: 994274 - RNA, 22 nt, Human
aggcacuguggguguggccgga

SEQ ID NO: 994275 - RNA, 22 nt, Human
gcagugugaccgagcuugcuuc

SEQ ID NO: 994276 - RNA, 22 nt, Human
gaggggcucuuuaauaguaaca

SEQ ID NO: 994277 - RNA, 22 nt, Human
ucucacugcaaauauuauguau

SEQ ID NO: 994278 - RNA, 22 nt, Human
aaggagucucagcugggccuga

SEQ ID NO: 994279 - RNA, 22 nt, Human
gcugcuccgucugagcucuggu

SEQ ID NO: 994280 - RNA, 19 nt, Human
ccagguggaacugagguag

SEQ ID NO: 994281 - RNA, 22 nt, Human
gccaggcucucagugacugccc

SEQ ID NO: 994282 - RNA, 22 nt, Human
agaguucagcuacugcaaaugu

SEQ ID NO: 994283 - RNA, 22 nt, Human
agagcuggccagggaucacucu

SEQ ID NO: 994284 - RNA, 22 nt, Human
cacccacauggaaauucacagu

SEQ ID NO: 994285 - RNA, 22 nt, Human
agagguagagguugcagugagc

SEQ ID NO: 994286 - RNA, 22 nt, Human
cagaaaaccugacucuagaacu

SEQ ID NO: 994287 - RNA, 22 nt, Human
gagcagcugcagugcagacccu

SEQ ID NO: 994288 - RNA, 19 nt, Human
ggagccuggagcacgugcc

SEQ ID NO: 994289 - RNA, 22 nt, Human
uggccucaagucugagggccuu

SEQ ID NO: 994290 - RNA, 19 nt, Human
uggcauugguccagauaaa

SEQ ID NO: 994291 - RNA, 22 nt, Human
aagaaaagaaaccugaggcuuu

SEQ ID NO: 994292 - RNA, 22 nt, Human
ccugggcaucucaugcaccugc

SEQ ID NO: 994293 - RNA, 17 nt, Human
uagagcugguucaggag

SEQ ID NO: 994294 - RNA, 22 nt, Human
cuuauguaaacuacagauaaua

SEQ ID NO: 994295 - RNA, 22 nt, Human
cucaggaucgcuugcccuaggg

SEQ ID NO: 994296 - RNA, 22 nt, Human
uggcagcagacaaaaggccauu

SEQ ID NO: 994297 - RNA, 22 nt, Human
gcagggccagguacaagaagca

SEQ ID NO: 994298 - RNA, 22 nt, Human
uauuuaaaaagaggccagcugg

SEQ ID NO: 994299 - RNA, 22 nt, Human
ccagggcagaaaaagagggaau

SEQ ID NO: 994300 - RNA, 22 nt, Human
uggccuggaaaaaugcagaugg

SEQ ID NO: 994301 - RNA, 22 nt, Human
cugggcaguuuauucaguucug

SEQ ID NO: 994302 - RNA, 22 nt, Human
cuggcuggucaucagcaguacg

SEQ ID NO: 994303 - RNA, 22 nt, Human
ugccaggagagugcaugcaggg

SEQ ID NO: 994304 - RNA, 21 nt, Human
gucaaacuugcaccagugccc

SEQ ID NO: 994305 - RNA, 22 nt, Human
cucugaacucuugggcagcaug

SEQ ID NO: 994306 - RNA, 22 nt, Human
gcugggagccguaccugucacg

SEQ ID NO: 994307 - RNA, 22 nt, Human
gucucuggguuaagcagugcau

SEQ ID NO: 994308 - RNA, 22 nt, Human
uggccugaggcucggcaugggu

SEQ ID NO: 994309 - RNA, 22 nt, Human
gagggcuccauuccccgugccc

SEQ ID NO: 994310 - RNA, 22 nt, Human
agacagcugcucgcagagcuau

SEQ ID NO: 994311 - RNA, 22 nt, Human
caaacugagcaucagaaaguuu

SEQ ID NO: 994312 - RNA, 22 nt, Human
ugcuggggauccguaccaaccc

SEQ ID NO: 994313 - RNA, 22 nt, Human
gccagcuggagugagagugggc

SEQ ID NO: 994314 - RNA, 22 nt, Human
uccuugaaugaauguucucucc

SEQ ID NO: 994315 - RNA, 22 nt, Human
ccugugucuuccccacuggugu

SEQ ID NO: 994316 - RNA, 22 nt, Human
ugggagcucagaaagggagguc

SEQ ID NO: 994317 - RNA, 21 nt, Human
guauucuuuaugaagugaaaa

SEQ ID NO: 994318 - RNA, 20 nt, Human
gcacugaagguuccagggga

SEQ ID NO: 994319 - RNA, 22 nt, Human
aacagaauugcugcugccaaug

SEQ ID NO: 994320 - RNA, 20 nt, Human
uccagccacuuccgcugguc

SEQ ID NO: 994321 - RNA, 22 nt, Human
uacccaggagaaacagcagggc

SEQ ID NO: 994322 - RNA, 22 nt, Human
aucuuucaguuucauaccaauu

SEQ ID NO: 994323 - RNA, 22 nt, Human
cucuucagauaaaagggauauu

SEQ ID NO: 994324 - RNA, 18 nt, Human
ucagagguacagaaaagu

SEQ ID NO: 994325 - RNA, 22 nt, Human
uuacaguauuguuaaacucuuu

SEQ ID NO: 994326 - RNA, 22 nt, Human
gcugucacaagcaucuggggca

SEQ ID NO: 994327 - RNA, 22 nt, Human
acagggccaggugagaggugcu

SEQ ID NO: 994328 - RNA, 22 nt, Human
ggcaaaaaccauaauuacuuuu

SEQ ID NO: 994329 - RNA, 22 nt, Human
ggaggagacccugugucaguuu

SEQ ID NO: 994330 - RNA, 21 nt, Human
gcagagccugagguucuugag

SEQ ID NO: 994331 - RNA, 22 nt, Human
caggggcagucugugugcgugg

SEQ ID NO: 994332 - RNA, 22 nt, Human
uaagcuauuccugaagaagguu

SEQ ID NO: 994333 - RNA, 22 nt, Human
gaggaggcuggcgccgccugcc

SEQ ID NO: 994334 - RNA, 22 nt, Human
gugcucacugugagacguccug

SEQ ID NO: 994335 - RNA, 22 nt, Human
gugccucagcaccgccugcagc

SEQ ID NO: 994336 - RNA, 22 nt, Human
gggaaggagccugcuugcuaga

SEQ ID NO: 994337 - RNA, 22 nt, Human
gggaucagaaacauagcccuga

SEQ ID NO: 994338 - RNA, 22 nt, Human
cagaccugagguugaguaccag

SEQ ID NO: 994339 - RNA, 22 nt, Human
ucuuccagcaaugugaaaucac

SEQ ID NO: 994340 - RNA, 17 nt, Human
agugacuuggaaagagc

SEQ ID NO: 994341 - RNA, 22 nt, Human
caauauucaguggaaaagccau

SEQ ID NO: 994342 - RNA, 22 nt, Human
gcugccuguccugaggaguccg

SEQ ID NO: 994343 - RNA, 22 nt, Human
ugaggcaguucuuacuuguauu

SEQ ID NO: 994344 - RNA, 20 nt, Human
auaaaauaacugccacaaga

SEQ ID NO: 994345 - RNA, 22 nt, Human
ucagagcuaaggggagagcaaa

SEQ ID NO: 994346 - RNA, 22 nt, Human
agugucauaugccacugcaucc

SEQ ID NO: 994347 - RNA, 22 nt, Human
gggugggaacaggaugccagga

SEQ ID NO: 994348 - RNA, 22 nt, Human
uaugcacauucacacaaaaaug

SEQ ID NO: 994349 - RNA, 22 nt, Human
guuuauuaacugucaagugauu

SEQ ID NO: 994350 - RNA, 22 nt, Human
cugaccaucauggugaaacccc

SEQ ID NO: 994351 - RNA, 21 nt, Human
uaagaacauuaucuucuuccu

SEQ ID NO: 994352 - RNA, 22 nt, Human
acagaguagcucaagaagauug

SEQ ID NO: 994353 - RNA, 22 nt, Human
cugccucugguuuuggucccug

SEQ ID NO: 994354 - RNA, 22 nt, Human
guuacacaggaaaacauuagca

SEQ ID NO: 994355 - RNA, 22 nt, Human
cacuuaagcaguuaauuuaucu

SEQ ID NO: 994356 - RNA, 22 nt, Human
ucucaggcuaccuugcacaagg

SEQ ID NO: 994357 - RNA, 22 nt, Human
cucugcagaggcccaaggcuga

SEQ ID NO: 994358 - RNA, 22 nt, Human
ccagagcccagggucaugcagg

SEQ ID NO: 994359 - RNA, 22 nt, Human
uuggccaagauacgagcacaua

SEQ ID NO: 994360 - RNA, 22 nt, Human
gggggcuggacuuucccacaca

SEQ ID NO: 994361 - RNA, 22 nt, Human
gagcucugggaaacaaagugua

SEQ ID NO: 994362 - RNA, 22 nt, Human
cagcuccagcccaggcagcucc

SEQ ID NO: 994363 - RNA, 22 nt, Human
uccaguggguugcugagggagg

SEQ ID NO: 994364 - RNA, 16 nt, Human
gucuggccuaccugcc

SEQ ID NO: 994365 - RNA, 22 nt, Human
augugugccccuuuuacucuuu

SEQ ID NO: 994366 - RNA, 22 nt, Human
gccucugcacuguggcacacca

SEQ ID NO: 994367 - RNA, 22 nt, Human
cccuggaggucagaggccuggg

SEQ ID NO: 994368 - RNA, 22 nt, Human
agccagagagccccagguucua

SEQ ID NO: 994369 - RNA, 22 nt, Human
cauuaucugccauugacaccau

SEQ ID NO: 994370 - RNA, 23 nt, Human
ugcugggcagagcuggugcugag

SEQ ID NO: 994371 - RNA, 22 nt, Human
ccugggaggcggagguugcagu

SEQ ID NO: 994372 - RNA, 22 nt, Human
acaaaugcaaguuuuaugucaa

SEQ ID NO: 994373 - RNA, 22 nt, Human
agggccugagcuggcugaccuc

SEQ ID NO: 994374 - RNA, 22 nt, Human
ugcuuuauguuaucagaagggu

SEQ ID NO: 994375 - RNA, 22 nt, Human
cugucccagauguucucagcac

SEQ ID NO: 994376 - RNA, 20 nt, Human
uggagccacagucagguucc

SEQ ID NO: 994377 - RNA, 22 nt, Human
ugcugcucuucaccauggccuc

SEQ ID NO: 994378 - RNA, 22 nt, Human
cagguggggagaguguggagca

SEQ ID NO: 994379 - RNA, 22 nt, Human
acugucacuccaacugagucgu

SEQ ID NO: 994380 - RNA, 22 nt, Human
uucacaggugacuggggauaac

SEQ ID NO: 994381 - RNA, 22 nt, Human
cagggcagaaggcacucuacuc

SEQ ID NO: 994382 - RNA, 22 nt, Human
cagcaauaguguguuuguuuca

SEQ ID NO: 994383 - RNA, 22 nt, Human
ggaggaccugcuggcccugcaa

SEQ ID NO: 994384 - RNA, 22 nt, Human
gauuucaaaaguagauccauca

SEQ ID NO: 994385 - RNA, 22 nt, Human
ucagggcaagauugguuaauaa

SEQ ID NO: 994386 - RNA, 22 nt, Human
auguucaaacuuuuuacacacc

SEQ ID NO: 994387 - RNA, 22 nt, Human
gucaaacaaauuaacauaucca

SEQ ID NO: 994388 - RNA, 22 nt, Human
cagugggugaugaguccugggg

SEQ ID NO: 994389 - RNA, 22 nt, Human
gcuggccauggggagugaggag

SEQ ID NO: 994390 - RNA, 22 nt, Human
gcugucugggaggccuccacuu

SEQ ID NO: 994391 - RNA, 22 nt, Human
aauaauguugacgauagucuua

SEQ ID NO: 994392 - RNA, 22 nt, Human
ugggaauggaugcuaagugcua

SEQ ID NO: 994393 - RNA, 22 nt, Human
cagaagcaaaugccuugcugag

SEQ ID NO: 994394 - RNA, 22 nt, Human
cugagccaccggcagggacauc

SEQ ID NO: 994395 - RNA, 22 nt, Human
acaggcugacuuccugccaugu

SEQ ID NO: 994396 - RNA, 22 nt, Human
uugacaaugcacugugcuaagu

SEQ ID NO: 994397 - RNA, 22 nt, Human
cagagcagagugauuguucugg

SEQ ID NO: 994398 - RNA, 22 nt, Human
uguaggauuuucaccagaccuu

SEQ ID NO: 994399 - RNA, 22 nt, Human
cauuucugugacacuuccaucu

SEQ ID NO: 994400 - RNA, 22 nt, Human
uagaaacacagaucugguguca

SEQ ID NO: 994401 - RNA, 22 nt, Human
ggagcugcacgcucugaagccu

SEQ ID NO: 994402 - RNA, 22 nt, Human
cugggcugcagcgggagcgacg

SEQ ID NO: 994403 - RNA, 22 nt, Human
cuggcugcuggccugaggaugc

SEQ ID NO: 994404 - RNA, 22 nt, Human
ccugagccucuugcacgcucag

SEQ ID NO: 994405 - RNA, 22 nt, Human
guuuacaaauauuuuaaauggu

SEQ ID NO: 994406 - RNA, 22 nt, Human
uagaauauacacuacagcuuaa

SEQ ID NO: 994407 - RNA, 22 nt, Human
aggagccuccuucucaugugca

SEQ ID NO: 994408 - RNA, 22 nt, Human
cuugugcaauugacauugaauc

SEQ ID NO: 994409 - RNA, 22 nt, Human
uggugcaagucucugaggaggg

SEQ ID NO: 994410 - RNA, 22 nt, Human
uuacuuuggauggucaagaaag

SEQ ID NO: 994411 - RNA, 22 nt, Human
cacuggugacuucugagcugga

SEQ ID NO: 994412 - RNA, 22 nt, Human
ucaugcaaggcugaaacauggu

SEQ ID NO: 994413 - RNA, 22 nt, Human
ccgggccucgggacaccgggua

SEQ ID NO: 994414 - RNA, 22 nt, Human
cucaggguaaugaaagacgaau

SEQ ID NO: 994415 - RNA, 22 nt, Human
gcaggaugagugaguacauuua

SEQ ID NO: 994416 - RNA, 20 nt, Human
gcaaauggaucccacaagcc

SEQ ID NO: 994417 - RNA, 22 nt, Human
uuaucguacgcuucagaaauuu

SEQ ID NO: 994418 - RNA, 22 nt, Human
gucagcaggguccccuugagug

SEQ ID NO: 994419 - RNA, 22 nt, Human
uuauuauuuuguguacagcaaa

SEQ ID NO: 994420 - RNA, 22 nt, Human
gcauguguggaggagaugugcu

SEQ ID NO: 994421 - RNA, 22 nt, Human
gccuggcaaggcccuguugacu

SEQ ID NO: 994422 - RNA, 22 nt, Human
aaauguauccuacuuccugagu

SEQ ID NO: 994423 - RNA, 22 nt, Human
uuccuggcgccacggagccggu

SEQ ID NO: 994424 - RNA, 22 nt, Human
cugccacuuucacccagugcuc

SEQ ID NO: 994425 - RNA, 20 nt, Human
cugggcugcccagcuauggg

SEQ ID NO: 994426 - RNA, 19 nt, Human
uggcagcauugguaccuug

SEQ ID NO: 994427 - RNA, 22 nt, Human
caaauguguagagcuuuugggg

SEQ ID NO: 994428 - RNA, 22 nt, Human
ccugucuggccuuccacggggg

SEQ ID NO: 994429 - RNA, 22 nt, Human
cauuucugucacguucuuuuau

SEQ ID NO: 994430 - RNA, 17 nt, Human
acacagccagguucucc

SEQ ID NO: 994431 - RNA, 22 nt, Human
cuuuauguucaguacaaugcuu

SEQ ID NO: 994432 - RNA, 22 nt, Human
acaaagucugaaaccugaggca

SEQ ID NO: 994433 - RNA, 22 nt, Human
ucuuugcaugcauuuucccuua

SEQ ID NO: 994434 - RNA, 17 nt, Human
ucaggauccaggguucu

SEQ ID NO: 994435 - RNA, 22 nt, Human
cuauuaggcuuccauuucaugc

SEQ ID NO: 994436 - RNA, 22 nt, Human
gccaggcagcaggaagccagug

SEQ ID NO: 994437 - RNA, 22 nt, Human
gccucugcgccucagccgaccu

SEQ ID NO: 994438 - RNA, 22 nt, Human
cagguggcuucucccuaggcca

SEQ ID NO: 994439 - RNA, 22 nt, Human
cagguaagagacggauuggccc

SEQ ID NO: 994440 - RNA, 22 nt, Human
guccuggguccccgcaggucag

SEQ ID NO: 994441 - RNA, 22 nt, Human
guccucugaaguugugcaaugc

SEQ ID NO: 994442 - RNA, 22 nt, Human
caagauggacauaaggagagaa

SEQ ID NO: 994443 - RNA, 20 nt, Human
gcacugaaauucaauguuug

SEQ ID NO: 994444 - RNA, 22 nt, Human
ucauugcaguagggagagaccc

SEQ ID NO: 994445 - RNA, 22 nt, Human
gcaggagcucguuuccaggcug

SEQ ID NO: 994446 - RNA, 22 nt, Human
agcaggaaagaaaaaucugugu

SEQ ID NO: 994447 - RNA, 22 nt, Human
guuuagaauucuaacuuuaagg

SEQ ID NO: 994448 - RNA, 20 nt, Human
gccuguccugagugucaugg

SEQ ID NO: 994449 - RNA, 22 nt, Human
agaugaagacucaggagcaggu

SEQ ID NO: 994450 - RNA, 22 nt, Human
gagcugccugaacaagcagcag

SEQ ID NO: 994451 - RNA, 22 nt, Human
cugcccugggaguaccuguccu

SEQ ID NO: 994452 - RNA, 22 nt, Human
uaugaagacaaugauagcauga

SEQ ID NO: 994453 - RNA, 19 nt, Human
ugccuggcaccagcuccac

SEQ ID NO: 994454 - RNA, 22 nt, Human
gccucugccaagggggcugcgg

SEQ ID NO: 994455 - RNA, 22 nt, Human
cagagacauuaagugccaugau

SEQ ID NO: 994456 - RNA, 21 nt, Human
gcuccuggugcugcguggcgc

SEQ ID NO: 994457 - RNA, 22 nt, Human
gcaggcaguuauuuaguagaau

SEQ ID NO: 994458 - RNA, 22 nt, Human
cccaggccagaacuugguugcu

SEQ ID NO: 994459 - RNA, 17 nt, Human
uuccacaauaguuuguc

SEQ ID NO: 994460 - RNA, 22 nt, Human
ccaggaagccucagaugcugag

SEQ ID NO: 994461 - RNA, 22 nt, Human
ucuggcuccuggcuccacugcc

SEQ ID NO: 994462 - RNA, 21 nt, Human
agaaaaguagaguuuucagag

SEQ ID NO: 994463 - RNA, 22 nt, Human
cugugcccuggccaggccucuc

SEQ ID NO: 994464 - RNA, 22 nt, Human
ggccugugagcccuugcaugua

SEQ ID NO: 994465 - RNA, 19 nt, Human
cucuggagcagacacugga

SEQ ID NO: 994466 - RNA, 22 nt, Human
ucacucuguguuucccugggac

SEQ ID NO: 994467 - RNA, 22 nt, Human
ugacauaaaucuaaaggaaagg

SEQ ID NO: 994468 - RNA, 22 nt, Human
ucagaguguuuuacuaaacaag

SEQ ID NO: 994469 - RNA, 22 nt, Human
caagagcugaggcuggagaggu

SEQ ID NO: 994470 - RNA, 19 nt, Human
gagcagcugcacccauuga

SEQ ID NO: 994471 - RNA, 22 nt, Human
agaaaucuaagaugcucaagga

SEQ ID NO: 994472 - RNA, 22 nt, Human
uggcccugugugcaggcugcac

SEQ ID NO: 994473 - RNA, 22 nt, Human
cugugucccaguaccuugggua

SEQ ID NO: 994474 - RNA, 22 nt, Human
cagaguguuagcgcugguuggg

SEQ ID NO: 994475 - RNA, 22 nt, Human
caugaagcacagcucucuuuuu

SEQ ID NO: 994476 - RNA, 22 nt, Human
aggcaagggggcgccaccuucc

SEQ ID NO: 994477 - RNA, 22 nt, Human
cuggccgguauuugccucuggg

SEQ ID NO: 994478 - RNA, 22 nt, Human
cagcuguggcugccacugcucc

SEQ ID NO: 994479 - RNA, 22 nt, Human
ucuucucccaucuccaggcagg

SEQ ID NO: 994480 - RNA, 22 nt, Human
ugugcuucagguugucgccacg

SEQ ID NO: 994481 - RNA, 23 nt, Human
acucagcuuugggagaugacuca

SEQ ID NO: 994482 - RNA, 22 nt, Human
ccugagacaugaaccaggcucc

SEQ ID NO: 994483 - RNA, 22 nt, Human
uugugucccccuuugagagcca

SEQ ID NO: 994484 - RNA, 22 nt, Human
uauugacaauaggcaacugagg

SEQ ID NO: 994485 - RNA, 22 nt, Human
ucugagagccucuagccuaagu

SEQ ID NO: 994486 - RNA, 22 nt, Human
aaauugugcucacacugauauu

SEQ ID NO: 994487 - RNA, 22 nt, Human
ugucaugccaccguuucccaga

SEQ ID NO: 994488 - RNA, 22 nt, Human
cuccuggcccugagcucccagg

SEQ ID NO: 994489 - RNA, 22 nt, Human
cugccaggacugacgucuucag

SEQ ID NO: 994490 - RNA, 20 nt, Human
cccaggagugagcagcuuua

SEQ ID NO: 994491 - RNA, 22 nt, Human
ucaguggagcuaagcaugagau

SEQ ID NO: 994492 - RNA, 22 nt, Human
ucucugucugagccuggcagac

SEQ ID NO: 994493 - RNA, 20 nt, Human
ucucugcuguccacauuugc

SEQ ID NO: 994494 - RNA, 22 nt, Human
augugaggaagaaagagguaag

SEQ ID NO: 994495 - RNA, 22 nt, Human
uuuaugagcaccuuggcccaga

SEQ ID NO: 994496 - RNA, 22 nt, Human
ugucccaggccucauguugcca

SEQ ID NO: 994497 - RNA, 22 nt, Human
uccaagaucuacagcaguuuag

SEQ ID NO: 994498 - RNA, 22 nt, Human
augucacagcucccauuccucc

SEQ ID NO: 994499 - RNA, 22 nt, Human
uauuaggguaaauuugacaugc

SEQ ID NO: 994500 - RNA, 22 nt, Human
acacagggaggaggugcugugc

SEQ ID NO: 994501 - RNA, 22 nt, Human
ccagagccucgcccggagccuc

SEQ ID NO: 994502 - RNA, 22 nt, Human
uuggaggcaaugggaaggaggc

SEQ ID NO: 994503 - RNA, 22 nt, Human
gcugagugauugauauuuuagu

SEQ ID NO: 994504 - RNA, 22 nt, Human
aaggcacuuuucuaaagaccuu

SEQ ID NO: 994505 - RNA, 20 nt, Human
agacccuguguccuguggcc

SEQ ID NO: 994506 - RNA, 22 nt, Human
uuuuagaaauacugauuuagug

SEQ ID NO: 994507 - RNA, 17 nt, Human
gcugagugcagggaguc

SEQ ID NO: 994508 - RNA, 22 nt, Human
uccuaggcaguuggugcuccau

SEQ ID NO: 994509 - RNA, 22 nt, Human
gcaggaugggagcuucacucug

SEQ ID NO: 994510 - RNA, 22 nt, Human
auuuugaaaagcauuugaguaa

SEQ ID NO: 994511 - RNA, 22 nt, Human
ggccugggcccacugucaagag

SEQ ID NO: 994512 - RNA, 22 nt, Human
ugcagaccucccauggcugccu

SEQ ID NO: 994513 - RNA, 23 nt, Human
ugucauugugacuacagaaccag

SEQ ID NO: 994514 - RNA, 21 nt, Human
cacaggugggucagugaggcc

SEQ ID NO: 994515 - RNA, 22 nt, Human
aaacaugagcaucucuucaagc

SEQ ID NO: 994516 - RNA, 22 nt, Human
gaggcagagugcaccccaggag

SEQ ID NO: 994517 - RNA, 22 nt, Human
aacacauaggcagagcaugaca

SEQ ID NO: 994518 - RNA, 22 nt, Human
guggcugcagagccagcaagcu

SEQ ID NO: 994519 - RNA, 22 nt, Human
agccauugaguuuuaugugcua

SEQ ID NO: 994520 - RNA, 22 nt, Human
aggguauguuuuuaucuacugu

SEQ ID NO: 994521 - RNA, 22 nt, Human
gugucccagccccacaggccug

SEQ ID NO: 994522 - RNA, 21 nt, Human
aguguccuugaucuugccuug

SEQ ID NO: 994523 - RNA, 22 nt, Human
ucuccuggcauuugguugagua

SEQ ID NO: 994524 - RNA, 22 nt, Human
agggacacaugugauuauuuau

SEQ ID NO: 994525 - RNA, 22 nt, Human
agcaucuggugagggccuaguu

SEQ ID NO: 994526 - RNA, 22 nt, Human
agccacagagguugaugugguu

SEQ ID NO: 994527 - RNA, 22 nt, Human
uuuuagauugggaaauguaaag

SEQ ID NO: 994528 - RNA, 22 nt, Human
uauauguaagcuauguaagagu

SEQ ID NO: 994529 - RNA, 22 nt, Human
guggcccucugauagggucagg

SEQ ID NO: 994530 - RNA, 22 nt, Human
aaggagaguacaggaguuggua

SEQ ID NO: 994531 - RNA, 22 nt, Human
acagggcagagaggcaggcuug

SEQ ID NO: 994532 - RNA, 22 nt, Human
cagcaugguggagcugcucuuu

SEQ ID NO: 994533 - RNA, 22 nt, Human
gccagggagucugggccacaga

SEQ ID NO: 994534 - RNA, 22 nt, Human
cugcugagguccuugcucagac

SEQ ID NO: 994535 - RNA, 22 nt, Human
ccagggugggaggcugaaggcg

SEQ ID NO: 994536 - RNA, 22 nt, Human
uuccaguucccaugaggauuaa

SEQ ID NO: 994537 - RNA, 22 nt, Human
cugccacuuacuaggcauggug

SEQ ID NO: 994538 - RNA, 22 nt, Human
ggcucugcccagaugaagagga

SEQ ID NO: 994539 - RNA, 22 nt, Human
gugcuuucugcaugguuccuac

SEQ ID NO: 994540 - RNA, 22 nt, Human
aggguggggugcuacaucuuua

SEQ ID NO: 994541 - RNA, 22 nt, Human
agguaaagacugcaaggagaau

SEQ ID NO: 994542 - RNA, 20 nt, Human
aacacacugguggcaucagg

SEQ ID NO: 994543 - RNA, 22 nt, Human
agggaagaugucucaucuuagg

SEQ ID NO: 994544 - RNA, 22 nt, Human
agcugccuguccuaggccauca

SEQ ID NO: 994545 - RNA, 22 nt, Human
uugcuauuuugagagucauagu

SEQ ID NO: 994546 - RNA, 22 nt, Human
cagcugccugcaacacaagcuu

SEQ ID NO: 994547 - RNA, 22 nt, Human
gagagcuggauucuggauaggu

SEQ ID NO: 994548 - RNA, 22 nt, Human
ugacagaacagguugggagcaa

SEQ ID NO: 994549 - RNA, 22 nt, Human
gcugagagaaaagugagguucu

SEQ ID NO: 994550 - RNA, 22 nt, Human
cagggccaguucucgcagcagu

SEQ ID NO: 994551 - RNA, 22 nt, Human
agaauuguaagcaauuugauua

SEQ ID NO: 994552 - RNA, 21 nt, Human
agcagaacagucgagcacugc

SEQ ID NO: 994553 - RNA, 22 nt, Human
gcugucaggccaugugggccuu

SEQ ID NO: 994554 - RNA, 22 nt, Human
ggcucagguugggucacaugac

SEQ ID NO: 994555 - RNA, 22 nt, Human
cagggcaggaugcugugauuau

SEQ ID NO: 994556 - RNA, 22 nt, Human
agaagccaacagggcaggagag

SEQ ID NO: 994557 - RNA, 22 nt, Human
gcugugcagccaagugccucug

SEQ ID NO: 994558 - RNA, 22 nt, Human
cagccuuugggucagaagauuc

SEQ ID NO: 994559 - RNA, 22 nt, Human
aauaauguuaugucauucuucu

SEQ ID NO: 994560 - RNA, 22 nt, Human
cagacacagcaauucuguguug

SEQ ID NO: 994561 - RNA, 22 nt, Human
cccugaggggaguggugaggug

SEQ ID NO: 994562 - RNA, 22 nt, Human
ugcugggggcuuucuggauacc

SEQ ID NO: 994563 - RNA, 21 nt, Human
gccacugcacuccagccuggg

SEQ ID NO: 994564 - RNA, 22 nt, Human
caugugucaaaugauguagcug

SEQ ID NO: 994565 - RNA, 22 nt, Human
gcugucccgaaccccugguaau

SEQ ID NO: 994566 - RNA, 22 nt, Human
gauuucaagcccccagagauuc

SEQ ID NO: 994567 - RNA, 22 nt, Human
ugccugggaaccaauccuggcu

SEQ ID NO: 994568 - RNA, 22 nt, Human
ucauggagacuuugagccuguu

SEQ ID NO: 994569 - RNA, 22 nt, Human
gggcaugguggugcacaccugu

SEQ ID NO: 994570 - RNA, 22 nt, Human
aaggacagaaacagauugcugg

SEQ ID NO: 994571 - RNA, 22 nt, Human
uccagggagauggcagaggcug

SEQ ID NO: 994572 - RNA, 22 nt, Human
agaccacagucaggcuccuggu

SEQ ID NO: 994573 - RNA, 22 nt, Human
uggcagacuuuagggucuacau

SEQ ID NO: 994574 - RNA, 22 nt, Human
gaagcucucaaacucuccccuu

SEQ ID NO: 994575 - RNA, 22 nt, Human
uacaaagcuguauagccugguc

SEQ ID NO: 994576 - RNA, 22 nt, Human
cauugaaaaacguugacugagu

SEQ ID NO: 994577 - RNA, 22 nt, Human
ugcucccagggacucuggcugg

SEQ ID NO: 994578 - RNA, 22 nt, Human
caggccugaguguggaagucuu

SEQ ID NO: 994579 - RNA, 22 nt, Human
cucugggcaaguaugauagaaa

SEQ ID NO: 994580 - RNA, 22 nt, Human
uuucacauuuuauacuuaagcc

SEQ ID NO: 994581 - RNA, 22 nt, Human
agcagagcuauucuugugcaau

SEQ ID NO: 994582 - RNA, 22 nt, Human
uugcauaaaagaguauaucuua

SEQ ID NO: 994583 - RNA, 22 nt, Human
ggcucugcuucagaaggcucau

SEQ ID NO: 994584 - RNA, 22 nt, Human
ccuggcagguggagguugcagu

SEQ ID NO: 994585 - RNA, 22 nt, Human
ugucaugccaggaaauaguccc

SEQ ID NO: 994586 - RNA, 22 nt, Human
augcaguacugauacaugccac

SEQ ID NO: 994587 - RNA, 19 nt, Human
guggccucggagcgcgcgg

SEQ ID NO: 994588 - RNA, 19 nt, Human
acauuuagaauguacuugc

SEQ ID NO: 994589 - RNA, 22 nt, Human
caguguggagggagagagccug

SEQ ID NO: 994590 - RNA, 22 nt, Human
aggcagcaugcucugcuucuac

SEQ ID NO: 994591 - RNA, 22 nt, Human
cuggguggcgucuggggccagu

SEQ ID NO: 994592 - RNA, 21 nt, Human
agaaaauggcguuuuagauuu

SEQ ID NO: 994593 - RNA, 21 nt, Human
gcccagcaaggugagaaggcc

SEQ ID NO: 994594 - RNA, 22 nt, Human
ugaaagguuauuuaggucugcu

SEQ ID NO: 994595 - RNA, 22 nt, Human
aaggcacucauucaaggagaua

SEQ ID NO: 994596 - RNA, 17 nt, Human
agcugaaauugcugaag

SEQ ID NO: 994597 - RNA, 23 nt, Human
ucaaacauauugugagacacagg

SEQ ID NO: 994598 - RNA, 22 nt, Human
gcagagugggagcccagggcug

SEQ ID NO: 994599 - RNA, 22 nt, Human
cugaggcuuugugugcaugccu

SEQ ID NO: 994600 - RNA, 22 nt, Human
gccucugcaucuucgccgcacu

SEQ ID NO: 994601 - RNA, 22 nt, Human
ugguggcuguugcagaacugag

SEQ ID NO: 994602 - RNA, 22 nt, Human
ugucagugguagacccagaggu

SEQ ID NO: 994603 - RNA, 20 nt, Human
acugcuucuuucucugaccu

SEQ ID NO: 994604 - RNA, 22 nt, Human
ucucagaguuccucuggagucc

SEQ ID NO: 994605 - RNA, 22 nt, Human
uugcucugacuggagugcagug

SEQ ID NO: 994606 - RNA, 22 nt, Human
uagagcuggaauuugcagcaag

SEQ ID NO: 994607 - RNA, 22 nt, Human
ucuccucaccaccagcagcaga

SEQ ID NO: 994608 - RNA, 20 nt, Human
ccugucuccucuuaccuggc

SEQ ID NO: 994609 - RNA, 22 nt, Human
gaagcagcaaaucugcaguauc

SEQ ID NO: 994610 - RNA, 22 nt, Human
ggagagcagggaggcugcucug

SEQ ID NO: 994611 - RNA, 22 nt, Human
ucagggcaggcgagcagcugcu

SEQ ID NO: 994612 - RNA, 22 nt, Human
uggagugaaguaaagaggacaa

SEQ ID NO: 994613 - RNA, 20 nt, Human
gagggcaggcacccauuuca

SEQ ID NO: 994614 - RNA, 22 nt, Human
cucaugucuucacccauucuaa

SEQ ID NO: 994615 - RNA, 22 nt, Human
gcagcuuuguggagaggcccau

SEQ ID NO: 994616 - RNA, 20 nt, Human
gacauucauaguuauuacca

SEQ ID NO: 994617 - RNA, 22 nt, Human
acauuucuauagugcaucuguu

SEQ ID NO: 994618 - RNA, 22 nt, Human
ccucaggggugcccacagcugc

SEQ ID NO: 994619 - RNA, 22 nt, Human
cucucugguuucagcgaagggg

SEQ ID NO: 994620 - RNA, 22 nt, Human
cgggcagauugggaagguucau

SEQ ID NO: 994621 - RNA, 22 nt, Human
ccucagaggugaacaucagugc

SEQ ID NO: 994622 - RNA, 22 nt, Human
aaaaaaucagaucuuugguuaa

SEQ ID NO: 994623 - RNA, 22 nt, Human
ggcagcagggucuagauugaug

SEQ ID NO: 994624 - RNA, 22 nt, Human
cccagccagccucuucccauau

SEQ ID NO: 994625 - RNA, 22 nt, Human
caggggcugagaaggaacgucc

SEQ ID NO: 994626 - RNA, 22 nt, Human
uuucauuauucaugcuaguuau

SEQ ID NO: 994627 - RNA, 22 nt, Human
cagggagaggcaucauagggaa

SEQ ID NO: 994628 - RNA, 22 nt, Human
cucucuggaagggggagcugau

SEQ ID NO: 994629 - RNA, 22 nt, Human
aucuggcuauuucuggucgggg

SEQ ID NO: 994630 - RNA, 22 nt, Human
auuaggcaauucugggcaucuc

SEQ ID NO: 994631 - RNA, 22 nt, Human
cagauaaaggcuuacuaguagu

SEQ ID NO: 994632 - RNA, 22 nt, Human
agggccugggauguccuccuag

SEQ ID NO: 994633 - RNA, 22 nt, Human
acacaugcugauaagaauauaa

SEQ ID NO: 994634 - RNA, 22 nt, Human
cugugucucuccuuacaagacu

SEQ ID NO: 994635 - RNA, 22 nt, Human
augugagguaucuaggucuucg

SEQ ID NO: 994636 - RNA, 22 nt, Human
ccuucugcuggucaucccagug

SEQ ID NO: 994637 - RNA, 22 nt, Human
ccucucucuccugcacacacac

SEQ ID NO: 994638 - RNA, 18 nt, Human
uggcucugcagccagaug

SEQ ID NO: 994639 - RNA, 22 nt, Human
uaauaggagccaggucacauag

SEQ ID NO: 994640 - RNA, 22 nt, Human
cugagggcccugaagcuuggca

SEQ ID NO: 994641 - RNA, 22 nt, Human
cagcagcugauggggaagugau

SEQ ID NO: 994642 - RNA, 22 nt, Human
gcucugcugauccgcagccauc

SEQ ID NO: 994643 - RNA, 22 nt, Human
uagcuuuacaaagugcugcacc

SEQ ID NO: 994644 - RNA, 22 nt, Human
uccucacaagcaagcacaggua

SEQ ID NO: 994645 - RNA, 22 nt, Human
cagcaaaauuugaggauugccu

SEQ ID NO: 994646 - RNA, 22 nt, Human
ggccucucuccagucagugcag

SEQ ID NO: 994647 - RNA, 22 nt, Human
ugaaacacuuucaauuacauau

SEQ ID NO: 994648 - RNA, 22 nt, Human
gcaggggaguggcaggcccgga

SEQ ID NO: 994649 - RNA, 22 nt, Human
caggcugcagugcaguggcuau

SEQ ID NO: 994650 - RNA, 22 nt, Human
ggagccagggaagcugcuuccu

SEQ ID NO: 994651 - RNA, 22 nt, Human
ggcaaaaaguucccaucagugu

SEQ ID NO: 994652 - RNA, 22 nt, Human
cacagcuggugcacuagcucug

SEQ ID NO: 994653 - RNA, 22 nt, Human
caaaugcuaacuucuuuccaaa

SEQ ID NO: 994654 - RNA, 22 nt, Human
augcacgccccacacuggugug

SEQ ID NO: 994655 - RNA, 22 nt, Human
gccuggagcucuccacuugggg

SEQ ID NO: 994656 - RNA, 22 nt, Human
ugaaagcacaaguucuaacagg

SEQ ID NO: 994657 - RNA, 22 nt, Human
acauuaaugaggugaugacaca

SEQ ID NO: 994658 - RNA, 22 nt, Human
auucuguauuucuaauaagauc

SEQ ID NO: 994659 - RNA, 22 nt, Human
aagccagggucaggggccuccu

SEQ ID NO: 994660 - RNA, 22 nt, Human
guggccaggacauugccaggca

SEQ ID NO: 994661 - RNA, 18 nt, Human
ccgggcuuuggugacaca

SEQ ID NO: 994662 - RNA, 22 nt, Human
ggcaggagaauggcgugaacuc

SEQ ID NO: 994663 - RNA, 22 nt, Human
ggucccagaauugguuagcaca

SEQ ID NO: 994664 - RNA, 22 nt, Human
ugucacagggauaccauggggc

SEQ ID NO: 994665 - RNA, 22 nt, Human
ucuacuuuucccuauacaguuu

SEQ ID NO: 994666 - RNA, 22 nt, Human
ggcucugccugcccagcagcac

SEQ ID NO: 994667 - RNA, 22 nt, Human
gagcuguccgccccugggccga

SEQ ID NO: 994668 - RNA, 22 nt, Human
guuauguauugggaaauccaag

SEQ ID NO: 994669 - RNA, 22 nt, Human
cuucuuaucaaguggcaaaucu

SEQ ID NO: 994670 - RNA, 22 nt, Human
cacauguaguaagcaggcaaug

SEQ ID NO: 994671 - RNA, 22 nt, Human
cuggguggaucgcagccccagg

SEQ ID NO: 994672 - RNA, 22 nt, Human
ugcugccuugaccuccugggcu

SEQ ID NO: 994673 - RNA, 22 nt, Human
uaaggucauggugaauaauaag

SEQ ID NO: 994674 - RNA, 22 nt, Human
guaucuuuuacaccaggaaauu

SEQ ID NO: 994675 - RNA, 22 nt, Human
guuauaaaugacugcaaaaguu

SEQ ID NO: 994676 - RNA, 22 nt, Human
caggaccccauauucacugaac

SEQ ID NO: 994677 - RNA, 22 nt, Human
uggagccagcccaggccccucu

SEQ ID NO: 994678 - RNA, 22 nt, Human
gagacaaaaguuggagugcaag

SEQ ID NO: 994679 - RNA, 22 nt, Human
ucccugggccacagcugugagc

SEQ ID NO: 994680 - RNA, 22 nt, Human
aagcaugugcuggggcuuuuug

SEQ ID NO: 994681 - RNA, 22 nt, Human
gagagugaugaaugguuaaaca

SEQ ID NO: 994682 - RNA, 22 nt, Human
uuucuguagggauuucacaguu

SEQ ID NO: 994683 - RNA, 22 nt, Human
gugccuggcacacagaaggcaa

SEQ ID NO: 994684 - RNA, 22 nt, Human
gaagccaguacugugcucugca

SEQ ID NO: 994685 - RNA, 22 nt, Human
ccuggcagcuaagugcuuugag

SEQ ID NO: 994686 - RNA, 22 nt, Human
uccucuggauauaagccucacc

SEQ ID NO: 994687 - RNA, 22 nt, Human
uagaaacagcauauauuagccc

SEQ ID NO: 994688 - RNA, 22 nt, Human
gcagggacaucuuugucuagua

SEQ ID NO: 994689 - RNA, 22 nt, Human
aagaugauaggacuugcuuaag

SEQ ID NO: 994690 - RNA, 22 nt, Human
ucuggcucuguguccucaccca

SEQ ID NO: 994691 - RNA, 22 nt, Human
ggcagauggagaagcagcaggu

SEQ ID NO: 994692 - RNA, 22 nt, Human
uuacaaagagugccagagugug

SEQ ID NO: 994693 - RNA, 22 nt, Human
agccuccaguagcugaagagac

SEQ ID NO: 994694 - RNA, 21 nt, Human
aaggccugcuuacugcuaguu

SEQ ID NO: 994695 - RNA, 22 nt, Human
agcaggagcugugggaagaugg

SEQ ID NO: 994696 - RNA, 22 nt, Human
ugaagccaucaggaagccagca

SEQ ID NO: 994697 - RNA, 22 nt, Human
gcugcccaggguggagccggcu

SEQ ID NO: 994698 - RNA, 22 nt, Human
agacaaaggauuaaugaugaug

SEQ ID NO: 994699 - RNA, 21 nt, Human
gagacagcccagugccagggc

SEQ ID NO: 994700 - RNA, 22 nt, Human
uauuagugaaagaauuaguuug

SEQ ID NO: 994701 - RNA, 22 nt, Human
aacaaaugauaccaguucucaa

SEQ ID NO: 994702 - RNA, 22 nt, Human
gccuggagagcacugugcgcuu

SEQ ID NO: 994703 - RNA, 22 nt, Human
cccagacauaacagcagagagg

SEQ ID NO: 994704 - RNA, 22 nt, Human
acucugcucuuuggacaaugcc

SEQ ID NO: 994705 - RNA, 22 nt, Human
uccuggagauaauugcagugaa

SEQ ID NO: 994706 - RNA, 22 nt, Human
aaugaacacagcccucuacuuu

SEQ ID NO: 994707 - RNA, 22 nt, Human
agucuucccugugccagagugu

SEQ ID NO: 994708 - RNA, 22 nt, Human
uuuuaucugugacaucuggcag

SEQ ID NO: 994709 - RNA, 22 nt, Human
aguaacucauguaaaccucaca

SEQ ID NO: 994710 - RNA, 22 nt, Human
agggcagccugagugcuggccc

SEQ ID NO: 994711 - RNA, 22 nt, Human
cacagaagaaucaugcuguguu

SEQ ID NO: 994712 - RNA, 20 nt, Human
aggagcugaauuagaggguu

SEQ ID NO: 994713 - RNA, 22 nt, Human
uaucuuuaacuugcaguauuua

SEQ ID NO: 994714 - RNA, 20 nt, Human
cccucugcacauggcugugg

SEQ ID NO: 994715 - RNA, 21 nt, Human
gugguuauuuucauuagcauc

SEQ ID NO: 994716 - RNA, 22 nt, Human
ugagcccuaagggucaagcagg

SEQ ID NO: 994717 - RNA, 21 nt, Human
ccucuggcuugugcugugccc

SEQ ID NO: 994718 - RNA, 22 nt, Human
auaaugugaagauaaugcaaga

SEQ ID NO: 994719 - RNA, 22 nt, Human
caaaguuaugaaugauaagauu

SEQ ID NO: 994720 - RNA, 22 nt, Human
caaaaguaauggcgguuuuuac

SEQ ID NO: 994721 - RNA, 21 nt, Human
uugaaggaucacuucuguacc

SEQ ID NO: 994722 - RNA, 21 nt, Human
cauuucuauugaugagaaaag

SEQ ID NO: 994723 - RNA, 22 nt, Human
ugcuggggucauggggcgcccg

SEQ ID NO: 994724 - RNA, 22 nt, Human
augugacaauauuuggucuuau

SEQ ID NO: 994725 - RNA, 21 nt, Human
guggcucugccaggacugaaa

SEQ ID NO: 994726 - RNA, 23 nt, Human
cuccuggaggguccggcccugcc

SEQ ID NO: 994727 - RNA, 22 nt, Human
cacugaagccacuggaagagga

SEQ ID NO: 994728 - RNA, 22 nt, Human
ccugagggcgccgagcucccag

SEQ ID NO: 994729 - RNA, 22 nt, Human
cagcagcucccauccgcugagc

SEQ ID NO: 994730 - RNA, 22 nt, Human
aagccaggcaugcuuggacagu

SEQ ID NO: 994731 - RNA, 22 nt, Human
uccucccacauaggacaauggg

SEQ ID NO: 994732 - RNA, 22 nt, Human
cagccuuuuccauguauuguug

SEQ ID NO: 994733 - RNA, 22 nt, Human
cugccugugugugccugcagaa

SEQ ID NO: 994734 - RNA, 22 nt, Human
uuuaaucaggcaaagcauaaua

SEQ ID NO: 994735 - RNA, 19 nt, Human
aauguaguguuaugucaac

SEQ ID NO: 994736 - RNA, 22 nt, Human
cagggacauugguggccagguu

SEQ ID NO: 994737 - RNA, 22 nt, Human
uccuggccugucuggaguagcu

SEQ ID NO: 994738 - RNA, 22 nt, Human
uguauuagaucugagaacuucu

SEQ ID NO: 994739 - RNA, 22 nt, Human
acauuaucccuggcacaacugc

SEQ ID NO: 994740 - RNA, 22 nt, Human
gcugagguaggagguugcagug

SEQ ID NO: 994741 - RNA, 22 nt, Human
agaggccagggacacugcucaa

SEQ ID NO: 994742 - RNA, 19 nt, Human
uggcugggugccaauggcc

SEQ ID NO: 994743 - RNA, 22 nt, Human
ucucaggaucuaauacauggua

SEQ ID NO: 994744 - RNA, 22 nt, Human
aucauuuaaaacaagucucuau

SEQ ID NO: 994745 - RNA, 22 nt, Human
ugggacugcucuugcugggguc

SEQ ID NO: 994746 - RNA, 22 nt, Human
aaacugcugguugcuggccagc

SEQ ID NO: 994747 - RNA, 23 nt, Human
gagagcugacugucaagacuguu

SEQ ID NO: 994748 - RNA, 22 nt, Human
agggcagagaucugagugggca

SEQ ID NO: 994749 - RNA, 22 nt, Human
ccaggaagcggugagggcugcc

SEQ ID NO: 994750 - RNA, 22 nt, Human
cagggccuucguaaguguccgg

SEQ ID NO: 994751 - RNA, 22 nt, Human
aagacccacaaggcugaauguu

SEQ ID NO: 994752 - RNA, 22 nt, Human
ccuggccuccuggccuucucau

SEQ ID NO: 994753 - RNA, 22 nt, Human
uuggccaauggugauucccggc

SEQ ID NO: 994754 - RNA, 23 nt, Human
ugcaggggaggcuuaaagcaggu

SEQ ID NO: 994755 - RNA, 22 nt, Human
augaguaaaaccacuauuuaca

SEQ ID NO: 994756 - RNA, 21 nt, Human
auacuuugaauuacagccuug

SEQ ID NO: 994757 - RNA, 22 nt, Human
cuggccagaguuggagggugug

SEQ ID NO: 994758 - RNA, 18 nt, Human
aggcacuggaauuaaggg

SEQ ID NO: 994759 - RNA, 22 nt, Human
uccuuucccuuuccauccuggc

SEQ ID NO: 994760 - RNA, 22 nt, Human
uggagcucaaaggccuguggga

SEQ ID NO: 994761 - RNA, 22 nt, Human
ggcagcucacugauuagcaauu

SEQ ID NO: 994762 - RNA, 20 nt, Human
accuuucaaaugauucagca

SEQ ID NO: 994763 - RNA, 22 nt, Human
agcagggcugcagugugucuuu

SEQ ID NO: 994764 - RNA, 22 nt, Human
uacaaaguagaaauucaguaaa

SEQ ID NO: 994765 - RNA, 22 nt, Human
cuggggaggcagggcugccccu

SEQ ID NO: 994766 - RNA, 22 nt, Human
ucauggcacuuagcacaguccu

SEQ ID NO: 994767 - RNA, 21 nt, Human
gcaggcuggucaaaccucagu

SEQ ID NO: 994768 - RNA, 22 nt, Human
guucacaagaugugguggggag

SEQ ID NO: 994769 - RNA, 22 nt, Human
gaggccuggguuggaggugcau

SEQ ID NO: 994770 - RNA, 22 nt, Human
uccuggccucacaguccugggu

SEQ ID NO: 994771 - RNA, 22 nt, Human
cuucaugcugauauccucgaug

SEQ ID NO: 994772 - RNA, 22 nt, Human
aagggcagcuauuaucgucauc

SEQ ID NO: 994773 - RNA, 22 nt, Human
cuuggcagagggcugggcucag

SEQ ID NO: 994774 - RNA, 22 nt, Human
caggcugaucagggcugggaug

SEQ ID NO: 994775 - RNA, 22 nt, Human
acucaagauagggaaaguacaa

SEQ ID NO: 994776 - RNA, 22 nt, Human
ucagagaacacagaggugaugu

SEQ ID NO: 994777 - RNA, 22 nt, Human
ucagcagggccuccuugugcag

SEQ ID NO: 994778 - RNA, 22 nt, Human
agagcuggcugguagcccugau

SEQ ID NO: 994779 - RNA, 22 nt, Human
acuucauuguaauauuauagca

SEQ ID NO: 994780 - RNA, 18 nt, Human
gggcauggaugcagcauc

SEQ ID NO: 994781 - RNA, 22 nt, Human
agacuucucaguuuuauuagua

SEQ ID NO: 994782 - RNA, 22 nt, Human
caauagaaaacucaauacuuaa

SEQ ID NO: 994783 - RNA, 22 nt, Human
cuucccuuggugaacagagcau

SEQ ID NO: 994784 - RNA, 22 nt, Human
cuggccuggucuggccucucca

SEQ ID NO: 994785 - RNA, 22 nt, Human
aguuggagugaacaugagauug

SEQ ID NO: 994786 - RNA, 20 nt, Human
uaaggcuguuuuguauuccu

SEQ ID NO: 994787 - RNA, 22 nt, Human
gacuguguccaugugcuggauu

SEQ ID NO: 994788 - RNA, 22 nt, Human
ccagucacagguguguuuauau

SEQ ID NO: 994789 - RNA, 22 nt, Human
cuuauaguaugauguugagaau

SEQ ID NO: 994790 - RNA, 22 nt, Human
uaaacagaaagcagauguacuu

SEQ ID NO: 994791 - RNA, 22 nt, Human
auaguaacuggcauguuuauga

SEQ ID NO: 994792 - RNA, 22 nt, Human
ugagcugggcugggcugagcug

SEQ ID NO: 994793 - RNA, 22 nt, Human
ugcucuguaaggucagaaaagg

SEQ ID NO: 994794 - RNA, 22 nt, Human
ggcuucaccaggugcaugcaug

SEQ ID NO: 994795 - RNA, 20 nt, Human
ccaauaaagcucuauaggga

SEQ ID NO: 994796 - RNA, 22 nt, Human
agcaaaguagcugcuguucuua

SEQ ID NO: 994797 - RNA, 22 nt, Human
auuagguuagugugcaagagaa

SEQ ID NO: 994798 - RNA, 22 nt, Human
gagcuuaggccagggacaggga

SEQ ID NO: 994799 - RNA, 22 nt, Human
ucauaaaaauagacucuaaagu

SEQ ID NO: 994800 - RNA, 22 nt, Human
aaauguguguauguacauauau

SEQ ID NO: 994801 - RNA, 19 nt, Human
cccuggcaggcaagccugg

SEQ ID NO: 994802 - RNA, 22 nt, Human
acucugcuaaauguguaggcuc

SEQ ID NO: 994803 - RNA, 22 nt, Human
ucucuggaguauaaccagggau

SEQ ID NO: 994804 - RNA, 22 nt, Human
gagaagcaauuuccaacugugc

SEQ ID NO: 994805 - RNA, 22 nt, Human
uggcucaguuaggucagaaaca

SEQ ID NO: 994806 - RNA, 16 nt, Human
agaggccuugaggaag

SEQ ID NO: 994807 - RNA, 22 nt, Human
accuuguuaaaaugaggauucu

SEQ ID NO: 994808 - RNA, 22 nt, Human
ggauuuggaagaccgggucaca

SEQ ID NO: 994809 - RNA, 22 nt, Human
gaagagcuguagccugcucuuu

SEQ ID NO: 994810 - RNA, 22 nt, Human
ugagccugaguucaaggcugca

SEQ ID NO: 994811 - RNA, 22 nt, Human
ucuggaguccagauccauuugg

SEQ ID NO: 994812 - RNA, 22 nt, Human
guuccaggcaagugggauagga

SEQ ID NO: 994813 - RNA, 22 nt, Human
uggcucugccacuaacuuggua

SEQ ID NO: 994814 - RNA, 22 nt, Human
uguguguauaugcauuuaucua

SEQ ID NO: 994815 - RNA, 22 nt, Human
gcccucucggcauagcaggggc

SEQ ID NO: 994816 - RNA, 22 nt, Human
uccugggcugcagggaagagca

SEQ ID NO: 994817 - RNA, 22 nt, Human
ucugggcagcagcagcuaguag

SEQ ID NO: 994818 - RNA, 22 nt, Human
uugcauugcuuggucuucaaga

SEQ ID NO: 994819 - RNA, 22 nt, Human
gggucccaggaaggagcagugu

SEQ ID NO: 994820 - RNA, 22 nt, Human
ccucgaccuccccaggcucagg

SEQ ID NO: 994821 - RNA, 21 nt, Human
accucaagcaacaaccaaggu

SEQ ID NO: 994822 - RNA, 22 nt, Human
acagacagggcaccugccuccu

SEQ ID NO: 994823 - RNA, 22 nt, Human
gacauuucaaucucauuauggg

SEQ ID NO: 994824 - RNA, 22 nt, Human
gcucugagaggugcagcaguaa

SEQ ID NO: 994825 - RNA, 21 nt, Human
ccagcuccaggaccuuggauc

SEQ ID NO: 994826 - RNA, 21 nt, Human
uccuggccagggcacuaggca

SEQ ID NO: 994827 - RNA, 22 nt, Human
ccucccuuggccauagccagcc

SEQ ID NO: 994828 - RNA, 22 nt, Human
uuccauauguauauagcuguua

SEQ ID NO: 994829 - RNA, 22 nt, Human
uggagcugacucacaccagcua

SEQ ID NO: 994830 - RNA, 22 nt, Human
acagcaggauuuggcgauguug

SEQ ID NO: 994831 - RNA, 22 nt, Human
ccagggugagaaaaggcuggau

SEQ ID NO: 994832 - RNA, 22 nt, Human
ccugcagguaaggcuaacugcc

SEQ ID NO: 994833 - RNA, 22 nt, Human
cagucccagcugcucagaaggc

SEQ ID NO: 994834 - RNA, 22 nt, Human
cuccucacacccacugcaacca

SEQ ID NO: 994835 - RNA, 22 nt, Human
aaagcagcagcaccugcauuuc

SEQ ID NO: 994836 - RNA, 22 nt, Human
ucacucuguguuugaacucaag

SEQ ID NO: 994837 - RNA, 21 nt, Human
ugacauaauccauaguacaaa

SEQ ID NO: 994838 - RNA, 22 nt, Human
uggcaacauggacaggucugcc

SEQ ID NO: 994839 - RNA, 22 nt, Human
ucacucuguuagaggaaagugc

SEQ ID NO: 994840 - RNA, 22 nt, Human
agcagcuggugagcaagcucag

SEQ ID NO: 994841 - RNA, 22 nt, Human
aguuucuaccgguacauucagg

SEQ ID NO: 994842 - RNA, 22 nt, Human
ugucagaacucuauugaugucc

SEQ ID NO: 994843 - RNA, 23 nt, Human
gacaccuuugccagaucaagaug

SEQ ID NO: 994844 - RNA, 23 nt, Human
agggguggucaguacccgcagug

SEQ ID NO: 994845 - RNA, 22 nt, Human
auaugaaaguaagcaugugugu

SEQ ID NO: 994846 - RNA, 22 nt, Human
ggcugcuggcauugagguaggu

SEQ ID NO: 994847 - RNA, 22 nt, Human
ugugugccagccuacgaggagc

SEQ ID NO: 994848 - RNA, 22 nt, Human
acagggcaugugcaagagacau

SEQ ID NO: 994849 - RNA, 22 nt, Human
gaguggggucugggcaucaguc

SEQ ID NO: 994850 - RNA, 22 nt, Human
cccuuccucccaggcuucugug

SEQ ID NO: 994851 - RNA, 22 nt, Human
ggcuccuggggaggugagcuug

SEQ ID NO: 994852 - RNA, 22 nt, Human
uccaguggcacuggagacuaga

SEQ ID NO: 994853 - RNA, 22 nt, Human
guggagccaggggcuguaggua

SEQ ID NO: 994854 - RNA, 22 nt, Human
auguagcaugaggcacugugcc

SEQ ID NO: 994855 - RNA, 22 nt, Human
ucagggaaauuuccauguguuu

SEQ ID NO: 994856 - RNA, 22 nt, Human
agccacagucaaccuguccaua

SEQ ID NO: 994857 - RNA, 22 nt, Human
aacugcauuugcauaaguccau

SEQ ID NO: 994858 - RNA, 22 nt, Human
auggccaagagucgauuugggg

SEQ ID NO: 994859 - RNA, 22 nt, Human
cugagcugguggaagcaugcag

SEQ ID NO: 994860 - RNA, 22 nt, Human
aaggagcucccggcagaccagg

SEQ ID NO: 994861 - RNA, 22 nt, Human
agugaaauaugcccauugcugu

SEQ ID NO: 994862 - RNA, 22 nt, Human
ucaaagucuaucuguaauuacu

SEQ ID NO: 994863 - RNA, 22 nt, Human
ccugggccugaaaacauuucuc

SEQ ID NO: 994864 - RNA, 22 nt, Human
uuacuggcugggccugagggcu

SEQ ID NO: 994865 - RNA, 22 nt, Human
cugaaggagguagagugacaua

SEQ ID NO: 994866 - RNA, 23 nt, Human
aggugcagcccuggaccugcccc

SEQ ID NO: 994867 - RNA, 22 nt, Human
agcagggcaaagucaggcuaac

SEQ ID NO: 994868 - RNA, 22 nt, Human
cuacauggagaagaaaauucuu

SEQ ID NO: 994869 - RNA, 22 nt, Human
cagacagggaccucgcuccaga

SEQ ID NO: 994870 - RNA, 22 nt, Human
uguauuuucugaagauaaucaa

SEQ ID NO: 994871 - RNA, 22 nt, Human
uggcuagcccuuguggggagag

SEQ ID NO: 994872 - RNA, 21 nt, Human
ugauuuccagaaaauuggccc

SEQ ID NO: 994873 - RNA, 22 nt, Human
aggcugucaucuuugcaggcag

SEQ ID NO: 994874 - RNA, 22 nt, Human
aaagacauggaacuagagaugg

SEQ ID NO: 994875 - RNA, 22 nt, Human
cagagcagaaaccugggugauu

SEQ ID NO: 994876 - RNA, 22 nt, Human
aaaugaacucuuccugcauccc

SEQ ID NO: 994877 - RNA, 22 nt, Human
uggccugcccagagcagcucug

SEQ ID NO: 994878 - RNA, 22 nt, Human
gaugcugagagguggagggaac

SEQ ID NO: 994879 - RNA, 21 nt, Human
ugccaggccugagcugggguc

SEQ ID NO: 994880 - RNA, 22 nt, Human
aaggcacugagccagccgucuc

SEQ ID NO: 994881 - RNA, 22 nt, Human
aauguacaaggguuccaguuuu

SEQ ID NO: 994882 - RNA, 22 nt, Human
ccagggcaugggaagaacugaa

SEQ ID NO: 994883 - RNA, 22 nt, Human
ucugucacccaggcuggagugc

SEQ ID NO: 994884 - RNA, 22 nt, Human
aucaguuucuaccauguggaau

SEQ ID NO: 994885 - RNA, 22 nt, Human
cuuuuacugugaaaagaaacug

SEQ ID NO: 994886 - RNA, 22 nt, Human
ugugaugguucacugggcauga

SEQ ID NO: 994887 - RNA, 22 nt, Human
uugcaguugucuuuccuaauuu

SEQ ID NO: 994888 - RNA, 22 nt, Human
auaaauuuauaauuguuuccug

SEQ ID NO: 994889 - RNA, 22 nt, Human
ggugaggcagguggcugcugag

SEQ ID NO: 994890 - RNA, 22 nt, Human
guggccugggguuuguucugag

SEQ ID NO: 994891 - RNA, 22 nt, Human
uggcucuguugugcugagccag

SEQ ID NO: 994892 - RNA, 22 nt, Human
gcuggccauucucuuugagaug

SEQ ID NO: 994893 - RNA, 22 nt, Human
cagagcugcuucccaguuugug

SEQ ID NO: 994894 - RNA, 18 nt, Human
ccauuucaugauuauuac

SEQ ID NO: 994895 - RNA, 22 nt, Human
ucugucacuuuuauuuacugaa

SEQ ID NO: 994896 - RNA, 22 nt, Human
cagcugagaccagaaugcaggu

SEQ ID NO: 994897 - RNA, 22 nt, Human
ggugaaggucuacugugugcca

SEQ ID NO: 994898 - RNA, 22 nt, Human
cauugaaaccuaacauaggcug

SEQ ID NO: 994899 - RNA, 22 nt, Human
uggccucugugggagcugagca

SEQ ID NO: 994900 - RNA, 22 nt, Human
ugugccaugaggcucugauaug

SEQ ID NO: 994901 - RNA, 20 nt, Human
gggaguggugguagccugug

SEQ ID NO: 994902 - RNA, 22 nt, Human
aaaaguauuuauggcuauguaa

SEQ ID NO: 994903 - RNA, 22 nt, Human
cugcagaggucuugcugauggu

SEQ ID NO: 994904 - RNA, 21 nt, Human
ugcuucucuagaucaacuacu

SEQ ID NO: 994905 - RNA, 22 nt, Human
agcauuuauuucuuagaaauug

SEQ ID NO: 994906 - RNA, 23 nt, Human
agaauuguaaauagaauauaccu

SEQ ID NO: 994907 - RNA, 22 nt, Human
aacagacauauuuuuaauaugc

SEQ ID NO: 994908 - RNA, 22 nt, Human
ugaugcugagccugggacugac

SEQ ID NO: 994909 - RNA, 22 nt, Human
cuggggcugcagcgaucuucau

SEQ ID NO: 994910 - RNA, 22 nt, Human
ugucauaaaacacaagcuguug

SEQ ID NO: 994911 - RNA, 22 nt, Human
ugcauauuuuauaaagauggaa

SEQ ID NO: 994912 - RNA, 22 nt, Human
cacagaauaaauugguaucaga

SEQ ID NO: 994913 - RNA, 19 nt, Human
ugagaaggcaguggggagc

SEQ ID NO: 994914 - RNA, 22 nt, Human
ccagaggugcugggagaggucu

SEQ ID NO: 994915 - RNA, 22 nt, Human
cagcaggggaacugugggccag

SEQ ID NO: 994916 - RNA, 22 nt, Human
agauaacuuuuggguauucaug

SEQ ID NO: 994917 - RNA, 22 nt, Human
ggauccuuaacuaucacaguga

SEQ ID NO: 994918 - RNA, 22 nt, Human
uccuggccagaggacaaagcug

SEQ ID NO: 994919 - RNA, 22 nt, Human
ggugcagugguguggcaaaggg

SEQ ID NO: 994920 - RNA, 22 nt, Human
guaacagaaagucaugcucauu

SEQ ID NO: 994921 - RNA, 22 nt, Human
gugcugcagagucucgugccgc

SEQ ID NO: 994922 - RNA, 22 nt, Human
ugggugggagcacccugucugg

SEQ ID NO: 994923 - RNA, 22 nt, Human
ugaugggaggugcugcaggacc

SEQ ID NO: 994924 - RNA, 22 nt, Human
gacagggcgcccagccuguuuc

SEQ ID NO: 994925 - RNA, 22 nt, Human
caaaaguaauguaugcucaucg

SEQ ID NO: 994926 - RNA, 22 nt, Human
ccagcccugccucucagggccc

SEQ ID NO: 994927 - RNA, 19 nt, Human
ggccuggauuuagggcucc

SEQ ID NO: 994928 - RNA, 22 nt, Human
ccagggcacguugggacaguac

SEQ ID NO: 994929 - RNA, 22 nt, Human
ucuucacaccgggcagcaggaa

SEQ ID NO: 994930 - RNA, 22 nt, Human
auuucugauaaacguaagcugc

SEQ ID NO: 994931 - RNA, 22 nt, Human
ucagggcacaggccuguggguu

SEQ ID NO: 994932 - RNA, 22 nt, Human
aggacuucuccgauaagucaga

SEQ ID NO: 994933 - RNA, 22 nt, Human
uggcagaggaggcucagauuga

SEQ ID NO: 994934 - RNA, 22 nt, Human
gagauucuguagucaggcaucu

SEQ ID NO: 994935 - RNA, 22 nt, Human
agcugcagucaagcugggccac

SEQ ID NO: 994936 - RNA, 22 nt, Human
aaggucauuuaacaauuuauga

SEQ ID NO: 994937 - RNA, 18 nt, Human
aggccaaacuuguaagca

SEQ ID NO: 994938 - RNA, 22 nt, Human
guguggcugugggagauguuca

SEQ ID NO: 994939 - RNA, 20 nt, Human
gugcuucagaagccauugcu

SEQ ID NO: 994940 - RNA, 22 nt, Human
ucuuuaaucauaaccaagaugg

SEQ ID NO: 994941 - RNA, 22 nt, Human
acauucaugucccacuucuagc

SEQ ID NO: 994942 - RNA, 19 nt, Human
uguuggugcggauguggag

SEQ ID NO: 994943 - RNA, 22 nt, Human
cugagcuuccaguuccuccagg

SEQ ID NO: 994944 - RNA, 21 nt, Human
ucuggagcccuaagcugagaa

SEQ ID NO: 994945 - RNA, 22 nt, Human
uugggcuggcagagguggucuu

SEQ ID NO: 994946 - RNA, 22 nt, Human
caaaugugacuuuugggcuucu

SEQ ID NO: 994947 - RNA, 22 nt, Human
gcagguguggaguggggugagc

SEQ ID NO: 994948 - RNA, 19 nt, Human
cgcaggagccgaggugacc

SEQ ID NO: 994949 - RNA, 23 nt, Human
uuacuuuugcaccaaccuaauau

SEQ ID NO: 994950 - RNA, 22 nt, Human
aaauauguaaccaaggugaagu

SEQ ID NO: 994951 - RNA, 22 nt, Human
auuuauguaucuguguagauca

SEQ ID NO: 994952 - RNA, 22 nt, Human
caaagaugcugauguuggauca

SEQ ID NO: 994953 - RNA, 22 nt, Human
ccuuccaggagucucugcaggu

SEQ ID NO: 994954 - RNA, 22 nt, Human
caaaaguaauugugguuuucac

SEQ ID NO: 994955 - RNA, 22 nt, Human
cugugcaguaggucagggcugg

SEQ ID NO: 994956 - RNA, 22 nt, Human
cuugcuuuguccagaaauucag

SEQ ID NO: 994957 - RNA, 22 nt, Human
ugagaggccccagcucuuggcc

SEQ ID NO: 994958 - RNA, 22 nt, Human
accaggcugugaagugagacua

SEQ ID NO: 994959 - RNA, 22 nt, Human
agaguguuauuugcucuguauu

SEQ ID NO: 994960 - RNA, 22 nt, Human
agacccugcaccucucgugggc

SEQ ID NO: 994961 - RNA, 18 nt, Human
agcagcugucagaaugcc

SEQ ID NO: 994962 - RNA, 22 nt, Human
gccugggaagacuaagugggag

SEQ ID NO: 994963 - RNA, 22 nt, Human
agccuccaucccaugcacaaag

SEQ ID NO: 994964 - RNA, 22 nt, Human
ucucucagcuuugagaccugcu

SEQ ID NO: 994965 - RNA, 22 nt, Human
cagagagagugggguguggauu

SEQ ID NO: 994966 - RNA, 22 nt, Human
gcucagagggaacaaggggcug

SEQ ID NO: 994967 - RNA, 22 nt, Human
aaucaguucuacaucuuaucca

SEQ ID NO: 994968 - RNA, 22 nt, Human
gcuguccagagcaugggagcaa

SEQ ID NO: 994969 - RNA, 23 nt, Human
cagugcagggcaacucagacucc

SEQ ID NO: 994970 - RNA, 22 nt, Human
cuguuuucaaagagagagaaug

SEQ ID NO: 994971 - RNA, 22 nt, Human
agaugcugugaggaagcuagga

SEQ ID NO: 994972 - RNA, 22 nt, Human
gcucccacgcaauucuuuucag

SEQ ID NO: 994973 - RNA, 22 nt, Human
cacugcagcaccaugcagggcu

SEQ ID NO: 994974 - RNA, 22 nt, Human
ccagucugugugccagccugcg

SEQ ID NO: 994975 - RNA, 22 nt, Human
aggcacugugcugaugucuuau

SEQ ID NO: 994976 - RNA, 22 nt, Human
guuugcauguguacuuaauugg

SEQ ID NO: 994977 - RNA, 22 nt, Human
ccuggcuuccuggagcucacaa

SEQ ID NO: 994978 - RNA, 22 nt, Human
aauuucaauuacuuuugcacca

SEQ ID NO: 994979 - RNA, 22 nt, Human
agaaaucucaguaucucaggga

SEQ ID NO: 994980 - RNA, 22 nt, Human
ugcugguggagaaaguggaggu

SEQ ID NO: 994981 - RNA, 22 nt, Human
ggcuucugguaaagaccacacc

SEQ ID NO: 994982 - RNA, 22 nt, Human
agggcugcaucugccuggugaa

SEQ ID NO: 994983 - RNA, 22 nt, Human
ugaagccagcuuuggaagacac

SEQ ID NO: 994984 - RNA, 22 nt, Human
agcagggcagguaaggaucaga

SEQ ID NO: 994985 - RNA, 22 nt, Human
agcccaugcaacaggccuagcg

SEQ ID NO: 994986 - RNA, 23 nt, Human
gcucagagguuuuucucuggaug

SEQ ID NO: 994987 - RNA, 22 nt, Human
cuguggcugcagccuugguccu

SEQ ID NO: 994988 - RNA, 22 nt, Human
agggacugagcuaggaucuagu

SEQ ID NO: 994989 - RNA, 22 nt, Human
gcagcaggcuuuucauaccuug

SEQ ID NO: 994990 - RNA, 22 nt, Human
gauggcacacagacauccccgc

SEQ ID NO: 994991 - RNA, 22 nt, Human
aucagcaagacuaggggaauac

SEQ ID NO: 994992 - RNA, 22 nt, Human
ggagagcaggguccugagauac

SEQ ID NO: 994993 - RNA, 22 nt, Human
ugccaggggaccuagggauguc

SEQ ID NO: 994994 - RNA, 22 nt, Human
aggcacuguacuagguacaggg

SEQ ID NO: 994995 - RNA, 22 nt, Human
ugggccugggcuccuguccucu

SEQ ID NO: 994996 - RNA, 22 nt, Human
cagccaggagcucccccugcuc

SEQ ID NO: 994997 - RNA, 22 nt, Human
uggcucugucaaacugcacaca

SEQ ID NO: 994998 - RNA, 22 nt, Human
cugccuugguuucuagcagggc

SEQ ID NO: 994999 - RNA, 22 nt, Human
cugcuuugauuagaagaguaca

SEQ ID NO: 995000 - RNA, 22 nt, Human
gucucagaguccuacuuauucc

SEQ ID NO: 995001 - RNA, 22 nt, Human
uuaauacagucuccagaaguaa

SEQ ID NO: 995002 - RNA, 22 nt, Human
cucuggacacuggcaugggguc

SEQ ID NO: 995003 - RNA, 22 nt, Human
aaugcagugagccauuaaaugg

SEQ ID NO: 995004 - RNA, 20 nt, Human
uauuucugggcaaccauuua

SEQ ID NO: 995005 - RNA, 22 nt, Human
ucagagugcagggaguagcagc

SEQ ID NO: 995006 - RNA, 22 nt, Human
gagauuggccuggcuugccaac

SEQ ID NO: 995007 - RNA, 22 nt, Human
guccuggggaauacagaagccg

SEQ ID NO: 995008 - RNA, 22 nt, Human
uccauuuucaucucauguauaa

SEQ ID NO: 995009 - RNA, 22 nt, Human
gccagcucagugccaggccccu

SEQ ID NO: 995010 - RNA, 22 nt, Human
guuguauucuucaauaucagag

SEQ ID NO: 995011 - RNA, 22 nt, Human
agggaagaaaauccaucgcugc

SEQ ID NO: 995012 - RNA, 22 nt, Human
uggcagcuugaaugcagucuuu

SEQ ID NO: 995013 - RNA, 22 nt, Human
agcuagaauguuccuuuucauu

SEQ ID NO: 995014 - RNA, 22 nt, Human
ugucacauugaauaugauuuau

SEQ ID NO: 995015 - RNA, 22 nt, Human
gcacagggagcaggucucuggu

SEQ ID NO: 995016 - RNA, 22 nt, Human
uaagaauuguguugaauagagu

SEQ ID NO: 995017 - RNA, 22 nt, Human
acagaacuuccugcuggagugg

SEQ ID NO: 995018 - RNA, 22 nt, Human
uuaguaauguguuaauaugaau

SEQ ID NO: 995019 - RNA, 19 nt, Human
uggggccuccugucccugg

SEQ ID NO: 995020 - RNA, 22 nt, Human
cccagguggguuggccucuguc

SEQ ID NO: 995021 - RNA, 22 nt, Human
gcucugagagugggugauucug

SEQ ID NO: 995022 - RNA, 22 nt, Human
gagaggccaccugacgagcagu

SEQ ID NO: 995023 - RNA, 22 nt, Human
uuaggcauuggaaggucagcuu

SEQ ID NO: 995024 - RNA, 21 nt, Human
gugguucuagagaaacagaau

SEQ ID NO: 995025 - RNA, 22 nt, Human
cugggaggcaccgcgucgugcu

SEQ ID NO: 995026 - RNA, 22 nt, Human
caggcagcauuuacucugauga

SEQ ID NO: 995027 - RNA, 22 nt, Human
ugucaugcccaggagcaaggua

SEQ ID NO: 995028 - RNA, 22 nt, Human
gcugccugccuaguuccacagu

SEQ ID NO: 995029 - RNA, 22 nt, Human
ccagcugcugugaggaccacag

SEQ ID NO: 995030 - RNA, 22 nt, Human
auuuagaaguuggagggcaaga

SEQ ID NO: 995031 - RNA, 22 nt, Human
ugaaaucuacccuauucagggu

SEQ ID NO: 995032 - RNA, 21 nt, Human
uggcucuguucaauauaugga

SEQ ID NO: 995033 - RNA, 22 nt, Human
gagagcugucagcguagcaccg

SEQ ID NO: 995034 - RNA, 21 nt, Human
gugcucugggcagcagagggc

SEQ ID NO: 995035 - RNA, 22 nt, Human
ccagcccuucccaacuggccag

SEQ ID NO: 995036 - RNA, 22 nt, Human
gccucccuguucuuccacaaua

SEQ ID NO: 995037 - RNA, 22 nt, Human
ggagggcucaauugacuccuga

SEQ ID NO: 995038 - RNA, 22 nt, Human
aagggcagagggaaucccacau

SEQ ID NO: 995039 - RNA, 22 nt, Human
cuccucccucuuugccacacau

SEQ ID NO: 995040 - RNA, 22 nt, Human
cagggugggcacccagccucca

SEQ ID NO: 995041 - RNA, 22 nt, Human
agcacuuuccuggcaaaugugg

SEQ ID NO: 995042 - RNA, 22 nt, Human
uuuuuccuagcgauuugucagc

SEQ ID NO: 995043 - RNA, 22 nt, Human
auucuuggcaaggagauuuaaa

SEQ ID NO: 995044 - RNA, 22 nt, Human
ggcuucccuuuccgagaggaga

SEQ ID NO: 995045 - RNA, 22 nt, Human
uggcgcaacucauucauggugu

SEQ ID NO: 995046 - RNA, 22 nt, Human
ugcagaagcagagaguugccaa

SEQ ID NO: 995047 - RNA, 22 nt, Human
ccugcccuagagaugacacaau

SEQ ID NO: 995048 - RNA, 22 nt, Human
gcuggccuccugcuagauggaa

SEQ ID NO: 995049 - RNA, 22 nt, Human
uuucuuaggcucuaaaaugacu

SEQ ID NO: 995050 - RNA, 22 nt, Human
gcagggugauagugaggcucag

SEQ ID NO: 995051 - RNA, 22 nt, Human
cucucugggggccaugccaaga

SEQ ID NO: 995052 - RNA, 21 nt, Human
cauuucaugauuauagaaaug

SEQ ID NO: 995053 - RNA, 21 nt, Human
ccuauugaauauaggaagauu

SEQ ID NO: 995054 - RNA, 22 nt, Human
ugcauuguugaccaguugugca

SEQ ID NO: 995055 - RNA, 22 nt, Human
ccagagcccagcacacggugcu

SEQ ID NO: 995056 - RNA, 22 nt, Human
aggccugagcagaggaguggac

SEQ ID NO: 995057 - RNA, 22 nt, Human
guucacaagaguuacagacaga

SEQ ID NO: 995058 - RNA, 22 nt, Human
uccagucaucucccuucacauu

SEQ ID NO: 995059 - RNA, 22 nt, Human
ucugccugaaauucacauguaa

SEQ ID NO: 995060 - RNA, 22 nt, Human
uuuucacacaaggugauaaguu

SEQ ID NO: 995061 - RNA, 22 nt, Human
cagcuugggaguuugguuuuau

SEQ ID NO: 995062 - RNA, 22 nt, Human
ugcuaucucuauauccauuuau

SEQ ID NO: 995063 - RNA, 22 nt, Human
ggaggggccggcugccugccac

SEQ ID NO: 995064 - RNA, 22 nt, Human
guauuugauacaugaaauggug

SEQ ID NO: 995065 - RNA, 22 nt, Human
uguucuuucaguuagacacagu

SEQ ID NO: 995066 - RNA, 22 nt, Human
uauguguacaucugguugagca

SEQ ID NO: 995067 - RNA, 22 nt, Human
gagcugggacauggguccucuc

SEQ ID NO: 995068 - RNA, 17 nt, Human
gccuggcccagccuggc

SEQ ID NO: 995069 - RNA, 22 nt, Human
uccagugguacauggagacacu

SEQ ID NO: 995070 - RNA, 22 nt, Human
cagaggcagaggucaucucugg

SEQ ID NO: 995071 - RNA, 23 nt, Human
gggaccagcuagggcugugaccu

SEQ ID NO: 995072 - RNA, 20 nt, Human
aaggcacuaugucugcuagc

SEQ ID NO: 995073 - RNA, 20 nt, Human
ugggccuguggcagaagucu

SEQ ID NO: 995074 - RNA, 18 nt, Human
gaaaggagagacaguagg

SEQ ID NO: 995075 - RNA, 22 nt, Human
aacuccuguucuaugacaagag

SEQ ID NO: 995076 - RNA, 22 nt, Human
ugaaggcuguuggauggggaag

SEQ ID NO: 995077 - RNA, 22 nt, Human
ugucucugaacagcuuacuaaa

SEQ ID NO: 995078 - RNA, 22 nt, Human
caaggcugcugcgggucgcacc

SEQ ID NO: 995079 - RNA, 22 nt, Human
gguagcacauugcauuaggaga

SEQ ID NO: 995080 - RNA, 22 nt, Human
uuugacagcuuguuacaaaguu

SEQ ID NO: 995081 - RNA, 22 nt, Human
accaaggaagagauucucaguu

SEQ ID NO: 995082 - RNA, 20 nt, Human
cucugcuuuaggagagucag

SEQ ID NO: 995083 - RNA, 22 nt, Human
agggaugguggagguugcaagu

SEQ ID NO: 995084 - RNA, 19 nt, Human
acugccugaggcucacagg

SEQ ID NO: 995085 - RNA, 22 nt, Human
ucauugaacgaagagcuccauu

SEQ ID NO: 995086 - RNA, 22 nt, Human
guguugacucuuggacuucaag

SEQ ID NO: 995087 - RNA, 20 nt, Human
aauguauauuuuaugccagg

SEQ ID NO: 995088 - RNA, 22 nt, Human
uuguccuuggaugaagcuggga

SEQ ID NO: 995089 - RNA, 22 nt, Human
acauuugucuucuuucagauua

SEQ ID NO: 995090 - RNA, 22 nt, Human
aagucuguagaaaaacaguuua

SEQ ID NO: 995091 - RNA, 22 nt, Human
cacauacaaugguguuauuugg

SEQ ID NO: 995092 - RNA, 22 nt, Human
agcugccacagagccuggccag

SEQ ID NO: 995093 - RNA, 22 nt, Human
acugaaagauaaaucaguuagc

SEQ ID NO: 995094 - RNA, 22 nt, Human
cucugagaaagcugugagcuaa

SEQ ID NO: 995095 - RNA, 22 nt, Human
ucacucuggaguccgcuaccag

SEQ ID NO: 995096 - RNA, 22 nt, Human
ccacagggacuguuaaaacccu

SEQ ID NO: 995097 - RNA, 22 nt, Human
gcacccagggacuuggcuggcc

SEQ ID NO: 995098 - RNA, 22 nt, Human
cacauaaguggguuccauugca

SEQ ID NO: 995099 - RNA, 22 nt, Human
cagcugccuguauuguccucau

SEQ ID NO: 995100 - RNA, 22 nt, Human
gaggcccaguccugcaagcacg

SEQ ID NO: 995101 - RNA, 22 nt, Human
auggggugagacuaggauuaaa

SEQ ID NO: 995102 - RNA, 22 nt, Human
agucuucagagaaauuaacucu

SEQ ID NO: 995103 - RNA, 21 nt, Human
ucuccaguauccuucucugag

SEQ ID NO: 995104 - RNA, 22 nt, Human
cuuggccucuucucaggguggg

SEQ ID NO: 995105 - RNA, 22 nt, Human
cuggggacuugcagacacaauu

SEQ ID NO: 995106 - RNA, 22 nt, Human
agccacagagagggagcugcaa

SEQ ID NO: 995107 - RNA, 22 nt, Human
ggagccugggcauuaguaauuu

SEQ ID NO: 995108 - RNA, 22 nt, Human
acugugcuuucucuggaggcau

SEQ ID NO: 995109 - RNA, 22 nt, Human
gcacagggcccugugcguaggu

SEQ ID NO: 995110 - RNA, 22 nt, Human
uccagggaccucccugagagcu

SEQ ID NO: 995111 - RNA, 22 nt, Human
caggacagagcccagacugugu

SEQ ID NO: 995112 - RNA, 22 nt, Human
gcaggccuuggcaaugagccug

SEQ ID NO: 995113 - RNA, 22 nt, Human
ggcugcaguuugucuuuugcuu

SEQ ID NO: 995114 - RNA, 22 nt, Human
gcccagcuccucugcagacccu

SEQ ID NO: 995115 - RNA, 22 nt, Human
gcaguggggcgcugggaguugg

SEQ ID NO: 995116 - RNA, 22 nt, Human
aggugagguuugggagguguca

SEQ ID NO: 995117 - RNA, 22 nt, Human
uacaguuuguuacauuguuagu

SEQ ID NO: 995118 - RNA, 22 nt, Human
agcaggcuuucaagagucuucu

SEQ ID NO: 995119 - RNA, 22 nt, Human
acagaaauugggcaaauggaag

SEQ ID NO: 995120 - RNA, 22 nt, Human
ggagcugcauuuagggagccuu

SEQ ID NO: 995121 - RNA, 19 nt, Human
ugucucugaaagaugagcu

SEQ ID NO: 995122 - RNA, 22 nt, Human
gcagcugccuauucagggcuug

SEQ ID NO: 995123 - RNA, 22 nt, Human
uggcagagucaucacaucugga

SEQ ID NO: 995124 - RNA, 22 nt, Human
agcucccagaagccagagucgg

SEQ ID NO: 995125 - RNA, 22 nt, Human
ugggauggcauccugggccuug

SEQ ID NO: 995126 - RNA, 22 nt, Human
gcugagcuagaaaaggaccaca

SEQ ID NO: 995127 - RNA, 22 nt, Human
guccacauaggaacccagcuuc

SEQ ID NO: 995128 - RNA, 22 nt, Human
auguuacagaaagcaaagauga

SEQ ID NO: 995129 - RNA, 22 nt, Human
uuucaauguaacauuuccaggc

SEQ ID NO: 995130 - RNA, 21 nt, Human
gccagggaagagaguuggcug

SEQ ID NO: 995131 - RNA, 22 nt, Human
ccacagggaacaugacagccuu

SEQ ID NO: 995132 - RNA, 22 nt, Human
uugcacuccagcccgagcaaca

SEQ ID NO: 995133 - RNA, 22 nt, Human
uguauuuugugaggaucacucu

SEQ ID NO: 995134 - RNA, 22 nt, Human
ucaggauccauagacucccaaa

SEQ ID NO: 995135 - RNA, 22 nt, Human
uagaauaugauuaauuuucuua

SEQ ID NO: 995136 - RNA, 22 nt, Human
uggcucugcaccucaguguacc

SEQ ID NO: 995137 - RNA, 22 nt, Human
uucaaugaggauagaacuggau

SEQ ID NO: 995138 - RNA, 22 nt, Human
guuuuuccuugcugaggacccg

SEQ ID NO: 995139 - RNA, 23 nt, Human
gaguguucauagcaggcucuugc

SEQ ID NO: 995140 - RNA, 22 nt, Human
augcaguagauaggcacuuuua

SEQ ID NO: 995141 - RNA, 22 nt, Human
uagauuucaggcuggcuugcgg

SEQ ID NO: 995142 - RNA, 22 nt, Human
agggcagagauuaauuaagaca

SEQ ID NO: 995143 - RNA, 22 nt, Human
uagagugguuaacaguuuagaa

SEQ ID NO: 995144 - RNA, 22 nt, Human
gcugcucuuuucagagaugaga

SEQ ID NO: 995145 - RNA, 22 nt, Human
ugcauuauuugcaugugccugu

SEQ ID NO: 995146 - RNA, 22 nt, Human
cagucauuuuauuugaaaauua

SEQ ID NO: 995147 - RNA, 22 nt, Human
aguguccccuccaagggccugg

SEQ ID NO: 995148 - RNA, 23 nt, Human
ggccucuguguucugcccacaug

SEQ ID NO: 995149 - RNA, 22 nt, Human
cucagagaaaaggagcaagggu

SEQ ID NO: 995150 - RNA, 18 nt, Human
aagcugcccucaggcagg

SEQ ID NO: 995151 - RNA, 22 nt, Human
gugugccaggaacuggcugcug

SEQ ID NO: 995152 - RNA, 22 nt, Human
agggagcuuccgaacuacagcu

SEQ ID NO: 995153 - RNA, 22 nt, Human
ccugagaggcccucucacuguc

SEQ ID NO: 995154 - RNA, 22 nt, Human
ucucucagaggccaggguccug

SEQ ID NO: 995155 - RNA, 22 nt, Human
gcugcucugaaaaugacuguug

SEQ ID NO: 995156 - RNA, 21 nt, Human
ggagcugcaggagccgaaggc

SEQ ID NO: 995157 - RNA, 22 nt, Human
uuagauaauguuauuguaauuu

SEQ ID NO: 995158 - RNA, 22 nt, Human
uuuagaguugaguauucauugg

SEQ ID NO: 995159 - RNA, 22 nt, Human
augcaguaaauguuaagaaaaa

SEQ ID NO: 995160 - RNA, 22 nt, Human
gagccuggauagccuuguucca

SEQ ID NO: 995161 - RNA, 22 nt, Human
ugggacaguuguccuccacucu

SEQ ID NO: 995162 - RNA, 22 nt, Human
gcaggaagaugagcucagguaa

SEQ ID NO: 995163 - RNA, 22 nt, Human
guauuuucaagagcaguaguau

SEQ ID NO: 995164 - RNA, 22 nt, Human
acagcugugaaaauccacagga

SEQ ID NO: 995165 - RNA, 22 nt, Human
ugacauaaaccagugagcaaaa

SEQ ID NO: 995166 - RNA, 20 nt, Human
accccagccccucuaucuga

SEQ ID NO: 995167 - RNA, 22 nt, Human
ugccuuccuggagcugaaggcu

SEQ ID NO: 995168 - RNA, 23 nt, Human
ccaaagucgaagucuaguccaga

SEQ ID NO: 995169 - RNA, 22 nt, Human
ugucacaaacauacauuauaga

SEQ ID NO: 995170 - RNA, 21 nt, Human
uggcucuggguaggagagugc

SEQ ID NO: 995171 - RNA, 22 nt, Human
guggcugguuuccugcaugcaa

SEQ ID NO: 995172 - RNA, 22 nt, Human
gucccaggcagagucaggaggg

SEQ ID NO: 995173 - RNA, 22 nt, Human
uaccaggcagcugcacagaggc

SEQ ID NO: 995174 - RNA, 22 nt, Human
ucaguguccggagccugagugc

SEQ ID NO: 995175 - RNA, 22 nt, Human
ugacaccacaacuagccauuga

SEQ ID NO: 995176 - RNA, 22 nt, Human
gcaggcucuucuuucugcccag

SEQ ID NO: 995177 - RNA, 22 nt, Human
uuauugagcacauaguaugugg

SEQ ID NO: 995178 - RNA, 22 nt, Human
ccagacaggaacacacaucucc

SEQ ID NO: 995179 - RNA, 22 nt, Human
caaagcucaugcucuuagccau

SEQ ID NO: 995180 - RNA, 22 nt, Human
uucucuuagcuguaaagucaau

SEQ ID NO: 995181 - RNA, 22 nt, Human
ccuuagagaguacugggcugcc

SEQ ID NO: 995182 - RNA, 22 nt, Human
gucccucugugucccugcaguc

SEQ ID NO: 995183 - RNA, 22 nt, Human
cugggaggauucauugagguga

SEQ ID NO: 995184 - RNA, 22 nt, Human
aggaggcugguucaggccauau

SEQ ID NO: 995185 - RNA, 22 nt, Human
gccugcuggauguggccaggcc

SEQ ID NO: 995186 - RNA, 22 nt, Human
ugacagaaauaguucuuaauuu

SEQ ID NO: 995187 - RNA, 22 nt, Human
acagggcaccugagguaggaag

SEQ ID NO: 995188 - RNA, 22 nt, Human
ccuuggagcggucagcacuggu

SEQ ID NO: 995189 - RNA, 22 nt, Human
uggcagcagacaucugaggucu

SEQ ID NO: 995190 - RNA, 22 nt, Human
aucuuugaagaggacuugaagu

SEQ ID NO: 995191 - RNA, 22 nt, Human
acccacgaagaugagcggcaug

SEQ ID NO: 995192 - RNA, 22 nt, Human
ucuuguuaucaggaaaacagua

SEQ ID NO: 995193 - RNA, 22 nt, Human
uccuucagauuccugcuucugg

SEQ ID NO: 995194 - RNA, 18 nt, Human
agucucagcggaggagua

SEQ ID NO: 995195 - RNA, 22 nt, Human
uuuacuuugugucaagucaaga

SEQ ID NO: 995196 - RNA, 22 nt, Human
aauaguguuguucacucaggag

SEQ ID NO: 995197 - RNA, 22 nt, Human
gaagagcugcucagaacaugau

SEQ ID NO: 995198 - RNA, 22 nt, Human
uggggacaggagacuuacagcu

SEQ ID NO: 995199 - RNA, 22 nt, Human
uuuccucuucgauuaaguuugg

SEQ ID NO: 995200 - RNA, 22 nt, Human
agggaggaucugcuccuugucu

SEQ ID NO: 995201 - RNA, 22 nt, Human
aggggccauuguucugcccgcu

SEQ ID NO: 995202 - RNA, 18 nt, Human
acaaaggucugcaagacc

SEQ ID NO: 995203 - RNA, 22 nt, Human
gauggcagucaaccaggugagg

SEQ ID NO: 995204 - RNA, 22 nt, Human
cuggggugucucgucugccauu

SEQ ID NO: 995205 - RNA, 21 nt, Human
auugaaagucaacaaucaguu

SEQ ID NO: 995206 - RNA, 23 nt, Human
ccugugugcccuuaauucacagc

SEQ ID NO: 995207 - RNA, 22 nt, Human
uuuauuauccaguguugucaug

SEQ ID NO: 995208 - RNA, 22 nt, Human
uuuuaagaugcuaguauuucag

SEQ ID NO: 995209 - RNA, 22 nt, Human
ccuggccagccagggcuggggu

SEQ ID NO: 995210 - RNA, 22 nt, Human
uuggccaagacucauguccuau

SEQ ID NO: 995211 - RNA, 22 nt, Human
aggaccagccuccaggucucuu

SEQ ID NO: 995212 - RNA, 22 nt, Human
agagaaggucacuaaggaccca

SEQ ID NO: 995213 - RNA, 22 nt, Human
aagggcaggagaagacggauau

SEQ ID NO: 995214 - RNA, 22 nt, Human
auguaacuucugugaaucugac

SEQ ID NO: 995215 - RNA, 22 nt, Human
ggcucugcccagguggacagca

SEQ ID NO: 995216 - RNA, 22 nt, Human
agguaaggcuguaagcuaagcc

SEQ ID NO: 995217 - RNA, 22 nt, Human
cgcugggcgccgaccugcuggc

SEQ ID NO: 995218 - RNA, 20 nt, Human
agugugcauuuagagucugc

SEQ ID NO: 995219 - RNA, 22 nt, Human
ugggcagaguagcucagaagaa

SEQ ID NO: 995220 - RNA, 21 nt, Human
ucucuggaguuagcagagaga

SEQ ID NO: 995221 - RNA, 22 nt, Human
augggaggcaggcucagaaccg

SEQ ID NO: 995222 - RNA, 22 nt, Human
aagcugccuugcugaggagaaa

SEQ ID NO: 995223 - RNA, 22 nt, Human
cagggccagccauccugcuggg

SEQ ID NO: 995224 - RNA, 22 nt, Human
cccaggcugauguucagcgggu

SEQ ID NO: 995225 - RNA, 22 nt, Human
ccaaaguccauaguuuacauua

SEQ ID NO: 995226 - RNA, 22 nt, Human
ggcagggucuggacugaaagcu

SEQ ID NO: 995227 - RNA, 21 nt, Human
guggccugauuaugaaugggu

SEQ ID NO: 995228 - RNA, 23 nt, Human
gacagagugagaccuugucuuac

SEQ ID NO: 995229 - RNA, 20 nt, Human
ucuccuggugacaguaccca

SEQ ID NO: 995230 - RNA, 22 nt, Human
gaggucaauaauaugugcuuua

SEQ ID NO: 995231 - RNA, 22 nt, Human
augucacagucugacucaguga

SEQ ID NO: 995232 - RNA, 22 nt, Human
gcucuggguagccacugccugg

SEQ ID NO: 995233 - RNA, 22 nt, Human
gagggaaggacccauuuuaagu

SEQ ID NO: 995234 - RNA, 22 nt, Human
auccaaagcccuaaguuaacug

SEQ ID NO: 995235 - RNA, 22 nt, Human
gcuguauuuaacaacuggcuca

SEQ ID NO: 995236 - RNA, 22 nt, Human
ccagggcuggugggagaugcug

SEQ ID NO: 995237 - RNA, 22 nt, Human
caguggcagagaacagagaccu

SEQ ID NO: 995238 - RNA, 22 nt, Human
ccuguguggaaaccgcaugacg

SEQ ID NO: 995239 - RNA, 22 nt, Human
aaaguuuuagaacuaggaagca

SEQ ID NO: 995240 - RNA, 22 nt, Human
gagggcugaugcuuacuuauuu

SEQ ID NO: 995241 - RNA, 22 nt, Human
guggaggagaggcgccuugcgg

SEQ ID NO: 995242 - RNA, 22 nt, Human
uguucaauccccagguccugaa

SEQ ID NO: 995243 - RNA, 23 nt, Human
ucccuggaggcagguccagggcc

SEQ ID NO: 995244 - RNA, 22 nt, Human
cuccuggaccagggcuauuggg

SEQ ID NO: 995245 - RNA, 22 nt, Human
gccuggcuccuaaggacuggcu

SEQ ID NO: 995246 - RNA, 22 nt, Human
gggagggaggugaugcuuggcu

SEQ ID NO: 995247 - RNA, 23 nt, Human
uggagcugggcucagacccuggg

SEQ ID NO: 995248 - RNA, 22 nt, Human
uacaagagguauauagaaacag

SEQ ID NO: 995249 - RNA, 22 nt, Human
caucagcacuaugauuaaagua

SEQ ID NO: 995250 - RNA, 22 nt, Human
acagugucaugucguguucccc

SEQ ID NO: 995251 - RNA, 22 nt, Human
cuuuuuaucucuuaaugauguu

SEQ ID NO: 995252 - RNA, 22 nt, Human
ccaggguggaggcuggauggag

SEQ ID NO: 995253 - RNA, 22 nt, Human
uggacaaaugauuucuaccuuu

SEQ ID NO: 995254 - RNA, 22 nt, Human
gggacuggcacagggcugggag

SEQ ID NO: 995255 - RNA, 22 nt, Human
ucucagagauuuauggaaaacu

SEQ ID NO: 995256 - RNA, 22 nt, Human
aauaauuuccagccaacuggaa

SEQ ID NO: 995257 - RNA, 23 nt, Human
uggcagcuguguaagagaaagca

SEQ ID NO: 995258 - RNA, 22 nt, Human
aggccucagugaucaucaucag

SEQ ID NO: 995259 - RNA, 22 nt, Human
uucaaaacaaucuguuugcauu

SEQ ID NO: 995260 - RNA, 22 nt, Human
ugauuaacugucuauuaaucau

SEQ ID NO: 995261 - RNA, 22 nt, Human
caagaacauugugaucacuuca

SEQ ID NO: 995262 - RNA, 22 nt, Human
agcucacaguguccuuccucaa

SEQ ID NO: 995263 - RNA, 22 nt, Human
cagugcaguuucccagaugcug

SEQ ID NO: 995264 - RNA, 22 nt, Human
ucaaaugcucuuugcagagagg

SEQ ID NO: 995265 - RNA, 22 nt, Human
ugacaauacagagagagcaaaa

SEQ ID NO: 995266 - RNA, 22 nt, Human
aggaaaaaccuguuaaugguag

SEQ ID NO: 995267 - RNA, 22 nt, Human
gaaggcugaugacagauucugc

SEQ ID NO: 995268 - RNA, 22 nt, Human
gcugagguggcugccuuaguaa

SEQ ID NO: 995269 - RNA, 22 nt, Human
caguuuuuagauuaguuggugg

SEQ ID NO: 995270 - RNA, 22 nt, Human
ucugcaggacugaggccuguuu

SEQ ID NO: 995271 - RNA, 22 nt, Human
uagaaaagaauuuuauuugaua

SEQ ID NO: 995272 - RNA, 20 nt, Human
guucucacugaucugcaggg

SEQ ID NO: 995273 - RNA, 21 nt, Human
uggcccuggccacggcugcca

SEQ ID NO: 995274 - RNA, 19 nt, Human
ggugaccaccuggucagug

SEQ ID NO: 995275 - RNA, 22 nt, Human
caaugauguuuagauaaaaucc

SEQ ID NO: 995276 - RNA, 22 nt, Human
cucucugaggcaggccuguggg

SEQ ID NO: 995277 - RNA, 17 nt, Human
ugagcaguagaagaugc

SEQ ID NO: 995278 - RNA, 18 nt, Human
cggcagagugcuucuagc

SEQ ID NO: 995279 - RNA, 22 nt, Human
auagaauagcauagaaaauuga

SEQ ID NO: 995280 - RNA, 20 nt, Human
uggagcugugguaaggagca

SEQ ID NO: 995281 - RNA, 22 nt, Human
ucugccuuuucacugccacuaa

SEQ ID NO: 995282 - RNA, 22 nt, Human
ugauuuccuaggucuggagaag

SEQ ID NO: 995283 - RNA, 22 nt, Human
uuucuuauauucugucauuguu

SEQ ID NO: 995284 - RNA, 22 nt, Human
ucccuggguccugcuugcucuc

SEQ ID NO: 995285 - RNA, 22 nt, Human
gcucucugccauaugaggauac

SEQ ID NO: 995286 - RNA, 23 nt, Human
aaguaacagggauaauagcaguu

SEQ ID NO: 995287 - RNA, 22 nt, Human
agaauccugaugaaaaggagag

SEQ ID NO: 995288 - RNA, 22 nt, Human
ucacauuuuccuugguaucugu

SEQ ID NO: 995289 - RNA, 17 nt, Human
cugagcauccgugcucu

SEQ ID NO: 995290 - RNA, 23 nt, Human
ucccagggaaggugagcgaggcu

SEQ ID NO: 995291 - RNA, 22 nt, Human
gcacacaguauaugcucauuaa

SEQ ID NO: 995292 - RNA, 22 nt, Human
ugaaguccuagaacuccuggua

SEQ ID NO: 995293 - RNA, 22 nt, Human
ccacagagacagagcccagggu

SEQ ID NO: 995294 - RNA, 22 nt, Human
ugucaccaguuccaggaaauaa

SEQ ID NO: 995295 - RNA, 17 nt, Human
ggugaguguccaggugg

SEQ ID NO: 995296 - RNA, 22 nt, Human
caggaaaaaugccaggagucag

SEQ ID NO: 995297 - RNA, 22 nt, Human
ucucaggguuuguacaagugua

SEQ ID NO: 995298 - RNA, 22 nt, Human
uucacagggcagcagcugagcc

SEQ ID NO: 995299 - RNA, 22 nt, Human
caggaacaauguaagucucauu

SEQ ID NO: 995300 - RNA, 22 nt, Human
uaaauguaccuucugccuuacu

SEQ ID NO: 995301 - RNA, 21 nt, Human
ucagggcagcugcucuucaga

SEQ ID NO: 995302 - RNA, 22 nt, Human
agagcuuagaauuucagaugau

SEQ ID NO: 995303 - RNA, 22 nt, Human
agagcugcaggguggacccagg

SEQ ID NO: 995304 - RNA, 22 nt, Human
cugugccuggggggcagagcug

SEQ ID NO: 995305 - RNA, 20 nt, Human
aguaggggaaugcaagagca

SEQ ID NO: 995306 - RNA, 22 nt, Human
acguguucaauuuccaucugac

SEQ ID NO: 995307 - RNA, 22 nt, Human
cuuucagagguuacucaggaaa

SEQ ID NO: 995308 - RNA, 22 nt, Human
agcagccaguucucugugguag

SEQ ID NO: 995309 - RNA, 22 nt, Human
agugaggcuaauaggcaauggu

SEQ ID NO: 995310 - RNA, 22 nt, Human
ccuuuuauacucagugauauca

SEQ ID NO: 995311 - RNA, 22 nt, Human
uuggccaagucacugguuaaug

SEQ ID NO: 995312 - RNA, 22 nt, Human
ccugucuggaacauggccuguu

SEQ ID NO: 995313 - RNA, 22 nt, Human
aggccaggcaacauucugaagu

SEQ ID NO: 995314 - RNA, 22 nt, Human
uccugccucaggcucuggagua

SEQ ID NO: 995315 - RNA, 22 nt, Human
ugcugccaggucuugcugucca

SEQ ID NO: 995316 - RNA, 22 nt, Human
agggcugagacuaaggccagau

SEQ ID NO: 995317 - RNA, 22 nt, Human
aggcagcaaagaaaugaugcug

SEQ ID NO: 995318 - RNA, 20 nt, Human
uaucaaucagaaagaagacu

SEQ ID NO: 995319 - RNA, 22 nt, Human
cacauuuaauccuuuauaagua

SEQ ID NO: 995320 - RNA, 22 nt, Human
gcaggagccacuucagggaugc

SEQ ID NO: 995321 - RNA, 22 nt, Human
cagcuggaucccugcagaacuu

SEQ ID NO: 995322 - RNA, 22 nt, Human
ugucucugagaugacucccacc

SEQ ID NO: 995323 - RNA, 22 nt, Human
gccaggcuggaaagaacagaca

SEQ ID NO: 995324 - RNA, 22 nt, Human
acauuucugcauguaggguaau

SEQ ID NO: 995325 - RNA, 22 nt, Human
gcucacagccggcuggcagggg

SEQ ID NO: 995326 - RNA, 22 nt, Human
agguuuucagcuguauccugag

SEQ ID NO: 995327 - RNA, 22 nt, Human
uacccagcuucaagucaggacu

SEQ ID NO: 995328 - RNA, 22 nt, Human
aagaugcuuauugcuccugcag

SEQ ID NO: 995329 - RNA, 18 nt, Human
cagcagagacauucaaaa

SEQ ID NO: 995330 - RNA, 22 nt, Human
cuuacauuuaaucaugugucau

SEQ ID NO: 995331 - RNA, 22 nt, Human
uccagggcuuggcugggacggu

SEQ ID NO: 995332 - RNA, 18 nt, Human
agcuggcccuggcugccg

SEQ ID NO: 995333 - RNA, 19 nt, Human
ugcagccacgugagagacu

SEQ ID NO: 995334 - RNA, 22 nt, Human
acagguggcuuauuggcugauu

SEQ ID NO: 995335 - RNA, 22 nt, Human
ucucuggcagggauaucuggcu

SEQ ID NO: 995336 - RNA, 22 nt, Human
ucucaagcuuguugguauguuu

SEQ ID NO: 995337 - RNA, 22 nt, Human
auccuugagccuuaucuuuugu

SEQ ID NO: 995338 - RNA, 22 nt, Human
guuugcauuucuugaacuauau

SEQ ID NO: 995339 - RNA, 22 nt, Human
uacauuguucaugcaugagaaa

SEQ ID NO: 995340 - RNA, 22 nt, Human
gaagccuugaacugcaaacccc

SEQ ID NO: 995341 - RNA, 22 nt, Human
ggagccugcgggagcucccauu

SEQ ID NO: 995342 - RNA, 22 nt, Human
ugcagaaggccugacauugcac

SEQ ID NO: 995343 - RNA, 22 nt, Human
gcucccaguucccaaagugacc

SEQ ID NO: 995344 - RNA, 22 nt, Human
cucccucugucuuguccagaaa

SEQ ID NO: 995345 - RNA, 22 nt, Human
cuggccuuuuguuucuggagaa

SEQ ID NO: 995346 - RNA, 22 nt, Human
aggccagcuguuacuagagcca

SEQ ID NO: 995347 - RNA, 22 nt, Human
uaaacaugugagugugcauaua

SEQ ID NO: 995348 - RNA, 18 nt, Human
aggcuucuuggcucaguc

SEQ ID NO: 995349 - RNA, 22 nt, Human
cagacaggcuagccagacucac

SEQ ID NO: 995350 - RNA, 23 nt, Human
gugauuucagggaacagaaucag

SEQ ID NO: 995351 - RNA, 22 nt, Human
aggucacacaacugucagaggc

SEQ ID NO: 995352 - RNA, 22 nt, Human
uguuccuaaauaugaauggaga

SEQ ID NO: 995353 - RNA, 22 nt, Human
cugcagggcagggccuccuggc

SEQ ID NO: 995354 - RNA, 22 nt, Human
gacagggcaagacucugucuaa

SEQ ID NO: 995355 - RNA, 22 nt, Human
ugacacagaaauuaagcuguca

SEQ ID NO: 995356 - RNA, 22 nt, Human
ucuuccaguguagacaucugcc

SEQ ID NO: 995357 - RNA, 22 nt, Human
ucgugucagaucagagguuccu

SEQ ID NO: 995358 - RNA, 22 nt, Human
cacugcucgcugcagcauggcc

SEQ ID NO: 995359 - RNA, 20 nt, Human
gcaaggcacagugaggaggg

SEQ ID NO: 995360 - RNA, 22 nt, Human
agcuggccuguuagagcugagu

SEQ ID NO: 995361 - RNA, 22 nt, Human
auuuaguguguauugcuauuau

SEQ ID NO: 995362 - RNA, 22 nt, Human
aagcugccaaugguaagcugcu

SEQ ID NO: 995363 - RNA, 22 nt, Human
aagaaauauugggccuuauaaa

SEQ ID NO: 995364 - RNA, 21 nt, Human
ggccugagcaccuguccaccu

SEQ ID NO: 995365 - RNA, 22 nt, Human
ugcucauuggcgaucugaggga

SEQ ID NO: 995366 - RNA, 21 nt, Human
cacugcagccuugaccugggc

SEQ ID NO: 995367 - RNA, 22 nt, Human
uagcaggguaaauguagaugga

SEQ ID NO: 995368 - RNA, 23 nt, Human
uggccugcagaguuucugcuggg

SEQ ID NO: 995369 - RNA, 22 nt, Human
caggcugaggcaguaggguuug

SEQ ID NO: 995370 - RNA, 22 nt, Human
gagaggccaaaaucccugcccc

SEQ ID NO: 995371 - RNA, 22 nt, Human
uggaaagagguagaggaucugg

SEQ ID NO: 995372 - RNA, 22 nt, Human
uuauguaccugaauuaguaaag

SEQ ID NO: 995373 - RNA, 22 nt, Human
auauucguggucaaguaaggcc

SEQ ID NO: 995374 - RNA, 22 nt, Human
gcucccaccuccagccugaguu

SEQ ID NO: 995375 - RNA, 18 nt, Human
uucagcagcagacacacu

SEQ ID NO: 995376 - RNA, 20 nt, Human
ucauugcacauaauggaagc

SEQ ID NO: 995377 - RNA, 22 nt, Human
ucuggagcuggagggcaaggca

SEQ ID NO: 995378 - RNA, 22 nt, Human
gcugucuucacuuccugguuuc

SEQ ID NO: 995379 - RNA, 22 nt, Human
gcucugcuggagggaaagagaa

SEQ ID NO: 995380 - RNA, 22 nt, Human
uaaugugugucaucaguagagu

SEQ ID NO: 995381 - RNA, 22 nt, Human
augcagagacagauguggcaug

SEQ ID NO: 995382 - RNA, 22 nt, Human
gccagagcacaggcugguagua

SEQ ID NO: 995383 - RNA, 22 nt, Human
cuguucaugcugauucuguaug

SEQ ID NO: 995384 - RNA, 22 nt, Human
ugggcaagucacuucugucuuu

SEQ ID NO: 995385 - RNA, 22 nt, Human
aggucauugaaguuauuuucuu

SEQ ID NO: 995386 - RNA, 18 nt, Human
gcagcugacacuggaguu

SEQ ID NO: 995387 - RNA, 22 nt, Human
ccagcuccgggaguugcugcug

SEQ ID NO: 995388 - RNA, 20 nt, Human
cugcugugugugccucagcc

SEQ ID NO: 995389 - RNA, 22 nt, Human
ccuccaggaacuugagagacac

SEQ ID NO: 995390 - RNA, 22 nt, Human
ggccacaagugguccugagucc

SEQ ID NO: 995391 - RNA, 22 nt, Human
ucauugucuugauaugauuguc

SEQ ID NO: 995392 - RNA, 22 nt, Human
gagacugcauuguccaaggguu

SEQ ID NO: 995393 - RNA, 22 nt, Human
cucugggcaggaccaguggacc

SEQ ID NO: 995394 - RNA, 22 nt, Human
cuggaaggcucugcugccuguc

SEQ ID NO: 995395 - RNA, 22 nt, Human
ccugggaggcugugggucugcu

SEQ ID NO: 995396 - RNA, 23 nt, Human
aaaguguagccagguuaagaacc

SEQ ID NO: 995397 - RNA, 22 nt, Human
cugccuggaaugccagcuucuc

SEQ ID NO: 995398 - RNA, 19 nt, Human
uccucagugacaaccucag

SEQ ID NO: 995399 - RNA, 22 nt, Human
agaaauguggaucguuuuaaaa

SEQ ID NO: 995400 - RNA, 22 nt, Human
cccagggcuuuucucacuagac

SEQ ID NO: 995401 - RNA, 22 nt, Human
gccaccagguuagauccagccu

SEQ ID NO: 995402 - RNA, 17 nt, Human
cuggagccaagagggcc

SEQ ID NO: 995403 - RNA, 22 nt, Human
ccuuuuauaaaguuguauugaa

SEQ ID NO: 995404 - RNA, 22 nt, Human
cugugcuucgcaacuccaaggu

SEQ ID NO: 995405 - RNA, 17 nt, Human
gcuuccugugcugggga

SEQ ID NO: 995406 - RNA, 22 nt, Human
ccagccagccuugaucugagua

SEQ ID NO: 995407 - RNA, 22 nt, Human
cucuggcuucuaccuugcaguu

SEQ ID NO: 995408 - RNA, 22 nt, Human
gugcaugugcauccauguguac

SEQ ID NO: 995409 - RNA, 22 nt, Human
auugacaaauggauguugacau

SEQ ID NO: 995410 - RNA, 22 nt, Human
uuucacaaagcauagcacuuua

SEQ ID NO: 995411 - RNA, 22 nt, Human
uaugcacaauaugaucuauuug

SEQ ID NO: 995412 - RNA, 22 nt, Human
gagcagugacuggagcaugaga

SEQ ID NO: 995413 - RNA, 22 nt, Human
agcaauaugacauugcuacauc

SEQ ID NO: 995414 - RNA, 22 nt, Human
uuggcucaggaccccugugacu

SEQ ID NO: 995415 - RNA, 22 nt, Human
acaggcugccuaccaaguauca

SEQ ID NO: 995416 - RNA, 22 nt, Human
ggccuggaaugcuuuccuacca

SEQ ID NO: 995417 - RNA, 22 nt, Human
aaggcugagggcuguaccuggc

SEQ ID NO: 995418 - RNA, 22 nt, Human
aucaguuuggugcuuucaguga

SEQ ID NO: 995419 - RNA, 22 nt, Human
augauuuccaguuguugcuaag

SEQ ID NO: 995420 - RNA, 20 nt, Human
auaauuuacccugcaccacu

SEQ ID NO: 995421 - RNA, 22 nt, Human
ggcugggagcuggacaggccgg

SEQ ID NO: 995422 - RNA, 22 nt, Human
cagcucccaguggcagcuccuu

SEQ ID NO: 995423 - RNA, 22 nt, Human
gcuguucugcgucccaggcugg

SEQ ID NO: 995424 - RNA, 22 nt, Human
ggcaggugcaccugagccaucu

SEQ ID NO: 995425 - RNA, 22 nt, Human
gugucaugggguuuguuauaca

SEQ ID NO: 995426 - RNA, 22 nt, Human
agagacaccgcgcaucauggcu

SEQ ID NO: 995427 - RNA, 22 nt, Human
aauaagauugacacaaguaccu

SEQ ID NO: 995428 - RNA, 22 nt, Human
cccaggccccagggcuugucag

SEQ ID NO: 995429 - RNA, 22 nt, Human
uaaauucugaucaaguuccuuc

SEQ ID NO: 995430 - RNA, 22 nt, Human
acaaggcugaacagugaagccg

SEQ ID NO: 995431 - RNA, 22 nt, Human
cagcccaggccgacaguuccuc

SEQ ID NO: 995432 - RNA, 22 nt, Human
uaggcaggugugcacugcccac

SEQ ID NO: 995433 - RNA, 22 nt, Human
gcugcucugcuguguaagcagg

SEQ ID NO: 995434 - RNA, 22 nt, Human
auacaaguugugauaauguaaa

SEQ ID NO: 995435 - RNA, 22 nt, Human
gccuggagaggaagccggugga

SEQ ID NO: 995436 - RNA, 22 nt, Human
guguccaucagcagccacugug

SEQ ID NO: 995437 - RNA, 22 nt, Human
uccagggagagccgcugcucca

SEQ ID NO: 995438 - RNA, 22 nt, Human
gucucagagagcuacucucuua

SEQ ID NO: 995439 - RNA, 22 nt, Human
ccaggagcagggcuggcugcac

SEQ ID NO: 995440 - RNA, 22 nt, Human
aggguggccaugagggagagau

SEQ ID NO: 995441 - RNA, 22 nt, Human
uccugggcuuuguuucucuccu

SEQ ID NO: 995442 - RNA, 22 nt, Human
caggagcucucaucgucagggc

SEQ ID NO: 995443 - RNA, 22 nt, Human
ugccucugugugcaggugagca

SEQ ID NO: 995444 - RNA, 22 nt, Human
ucuggccuauuucugucagauc

SEQ ID NO: 995445 - RNA, 22 nt, Human
ucugccaccaccuacacuagua

SEQ ID NO: 995446 - RNA, 22 nt, Human
cugcugcauuccucuuuaugag

SEQ ID NO: 995447 - RNA, 22 nt, Human
uuaaugcagaaaucaaacugac

SEQ ID NO: 995448 - RNA, 22 nt, Human
ucaggcuggaaugcaguggggc

SEQ ID NO: 995449 - RNA, 22 nt, Human
acaaaaagcuccauuacugucc

SEQ ID NO: 995450 - RNA, 22 nt, Human
gcugucccaugguugcaagaug

SEQ ID NO: 995451 - RNA, 22 nt, Human
gaaaaugugucaucccuacugu

SEQ ID NO: 995452 - RNA, 22 nt, Human
uggggcuguggauucucacgaa

SEQ ID NO: 995453 - RNA, 22 nt, Human
accuggcacuacaggcaccugu

SEQ ID NO: 995454 - RNA, 22 nt, Human
ucugucaggagauuggcagcug

SEQ ID NO: 995455 - RNA, 22 nt, Human
uaggaucucaccauagaaggaa

SEQ ID NO: 995456 - RNA, 22 nt, Human
gcccagcacauugcugaggacc

SEQ ID NO: 995457 - RNA, 22 nt, Human
ggcagcaguaggagcuaaucuu

SEQ ID NO: 995458 - RNA, 22 nt, Human
caggucagagucccccuguccu

SEQ ID NO: 995459 - RNA, 18 nt, Human
aggauauuaagaguacag

SEQ ID NO: 995460 - RNA, 22 nt, Human
ucccaguguggcaggccaugga

SEQ ID NO: 995461 - RNA, 22 nt, Human
uuuuuaagagauucuccagucu

SEQ ID NO: 995462 - RNA, 20 nt, Human
uuggcagcagcucagccacc

SEQ ID NO: 995463 - RNA, 22 nt, Human
auugaaaguccuaucuaaggga

SEQ ID NO: 995464 - RNA, 19 nt, Human
ucaaagcaagcauguucug

SEQ ID NO: 995465 - RNA, 22 nt, Human
aaauacagaguugcuuaaaagc

SEQ ID NO: 995466 - RNA, 22 nt, Human
aguggcaggcggagauguagga

SEQ ID NO: 995467 - RNA, 22 nt, Human
cugggcacuugcucacagcucu

SEQ ID NO: 995468 - RNA, 22 nt, Human
gggagcugagcuggaagagaau

SEQ ID NO: 995469 - RNA, 22 nt, Human
cgcagaagagguugucuagucc

SEQ ID NO: 995470 - RNA, 22 nt, Human
uauuugaaaguguacaaaaacu

SEQ ID NO: 995471 - RNA, 22 nt, Human
ugccaggaggaggugggacaga

SEQ ID NO: 995472 - RNA, 22 nt, Human
gaagcagccacggggagacaga

SEQ ID NO: 995473 - RNA, 22 nt, Human
guuauuagaagugaaggauugu

SEQ ID NO: 995474 - RNA, 22 nt, Human
aagccagguuccauggaggagc

SEQ ID NO: 995475 - RNA, 22 nt, Human
gcauuccuacaggcugcuauga

SEQ ID NO: 995476 - RNA, 22 nt, Human
gcaggccugacuguagggggca

SEQ ID NO: 995477 - RNA, 22 nt, Human
agccacagggggugagggacaa

SEQ ID NO: 995478 - RNA, 22 nt, Human
ucacgagaggcacagaauagag

SEQ ID NO: 995479 - RNA, 22 nt, Human
auuugagaugguaaauaacuuu

SEQ ID NO: 995480 - RNA, 22 nt, Human
gcagggcugcagagggcacugu

SEQ ID NO: 995481 - RNA, 22 nt, Human
uggccugucuuguugugcuaga

SEQ ID NO: 995482 - RNA, 22 nt, Human
gugcauauaugcacauaugugu

SEQ ID NO: 995483 - RNA, 22 nt, Human
uggccauagcucagcuccuuca

SEQ ID NO: 995484 - RNA, 22 nt, Human
uagggcagccuuauagcuccca

SEQ ID NO: 995485 - RNA, 22 nt, Human
gcugauguuuaguugauguuac

SEQ ID NO: 995486 - RNA, 22 nt, Human
gcaggagcccuggcauguucuu

SEQ ID NO: 995487 - RNA, 22 nt, Human
agguauagaauugaaaggguuu

SEQ ID NO: 995488 - RNA, 22 nt, Human
ugaugguugauuauaaaucagu

SEQ ID NO: 995489 - RNA, 22 nt, Human
cacugccuggaaggagagacau

SEQ ID NO: 995490 - RNA, 22 nt, Human
ggagugggcagcacugcccugu

SEQ ID NO: 995491 - RNA, 22 nt, Human
uuauuuucuccucagaaagugg

SEQ ID NO: 995492 - RNA, 22 nt, Human
ggagucccagcaaagccuuccc

SEQ ID NO: 995493 - RNA, 18 nt, Human
aggcuucccaggcaggcc

SEQ ID NO: 995494 - RNA, 22 nt, Human
uuucagaucauuuuuuaaguac

SEQ ID NO: 995495 - RNA, 22 nt, Human
ucacucugggcccuacugggcu

SEQ ID NO: 995496 - RNA, 22 nt, Human
ggcaguggguggaucucaggga

SEQ ID NO: 995497 - RNA, 22 nt, Human
ucacaggguguacaucaccuau

SEQ ID NO: 995498 - RNA, 22 nt, Human
ugucccaggcugaaguacagug

SEQ ID NO: 995499 - RNA, 22 nt, Human
ucuuugcaucccuuccauaguu

SEQ ID NO: 995500 - RNA, 18 nt, Human
cccagcccaccauuucuc

SEQ ID NO: 995501 - RNA, 22 nt, Human
guggccugccagcagauggcgc

SEQ ID NO: 995502 - RNA, 22 nt, Human
acagcaugucuaguuaaauacu

SEQ ID NO: 995503 - RNA, 22 nt, Human
caguggcugugaccagggaccu

SEQ ID NO: 995504 - RNA, 18 nt, Human
acagaggcagacauguau

SEQ ID NO: 995505 - RNA, 22 nt, Human
ucacagcaaaagugugcagagc

SEQ ID NO: 995506 - RNA, 22 nt, Human
cucuggaauguuuacaugcccu

SEQ ID NO: 995507 - RNA, 22 nt, Human
ggagugacucacagcugggaca

SEQ ID NO: 995508 - RNA, 22 nt, Human
caugaagcuugaagcaguccac

SEQ ID NO: 995509 - RNA, 22 nt, Human
gcagcuuggauuucuguaguuu

SEQ ID NO: 995510 - RNA, 22 nt, Human
gugggaugguagguagguaaua

SEQ ID NO: 995511 - RNA, 22 nt, Human
cuguagcaaguuauucaauaaa

SEQ ID NO: 995512 - RNA, 21 nt, Human
ccugagggugguugugaagau

SEQ ID NO: 995513 - RNA, 16 nt, Human
aggccaaaaaggggca

SEQ ID NO: 995514 - RNA, 22 nt, Human
cucacaggagaaagucaugguc

SEQ ID NO: 995515 - RNA, 22 nt, Human
gccaccucggcuuucucugcuc

SEQ ID NO: 995516 - RNA, 22 nt, Human
cugagccacugcuuguucagug

SEQ ID NO: 995517 - RNA, 22 nt, Human
gcuggaaggcuaggcucaguug

SEQ ID NO: 995518 - RNA, 22 nt, Human
uauaacaguuuaggugguguca

SEQ ID NO: 995519 - RNA, 22 nt, Human
uggcagggaguugcaggauuuc

SEQ ID NO: 995520 - RNA, 22 nt, Human
ucuaggagaaccaucagggagg

SEQ ID NO: 995521 - RNA, 21 nt, Human
gccacguuucagucuucucag

SEQ ID NO: 995522 - RNA, 22 nt, Human
agacagaacagaauaauuguug

SEQ ID NO: 995523 - RNA, 22 nt, Human
ggccucuguucugcauuccucc

SEQ ID NO: 995524 - RNA, 22 nt, Human
uacaugaacaaaauagcagaaa

SEQ ID NO: 995525 - RNA, 22 nt, Human
ccaggaggcagagguuacagug

SEQ ID NO: 995526 - RNA, 22 nt, Human
cucugagaggugagaagcagca

SEQ ID NO: 995527 - RNA, 22 nt, Human
uguguuccugccuggcucuggu

SEQ ID NO: 995528 - RNA, 22 nt, Human
cagaagaauggugucugagcuc

SEQ ID NO: 995529 - RNA, 22 nt, Human
aagguacaccaaaguucaaguu

SEQ ID NO: 995530 - RNA, 22 nt, Human
ugggcagacauugaguuuguuc

SEQ ID NO: 995531 - RNA, 22 nt, Human
gagaggaguaggcugauggugc

SEQ ID NO: 995532 - RNA, 17 nt, Human
cagggcugucugccuag

SEQ ID NO: 995533 - RNA, 23 nt, Human
ggucccaguggagaggccucacc

SEQ ID NO: 995534 - RNA, 22 nt, Human
uagaaaagauaacauucugugc

SEQ ID NO: 995535 - RNA, 22 nt, Human
aucuggcuggauucuuagcguu

SEQ ID NO: 995536 - RNA, 22 nt, Human
ugauuuccucuacuagcaauua

SEQ ID NO: 995537 - RNA, 22 nt, Human
cuggggcugcgguggaggagcc

SEQ ID NO: 995538 - RNA, 22 nt, Human
uacauugugauguuucaauaca

SEQ ID NO: 995539 - RNA, 22 nt, Human
uuuauauagagauuugugcaug

SEQ ID NO: 995540 - RNA, 22 nt, Human
caggaggcaucauggagcggac

SEQ ID NO: 995541 - RNA, 22 nt, Human
gcauaauauacaugcuugaucc

SEQ ID NO: 995542 - RNA, 22 nt, Human
uauuaucauugguaauaugguc

SEQ ID NO: 995543 - RNA, 18 nt, Human
ucagggaaucuuggccuu

SEQ ID NO: 995544 - RNA, 22 nt, Human
guggccugucagaagccguggg

SEQ ID NO: 995545 - RNA, 22 nt, Human
ggacacaagcuccggggcugca

SEQ ID NO: 995546 - RNA, 18 nt, Human
aaguaacagaagagcaca

SEQ ID NO: 995547 - RNA, 22 nt, Human
cugggccucaaucucagaguuu

SEQ ID NO: 995548 - RNA, 22 nt, Human
ggcucacgcaauuaucccggcc

SEQ ID NO: 995549 - RNA, 22 nt, Human
agcuguccuggcucaggcugug

SEQ ID NO: 995550 - RNA, 22 nt, Human
caguuucuguuuuaaauagcag

SEQ ID NO: 995551 - RNA, 22 nt, Human
agcccuucaaccugccuacucc

SEQ ID NO: 995552 - RNA, 22 nt, Human
gucaccagugcuaagaggugga

SEQ ID NO: 995553 - RNA, 23 nt, Human
cuccucguaacucuguggugggu

SEQ ID NO: 995554 - RNA, 22 nt, Human
gaugguuuggaaugaaguagcu

SEQ ID NO: 995555 - RNA, 22 nt, Human
ccagcuuguuugaagcucguca

SEQ ID NO: 995556 - RNA, 22 nt, Human
acucugcuuaauuaaaaccagg

SEQ ID NO: 995557 - RNA, 22 nt, Human
aaacucaaauuaaacuagcuua

SEQ ID NO: 995558 - RNA, 22 nt, Human
cagcccuggaacagcugacuca

SEQ ID NO: 995559 - RNA, 22 nt, Human
agcuguguguuuccacugagcu

SEQ ID NO: 995560 - RNA, 22 nt, Human
agccaaagaucagugugcaagu

SEQ ID NO: 995561 - RNA, 22 nt, Human
aucagcaaucaaauugcagagu

SEQ ID NO: 995562 - RNA, 22 nt, Human
aaaaaugucauuauggaacuga

SEQ ID NO: 995563 - RNA, 22 nt, Human
gcuggccauagaagccaaagag

SEQ ID NO: 995564 - RNA, 22 nt, Human
uggcagcaccagcaguguccuu

SEQ ID NO: 995565 - RNA, 22 nt, Human
acucugcuauugcagugcaaaa

SEQ ID NO: 995566 - RNA, 22 nt, Human
ccuaagaauuaaugaauacacc

SEQ ID NO: 995567 - RNA, 21 nt, Human
ccugagccuguuuauccagaa

SEQ ID NO: 995568 - RNA, 22 nt, Human
gccuggcaggggccugggagug

SEQ ID NO: 995569 - RNA, 22 nt, Human
gcacagcucgagcucaggaggg

SEQ ID NO: 995570 - RNA, 19 nt, Human
ccucugcuccaguuuccuu

SEQ ID NO: 995571 - RNA, 21 nt, Human
uccuccuucaaguccuggccu

SEQ ID NO: 995572 - RNA, 22 nt, Human
gcaccuuuuucuaggagaaugu

SEQ ID NO: 995573 - RNA, 22 nt, Human
ucucugauguauaucagagaac

SEQ ID NO: 995574 - RNA, 22 nt, Human
gggucagcugcugggggcugac

SEQ ID NO: 995575 - RNA, 22 nt, Human
ccugucugaaggcagggggaug

SEQ ID NO: 995576 - RNA, 21 nt, Human
ggcuccugcuuugugaggggc

SEQ ID NO: 995577 - RNA, 22 nt, Human
uugaaaggugaacaugaugcac

SEQ ID NO: 995578 - RNA, 22 nt, Human
agcugucuuucugccuccugau

SEQ ID NO: 995579 - RNA, 22 nt, Human
ucuucagagacucugagccccu

SEQ ID NO: 995580 - RNA, 23 nt, Human
cagaagcaccuguugacugcugc

SEQ ID NO: 995581 - RNA, 22 nt, Human
cugggccuagcaacagaggagu

SEQ ID NO: 995582 - RNA, 22 nt, Human
ugcugccaagcccgugcuccug

SEQ ID NO: 995583 - RNA, 17 nt, Human
agaugcuggccacaugu

SEQ ID NO: 995584 - RNA, 22 nt, Human
ucucuggagggcuccaggcggg

SEQ ID NO: 995585 - RNA, 22 nt, Human
caguuauuaugaggucauuagg

SEQ ID NO: 995586 - RNA, 22 nt, Human
guggccuuuccugaagaaauga

SEQ ID NO: 995587 - RNA, 22 nt, Human
agagauucauguuuacuguagg

SEQ ID NO: 995588 - RNA, 22 nt, Human
ugggcagaggcucugaagucca

SEQ ID NO: 995589 - RNA, 22 nt, Human
gcuggcugcgucaucacagggc

SEQ ID NO: 995590 - RNA, 21 nt, Human
auccuugaucagaagagugcu

SEQ ID NO: 995591 - RNA, 22 nt, Human
cagaaugcaaauuuuauaauau

SEQ ID NO: 995592 - RNA, 22 nt, Human
aauguguacaugacagauagaa

SEQ ID NO: 995593 - RNA, 22 nt, Human
caggacaguauaggcuuuagga

SEQ ID NO: 995594 - RNA, 22 nt, Human
caacagaagguguacuacugaa

SEQ ID NO: 995595 - RNA, 22 nt, Human
uauuuaauaaaacuauggcaug

SEQ ID NO: 995596 - RNA, 22 nt, Human
gaaggccucacucugcagcaua

SEQ ID NO: 995597 - RNA, 22 nt, Human
cccuggagggauuucucaauca

SEQ ID NO: 995598 - RNA, 22 nt, Human
ucacucugagaggucacuggaa

SEQ ID NO: 995599 - RNA, 22 nt, Human
aaggcacugacugugcagggga

SEQ ID NO: 995600 - RNA, 22 nt, Human
ggccucaguuucuucaacugua

SEQ ID NO: 995601 - RNA, 22 nt, Human
agucugcacucagguggagguc

SEQ ID NO: 995602 - RNA, 22 nt, Human
uuggccaaauaaucuugcagau

SEQ ID NO: 995603 - RNA, 22 nt, Human
ucugcuggccuuagcaggucua

SEQ ID NO: 995604 - RNA, 22 nt, Human
cucccuggcacagcgagagguu

SEQ ID NO: 995605 - RNA, 22 nt, Human
ucccagaggacuguuggugcua

SEQ ID NO: 995606 - RNA, 22 nt, Human
cuggagcccaggccuggugucu

SEQ ID NO: 995607 - RNA, 18 nt, Human
gucuggaggucaggagcu

SEQ ID NO: 995608 - RNA, 17 nt, Human
gcaaucucagucuccuu

SEQ ID NO: 995609 - RNA, 22 nt, Human
uuaguuaggaaacaaaguuguu

SEQ ID NO: 995610 - RNA, 22 nt, Human
ccugggagagucuguggucucc

SEQ ID NO: 995611 - RNA, 22 nt, Human
augguacaauguguuuguuagg

SEQ ID NO: 995612 - RNA, 22 nt, Human
ggcuggcacucuguccaguguc

SEQ ID NO: 995613 - RNA, 22 nt, Human
cggccaagccggggccccgaag

SEQ ID NO: 995614 - RNA, 22 nt, Human
gugccugggguugagcuaugaa

SEQ ID NO: 995615 - RNA, 22 nt, Human
agcugcucugauaaaccuacuu

SEQ ID NO: 995616 - RNA, 22 nt, Human
cugaggucucuuuccauaguga

SEQ ID NO: 995617 - RNA, 22 nt, Human
aggcacugguccauuuucugca

SEQ ID NO: 995618 - RNA, 22 nt, Human
aggccugacuugaauuuagggc

SEQ ID NO: 995619 - RNA, 22 nt, Human
aaaaauagcuucucuugucccu

SEQ ID NO: 995620 - RNA, 22 nt, Human
gcuggccucgcaggcaggaugu

SEQ ID NO: 995621 - RNA, 22 nt, Human
aaggugucacugggacaggaaa

SEQ ID NO: 995622 - RNA, 22 nt, Human
aaguaugugauacauguuaauu

SEQ ID NO: 995623 - RNA, 22 nt, Human
auuggucaggacuggcaugugg

SEQ ID NO: 995624 - RNA, 17 nt, Human
accagccucuccugggg

SEQ ID NO: 995625 - RNA, 22 nt, Human
gcagccacucucauuccacgug

SEQ ID NO: 995626 - RNA, 20 nt, Human
accauaauguuaauuacaaa

SEQ ID NO: 995627 - RNA, 22 nt, Human
aggagcuggaguccaggcaagu

SEQ ID NO: 995628 - RNA, 22 nt, Human
ucuggcagggguucugcacuug

SEQ ID NO: 995629 - RNA, 22 nt, Human
uccaguggugguuugaagggca

SEQ ID NO: 995630 - RNA, 22 nt, Human
ugcaggagcagagauggcugga

SEQ ID NO: 995631 - RNA, 22 nt, Human
ccugcugugaaacuggcauaug

SEQ ID NO: 995632 - RNA, 22 nt, Human
ucagugcagaauagugaugcau

SEQ ID NO: 995633 - RNA, 22 nt, Human
uugcauugauguuccuucuugc

SEQ ID NO: 995634 - RNA, 22 nt, Human
agcucccagcuccuuugagaga

SEQ ID NO: 995635 - RNA, 22 nt, Human
agcagaagaaagccacaugacu

SEQ ID NO: 995636 - RNA, 21 nt, Human
gagcauggcuuacaucagcag

SEQ ID NO: 995637 - RNA, 22 nt, Human
gcagggcucugcuguaguccua

SEQ ID NO: 995638 - RNA, 22 nt, Human
cagaauaugacaagauuuuccu

SEQ ID NO: 995639 - RNA, 22 nt, Human
auggcagggcagccucucagag

SEQ ID NO: 995640 - RNA, 22 nt, Human
uggagggcucuuucaccuggua

SEQ ID NO: 995641 - RNA, 22 nt, Human
cugguccuccuugccuucagau

SEQ ID NO: 995642 - RNA, 17 nt, Human
ucagcaaagacaaagga

SEQ ID NO: 995643 - RNA, 22 nt, Human
gccugucaauuuuguguacaau

SEQ ID NO: 995644 - RNA, 22 nt, Human
gggauggcucaaaggagucagg

SEQ ID NO: 995645 - RNA, 22 nt, Human
aaaaaugaaacggcugguuggc

SEQ ID NO: 995646 - RNA, 22 nt, Human
uuccgcuggggccgccuggcgg

SEQ ID NO: 995647 - RNA, 22 nt, Human
uggccacagccucugccaguuc

SEQ ID NO: 995648 - RNA, 23 nt, Human
aggaggaaaaguuaucugcugag

SEQ ID NO: 995649 - RNA, 16 nt, Human
gcuccugggcccucga

SEQ ID NO: 995650 - RNA, 22 nt, Human
ccuggggagaagagcuuccccc

SEQ ID NO: 995651 - RNA, 22 nt, Human
gagggcagagucuaaugaugca

SEQ ID NO: 995652 - RNA, 22 nt, Human
caaagguaaagaucugcugugg

SEQ ID NO: 995653 - RNA, 22 nt, Human
aaguuugacagaaguuucuaau

SEQ ID NO: 995654 - RNA, 22 nt, Human
ugcaccauguaaguggccacgu

SEQ ID NO: 995655 - RNA, 22 nt, Human
ugucaugcuuauguuacauacu

SEQ ID NO: 995656 - RNA, 22 nt, Human
caggcagcugacugucagauau

SEQ ID NO: 995657 - RNA, 22 nt, Human
aaaaagauguccugaaguuuag

SEQ ID NO: 995658 - RNA, 22 nt, Human
acagagcuuaauucaggagcuu

SEQ ID NO: 995659 - RNA, 22 nt, Human
uacacauguuuggcaaguaugu

SEQ ID NO: 995660 - RNA, 22 nt, Human
aggcugcuuucauggccgcccc

SEQ ID NO: 995661 - RNA, 22 nt, Human
cccagcaucuccaggcauggcc

SEQ ID NO: 995662 - RNA, 22 nt, Human
gaacagaauuaccgaagaucug

SEQ ID NO: 995663 - RNA, 22 nt, Human
ccagcugcuugggaaaaugucu

SEQ ID NO: 995664 - RNA, 22 nt, Human
uccugcagccacugcaggcaga

SEQ ID NO: 995665 - RNA, 22 nt, Human
acagggcagugucuugaaaaau

SEQ ID NO: 995666 - RNA, 22 nt, Human
aagggcagcugacagaugcuua

SEQ ID NO: 995667 - RNA, 22 nt, Human
uguccucuaauuggccucuugc

SEQ ID NO: 995668 - RNA, 22 nt, Human
aaggcagauauaaagacuagag

SEQ ID NO: 995669 - RNA, 22 nt, Human
cagcaagauuuuuaaagcaagg

SEQ ID NO: 995670 - RNA, 22 nt, Human
uggcuggggccugaauccugca

SEQ ID NO: 995671 - RNA, 22 nt, Human
aacuuuauuguuaggggcuaaa

SEQ ID NO: 995672 - RNA, 22 nt, Human
ccaccuccaccuauugccagcc

SEQ ID NO: 995673 - RNA, 22 nt, Human
uuggcuucuggcagucuggacg

SEQ ID NO: 995674 - RNA, 22 nt, Human
agccuggccugggcaggcacau

SEQ ID NO: 995675 - RNA, 22 nt, Human
uucaaugauuuuuagggaucau

SEQ ID NO: 995676 - RNA, 22 nt, Human
cugagccaguagucagggacaa

SEQ ID NO: 995677 - RNA, 23 nt, Human
acagcugcaccuggccgccuggc

SEQ ID NO: 995678 - RNA, 22 nt, Human
uccuuggcuuucuggagcuucu

SEQ ID NO: 995679 - RNA, 22 nt, Human
aaggcacuguacuaguuaguua

SEQ ID NO: 995680 - RNA, 22 nt, Human
ccagguggugaaagugggcccu

SEQ ID NO: 995681 - RNA, 22 nt, Human
ucagggcagguuaacuugggug

SEQ ID NO: 995682 - RNA, 22 nt, Human
ggugggcaacauuuggccugag

SEQ ID NO: 995683 - RNA, 22 nt, Human
gagcagaacaggccggguggga

SEQ ID NO: 995684 - RNA, 22 nt, Human
uuauuuaaaauguagguuggga

SEQ ID NO: 995685 - RNA, 22 nt, Human
aaaucagugcucauuugaaagg

SEQ ID NO: 995686 - RNA, 22 nt, Human
ccuuuucaacuaagauucugca

SEQ ID NO: 995687 - RNA, 20 nt, Human
cagcuuggaugagaggcuga

SEQ ID NO: 995688 - RNA, 22 nt, Human
gaguuauuggguggaaagguag

SEQ ID NO: 995689 - RNA, 22 nt, Human
cagggcaguuuuacuucucucu

SEQ ID NO: 995690 - RNA, 22 nt, Human
aaaucacuaaguuauagugugg

SEQ ID NO: 995691 - RNA, 22 nt, Human
uuguggaaauacagacuccaag

SEQ ID NO: 995692 - RNA, 22 nt, Human
ccaaagugcugagauuacaggu

SEQ ID NO: 995693 - RNA, 20 nt, Human
agccagaagaaggcuggaga

SEQ ID NO: 995694 - RNA, 20 nt, Human
ugugugcacacaugacauuc

SEQ ID NO: 995695 - RNA, 22 nt, Human
aaguuauuuccucgugacugaa

SEQ ID NO: 995696 - RNA, 22 nt, Human
cagagcugucauuugccaguga

SEQ ID NO: 995697 - RNA, 22 nt, Human
uauuaguagcuugaaauuggug

SEQ ID NO: 995698 - RNA, 22 nt, Human
gccugagcuacuagggagucug

SEQ ID NO: 995699 - RNA, 22 nt, Human
gguuggaggugggaauagcuag

SEQ ID NO: 995700 - RNA, 22 nt, Human
gcucugcugcuuacuagauggu

SEQ ID NO: 995701 - RNA, 22 nt, Human
caggccucaggggcucaggcug

SEQ ID NO: 995702 - RNA, 22 nt, Human
uccuuuuuaagucguuguggua

SEQ ID NO: 995703 - RNA, 22 nt, Human
aaucagaaaauucaguggaauu

SEQ ID NO: 995704 - RNA, 22 nt, Human
uaagaacagauaaaguuucccc

SEQ ID NO: 995705 - RNA, 22 nt, Human
acugugcaaugaguaauaaacu

SEQ ID NO: 995706 - RNA, 22 nt, Human
gcuggccaaaguguaccuggag

SEQ ID NO: 995707 - RNA, 22 nt, Human
ggguggcacaggugcagagggu

SEQ ID NO: 995708 - RNA, 22 nt, Human
ggcugcaggcagaggcugucug

SEQ ID NO: 995709 - RNA, 22 nt, Human
gaguguuccagaaacuggcccu

SEQ ID NO: 995710 - RNA, 22 nt, Human
aauuaguauugcgauucauuag

SEQ ID NO: 995711 - RNA, 22 nt, Human
gcagcagagcuuuguccuggcu

SEQ ID NO: 995712 - RNA, 22 nt, Human
uauuggugggggcagagagaga

SEQ ID NO: 995713 - RNA, 22 nt, Human
ucaugcccagagcaguaaauua

SEQ ID NO: 995714 - RNA, 22 nt, Human
ugaaagcacucacuucugcucu

SEQ ID NO: 995715 - RNA, 22 nt, Human
caagaugccccugguagggauc

SEQ ID NO: 995716 - RNA, 23 nt, Human
acuuuagauaaauuaugugcaca

SEQ ID NO: 995717 - RNA, 22 nt, Human
uugaaugaccaugaugcaaggg

SEQ ID NO: 995718 - RNA, 22 nt, Human
aguggcagagguugacugcagu

SEQ ID NO: 995719 - RNA, 22 nt, Human
ccucucccacguggcagaggcu

SEQ ID NO: 995720 - RNA, 22 nt, Human
uccagcucuaacaugcugggcc

SEQ ID NO: 995721 - RNA, 22 nt, Human
auauuucuugagcaccugguau

SEQ ID NO: 995722 - RNA, 22 nt, Human
uagacacaagagaaggguauaa

SEQ ID NO: 995723 - RNA, 22 nt, Human
auuucacucucccugccacuua

SEQ ID NO: 995724 - RNA, 22 nt, Human
aaauaguaaagugguagccauc

SEQ ID NO: 995725 - RNA, 22 nt, Human
acuggcugaaguuuacuuuuug

SEQ ID NO: 995726 - RNA, 22 nt, Human
gucccaggugggcuccaccucu

SEQ ID NO: 995727 - RNA, 22 nt, Human
agagcuggauggucaagauggc

SEQ ID NO: 995728 - RNA, 22 nt, Human
uccuugaaaaucuugguuuaga

SEQ ID NO: 995729 - RNA, 22 nt, Human
cuggccacuggagguggcaccc

SEQ ID NO: 995730 - RNA, 22 nt, Human
caggccugauacacugaacucu

SEQ ID NO: 995731 - RNA, 22 nt, Human
aaugcuguaaagaugcuaucug

SEQ ID NO: 995732 - RNA, 22 nt, Human
cguguggucccggcaaggcaag

SEQ ID NO: 995733 - RNA, 22 nt, Human
aaaaacuguaauuacuuuugca

SEQ ID NO: 995734 - RNA, 22 nt, Human
gggcuugcugauuugggcagga

SEQ ID NO: 995735 - RNA, 22 nt, Human
cuccagggagcuuggaaagacc

SEQ ID NO: 995736 - RNA, 22 nt, Human
cuggagccuucaccaggggaaa

SEQ ID NO: 995737 - RNA, 22 nt, Human
aucuggcuuaccuagggugccu

SEQ ID NO: 995738 - RNA, 22 nt, Human
aagugaguggccuggagaggug

SEQ ID NO: 995739 - RNA, 22 nt, Human
cugggcugcgggcgccccucca

SEQ ID NO: 995740 - RNA, 22 nt, Human
caagccugucucaccagugcua

SEQ ID NO: 995741 - RNA, 22 nt, Human
auuucuucaggucagaaauaga

SEQ ID NO: 995742 - RNA, 22 nt, Human
cagagacagaaaauggaucuag

SEQ ID NO: 995743 - RNA, 22 nt, Human
gcugagagcaaagcaugucuag

SEQ ID NO: 995744 - RNA, 22 nt, Human
uaugugaauacagcaguggaug

SEQ ID NO: 995745 - RNA, 22 nt, Human
uccagccaagggagguuacuag

SEQ ID NO: 995746 - RNA, 22 nt, Human
agggaucaaaaaauguacaugc

SEQ ID NO: 995747 - RNA, 22 nt, Human
guacuuccagccaagugagaca

SEQ ID NO: 995748 - RNA, 22 nt, Human
agcucccugagaugccacagca

SEQ ID NO: 995749 - RNA, 22 nt, Human
uggccugaauuauggcagaucu

SEQ ID NO: 995750 - RNA, 22 nt, Human
cagcagagcauuugguaggagg

SEQ ID NO: 995751 - RNA, 22 nt, Human
acugucucucuagcaguucagg

SEQ ID NO: 995752 - RNA, 22 nt, Human
guacauuggcaacucucuuaga

SEQ ID NO: 995753 - RNA, 22 nt, Human
cagggccauuggcguggcuguc

SEQ ID NO: 995754 - RNA, 22 nt, Human
ggugcuggacacguggcacucc

SEQ ID NO: 995755 - RNA, 22 nt, Human
agugucugccaacugcaugguc

SEQ ID NO: 995756 - RNA, 22 nt, Human
uuacaaagcguugagacaagua

SEQ ID NO: 995757 - RNA, 22 nt, Human
cucuggagaacuccuugugucu

SEQ ID NO: 995758 - RNA, 22 nt, Human
aguggccagugcugcucugggg

SEQ ID NO: 995759 - RNA, 22 nt, Human
ugugcagcuaguccuggacuug

SEQ ID NO: 995760 - RNA, 22 nt, Human
uccuggccuuauccccaaacug

SEQ ID NO: 995761 - RNA, 22 nt, Human
aggccugucuggggcucagcca

SEQ ID NO: 995762 - RNA, 22 nt, Human
ugggccugacucaccugccucc

SEQ ID NO: 995763 - RNA, 22 nt, Human
agccuggagaagauguguauug

SEQ ID NO: 995764 - RNA, 22 nt, Human
cauuuagacauuugauuugggg

SEQ ID NO: 995765 - RNA, 22 nt, Human
aaauaaguuaaacuagaaugau

SEQ ID NO: 995766 - RNA, 22 nt, Human
agccaggauggucucgaucggc

SEQ ID NO: 995767 - RNA, 22 nt, Human
cugcugggaaggucugcucagu

SEQ ID NO: 995768 - RNA, 22 nt, Human
auagugcaguggacugaguuaa

SEQ ID NO: 995769 - RNA, 22 nt, Human
ccagccuggagggcaguggugg

SEQ ID NO: 995770 - RNA, 22 nt, Human
acuuugcacuaaguuacucauu

SEQ ID NO: 995771 - RNA, 22 nt, Human
ggucagggcucuuccaguggcu

SEQ ID NO: 995772 - RNA, 22 nt, Human
cccccaaggccaggcugagacc

SEQ ID NO: 995773 - RNA, 22 nt, Human
uuuccucuuccgagggggaggc

SEQ ID NO: 995774 - RNA, 22 nt, Human
accuauuuaugcaauuaugaaa

SEQ ID NO: 995775 - RNA, 22 nt, Human
agucaguguagaaagcccaggc

SEQ ID NO: 995776 - RNA, 22 nt, Human
gaggggcuggguagggcaaccc

SEQ ID NO: 995777 - RNA, 22 nt, Human
ucucccagaggaucccagugga

SEQ ID NO: 995778 - RNA, 22 nt, Human
uguagcacagagcuuugacacu

SEQ ID NO: 995779 - RNA, 22 nt, Human
cagggccucuccuccaggaacu

SEQ ID NO: 995780 - RNA, 22 nt, Human
gagagcuguaauagucaugucu

SEQ ID NO: 995781 - RNA, 22 nt, Human
gucucccacuuucuggccucuu

SEQ ID NO: 995782 - RNA, 20 nt, Human
aggcacuggauuucuuauau

SEQ ID NO: 995783 - RNA, 22 nt, Human
gcccucagaguuccccacagug

SEQ ID NO: 995784 - RNA, 22 nt, Human
ucauccaguaccauggaaggca

SEQ ID NO: 995785 - RNA, 22 nt, Human
aggccaaauagcagguuugcua

SEQ ID NO: 995786 - RNA, 18 nt, Human
cauuaugugguuauagaa

SEQ ID NO: 995787 - RNA, 17 nt, Human
cauguguaugugggagu

SEQ ID NO: 995788 - RNA, 22 nt, Human
acauccugaagucagucauuug

SEQ ID NO: 995789 - RNA, 20 nt, Human
ugcucaggauggagaggugu

SEQ ID NO: 995790 - RNA, 22 nt, Human
gaggccacgguuuuccuugggg

SEQ ID NO: 995791 - RNA, 22 nt, Human
uguuuauaccuugguauaacca

SEQ ID NO: 995792 - RNA, 22 nt, Human
gccugggagggcagcagugugg

SEQ ID NO: 995793 - RNA, 22 nt, Human
gcauggcagugaggauggugcu

SEQ ID NO: 995794 - RNA, 22 nt, Human
cauuucuguacauguuuuggug

SEQ ID NO: 995795 - RNA, 22 nt, Human
uucaagaugccagggacgcggc

SEQ ID NO: 995796 - RNA, 21 nt, Human
gagcucucaggcaagaagcag

SEQ ID NO: 995797 - RNA, 22 nt, Human
cuggcagguggauggggacucc

SEQ ID NO: 995798 - RNA, 20 nt, Human
gcuuuuucuaauagcagucc

SEQ ID NO: 995799 - RNA, 22 nt, Human
agauuucccaaauacuuguuau

SEQ ID NO: 995800 - RNA, 22 nt, Human
uucaggauucuuucagacuggg

SEQ ID NO: 995801 - RNA, 22 nt, Human
gagcuggcuccgccaugcugcu

SEQ ID NO: 995802 - RNA, 22 nt, Human
gcagcuggagccagccagacac

SEQ ID NO: 995803 - RNA, 22 nt, Human
cccaggcagggacgugcucugg

SEQ ID NO: 995804 - RNA, 22 nt, Human
ccuagagcucugcuuuaucuaa

SEQ ID NO: 995805 - RNA, 17 nt, Human
ugcauguccuuuguucc

SEQ ID NO: 995806 - RNA, 22 nt, Human
ugccuggguucccaccccaaag

SEQ ID NO: 995807 - RNA, 22 nt, Human
aggcaguguauugcuagcggcu

SEQ ID NO: 995808 - RNA, 22 nt, Human
agaauucuggaguugggaggaa

SEQ ID NO: 995809 - RNA, 22 nt, Human
augauugguggucagcaguaug

SEQ ID NO: 995810 - RNA, 22 nt, Human
uuccuucucagcccucgaggau

SEQ ID NO: 995811 - RNA, 21 nt, Human
ucuuuccugcccaguugcccu

SEQ ID NO: 995812 - RNA, 22 nt, Human
aggagagagaacacuugggucc

SEQ ID NO: 995813 - RNA, 22 nt, Human
uauauagaaaagcagauguugg

SEQ ID NO: 995814 - RNA, 22 nt, Human
agugggcaugaucuggugucug

SEQ ID NO: 995815 - RNA, 22 nt, Human
acaaugcaccagcaucuucacc

SEQ ID NO: 995816 - RNA, 22 nt, Human
acacaguauuacaauaggugcu

SEQ ID NO: 995817 - RNA, 22 nt, Human
ugcauugcaguuaacucaguau

SEQ ID NO: 995818 - RNA, 22 nt, Human
agcugauuccacuuuuucccca

SEQ ID NO: 995819 - RNA, 22 nt, Human
uuuuauuaucuuugaaugggac

SEQ ID NO: 995820 - RNA, 18 nt, Human
uggcucuggacuugcucc

SEQ ID NO: 995821 - RNA, 22 nt, Human
gcugucaguuuuacccacagac

SEQ ID NO: 995822 - RNA, 22 nt, Human
cacacaggagagugcuggaggu

SEQ ID NO: 995823 - RNA, 22 nt, Human
ugguccugagcaccagccugac

SEQ ID NO: 995824 - RNA, 22 nt, Human
aaagauguuuuauaaguuaugg

SEQ ID NO: 995825 - RNA, 22 nt, Human
cagcaggguauacagggaauuu

SEQ ID NO: 995826 - RNA, 21 nt, Human
ucacaugcccauuacuggagc

SEQ ID NO: 995827 - RNA, 22 nt, Human
agcaggguuccaggaguugcag

SEQ ID NO: 995828 - RNA, 22 nt, Human
gaugauggacaaagcauuggug

SEQ ID NO: 995829 - RNA, 18 nt, Human
gcugagguggugucagag

SEQ ID NO: 995830 - RNA, 22 nt, Human
ccugggagguggagguugcagu

SEQ ID NO: 995831 - RNA, 22 nt, Human
ccaggcagcaaauuuucugaau

SEQ ID NO: 995832 - RNA, 22 nt, Human
ucccagagugagccaggggcag

SEQ ID NO: 995833 - RNA, 22 nt, Human
gcagacaggcccaguggaggga

SEQ ID NO: 995834 - RNA, 22 nt, Human
gggcugcuuuuuucuuagcaga

SEQ ID NO: 995835 - RNA, 21 nt, Human
aggcagaaagagcccaggcug

SEQ ID NO: 995836 - RNA, 22 nt, Human
ccacagggcacaagggagguug

SEQ ID NO: 995837 - RNA, 22 nt, Human
ugugugccugagccgugccugg

SEQ ID NO: 995838 - RNA, 22 nt, Human
cugcugcugagagcucagccug

SEQ ID NO: 995839 - RNA, 21 nt, Human
uguaugcacgcacaugcacac

SEQ ID NO: 995840 - RNA, 22 nt, Human
uagcugccuuugggcuccugcu

SEQ ID NO: 995841 - RNA, 22 nt, Human
ugggcugcccugaugguccuca

SEQ ID NO: 995842 - RNA, 22 nt, Human
agaaaugaagcaggaguuauua

SEQ ID NO: 995843 - RNA, 22 nt, Human
aaagccuugggauuugugauca

SEQ ID NO: 995844 - RNA, 22 nt, Human
cugagaaggaagccuccacucu

SEQ ID NO: 995845 - RNA, 22 nt, Human
ccagagacgucggucagggcgc

SEQ ID NO: 995846 - RNA, 22 nt, Human
uggcaucauagccaaggugcuu

SEQ ID NO: 995847 - RNA, 22 nt, Human
cucagaaguucagccuagagua

SEQ ID NO: 995848 - RNA, 22 nt, Human
agagccuugaagaucuggaaaa

SEQ ID NO: 995849 - RNA, 22 nt, Human
gggauggggggaagcguccaug

SEQ ID NO: 995850 - RNA, 22 nt, Human
gggcacugcuggaggcucccug

SEQ ID NO: 995851 - RNA, 17 nt, Human
ucugaagccagucugcu

SEQ ID NO: 995852 - RNA, 22 nt, Human
ugagggaguuggguguauagga

SEQ ID NO: 995853 - RNA, 18 nt, Human
gcuccuggagucugacuc

SEQ ID NO: 995854 - RNA, 22 nt, Human
agggagaaaauuggaugcacaa

SEQ ID NO: 995855 - RNA, 22 nt, Human
auucacaaaugcugccccauuc

SEQ ID NO: 995856 - RNA, 22 nt, Human
gcugcuuccuuuccugcugacc

SEQ ID NO: 995857 - RNA, 19 nt, Human
uuucaauggcuuagagaaa

SEQ ID NO: 995858 - RNA, 22 nt, Human
cucagaguggggcucccugagg

SEQ ID NO: 995859 - RNA, 18 nt, Human
cagggccccagaauuauc

SEQ ID NO: 995860 - RNA, 22 nt, Human
gaaaggucaguuccacuuccau

SEQ ID NO: 995861 - RNA, 22 nt, Human
agggggaggcugugcugcgucu

SEQ ID NO: 995862 - RNA, 22 nt, Human
ggcuggcucagggcuugagaga

SEQ ID NO: 995863 - RNA, 22 nt, Human
cagggugcgccacucagaugua

SEQ ID NO: 995864 - RNA, 22 nt, Human
acucugcucuguauuucacugu

SEQ ID NO: 995865 - RNA, 22 nt, Human
ggcccugagcugaaguacugug

SEQ ID NO: 995866 - RNA, 22 nt, Human
cuguacaggugaggagggggcu

SEQ ID NO: 995867 - RNA, 22 nt, Human
agaaaugugaauuucauuuccu

SEQ ID NO: 995868 - RNA, 22 nt, Human
ucagcagaggggaaggcaucug

SEQ ID NO: 995869 - RNA, 17 nt, Human
uuccccugaccaagccu

SEQ ID NO: 995870 - RNA, 22 nt, Human
ccuggcugcuuucacuauggag

SEQ ID NO: 995871 - RNA, 22 nt, Human
gcucucugccuuucucaaugac

SEQ ID NO: 995872 - RNA, 18 nt, Human
gcccagaggucugggccc

SEQ ID NO: 995873 - RNA, 22 nt, Human
gccagccccuuagggcucuccc

SEQ ID NO: 995874 - RNA, 22 nt, Human
cucagaguccccaguggguuug

SEQ ID NO: 995875 - RNA, 22 nt, Human
ugauacagucagcucacaauug

SEQ ID NO: 995876 - RNA, 22 nt, Human
uaaaccuugguagcaucuugcu

SEQ ID NO: 995877 - RNA, 22 nt, Human
gcauuuguguucuuccuagagc

SEQ ID NO: 995878 - RNA, 22 nt, Human
aaauauuagggagaacagggac

SEQ ID NO: 995879 - RNA, 22 nt, Human
ugaggccaggaucccaggcucu

SEQ ID NO: 995880 - RNA, 22 nt, Human
gcccagccuccaagcuccaagg

SEQ ID NO: 995881 - RNA, 22 nt, Human
aaagguuaguucuuagaagugc

SEQ ID NO: 995882 - RNA, 22 nt, Human
agggcagcacaaggcauggacu

SEQ ID NO: 995883 - RNA, 22 nt, Human
gcuucuggaggagcugggcuga

SEQ ID NO: 995884 - RNA, 22 nt, Human
auuguacaugcagugagucauc

SEQ ID NO: 995885 - RNA, 22 nt, Human
ccugggugacccgugagcgucc

SEQ ID NO: 995886 - RNA, 22 nt, Human
uggggcuggggaucuugagccu

SEQ ID NO: 995887 - RNA, 22 nt, Human
ugcagaagcagagccgguggcc

SEQ ID NO: 995888 - RNA, 22 nt, Human
agucucagggccacccggggaa

SEQ ID NO: 995889 - RNA, 22 nt, Human
agcagcuggggccugugacgau

SEQ ID NO: 995890 - RNA, 22 nt, Human
cagucacauugcccugcauuua

SEQ ID NO: 995891 - RNA, 22 nt, Human
guacuuccguggacuaauuguu

SEQ ID NO: 995892 - RNA, 22 nt, Human
uacagaaaucacaucgcuuuga

SEQ ID NO: 995893 - RNA, 22 nt, Human
uaaauguguguagccaucugug

SEQ ID NO: 995894 - RNA, 21 nt, Human
gaaaggucuuaacuuacagag

SEQ ID NO: 995895 - RNA, 22 nt, Human
gaagcagcuaggaucuucauuu

SEQ ID NO: 995896 - RNA, 22 nt, Human
uggcacugccaaccugcuaggu

SEQ ID NO: 995897 - RNA, 22 nt, Human
gggugggguguaucggauccua

SEQ ID NO: 995898 - RNA, 22 nt, Human
guccuggcccacuggcaggcug

SEQ ID NO: 995899 - RNA, 22 nt, Human
cacagcuaggaggaaagcagag

SEQ ID NO: 995900 - RNA, 22 nt, Human
caggccugggcuucggggcuga

SEQ ID NO: 995901 - RNA, 22 nt, Human
aaggcagccucugccagccggg

SEQ ID NO: 995902 - RNA, 22 nt, Human
ucaguguagcagacuuguagcc

SEQ ID NO: 995903 - RNA, 22 nt, Human
gccuuuuuuguugcucugucac

SEQ ID NO: 995904 - RNA, 22 nt, Human
ggucuuccgagaggccugugcu

SEQ ID NO: 995905 - RNA, 22 nt, Human
cugcccaaauccuucuuccucu

SEQ ID NO: 995906 - RNA, 22 nt, Human
auuaggauguguauauuguguu

SEQ ID NO: 995907 - RNA, 22 nt, Human
ugucacauaggcaaaauguuuu

SEQ ID NO: 995908 - RNA, 22 nt, Human
cuucacaaucaccuuuucggaa

SEQ ID NO: 995909 - RNA, 22 nt, Human
cuggccuagcucucugcuugaa

SEQ ID NO: 995910 - RNA, 22 nt, Human
ggcugcagguugguuggcagcu

SEQ ID NO: 995911 - RNA, 22 nt, Human
uauguacaucguugaauucaaa

SEQ ID NO: 995912 - RNA, 22 nt, Human
cuccucacuuuccagacugggc

SEQ ID NO: 995913 - RNA, 22 nt, Human
ugcuucaggagaugucaccaug

SEQ ID NO: 995914 - RNA, 22 nt, Human
agcugcuguggggcucggccug

SEQ ID NO: 995915 - RNA, 22 nt, Human
ugagagugauugguucgaaugu

SEQ ID NO: 995916 - RNA, 22 nt, Human
ucucuggagcugcagauccagg

SEQ ID NO: 995917 - RNA, 22 nt, Human
cugcuuuguaaaauagacauaa

SEQ ID NO: 995918 - RNA, 22 nt, Human
aagauuucagaguuugggggaa

SEQ ID NO: 995919 - RNA, 18 nt, Human
ccagguggugacagagau

SEQ ID NO: 995920 - RNA, 22 nt, Human
gaggcugggaaguccaagacca

SEQ ID NO: 995921 - RNA, 22 nt, Human
uguggcugacuccuggucccca

SEQ ID NO: 995922 - RNA, 22 nt, Human
agcaguggagcgagauguuuaa

SEQ ID NO: 995923 - RNA, 22 nt, Human
acauuucuaauuuaauguaaca

SEQ ID NO: 995924 - RNA, 22 nt, Human
ugcuauugugaacagugccaca

SEQ ID NO: 995925 - RNA, 22 nt, Human
agcuauguauaaauaggccacu

SEQ ID NO: 995926 - RNA, 22 nt, Human
agggcagagacaugcuuccuga

SEQ ID NO: 995927 - RNA, 22 nt, Human
aaaauggucucagcuggcacca

SEQ ID NO: 995928 - RNA, 22 nt, Human
uccucugcuccaggcuggacuu

SEQ ID NO: 995929 - RNA, 22 nt, Human
aaaggcuaugagauagaagaua

SEQ ID NO: 995930 - RNA, 22 nt, Human
ucauugaauauggggccauaca

SEQ ID NO: 995931 - RNA, 22 nt, Human
cuggcccagagagcagagcuua

SEQ ID NO: 995932 - RNA, 22 nt, Human
gaaaugcagaaccugagaccau

SEQ ID NO: 995933 - RNA, 21 nt, Human
ugcuuuaugggaaaaauguca

SEQ ID NO: 995934 - RNA, 22 nt, Human
agauuucacaugcugcucuauu

SEQ ID NO: 995935 - RNA, 22 nt, Human
agccagggauggcagugcccag

SEQ ID NO: 995936 - RNA, 22 nt, Human
uugcucaggcuuagagcuacua

SEQ ID NO: 995937 - RNA, 22 nt, Human
ugagcccaggaguuggagaccg

SEQ ID NO: 995938 - RNA, 22 nt, Human
uccugcugagcgucugucauuu

SEQ ID NO: 995939 - RNA, 21 nt, Human
ugagagccuccaaccggcuac

SEQ ID NO: 995940 - RNA, 22 nt, Human
gagugugggcacgggggccuug

SEQ ID NO: 995941 - RNA, 22 nt, Human
ucuccugggaggacaaggaagg

SEQ ID NO: 995942 - RNA, 22 nt, Human
ccacucugauuuuggcuccacu

SEQ ID NO: 995943 - RNA, 22 nt, Human
ggugcagaaggaagggagcugg

SEQ ID NO: 995944 - RNA, 22 nt, Human
auuuccucaugaucauaaugca

SEQ ID NO: 995945 - RNA, 22 nt, Human
agccuggagguaaugaggaaac

SEQ ID NO: 995946 - RNA, 22 nt, Human
gcaaggcugagcacauuugcau

SEQ ID NO: 995947 - RNA, 22 nt, Human
uguggugagaaacugguagauu

SEQ ID NO: 995948 - RNA, 22 nt, Human
agugugaccuuauuuggaaaca

SEQ ID NO: 995949 - RNA, 22 nt, Human
uuuccucugggcccugccaccc

SEQ ID NO: 995950 - RNA, 22 nt, Human
gcuccuggugcaaaguuucuuc

SEQ ID NO: 995951 - RNA, 22 nt, Human
ggaagugaggaauuagguuuau

SEQ ID NO: 995952 - RNA, 22 nt, Human
cagagccaggccugcccucuuu

SEQ ID NO: 995953 - RNA, 21 nt, Human
cacucaggguaugugccaggc

SEQ ID NO: 995954 - RNA, 22 nt, Human
aaugaaauguagcuuauccaua

SEQ ID NO: 995955 - RNA, 22 nt, Human
aagaacaguguccugggacucg

SEQ ID NO: 995956 - RNA, 22 nt, Human
gcaggagucacugacuuggucc

SEQ ID NO: 995957 - RNA, 22 nt, Human
ugaagcaggugaauggaugucg

SEQ ID NO: 995958 - RNA, 22 nt, Human
gcuggccaggaagagucucaga

SEQ ID NO: 995959 - RNA, 22 nt, Human
auauaauaguuucauaaaggcu

SEQ ID NO: 995960 - RNA, 22 nt, Human
ucucuggguuuuuguccuguac

SEQ ID NO: 995961 - RNA, 22 nt, Human
aaaaucugguaauuugaaugug

SEQ ID NO: 995962 - RNA, 18 nt, Human
acuaugcugaauaaaugg

SEQ ID NO: 995963 - RNA, 22 nt, Human
gugaccaucagagaauaacaaa

SEQ ID NO: 995964 - RNA, 22 nt, Human
accagagcgcucaagccuuccc

SEQ ID NO: 995965 - RNA, 22 nt, Human
ggaagugaggaaauauuuuguu

SEQ ID NO: 995966 - RNA, 22 nt, Human
uguaggaguccaaucaggagac

SEQ ID NO: 995967 - RNA, 22 nt, Human
uucucuucuguucagugcccaa

SEQ ID NO: 995968 - RNA, 22 nt, Human
agggcuggccacaugauuuggu

SEQ ID NO: 995969 - RNA, 22 nt, Human
gagugaaaaaggaagggccaua

SEQ ID NO: 995970 - RNA, 22 nt, Human
ugccaggccucaggagucucca

SEQ ID NO: 995971 - RNA, 20 nt, Human
aggccaaacccagcgcgccc

SEQ ID NO: 995972 - RNA, 22 nt, Human
agcccuagagcuggaggucagu

SEQ ID NO: 995973 - RNA, 22 nt, Human
gcagcaggcacggucucgacau

SEQ ID NO: 995974 - RNA, 22 nt, Human
ggucucaggagacuggagagca

SEQ ID NO: 995975 - RNA, 22 nt, Human
gggugggccugucuggccaugu

SEQ ID NO: 995976 - RNA, 22 nt, Human
caaguaaagaaucacauuucuu

SEQ ID NO: 995977 - RNA, 22 nt, Human
ucugagagguuaagcaauuuga

SEQ ID NO: 995978 - RNA, 22 nt, Human
ugagccaguggaagauggcagu

SEQ ID NO: 995979 - RNA, 22 nt, Human
cuguccugauggugccacuggu

SEQ ID NO: 995980 - RNA, 22 nt, Human
cugccacuagcuuucacaucuu

SEQ ID NO: 995981 - RNA, 17 nt, Human
agaaagaggauccacag

SEQ ID NO: 995982 - RNA, 22 nt, Human
ggccagagagccgcuguuagga

SEQ ID NO: 995983 - RNA, 22 nt, Human
agcaucuggucaugagugagaa

SEQ ID NO: 995984 - RNA, 22 nt, Human
gaucaaaagcuggguucuaaaa

SEQ ID NO: 995985 - RNA, 20 nt, Human
auggccaaccugcuuaugac

SEQ ID NO: 995986 - RNA, 22 nt, Human
uuguuuuggagaugagcuaaaa

SEQ ID NO: 995987 - RNA, 22 nt, Human
aguacuuugcacuuugcucaga

SEQ ID NO: 995988 - RNA, 19 nt, Human
acaaagcugugagcagcuu

SEQ ID NO: 995989 - RNA, 22 nt, Human
agagcugugaaaaugagguuug

SEQ ID NO: 995990 - RNA, 22 nt, Human
uggcccugcuguaucaucugcu

SEQ ID NO: 995991 - RNA, 22 nt, Human
auacuuacuuuucuucagacua

SEQ ID NO: 995992 - RNA, 22 nt, Human
gaggccugcuuuggcacucugg

SEQ ID NO: 995993 - RNA, 22 nt, Human
uuggccaauuuagaacguguug

SEQ ID NO: 995994 - RNA, 22 nt, Human
ccugggcuugcaucugugcugg

SEQ ID NO: 995995 - RNA, 22 nt, Human
uggcuuucucccccagcuucuc

SEQ ID NO: 995996 - RNA, 22 nt, Human
uccucagaugcucuuggacgcc

SEQ ID NO: 995997 - RNA, 22 nt, Human
aaaugcacaggagaaccaauuc

SEQ ID NO: 995998 - RNA, 22 nt, Human
cucccaagggguaagggagcug

SEQ ID NO: 995999 - RNA, 22 nt, Human
uccuauugguagacauuucugu

SEQ ID NO: 996000 - RNA, 22 nt, Human
ucucuggaauuuugagagugac

SEQ ID NO: 996001 - RNA, 22 nt, Human
cugagguggaacagaggugaag

SEQ ID NO: 996002 - RNA, 21 nt, Human
cugcucugacagugaggccag

SEQ ID NO: 996003 - RNA, 22 nt, Human
ccuucugcucccuggccagggc

SEQ ID NO: 996004 - RNA, 22 nt, Human
ggagugaaucacuagaugcaga

SEQ ID NO: 996005 - RNA, 22 nt, Human
gagcugucuggggacucugggu

SEQ ID NO: 996006 - RNA, 22 nt, Human
cacagaaguuucauagucucga

SEQ ID NO: 996007 - RNA, 22 nt, Human
cacagggcuuugauggcugagu

SEQ ID NO: 996008 - RNA, 22 nt, Human
auguagcagauauuugugcaca

SEQ ID NO: 996009 - RNA, 22 nt, Human
gccuggagggucccucucugga

SEQ ID NO: 996010 - RNA, 22 nt, Human
ccaggcugggcggggaaccugg

SEQ ID NO: 996011 - RNA, 22 nt, Human
cucacuggcaagacuacaggug

SEQ ID NO: 996012 - RNA, 22 nt, Human
gcugucaggaacaugccuuggu

SEQ ID NO: 996013 - RNA, 22 nt, Human
ugcagugggccggaggccaggg

SEQ ID NO: 996014 - RNA, 22 nt, Human
ucagaagacuacuaggacacau

SEQ ID NO: 996015 - RNA, 22 nt, Human
ugccagcaguagcaguaggcca

SEQ ID NO: 996016 - RNA, 22 nt, Human
gucacuggggccacaugcagaa

SEQ ID NO: 996017 - RNA, 22 nt, Human
uuagaaaauuugcuucuuugga

SEQ ID NO: 996018 - RNA, 22 nt, Human
guuauaaauaccuaauaggauu

SEQ ID NO: 996019 - RNA, 22 nt, Human
aacauuucugagaauaucaguu

SEQ ID NO: 996020 - RNA, 22 nt, Human
agaugcugugucuguucccuug

SEQ ID NO: 996021 - RNA, 22 nt, Human
uaaagcacgucuauuuaaugau

SEQ ID NO: 996022 - RNA, 22 nt, Human
acagcuggcaggggggcaugaa

SEQ ID NO: 996023 - RNA, 18 nt, Human
ugacucacccugucagug

SEQ ID NO: 996024 - RNA, 20 nt, Human
acccagcucugugcccuggg

SEQ ID NO: 996025 - RNA, 22 nt, Human
uuccuuguuuguagcucuggga

SEQ ID NO: 996026 - RNA, 22 nt, Human
uccugccuucauacugcuguau

SEQ ID NO: 996027 - RNA, 22 nt, Human
uuggccuuguuaaggaggcccu

SEQ ID NO: 996028 - RNA, 22 nt, Human
gucuuucuuaauucaagugcuu

SEQ ID NO: 996029 - RNA, 22 nt, Human
gcucagaggagcaucauaagga

SEQ ID NO: 996030 - RNA, 22 nt, Human
cucuggacagcaggugcugugg

SEQ ID NO: 996031 - RNA, 18 nt, Human
acagacaaaauggaaaug

SEQ ID NO: 996032 - RNA, 22 nt, Human
acagaccucuagauuacauuug

SEQ ID NO: 996033 - RNA, 22 nt, Human
cuuuugauaguugcugagcagg

SEQ ID NO: 996034 - RNA, 22 nt, Human
auguagcagaagauguuuuccu

SEQ ID NO: 996035 - RNA, 22 nt, Human
caggcagcagaggaguguggga

SEQ ID NO: 996036 - RNA, 22 nt, Human
auauauaagcugaugagccaca

SEQ ID NO: 996037 - RNA, 22 nt, Human
agcacagauucugaagaguccu

SEQ ID NO: 996038 - RNA, 22 nt, Human
uccuggcccggccgggccugcu

SEQ ID NO: 996039 - RNA, 22 nt, Human
cagccagggagcaaagaguuga

SEQ ID NO: 996040 - RNA, 22 nt, Human
auaauaacaccugaauaggaaa

SEQ ID NO: 996041 - RNA, 22 nt, Human
ugguuuugcuccaguauaaaua

SEQ ID NO: 996042 - RNA, 22 nt, Human
uguacaguguagucaugagguu

SEQ ID NO: 996043 - RNA, 22 nt, Human
gcucccaggaagagaagggcca

SEQ ID NO: 996044 - RNA, 22 nt, Human
agcugcugagagucugccgggc

SEQ ID NO: 996045 - RNA, 22 nt, Human
agcuguguggugucugacagcu

SEQ ID NO: 996046 - RNA, 19 nt, Human
cugggccagaaucagcuca

SEQ ID NO: 996047 - RNA, 22 nt, Human
gaagcagcagcuggggacaguu

SEQ ID NO: 996048 - RNA, 22 nt, Human
agggcuggagccacagcuggga

SEQ ID NO: 996049 - RNA, 20 nt, Human
gcugccuuguccugcuuggu

SEQ ID NO: 996050 - RNA, 22 nt, Human
acccagaggugucuagcaagcu

SEQ ID NO: 996051 - RNA, 23 nt, Human
agccagggcacugguggagauug

SEQ ID NO: 996052 - RNA, 22 nt, Human
ugcacacaguucucaggaaaga

SEQ ID NO: 996053 - RNA, 22 nt, Human
ucuggcucuaacuaggcaucag

SEQ ID NO: 996054 - RNA, 22 nt, Human
uugaggagucaggggcacggaa

SEQ ID NO: 996055 - RNA, 22 nt, Human
aauuuggcagugucuugaagua

SEQ ID NO: 996056 - RNA, 22 nt, Human
cagcaucuuucucuucuggagu

SEQ ID NO: 996057 - RNA, 22 nt, Human
cugagccagagggagucggguc

SEQ ID NO: 996058 - RNA, 23 nt, Human
cuggcuccgaagacuccaggauc

SEQ ID NO: 996059 - RNA, 22 nt, Human
acagacauucagcuaagucuau

SEQ ID NO: 996060 - RNA, 22 nt, Human
uauaguacauggaaucuucaua

SEQ ID NO: 996061 - RNA, 20 nt, Human
gauuucaaagcagaguggcc

SEQ ID NO: 996062 - RNA, 22 nt, Human
ucagccacuacccaccuuaaca

SEQ ID NO: 996063 - RNA, 22 nt, Human
aagggcaggaaaagauggaugu

SEQ ID NO: 996064 - RNA, 22 nt, Human
ccugggucacucaggcaggcgg

SEQ ID NO: 996065 - RNA, 22 nt, Human
auggauaagaacaaauaucuga

SEQ ID NO: 996066 - RNA, 22 nt, Human
gucccuggaucugggacagcug

SEQ ID NO: 996067 - RNA, 22 nt, Human
cccucagcuucucccugcagcu

SEQ ID NO: 996068 - RNA, 18 nt, Human
ggaaaaggagugucuagc

SEQ ID NO: 996069 - RNA, 22 nt, Human
cagcacugcugcuguacacaca

SEQ ID NO: 996070 - RNA, 22 nt, Human
gcagaaggucuggcacuucagg

SEQ ID NO: 996071 - RNA, 22 nt, Human
auuagggaaggauuuggccuga

SEQ ID NO: 996072 - RNA, 22 nt, Human
aaggcagcccuggcucagccug

SEQ ID NO: 996073 - RNA, 22 nt, Human
agaaagcacucugucuuuuacc

SEQ ID NO: 996074 - RNA, 18 nt, Human
ggagccagucugucucug

SEQ ID NO: 996075 - RNA, 22 nt, Human
cauucauuuacuuucaacagcu

SEQ ID NO: 996076 - RNA, 22 nt, Human
uuugggaagaggaaucucugga

SEQ ID NO: 996077 - RNA, 22 nt, Human
aauuucaaacuaauaggaacca

SEQ ID NO: 996078 - RNA, 22 nt, Human
ccuggcugggguagaagugagg

SEQ ID NO: 996079 - RNA, 22 nt, Human
gccaggcuggcaaaaggaaacc

SEQ ID NO: 996080 - RNA, 22 nt, Human
auucaucaacugauagccauag

SEQ ID NO: 996081 - RNA, 22 nt, Human
caucacuguccaaaguucaguu

SEQ ID NO: 996082 - RNA, 22 nt, Human
gaagagcuuaguuguccuagaa

SEQ ID NO: 996083 - RNA, 22 nt, Human
gcucacuggccugaagaggacg

SEQ ID NO: 996084 - RNA, 22 nt, Human
ccagggugagugucauggguua

SEQ ID NO: 996085 - RNA, 22 nt, Human
gaugguuuaugauagaugggaa

SEQ ID NO: 996086 - RNA, 22 nt, Human
cauggcccucuucuggagcaau

SEQ ID NO: 996087 - RNA, 22 nt, Human
aaagaacaucggagugggcggg

SEQ ID NO: 996088 - RNA, 22 nt, Human
gagcuuccacucuagaaggagu

SEQ ID NO: 996089 - RNA, 20 nt, Human
ugaaaaggucaggagacaug

SEQ ID NO: 996090 - RNA, 22 nt, Human
ccaaggagcaaguuuacaccug

SEQ ID NO: 996091 - RNA, 19 nt, Human
guggccagggcaggggcug

SEQ ID NO: 996092 - RNA, 22 nt, Human
ccaggaaugaaauguagauaaa

SEQ ID NO: 996093 - RNA, 22 nt, Human
agugacagcugggaaggugaaa

SEQ ID NO: 996094 - RNA, 22 nt, Human
uuucuagaggcuccaggggagu

SEQ ID NO: 996095 - RNA, 22 nt, Human
acagagcugggaucugaaccca

SEQ ID NO: 996096 - RNA, 22 nt, Human
gcagggaagggaaacagagacc

SEQ ID NO: 996097 - RNA, 22 nt, Human
agggguggagaguguugccagu

SEQ ID NO: 996098 - RNA, 15 nt, Human
aggcacugugggacc

SEQ ID NO: 996099 - RNA, 22 nt, Human
uccaaagggaagcgcuuucugu

SEQ ID NO: 996100 - RNA, 22 nt, Human
gcacaugagcugcugggauggg

SEQ ID NO: 996101 - RNA, 22 nt, Human
gagcugcuucugugugccgggu

SEQ ID NO: 996102 - RNA, 18 nt, Human
uggagccagcucuaggau

SEQ ID NO: 996103 - RNA, 21 nt, Human
aggugggagaccauguagguc

SEQ ID NO: 996104 - RNA, 22 nt, Human
caagagcugugaccucauucac

SEQ ID NO: 996105 - RNA, 22 nt, Human
uaguuuaauggucaacuaauga

SEQ ID NO: 996106 - RNA, 22 nt, Human
gccuucugugcuccuggccuuu

SEQ ID NO: 996107 - RNA, 22 nt, Human
aaauaguuguuuggaucaauaa

SEQ ID NO: 996108 - RNA, 22 nt, Human
aggccugaaguguggagugggg

SEQ ID NO: 996109 - RNA, 22 nt, Human
cccccagccagcagugcucagc

SEQ ID NO: 996110 - RNA, 22 nt, Human
uuuccuuccuugcuagccugag

SEQ ID NO: 996111 - RNA, 22 nt, Human
cagggccaagcugcagcaucug

SEQ ID NO: 996112 - RNA, 22 nt, Human
gagucacauuaauuuaauuuua

SEQ ID NO: 996113 - RNA, 22 nt, Human
uauguuuuucaagugcacacua

SEQ ID NO: 996114 - RNA, 22 nt, Human
cccagacucaucccugggagcu

SEQ ID NO: 996115 - RNA, 22 nt, Human
agaggcuccuagccacuggcuu

SEQ ID NO: 996116 - RNA, 22 nt, Human
auuccaaagccugaauaaugga

SEQ ID NO: 996117 - RNA, 22 nt, Human
cccugccugugggcaucaacau

SEQ ID NO: 996118 - RNA, 22 nt, Human
gccagaaacauacacaucacuu

SEQ ID NO: 996119 - RNA, 22 nt, Human
gccagagcugagugagguucuu

SEQ ID NO: 996120 - RNA, 22 nt, Human
caguagcacuagauaugugugg

SEQ ID NO: 996121 - RNA, 22 nt, Human
ucucuuucuauugcaccaugcu

SEQ ID NO: 996122 - RNA, 22 nt, Human
aaccuuuugcaagugccuugac

SEQ ID NO: 996123 - RNA, 22 nt, Human
gccucuggggcagcugagucau

SEQ ID NO: 996124 - RNA, 21 nt, Human
cauauuaaaucggugccuuua

SEQ ID NO: 996125 - RNA, 18 nt, Human
uaaaugcauguuaauaac

SEQ ID NO: 996126 - RNA, 22 nt, Human
uggcuggcaaggcuggagucag

SEQ ID NO: 996127 - RNA, 22 nt, Human
auaugugugaugcauggacuaa

SEQ ID NO: 996128 - RNA, 23 nt, Human
ccagucucacguauacaggauuu

SEQ ID NO: 996129 - RNA, 22 nt, Human
ccugggcagguguggcuucccc

SEQ ID NO: 996130 - RNA, 22 nt, Human
cagagguauugcaaaagccuag

SEQ ID NO: 996131 - RNA, 22 nt, Human
cugagcucuaaugucagccuug

SEQ ID NO: 996132 - RNA, 22 nt, Human
ccacugucagaggggcugugcc

SEQ ID NO: 996133 - RNA, 22 nt, Human
gcugggcaccggagagacccca

SEQ ID NO: 996134 - RNA, 22 nt, Human
auugacaaggaaacuauaccag

SEQ ID NO: 996135 - RNA, 22 nt, Human
ucugucacuauuggccagaaca

SEQ ID NO: 996136 - RNA, 22 nt, Human
ggaggccaaggcagguggauca

SEQ ID NO: 996137 - RNA, 22 nt, Human
uccaggcuagguuuacaggaca

SEQ ID NO: 996138 - RNA, 22 nt, Human
uggccugguccuugucaaggca

SEQ ID NO: 996139 - RNA, 22 nt, Human
ugagagugaaaugucacauguc

SEQ ID NO: 996140 - RNA, 22 nt, Human
gcugucuugcucacucuugcag

SEQ ID NO: 996141 - RNA, 22 nt, Human
aggccagguuccucaaucuuga

SEQ ID NO: 996142 - RNA, 22 nt, Human
aggaugggccugggauaugcuu

SEQ ID NO: 996143 - RNA, 22 nt, Human
cuacauuucccagcugccuucc

SEQ ID NO: 996144 - RNA, 22 nt, Human
aggggcuguggaaaccaacucu

SEQ ID NO: 996145 - RNA, 20 nt, Human
gcugccagugccugaugcuu

SEQ ID NO: 996146 - RNA, 22 nt, Human
caggaugggugucggccagcac

SEQ ID NO: 996147 - RNA, 22 nt, Human
acauuucucaucuaguagagua

SEQ ID NO: 996148 - RNA, 22 nt, Human
acucuuuuauaaagcaucuuga

SEQ ID NO: 996149 - RNA, 22 nt, Human
ugagaauaggcauagaaccugg

SEQ ID NO: 996150 - RNA, 22 nt, Human
auggacagugugucuguuucca

SEQ ID NO: 996151 - RNA, 22 nt, Human
uaaaguauauuuuuucucaaua

SEQ ID NO: 996152 - RNA, 22 nt, Human
cucagagucugcauuucuguca

SEQ ID NO: 996153 - RNA, 22 nt, Human
aaaagacauaugugggcauucu

SEQ ID NO: 996154 - RNA, 22 nt, Human
cagaagcacuaggaggaaacgu

SEQ ID NO: 996155 - RNA, 22 nt, Human
uggccugggccggcagauauac

SEQ ID NO: 996156 - RNA, 23 nt, Human
ucuuuccucagcacacaccaaga

SEQ ID NO: 996157 - RNA, 23 nt, Human
agaggccaacuucuugccccucc

SEQ ID NO: 996158 - RNA, 22 nt, Human
caggacaguuugcuuugcccug

SEQ ID NO: 996159 - RNA, 22 nt, Human
caugucuggguauaugcauaug

SEQ ID NO: 996160 - RNA, 22 nt, Human
ccuggagcaggagcugcagagg

SEQ ID NO: 996161 - RNA, 22 nt, Human
ucucccacagccgugcuucaag

SEQ ID NO: 996162 - RNA, 22 nt, Human
uguguauagcaguuuccagucu

SEQ ID NO: 996163 - RNA, 22 nt, Human
ccuggcucuucagagguuccua

SEQ ID NO: 996164 - RNA, 22 nt, Human
aauauuaauagaagggguucua

SEQ ID NO: 996165 - RNA, 22 nt, Human
ccugccaggccagugagcuucc

SEQ ID NO: 996166 - RNA, 22 nt, Human
cagggaguuuuuguuccucuag

SEQ ID NO: 996167 - RNA, 22 nt, Human
acaaaugcuuaguucaccaaaa

SEQ ID NO: 996168 - RNA, 22 nt, Human
ccagagcugcauccagcagguu

SEQ ID NO: 996169 - RNA, 22 nt, Human
uuuugaaagccagguuuguaug

SEQ ID NO: 996170 - RNA, 22 nt, Human
auuguggugucaguuauaggca

SEQ ID NO: 996171 - RNA, 22 nt, Human
acuguguguuugucuagcacag

SEQ ID NO: 996172 - RNA, 22 nt, Human
aagcugccugccacgcuagaua

SEQ ID NO: 996173 - RNA, 22 nt, Human
cauaagaaauuuaacagaacuu

SEQ ID NO: 996174 - RNA, 22 nt, Human
cccagcaggucggugcugccug

SEQ ID NO: 996175 - RNA, 22 nt, Human
aaacaaguuuagaauaaugaau

SEQ ID NO: 996176 - RNA, 22 nt, Human
uccugagaugagacagugcugc

SEQ ID NO: 996177 - RNA, 22 nt, Human
uccagccuaauguucuucccac

SEQ ID NO: 996178 - RNA, 22 nt, Human
gggccugugcacaguucuguua

SEQ ID NO: 996179 - RNA, 22 nt, Human
caggaugugaggaggccauuug

SEQ ID NO: 996180 - RNA, 22 nt, Human
agagcugugcuuugcaccacgu

SEQ ID NO: 996181 - RNA, 22 nt, Human
ggcagcaugagccuggugaauu

SEQ ID NO: 996182 - RNA, 22 nt, Human
guuuuauuggaacacagccaug

SEQ ID NO: 996183 - RNA, 22 nt, Human
ugaauaagaauuauuauaauga

SEQ ID NO: 996184 - RNA, 22 nt, Human
gcaggcagagagggguuuccag

SEQ ID NO: 996185 - RNA, 22 nt, Human
cccucugccugcgcccuggugu

SEQ ID NO: 996186 - RNA, 22 nt, Human
auaaaaacugacccauccuuug

SEQ ID NO: 996187 - RNA, 22 nt, Human
agcccuggcccggcugugcuuu

SEQ ID NO: 996188 - RNA, 22 nt, Human
caguacuuaacuuauaggagag

SEQ ID NO: 996189 - RNA, 22 nt, Human
ucugaggcuauguucaggcuaa

SEQ ID NO: 996190 - RNA, 17 nt, Human
uccuucagugccucugc

SEQ ID NO: 996191 - RNA, 22 nt, Human
ggagacagugacuuagagacug

SEQ ID NO: 996192 - RNA, 22 nt, Human
cagugcuccugauguacccuug

SEQ ID NO: 996193 - RNA, 22 nt, Human
cuuuauguuggggugucuuagu

SEQ ID NO: 996194 - RNA, 22 nt, Human
guggcagagguuccucagugug

SEQ ID NO: 996195 - RNA, 22 nt, Human
cagccaggcccccgagucguug

SEQ ID NO: 996196 - RNA, 22 nt, Human
accacuguaucuccagcacauu

SEQ ID NO: 996197 - RNA, 22 nt, Human
ucuuuacaaucuaagcauaguu

SEQ ID NO: 996198 - RNA, 22 nt, Human
uagugaaacaguuaucaaucug

SEQ ID NO: 996199 - RNA, 22 nt, Human
gccugccuuuguaugacccuga

SEQ ID NO: 996200 - RNA, 22 nt, Human
uguguacucaauugagccauuu

SEQ ID NO: 996201 - RNA, 22 nt, Human
gaggaggcuaagugggcucugg

SEQ ID NO: 996202 - RNA, 22 nt, Human
gaugcacuugccccuccucaga

SEQ ID NO: 996203 - RNA, 22 nt, Human
acauuucucagguaagucauuu

SEQ ID NO: 996204 - RNA, 22 nt, Human
acugggaguucuccaugucccu

SEQ ID NO: 996205 - RNA, 22 nt, Human
guaauaaugguccccaaacacu

SEQ ID NO: 996206 - RNA, 22 nt, Human
ugccugaguuuaacccucagag

SEQ ID NO: 996207 - RNA, 22 nt, Human
ucagaaauacuaucagcuuuug

SEQ ID NO: 996208 - RNA, 22 nt, Human
ucaaagucacaacucucuaauu

SEQ ID NO: 996209 - RNA, 22 nt, Human
cugggaugucuauagaacacuu

SEQ ID NO: 996210 - RNA, 22 nt, Human
ggucucagacuggcaggcagug

SEQ ID NO: 996211 - RNA, 22 nt, Human
uaaggcacccgugagcugccag

SEQ ID NO: 996212 - RNA, 22 nt, Human
ccugagcugaacuaagcaguuu

SEQ ID NO: 996213 - RNA, 22 nt, Human
aaagguaacaguuauaaccagg

SEQ ID NO: 996214 - RNA, 22 nt, Human
cuuccagagauagggccucaag

SEQ ID NO: 996215 - RNA, 22 nt, Human
cuggccugaggucggcuguagg

SEQ ID NO: 996216 - RNA, 22 nt, Human
gcccaugcucucaggcgggccu

SEQ ID NO: 996217 - RNA, 17 nt, Human
gcuggcugacccaugcc

SEQ ID NO: 996218 - RNA, 22 nt, Human
ggcaugggccgaggugccuccu

SEQ ID NO: 996219 - RNA, 22 nt, Human
ccugagguggcugcagcacugc

SEQ ID NO: 996220 - RNA, 22 nt, Human
caggguggcaggcaccauggcc

SEQ ID NO: 996221 - RNA, 22 nt, Human
uuucacauguggaaugccaggu

SEQ ID NO: 996222 - RNA, 19 nt, Human
uggccagguacugucugcu

SEQ ID NO: 996223 - RNA, 20 nt, Human
agcuggccuguccuaggccu

SEQ ID NO: 996224 - RNA, 22 nt, Human
ggagggcaucaaucaggccugg

SEQ ID NO: 996225 - RNA, 23 nt, Human
uggggagaguuacccuggaagcg

SEQ ID NO: 996226 - RNA, 22 nt, Human
gcucugcuugcaucaugacugc

SEQ ID NO: 996227 - RNA, 21 nt, Human
uggcagggguaguaguacagc

SEQ ID NO: 996228 - RNA, 22 nt, Human
auguguagaacuguaaugccca

SEQ ID NO: 996229 - RNA, 22 nt, Human
auuguguaauuuucagcucaua

SEQ ID NO: 996230 - RNA, 22 nt, Human
aacagaacccgagugugaaucu

SEQ ID NO: 996231 - RNA, 22 nt, Human
aaguucaaggcagguccugagg

SEQ ID NO: 996232 - RNA, 17 nt, Human
aggugcagaggcagagc

SEQ ID NO: 996233 - RNA, 22 nt, Human
uguuuuaugagccauauaaccu

SEQ ID NO: 996234 - RNA, 22 nt, Human
gccuggagugguccugcugccc

SEQ ID NO: 996235 - RNA, 22 nt, Human
uggcucagauaauucaaggggc

SEQ ID NO: 996236 - RNA, 22 nt, Human
gggcagggguagcauuccaagu

SEQ ID NO: 996237 - RNA, 22 nt, Human
gugcauguuaaugguguacaaa

SEQ ID NO: 996238 - RNA, 22 nt, Human
caaaagcaguucuaucugaguu

SEQ ID NO: 996239 - RNA, 22 nt, Human
acuuaguauuuuucagcuuuga

SEQ ID NO: 996240 - RNA, 22 nt, Human
uggcuuccugcacagugucugc

SEQ ID NO: 996241 - RNA, 22 nt, Human
agacccugucaguguuaggaaa

SEQ ID NO: 996242 - RNA, 22 nt, Human
gggcacuguggggcccaugcug

SEQ ID NO: 996243 - RNA, 22 nt, Human
auguacauuuuccuaauguuuu

SEQ ID NO: 996244 - RNA, 22 nt, Human
uggaagagacacuuacauucag

SEQ ID NO: 996245 - RNA, 22 nt, Human
cccagggacagaugggcagcua

SEQ ID NO: 996246 - RNA, 22 nt, Human
ggggauggaggcgugugguccu

SEQ ID NO: 996247 - RNA, 23 nt, Human
ccugucugugcuggguggacaca

SEQ ID NO: 996248 - RNA, 21 nt, Human
gccucugcugucuuauuguga

SEQ ID NO: 996249 - RNA, 22 nt, Human
ccagggcagcgccccuccacgc

SEQ ID NO: 996250 - RNA, 22 nt, Human
auccugggcagugugucacucu

SEQ ID NO: 996251 - RNA, 22 nt, Human
ucugccuugagguccucagcuc

SEQ ID NO: 996252 - RNA, 22 nt, Human
cuggagagauccuccugaaaaa

SEQ ID NO: 996253 - RNA, 22 nt, Human
uggcucaggccacuucuuuuau

SEQ ID NO: 996254 - RNA, 22 nt, Human
gcucugcucuaacauuccugac

SEQ ID NO: 996255 - RNA, 22 nt, Human
uaacagaaaggggacagaaaua

SEQ ID NO: 996256 - RNA, 22 nt, Human
uauuacugagguuuuauggagu

SEQ ID NO: 996257 - RNA, 22 nt, Human
ucagaggaauaaugcugcauuu

SEQ ID NO: 996258 - RNA, 21 nt, Human
ucugucugguuuuagaguggc

SEQ ID NO: 996259 - RNA, 22 nt, Human
ugccagcacuucuggcugucug

SEQ ID NO: 996260 - RNA, 22 nt, Human
cuggagccggcgagccccagcc

SEQ ID NO: 996261 - RNA, 22 nt, Human
agagcuggggccagagucaagg

SEQ ID NO: 996262 - RNA, 22 nt, Human
cugggccagcaacugcaaugga

SEQ ID NO: 996263 - RNA, 21 nt, Human
cagagguggccugaccucuga

SEQ ID NO: 996264 - RNA, 22 nt, Human
gcaaggcugugcacuuugcauu

SEQ ID NO: 996265 - RNA, 22 nt, Human
cccagcuccaagggacagcgaa

SEQ ID NO: 996266 - RNA, 22 nt, Human
gcagugccuugcuucucugucu

SEQ ID NO: 996267 - RNA, 22 nt, Human
gucucccaucguuugugaggaa

SEQ ID NO: 996268 - RNA, 22 nt, Human
uccugcagagccgcccucaggu

SEQ ID NO: 996269 - RNA, 22 nt, Human
gaagagcugugauucaggcuua

SEQ ID NO: 996270 - RNA, 22 nt, Human
uugagggaacaugagaaucauc

SEQ ID NO: 996271 - RNA, 22 nt, Human
ccugucuguauugguuugcuau

SEQ ID NO: 996272 - RNA, 22 nt, Human
uuagagaugucccaaaaugaag

SEQ ID NO: 996273 - RNA, 22 nt, Human
cagcuggcguggagugauugca

SEQ ID NO: 996274 - RNA, 22 nt, Human
cacagcugaaguagccaugugg

SEQ ID NO: 996275 - RNA, 22 nt, Human
caguguguggauccucccagga

SEQ ID NO: 996276 - RNA, 21 nt, Human
ugccagggauuuacagagccu

SEQ ID NO: 996277 - RNA, 22 nt, Human
aauguguguucggggcccagag

SEQ ID NO: 996278 - RNA, 22 nt, Human
acaggugaccugcucauaugaa

SEQ ID NO: 996279 - RNA, 22 nt, Human
cugguccuugacgcgugggagg

SEQ ID NO: 996280 - RNA, 22 nt, Human
agccaaggacacggagccuccu

SEQ ID NO: 996281 - RNA, 22 nt, Human
gcccugucggaacugcgaccuc

SEQ ID NO: 996282 - RNA, 22 nt, Human
cggggcugcucguccuccugug

SEQ ID NO: 996283 - RNA, 22 nt, Human
aaauguggguaaugggacugga

SEQ ID NO: 996284 - RNA, 22 nt, Human
aguauguagugcaaucagucag

SEQ ID NO: 996285 - RNA, 22 nt, Human
cugggccaucuccuuugugugg

SEQ ID NO: 996286 - RNA, 19 nt, Human
agcagccauagacaauaug

SEQ ID NO: 996287 - RNA, 21 nt, Human
agcuuguguguaucacagugu

SEQ ID NO: 996288 - RNA, 22 nt, Human
cuuuauguccuugaagaguugu

SEQ ID NO: 996289 - RNA, 22 nt, Human
ugccaggcgugguggugcgcac

SEQ ID NO: 996290 - RNA, 22 nt, Human
aggugcagcaugaguccaacgg

SEQ ID NO: 996291 - RNA, 22 nt, Human
cuggagcucuguguguuccuga

SEQ ID NO: 996292 - RNA, 22 nt, Human
cagcuggcauaccugggcccgg

SEQ ID NO: 996293 - RNA, 22 nt, Human
cuggagaggccccaagauauuu

SEQ ID NO: 996294 - RNA, 22 nt, Human
ggcugcagauagccagccacca

SEQ ID NO: 996295 - RNA, 22 nt, Human
auucuuggagcagucaaagaag

SEQ ID NO: 996296 - RNA, 22 nt, Human
uuucagaugcaauuaauuuuca

SEQ ID NO: 996297 - RNA, 22 nt, Human
ccuccugguccagcaucucuuu

SEQ ID NO: 996298 - RNA, 20 nt, Human
ggaccagguggggcgguggc

SEQ ID NO: 996299 - RNA, 22 nt, Human
ggcugagcacuuuaggcaggag

SEQ ID NO: 996300 - RNA, 22 nt, Human
aaaguguugggaagaaagugca

SEQ ID NO: 996301 - RNA, 22 nt, Human
cugagccagcuggcaugugcua

SEQ ID NO: 996302 - RNA, 22 nt, Human
caaaaagcuuagguaacaagcc

SEQ ID NO: 996303 - RNA, 22 nt, Human
agcagccacagcagaucugagu

SEQ ID NO: 996304 - RNA, 22 nt, Human
ugagccaggcucaagugauccu

SEQ ID NO: 996305 - RNA, 22 nt, Human
ugcccacaggaagacaccagcg

SEQ ID NO: 996306 - RNA, 22 nt, Human
aggccuggguguucaccagaag

SEQ ID NO: 996307 - RNA, 22 nt, Human
acagagcugggugcccccugga

SEQ ID NO: 996308 - RNA, 17 nt, Human
cuggagccuccaacucc

SEQ ID NO: 996309 - RNA, 22 nt, Human
guuuuauaggugaaauauuacu

SEQ ID NO: 996310 - RNA, 22 nt, Human
uagggcaggugaagaaaagcua

SEQ ID NO: 996311 - RNA, 19 nt, Human
cugugcuuuaaacuccuau

SEQ ID NO: 996312 - RNA, 22 nt, Human
gaggccugaggcugccuggagc

SEQ ID NO: 996313 - RNA, 22 nt, Human
ggagccaguauuuaguggucuu

SEQ ID NO: 996314 - RNA, 22 nt, Human
ggcuucuuccugugaacauguu

SEQ ID NO: 996315 - RNA, 22 nt, Human
cugagcugggcucucuugaggg

SEQ ID NO: 996316 - RNA, 22 nt, Human
ucaggccacuucacaggugauu

SEQ ID NO: 996317 - RNA, 22 nt, Human
ggguccagcgacagcaggcuca

SEQ ID NO: 996318 - RNA, 22 nt, Human
uuuggaaaguugucacuuuaga

SEQ ID NO: 996319 - RNA, 17 nt, Human
uugggagagaaagguau

SEQ ID NO: 996320 - RNA, 22 nt, Human
gcugugcuggaaggggaccugc

SEQ ID NO: 996321 - RNA, 22 nt, Human
acauucuuaacaguuaaaaacu

SEQ ID NO: 996322 - RNA, 22 nt, Human
ugcucccaggcauucucuguug

SEQ ID NO: 996323 - RNA, 22 nt, Human
ggaagagccuggggugucaggc

SEQ ID NO: 996324 - RNA, 22 nt, Human
uugcaccauuucacuuccauua

SEQ ID NO: 996325 - RNA, 22 nt, Human
ggcacagggaggcccuggugug

SEQ ID NO: 996326 - RNA, 22 nt, Human
uggggaagggcacccuggagac

SEQ ID NO: 996327 - RNA, 20 nt, Human
ccagguggugccuggagagg

SEQ ID NO: 996328 - RNA, 22 nt, Human
ugggggucaggaugaggccuug

SEQ ID NO: 996329 - RNA, 23 nt, Human
aagcugccuucgcaguuggucug

SEQ ID NO: 996330 - RNA, 22 nt, Human
ucagggcauucaagaggccugg

SEQ ID NO: 996331 - RNA, 22 nt, Human
cugcauucauaucagauagaag

SEQ ID NO: 996332 - RNA, 22 nt, Human
agaagccagcuucagcugcccg

SEQ ID NO: 996333 - RNA, 22 nt, Human
cuuucauucuuagauauuagug

SEQ ID NO: 996334 - RNA, 22 nt, Human
gcugggcuugguuucccugcuu

SEQ ID NO: 996335 - RNA, 22 nt, Human
acuuccugaauggggcuaauua

SEQ ID NO: 996336 - RNA, 22 nt, Human
uugcagcagggugaauucacuc

SEQ ID NO: 996337 - RNA, 22 nt, Human
aucaguuuaaaugggcuguugg

SEQ ID NO: 996338 - RNA, 22 nt, Human
cauugacaucaggcuuggccaa

SEQ ID NO: 996339 - RNA, 22 nt, Human
gccagacacuccccugggcagg

SEQ ID NO: 996340 - RNA, 22 nt, Human
gcuggcagagacaagaagacua

SEQ ID NO: 996341 - RNA, 22 nt, Human
cccuggaggaccccaauguggc

SEQ ID NO: 996342 - RNA, 21 nt, Human
agcagaggggacauguuugau

SEQ ID NO: 996343 - RNA, 22 nt, Human
uggaagccaggcccgcuccuaa

SEQ ID NO: 996344 - RNA, 22 nt, Human
ccuggccaguuuccaggcccug

SEQ ID NO: 996345 - RNA, 18 nt, Human
gagcugccauauuuaguu

SEQ ID NO: 996346 - RNA, 22 nt, Human
ggggcagaaguagugccccuga

SEQ ID NO: 996347 - RNA, 22 nt, Human
aucacgucaugguuugaucugg

SEQ ID NO: 996348 - RNA, 18 nt, Human
cugaggcuggcaggagcc

SEQ ID NO: 996349 - RNA, 22 nt, Human
ucucagaguuuuuuuccaggac

SEQ ID NO: 996350 - RNA, 22 nt, Human
ccaggcucaggugcgagagaca

SEQ ID NO: 996351 - RNA, 22 nt, Human
uggcucagcauucacuggucuu

SEQ ID NO: 996352 - RNA, 22 nt, Human
uagaaaucauuuagaaguauug

SEQ ID NO: 996353 - RNA, 22 nt, Human
agguggaacguucaggugcuag

SEQ ID NO: 996354 - RNA, 19 nt, Human
gagcccucuccauggccac

SEQ ID NO: 996355 - RNA, 22 nt, Human
uaugcauuuuauagugcaaagc

SEQ ID NO: 996356 - RNA, 22 nt, Human
gccucugcccauccaccaucag

SEQ ID NO: 996357 - RNA, 22 nt, Human
uuccauuguuucugucuucacu

SEQ ID NO: 996358 - RNA, 22 nt, Human
uggaggaaucagggcuuaggcu

SEQ ID NO: 996359 - RNA, 22 nt, Human
aaauguguuucgaaaacuggug

SEQ ID NO: 996360 - RNA, 22 nt, Human
caugcacaaagguaagaugcgu

SEQ ID NO: 996361 - RNA, 22 nt, Human
ucugccacuagugguuaccuua

SEQ ID NO: 996362 - RNA, 22 nt, Human
cuguuuaucuaggaguugcagg

SEQ ID NO: 996363 - RNA, 22 nt, Human
ccugccuggagcugagugugga

SEQ ID NO: 996364 - RNA, 22 nt, Human
gccuggguccacugaucaugcu

SEQ ID NO: 996365 - RNA, 22 nt, Human
ucccugggccuccugcuaugca

SEQ ID NO: 996366 - RNA, 20 nt, Human
uugaggagauauugaauacu

SEQ ID NO: 996367 - RNA, 22 nt, Human
agccucucuccagcuuggcaga

SEQ ID NO: 996368 - RNA, 22 nt, Human
gagcacugauuuauuuuugucu

SEQ ID NO: 996369 - RNA, 19 nt, Human
aguguguacugaaagcacu

SEQ ID NO: 996370 - RNA, 22 nt, Human
aagcugccacacggugaguacu

SEQ ID NO: 996371 - RNA, 22 nt, Human
aaaguguacuaugucaugaaca

SEQ ID NO: 996372 - RNA, 22 nt, Human
cauucacauucuucuuacuguu

SEQ ID NO: 996373 - RNA, 23 nt, Human
uuucacaaugagcauuacagaau

SEQ ID NO: 996374 - RNA, 22 nt, Human
cucaggauauugggcuggagca

SEQ ID NO: 996375 - RNA, 22 nt, Human
cagggcagggauguugcggcag

SEQ ID NO: 996376 - RNA, 22 nt, Human
aagcccagcugaaagcauuuuu

SEQ ID NO: 996377 - RNA, 22 nt, Human
gcagggagguuugcugaccugg

SEQ ID NO: 996378 - RNA, 22 nt, Human
ugaagacagaccaaggagaaug

SEQ ID NO: 996379 - RNA, 22 nt, Human
uuauguaggauaaugaauugcc

SEQ ID NO: 996380 - RNA, 22 nt, Human
auaaagaggauguauuuacagc

SEQ ID NO: 996381 - RNA, 22 nt, Human
ggcagcuguggacgucgucauu

SEQ ID NO: 996382 - RNA, 22 nt, Human
ccuggcugucguuuugugaaau

SEQ ID NO: 996383 - RNA, 19 nt, Human
aagcagcccuggcaagagc

SEQ ID NO: 996384 - RNA, 22 nt, Human
ugcaccuucauuuuaggcagcu

SEQ ID NO: 996385 - RNA, 22 nt, Human
uuauuuuuaaaaguucacacag

SEQ ID NO: 996386 - RNA, 22 nt, Human
uccugaggaaaguucaugaaug

SEQ ID NO: 996387 - RNA, 22 nt, Human
aggcucuguuauucuagagggc

SEQ ID NO: 996388 - RNA, 22 nt, Human
gccuucaggaggguuccagaca

SEQ ID NO: 996389 - RNA, 22 nt, Human
ugcugucaguuggcaggaugag

SEQ ID NO: 996390 - RNA, 22 nt, Human
uuucacaacacaaucucguuaa

SEQ ID NO: 996391 - RNA, 22 nt, Human
ccugggagcuguggaaaggcug

SEQ ID NO: 996392 - RNA, 22 nt, Human
ugggccugccccaggcuucagc

SEQ ID NO: 996393 - RNA, 22 nt, Human
ucucagagagcuguguuuuccu

SEQ ID NO: 996394 - RNA, 22 nt, Human
gaagcagcuagcccacuaguca

SEQ ID NO: 996395 - RNA, 22 nt, Human
ccagggcaucacauccaguguu

SEQ ID NO: 996396 - RNA, 22 nt, Human
cagcucugggugacaggagggc

SEQ ID NO: 996397 - RNA, 22 nt, Human
auggccaagaauauuucucaac

SEQ ID NO: 996398 - RNA, 22 nt, Human
caggguccggcugccuggcugu

SEQ ID NO: 996399 - RNA, 22 nt, Human
gcccugugcgacucuagagguu

SEQ ID NO: 996400 - RNA, 22 nt, Human
uggaaagaauuccuaugguuca

SEQ ID NO: 996401 - RNA, 20 nt, Human
cuaucuccuggcgugccuuc

SEQ ID NO: 996402 - RNA, 22 nt, Human
aaaauguguuuaugcauuucgu

SEQ ID NO: 996403 - RNA, 22 nt, Human
acugugcacaauucuaaguccu

SEQ ID NO: 996404 - RNA, 22 nt, Human
gcagauggcugagccugcagau

SEQ ID NO: 996405 - RNA, 22 nt, Human
aggagugcaaauaguccagaga

SEQ ID NO: 996406 - RNA, 22 nt, Human
ccugucauacuaacguaguggg

SEQ ID NO: 996407 - RNA, 22 nt, Human
aggcuuccuggaggaagaggua

SEQ ID NO: 996408 - RNA, 22 nt, Human
aaggccagcuuguagggcuggu

SEQ ID NO: 996409 - RNA, 17 nt, Human
ucugggcuucagugguc

SEQ ID NO: 996410 - RNA, 22 nt, Human
ucagguggcuucggggaguggc

SEQ ID NO: 996411 - RNA, 22 nt, Human
caggggcucccugggugccagu

SEQ ID NO: 996412 - RNA, 22 nt, Human
uuaaguccuugguaauuuucuu

SEQ ID NO: 996413 - RNA, 22 nt, Human
uccagagcagguggucagaagg

SEQ ID NO: 996414 - RNA, 22 nt, Human
caaaauguucuggcaccuuuaa

SEQ ID NO: 996415 - RNA, 22 nt, Human
aagcagaugggacuccaaggca

SEQ ID NO: 996416 - RNA, 22 nt, Human
uaaguuuaaauguacaugaagc

SEQ ID NO: 996417 - RNA, 22 nt, Human
cagagccugccaccuuucuccc

SEQ ID NO: 996418 - RNA, 23 nt, Human
agaugaggcuucuccauguuggu

SEQ ID NO: 996419 - RNA, 18 nt, Human
aacuucaacuacaaugga

SEQ ID NO: 996420 - RNA, 18 nt, Human
guucaaggucaagagaga

SEQ ID NO: 996421 - RNA, 22 nt, Human
ugcaaacuauugguagagaugg

SEQ ID NO: 996422 - RNA, 22 nt, Human
uucucucauucaaauuaaagug

SEQ ID NO: 996423 - RNA, 22 nt, Human
uuuaggaugcucuauucugacu

SEQ ID NO: 996424 - RNA, 22 nt, Human
auagaguccaaaguaugaauau

SEQ ID NO: 996425 - RNA, 22 nt, Human
aggcugucugaccccagagccc

SEQ ID NO: 996426 - RNA, 22 nt, Human
uuguauucauugcuuacccaau

SEQ ID NO: 996427 - RNA, 22 nt, Human
gccuguguggaugcgccggugc

SEQ ID NO: 996428 - RNA, 22 nt, Human
cccaaacaguuccugugguacu

SEQ ID NO: 996429 - RNA, 22 nt, Human
gaagagcugacagugucauccu

SEQ ID NO: 996430 - RNA, 19 nt, Human
acauuuaaauucagaucuc

SEQ ID NO: 996431 - RNA, 22 nt, Human
uaagaacaguguuucaucucua

SEQ ID NO: 996432 - RNA, 22 nt, Human
gaagcccauuuguacagcacau

SEQ ID NO: 996433 - RNA, 22 nt, Human
gugcucuccuggcugcccugac

SEQ ID NO: 996434 - RNA, 22 nt, Human
ugucucugcuuuccuugcaggg

SEQ ID NO: 996435 - RNA, 22 nt, Human
ucuccuggagcaggaagguggg

SEQ ID NO: 996436 - RNA, 22 nt, Human
ccagcugaggcagccacacagg

SEQ ID NO: 996437 - RNA, 22 nt, Human
caaaugcauaguuuauaagaag

SEQ ID NO: 996438 - RNA, 22 nt, Human
gggcuggcucccagguguugaa

SEQ ID NO: 996439 - RNA, 22 nt, Human
gcugggaggaauuuggggaaua

SEQ ID NO: 996440 - RNA, 22 nt, Human
aaagaauuuguacacccuacua
